United States Patent 9,254,311 (MODIFIED POLYNUCLEOTIDES FOR THE PRODUCTION OF PROTEINS) - sequence listing, part 16

SEQ ID NO: 32293 - DNA, 8553 bp, Artificial Sequence
  Description of Artificial Sequence: Synthetic coding sequence
atgagcgagaagagtggccaatcaacaaaagcaaaagatggaaaaaaatatgccacattgtcgctctttaatacctataagggaaagtctctggagactcaaaaaacgacagcccggcatggcttgcagtctcttgggaaggtcggcatctctcgcagaatgcctcctcccgcaaacctgccctccttgaaagctgaaaacaaggggaacgatccaaatgtgaatatcgttcctaaagacggtaccggatgggcctccaaacaggagcagcatgaagaggaaaagactcctgaggtgccacctgcacagccgaaacctggtgtggcagcgccgcctgaagttgcgccagcacccaagtcctgggcctccaataaacaaggagggcagggcgacggcatacaggtgaactcccagttccagcaggaatttccttcactgcaggcggccggcgatcaggagaaaaaagaaaaggaaactaacgacgacaactatgggcccggcccctccctgcgacctcccaacgtcgcctgctggcgtgatggaggaaaggctgccggcagcccatcgagttcggaccaagatgaaaagcttcccgggcaggacgagtccacagccggcacatccgagcagaacgatattttaaaggtcgttgaaaagcgcatcgcgtgtggtccacctcaggcgaaactcaatggccagcaggcggcactggccagtcaataccgtgctatgatgcctccctatatgtttcagcaatacccacggatgacctatcctcctttgcacggaccaatgcggtttcccccatctctgtcagaaactaataaaggcctgagaggccgaggaccaccgcccagctgggcttccgagccggaacgcccttctattctgtctgctagcgagttaaaagagttagataagttcgacaatctagatgctgaggccgacgagggatgggcaggcgcccagatggaagtggactacacggagcagctgaactttagtgacgacgatgagcaggggtctaacagtcccaaagaaaataattccgaagaccaaggttcaaaagcttcagaaaacaacgagaataagaaggaaaccgatgaggtcagtaatacgaaatcgtcctctcaaatacccgcgcagccgagcgtggccaaagtgccctacgggaaaggacccagctttaatcaggagcggggcacatcttcacacctcccgcccccacccaagttgttagcccagcagcaccctcccccagaccgccaggccgtcccgggtagacctggacccttccccagcaagcagcaggtggccgatgaggacgagatctggaagcagcgcagacgtcagcagagcgagatatcagccgctgttgagcgtgctcgaaagcgtcgggaggaggaggagagaaggatggaagagcagagaaaagcagcctgcgcagagaagctaaagcgcttggatgagaagcttggcattctcgagaagcagccatcgccagaagagatccgcgagagggagcgcgagaaagagagagaacgggaaaaagagttggaaaaggagcaggagcaggaacgggagaaagaaagagagaaagatagggagcggcagcaggaaaaggagaaggagttggaaaaagaacaagagaagcagcgggaaatggaaaaggaacgcaaacaagagaaagagaaggagttggagcggcaaaaagagaaggaaaaggagctgcaaaagatgaaagagcaggagaaagagtgtgagctcgagaaggagcgggaaaaactcgaggagaagattgaaccccgcgaacctaatctggaacctatggtggagaaacaggagtccgagaactcctgtaacaaagccgaagaggaacccgtctttactcgtcaagacagcaaccggtctgaaaaagaagcaacacctgtcgtccacgaaactgagcccgagagcgggagtcagccccggcctgccgtgttgtcgggctactttaagcagttccagaagtcattgccccctcgcttccaacgccagcaggagcagatgaagcagcaacaatggcagcagcagcaacagcaaggggtgctcccacaaacggtgccttcacagccatcctctagcaccgttccgccccctccccatcggccgctttaccagcctatgcaacctcacccacaacatcttgcgtccatggggtttgatccgagatggcttatgatgcagagctatatggaccccaggatgatgtctgggagaccggccatggatatccctccaatccatccaggcatgattcctccgaaacctctgatgagaagagaccaaatggaaggctcccctaatagctccgagagtttcgaacacattgcccggtcagcaagggaccacgcaatcagcctaagcgaaccacgcatgctctggggaagcgacccatatccacacgccgaaccccaacaggccaccacacccaaggcaaccgaggagccagaagacgtgaggtctgaggctgccttggaccaggagcagatcactgccgcgtacagtgtcgagcacaatcaattggaggcacaccctaaggccgatttcatcagagagtccagcgaggctcaggtgcaaaaatttctgtctagatctgtggaggacgtgcggccacaccataccgatgcaaataatcagtcagcgtgctttgaggcccccgatcaaaaaacactctctgcaccccaggaggaaagaatctctgctgtcgagagtcagccctcacgcaaacgctctgtatctcatggttctaaccacacacagaagcccgacgaacaacgcagcgaaccgtctgccgggattccaaaggttacctcccgctgtattgactcaaaagagcccattgaacgtccagaagagaaaccaaaaaaagaggggttcattcggtccagcgaggggcccaagcccgagaaagtctacaagtccaaatccgaaactcggtggggcccaaggccaagcagtaacaggagggaagaagttaacgacaggcctgtgagacgttccggtccgatcaagaagcccgtattgagggacatgaaagaagagcgtgaacaacggaaagagaaagaaggcgaaaaagctgagaaagtgacggagaaggtcgtggtcaagccagaaaagacagagaaaaaagacctgccccctccacctccccctccccagccccccgctcccattcagcctcagtccgtgccccccccaatccagccagaggcagagaagttccccagtactgaaactgcaaccctagctcagaagccaagccaggatacagagaaacccctggagccagtgagcactgtgcaggtggagcctgcagtcaaaaccgtgaaccaacagacaatggccgcccccgtcgtcaaagaggagaagcagccagagaaagtgatctccaaagatctagtgattgaacgacccaggccagacagccggccggcagtcaaaaaggagagtacactgcctccaaggacctattggaaagaggctcgtgaaagagattggtttcccgatcagggctatcgtggaagaggaagaggggagtattattcgaggggcaggagctaccggggtagctacggcggtcgaggccgggggggaagaggacacacacgggattacccacagtacagggacaataaaccccgcgccgagcacattccctctggcccactgcggcagcgcgaggagtccgaaaccagatcagaatcatcggattttgaggtggtccctaagagacgaaggcagcgcgggagtgagacagacaccgattccgagatacacgagtctgcaagcgataaagatagtttgtcaaaaggtaagctgcccaagcgggaggagaggccggagaataagaagcccgtcaaacctcacagctccttcaaacctgataaccatgtgcgaattgacaaccgcctgctcgagaagccatacgtgagagatgatgacaaagcgaaacccgggttcctgccgaagggtgagcccacgaggcgcggacgtggcgggacctttagaagggggggacgagacccagggggaaggccatctagaccttctactttgcgtcggccggcctatcgcgataaccagtggaatccgaggcagtccgaggtaccaaagcctgaggacggggagccacctagaagacatgagcagttcatacccatcgcagctgataagcgccctcctaagtttgagaggaagtttgacccagctcgtgaacgtcctaggagacagcgaccaaccagaccccccaggcaggataagcccccgagatttcggcggttgagagagcgggaagcagcgtcaaagagcaatgaggtagtggccgtcccaaccaatgggacggtgaacaatgtcgctcaggagccagtgaacactcttggcgacatatccgggaacaagactcctgatctaagtaatcaaaattcgtctgatcaagctaacgaggagtgggagactgcctcagaaagttcagatttcaacgagcgccgagaaagggacgaaaaaaagaatgctgatctgaacgcacagaccgtggtgaaggtcggcgaaaacgtgctgcccccaaagcgcgagatcgccaagcggtctttctcttcgcagaggccagtggatcggcaaaaccgacgggggaataacggaccacctaagtctggtagaaatttcagcggcccacgcaacgagaggagatccggcccaccgtctaaatctgggaagagaggcccatttgacgaccagcctgctgggactactggagtcgacttgattaacgggtcctcagcacaccatcaagagggcgtaccaaacggcactgggcagaagaatagtaaagacagtacgggcaaaaagcgtgaagatcctaaacccggcccaaagaaacccaaagagaaggttgatgcactctctcagttcgatctgaacaactatgctagcgtggtcataattgatgatcatcctgaggtgaccgttatcgaagaccctcagtctaatctgaacgacgatggattcaccgaagtggtatctaaaaaacagcaaaagcgattgcaggatgaagagcggcgaaagaaggaggagcaggtgattcaggtgtggaataagaagaatgctaacgagaaaggcaggagtcagacatctaagctgcctcctcgtttcgcaaaaaagcaagccacagggatccagcaggctcagtcgtccgcatctgtcccaccactcgcttccgctcctctgccacctagcacgctcgcccccgtgtcagcctcagccagcgtgagcgcgagcgttccggcatctacatcagcagctgccatcaccagttcttctgcaccagcctctgctcccgccccaactcccatcctggcttccgtgtccactccggcaagtgtcaccattctagccagtgctagtatccctattctggctagcgccctggcttctacctctgctccaaccccagctccagctgcgagtagtccggccgcacctgtgataacggctcctaccatcccagccagtgccccaaccgccagcgttccactggcccccgcttctgcctccgctcctgccccagcgcccactcctgtgtcagcgcctaacccagccccccccgctcccgcccagacgcaggctcagacacataagcctgtgcagaatcctctccaaaccacttctcagagtagcaaacagcccccacccagcatccgcctacctagtgcccagacccctaacggaacggactacgtcgcatccgggaagtctatccagacccctcagagccacgggactttgaccgctgaactctgggataataaggtggcgcctccagctgtgctcaacgacatctccaagaagctgggccccatctcaccaccgcagcctcccagtgtctcagcctggaataaacctttgacctcgttcggctctgctccatcctcagaaggggccaagaatggacaggagtctggtctcgagatcggtacggataccatccagtttggggcaccagcatccaacggaaatgaaaacgaagtggttccagttttgtctgaaaaatcggccgacaagatcccagagcccaaagagcagagacaaaaacagccacgcgccggaccaattaaggcccaaaagctgccggatctgagtccagtagagaacaaggagcataagccaggcccgatcggaaaagagcgctctctcaagaatcgtaaggtgaaggatgcacaacaggtggagcctgagggccaggagaagccgtcccccgccaccgtcagaagcaccgaccctgtgacaaccaaagaaaccaaggccgtttcggaaatgagtacagagatcggaacaatgatctctgtgtcgagtgctgaatatggaactaacgccaaagagagcgtcaccgattatactacacctagttctagcctgcctaacacagtagctacaaacaacactaaaatggaagacacactggttaacaacgtccccctcccaaacacactgccactgccaaagagagaaactatccagcagagctcctctctaacaagcgtaccgccgaccactttcagcctgaccttcaagatggagtccgcaaggaaagcttgggagaattcccctaacgtgagggagaaaggcagtcccgtcacctctaccgccccccctatcgctactggcgttagcagctctgcctccggcccatcaacggccaattataacagcttctcttccgcaagcatgcctcagattcctgttgcttctgtcacccctactgcgagcctcagtggcgccggtacctacactacaagttctctcagcacgaagagtactaccacgagtgatccacccaatatatgtaaagtgaagccgcaacaattgcagacatcaagccttcctagtgcgtcccatttttcccagctttcctgcatgccaagtctcatcgctcagcagcagcagaatcctcaggtgtatgtctcccagtctgcggctgcacagatcccagccttttatatggatacctcgcaccttttcaacactcagcatgcccggctggcgccaccaagcctggcccagcaacagggattccagcctgggttatcccagccaacttccgtccagcagataccaattcccatttatgctcctctgcagggacagcatcaagcgcaactgtccttgggcgcaggaccggcagtgagccaagcacaggagctgttctcctcctcactccagccttatcgatcccagccggcctttatgcagtctagcctgtcacaaccatcagtcgttctatccggcactgccatccataacttccctaccgtgcagcatcaggaactggctaaggcccaatccggcctcgcgtttcagcagacctcgaatacacagccaatccctatactgtatgaacatcagctgggtcaagcctccggtcttggcggttcccagttgatagatactcacttgctacaggcaagagctaatctgacgcaggcttccaatttgtacagcggacaggtacagcagcccggccaaaccaacttctataacaccgctcaatctccaagcgctctgcagcaggtgaccgtccctttgcccgcatcccaattgagcctccccaatttcggtagcacgggacagcccctaatcgcattgccgcaaactctgcagcctcctctgcagcacactacgccacaggctcaggcccagtcgctgtccagacctgcacaggtcagccagccattcagaggtctcattccagcaggtacccagcatagcatgatagccaccaccggtaagatgtcagaaatggaactcaaagcattcgggtccgggattgacattaagcccgggacccctcctattgccggccgaagcaccaccccaacatccagtccttttagagctacttcaaccagtccgaacagccagagttcaaaaatgaactcaattgtttatcaaaagcagttccaatccgccccggccacggttaggatgacccagccattccccactcagtttgccccacagattctttcacagcccaatctagtccctcccttggtgagggccccccataccaacacctttccagcccccgtgcagaggccacccatggcactcgccagtcagatgcccccaccattaaccacgggcctcatgtcccatgcaagactgccacatgtcgcgagaggcccttgcgggagcctgtcgggggtccgtggaaatcaggcacaagctgccctcaaggcggaacaggacatgaaggcaaagcagagagcagaagtgctgcagtcaacgcagcggttctttagcgaacaacaacagtcaaagcagatcggaggcggcaaggcccaaaaggttgacagcgattcttccaaaccacctgagactcttacggaccccccgggcgtttgtcaggaaaaggtcgaggaaaaacctcccccagcccccagcatcgccaccaaacctgtccgcaccgggcccatcaagccccaagcaatcaagacagaggagaccaagtcctag

SEQ ID NO: 32294 - DNA, 2292 bp, Artificial Sequence
  Description of Artificial Sequence: Synthetic coding sequence
atcctcccccctacgcagatgttccagcaatatccacggatgacttacccacccctgcatggtccgatgaggtttccgcccagcctgagtgagaccaacaaaggcctgcgcggcagaggtcctcccccttcatgggcatctgaacccgaaagacccagcatattatccgcatccgaactaaaggaactggataaatttgacaatctggacgccgaagctgacgaaggttgggcaggagcccagatggaggtcgactatacagaacaactcaactttagtgacgatgacgagcaggggagtaacagcccaaaagaaaacaactcagaggaccagggatcaaaggcatctgaaaacaacgagaacaaaaaggagactgatgaggtgagcaacaccaagtcctcatcccaaatcccagcacagccaagcgtcgcaaaagtcccctatggaaaagggccttcctttaatcaagagcgaggaacttccagtcacctgccgcccccacccaaactcctcgcccaacagcatccaccccccgacaggcaagcagtcccgggaagacctggcccgttcccatcaaagcagcaggtggcagacgaggacgaaatctggaaacaaagacgacgccagcagagtgagatatccgcagcagtggagagagcaaggaaacgccgtgaagaggaagaacggcgcatggaggaacagagaaaggctgcatgcgcggaaaaattaaagcgcctagatgaaaaactaggaatcttggagaaacagccttcgcccgaagagatcagagagcgcgaaagagagaaggagcgagaaagggaaaaggaattggagaaagagcaggaacaggaaagagagaaggaacgcgagaaggatagagagcggcagcaagaaaaagaaaaggaattggagaaggagcaggagaaacagcgtgaaatggagaaggagcgaaaacaagaaaaagaaaaggaattagagcgtcaaaaagaaaaggaaaaggaactgcagaaaatgaaagagcaggaaaaggagtgtgagctggaaaaagagagggagaaactggaggagaagatcgaacctagggagcctaacctggaaccaatggtggagaagcaggaatccgaaaactcttgtaataaggcagaagaggagcctgttttcacacggcaagattctaaccggagcgagaaggaggctacaccggtagtacacgagactgaacccgaatcaggctcccagcccaggcccgcggttctctccggctactttaagcaattccagaagtctctgcctccgcgcttccagcggcagcaggaacagatgaaacagcagcagtggcagcagcagcagcagcagggcgtgctgccgcagacagtgccatcccagcctagtagtagtactgtccctcctccccctcatagacccctatatcaacctatgcagccacacccgcagcacctggcgagtatgggcttcgacccccggtggttgatgatgcaatcttacatggacccgaggatgatgagtgggcgcccagccatggatattcctcctattcacccaggcatgatcccgccaaaacctctcatgaggagggatcagatggagggctctccgaatagtagcgagtcttttgagcatattgcccgatccgccagggaccatgcgattagcctgtccgagcccagaatgctgtggggatccgacccctaccctcatgccgagcctcaacaggcaacgacaccaaaagccacagaagagcctgaggatgtgaggagcgaggctgcgctggatcaagaacaaataaccgccgcatacagcgtggagcataatcaactggaagcccaccctaaagccgattttatcagagaatcctctgaggctcaggtacagaagttcctctctcgctcagttgaagacgtgaggccacaccacaccgacgccaacaatcagagcgcttgctttgaagcaccagaccagaagaccctgtccgcgccccaagaggagaggattagtgctgtggagtcgcagccttctagaaaacgttctgtttcgcatggctccaaccatactcagaagcccgacgaacagcgcagcgagccgagcgctggcatccctaaagtgactagccgctgcatcgattccaaggagccgatcgagcggcccgaggaaaaaccaaagaaggagggcttcatcaggagttccgaaggccccaaaccggagaaggtgtacaagtcaaagagtgagacccggtggggacctagacctagtagcaaccgccgagaggaatag

SEQ ID NO: 32295 - DNA, 930 bp, Artificial Sequence
  Description of Artificial Sequence: Synthetic coding sequence
atgctgctgatactcctgtctgtcgcccttctggccttaagtagtgcgcagagccttaacgaggatgtgtcccaagaggaatcgccgtctgttatttcaggaaagcctgaaggccgcaggcctcagggtggaaatcagccacagagaacaccgcccccgcccggcaaaccggagggcaggcctcctcagggtggtaaccagagccaggggcctccaccacgccccggaaagcctgaaggacctcctccgcaaggcggaaatcagagccagggcccacccccccgccccggcaagccagagggccaaccccctcagggaggaaatcagtcacagggtccgcctcctagaccagggaagcccgagggccctccacctcaaggagggaatcagtcccagggtccccccccccgccccgggaagcctgagggtcctcctcctcagggtgggaatcagtctcaaggaccaccaccaagaccgggcaaaccagagggcccaccaccccaaggtggcaaccaaagccagggtcccccaccccatcctggcaaaccagaggggcctcctccccagggcgggaatcaaagtcaggggccacctccgcgccctggaaagcctgagggcccccctccacaggggggcaatcagtcgcaaggccctcctccgcgcccaggaaaacccgagggaccgccttcgcagggtgggaacaaaccgcagggtccaccaccccaccccggcaaacctcaaggaccaccaccacaggagggtaataagccccaacggccccctccaccagggcgaccacaaggcccgccgccacctggcgggaacccccagcaacccctgccacctccagcaggtaaaccacagggtcccccacctcctccccagggtggcagaccacacaggcccccgcagggccagcccccacaatag

SEQ ID NO: 32296 - DNA, 930 bp, Artificial Sequence
  Description of Artificial Sequence: Synthetic coding sequence
atgcttctgatcctgttgagcgttgctcttctcgccctgagctctgctcagtctcttaatgaagatgtttcccaagaggaatctccatccgtgattagtgggaagcccgagggacggcgacctcaggggggtaaccagccacaacgcactccacctcctccaggtaaacccgaaggccgacctccccagggcggcaaccagtcgcaaggaccacccccccgccctggtaagcccgaaggccctccgccccagggtggaaaccagagccagggacctcctccccgccctggtaaacccgaaggacagcccccccagggcggaaaccaatctcagggacctcctcccaggcccggcaaacccgaaggccccccaccacaggggggcaaccaatcccagggccccccccccagacctgggaaacctgagggaccgccacctcagggaggtaaccagagccagggtcctccaccacatccaggcaaaccagagggccctcccccccaggggggtaatcagtcccaggggccacctccccgacccggcaaacctgagggaccacccccgcaaggaggcaaccagagccagggcccaccaccgagaccagggaagcccgaaggcccgcctccacagggaggaaaccagtcgcagggcccgccaccacgacccggcaaacctgaggggcccccatctcaggggggcaataaaccccagggtccgccacctcatccaggaaagcctcagggaccacccccccaggagggaaacaaaccgcagaggccgcctccccctgggaggccacagggccccccccctccaggcggaaatccacagcaacctctccccccacctgcaggtaagccccagggacctccccctccccctcagggaggcaggccacaccggcccccacagggacaacctccccagtag

SEQ ID NO: 32297 - DNA, 501 bp, Artificial Sequence
  Description of Artificial Sequence: Synthetic coding sequence
atgctactgattttgttatccgtggctctcttagccttctccagcgcacaggacttggacgaagacgtgagccaagaggatgtccctctggttatatctgatggaggcgactcagagcagttcattgacgaagagcggcagggcccgcctctgggcgggcagcagtctcagccttccgccggggatggtaatcagaatgatggtcctcagcaaggcccccctcagcagggtgggcagcagcagcaggggcctccacccccccagggcaaacctcaaggcccacctcaacaagggggccatccaccaccacctcagggacggcctcagggtccccctcagcaaggggggcatccacggcccccaagggggcggccacagggcccaccgcagcagggcggccaccagcagggtcctccgccgccgcccccgggcaaaccccaagggccccccccacaggggggccgtccccaggggccgccacagggccaaagcccccagtag

SEQ ID NO: 32298 - DNA, 501 bp, Artificial Sequence
  Description of Artificial Sequence: Synthetic coding sequence
atgctcttgattctcctgagtgtggccctgttggccttctctagcgcccaagaccttgatgaggacgtgagccaggaagacgtccccctcgtcatttcagatgggggggactcagagcagtttatcgatgaggagcgccagggtccgccgctgggaggccagcaatcccaaccaagtgccggcgacggaaaccagaatgatggccctcagcaggggccacctcagcagggtggccagcagcaacaaggaccaccaccgccgcaagggaagccccagggccctccccaacagggcggtcaccctccacctccgcaaggcagaccccaagggcctccgcagcaaggtggtcatccgcggcctcccaggggaagacctcaaggccccccacaacagggaggtcatcaacagggccctcccccgccgcctccaggcaagccccagggcccccctccccaggggggtcggcctcagggaccaccacaggggcagagtccacagtag

SEQ ID NO: 32299 - DNA, 501 bp, Artificial Sequence
  Description of Artificial Sequence: Synthetic coding sequence
atgctgctgatcttgttaagcgttgccctcctcgctttctcgagtgctcaagacctagacgaggatgtcagccaggaggatgtcccattggtaatatcggacgggggggactcagagcagttcatcgatgaggagcgccagggcccgccactcggaggacagcagtctcagcccagcgctggtgatgggaatcagaatgatggcccacagcaaggacctccgcagcaggggggccagcagcagcagggtcccccccccccgcagggaaagccccaggggccgccccaacagggggggcaccctccccctcctcagggacgacctcagggtcccccacagcagggcggtcatcctaggccacctagggggcgcccccaaggccccccccagcaaggaggccaccagcaagggccccctccgcctcctcctggaaagccccagggcccgccgcctcaaggaggccggcctcagggtcccccacagggccaaagcccgcagtag

SEQ ID NO: 32300 - DNA, 501 bp, Artificial Sequence
  Description of Artificial Sequence: Synthetic coding sequence
atgctcctaattttattgagtgtggccttattggccttcagttcagctcaggatttggatgaagatgtgtcccaggaggatgttccactcgtaatttccgatggtggggactccgagcagttcattgacgaagaaagacaaggcccccccttgggtggccagcaatctcagccctctgctggcgatggcaaccagaacgacggcccgcaacaaggcccgccgcagcaggggggccaacagcagcagggccctccacctccacagggcaagcctcagggccctcctcagcagggcggacacccccctcctccacagggccggccccagggcccgccccagcaaggaggacaccctcgtccaccccgcggcagacctcagggccctccccagcagggaggtcaccaacagggcccgcctccccctcccccaggtaagccccaggggccccccccgcaggggggacgaccccagggcccaccccaggggcagagcccacagtag

SEQ ID NO: 32301 - DNA, 486 bp, Artificial Sequence
  Description of Artificial Sequence: Synthetic coding sequence
atgttctccttacctttaaactgcagcccggaccatatccgtagaggctcctgttggggccgtccccaggatctcaagattgccgcaccagcgtggaactcgaagtgtcatcccggcgctggggcagccatggcccgctgtaagaatgcggacggcgttgaactgtataatgagattgaattctatgccaaagtgaattcaaaagattcacaggataagcgatcgtcccgctctattacttgcttcgtcaggaaatggaaggagaaggttgcatggcccaggctgactaaagaggatattaagcctgtctggcttagcgttgattttgacaattggagagactgggagggagacgaggagatggagttagcccacgtcgaacactatgcagaactgctcaaaaaggtgagcactaagcgcccccccccagcgatggatgacttggatgacgactccgactcagccgatgatgccacatctaattag

SEQ ID NO: 32302 - DNA, 387 bp, Artificial Sequence
  Description of Artificial Sequence: Synthetic coding sequence
taacaacacgcgcgcaccttgtggtatgatcgtccatcttgtaaaaatgccgatggcgtcgagttatacaacgagattgaattttacgctaaagtcaattccaaagactcccaggataagagatcgagtcggtccatcacatgctttgttagaaaatggaaagagaaagtggcgtggccccggctgaccaaagaggacatcaagcctgtgtggctgtctgtggacttcgataactggcgcgattgggagggtgatgaggaaatggagctagctcatgtggaacactatgctgagttgctgaagaaggtctctacaaagcggcccccgccagcaatggatgatctggatgacgactcggattccgcggatgacgcgactagtaattag

SEQ ID NO: 32303 - DNA, 297 bp, Artificial Sequence
  Description of Artificial Sequence: Synthetic coding sequence
atgagaaagatgaacactctcctgctggtatcgttgagtttcctgtacctcaaggaggtgatgggactcaagtgtaatacttgtatctacacagaggggtggaagtgtatggcaggaagaggtacatgcattgctaaggaaaatgagctttgttccacaaccgcctacttcaggggcgacaaacacatgtacagcacccacatgtgtaaatacaagtgcagggaggaggagagttccaaacgcggcttgctacgcgtgaccttatgctgtgataggaacttttgcaatgtattttag

SEQ ID NO: 32304 - DNA, 345 bp, Artificial Sequence
  Description of Artificial Sequence: Synthetic coding sequence
atggccgggttggcgctgcagcctgggacagccctcctgtgttacagctgcaaagcccaggtttcaaacgaggattgtcttcaggttgagaactgcacccagctgggcgagcagtgctggacggcccgtattcgcgcagttggccttctgacggtcatcagcaaaggttgttctctgaactgcgttgatgatagtcaggactactatgttggcaaaaagaatatcacttgctgcgataccgatctgtgtaatgcctccggagcccacgccctgcaacccgccgccgctattctcgctctgctgcctgctctgggactgctcttgtggggtcccggccagttgtag

SEQ ID NO: 32305 - DNA, 312 bp, Artificial Sequence
  Description of Artificial Sequence: Synthetic coding sequence
atgggctctaggtgcgccaaactgaatacgggccagagcccagggcacagcccaggccactccaccggacatggaagaggccatgaaagttctatgaagaagctgatggcatgtgtgtctcaagacaacttttccctgagttcggcgggcgaagaggaagaagaggaagaggaggagggggaggaggaagaaaaggaagagctgccagtacaggggaaactcctgttgctggaacctgagagacaggaggagggtcacaaggacaacgctgaagcccagcagtcacccgaaccgaagcgcacaccctcttag

SEQ ID NO: 32306 - DNA, 744 bp, Artificial Sequence
  Description of Artificial Sequence: Synthetic coding sequence
atgaatctgctcctgatcctgacctttgttgctgctgcagtggccgcccccttcgatgacgacgataagatcgtgggaggatacatctgcgaggaaaattcagtgccatatcaggtgagtctgaactccggctaccacttctgcggtggcagtctcatctcagaacaatgggttgtgagcgccggccattgctacaaaagtcggatacaggtgaggctgggcgaacataacatcgaagtactggagggtaatgagcagttcatcaacgcagcaaaaattatacgccaccctaagtacaattctaggactctggacaacgatattttgctgattaaactcagcagcccagctgtgattaactcaagagtgagcgctatatcactgcccacggctcccccagccgcgggcacagagtctcttatctcagggtgggggaacaccctgtcatcgggagccgattaccccgatgagttacagtgcctagacgcacccgttttgagccaggctgagtgtgaggcctcttatcctggcaaaatcaccaataatatgttctgtgtcgggttcctggagggcgggaaagactcatgccagggagacagtggagggcctgtcgtttccaatggggaacttcagggcatagtatcgtggggctatggttgtgctcagaagaatagacctggcgtttacacgaaggtctacaattatgtggactggatcaaagacactattgccgctaattcctag

SEQ ID NO: 32307 - DNA, 525 bp, Artificial Sequence
  Description of Artificial Sequence: Synthetic coding sequence
atggcctgtggtcccggcgatctgcagagccttacctcgcccctttctagcgcccgattggattaccaaccttcgatcgaaggtccctggctgagggcctgtggccagacaaatgttagttgcagagttgtcaagggtaagcttgtggaggttggcaaatggccatggcaggtttctatcctgtttctcggaacatatatctgctctgggtccttgatacaccatcagtgggtcctaactgctgcccactgccttcagcgcttcaaggatctcagcctctactccgtgatggttggcgtgcatcaacgaccagagaattcaacccagctacccctaacccgcatggttattcacaaggatttttcaaatctgatgagtcaggacattgccctgttgaaactaagagatagcatatcatggagcccctttgttcagccggtttgcctgcccaatatcaagttcaagccctcaatcggatcgatgtgctgggtaatcggatggggcacgaccggaaagaaaggctag

SEQ ID NO: 32308 - DNA, 726 bp, Artificial Sequence
  Description of Artificial Sequence: Synthetic coding sequence
atgaagttcatcttgctttgggctctgcttaacctgaccgtggctcttgcgttcaaccctgattacactgtgagctctacacctccgtatttagtgtacctcaaaagtgactacctgccctgcgccggagtgctcattcatcccttgtgggtaatcacagcagcccactgcaatctgcccaagctcagggttatactgggggtgacaattcctgcggatagcaacgagaagcatctccaggtgatcggatacgaaaagatgattcaccacccccacttttccgtgaccagcatcgatcacgatatcatgctgatcaaacttaagaccgaggccgaattgaatgactacgtgaaactcgccaatcttccttatcagaccatcagcgagaacacaatgtgttctgtctctacttggtcctataatgtatgtgatatttacaaagagcccgactccctgcagactgtgaacatctcggtcataagcaagccccaatgcagagatgcctataaaacctacaatataaccgaaaacatgctatgtgtgggcatcgtgcctggacgcagacagccctgtaaggaagtcagcgccgcccctgccatatgtaatggcatgctccagggcatacttagcttcgccgacggatgtgttttgcgtgctgacgtgggcatctacgctaagatcttctactacatcccatggatagagaacgtaatccagaataattag

SEQ ID NO: 32309 - DNA, 783 bp, Artificial Sequence
  Description of Artificial Sequence: Synthetic coding sequence
atgactcgccactggccctgggaagtgtccctgagaatggaaaatgaacatgtgtgtggaggagcgctcatcgatccctcctgggttgtcaccgccgctcattgcatacaagggaccaaagagtatagtgtcgtccttggaacaagtaagctgcagcccatgaatttctccagggctctgtgggttccagtgcgggacattattatgcatccgaagtattggggtcgtgcattcatcatgggcgacgtggctttagtccacctgcaaaccccagtgactttcagtgagtacgtccagccaatttgccttcccgaaccaaattttaatctcaaggtcggaactcagtgttgggtcactggctggagccaggtcaagcagaggttctctgccaatagcatgctgactcctgaactgcaggaagcagaagtcttcatcatggacaataaacggtgtgatagacactataaaaagtctttctttcccccagtggttcccctggtgctcggcgatatgatttgtgccaccaattacggcgagaacctgtgctacggcgatagcggaggtcccttggcctgtgaagtcgaaggtagatggatcctggccggggttttgtcatgggaaaaagcctgcgtgaaagctcagaatcccggggtctacactcgcatcacaaagtatacaaagtggataaagaaacagatgagcaatggggcgttttccgggccttgcgcgagtgcatgtcttctgttcttgtgttggctgctccaaccacagatggggagctag

SEQ ID NO: 32310 - DNA, 687 bp, Artificial Sequence
  Description of Artificial Sequence: Synthetic coding sequence
atgacaaggcactggccttgggaggtgtccctacgaatggagaacgagcacgtttgtgggggcgcccttatagacccgtcatgggtggtgaccgcagcacactgcatccagggcactaaggagtactccgttgtactgggcacgagtaaattacaaccgatgaacttttctcgtgcgttgtgggtgcctgtgagggatatcataatgcatcctaagtattggggcagagcattcattatgggggatgtcgcccttgttcaccttcaaactccggtgacattctctagcacagcaaacagtatgctgaccccggagctgcaggaggccgaggtgttcattatggataataaacgatgtgatcgacattacaaaaaaagcttttttccacctgtggtcccattggtcctgggcgacatgatatgcgccactaattacggggagaatctgtgttatggggattccggcggtcctctcgcgtgcgaagttgaggggagatggattctcgccggcgtgctgagttgggaaaaggcttgcgtgaaagcccaaaaccctggcgtatatacacgtatcaccaaatacacgaaatggataaaaaagcaaatgagtaacggagcgtttagcgggccctgtgcatcagcttgtctgctgttcctgtgttggctgctgcagccacaaatgggaagttag

SEQ ID NO: 32311 - DNA, 1179 bp, Artificial Sequence
  Description of Artificial Sequence: Synthetic coding sequence
atggccgcccccctgcgcatacagagcgactgggcgcaggcattgcgcaaggacgagggcgaggcgtggctttcttgtcacccgcccggcaagccgagtctctacggatctcttacctgccaaggcataggtctcgatggcattccagaggttacggctagcgaaggcttcacagtgaatgagattaacaaaaaaagcatccacatcagctgtcctaaagagaatgctagttcaaagttcctggcaccttacactactttcagtagaatccataccaagtccataacttgcctcgatatttccagtaggggaggactaggggtgtcttccagcacagatggtaccatgaaaatctggcaagcatccaatggtgagttgcggagggttctcgaagggcacgtctttgatgtcaactgctgtcgattcttcccctctggattagtggtgcttagtggtggcatggacgcacagctgaagatttggtccgccgaagatgcatcatgcgtggtgacctttaaaggccacaaaggcgggattctcgacaccgctattgtggataggggcaggaatgtggtctcggcctctagggatggcaccgcgagactctgggattgcggcaggagcgcctgcttgggggtgctggcggactgcggcagcagtattaatggcgtcgcagtcggagccgccgataactcgattaacctagggagccccgagcagatgccctcggagagggaagtcgggaccgaggccaaaatgctgctgctggcccgggaggataagaaactgcagtgtctcgggctgcagagccgccagttggtgttcctcttcatcggcagcgatgccttcaactgttgcactttcctgagcggatttttgctgctggctggcactcaagacggcaatatctaccaactagacgtgagaagccctcgtgcccccgtgcaggtgatccatagaagtggggcacctgtcctgagtctgctgtcggtgcgggatgggtttattgcctcccagggagacggcagctgcttcatcgtgcagcaggatttggactatgtgacagagctgacaggcgccgactgcgacccagtgtacaaggtggcgacctgggagaaacagatttatacttgctgtagggacggactagtcagacgctatcagctctccgatttgtag

SEQ ID NO: 32312 - DNA, 1128 bp, Artificial Sequence
  Description of Artificial Sequence: Synthetic coding sequence
atgctcgtgccttgttttctctactctctacagaaccgaaagccctcactctacggatctctgacgtgtcagggaatcggtctcgatggcatccccgaagttaccgcatctgaggggtttacagtgaacgagattaacaaaaagagcatccatattagctgccccaaggaaaatgcctcatcaaaatttctggcaccctatacgacattctcgcgtattcacactaaatccattacctgcctggatatcagctccagaggtgggttgggggttagttcctctacggacggtactatgaagatctggcaggcctccaatggtgagctgcggcgcgtcttggagggccacgtgttcgacgtaaactgttgcagattttttcccagcggcttggtggtcctctccgggggaatggatgcgcagctgaagatatggtcagcagaggacgcgtcttgtgtcgttacctttaaggggcacaagggaggaattttggatacagccattgtggaccggggcaggaacgtggtatctgcctcccgagacggcaccgccagactttgggactgtggccggagtgcttgcctcggagtgctggccgactgcggcagctccatcaatggagtcgctgtgggcgctgccgacaattccatcaacctgggcagtcccgaacagatgccttcagagagagaggttgggaccgaggctaagatgctattgttagctagagaggataagaaattacagtgtctaggattacaatcaaggcagctggtcttcctttttatcggcagcgatgcttttaactgctgcacatttcttagtggcttcctgctgctcgcgggaactcaggacggaaacatctaccaacttgacgtccggagtccccgcgcacctgtgcaagtgatccaccgttctggtgccccggtgctttcccttcttagcgttcgcgatggctttatagcctctcaaggagatggatcttgcttcattgtgcagcaggatcttgattacgtgaccgaactgacgggtgctgattgtgatcctgtgtacaaagtggctacctgggagaagcaaatttatacatgctgccgcgacgggctggtcaggcgctatcagctgtccgacctctag

SEQ ID NO: 32313 - DNA, 714 bp, Artificial Sequence
  Description of Artificial Sequence: Synthetic coding sequence
atgctggtgccgtgttttctgtacagtttacagaaccgaaagccctcactgtacggcagtctgacctgccagggaatcggcctggatggaattccggaggtgacagcaagtgagggcttcaccgtgaacgagatcaacaaaaaaagtatccacatctcttgcccaaaagagaatgcgtcaagtaaatttctggctccttatacgactttctcaagaattcatacaaaaagtattacctgtctcgacatttcctctaggggaggcttgggagtttcatcatcaaccgatgggacaatgaaaatctggcaggccagcaatggggaactcaggcgggtcctcgaggggcatgtgttcgacgtaaattgctgccgattcttcccttcgggactggtggtcttgtccgggggaatggatgcccagctcaaaatttggtcggccgaggatgcaagttgcgtagtgacctttaaggggcataagggagggatactggacactgcaatagtagacagagggaggaacgtggtgagtgccagccgggatggaaccgcgaggttatgggactgcggccgcagcgcgtgcctcggtgtactggcggattgtggctcctccattaacggtgtggcagtgggcgccgcggataattctatcaacctgggtagcccagaacaaatgccaagcgagcgagaggtgggcactgaagcaaaaatgctttag

SEQ ID NO: 32314 - DNA, 1128 bp, Artificial Sequence
  Description of Artificial Sequence: Synthetic coding sequence
atgttggtaccatgcttcttgtactcactgcagaacagaaagcccagcctgtatgggtccctcacatgccaggggataggcttggacggcattcctgaagtgaccgcctccgagggctttacagtgaacgagatcaataagaaatctatccatatcagctgtccaaaagaaaacgcctctagcaagttcttagccccctacaccactttttcacggatccacacgaaaagcattacatgcctggacatttcctctagaggaggactgggggtctcttcttctaccgacgggacaatgaagatctggcaggcctcaaacggagagctgcggcgagtcctggaggggcatgtctttgacgtcaattgctgccgttttttccctagcggcctggttgtcttaagcgggggcatggacgcacaactgaagatctggtctgccgaggatgctagttgcgtggtgacgttcaagggtcataagggcggcatcctggatactgcaattgtcgatcgcggcaggaatgtagtgagcgctagccgagatggtactgctcggctatgggattgtgggcgcagtgcctgcctgggcgtactcgcagattgcggctcatcaatcaacggcgtagccgtgggagctgccgataattcaattaacctgggaagccctgaacagatgcccagcgagagagaagtgggtacagaggccaagatgctgctcctagcacgggaagataagaaactacagtgcctgggactccagagtaggcagttagttttcctgttcatcggtagtgatgctttcaattgttgcacctttttgagtggctttctactgctcgccggcacgcaggatggaaatatctatcagctggacgtccgatccccacgggccccagtgcaggtgatacacaggagcggcgcacctgtactctcacttctgagtgtgcgcgatgggttcatcgccagtcaaggggatggatcatgctttatagtccagcaggacctggattacgtgactgagttgacaggcgctgactgcgatccagtgtataaagtggctacgtgggagaagcaaatctacacttgttgccgcgacgggctcgtccgtagatatcagttgtcagatctctag

SEQ ID NO: 32315 - DNA, 744 bp, Artificial Sequence
  Description of Artificial Sequence: Synthetic coding sequence
atgttggtaccctgtttcctctactctttgcagaatcggaagccctcattgtatggtagcctgacatgccaaggcattggtctggatgggattccagaggtgacagcttccgaaggattcaccgtgaatgagataaacaagaagtccatccatataagctgtcccaaagaaaacgctagcagcaagttcctggccccctataccaccttctctcgcatccacacaaagtccataacatgccttgacataagctcaaggggcggattgggtgtctcctcttctaccgatggcaccatgaagatttggcaggccagtaacggtgaactgcgcagagtgctcgagggtcacgtgttcgatgtcaactgctgtcgatttttcccgtcagggcttgttgtcctctcaggggggatggatgcgcagttaaaaatttggtcagccgaggatgcctcttgcgtcgttaccttcaagggccacaaaggaggtatcctcgatacagctatcgtcgacagaggtcgcaatgtggtgtccgccagcagggatgggactgccaggctttgggactgcggtcggtccgcctgcttgggcgtgctcgcggattgcggttcttctatcaatggcgtcgcagtaggagccgcagataattccattaacctgggaagtcccgagcagatgccaagcgagcgcgaggtaggcaccgaggccaagatgctcctgctggcccgtgaagacaagaagctccagtag

SEQ ID NO: 32316 - DNA, 1128 bp, Artificial Sequence
  Description of Artificial Sequence: Synthetic coding sequence
atgctggtaccctgttttctgtattcactgcagaacaggaagcccagtctgtatgggtccctcacatgtcagggtatcgggctcgatggcatccccgaggttaccgcctctgagggattcactgttaatgagataaacaaaaaatccatacatatatcatgcccaaaggagaacgctagcagtaaattcctggcgccttataccaccttcagtagaattcataccaagagtattacctgcctggacatttctagccggggtggtttaggtgtttctagtagcactgacgggactatgaaaatttggcaggccagcaatggagagctgcgacgagttctagagggccacgtttttgatgtcaactgctgccgattctttccatccggactggtagtgctgtccgggggtatggatgcccagctgaagatttggtccgcggaagacgcgagttgcgtggtgacgttcaaaggacataaggggggaatcttagacacggcaatcgtggatcgaggtcgaaatgtcgtttcggcgtctagggacggaacggcacgtctgtgggattgtggacggtctgcctgtttaggcgtcctcgctgactgcgggtcgagcataaacggggtcgcagtcggggctgcagataacagcatcaatctgggtagtccggaacagatgccatctgagcgggaagtgggtacagaggctaagatgctacttttggcacgggaggacaagaagttacaatgcctcgggttgcaatccagacagctggtcttcttatttataggttcagatgcatttaactgctgtacttttttgtctggtttcctgctgctagccggcacccaggatggcaacatttaccaactcgatgtgaggagtccacgagctcctgttcaggtcatccaccgcagtggcgccccggtactgtctctgctttcagttcgggacggttttattgcttctcagggagatggttcctgcttcattgtgcagcaggacctagactatgtcactgaactaactggcgctgattgtgatcccgtgtacaaagtggcgacatgggaaaagcaaatttacacatgctgtagggatggcttagttaggcgttaccaactgtcggacctgtag

SEQ ID NO: 32317 - DNA, 1566 bp, Artificial Sequence
  Description of Artificial Sequence: Synthetic coding sequence
atgaaacaggaggggagtgcccggcgtaggggtgctgataaggcaaaaccacctcccgaagacgtggaaatgaaggaagaggctgcaacggggggaggctctaccggtgaagccgacgggaaaacagcagccgcagcggccgagcatagccagcgcgagctggatacagtaacgttggaggacatcaaagaacatgtgaaacagctggagaaagctgtatccgggaaagagccgcgctttgtattgagagccctgcggatgctgccctccacaagtcgtagactcaaccactatgtgctgtataaagcagtccaggggttcttcacctccaataacgcgacaagagacttcctgctgcctttcttagaagaaccaatggataccgaggccgacctccaatttaggccgagaaccgggaaagctgcctctaccccactgcttccagaggtcgaggcctacctgcagttattagtcgtgatattcatgatgaattcaaaacgttataaggaagcccagaaaatttccgatgatctgatgcagaagattagcacacagaatcggcgggccctcgatctcgtggctgctaagtgctattactaccacgcgcgcgtgtacgagtttctagacaaactggacgtggtgcgaagttttctgcatgctcggctgcgtactgctacgctgcgtcacgatgcagatggtcaggccacattgcttaacctgttactacggaattacttgcattactccctctacgaccaagccgagaagcttgtgagcaagtccgtctttcctgaacaggccaacaataatgagtgggcaagatatctgtactacacaggccgcattaaggctattcaactggagtatagcgaggcccggaggacaatgacaaacgccctgcggaaggccccccaacacacagccgtggggttcaaacagacagtacacaagctgttgatagttgtcgaattgttgctgggtgagattcccgacagacttcaattcaggcaaccctccctgaagaggagcctgatgccctattttcttctgacccaggcggtcagaactgggaatctggctaaattcaaccaggtgctggatcagtttggggagaagttccaggccgatggtacttacaccctgattatccgccttcgccataatgtgatcaaaaccggggtccgcatgattagcctgagttatagtcggatatctctggccgatattgctcagaagctccaactggattctccagaagatgctgaatttattgtcgctaaggccatccgtgacggcgttattgaggctagcattaaccacgaaaaaggatatgtccagtccaaagagatgatcgatatctacagtactagagagccgcaacttgcttttcaccaacgcatctcgttttgtctcgatatacacaacatgtccgtgaaggccatgaggtttcccccgaaaagctataataaagacttggaatccgctgaagagcgcagagaaagagaacagcaggacctcgagttcgccaaggagatggcagaggatgatgacgatagttttccttag

SEQ ID NO: 32318 - DNA, 348 bp, Artificial Sequence
  Description of Artificial Sequence: Synthetic coding sequence
cttaccagccccaggtcttgcagttggatcgctcccaagatgcaaagcagcttgttagcacaggcgatcagggacggagtgattgaggctagtattaatcatgagaagggatacgtacagtctaaggagatgattgacatctatagtacacgggaaccccaattggccttccatcagcgaatctctttctgtctggatatccataatatgagtgtgaaggctatgcggtttccgccaaaatcatacaacaaggatctggaatctgctgaggaacggcgggagagggagcagcaagacctggaattcgctaaggaaatggccgaagacgatgacgacagctttccctag

SEQ ID NO: 32319 - DNA, 1071 bp, Artificial Sequence
  Description of Artificial Sequence: Synthetic coding sequence
atggacaccgaagccgatctgcagtttcgtccgcggaccggcaaggcggcttccacccccctcttacctgaggtagaagcctacctgcagctcctcgtggttatattcatgatgaatagtaaacggtataaggaagctcagaagatctctgatgatctcatgcaaaagatcagcactcaaaatcggcgagcccttgacctggttgcagccaagtgctactactaccacgctcgagtgtacgagtttctggacaaacttgacgtcgtgcgctcctttctccatgcacgcctccggaccgccactctgcgccacgacgctgacggacaggctacactgctcaatctactgctcagaaattacctccactacagcctatatgatcaggctgagaaactggtctctaagtccgtctttccagaacaggctaacaataatgagtgggcaaggtatctttattacacaggacgtatcaaggctatacagcttgaatatagcgaggcccgcaggacaatgaccaatgctttgagaaaagcaccacagcatactgccgttggctttaaacagacagtccacaagctcttgatcgtggtagaactgctgcttggggagattccagaccgacttcagttcagacaaccaagcttaaaacggagtcttatgccgtatttcctgctaacacaggcagtacggaccggaaatttggccaagttcaatcaggtactggaccagttcggcgagaagttccaggctgacggcacatacaccctgattatcaggctgagacacaacgtgataaaaaccggagtcagaatgattagtttatcctattcccgcatcagcctggcagacatagcgcagaagttacagcttgacagtcctgaggatgcagagtttatagttgctaaggcgatcagagacggggtgattgaggccagtataaaccacgagaagggctacgtgcagtctaaggagatgatcgacatttattctacaagagagccacagctggcttttcaccagcggatatccttctgtctagatattcacaatatgtctgtcaaagggtggtag

SEQ ID NO: 32320 - DNA, 369 bp, Artificial Sequence
  Description of Artificial Sequence: Synthetic coding sequence
atggaggacactccgctcgtgattagcaaacagaaaaccgaggttgtttgtggggtgcctactcaggtggtatgtacggcattcagctcccatattttggtagttgtcacgcagtttgggaagatgggaacactcgtgtctctagaacccagctccgttgcatccgatgtgtccaaacccgtgctcactacaaaggtgctgctgggtcaggatgagcctctgatccacgtgttcgccaagaacttagtagcgtttgtgtcccaggaggccgggaatcgggccgtcctgctggccgttgctgtcaaggataagagcatggagggccttaaggcactccgtgaggttatacgagtttgccaagtgtggtag

SEQ ID NO: 32321 - DNA, 369 bp, Artificial Sequence
  Description of Artificial Sequence: Synthetic coding sequence
atggaggacacacctctcgtgatatcaaagcagaagacagaagtggtgtgcggagttccaacacaggtggtctgtaccgccttcagtagccatatactggtggtggtgactcagtttggcaagatgggaactctggtgtcacttgagcctagctccgtcgcatcagatgttagcaaaccagtgctaaccacaaaagtgctactgggacaggatgagccgttgattcatgtgtttgctaagaacctggttgccttcgtctcccaggaagccgggaatcgggccgtgcttctggccgttgccgtcaaggacaaatccatggaggggctgaaggccctgagagaggtgattcgagtgtgtcaggtttggtag

SEQ ID NO: 32322 - DNA, 369 bp, Artificial Sequence
  Description of Artificial Sequence: Synthetic coding sequence
atggaggacacccccctcgtcataagtaaacaaaagaccgaggtggtgtgcggggtccctactcaggtggtctgtaccgcattcagctcccacattctggtggtggttactcagttcggcaagatgggcacactggtaagcctggaacctagttcggttgcttctgatgtatcgaaaccagtactgactactaaagttctgctcggacaggatgagccgcttattcatgtcttcgctaaaaacctggtagctttcgtgagccaagaggcagggaatagggccgtacttctggctgtagccgtgaaagataaatcaatggagggcctgaaggccctccgcgaggtaattagggtgtgccaggtttggtag

SEQ ID NO: 32323 - DNA, 489 bp, Artificial Sequence
  Description of Artificial Sequence: Synthetic coding sequence
atggaggggctggtagtggccgcaggaggcgatgtgtcacttcacaatttctctgcgaggctctgggaacagctagtgcacttccatgtgatgcgcctgacagactctctctttctctgggtaggggccacccctcatcttcgcaatcttgcagtggcaatgtgtagcaggtacgatagtatacccgtgagcacttctctgctgggcgatacgtcagacacgacatctaccgggctggcccagcggttaggcctcggcggaaagaccggcctggcttgtgagtgcggagttgagtggggtctatcaaaggggcacgaggctgagtgcagtactctgcccactccacagcacactagctgtggccctgcccgcaagacaaataagcaggtcttcgttagctacaatctccaaaatacagatagtaacttcgcgctactggtggaaaacagaatcaaagaggaaatggaagcctttcctgaaaaattctag

SEQ ID NO: 32324 - DNA, 372 bp, Artificial Sequence
  Description of Artificial Sequence: Synthetic coding sequence
atggaaggactggtggttgcggccgggggcgatgtgagcctgcacaacttttctgctaggctgtgggaacagcttgtacattttcacgttatgcgactgacagactccctgttcctttgggttggagctaccccacacctgcgcaatttggccgttgctatgtgctcaaggtatgattccatcccagtgagcacctctctgttgggcgacactagcgacactacatcgacggggctggcccagcggttggctcggaaaacaaataaacaggtgttcgtgtcgtacaacctccagaatacagattcaaacttcgctctcctggtggagaaccgcattaaggaggagatggaggcctttcccgaaaaattctag

SEQ ID NO: 32325 - DNA, 315 bp, Artificial Sequence
  Description of Artificial Sequence: Synthetic coding sequence
atggaaggcctggtcgtggccgcaggcggcgacgtttcactccacaatttttcagctcgactctgggagcagctggtacatttccatgtgatgcggctgactgatagtctgttcctctgggtgggggctaccccacatctacgaaatctggctgtggcaatgtgctcacgctacgacagcatacctgtatccaccagtttgttgggtgataccagcgatacaacctccacagggctcgctcaacgactgggcatgtacccccagctcgccctgcacggccagcccggtggcgcccactctcttatggaaccctag

SEQ ID NO: 32326 - DNA, 639 bp, Artificial Sequence
  Description of Artificial Sequence: Synthetic coding sequence
atggcatccagatacgatcgagcaatcactgtctttagtcccgatggccatttattccaagtggagtacgctcaggaagcagtgaagaagggcagcaccgccgtgggtatccggggcttgaccgctgatgcacgagtggtcatcaacagggcccgcgtggagtgtcagagccacaagctgacagtcgaggatccagtgactgtggagtacattacaaggtttatagcaactctgaagcaaaagtatacacaaagcaacggaaggcgacctttcgggatcagcgctttgatagtgggattcgatgacgatggcatcagtcggctctaccagacagatccctccggaacttatcacgcgtggaaggctaatgctatcgggagatccgccaaaactgtcagagagtttctcgagaaaaattacaccgaggatgccatcgcaagtgatagcgaagccataaagctagccatcaaagctctgctggaggtggtccaatccggcggaaaaaacatcgagctggccattatacgcagaaaccagcccctgaagatgtttagtgccaaggaagtagagctctacgtgacagagatagagaaggagaaagaagaggctgagaaaaagaaatccaaaaaatctgtgtag

SEQ ID NO: 32327 - DNA, 753 bp, Artificial Sequence
  Description of Artificial Sequence: Synthetic coding sequence
atggccagtcgctatgatcgcgccatcacagtgttctctccagatgggcacctgtttcaggtggagtatgcccaggaggccgtgaaaaagggaagtacggctgtgggaatcaggggcaccaacatcgtggttctcggtgtggagaagaagagtgtggctaagttgcaggacgagagaacagtgaggaagatctgcgctctggatgaccacgtttgtatggcctttgctgggctcacggctgacgcccgagtagtgattaacagggcacgcgtagaatgccaatctcataaactgacggtggaggaccccgtcacagttgagtatatcacgcgctttatcgctacactgaagcagaaatacactcaatccaatgggcgaaggcccttcggtataagcgctctgatcgtgggcttcgacgatgatgggatatctcggctgtatcaaactgatccctcagggacctatcacgcatggaaggcaaacgccatcggtaggagcgctaaaacagtacgcgaatttctcgagaagaactatacagaagatgccatcgcgtccgattcagaagcaatcaagttggctatcaaggcgctcctcgaagttgttcagagtggcggaaaaaatatcgagcttgcgattataaggaggaaccagcccctcaaaatgttttctgccaaagaggtagagctgtacgtaaccgagatcgagaaggaaaaggaggaggccgagaagaagaagtctaagaaatcggtctag

SEQ ID NO: 32328 - DNA, 639 bp, Artificial Sequence
  Description of Artificial Sequence: Synthetic coding sequence
atggcgtcgaggtatgaccgtgcaatcactgtatttagtcctgatgggcacttattccaagttgaatacgcccaggaagccgtaaagaagggaagcactgccgttatcttcattggcctcacggcagatgcaagagtggttatcaatcgcgcaagggtggagtgtcagagtcacaaattgacggttgaggatcccgtcaccgtggagtatatcacacggtttatcgcaacactcaagcagaaatacacacagtcaaacggccgtcgaccctttggcatctccgccctgattgtgggttttgacgatgacggaatcagcagactgtaccagacggaccccagtggtacgtatcacgcatggaaggccaacgctattgggagatctgcaaaaacggtgcgggagttcttggagaaaaactataccgaggacgcaattgcgtctgattctgaggccattaagcttgccatcaaggctctgttagaggtagtgcagtctggtggcaaaaacatcgagctggctatcattagaagaaatcaacccttgaaaatgttcagcgccaaagaagtggagctgtacgtaactgagattgagaaagaaaaggaagaggccgagaaaaaaaaatctaagaagagtgtctag

SEQ ID NO: 32329 - DNA, 636 bp, Artificial Sequence
  Description of Artificial Sequence: Synthetic coding sequence
atggatgtttgtaccttcgaaaaggtgggcattcggggtaccaatatcgtggtcctgggcgttgagaagaaatccgtggcgaaactgcaagacgaaagaactgtccgtaaaatttgtgccctggacgaccatgtatgcatggcctttgccggcctaacagctgacgcgcgtgtggttatcaaccgcgccagggtggagtgtcagagccataagttgactgtcgaggaccccgtgactgtggagtacatcactagatttatcgcaacacttaaacagaaatatactcagtctaacggccggcgcccctttggaataagcgccctgattgtcggattcgatgatgatggtatatcgcgtttataccaaacggatccctcaggcacctaccacgcttggaaggctaacgctatcggccggtctgccaagacagtgcgtgagttccttgagaagaattatacagaagatgccatcgccagcgatagcgaagcaatcaagctggcaataaaagctctgctggaggtggtgcagagcggtggaaagaatatcgaactggcaataattagaagaaatcagccgctgaagatgtttagcgcgaaggaggtggagctttatgtgactgaaattgagaaagaatag

SEQ ID NO: 32330 - DNA, 1632 bp, Artificial Sequence
  Description of Artificial Sequence: Synthetic coding sequence
atgaactgccttgagggccccggaaaaacttgcggtccacttgcatctgaagaagaattggtgagtgcctgtcagctcgaaaaggaagaggagaacgagggggaagaggaagaagaagaagaggatgaagaggacttggatccagaccttgaccccgacctcgaggaggaggaaaacgatttgggggaccccgctgtcctcggcgccgttcacaacacacaaagagctctgctttcatctcctggcgtgaaagctccagggatgttagggatgtccctggcatccctccacttcctgtggcagaccctggactacttgtctccaatcccattctggcctacgttccctagcacctccagcccagcccagcacttcggcccgagactaccgagtccagatcctactcttttctgcagtctgttgaccagttggcctcccaggttctcacatctcactcagctccacccgcgacaccagaggatattacaacagcagcaacattctcagaccccctctccccctgctaagaagccttggtcccagcagccagacccctacgctaacctgatgacgaggaaggagaaagattgggtgattaaggtacagatggtgcagcttcagagtgctaagccgaggctggatgactactactaccaagagtattatcagaaacttgaaaagaaacaggccgacgaggagttgctcggcaggagaaacagagtggagtcccttaagttggtgacgccctatatccccaaagccgaagcatatgagagcgtggtaaggatcgaaggttccctgggccaagtagccgtgagcacctgtttttctccacgacgtgctatcgacgcggtcccccatgggactcaggaacaggacatagaagccgcttctagtcagcgcttgagagtgctttataggatcgagaagatgttccttcaactgctggagatcgaggagggatggaagtatcggcccccacctccgtgcttttcagaacaacagagcaaccaggtagagaaactattccagacattgaagacgcaggaacagaataacttggaggaggcagcagatggctttctacaggttctctcggtcaggaagggaaaggcattggtagcgagactgctgcctttcctaccgcaggaccaggctgtcactatacttctcgccatcacgcatcaccttccactgctagtccgccgcgatgtcgccgaccaggccctgcagatgttgttcaagccgctgggcaagtgtatcagtcatctgacactgcatgagctgctacagggcttacaagggcttaccctcctgcccccgggaagtagcgagagacctgtgacagtcgtgctgcagaaccaatttgggatcagcctgctatatgccctcctctcacacggcgagcagctggtctctttgcactcatcactcgaggaaccaaatagcgatcatacagcctggaccgatatggtggtcttgatcgcctgggaaattgcccaaatgcctaccgcctccctggctgagcccctggcatttccatccaacctactgcccttattctgtcaccatgttgacaaacagttagttcagcagcttgaagctaggatggagttcgcttggatctactag

SEQ ID NO: 32331 - DNA, 1632 bp, Artificial Sequence
  Description of Artificial Sequence: Synthetic coding sequence
atgaactgcctagaaggccccggtaagacctgcggcccattagccagcgaggaagaactagtgtcagcttgccagcttgagaaggaagaggagaatgagggcgaagaagaagaagaggaagaggacgaggaggatctggacccagatctggatccggaccttgaggaggaggaaaacgaccttggggaccccgctgttcttggggcggtccacaacacccagcgggctttgctgtcatcacccggcgtgaaggcccccggcatgctcggcatgtccctcgcttcattacactttctgtggcagactctggattacttatcacccattccgttttggccgacattcccttcaacctcctcacctgcacaacactttggtcctagattgccctccccagatcctacattgttctgctccttactgacaagttggccccctcggttctctcacctgactcagctgcacccacggcaccaaaggatacttcagcagcaacagcactcccagaccccctcccccccagcaaaaaaaccatggagccagcagccagacccgtacgccaatctgatgacacgtaaggaaaaggattgggtgatcaaggttcagatggttcagctacagagtgccaaacctcgcctggatgactactattatcaggagtattatcagaagctggaaaaaaaacaggccgatgaggaacttttgggaagaagaaatcgggtagaaagtctaaagctggtcacaccctacatccccaaagcagaggcttatgagtcagtcgtgagaattgagggtagcttaggccaggtggccgtgtccacctgcttttcccccagaagggccattgatgctgtcccccacggtacgcaggagcaagacattgaggcagcaagcagccaaaggctacgggtgctgtatagaatcgaaaagatgtttctacagttactggaaatcgaggagggatggaagtacagacccccccccccttgttttagtgaacaacaatcaaaccaagtggaaaaacttttccagacacttaaaacacaggagcagaacaatctggaagaagccgccgacggatttctgcaagtgttgagcgtccgcaagggtaaagccctggtcgccaggctgttgccgttcttgccacaggatcaagccgtaactattctcttggccatcacccaccatctgcccctcctggtccggagggatgttgcagatcaggctctccagatgctgtttaagcctcttggaaaatgcattagtcacctgactctgcacgagctgctgcaaggcctgcagggtcttaccctgctgccgcccgggagctccgaacgaccagtgactgtggtgcttcaaaaccagttcggaatcagcctgctgtacgctctgttgtcccacggagagcaactcgtttccctacatagcagtctcgaagaacctaattccgaccatacggcatggaccgatatggtggtactaatagcttgggaaattgcacagatgcctactgcgtctctcgcagaacctcttgcatttccctccaacctcctcccccttttctgtcatcacgtcgacaaacaattagtccagcaattggaggctaggatggagtttgcttggatctactag

SEQ ID NO: 32332 - DNA, 6708 bp, Artificial Sequence
  Description of Artificial Sequence: Synthetic coding sequence
atgcctcttttctttagtgcactcctggtgctgttgttggtggctctctccgccctcttcctgggcagatggctcgtggtgagactggctactaaatggtgccaacgcaagctccaagccgaattaaaaatcggatctttcaggttcttctggattcaaaatgtgtccctgaaattccagcagcaccagcagactgtcgagatcgataacctgtggattagctcaaaattgcttagtcacgatctccctcactacgtagccttatgctttggtgaggtgaggattaggacagacctgcagaaagtcagcgacttgagcgcccccttctcgcagtctgccggagtggatcagaaggaactgtcttttagcccatcactgttgaagatcttttgtcaactgttctctatccacgtagatgcaatcaatataatggtgctcaaggtggacacttctgaaagtctgtggcatatccagattagccgctcgaggtttctactcgatagtgacggaaagaggctcatttgtgaggtgtctctgtgcaagatcaattccaaggttttgaaatctggccaactggaagacacctgtctggtggaactgtctctggcgctggatctatgcctgaaggtggggatatcaagccggcacttaacggccatcaccgtggatgtgtggacccttcacgccgagctgcacgagggcctgtttcagtcgcagctgctgtgccaggggcctagtcttgcctctaagcctgtaccatgcagcgaagtgaccgaaaacctggtggagcccaccctgccgggtctgtttctcctgcagcagcttcccgatcaagtcaaagtaaaaatggagaatacgtcggtggtgctgtctatgaatagccagaagaggcatctgacttggaccctgaagctcctacagtttttataccatagagacgaagatcagttacccctgagatccttcacagctaactcagacatggcccagatgagtaccgagctcctgctcgaggatggcctgctgttgagtcagtctagacaacggatcgtgtgtctgaattccctgaaggcaagtgtgcaggtgacgactatcgacctgagcgcatccctcgtcctcaatacctgcatcattcattacagacatcaggaattttcccactggcttcatctcctcgctctcgagacacaaggcagctcgtcaccagtcctgaaacagcgaaaaaaaagaacgtttccacaaatcttggctcccattatattctcaacctccatctcgaatgttaacatcagtatccaacttggcgacaccccccccttcgcattgggcttcaattctatttccctggactatcagcatctcagaccccagtccatccatcaaagaggcgtacttactgtagaccatctctgttggcgggtgggatctgactcacacatccagcgtgctccccatccgcctaatatgcatgtctggggggaggctctagtcctcgactcatttacccttcagggtagctataaccaacctctcggactgtcttccacacagtcagatactctcttcctggattgcactattaggggcttgcaggttgaagcctctgatacctgtgctcagtgcctctcaagaatcttaagcctcatgggccctcagtccggcaagagtgccgtcagtagacattcatccttcggagagagcgtgtcattgttgtggaaagtcgacttaaaggttgaagacatgaacttatttaccctctccgctctcgtaggtgcatctgaggtacgtctggataccctgacaattctgggctctgccgagacgtctactgtcggcatccagggtctggtgctggcactggtgaagtccgtcacggaaaagatgcagccctgctgcaaagcccccgatattcctacaccagtgctcagcctcagcatgttgagcataacttatcacagttccatccgcagtctggaggttcagtgcggagctggactcaccctgctgtggtccccgcctgatcatatgtacctgtatcagcacgtcctcgcaacgctccagtgtagagacctcctgagagccacagtgtttcctgagaccgtcccgtccctcgctttggaaactagtgggacaaccagcgagttggagggtcgtgcaccagaacctttgcctccgaagcgccttctcaatttgacgcttgaggtgagtacggctaagttgacagcctttgttgcagaggataagtttatcactctggccgccgagagtgtgagcctgtcccggcatggcggctccctccaggcctactgtcctgagttagctgctggctttgatggcaacagcattttcaatttcaaggaggtggaggtccaactcctgccagaacttgaagaaatgatcttacatagaaacccatttccggctctccagacactcagaaatcgcgtatggctgcttagctttggctcagtcagcgtggagttcccctatcagtacgacttttctcggacccttgacgaggccgtcggggtacagaagtggttaaagggtctgcatcaaggtacaagggcctgggccagcccatctccggtaccactgcctcccgatctgctgttgaaggtggagcacttcagctgggtgtttctcgacgacgtattcgaagtgaagctgcatgacaattacgaactgatgaaagatgagtcaaaggagtcagcaaagcgtctgcagctgttggacgcaaaagtagctgctctacggaagcagcacggagagctcctacccgcccgaaaaattgaggaactttatgcctccctggaaagaaagaatatcgaaatttacattcagcggtctaggcgcctgtatggaaatacacccatgcgacgggccttactgacctggagtctggccggcctggagctggtcgcccttgccgatgcctcctttcatgggccagagcacgttgtggagcaagtccaggagttagaccccggctccccattcccccccgaaggtttggatctggtgatccagtggtgccgcatgctgaagtgcaatgtaaagtcgttcctcgtacggataagagactatccccgctatttgttcgagatacgcgactggcgactgatgggacggctcgtaggcaccgagcaaagcggtcagccatgctctagacggcggcaaattctgcacctggggctgccttggggcaatgtcgcagtcgaacgaaatatgccccccttaaagttctatcatgactttcattccgagatcttccaatataccgtggtgtggggcccctgttgggaccccgcatggacactgatcggccagtgcgtggatcttttgacaaagcccagtgcagatcctagcccgcccttgccctggtgggataaaagtcgcttgttattccacggcgattggcatatggatatcgaacaagccaatctccaccagcttgctaccgaagatccttataacaccaccgagaatatgcattgggagtggtcccacctgagcttccattggaagcctggacagtttgtgttcaagggagatttagatatcaacgtgagaaccgcttccaaatacgacgactgttgcttcttgcatcttcctgacctttgcatgacactcgatttgcaatggctgtgtcacggaaacccacatgatcaccatagcgtaactctgagagcacccgagtttctgcctgaggttccgttaggacaactgcatgacagctaccgggcatttcgaagtgagaacctgaaccttagcataaaaatggatttaaccagacactctgggactatcagccaacctcggatcctcctgtatagttctaccctgcgctggatgcagaatttttgggcgacttggaccagcgtgacccggcccatctgccggggaaaactgttcaataacctgaaaccaagcaagaagaagctggggcagcattacaagcaactgtcatacaccgcactctttccgcagctccaggtccactattgggcttccttcgcacagcagagagggatccagatagagtgcagccaggggcacgtgttcacacgcgggactcagagactgattcctcaagccggcacggtgatgaggcgcttgatctccgattggagcgtgacacagatggtttccgacctaagccaggttactgttcatctcatggccagcccaactgaggaaaatgccgatcattgcctggatccgttggtgaccaagacccacctgctctcacttagcagcttaacttaccagcggcactccaacagaacagccgaagaggagctctctgcgagagatggtgatcctacctttcatacacatcagctgcacctggtggaccttcggatctcttggacaaccactaaccgagatattgccttcggactgtatgacgggtataagaaggccgctgttctcaagaggaatctctcaacggaagccttaaagggcctgaaaattgatccccagatgccagctaagaagcccaagagaggtgttcctacctctgcgagcgctccacctagagtcaacactccatccttttccggacagcctgacaaggggtcaagcggtggagcttacatgctccaaaaactgattgaggagacagatagattcgtagtcttcacagaggaagagtctgggatgtcagatcagttatgtggcattgccgcgtgccagaccgacgatatttataatagaaactgtttaatagaattggtcaactgccaaatggtcctgaggggcgccgagacggaagggtgcgtgatcgtatcagcagcgaaggctcaactgctgcagtgtcagcaccatcctgcctggtacggggataccctgaaacaaaaaacctcctggacctgcctcctcgacggcatgcagtatttcgccaccaccgagtcctctcctactgaacaggacggccgacagctgtggttggaggtgaaaaatattgaagaacacaggcaacgatcactggattccgtgcaagagctgatggagtccggtcaggccgtcgggggcatggtgactacaactaccgattggaaccagcccgccgaggctcagcaagctcaacaagtccagcggattatttctcgctgcaactgtagaatgtattacatcagttacagtcacgatattgaccctgagttggcaacacaaatcaagcctccggaggtgctggagaaccaagaaaaagaggatctcctgaaaaaacaagagggagccgttgataccttcaccctgatccaccacgagctggaaatctccactaatccagctcagtatgctatgattctggatatcgtaaataatttattgctgcatgtcgaacctaagaggaaggagcatagcgaaaagaagcagagggtgagatttcagttggaaatctccagtaatcctgaagagcagcggagctctatcctgcacctgcaggaggcagtgcggcaacatgttgcccagatacggcagctcgaaaagcagatgtatagtatcatgaagtccctccaggacgattccaagaatgagaatctcctggaccttaaccagaagctccagcttcagctgaaccaggagaaggccaatcttcaactggaaagcgaagagctgaacattcttattcggtgcttcaaagatttccaattacaacgggccaacaagatggaactcagaaagcagcaagaagacgtgtctgttgtgaggcgcaccgagttctattttgcccaggcacggtggcgtttgactgaggaggacggacagctcggtatagctgaattggaattgcagaggttcttgtacagtaaggttaataagtctgacgacacagctgagcaccttctggagctggggtggttcaccatgaataacctgctgccaaacgcagtttataaggtagttctgcgaccacagagttcctgtcagtccggtcggcagctggcactcagattattctccaaagttaggcctcctgttgggggtatttccgtcaaggagcactttgaagtcaacgttgttcctctcaccatacaacttactcatcaattctttcatcgcatgatgggcttcttttttccaggccggtccgtggaggatgatgaggtgggggatgaggaagacaagtcaaaactcgtgaccactgggataccagtggtgaaaccaagacagctcattgccacggacgatgccgtgccactagggcctggaaaaggggtggcccaggggctgactcgttcaagcggagttcgacggagcttccggaaatcccctgaacacccagtggacgacattgataaaatgaaggaacgcgccgccatgaataacagcttcatctatattaaaatcccgcaggtgcctctctgtgtcagttataagggcgagaaaaactcagtggattggggcgatcttaatctagtgttgccttgtcttgaataccataacaatacgtggacttggctggactttgctatggccgtgaagcgtgactcccgtaaggccctggtcgcacaggtgataaaggagaagcttcggctgaagtctgcaaccgggtccgaggtgcgtggcaagctggagaccaaaagcgacctaaatatgcagcagcaggaggaggaggaaaaagccaggttacttatcggactgagcgtaggggacaaaaaccctggcaagaaaagtatctttgggcgaagaaaatag

SEQ ID NO: 32333 - DNA, 417 bp, Artificial Sequence
  Description of Artificial Sequence: Synthetic coding sequence
atggaggcttgggagtcctctcagcctctcttgcggtgcgagatcccttgtccactgcccggaaccgatagggatgggtcagtatctctgcccggagaggccgcgtcctgcgacctcgacacactggaaccggagcacgggaatcggcgtgtttcaggcaatcccatttccgtttgttgggcttacaaagttactaaagtgaaatgctggtccgtgcgcgaacgaggaggcagacacatcgggggacctagaaacacattgaaacatcccgcgcatcacggcatggggaaaaatcttgcaacgtcgctgcccacggcagccagcttaggcttggggaaagggcagctcctggtgagtatcaggtttatggacaccaccaagaaacggggccagtctgagaccttcaacatttgttag

SEQ ID NO: 32334 - DNA, 1203 bp, Artificial Sequence
  Description of Artificial Sequence: Synthetic coding sequence
atgggtgttctgatgagcaaacggcagacagtggaacaggtccagaaggtgagcctggcagtttctgcattcaaggacggattgcgggatcgcccttctatccggagaacaggagaattaccggggagccggcgggggactgttgagggaagcgtgcaggaggtacaggaagaaaaagaggctgaggccggcaccagcgtagtgcaggaggagagtagcgccggaagagcagcttgggagcggctgcgcgacggacgcggcgtggaacccgaggagtttgaccgcacctcaagatttacaccaccagctttcatccggcccacaagaaagctggacgacgataagcccccagagatatgcctggaaccccgggaacccgtggtgaacgacgaaatgtgtgatgtatgcgaagtctggacagctgagagtctgtttccctgcagagtctgtacacgagtgtttcatgatggatgccttcgcagaatgggctatatccagggcgactcggcggccgaggtgacagagatggctcatactgagaccggatggagttgtcactactgcgataatatcaatctgctgctaactgaagaagaaatgtattccttgacggaaacttttcagcggtgtaaagttattccagattgctcacttaccctggaggactttctgcggtatcggcaccaagccgccaaacgcggagatagagaccgcgcacttagcgaggagcaggaggagcaggccgcccgccagttcgctgccctcgatcccgagcaccgggggcacatcgagtggccagactttctgagccacgaaagtctactacttcttcagcagctgcgaccccagaatagccttctccggttgcttacggtcaaggagcgagagagagcccgagctgcattcctggctcggggatccggttcaacggtgagcgaggcagaatgtcggagggctcagcattcttggttttgcaaacggtttcctgaggccccgagttgctccgttagcatcagtcacgtcggcccaattgcagatagtagtcccgctagcagttcttccaaaagccaagataaaaccttgctgccgactgagcaggaatcccgattcgtcgattggcccacgttcctgcaggagaacgtgttatatatcctcgccgctaggcctaactcggcggcaatccacctgaagcccccaggctag

SEQ ID NO: 32335 - DNA, 1230 bp, Artificial Sequence
  Description of Artificial Sequence: Synthetic coding sequence
atgggctctcaggccgccgcggaatggcgaaattgggcgtcctgggaagtgagctctagcttgtcaggatgctcaatgggttgcttcaaagacgatcgaatcgtgttttggacatggatgttctccacctacttcatggagaagtgggcgccccgacaggacgatatgcttttctacgtaaggaggaaactcgcatatagcgggtcagagagtggcgccgatggccgaaaggcggccgaaccggaagttgaagtcgaagtctataggcgcgacagcaaaaaacttcccggattgggggaccctgacatcgactgggaggagagcgtttgccttaatctgatcctgcagaagctagattacatggtcacgtgcgcagtttgtacccgtgccgatgggggggatatccatatacataaaaaaaaatctcagcaagtctttgcatcaccaagcaagcatcccatggactccaagggagaagaatcaaaaatctcatatcctaacattttcttcatgatcgattcattcgaagaggtcttcagcgacatgaccgtcggcgaaggagagatggtttgcgtcgagctagtggcctccgacaagactaatacctttcagggcgtaatcttccagggttcaatccggtatgaagcactgaagaaagtttatgataatcgggtctcagtagccgcaaggatggctcaaaaaatgtctttcggattttacaagtattctaatatggaattcgtgaggatgaaggggccccaaggaaaaggacatgctgagatggcagtgtctcgcgtctccacgggagacacgagcccctgtggtaccgaggaggattcatcccccgcatcccctatgcacgaacgggtgacatcctttagtacacctccaactcccgaacgcaataatagaccggcttttttctcacccagcctgaagaggaaggtgcctcggaatagaatcgccgaaatgaagaagtcccactccgcaaacgattcagaagaattttttcgggaagacgacggtggtgccgacctgcacaatgccaccaatctccggagtagatccctgagtggaaccggcagatctttagtggggtcctggctgaagctgaacagagcagacggcaactttctgctgtatgcccacttgacttacgttaccttgccattgcaccgcattctaactgatattttagaagttaggcagaaacccattttgatgacatag

SEQ ID NO: 32336 - DNA, 333 bp, Artificial Sequence
  Description of Artificial Sequence: Synthetic coding sequence
ggcgcccgcagccccgggtccacccaccagggttccctggcctcaggagtgctcccaatcaagtgtagccacgttgagttcggtatgtggaaaggaggacgcagccatccctttctaccgcacagctcacgttgcgccggctccgggggccagctggatagcatcctaccccatcagtccccagcctggggaccctggggatgcaaggatcttagcagcggctttccatcattcttaacctcctcaatcctgtggaagtctgccgtggttagagaaccccatattagtcctcaccaagctcctccatataagacctcggactgcataatgtag

SEQ ID NO: 32337 - DNA, 3753 bp, Artificial Sequence
  Description of Artificial Sequence: Synthetic coding sequence
atggcagccatggcccctggagggagtggtagtgggggtggtgtgaatccgttcctatctgacagtgacgaggatgatgatgaagtcgccgctaccgaagagagacgggctgttctgagactaggggcgggatcagggctggaccccggaagtgctgggtccttgtctcctcaggatccagttgctcttggcagttccgcccggcccggactgcccggggaagcaagtgccgctgccgtcgcacttggaggcacgggggagacccccgcgcgcttgtctattgacgccattgccgcgcagctattaagagaccaataccttctcacggcgctggagctccacacagagctgcttgagagtggaagagagctgccccgattgagagattacttctctaatcctggtaacttcgagcgccagtccggcactccacctggtatgggggctcctggggttccgggggccgccggagtaggaggagcaggcggccgtgagccctccacggccagcggcggcggacaattgaacagagccggcagtattagtactctggactctctggatttcgcaaggtactctgacgacggaaaccgcgaaactgacgagaaggtggcagtcctagagtttgagttgcgcaaggccaaagaaaccatccaagcgctgcgggccaacctgacaaaagcggctgagcacgaggtgcctctgcaggagcggaagaattacaagtcatcccctgaaatccaggaaccaataaagcccctggagaaaagagcactcaacttcttggttaatgaatttttgcttaaaaacaattataagctgacatctataacattcagcgatgaaaatgacgaccaggacttcgagctctgggatgatgtgggactgaacatcccaaagccacctgacctcttgcagttgtacagagatttcggcaatcatcaggtgaccggaaaagatctagtggatgtggccagcggtgtggaggaagatgaactcgaggccctcactcccattatctctaaccttcccccaacactggaaaccccccagcccgcagaaaactcaatgctcgtgcagaaattggaggacaagatctctctcctcaacagcgagaaatggagcctgatggagcagatcagacggctcaagtccgaaatggatttcctaaagaatgagcatttcgccatcccggctgtgtgtgactctgtgcagccccctctggatcagctgcctcacaaagatagcgaggacagcggccagcacccagatgtgaattcatcagacaaggggaagaataccgacatccacctgtcaatctccgacgaagcagactcaaccatccccaaggaaaacagcccaaactctttcccccgcagagagagagagggcatgcccccaagctccctgtcttcaaaaaagactgtacactttgacaagcctaaccgcaagctgtctcctgcatttcaccaggcattactttctttctgccgcatgtcagccgactctagactcggctatgaggtgagtcgaatcgcggattctgagaaaagtgtgatgctgatgctggggcgatgtctgcctcacattgtgccaaatgtcctgcttgccaaaagggaggagctgatacccctcatcctctgtacagcttgtttgcatcccgaaccaaaggaacgtgatcagctgctccatatccttttcaatctcattaaaagaccagacgacgaacagaggcaaatgattctcacaggatgtgtggcctttgctagacacgtgggacccacgcgcgtcgaagccgaactgctcccccaatgctgggaacagataaatcataaatatcctgagaggcggctactggttgccgagagttgcggcgcccttgcgccatatctgcctaaggagatacgcagttctctcgtgcttagtatgttgcaacagatgctgatggaggacaaggctgatttagtgcgtgaggccgtcattaagtccctggggattatcatgggttacattgatgaccctgacaaataccaccaagggttcgaacttctcctgagtgccctcggggatccgtccgagcgcgtggtgagcgctacccaccaagtattcttgcccgcctacgctgcctggaccacggaattgggaaacctccagtctcacttgatcctgacactactaaacaaaattgagaagctgctgagggagggagaacatgggctcgacgaacataaactccatatgtacctgtccgccctgcagagtctcatccctagcctattcgccctcgttctccaaaatgcgcccttctctagcaaagccaaacttcacggggaggtgcctcagattgaagtgactcgtttccccagacctatgagccccctgcaagatgtatcgacgattatagggtcccgagagcagcttgccgtcctgctgcagctctacgattatcagttagagcaagagggcactaccggctgggaaagcctgctttgggtagttaatcagcttctgccacagctgattgagatcgtcggtaaaattaatgttacctctactgcttgtgtgcacgaattcagtcggttcttttggcgtctctgtagaaccttcggtaaaatcttcacgaacacaaaggtcaaacctcagttccaagagatcctaagactgtcagaggagaacatcgatagcagcgccggcaacggggtcctgacaaaagcgaccgtgcccatctacgcaacaggcgtgttgacatgttacattcaaattaaggaatatctccatatacacaatgagatctcatgggaatgggatccatctctcaataccaagtgtgtcagctacacacattacacccattcactcaaggaagaagatcgaaaactcctggtagggtttctggaagacgtcatgactctcctgtctctctcacacgcccccctcgattctctgaaggcttcatttgtggagttgggcgcaaatcccgcatatcatgagcttctgcttactgtgctttggtatggcgtagtacatacgagtgctttggttaggtgcaccgctgctaggatgttcgaactccttgtgaaaggagttaacgagacgcttgtcgctcagcgagtggtgcctgcactaattaccctctcctccgacccggaaatctccgtacggatagctaccatccccgctttcggcaccattatggagaccgtcatccagcgggaactgctagagcgggtgaaaatgcaattagcctctttcctggaagatccccagtatcaggaccagcattcgcttcataccgaaataatcaaaacttttgggagagtgggtcccaacgccgaacctagattccgtgacgagtttgtcattccccacttgcataaacttgcgttggtcaataaccttcagatcgtagatagcaagcgcctggatatcgcgacccacctgtttgaggcctattccgccctgagttgctgtttcatctctgaggacctcatggttaaccactttctgccagggctacgctgtctgaggacagacatggagcacctcagccccgagcacgaagttatcctcagcagtatgattaaagagtgtgaacagaaagtagagaacaaaaccgttcaagagccccagggaagtatgtcaatcgccgcctcactcgtgtctgaggacacaaagacaaagttcttaaacaaaatgggtcaactgaccacatccggagcaatgttagcaaatgtgttccagagaaaaaagtag

SEQ ID NO: 32338 - DNA, 6054 bp, Artificial Sequence
  Description of Artificial Sequence: Synthetic coding sequence
atgacaagccgcactaagcgtaggcagaaggtgaagatctcaatttcaaagattaatcactctagctataggaaggaacaccgacccttctgggaacaccaaccaccaccacaccagaattgggcagttgggggcagatgtggagcaggcgctcgccctggcctaagtcagcgccgaggacgcgaagtgagaagagaggctcagggaggggcgtccagccggcgtctgagggcacgtttatatttcagcgagtcaaccagtctgcccctggaccgtcggggatctcccggacccctgggccccgctccacatggtctgcgcagggccgcaccacggggcccggcgcgcagaaccccgagatcaaccgcactcacatcgcgaagaagagctcagagaccccgccacggtgacaggctgaggctgcggagcgaggccagacccagggctgccggcgattggccctgcgctagaggtggcgctgtcagacctgggcgccctcatcgcccgccgagagtggagagtgcccgcggtgcacacgcaggacgtgcggccaccgaccaactggagcgggtgttcctccgactaggtcacgccgaaacggatgagcagctccaaaacatcatttctaaatttttgccaccagtgcttctcaaactttctagtactcaagagggcgttcgtaagaaagttatggagctgctcgtgcacctgaataagaggattaaatctcggccgaaaatccagcttcccgtggaaacgctcctagttcagtaccaggatccggccgctgtcagctttgttacaaatttcaccatcatttatgtgaaaatgggttacccgcggctgcccgtggaaaagcagtgcgagcttgcgcccacccttctgactgccatggaggggaagccccagccacagcaggattcactcatgcacctccttattcctaccctattccacatgaaatatcccgtcgagtcctccaaaagtgcatcccccttcaacctcgccgaaaagccaaagaccgtacaacttttgctggacttcatgctggacgtgctcttaatgccgtacggctacgtgctcaacgaatctcagtctcggcagaattctagttctgctcaaggctcaagctctaactcgggcggcgggagcgggatcccccagccgccccccggcatgagcttttacgctgccaaaagggtcatcggcgataacccatggacccccgagcagctggagcagtgtaagttgggcatcgtgaagttcattgaggctgaacaggtcccggagctagaagctgtacttcacttggtaatcgcctcatctgatacccggcactcagtggccaccgctgccgacctggagctgaaatcaaaacaatcactgatagactggaacaatccggctatcattaataaaatgtataaggtgtatcttggcgatatccctctaaaaactaaggaaggcgccgtcctgaaacccgagctgaagcgcgatcccgttagcacccgcgtaaagctgaagatcgtgcctcatcttttacgctccaggcaagctgctgagacattcccagccaatatccaagtggtgtacgatggtctttttggtactaatactaattctaagctcagaacactgtcattgcaatttgtacaccacatctgcattacgtgcccggagatcaagattaaacccttaggacctatgctgctgaatggcttaacaaaactaatcaatgagtacaaggaagaccccaaactgctttcaatggcctacagcgctgtgggaaaactttcgagcagaatgccccatttgtttacaaaagacatcgctcttgtgcagcagttgttcgaggccctgtgcaaggaggaacccgagactagactggctattcaggaggccttgtccatgatggtgggcgcctatagcaccctcgagggcgcacagcggacattgatggaagctttggtggccagttatctgatcaagcccgaggtgcaggtcagacaggtcgccgttaagttcgcctccactgtgttccctagcgaccacatccctagcagatacctcttgctcctagctgccggagacccaagagaggaggtccacggggaggcacagcgagtgctgcggtgcctgcctgggcggaacagaaaggaaagtacatcagaacaaatgccttcttttcctgagatggtgtattacattcaggagaaggccagccaccgcatgaagactccggtcaagtatatgaccggtactacagtactgccattcaacccagcggcttttggggagatagtgctgtacttgcggatgtgtctggcacactccgctggcgtggtgcctacgagccagagcctcgctgatatgcaggaccacgcacctgccatcggacgctatatccgcacactgatgagtagtggtcagatggctccctccagctctaataagtcgggtgagacaaacccggtccaaatctatattggtctgctccagcagctgcttgcaggcgttgggggcctccctgtgatgtactgtctgttggaggctgtgagcgtttatcccgaaaagttagccactaagttcgtcgacaagactgagtggattaagagcctaatgaataatagcaaggaggagatgagggagctggcggccttgttctatagcgtcgtggtcagcaccgtttctggtaacgagttgaaaagcatgattgagcagctgattaaaacgacaaaagacaaccactctcctgagatccagcatggttcactgctggccctggggtttacggtgggccgttacctcgcgaaaaaaaagatgaggatgtccgagcagcaagacctagaacgcaatgccgataccctcccagatcaggaggagctgattcagtcagcaaccgagacgatcggctcttttctggacagcaccagtccactgttggccatcgccgcttgcactgccctgggtgaaattgggaggaatggaccccttccgataccgagcgagggttcaggttttactaaactgcatctggtggaatccctgttgtcccgtattcctagcagcaaagaaacaaataaaatgaaggaaagagctatccagaccctgggctactttccagtcggcgacggagactttccccatcagaagcttctgctgcagggcctgatggactccgttgaagctaaacagatcgagctccaattcaccattggagaggcgataacgagtgctgccatcggaacctcatcagtagccgctcgagacgcttggcagatgactgaggaggagtacacaccgccagctggagcaaaagtgaacgatgttgtgccgtgggtgcttgatgtcatcttgaacaaacatatcatttcccccaatcctcatgtcagacaggcagcatgtatttggctgctgagcttggtgagaaagctgtccacgcataaggaagtcaaaagtcatctgaaggaaattcagtctgcctttgtgagtgtgctgtccgagaatgacgaactcagccaggacgttgcatctaaaggtctcggcctggtgtatgaacttggtaatgaacaggatcaacaggagctcgtgagcacattggtggagaccctgatgactggtaagagagttaaacacgaagtttccggagaaaccgtggtctttcagggaggcgcactgggtaagactccggatggccagggattgagtacttacaaggagctatgctcactggctagcgatttgtcccagcctgacctggtgtacaaatttatgaacctcgctaatcatcatgcaatgtggaatagccggaagggtgccgctttcgggtttaacgtgatcgctacgagggctggcgagcagctcgctccgtttctaccacaactggttccacgcctgtaccgctaccagttcgaccccaatctggggattaggcaggctatgacttctatctggaacgccctggttactgacaagtctatggtcgataaatatctgaaggaaatcttgcaagaccttgtgaagaatctcacttctaacatgtggagagtccgcgagagtagttgcctggcactgaatgacctgctcagaggcaggccattggacgatattattgataaactacccgagatttgggaaactctgtttcgggtgcaagacgacatcaaggagtcagtgcgcaaagcagcagagcttgctctcaaaacgctgtctaaggtttgtgtcaagatgtgtgatccagccaagggagcagcaggtcagcgcacaattgccgcgttactaccatgtctgctggataaaggcatgatgagcaccgtaactgaagttcgtgcgttaagcattaataccttggtaaagatctctaagtctgctggggccatgctgaagccacatgcgcctaaactgatcccggccctcctggagtctctttctgtgctcgagcctcaggtcctgaattatctgagtctgagagccactgaacaggagaaggcagcaatggacagcgcccgcctgagcgcagctaagtccagcccgatgatggaaactattaacatgtgcttgcagtatctcgatgtgagtgtactcggggagttggtgccccgcctgtgtgagctcatccgtagcggggtagggcttgggactaagggcggctgtgcttcggtgatcgtctccctcaccacacagtgtccgcaggatttgaccccttattccggtaagctgatgtccgctttgctgtcagggttgaccgatagaaactcagtaatacagaagtcttgcgcattcgctatgggacacctggttagaaccagtcgcgacagctctactgagaagttacttcagaaacttaacggatggtatatggaaaaggaagagcctatctacaagacctcctgtgccctgaccattcacgctatcggtcgttacagcccagatgtccttaaaaatcatgctaaggaagttctccccctggcgttcttgggaatgcatgaaattgccgatgaagaaaaaagcgaaaaagaggagtgcaacctttggaccgaggtgtggcaggaaaatgttccggggtcttttggtggaattcgcctgtatctgcaggagctcatcacaatcacacaaaaagccttgcagtcgcagtcatggaaaatgaaagcacagggggccattgctatggcctccatagccaagcagacatcaagtttagtgcccccatacctggggatgatcctgactgctctgcttcaaggtctagcaggtcgcacctgggccggaaaggaagagctgctgaaggccatagcctgcgtggtaactgcctgttctgcagagctggaaaagtctgtccctaaccaaccgagcaccaatgagattttacaggctgtactgaaagagtgctccaaagagaacgtgaagtataaaatcgtggccatttcctgcgcagccgacatccttaaggccacaaaggaggacagatttcaagaattcagtaacatcgtgattcctctaatcaagaagaactcacttgagagctccggggtacggacaacaaagaatgaagaggagaacgagaaggaaaaggagcttcagctggagtacctgctgggcgctttcgaatctcttggcaaagcttggccccgaaatgcggagacacaacgatgttacaggcaggagttgtgtaaattgatgtgcgagcggctcaagctgagtacatggaaggtccagctaggtgtgttacagtccatgaatgccttttttcaagggctgatgctcctggaggaggagcatgcggaccccgaggccctcgcagagatcttgctcgaaacatgcaaatcaatcacctacagcctggaaaacaagacttactcatcagtgcgcactgaagcattgagcgtgattgagttgcttcttaagaagctggaagagtccaagcagtgggagtgcctgactagcgagtgcagagtgttgcttattgagtccttagcaaccatggagccggatagtcggccagaactccaggagaaagccgctctgctgaagaagaccttggaaaatctggagtag

SEQ ID NO: 32339 - DNA, 4857 bp, Artificial Sequence
  Description of Artificial Sequence: Synthetic coding sequence
atggatggccagaccttgcggaaggcagaacgatcctggtcatgttctagggaaaagaaggaggggtatgccaaggatatggtcactgacttcgatgagaaacatgatgagtaccttattttattacagcaacgtaacagaattctcaagcaccttaaatctaaggacccggtccaactccgactggaacacctagaacaagggttcagcgtgtatgtcaacggcgcaaatagcgagcttaagtcctcccccagaaaggccatccattccgacttctcccggtctgctagtcacactgaaggaacacacgattatggccggcggacactgtttcgggaggccgaagaggcactcaggcggtcaagtagaaccgccccctcgaaggttcagagacgcggttggcaccagaagagcgtacagatccggaccgaagcaggcccaaggctccatattgaacccccagtggactacagcgacgatttcgagctgtgtggggatgtcactctgcaggcaaataacacttcagaggataggcctcaggaattgcgaagatcactggaactgtccgtgaacctccagagaaaacaaaaggactgcagttctgacgagtatgacagcatcgaggaggatatactatccgagcctgaacccgaggatccagcattagtcggacatccccgacatgaccggcccccgtcgtctggtgactggacacagaaggacgttcacggtgaacaggagacagagggtagatcctcccccggtcctgacacactggtggtattagaatttaatccagccagcaaatcacacaagcgggaacgcaacctgagcgctaaacgcaaagacaacgccgaagttttcgtccccaccaagcccgaacctaacttaaccccgcaagcgcccgcggtgtttcccgaccaggagagaatgtgctccagaccgggcagcagacgcgagagaccacttagcgccacgaggaaaactctttgtgaggcagagtatcccgaggaagatgcaagcgctgtgttacaggcgattcaagtagagaatgccgcactacagcgcgctcttttgtcgcgaaaagccgagcagccagcctctcccctccaggatgccgaggggcctccagcaaagccatggacatcattgctagaggagaaggaggaaaccctggagctgctacccatcaccactgcaaccaccacacaagagcctgctggagccgctggtggcgccagggccattaatcaggctatggaccgcattggcctgctagggtcccgccagcagcagaagttactcaaagtcctgcaggctgtcgaaagcgatagcgcccacttaggacgggtggtgtctcccaccaaggaacaagtttcagataccgaggacaagcagagaatgagggccgacgaaattaaggacgctatctatgtgaccatggagattctctctaattggggtaactcttggtgggtcgggttgacagaggtggagtttttcgatctgaacgataccaagctgtatgtgtcaccacacgacgtggatatcaggaacactgccactcccggcgaactcggtcggctggtaaatcgcaacctggcaggcaagaaagactcgagcccctggacttgtcccttccaccctccgctgcagctgttcttcgtgatccgtaatacccgccagctgggggacttccacctggcaaaaataaaagtgagaaattactggaccgcagacggagacctggacatcggtgccaagaacgttaaactgtatgtgaatagaaatctgatcttcaacggcaagctggacaagggcgatagagaagccccagccgaccattccattctggtggaccagaaaaacgagaaatccgagcagctggaggaagcaatgaatgcacacagtgaagagtccaaggggacccacgaaatggccggagcgagcggcgacaaggagcttggccttggctgtagtccccctgcagagactttggccgatgcaaaactctcctctcagggcaacgtgtccggcaaacgtaaaaactctaccaactgtagaaaagattctctgagtcagttggaagagtacttgcgtctcagcgccgtgcccactagcatgggcgacatgccatctgcccctgcaacgtcccccccagtgaagtgccctccagtccatgaggagccttctctaattcagcagctggagaatctaatgggccgaaaaatctgcgaaccccctggtaagaccccaagttggctgcagccttctcctacaggaaaggataggaagcagggcggccgcaagcccaagcctttgtggttgtcacctgaaaaacccttggcttggaaaggccgactgccctcagatgatgttatcggggagggccctggagagaccgaggcccgcgataaaggcctgcgacacgagccagggtgggggacatcacgcagcgttaatacaaaagagcgacctcagagagctacaaccaaggtccactctgacgattccgacattttcaatcagcctccaaatcgcgagaggcctgcgagtgggcggcgaggctcacgcaaggatgctgggtcctcatctcatggggacgaccaaccggcgtcgcgcgaggatacatggtcttctagaactcctagtaggtcacggtggagatccgagcaggaacacacactgcatgaatcctggtcgtccctctccgccttcgatcggagtcatcgcggacgtatctcgaacactgaactgccgggcgatatcctggacgaactcctccagcagaagtcttctcgccactctgacctgccacctagcaaaaagggagagcagcctggcctttcgcgaggacaggacggctatagcggggagactgatgcagggggtgacttcaagattcccgtccttccctatggccagaggttagtgattgatattaaaagcacctggggcgacagacattacgtagggttgaacggaattgagattttttcttcaaagggggaaccggttcagatttccaatatcaaggctgacccacctgatataaacattctgcccgcatacggtaaggatccgagagtggtgacaaatctgatcgatggtgtgaatcgaactcaggacgacatgcacgtgtggctcgcgccctttacacgcggccgctcacattctataactatcgatttcacacatccctgtcatgtcgcactgattaggatttggaattacaataaatcccgtatacatagtttccgaggcgtgaaagatataacaatgctgctcgacacccagtgtatctttgagggagagatcgctaaagctagcggcacactggccggagccccggagcactttggcgatactatcctatttacgacagatgacgatatcttagaggccatcttctattcagatgagatgtttgatctggatgtcgggagcctggattcattgcaggatgaggaggccatgcggaggccctcaaccgctgatggcgagggggacgagcgaccttttacccaagccgggttgggcgcggacgagaggattcctgagctggagctacctagtagtagccccgtgccacaggtcaccacccccgagccaggtatctatcatggcatttgcctgcagttgaatttcacggcttcttggggtgatctgcattacttaggactcactggcctcgaggtggtaggcaaagagggtcaggccctccccattcacctccatcagatttccgcctcacccagagatctgaatgagttgccagaatactcagatgattctagagctctggataaattgatcgacggcactaatattactatggaggatgagcatatgtggctgatccccttctccccagggcttgaccacgtggtgacaattcgactggaccgggctgaatctatcgctggtttgcgattttggaactataacaaaagcccagaagacacatatcggggcgccaaaatcgtgcacgtgtcactcgacgggctctgcgtctctccaccagaaggttttctaatcagaaaaggtcccggcaattgtcattttgattttgcccaggaaattctcttcgtggattacttacgcgcccagttgctgccccagcccgcccgaagactagatatgcgcagtctcgagtgtgcctccatggactatgaagctccccttatgccctgtggtttcattttccagttccaactgctgacttcctggggagatccttattacattgggttaactgggctggagctgtacgacgaacgcggcgagaaaatccccctttctgaaaacaacatcgccgcattccccgatagcgtcaatagtctggagggagtgggaggtgacgtcagaacaccagataaactcatcgatcaggtgaatgatacgtccgacggacgtcacatgtggctcgcgccaattttacccggcctcgtgaacagagtgtacgtgattttcgacctgcccacaaccgtgagcatgatcaagttatggaactatgcaaagaccccgcataggggtgtcaaggagtttggtctcctggtcgacgacctgctcgtgtataatgggatcctagctatggtgagccacctggtgggcggaatcttgccgacttgtgaacccaccgttccgtatcacacgatccttttcacagaggatagggatattagacaccaagagaaacacactactatatcaaaccaggcggaagatcaggatgtgcagatgatgaacgagaatcagatcattacaaacgcgaaacggaagcaatcggtggtggatcctgctctgcggcctaagacttgtatttccgagaaggagactcgccgacggcggtgctag

SEQ ID NO: 32340 - DNA, 3354 bp, Artificial Sequence
  Description of Artificial Sequence: Synthetic coding sequence
atgctcgccggtcggccagggaccagaagcgccgtgggagagctgggcaccgagtctagcgataatttggatcgcgccccactaggacctagggaatcgggaggccaccaccgccccggctcatacctggatatgaagatccaccttgagaaaaatctggaagaggaacgccaaatcctgctgcagcagcagaaaatctgtaggaaccgcgcacgaaaatattttgtggaatccaacagacgcaaaaaggcattcgaggagaaaagaaaagagcaggaggagaaggaacaccagatccgcgaacaaatactgcagcaacgcaagcaaaagttcgaggaagtgacagagaaattccagagggcgcacgtgcctctatcccagcgaaggaaggctgtatcccgcaagcctgtgccaccactggaggaggctctcaaacaaatacaggagagcaatctgaaatccgaggtcaacctccccttcagcagaaggccgactataaactggagggccatagatagtgcactgcccagcgctctgtccaagaatgaccataaacaccagaagcagctcttgtccaaaataaattgcgaaaaagaaatgaacgaaaatatgcgcgcaacactggcaactagcaaaaacgtgtttcagctgaaacttgaggaaacgcagaagttactggaggaccagcatttgtccaacttacagaagttcggagatgaggtgaaccaaatcactaactctgagacactgtccagtatcgattccttagaggcaacagaacacgaagaaatttacctgactcttaacaaagagcactcaacaagtatccaacgaaacactatctcgttgaaaccagcaaatatgcagagtaccaacctcagctgtttcgacgaggataaactggcattctcaaagactcaacacataaacaattggttaacaaacctcgacgccagtaacacccagaatgtgaccgccttctccgatatcctgtccaaatctaacgttttgccttcctgggagtatttcaacagcaaagagcagaacccctctccattaaacggtacagttgagagagccaccaacacggctaacaactccgtcccattcgtatctagcccgcccatgtttgtcctggataagaagtgcgagaagactagcgagaccagcactatgcgtacaacagacagcacgagcggcgcctttaaaagagagcgccccctggtcactgaatctccaacatttaaatttagtaagagtcagagtacaagcgactccctcacacaggaggtcgcgacattcccggaccaggagaaatacagcgaattgaaccaagagaacgggacaacctctattcctacatcatgtgtcccagtagccacccctctcgtcctgcccagcaacatccaatcagcccgcccaagcgccaaaaattccattcacattaaggagattgacgccgtgcagtgtagtgataaattggacgagctaaaggacgggaaagaggaagagatcaagtactttaactgtaataaagaggaactccctctcttcagcgattcttttcaggatgcttatatcccccacaatcccgacagtaaggatgagaagcaaaagctggctgaaacaagtagcctgtccaatgtcactagcaactatgactttgttgggcaacacaagaaaatgaagtacaatatccacgaaaggaacggagtgagatttctcaaatctatcctcaagaaagaatcaaaatatgagcatggctacctcaaagcccttataattaaccagtcctttaagttcgggaatcagaaagcagcggctattagagattctatcgaattgacaaaggagaaaggggcggagattcccaaaaccatcaagaagttgcgttggtttgacgaaaccagtaatattgagaacaatgccgagaacagtcactctctgaaaaataaaacaggcacaactcagcagcactcacagcagtttcacatccaatcaggcgccggatctaatataatcagcgtgtccacctgcgcagtcaacagcgccgatacaaaaaagtccagggaggactcaattagcgaaaacgtcacaacattgggaggttctggagcagaccacatgcccctcaattgctttatcccaagtggttacaactttgcaaagcacgcttggcctgcttctaagaaagaagagagcaaaatcccggtccacgacgactccaagaccaaacaagggaagccacaaaggggcagggccaagattatcaggaagccgggatccgcaaaggtgcagtctggtttcatatgcacaaataggaagggtgcggtcattcaaccccagtctgcatccaaagtgaacatttttactcaggcacaggggaaactgatcatcccctgtccccctcctcagtccacctctaatatccgctctggtaagaatatccaggtgtcacagtgccaaccagtaactcctgaaaacccccagaatattatcacacataattcatttaatagcaaacatgttctgcctaccgaacactctctgaaccagtggaatcaggaaagcagcagtcctctgtccaatgcctgtagcgatttggtcaccgtcatcccctcgctccccagttattgctcgagcgagtgccagaccttcgccaagatcaaccactcgaacggtactcaggccgttgcaagacaagatgcaactctctactgtacccagcgatcgccggtgtgcgaggagtcttacccttctgttactttgcgaaccgccgaggaagaatctgttcccctgtggaagagagggccgaacgttctgcaccagaataaacgagccaccggttctaccgtcatgaggagaaagcggattgccgaaactaaaaggcgaaatatcttggagcagaagcgacagaaccccgggagtgttggccagaaatactcagagcagatcaataactttgggcagtctgtgttgctttctagctcagagcctaagcagaccacgcggggcacaagttatatcgaggaggtgagtgactcaaccagcgagtttttgatggccgagaacctggttaaggcgtcagtgccggaagatgagattctgacggttctgaattctaaacagattcaaaagtccaatctccctctcaataagacacaacaattcaatatttgtacgctttccgccgaggaacaaaaaattctggagtctcttaacgatctctcagagcgactgcactacatccaggaatccatctgcaaaaatccatcaattaaaaacactttgcagatcattcccctgctggaaaagcgtgaagacagaaccagctcctgcagagataaacgctag

SEQ ID NO: 32341 - DNA, 2571 bp, Artificial Sequence
  Description of Artificial Sequence: Synthetic coding sequence
atgggaaccactgcttcaaccgctcagcagacagttagcgccggtactccctttgagggacttcaggggtccgggaccatggattccaggcacagtgtgtctatccacagctttcaatccacttctttacataactctaaggccaagtctatcatacctaataaagttgcaccggtggtcattacctataactgcaaagaggaattccagattcatgatgagctgcttaaagctcactacacattgggacgtctctccgacaacacacccgaacactaccttgttcagggccggtacttcctggtgagagacgtgaccgagaagatggatgtactaggcaccgtgggtagttgcggcgcccccaacttcagacaggtgcagggggggcttactgtctttggcatgggccaacctagtctatccggctttcggcgggtattacaaaagctgcagaaagatggacaccgggaatgcgtgatattctgcgtgcgggaggaacctgtgctgttcctccgggcggatgaggatttcgtgagttacactcctcgagacaaacagaatctgcacgaaaaccttcagggtctgggtccgggtgtgagggtcgagtcgttggagctggctattaggaaagaaatccatgacttcgctcagttgtctgaaaatacctatcacgtgtatcataacacggaagatctatggggggagccccacgccgtcgcaattcacggcgaagatgacctgcacgtcactgaggaagtgtataaacgacctttattcctgcagcctacctacaggtaccatcggttgccgctgccagagcaggggtcccctctggaagcacaacttgatgccttcgtgtctgtgctgcgggaaacccctagtttactccagctccgggatgcccacgggccccctcccgctctcgtattttcatgccagatgggcgtgggtcgcacgaatctgggcatggtactgggtacgctgattctgctgcatcggtctggaacaacctcccagccagaagccgcccccacgcaagccaaaccacttcctatggagcaattccaggtgatccagagctttcttaggatggttccccagggccggagaatggtcgaagaggtggaccgtgccatcactgcatgcgcagagcttcatgacctgaaggaggtcgttctggaaaatcaaaagaaactggaaggcattcgccctgaatcccccgcacaggggagtggctcccggcactccgtgtggcagagggccctgtggtctctcgagaggtacttttaccttatccttttcaattactatctgcatgaacagtacccactggcgttcgctctttcgttctcacgatggctttgcgcacaccccgaactctatcgactgccggttaccttaagttctgccggtcctgttgccccccgggaccttattgcaaggggctctcttagggaggatgacttggtctcaccagatgctctgagtacagtccgcgagatggatgtagctaacttcagacgcgtgcccagaatgccaatctacgggactgctcaacctagcgccaaggccctgggtagtatccttgcatatctgacggacgcaaagagacgcctgcggaaggtggtctgggttagccttagggaagaggctgtgctggaatgcgacggacatacctactccttgcgctggccagggcctccagtagctcctgaccagctggagactctcgaggcccaactgaaagcccatctatccgagcctcctccaggtaaagaagggccgctcacttaccgattccagacctgtctgactatgcaggaagtgttctcacagcaccgacgcgcttgcccaggactgacctatcacaggataccaatgcctgatttctgtgctccgagagaagaagattttgatcagcttttagaagccctcagggcggccctgagcaaggatcccggtacaggctttgtgttttcgtgtttgtccggacagggaagaacaactactgcaatggtggtcgcagtcctggccttttggcatatccagggattccccgaagtgggagaggaggagctggtctccgtccccgatgcaaagtttaccaaaggcgagtttcaggttgtgatgaaagtcgtgcagctgctgccagatgggcaccgtgttaaaaaggaggttgatgcggccctggataccgtgtccgaaacaatgaccccgatgcattatcacttgagagagatcattatctgcacatatcgacaggcgaaagccgccaaagaggcccaggaaatgcggcgactacagctgagaagtctccagtatttggaacggtacgtgtgcctaatcttattcaatgcctatctgcatctcgaaaaagcagacagctggcagcgccctttttctacctggatgcaggaagtggcctccaaggctggtatctatgagatcctgaatgagttaggcttccctgagttagaatccggtgaggaccagcccttcagtcgtttaagatatcggtggcaggaacagtcatgctccctcgagcctagcgcgccagaggatctgctctag

SEQ ID NO: 32342 - DNA, 1230 bp, Artificial Sequence
  Description of Artificial Sequence: Synthetic coding sequence
atgtcattacacgcgtgggagtgggaagaagacccagcatccatagagccgatctcctctatcacatctttctatcaatccacctcagaatgcgacgtggaggaacaccttaaggctaaggcgcgcgctcaggaatcagactcagatcgcccttgttcctctatcgagtcatcctctgagcctgccagtactttctcttccgatgttccgcatgtggttccttgcaagttcacaataagcctggcctttccggtgaatatgggacaaaaaggaaaatacgccagtcttatcgagaagtacaagaagcatcccaaaactgacagctctgtcactaaaatgagacggttctatcatatcgaatatttcctcttgcctgacgatgaagagcccaagaaggtggatattctcctgttccctatggtggccaaagtgttcctggaatccggggtcaagacagtgaaaccctggcatgaaggagataaggcctgggtgtcatgggagcaaaccttcaacattacagtgacaaaagagctactgaagaagatcaattttcacaagataacccttcggctgtggaatactaaggataagatgtcaaggaaggtccgctattaccgcctgaagactgctggtttcactgacgatgtgggggcttttcataagagcgaagtgaggcatctcgtgctgaaccagaggaaactgagcgagcagggcattgaaaacacaaacattgttcgggaggagtccaatcaagaacatccgccaggcaaacaggagaaaacggagaagcaccccaagagcctgcagggcagtcatcaggccgagcccgagacaagcagtaagaatagtgaagaatatgagaaaagtttgaaaatggacgattcatcaactatccagtggagcgtaagcaggaccccaaccatcagtctggctggagcttcaatgatggaaataaaggagctaatcgaaagtgaatcattatcaagtctgaccaatatactggatcgccagcggagtcaaattaaaggcaaagacagcgaaggccgaagaaagattcagcggcgacataagaagccccttgccgaggaggaagccgatcccactcttaccggtccacgcaagcaatcagcctttagtattcagcttgctgtgatgcccctgctcgccgggacccattgcttgccttgttcgcagcaactgcttttggtgctgtggccggagagaccctag

SEQ ID NO: 32343 - DNA, 3603 bp, Artificial Sequence
  Description of Artificial Sequence: Synthetic coding sequence
atggacccaccatccttggacacggctatccagcatgctctcgcaggattgtaccctccatttgaagccacagcacctactgtcctaggtcaggtctttcgcctcctagattcagggtttcaaggggatggtctgtcttttcttctcgattttctcatccccgcaaagaggttgtgcgaacaagttcgggaagctgcctgcgcgccatacagccactgtttatttctccacgagggctggccgctgtgccttcgagacgaagtggtcgtgcacctggcgcccttaaaccctctgttactgaggcaaggggatttctacctccaagtcgaaccacaggaggagcaatccgtctgtatcatgataaaatgcctgagtctggatctctgcacggtggacaagaaacccgttccagagcctgcctatcctatattatttacgcaagagtggctggaggccattaactctgatttcgagggcaacccactgcacaattgcctggtcgcctcggaaaatggcatagctccagtgccttggaccaagattacatctcctgaattcgtcgatgaccgacctcaggtagtgaacgccctatgccaggcgtggggccccttaccacttgaggctctggacctcagttctccccaggagctgcatcaagcttcctcccccgacaatcaggtgttgcctgcgcagtctctggccaagggcaagggcagaacctatggatcgaaatacccaggtctaatcaaggtggagcaggccagatgtggtgaagtcgcctttcgaatggatgaagtagtcagccaggattttgaaggtgattacgtggctctgctggggttttctcaggagtcccggggagagagcccctcaagagaggccggaacgtcttcaggctgcacttccggcgcactggaggagattgccgggaccaaagaaactcccttattccagaagattctcccgctttctgaagcaaatgagggacctagccttgggaatcgcgcctgtaccaaaccagaatctagcgaggaacgaccctataatcttggattcagacggaaagtaaatcttaaggctccaactcacaactctgagagacctcctcagggaagttacatgaatgtgctagaggacgccttagactgtgcctccggcttgcgtgccggggttagtcaggaaccagctgcctcaaagatgcaggggccattgggtaacccagagaacatggtacagttaagacccggcccaagacaagcctccagtccacgcttatcccccgctagccccgccgctgctgcgtccgaaaccaagatagaagtcaagacaaaggaacgtaacggcaggttgcccaaaccgatgccgtgcccaagtagaaacaccagcagccccgagccacctactcctgggctgaagttttccttcctccgcggccagcggcagccatccgtcactcctgagaaggcgtccctgcagcataacggcccatggaaggttctttgttctctgtattcacctaaacctaatcgggccaaaagcctggggaaggcgggaactacacaaaccaagacttcgggtccggccaccgccccgtcacctttgactgaagagaaagccgcgcttccagaagcatccgccgggagcccagaaaggggtccaaccttggaagaagagccacccggacccgaacccagaattggcgccctgggggttaaggtgttcagaagtagaatcgcctgccttccaggcggtagggacagggccgggagacccctacttctggtgtccaccactgagggggcatgggaagccccctggtgcacggtgtccgaagttacaaaactcctatcatacttgtgcaccatcccaagaccagaagacaaagcgaagggtctcgccgtgctgatcgacgcgaggcgacaaccgccgcagccgggactcgtttccgcattacaggccacccaggctcaggtacccgcatccattcgagcgatcctgtttctcggcgagaaggaggcagccctgcagctgcagaccctgcccgacgtgcaggtggaagtccttacgtcattaaaagctctgtcacatcacgttgatccttcccagctgccggctgttcttgaaggtcccttcccatattgccataccgaatgggtgcattttttccaaaagctagacccatttctcgccgacctccaccaggcaagtagccttctgcaagcatcaatcgaggagtttgagaaagccgatccacctggtgggatgcaggaagccacccgatgcctctcaaaatccaaggaactcatggaagcggttctgcgagatcctggcctgctcggactgcagagggagggcggagcaacactagctcgcctgcagcatgatgcttcccgcctcgatttttctccggacgtgcgttcacacctcgctgcagccaccgcactttactctttggtcgacgagcaactccacgtactggtgacggcctccaacagtcttctggggaaactggaactgcgcgtccgcttgggccgtctggaggcagctattcatcaggtctccgattggatggagcaagaagggaggcgctgccttcaaagtctgacaccgaaagacggatcacttgaaaccgttgaaaaggcgcacgccgaatttgagaacttcttcctgcaggccgctgctcaatacaggaggggccttgaactttctaagcaggccgctcagttgggcgctaccgctagaggtgcgggcgaggccgagagagcagaattcccagagctggcggccttcgcaagcactcagcgtgcctttcaggcggaattgacccatttctacatggccgcagagcgacagagaactgatctcgagacattgctgcacttgcatcgtttttgcaagagaatgacctggtttcatatggactgccaagatctgatggcccaacttaggctggataaaacgtcacgggtttcgcctggcgaccagaggcgactgcaccgttacctccagagactagcctccgagtttccagctgagaagctggctgcggtcggtctgcaggtggcctcactgagcagggccggactaggacaggaactgtgggaggaggcaagaattagacatgaggaaattcgcatgttactggagaaagcattgacacactcatcttgtcccgaggcccctgccgcccattctgcgcgccccgaacggcggggtgtggcagccaaaggacagggagtgtccgtcgaagtaaccagcaagggccgttgggatcagccgcctctggatagccttggcatggatcacttaccgaagtcatactggccccccgggccaccacgcggggagcagaaccgaacctttcaggcgggctcacctcctcaagaagccgggcaagctgccgaagcagaagatggcaaaggatcccacaagcttcctgacccggcccgggagcatttgctggcgacgacattctttagacagcagcctccccgccagagccaggtaccaaggctcactgggggatctttctctagtgaagggaccgactctcagacatcccttgaggactcgccccagacatccccactcgccagcctttag

SEQ ID NO: 32344 - DNA, 1734 bp, Artificial Sequence
  Description of Artificial Sequence: Synthetic coding sequence
atggcagacgtggccggcccaagtcgcccctcagccgccgcgttctggagccgggacttcagcgacgaggagcagagcgtcgtgtatgttccaggaatctccgccgaggggaatgtgaggagtaggcataaactgatgtcccctaaagcagatgttaagttaaagaccagccgcgttacagacgcctctatctccatggagtccttgaaaggaactggcgattcagttgacgagcaaaattcctgccgcggagagatcaagagcgctagtcttaaagacctttgcctggaggacaagcggcgcattgccaacctgatcaaagagttggcacgggtgagtgaggagaaggaagtgaccgaggaaagactgaaggctgagcaggagtcatttgaaaaaaaaattcgccaactcgaggagcagaatgaactcataattaaggagagggaagcgctgcagctgcagtacagggagtgtcaggagcttctaagtttatatcagaagtatctgagcgagcagcaggagaagcttactatgtccctgagtgagctgggggccgcgagaatgcaggaacagcaagtgtcctcccggaaaagcaccctgcagtgtagtagtgtggagctagacggatcttatctctcaattgctcggccgcagacctattatcagaccaagcagagaccgaagagtgcagtccaagatagcgcctcggagagtctgattgcttttcgaaacaactctctgaaacctgttacactgcatcaccctaaggacgacctggataaaataccatccgagaccaccacgtgtaattgcgagagccctggccgcaagcccgcggtacctactgaaaaaatgcctcaagaggaattacacatgaaggagtgtcctcatctgaagccaacccctagccagtgctgcggccacaggctggctgccgatagagtgcatgatagccatcctacaaacatgactccgcagcatcccaaaacccatcctgagagttgcagttactgccgcctgtcttgggcctccctcgtgcatggcggtggcgcgttgcagcccatcgaaacactgaaaaagcagatatcagaagatagaaagcagcagctgatgctccaaaaaatggagcttgagattgaaaaagagagactgcagcacttgctggcgcaacaggaaacaaagctgcttctgaagcagcaacaactgcatcagtccaggttagattataactgcctgttaaaaagcaattgtgatggatggctgttggggacaagcagcagcatcaagaagcaccaggacccccccaactccggcgaaaatcgaaaggagcgaaagaccgtggggtttcactctcacatgaaggatgacgctcagtggtcatgtcagaagaaggatacatgtcgccctcagagaggaaccgtgacaggcgtacgcaaagacgccagtaccagccccatgcccacaggttctcttaaggactttgtaaccacagccagcccctccctgcagcatacaaccagccgatatgaaacatcccttcttgacctcgtccagagtctctctcctaactccgccccaaagccgcaacggtatccttctcgggaagcaggagcctggaatcatgggacctttaggttatcccccctgaagtccactcgcaagaaaatgggcatgcaccgaaccccagaggagcttgaggaaaatcagattttggaagacatcttcttcatttag

SEQ ID NO: 32345 - DNA, 1416 bp, Artificial Sequence
  Description of Artificial Sequence: Synthetic coding sequence
atggtcctggactctggagcacaggcgtacgaccaagctccacctagccctcctacctctcccccatctcttcggcatcgtctcaagccgtctgaccgggacggtcctcccctttatccatggagtcagtcactcgccttgcccttagctctggctgtgccccctgcccttcagccccagccggagcagcaaccctttagtcagatgctgctcggacaccgtggacacatgagacgctccgaaagcacgtatagcgtgaattcaacgggtcgccgtggccggggcactttgggacgcccccctccaggccgcggtaggaacccaggcggcgggactttgcgccccgctgcctccctgccccacattgctaagacgcagagagatgcagggcatatcgcctctaagagcccctgtatgctggtcgccctcagaccaactaacatggacagagaaagagataagtttttccagtcacattacacctacaatccacagttcgagtatcaagagcccatgccaacggctgtcttggagaagtactgtgaggcttcaggacagttcatacaccaggcggttgggatcattgaagcggtgctggagaagtttgggacctacgagcatttcgaggcagcaacgggtggtcagctcctgaccaagtgccagatttggagcatagtgcggaagtacatgcagaaagaggggtgtgctggagaggttgtggtgcagctgagcgaggacctgttatcccaggccgtgatgatggtcgagaatagccgccccacgttggccattaacctcacaggggctcggcagtattggctcgagggcatgctgaggcatgagattggcacccactatttgaggggcgtcaataacgcccgacagccctggcacaacgcagaaggacgtctgagatatggcctgcgtccggctaatccaacggaagaagggctggctagcctgcattccgtgctgtttcgtaaacagccatttctttggcgggcagctctcctgtattatactatccacagagcagctaggatgtccttccgtcagttatttcaggatctggaacgttatgtccaagacgcggacgttcggtgggagtactgcgtccgggcgaaaagggggcaaaccgatacttcactgcctggatgcttcagcaaagaccaggtctatctagacggcatagtgcgcatcctgcgccatcgacagaccatcgacttccccctgctgacttcactgggaaaggtgagctatgaggatgttgatcacctgagacctcatggcgtgcttgataacacacgagtacctcactttatgcaggatcttgccagataccggcagcaactggaacacataatggctaccaaccgcctggatgaagcggagttgggaaggctgctgcccgattag

SEQ ID NO: 32346 - DNA, 432 bp, Artificial Sequence
  Description of Artificial Sequence: Synthetic coding sequence
atggtcgtctttgttggaagacgcttgcctgccctgctcgggctgtttaagaaaaagggcagtgccaaagccgaaaatgataagcaccttagcgttgggcccggccaggggcccggatcagccgtggacgaacaccaggataacgtgttttttccatcaggaagaccccctcatcttgaggaactacacacgcaagcccaggaggggttacggtccctacagcaccaagagaagcagaagcttaacaagggtggttgggaccacggcgacacacagtccatccaatccagtcgcacgggcccagacgaggataatatatccttttgttctcaaacaactagttacgtggcagagtcatctacagctgaagatgcgttatccatcaggtctgagatgattcaacgtaaggattcacagaaggagctcgcttag

SEQ ID NO: 32347 - DNA, 2124 bp, Artificial Sequence
  Description of Artificial Sequence: Synthetic coding sequence
atgtccagggggtactcggagaataataacttcctcaacaataacaaccagatggtgttggatatgatcctgtatccgttgattggcatcccacagacaattaactgggagaccatagccaggctcgttccgggactgacccccaaggagtgcgctaaacgcttcgatgaacttaagagctcaggctccagtccagtggataaccagtataattcactgatggctgccggcgagagtcctgtcgagacgctcgcaacttacattaagtcatcactcctcgatatacacggggaatttcaagagaccccggtcggccacgacgctgtgtcgaagacaggacgccacagtatcgcctctacacggaattgctcttcagaatccgagaactgcactactcataatggcggcgagatgaccgaggaatctgaggggcctaacatggtgatccacgtgtgcgacgaggctaagaacctgaaggaggatttcacatgccctagggatctgctgatatcagaaatgaagtacttcgcggaatacttaagcatggacgcgcagcgatgggaagaggttgacatatctgtgcactgcgacgtccacatttttaactggctcatcaaatatatcaagagaaataccaaagaaaataaggattgtgaaatgcctaccttggagcctggaaacgtgatttctatcctgatctcctctgagttcctcaagatggatagtctggtggagcagtgcattcaatactgtcacaagaacatgaatgcaattgtggctaccccttgtaacatgaactgcattaatgcgaatttgttaacgaggatcgctgatctgttctcccataacgaggtcgacgatttgaaagataagaaagacaagtttaagtccaagctgttttgcaagaaaatcgagaggctattcgatcccgagtacctgaaccccgacagtcggtccaacgcagctacattatacaggtgctgcctgtgcaagaagctcctgactaaagagacagagaggcgcattccatgtattccaggcaaaatcaacgtcgaccgccgtggaaatatcgtgtatatacacatccgggacaaaacgtgggacgttcacgagtacctaaattccctgttcgaggaacttaaatcctggagggacgtgtactggcggctttgggggaccattaactggctaacttgtagcagatgctaccaggcttttctttgcattgagttctcgcactgccagtaccattctgagaccgtagtttacccaaccgccgcctccagcctgaataccgttggcacgggaatctatccttgctgcaatcaaaaagtgttgcggttcgatcctacccaactcacaaagggctgtaaagttagagaccacatggtcactctgagggaccagggggagggcggtgacctgcccagttgtccaactgctaggatgttagacgaccttcacaagtatcgcgatgtgattgtcgtcccattctccaaggatacagtatctgacgtgggtgtagggctttgtgatgagaaagggatcgaatgtgacgtcttgctagaaccgaataccccttggggaccaaagactggagagctgaacgcgtttctgtcccttaagaactggacactccaactgaaacagcaatccctcttctcagaggaggaggaatataccactggtagtgaggtgaccgaagacgaggtcggggacgaggaggaggtctcaaagaaacagcggaaaaaagagaagcctaagaaatttacaagacagccaaagaagcaagtatctagtccttgcgctcaaaggaaggaaaaggcccttgagaagtcagctagccgggatgtctccccattcgtgatgtcgatgcagaagaacaaatgggatgctacacgcagcttgcgctttaaccaggacgcccagagagaagatgaccagaggagaatgaccgaaattactggacacctgatcaagatgaggctgggagacctggaccgcgtaaagtctaaagaagctaaagagactgacaagctccgaccacgagatggtactgtgtctaagagcaacaggaagagcggtctgtcttcagtcttactcatgacggtgctcctgtgctag

SEQ ID NO: 32348 - DNA, 2811 bp, Artificial Sequence
  Description of Artificial Sequence: Synthetic coding sequence
atgctcttagccccacaaggtaggtccttcagtaaaaagcggatgggacttaacaggtggaagcggtttaccaggaaacctagtcctaaaccaactttcggtccagactccgtagagcattggataaagagagtcgagaaagctagcgagttcgcagtgtcgaatgcattctttacccgaaattcagatttgccaaggagtccctgggggcagataacggacctgaagacctccgaacagattgaagaccacgacgaaatttacgccgaagcacaagaacttgttaatgactggctggacaccaaactgaaacaggagctggccagtgaggaggaaggtgatgcgaagaacactgtctcaagcgtcacgataatgccagaggccaatggtcatctgaaatacgacaaattcgacgatctctgtggttacttagaagaagaggaggagtcaaccactgtgcagaaatttattgaccaccttctccataagaacgttgtggactcagctatgatggaggatctaggcaggaaagagaaccaagacaagaagcagcaaaaggacccacgtctgactatggaaatgcgccacaaacaggtgaaggagaaccggcttcggcgcgagaaggaactggagtatcaaagaatagagaagactttgaagaagagtgcgttcctcgaggcacagtgtctggtacaggaggagaagaaaagaaaggcactggaggctaagaaagaagaagaggaaattcagcgggagatggttaaactgaggcgcgagatcattgaacgccgccggaccgttaaggcagcctggaaaatcgagaagaaacgtcaggaagaaaactcgcagaacagctccgaaaaggtgatgttccaatctacacatatactgcccgacgaggaaaagatggtcaaagaacggaaacggaaactgaaagaagtcctgattcagacattcaaagaaaaccaacagtgtcagaagagatattttgccgcatggcataagctgatcttggatcaccgcatcaaattgggaaaagcaggtactctatcagactggaagatacaattgaaagttttgcgggcctggcgcgattatacccggttccaaaagctggaacgggagacccaggcactggaaaatgaccttagagaagagaacagaaagcagcagctggccaccgagtataataggaagcaggtgttgcgacattgtttcacagagtggcaacattggcatggggcggaactgttgaagagagagcttgccctcacaaaggaggaaacgcggaagaaaatggatgccttgctgcaggccgcatcgctgggtaagctcagtgccaatggactcagcggaatctcactccctgaggaggctaccgcgatggtgggacctccagtgaaaaatgggcaagaaaccgctgttccgcctttatgggaaaagcctccgctgggctcatctggatgcatgttgtcacctccactgggcagaaccacaaccggaaatctccaaggaagcttgcagaacgtgtctctatctgcccccggaaacaagcagcataagactctgggagctgagccgagtcaacaacccggttctaacgagacgctgaggacaaccagtcagaaagctgagccactctgcctggggcatttccacaacaggcatgtgtttcagcagcagctaattgagaaacagaaaaagaaattgcaggagcaacagaagaccattttagagcttaagaaaaatctccagcttgctgaggcccagtgggccgctgagcacgctctggctgttacagaggcgcagtcacatctgctgagtaagccacgggaggaagaaccgcggacctgtcaaatgctggtgaactctccagttgccagccccggcacggagggcagatctgactcaaggaacagtttgagtggtcttcggcgaaaaccaaagcagctgatgactccacatccaattctgaaggccatggaggagcgggcaattcaacgggcagaatgtcgccgcatcctggccgagaaaaaaaagaagcaggaggaggagaaattagcgcagctgaaggcccaagaagaagagcggcaaaaacgagaagctgaagagaaggaggcccagcttgaaaggaagcgcgaagagaagaggctcaagaaaatgaaggagctagagaagcagaagcggatcaagcggaatcagcagctggaagccattgctaaggaacactatgaaagagtgttactgcgaaaaaaaggtctagaaccatggaaacgcctgaggatgcagtcgaaacaaaacatccaggtggcagaggagcattacagcctgtttctgcagagaaaatatatgctgacatggttccaaagatcccaggagtctctggctcgtaaaatggcccaagccgaccagttttatagccagattctcctcaagcgcgtgatccagtcctggctccagtatgtgattgacttacaggaggaggtgcgcaaattctgcgtgcacttcttgcagaaaaagatctttcgcgcatggtttaatatggtaagggaagtcaaaatcgatagtcagggcaagcatgagatcgctgcagaacatagtgatcggcgaattctgtggatcacccttcgaacatggaaaaaattcgtgaagttcatgaaggaggagcgggtgaaggaggaaagacggcagcagctccgtcgtaaggttgtggaaatacttcccgactttcaagtccccggccgataccatgagttgtaccagcagagcgacacctggtcattgtccaaaacatccttggttaacgagtag

SEQ ID NO: 32349 - DNA, 465 bp, Artificial Sequence
  Description of Artificial Sequence: Synthetic coding sequence
atgagcaaacggaatcaggtatcatatgtgcggcccgccgagccagcctttcttgccaggttcaaagagcgagttggttacagagagggtcctaccgtggaaactaaaagaatacaaccacagccgcctgatgaggacggagaccattctgataaggaggatgaacagccgcaggttgtggttctcaagaaaggtgatttgagcgtggaagaagtcatgaagatcaaagccgagatcaaggcggcaaaggcggatgaggaacccaccccagccgacggccggatcatttaccgaaaaccagtgaagcacccatccgacgaaaagtactccggcctgaccgcttcctccaaaaaaaaaaaaccaaacgaggacgaggtgaatcaagattctgtgaagaagaattcccagaagcagattaagaacagctctttgcttagcttcgataacgaagacgagaacgaatag

SEQ ID NO: 32350 - DNA, 495 bp, Artificial Sequence
  Description of Artificial Sequence: Synthetic coding sequence
atggacgaagaagttagtgatccaacgagcgccgctgcacagttacgtcaactgagggaccatctgccccccccctcgtcagcttccccaagccgggctctgcccgagccacaggaagcccaaaaactggctgccgaacgggcacgcgcccctgtcgtgccttacggagtcgatttgcattattggggtcaggaactcccaaccgcgggcaagattgtcaagtccgacagtcagcatcgcttttggaagcccagtgaggtggaggaggaagtggtaaatgctgatatctcggaaatgctccgcagccgccatatcaccttcgctgggaaatttgagccagttcagcactggtgcagagctcctcggcccgatggtagactgtgtgaaagacaggatcgcctcaaaacatttcactcatgcccgcggccctctggaagcaggggtgggaccgagcccagccctcgcccatgtggttcccaggacgcattattgtag

SEQ ID NO: 32351 - DNA, 6801 bp, Artificial Sequence
  Description of Artificial Sequence: Synthetic coding sequence
atgatgcccggagagacccactccgcagcacctgggactgctgccgacctgagcaggtgccaaggctgcgcctctcttcagcagaatttaaacgaatacgtcgaggctcttattaccctcaaacagaagattatcaataccgacaacctccttactgagtaccagaagaaatgcgatgagctccagttcgccagacgggaaaactccaatctgcaccatcaggtggaagagatgctgcagaaaatttcaccattgcagaagtgccaagaagagctcgggtccctgaaggccgaattagaggaaaagaaatcctctctgaaattgtatcaggacacacaccaggaatacgcaagggtgaaggaagaatgtctcaagagtgatgcacagaaaaaaaagctagaggcaaaggtgaagaagctgcaggaggcagccgttaaacaaacacaagatttcaagcaactcaggaatgagaagaaaatcctggagaaagagttcaaaaagacccaggagagattggatgagttcagcaaacagaaaaacgaaaaagaactcagacatatcggcacgcagatctcttccgacagctacgggtcaattgataagcgtaaggtcaagctgctcttgaaggaactgtggctgtgcgtgaacacgacacatagactccccggtgagggatccagatgtgtgcctgaaaaacctgccaaggccattacctcaagtagggtgcccggggaggacgggaccctgccacccactcaaggaagccctctgaggacaagtaatgtccagacctgccttactaaactcagtatggaaatcaaggaagacttcctctgccagaacgtcgagaaacagtcaagttcaggaacaaattgcagtagcgaccatgtgtttaacgagaatgggaatttagaggtcctggttcagagtcacagagacggcggttccactgaattcgtggatcacgaccacttcttcgatgaagacctccaggccgccatcgacttctttaagctgcctcctccactactttcccctgtgccttctcccccccctatgtcctccccacaccctggatccctacccagcagttttgctccagagacatattttggggagtataccgacagtagcgacaacgattccgttcagcttcggaactcagctgagtgcgtgagcgaggacgacactacggaatcccagaactactttggctcgcttcggaaaaataaaggatctggaacatgggaggagaaacccaagagccatgaagccattcaggcgctcaacacttgggaagtgaacaaggtgacgacgagcggactcgagactttcacagccaccctgagggaaagctcagccacccatagcctggtgggcgaaaaacattggacaacagcatcacgaagtatgagtgacagaaagcgagacattttacatgaaaccaaaacacagatggaagtgcgtgagatggacaagtccgtgcagactgagaagaccattcataagctcacaagaggcctctgtattgaaaggctctccgcctcccccgcgcaagaaaaagaggcggcccccggcaagagcgagctgtgctctagtcccctggggaaacgtccgctcaatgaattgatggagagcgaaggaaagaccgtcctttccaagatgatgggaagccccaagagtgagtttactaaatggactcgcattaatgaaatcactagtgaaccggacagaatcaccgtgtccggccatttccaccgcctttcaagagagcttgaaaaggaaaaagaggacacgcaagggtttactctgggggagtcacccgagtccgaagatgatgattcgggtgacggaatggacgtggcgggacttgacatagaaacttcatttagctcatcatcgacgcttgtcgcgctttcagtaggaagtaatccacaaagctcatccggcctggattgtggcaacgatactgacatcactactaaggttttctccacggagcctcatcactccgaacataagctgcagaccaaaacgctaaatacattacacctccagtcagagccccccgaatgctctatcggagggaataatctggagaacagcttgtgtgccctgtcccctgaactgggggcgtcaaactttaacgaccagaagagctctgggattgaatacactaaagtagtgaagggcctgacaaagatccactctcttccgcgctctgtttttatgaaggcgacaaaggatgggcagtgtgagtcccaggatccccgtatcgagttgaccctgaacaagccagactttacttcactcattggcagccaggctgcactgattaaatcaggtctaggattcgtgaagtcaacatcatggcaccattctgacctgcttcgcaaggggggtgaagaaagtcttagggcaaaatccgaacatgaacagaagacgtcacatcaattgcagaaagccatgccattcctgcagaaccgtggtccaaccccaaaacctgatctgctccgcgaaaataataaccccgtggagttcaagaccacagccagtgtgcttccaaaccaggtgtccgttatcacgaagcagacaagaccagagaaggtgcagtctgccaagttggagcacttgaggccccatagagtggagcccacactggtcacggaaaattctggtaataagaccgggatgtcaacagtcgctaagtgtgacggcgaacgtgacgacactacacagaacatcacagaggtggcagcagttaagtcgatctcacccgaagtgagcgcatctaggcgcaaactggacttcaattctcctggaggaagctcccctgtggagaactcagactgctcgaccaattcccgcctgtccttcagtcctgaaaacattcttattcaaaaccaggacatagtgcgagaggcagccgtgcagggggacggacagaagcagcggcagcctcaggctaccgatctggacagctctgggacccatggctcagaaatgctgccagcgaccgaagtcacagtatccggagggttttccgttgaggagacctcatgtggagataccggtaggtccggaggagaggcactcgcagtcgcgaacgatagcacctctaccccccagaatgctaacggtctttggaagctgaaatccaccactcccgggggcgccctccccgaatgtttcggtaccaccgataccacttttagcagtgccttttgcaggaagcacggggagacgcaagacacatcccagtccagtctgcctggtaccctacattgttacactgggatccgagaaggcggtgatgatacggaagtggaatccgaggcattttcttgcagcgagggctcagagcagcaagacgcacccgacgattcccagaagaatctgggcgataccgatgcggccgtggctgaagtgcgccctagcttggaggttggttatctgacaagcgccctccaggactttaatatcagcacttttagcgagctggatcgtctgagcacgtcagaggtggtgatgtttctggagagttgtcaactgggggactattccagtggagatagcgtgtcggagtgcagctctaagggtactctgagtaaagagatgaacaaggagctgaaggcctccgagattggggagaaataccggaagcagccctgtgaggaggagacgctgggtacgtgcgaggaatggattgagagtgaggaggacgattactccttgaaaaacacctcccagctgacccaatgctcactggagactctgagcgaagttctgactaagattaggcaggaactccagactaatagtgaagactgcaatgggaaggataccggctcactgctacttctaaacgtgaacaacaatatgaccacagagaacctgaaggagaagtccccattcagagagactactggatcttcctctcacgcctccgagcctacgccgcaggcagccgccctggatacggaaggttccagcccaatctcaggaatgcctcaaaacgagaacccacaatcccgtccggaagccagatctgacgctggtcggcagaccgatggcggcgaagaagatctgcctgagcccgtcgagccgagcgcactgtgttcagactctgtgatggaaccaagcatagaacagtccagtaattgcgaagccgagacaacgtttcagtgccagatcgccacagtgaccagtgaggtgataaacgttctgatcaataaggatcaaaacctggtgatcgaaaaaggggataactggactattatctccggcgtcgccgtgctgccccatgttgatcaggtgacactgtgtgatattcctggcgatatccctattagccaggatcaaggagaattagaagcagggtgcatccctgtcacgtccgcggaaaaaagcccagaggccagtcacactggtccagcttttcaggaagctccctgtgggaataatctgagctgtccccaggaggacgtgtcaagcagcgggcaaagtaccaatttcgataagtcacggctgagaaacaggcctgtaaagccttcgatatggatcagcagccagatttatgaccagaattttgagactcagatcgtggccagcgatcacacgtattataattcgaagctcgagcctagtggtaagaacaagaatagaagtaaaatttcaaacaaagatcagtctaacaaacctgtaaagacgtcagcatcatctcgggtggagacacaccaatctgaggtggcccagagcttttccggagaaaaagctaacacgaaaacacagcgatcccagacacaaactattctggccaacgctgatacaagcacccccaccgattgtagtcccgatacactgtctaaaatacggcaggaggttggtccgccactgcccccattgttagccccattaatagcaacccccccaaggacctctcagccactgtcacccttgattagcagtagttctccctcatccccagcttcgcccgtggggcaagtgagcccattcagagagactccagtaccgcctgccatgtcaccctggccagaagaccccagacgagcttctcctccggacccatctccgtccccgtcagcagctagcgcctcagaaagagtggtcccatcgcctctgcagttttgcgctgccactccaaagcacgcgctcccggttccaggtagactgccaccctgcgctagcgggcacgcggccgtaggcggacctcaagagaattctgtgaagattctcgatacgatgtatcctgagctgagcgcacgagcgagaaccctgaacattctgaagggcaatatacagttaacccgcggacctcccgccgattgcaaaaatttaccgggtccagcatctgccatgataggcttcaagaccatcacttccgcggcaacagccttcgttaagacaggcagctcttccggcggggattgcaaccaagacaaatccagggatctcggaacccagcaggattcatctggaaagcggacactttctactagcaccctccgttcagccaaaagactcagactggataccggctctcccgagccagagacccggggcgtgactgccgaagggatccacaaaaatctgcccggcaatcttcctcccgcagaggtggctaccaccaatgaagaaaggtcctgttcctctcccgcggtgtcggcagtctcccagttacccctgagcccaaaggagactgtggagagtcacgacaaagctatagcaaacgccctgaagaagatcgcggaattttcctttgacctcctgcctgtgatccggtcacacgtgtacgttggaaatatatcaaagaaacccgtgatgcgggatcaggaaaaggaggtggtttatgagttcagtacaactaaaaagcacttggctgaatgcctgctccacagcatcctttcagagctgaagatccagaagatttctatggaccacaattacattcatgccttgtgccgggtgtacgttggcatttgccgccagctcggcgatctcgagcgagcccgcctcttttgctattctctcttgaaggaggacttcccggaaagcgagaagctgaccctgttcattgctaacatgtggcacgacatcttcctgtctcagtctgttatcaacaaagctatgcagttggtagctaggcagcgggccaaaggcgaggtgctgaattgtttgcgtgcctttctgaactgggaaaagaatgctcctgtggacgttggattcatggtttcaaagctattactcactattcagctgtgccccaaaactgaatttcagcccagcgaaaagttcggagaagatctgtccgataatacctgggagtatatttttgcaatcgacctgctatgctgccatcagaaatggatttggactcatgacaacatcatctctaaggagctctggcctgtaatggacaaatggattaagtatcggaaggggcatgcgaatattgcctataccccagatattatcattgccagcattctgcgactgataggcaggctgggtcaacttggcctgaaagagggtttcccatccgcagttaagaatatcagttcagtgatcggcatgtttatccaacacgctcacgatgaagacatcccttggggaatccagcttgctgctgtctatgctctgtgtgacttgtctccatccaaccctgcagagataagcaaaatcttggaagcatggcgtagagaggcctcaaagagcgttccctcagcaattgtctcttgcctggaggaggtaagtgcgttgtccaccgaggaactaggctag

SEQ ID NO: 32352 - DNA, 1362 bp, Artificial Sequence
  Description of Artificial Sequence: Synthetic coding sequence
atggatcaatttggagacattctagagggcgaagtcgatcacagttttttcgactccgatttcgaggagggaaagaaatgcgaaacgaacagtgtcttcgacaagcagaacgatgatccaaaggaacgtatcgacaaagacacgaagaacgttaactctaacaccggaatgcagacaacagaaaactaccttactgaaaaaggaaacgagaggaatgttaaattcccaccagagcacccagtggagaatgacgtgactcagacggtaagcagcttcagcttgcccgcttcaagccgcagcaaaaaactctgtgacgtgacgactggcctgaagatccatgtttcgattcccaaccgcattcccaagatagtcaaagagggcgaggatgactactacacagacggtgaagagtcatccgacgacggaaagaagtatcatgtgaagagtaaaagtgctaagccctcaacaaatgtcaagaaatcaataagaaaaaagtactgcaaagtcagttctagcagctcgagttctttgtcctcttcctcaagtggtagcggtaccgactgcctagatgcagggagcgacagtcacctgagcgactcttctcccagctcaaaatcttccaaaaaacacgtgtccggcattaccctcctgtccccgaagcataaatacaagtccggaattaaaagcacagagacccagccatccagcactactccaaagtgtggccactatcctgaggagagcgaggatactgtgacggatgtatctcccttgtccacgccagatatatccccgctgcagagctttgagctgggcatcgctaacgaccaaaaggtcaaaattaagaagcaggaaaatgtgtcacaggaaatttatgaagacgttgaagacctcaaaaataatagcaagtacttgaaagccgcaaaaaaagggaaggagaagcatgaacccgatgtgagcagcaagtccagtagcgttcttgactcttcgctagatcatcgacataagcagaaggtactgcacgacaccatggatctcaatcatctgctgaaagcattcctccagttagataaaaagggcccccagaagcaccacttcgaccagccatctgtggcacccggtaagaattattcctttactcgggaagaagtgaggcagatcgaccgcgaaaatcagaggcttctgaaggagttaagtcggcaggcggaaaagccagggagcaagtctaccataccaagatctgccgaccatcctcctaaactgtaccacagtgctctgaaccgtcagaaagaacaacagcggatcgagagggagaatctgactatttcgctctgccatccaggttggagtgcagtcacatag

SEQ ID NO: 32353 - DNA, 342 bp, Artificial Sequence
  Description of Artificial Sequence: Synthetic coding sequence
gaggaacgcgccgaatataccgctgacatcatttccaccaccgtggccgaaccctatcgaacctgttttactgccggaggctccaagacttcccccgtcgaacagcagcctgagcagcagcaaccccaggatatcgtgtctctgcctttgcctccattgccgcatgcaacgccagatcctttcactctatactctcacagaacagagagcgccggcgggcacctcttcttgccccaagatctgcgatggaaaagtccggggttgggagtcttcgctgtacagtctgtgtatgaactcgcccgtcggcataatgtttctcctttttattctggacctccctag

SEQ ID NO: 32354 - DNA, 1563 bp, Artificial Sequence
  Description of Artificial Sequence: Synthetic coding sequence
atggctggttgtaccaggaaattgacccacttgcgcaagcgaattcatcgtccaagaaggcgaaccacaagacgctggaaaaggtggttcaaattccggaaaagaaaaggagaaaagaggcccagacctaaccacaaggcggtagcgcgtcgagcaaagctgaaattctccaccagcgagaagctgcattggcccgaacaagaactcgccaaaaagagtatcctcaatgctgaagactcgctgattatcgataataaacggtcaatcagtcacctttcttccggcgtgctgaaggatatatttacaaccggcacttcaagttacaacgtgctactacagtccaaggaggagaagaagtatcattcccaaaaacagagctcctcgacctattccaaaagatgcagaaaacccagcaagtctcctaacactagcagaagcaaggaccctcgccgtatgaaggccctggtgccagtcacatcgtccggcacatggtattgtctggagagaagaccggccgtttttgtgaccagtagtgtttcgtcccccgtgaagttcacacacgatatttccgtgaccggcaacggtatagtcctgcctcccaaacctaagtccaaagtgaagtggtgccatttctccactctgcctaagccaaagcctcagctgtcacgctcgttcgagaagggcgacgatttctccggcaaaaagttttgcatcctgaccgccatcaagcctaccaacctggaaaaggagaagcttcgtttcttcaagtcagattacacctataatcctcagtttgagtacgccaaccccgctctgccatctgttctggccaaacatagccacgcttcggacagattcctgaaacagatcgtggtccacctgacagaggatctgctgagcagagcttccatgactgtggtgaacgggtgccctaccctcacgattaacgtgtctacggctcgcgagcactggttggaaggcatgctgagacatgagatcggcacacactactttcggggaatcaataatctccagcagccctggaacagctggaccggtagaaagaaacacgaattaaaaccaaataaccctaccgaagagggcttggcttccatccacagcgtgctgttcaggaaggatccttttctgtggcgcgctgccctgctttactacaccgtatatcaagcctcccagatgtccttttgtgagctgtttaaagacatcggacgcttcgtgaaggatccgaatacacgctgggactactgtgtccgcgcaaagaggggatggaccgacaccagccagcccggatgtttcagtaaggaccaagtttacttggacggaatcctgcagattctccgctatagggatacgattgatttccacctactgaccgcacttggaaaggtgtcatacgaggatgtggatcggctgaaaggattggctgtgactgaaaatatgagggtgccacacttcctccaggaccacggaaggtatatggagcacctcgagaaaatcatggaggtgaacgaactgactgatcgggagctcaaggatctgatctag

SEQ ID NO: 32355 - DNA, 2748 bp, Artificial Sequence
  Description of Artificial Sequence: Synthetic coding sequence
atgcccagaggatcaagagctagaggctcaaaaagaaaacgatcatggaataccgagtgcccttcttttcctggcgagaggcccctgcaggtgaggagagcaggtttacgaacggctggggccgccgcgagtttgagcgaggcgtggctcagatgtggtgagggcttccagaacacttctggcaacccctccctcacagctgaagaaaaaacaataacagaaaagcatttggaactctgcccacgacctaaacaggaaactactacctccaaatccacatctggccttaccgacattacctggtcctcttctggttctgacctcagtgatgaggataaaacactcagccagttgcagagggacgaactccagttcatcgactgggagatcgacagcgatcgggcagaggcgtccgattgcgatgaattcgaggacgatgagggagctgtcgagatttctgattgtgcgtcttgtgccagcaaccagagcctgacatcagatgaaaagctgtccgagctccccaaacccagttccatagagattttggaatatagttctgatagcgagaaagaagacgacctggagaacgtgctgcttatcgacagtgagtcgcctcacaaatatcacgtgcagtttgccagcgatgctcgccagattatggaaaggctcatcgatccgcgaactaaaagcaccgaaacaatactgcacactccccagaagcccaccgccaagtttccacggacacctgaaaattctgccaaaaaaaagttactcagggggggtttggccgagcgccttaacggattgcagaatagagagaggtctgcaatctccctctggcgacaccagtgcatctcttatcaaaagaccctgagcggccgtaagtctggcgtgcttactgtaaagattcttgaactccacgaggaatgcgcgatgcaggtagcaatgtgcgagcagctgttggggtcgcccgcgacaagctcaagtcagagcgtcgcccctcgccctggggctggcctcaaagtcctgttcacaaaggaaacagcaggttacctcagaggcagaccccaggatacagtacggatctttcccccatggcaaaagctaattattcctagtggctcttgtcccgtgatcctgaacacatatttctgcgagaaagtagttgccaaggaagactcagaaaagacgtgcgaggtgtactgtccagatatccccctccctcggcgatccattagcctcgcacagatgtttgtgataaaagggctgaccaataacagtcccgagattcaggtggtatgctccggggtggcaaccactggaaccgcctggacacacggtcacaaggaggccaaacagagaatccccacaagcaccccacttcgagactcgctgctggacgtagtagaaagccagggagccgctagctggccaggcgctggcgtgagagtggtggtgcagcgagtgtactccctgccttccagagactctactcgcggccagcagggcgcctcaagcgggcacacagacccggcaggtacaagagcttgtctccttgttcaggacgcctgtggcatgtttggcgaggtgcatctcgagttcaccatgagtaaggcccgccagctggaaggaaaatcctgcagcctggtaggtatgaaggtgctccagaaagttactaggggaaggaccgcagggatattcagccttatcgataccctctggcccccagcaatccccctgaagactcccggcagagaccagccctgcgaggagattaaaacacacctgccccccccagcgctctgttacattctgactgcccaccctaacctgggccagattgacatcattgacgaggatcccatctacaagttgtaccagccaccggtgacgaggtgccttcgcgatatcttgcagatgaatgacctgggtacccgctgctccttctacgccaccgtcatttaccagaagcctcagctgaaaagcttgttgctgctggaacagagggagatctggctgctggtgactgatgtgaccctgcaaactaaagaagagcgcgatccccgcctgccaaagactctattggtttatgtggctcccttatgcgttctggggtccgaagtcttagaggccttggccggggcagctccccattcactcttctttaaagatgctcttagggatcagggccgcatcgtctgcgcagagagaaccgttctcctattacagaagcccctactgtctgtagtatccggtgccagttcatgtgagcttcctggcccagtcatgcttgatagcctggactccgcaaccccagtgaattccatctgtagcgtgcaggggacagtggtaggagtggacgagagtacagctttctcgtggcctgtctgcgacatgtgtgggaatggacgactagaacagcgtcctgaggatcggggggcgttctcttgcggcgattgtagcagagtagtgacctcgcctgttctgaagcgacatttacaggttttcttggactgtaggtccagaccccagtgcagggtgaaagtcaagctcctacagagaagcatctcttcactcctcaggtttgccgcaggggaagatggatcatacgaagttaagtccgtgctggggaaagaagttggactactgaattgcttcgtgcagtccgtgactgctcatcccacatcctgcatcggcctggaagagatcgagctgctaagtgcaggaggggcatctgcagagcactag

SEQ ID NO: 32356 - DNA, 918 bp, Artificial Sequence
  Description of Artificial Sequence: Synthetic coding sequence
atggccagtagacagcctgaggtgccagccttagaggcatccgccccactgggcaagatgtctctccccatcggcatttaccggagggccgtgtcctacgatgatacccttgaagatccagcacctatgaccccccccccatccgatatgggctcagtcccgtggaaaccagtgatccccgaacgcaaataccagcatttggccaaggttgaggaaggcgaagcctctctgccttcccccgctatgactctttcgtcagcaatagactctgtggacaaagtcccagtggtcaaggcaaaggccacacatgtgattatgaatagcctgatcaccaagcagactcaagaatcgatccagcacttcgagcgccaggccggactgcgcgacgctggttacacccctcataagggcctaacaacagaggagaccaaatatctccgcgtggcagaggcactgcacaagttgaagctgcagtctggagaagttacaaaggaggagagacagccggcaagcgcccagtccaccccgtcaactaccccacactcctctccgaagcagcggccacgcggatggtttacttccggatctagtactgccttgccaggacccaatcctagcacaatggactctgggagcggggacaaggacagaaatctgtcggacaagtggtcactcttcggccctagatctctgcagaagtacgattctggctccttcgctactcaggcatacaggggagcccaaaaaccaagtccccttgaactcatccgggcacaagcaaaccggatggccgaggatcccgccgctctgaaacctccgaagatggatattccggtcatggaggggaagaagcaaccaccacgcgcccataacctgaaaccacgtgatctcaacgtcttgacccctacagggttttag

SEQ ID NO: 32357 - DNA, 3213 bp, Artificial Sequence
  Description of Artificial Sequence: Synthetic coding sequence
atgtactgctgttctgcccaggattcaaagatggactacaaacggaggtttttactcgggggctccaagcagaaggttcagcagcaccaacaataccccatgcccgagcttggacgggcgctctcagctcctctggcctccacggctaccactgccccccttggctcgctgactgcagctggatcctgccaccacgccatgccccataccacaccaatcgccgatatacagcaaggtatctccaagtacttggacgcacttaacgtgttctgcagggcctccacgtttctgactgacttatttagtaccgtgttccgaaactcacattactcaaaagccgcaacccagctgaaggatgttcaggagcacgttatggaggctgcatccagactcacaagtgccatcaagcccgagatcgctaaaatgctcatggaactctcggcaggcgccgctaacttcactgaccagaaagagttcagcctccaagacattgaagttctgggcaggtgcttcctgaccgtggtgcaggtccacttccagttcctgacacacgcacttcagaaggtgcaacctgtggcacatagctgctttgcggaagtaattgtgcccgaaaagaagaatagcggcagtgggggggggttgtcaggaatgggccatactcctgaagtcgaagaagcagtgagaagttggagaggcgcggcggaggcgacttctcggcttcgagaacgtggatgtgatggttgtctcgccgggattgaggtgcaacaactcttttgctcccagtctgccgctattcccgagcaccagctgaaggaactgaacatcaaaatagattctgctctacaggcttataagatagctctcgaaagcctgggtcactgcgaatacgctatgaaggcagggtttcacctgaacccaaaagccattgaagcatccctgcagggttgctgcagtgaagcggaggcccagcagaccggaaggcgtcagactccccctcagccaatgcagtgcgagctgcccacagtacccgtgcaaatcggttcccattttctgaagggggtgagctttaatgagtccgccgccgataacttgaagctgaagactcacactatgctccagctcatgaaggaggccggatgctataatggcatcacatcacgcgatgattttcctgttactgaagttctcaatcaagtttgcccatccacttggagaggggcctgcaaaaccgcggttcaactgcttttcgggcaagccggactggtggtggtcgacacagcccagattgagaacaaagaggcctatgctccacaaatctcactggaggggtccaggatcgttgttcaggtcccctcaacatggtgcctcaaggaggacccagccaccatgtcactacttcagaggtctctagaccccgaaaagacacttggactcgtggacgtattgtataccgctgtcctagatctcaatcggtggcgcgccggcagggagcaggccctgccctgtatacagatccagttgcagcgggaaatctgcgattttggtaatcaagccgacctgccttcaggaaatggaaacaagtcctctggtgggctccagaaaactttcagcaagctcactagtcggtttacaaagaaggctagctgtacgtcctcctcatcctccacaaattactcaatccaaaatacaccctcaaagaacatctttatcgcgggatgctctgaagaaaaagctaagatgcccgggaacatcgatacgcgccttcagtctattcttaacattggaaatttcccaagaacaactgacccgagccagtcggcccagaatagctcgaataccgtagccaatggatttttgatggaacgtcgcgaaaacttcctgcacggagacgatggaaaagacgagaaaggaatgaaccttcccacagatcaggaaatgcaagaggtcattgactttctcagcggatttaacatgggccagagccaccagggctcgcccttagtgacacggcacaactctgctgcaactgccatggtcacagaacagaaagccggcgccatgcagccacagcagccatcgctccctgtccccccacccccccgcgccccccaagctggggcacacacgccactgacaccccagcccggtctggccccacagcagcaaagcccaaaacagcaacagcctcaggtgcagtattatcaacacctgcttcagcctattgggccccagcagcctcccccacagccaagggcccctggtaaatgggtccatggttctagccagcagccagcccaggctgtgggcgcaggtctgtcacctctgggtcagtggccaggcatttcagacctgtcatcagatctctattcccttggcctagtctcaagttacatggacaatgtcatgtctgaagtgttgggccagaagccccaggggcctcgcaataacacctggcctaatagagatcaatctgacggagtgtttgggatgctcggagagatcctcccttttgatccagcagtgggctctgacccggaatttgccagatacgtggccggcgtgtcacaggccatgcaacaaaaacgacaggcccaacacgggcgaagacccggcaatccacggggtaactggccaccaatggacgacgcacatcggacttggcccttcccagagtttttcacagaaggagatgggctgcatgggggctggagcggagcacagggagatagtgcctcatcttctgatgagacgtctagcgctaacggggatagtctattttccatgttctccggcccagacttggtcgcggccgtgaaacagagacgcaagcactcaagcggcgagcaggacactagtaccttgccaagccctccactgcttaccactgttgaggacgtgaatcaggacaataagactaagacttggccccctaaggcaccttggcagcaccctagccccctgccatccactctgccaagtcccagcgcccctctttatgctgtcacttcacctgggtctcagtggaacgacacgatgcaaatgctgcaatcccccgtatgggccgcaactaatgattgctcagccgccgcattttcctacgtgcagacccctccacagccaccaccgccacccgcgcacaaggctgcacctaaggggtttaaggcattcccgggtaaaggagaacggcgcccggcctacctcccgcagtactag

SEQ ID NO: 32358 - DNA, 4188 bp, Artificial Sequence
  Description of Artificial Sequence: Synthetic coding sequence
atgtatccgatctgcacagtcgttgtggatggcctgccctcagagtcaagctctagttcctaccccggtccagtctccgtctctgaaatgtctctcctccacgcactgggacctgtgcagacctggctggggcaggaactagagaaatgcggcatcgatgccatgatctacacgcggtatgtgctgtctctgctcctgcatgacagttacgattatgacctccaagaacaggaaaacgacatcttcctcgggtgggagaagggtgcctataaaaagtgggggaaatcaaagaagaaatgttcagatctgacccttgaggagatgaagaaacaagccgccgtgcagtgcctgagatctgcctctgacgaatcatcagggatagaaacattagtcgaggagctgtgtagcaggctgaaggatctccaatccaaacaggaggaaaagatccacaaaaagcttgaaggctctccctcaccagaggccgaattgtcgccccctgcgaaggatcaggtggaaatgtattacgaagctttcccaccactctcagagaaacccgtatgtttgcaggaaatcatgactgtctggaacaagagtaaggtctgtagttattcttcttctagtagttcttccaccgctccacccgcgtccaccgacacctcaagcccgaaggactgtaactcggagagcgaggtcaccaaagagaggtcctccgaggtccccacaaccgtgcatgaaaaaactcagagtaagagtaaaaatgagaaagagaataagtttagtaacggtacaatagaggaaaagccggctctgtataaaaaacagatcaggcacaagcccgaaggtaaaattcgcccccgatcgtggtcaagcggcagctccgaagccggaagctccagcagtggaaaccagggcgagctcaaagccagcatgaaatatgtgaaggtccgccacaaggccagggagatccggaacaagaagggcagaaatggacagtcaaggctttcccttaagcatggcgaaaaggctgagcggaatatacacaccgggtcttcaagctctagctccagcgggtctgtgaagcagctgtgtaagaggggcaagcggcccctcaaggagatcggaagaaaagacccagggagtacagagggcaaggatctgtacatggaaaaccgtaaggacacggagtacaaagaggagccattgtggtataccgagccgatcgctgagtactttgtaccactgagcaggaaaagcaagttggagacaacctacagaaaccggcaagacacaagcgaccttacgagtgaggccgttgaggaactgagcgaatcggtgcatggcctctgcattagcaacaataatctccacaaaacctacctggcagcgggcactttcattgacgggcattttgtggagatgcccgctgtgatcaatgaggacattgatttaaccgggactagcctgtgctcccttccagaagacaacaaatatcttgacgacattcacctctctgaattaacccacttctacgaggtcgatattgaccagagtatgcttgacccaggtgcatcggagacaatgcagggagagtctcggatactgaacatgattcgccagaagagtaaagagaacaccgatttcgaggcagagtgttgcatcgtgcttgacgggatggagctgcaaggcgagcgtgctatctggacagattccactagctccgtaggtgctgagggattgttcctacaagacctgggaaacttagctcagttctgggagtgctgctcatcatcttcaggtgacgctgacggagaatcattcggaggggatagccctgttcgattgtcaccaattctggattcgacagtcttaaatagccacctgctggctgggaaccaggagcttttcagtgacattaacgaaggaagcggcataaactcttgcttcagtgtctttgaagtgcagtgtagcaacagcgtgcttcccttttcctttgagactctaaatctgggcaacgagaatacggattcatctgcaaatatgctgggaaagactcagtccaggttactcatctggaccaaaaatagtgcatttgaggagaacgaacattgctctaatctgtctaccagaacatgttccccatggagccacagtgaagagaccagatctgacaacgaaacgctgaatatccagtttgaggagagcacacaatttaatgctgaagatatcaactatgtcgtgcccagagttagctcgaattacgttgacgaagagctcttagacttcctgcaagatgagacctgtcagcagaactctcgaacgctgggcgaaatacctacactggtgtttaaaaagacatctaagcttgaatctgtctgcgggatacagcttgagcagaagacagaaaacaagaattttgagacaacccaggtttgtaacgaatcccctcatggagatggctattcatcaggtgtcataaaggatatttggacaaaaatggccgataccaacagcgttgctacagtggaaattgaacgtacagacgctgaactcttctctgccgacgtgaacaattactgttgctgcctcgatgcggaagcggagctcgagacgttacaagagcctgataaggccgttcggcgttctgagtaccacctgtgggaagggcagaaggagtctttggagaagagggccttcgcatcctctgagcttagcaatgtcgatggtggcgattacactacaccaagtaagccttgggatgtggctcaggacaaggaaaacactttcattctgggcggcgtctatggagagctgaagacatttaacagcgatggggaatgggcagttgtccccccaagtcataccaagggatcgctccttcaatgcgcagcctccgatgtcgtgacaattgccggtaccgacgtgttcatgacgcctggcaactcattcgccccaggccatcggcaactgtggaagccttttgtctctttcgagcagaacgaccagccaaagtccggggagaacgggctgaacaaaggcttttctttcatcttccacgaggacctgttgggagcgtgtggcaacttccaagtagaggacccaggattggagtattcttttagttcttttgatctttctaatccgtttagtcaggtgttgcatgttgaatgcagcttcgagcctgagggcatcgccagtttctccccgtccttcaaaccgaagagcatcttgtgctctgactcagacagcgaggtctttcacccccgtatttgtggggtcgacaggactcaatacagggcaattaggatcagccctcgcacccactttcgcccgatctcggctagcgagctgtcgccaggaggcggctccgagtcggaatttgaatccgaaaaggacgaggccaatatcccaattccttctcaggtcgatatctttgaggacccccaggccgacctcaaacccttagaggaagatgctgagaaggaggggcactactacggtaaaagcgaattagaaagtgggaaattcctacctcggctgaaaaaaagcgggatggaaaagagcgctcaaaccagtctggactcccaggaggagtcaaccggcatactgtcagttggaaagcagaaccagtgcctcgagtgctcaatgaacgaatccctggagatcgacttggaaagtagcgaagccaattgtaagatcatggcacagtgtgaagaggagattaataatttctgcgggtgcaaagccggctgccagttccctgcatacgaagacaacccggtgagctccggccagctggaagaattcccagtgctcaacaccgatatccagggaatgaaccgcagtcaagaaaaacagacctggtgggaaaaggcactgtatagccctctcttccccgcctctgagtgtgaggagtgctataccaacgctaaaggggaaagtggtctggaggagtatcctgacgcaaaggagacaccgtccaatgaagagcgcctgctggattttaaccgggtgagtagcgtgtacgaagcccgctgcaccggcgaacgtgactccggggcgaaatctgacggcttcagagggaagatgtgctcctctgcatcaagtacttcagaggagaccgggtccgagggcggcggggagtgggtgggcccttcagaagaagaattattttcccggacccacctgtag

SEQ ID NO: 32359 - DNA, 5229 bp, Artificial Sequence
  Description of Artificial Sequence: Synthetic coding sequence
atgtggccagccggcgccggcactaaactgccatgcccaagggactctgccctcagacgcgcagcgtttagtggaaatttaacagcgctgcctagtcacctcgtgccggcaggaaggtcagttagagtgttcatctccgcgaaccccgaggacaccggcgccgaacgccaagctcttagagagaatgtctaccctaagttaagggaattctgtcgcgagaactatggtcttgagttccaggtcattgacctctattggggagttgaagaagatgaatgggattccccagaactgcagaagacccgaatgaaactgctggaaaattgcctaaagacttccgccggtccatgtttcgtgggcctgcttggcgagaagtatgggaacataaggatacctggtgaagtggaagcgagcgagttcgagatgattttggatgccgcgattgaagccaaacttgaaaccaaattgcttgaagaatggtattgccgagacgagaactctgtgcccgcggcctactatctgagaccaaaatctgaaatgctgaggagtaaccggaatgctatgcagccttctaccaacgctgagaatgaaaagacttggcaggagatctcagacgagattaaaaagatttttaaggccgcagtcaagctcctccacgaaaaggggaagatgaaacattctcaggcaaagcggtacctgtttagtgcaatcgaggacgagtttgacttcgcgctaggaaagcagacaccagcctttctgaaaaagtgcgtctgctacatcaggaaaatagcaaacattgaacgcttcgtgaaaatccctgaaatgggtaagtacatggatatcacaggcacagaaccccgcatcattcgggaccccgaggctcaggagaaattgatcaaactgagagacgaatttatcccaacaatcgtcgctagtagcaatctccgggtgtatacttccgtgacccattgcgatatgaagttaggctatagtcaggaaattgagaaccactatatcgaaggtctcggcaagcagttctacgaagacatgattgacatcatccaggccacaatccaacagaattttgacactgagacagacacgctgtatgatgagattcttcagcacagcagcctgtgcaagacgtacgcctctttttacgaatacaagtgcgaaagccttaacatagtgcacaattacattctgcctagtaaagctggccacatcaaccccctaattatttacggcggcccatgtactggcaaaacactgttgctggcagaggtggccaaaaaggcctatgggtggctgcacgaggatacagggccggagagtgatcccgtcgtcatcgtgcgctttctcggtactaccgacatgtcctctgacttgcggacactcctactgagtgtctgtgagcaactagccgtgaactacaggtgcctggttcaatcctatcctaagaagatccacgacctctgtgacctttttattaacctgttgaatgagtcatcattacaacggccactggttattatcttcgacgccttggagcagcttagcgagaacgacgatgctcgtaaactgtggtggctgccagctcatttgccacgctttgttagaatcgtcctttctaccctaccgaacaagcacggaattttgcaaaagcttaggtgtctaatccatgaggaagacaattacatcgagctcatcccccgcgacaggaaaatgtgctcgcaggtcctgaaacaccagctcttgcgtgttaagaggaaagtaaccagtgggcagcagatctacgtcaacaatgcactctctaaatgtacgctccccatgtttgtcaacctcacttttcgggaagtcaggcactggcgaagccacaaagatgtcgacgagtcatctctaagtgtgacagtccacgaaagcatcgaacagcttttctggtccctggaaaagaagtgcgggcagaagctagtgtcgcgggcattgggctacattacaatggcaaagatggggttgtccgaaatggaattggaagacgtgctggccttagacaactccgtgatgagtgagctgaaggaaaacactcgtccttcaaaccctctgagagtaccctacctgtatattgccaggctgaaggaagggctgtcaggttacctgattgagcgacacgttaaaaacgtgacgctgctggtatgggccaatagacacctgcagctgattgcacagaaactgtacttgcaggatgacaatgacctccgtgaaatgcacacaatcctcgcagactacttcttgggggtctggagcggcggaagacgcaaagctttttgcctggaagacccctatcttaatggctgccttgatctggagaacaggtccctgcttgaagaggagaagcactttatggagcaagcatcctttgatcgacaagcgcctgatcagccctgggtgttccagtgcaaccccctggaacctgatatttttttcgtaaaccatcgcaagatgagcgaattgctctaccatctgacacgatgcgggaagacagatgacctgctgtacgggattatcatgaattttagctggctgtatacgatgatcaaaattggccaattcgacaaggtgctgagcgatattgagctagcttataactactctcaggaaaaggaactgaagttcctagcgaataccctgcggagtattaagaataaggttacggctttcccagggtctctctctgccgagctgcagcagcgcttgctccccgtggtgtcatccctgccgaaacttcgccatctgctcctggaatgcgataaggatggtcccaaatactgctccattgtgccccttcacagttctatggatgtgacctactcccccgagaggctgcccctgtcttcttctcaccttcacgtaacagagatcctaccaacgtgtaatcctagcacagtacttaccgcgctagaaaacggcagtatctcaacttgggacgtggagacgagacagctgctgaggcagatcactaccgcccagagtgttattttaggaatgaagcttacctctgatgagaaatacttagtggtggctacaaccaataacactctgttgatttacgacaacgtgaactcgtgcctgctgtccgaggtcgaaatcaaaggtaccaagcatggctcttcagctacatacatcaacggctttacgttatctgccaatcatgcgctagcctggctagaagcctctaaagacgtgacggttattgaccttctatacggctggcctctgtatcagttccactgttggtacgaggttacgtgtgtgcagtgctctttagacggtctgtacgccttttgcggtcaatacctgaacaccaccacaattttccacttagggagtggcgaaaagttgtgcactgtcaccagcgagttctctggtggatttgtaaagttcttgctgattttggacaccgcacaagagatggtcatggtggattccgagggaagcctcagcgtctggaacacagaggatatcagcagtccacagttaacagacgactttgattgccgccgtgaggactccgaagtcgtgtccatcgagctgagcgaggaccagtcggcggtcttaatatgtaaagccctctctattgagctactggataccggtctctggaaggtggctgagaagttccgggcaaagcataatgaaaggttcatatccgccgtgctcagtaagaacggggactgcattattgctaccatggagaatactagcgctgttttcttttggcgacgggataccggccagtgcatggcgtcattacaagagatttctggatccatcgtcaagctggtgaagtccagtcatcacaatatgcttttgagtctatctacgagcggtgtgctctcaatctgggacatcgacattatcacagcaatgagtaatatcgacaagaccgggaaaccaatacagtccctgctcctacctgcccgcggcgagattatttactctttggatggtagcgattgtgtgcacaaatggaacttctccagtggttttatagaagccgtgttcaagcacgagggaatagtggagcactgtgtgctgacttccaccggggatattatggtcacatccgacgataaaagctcacagtatgtgtggcacacctcctcgggagaaaacttattcagaataaacggccagaggatctctcaactcctgataacacataatgatcagttcgtggtcagtctctgtgaagagaacgcatcaagggtgtggcggctggcaaccggccaccgtgtgtgcaacatcctgacaacactgcagaatgcgttcattactagcgctaacacattcgtcgtaggcatgaccaagtctaaagtcctggcagtcagcttgtggaccggctctatcaccaagaagttttgttgcgaagacggcactaccatcgtgaacttcaagctcatacctgactgccccgacataatcgtgtttatcaccagcgctgagaccgtcaatatctggtcactaacagatgaggtgatatgccgcagggtgcagctgcccaacaatttcttgaaaaatcttgaagatttcgagatttcaccaaatggtaaactggggataatcgcgagaggggatgaaaacatcaatgttctcgacttgtattctggtaagctccgcgtggtgcacgcgtcaggaatcatctggcggcagcgcctcagtcgcgacggccgctacttggtctacatatgctttagaaacggcgaggaagaggacgagaacggcgccatctttagcctaatagtgatgcgcctggcagatggaaagaacataggcgcttgctctctgtacaaaacacccaccttcctagcactaagccagagacacctgaacatcatcgtgggcttcgacgacggcagcatcggcatttacacggttgtggatcgggtagatgcagccttgaagattaagattgccacgagtaattctcgtcagatctttaataacgcaacacacactagccggccaaagtgtaattcttattgtttcaaaattagcgtggactgtctctggagggagtctacagaagtttttgcgcgagacagtcctatcactgtttccgactctactgagtctaacgaagctacaccttccaagaagcacaatagctgctacgaaagggtctgtagtgctctcgaagcgcgcggtcacagctatgcgcctgacaattag

SEQ ID NO: 32360 - DNA, 348 bp, Artificial Sequence
  Description of Artificial Sequence: Synthetic coding sequence
gtgagcgggggagtgcgcctgccagcttctgagagacgcttcctctcatgttgtcctttgccagctcggcccctgctccagcggctggcttctagacatccggcctccctgccctgcagtcaacagctcctgtggagatcctcacgcgcaccccccctgctgccctcactgcccctgggcgtgcttattacagacccactgactaggcacccggggcaccaccatccagctcctttccactcagctgccctgctggttcccgtcaagccccctactgcatgggaaggcaagagtcggttagcaaggccctgtctttctcaggcactcgaggcctgccagctcacctag

SEQ ID NO: 32361 - DNA, 585 bp, Artificial Sequence
  Description of Artificial Sequence: Synthetic coding sequence
atggccgcgaaaagcactcaggactccctgcccagggacacaggtgaaccaagtgcccttcctgtgcagggtagggcagaagggcggtctagtgagggacgaaaggagcggacggccgaatgcgccctgcgaggaaaacaagcctcagaaccagcattgagaaagaggaatttccttcccggacctaactccgatacagtgcggcccgccgccgaaaccgagctggtaccttgttccctgaggcatccgaggcaagacctttgtggggagcatccctctttccccgtcatgcaaccgtccctggagacacaggctaagcccgaaagagaccgggccgtgctgatcccgcccaagggaccatggcctcccgctcagggcctggctatgcggactcactgccccacaggacccccctctaaagcctactgccgcgggggatcctcctctacgtccagaaaccaagtagccagcctcgcctatcgtactcagaacactgctgcttcccagccgcgtcagccagggggacgcggtaaggaagatactgcaggctatggctcctgctctccgaggtcgctcgctgtatag

SEQ ID NO: 32362 - DNA, 2817 bp, Artificial Sequence
  Description of Artificial Sequence: Synthetic coding sequence
atggattgggacgacgagtactcccacaattctttcgacttgcactgtctgctgaactcatttccaggggatttggaattcgagcagattttctccgatattgacgaaaagatcgagcaaaatgccgctagtattaaacactgtattaaggaaattcaaagcgaaatcaacaaacagtgtccaggtgtgcagttgcagacaaccaccgattgctttgaatggcttaccaactataattacagcacaagcgagagcagcttcatttcccacggcgacctcattaagtttttcaagaccctgcaagatctcctgaagaacgagcagaatcaggaagagatgactttagatctgttgtgggacctcagctgtcattcctccgtgagcttcccatcaacactgagcgggaccagcttccacttcttgtctcggacctcccttcactcagtcgaggacaatagctcaatggacgtgaagtcaatgtgggatgacattcgcctgcatctccgacggtttttggtctccaaactccagtcccacaatgaaataaataacagtcagcaaaaaattctgttgaagaaacagtgtttacagcagctgctgtttctttatcccgaatccgaggtgataataaaatatcaaaacatccagaacaagctgcttgccaacctcctctggaactgcttcccatcctataaccgggactcaaatttggacgtaatcgcgcacgggtaccagtctacaatgctgaagctgtacagcgtgataaaggaagacttcaacacactgtgtgaaattctagctccttcctctatggtaaagttcattaaagaaacgtacctggataccgtgaccgaggaaatggctaagtttctcgagaatttctgtgagctacaatttagggagaacgccgtgcgagtagtgaaaacttcaaaaagcagctccaagcataggggagccgtacacgccctggtgaccacagagtgcccccagaaagggcgtaattttagtctgcccctggataaagtagaattcttgagccagcttatcaagagcttcatgaaattagaaaaaggcgtgcaggagcttttcgatgagattctcctctctctaaaaattacacgagatacttcagggatcctggaaaaaagcgaccgagaggtggtaatggagaagcccagggctaatgagaccaatatcccgagtgagcagtctctgccagggaaagaggctaccctgctggatttcggctggcgctctgcgtttaaggaggtctcattgccgatggcacactgcgtggtgaccgcaattgagggctttagtacaaagatcttgcagcaagagcagaacgagaggagcagcgcggtctcttacgccatgaatctggtgaacgtccagcaggtatggcaagactctcatatgtttccagaggaggagcagcccaaaaagatcggtaaattctgctcagatatcatggagaaattagataccatgctgcctttggcgcttgcatgcagagatgattccttccaggagatcagggcaaatcttgtcgaagcctgctgtaaagtagcgacagccgtgctccagcgccttcaagagcgagccaaggaagtcccctctaaggccccactgaagaacttgcacacctacctctcaacagccgtgtatgtgttccagcattttaagaggtacgataatcttatgaaggagatgactaaaaagccaatctttctcgtcctggttcaaaggtaccaggaatttatcaacaccctccaatttcaggtcaccaactattgtgtcagggtgtgcgcaaccagtatcctccaggacgccgagtcccatcactgggatgattacaaggccttttacgagggcgagcgctgcagtttttcaatacaaatgtggcattacttttgttggagtctgcactatgatctttggaccatcctgccccctaaacttgcccaggagattctggtagaggtgctggaaaaaagcctgtccttgctggcttccagatatgccagagcacaccctagcaggaagaggacccctcagctacggctggatgtgacgaccatactgatatgcaccgaaaatatgctgtggtctgtgtgcacctccgtccaaaaacttctgaacccgcaccagcatacggacgataaaatctttaagatacacacccactgcaacaatctattcactacactcgtgatcctcacctccccattaacggagctttataagactttccaacacggactggatgaatccgcctctgactcactgaagtcctttttcaaacagccgctgtattgggtgagttgtattagccacttttacccctcacttctccggaccccctcagctggaggcctcaaggccgagggtcaacttaagttgttgttaagccagcccagatgcaactggaatctgctccttgaaactctgctgcaccacgatggcttgctgctcagaatcctgctgaaatcatctaaaaggacattccaggagcaggtgagtgacactgaaaacaatctaaatcagggacctagtttgatggaagccatattcaagatattgtatcactgttctttctcccctcagactttcgcaaatgttttcgtgtcttatatggaggaagaacagctctgggactttctgtacaatatcccagggatgcggcacttgctgtttgtcaaagaaatgttttaccggtacctttatgtgcccctgaaaatgttccgctcctgtattgacacaggatttgccgagtcagtggtgggtgagtccctgccatatatatttagcgtgtag

SEQ ID NO: 32363 - DNA, 480 bp, Artificial Sequence
  Description of Artificial Sequence: Synthetic coding sequence
atgagaaacgcacggtccatccgaccagcccgagctgaatcctggaggctgagcttgtgttttctgaactggcaagacgcaatcatctctaaaccccactgcccagcagggagaacctgcccaaccgctgccgcttcacatggcagccggggcgcaggtcatagcgacaaggaccaaggcagaagtccaaagcacgtggtttgtcacgtagagcacaagaaacagtgccctgcggagtttaccgacagccgaggcgtgcacaacgccgcagccagcattagttcccaggtaggtttcccggggcatttgactgcccgaactgctgcacataagagagaggccttagccgttagccctacacctacactccaagtgaacgcccccggagccaagctgagagctcccaaagcaccaagaacgcccgaagctctcggccgcgggccaaagcgcgccggagagtggaaaacgggatgtttctag

SEQ ID NO: 32364 - DNA, 3240 bp, Artificial Sequence
  Description of Artificial Sequence: Synthetic coding sequence
atggatgacgatgacgacagttgcctgctggacctaatcggcgatcctcaggccctgaactatttcctccatggaccgagcaacaaatcgagtaacgacgatctgacaaatgccgggtactcagcagccaactcaaattcaatttttgcaaattccagcaatgcagatcccaagtcatccctgaaaggcgtgtcaaatcagctgggcgaaggccctagtgacggcctgccactatcttcctccctgcagtttttggaggatgaactggaaagttccccactcccagacctgactgaagatcaacccttcgatatcctacagaaaagcctgcaggaggcaaacatcaccgagcagacattagcagaggaagcttatctcgatgctagcattgggtctagccagcagttcgctcaggcccagctccatccttcaagctctgcctcatttacacaggctagcaatgtttcaaactactccggtcaaacactgcaacctatcggggtgacccatgtccccgtcggcgcctcctttgcgagcaatacggtgggcgtccagcatggctttatgcagcacgttggtatcagcgtcccaagccagcacctcagtaatagttcacaaatcagtggtagcggccagatccagcttattggttcatttgggaaccatccctccatgatgactattaacaacctggacggcagtcaaatcatcctcaaggggtccgggcagcaagcaccttccaatgtgtccggaggccttctcgtgcatcggcaaacccccaacggaaatagtttgttcggcaactcttcttcctcccccgtggcccagcctgtaactgtcccattcaatagtaccaacttccagacatctttgccagtccataacatcatcattcaaagaggcctggcacccaactcgaataaagttcccatcaacatccagcctaagccaatccaaatgggtcagcaaaacacttataatgtcaacaacctgggcattcagcagcatcacgtacaacaagggattagctttgcatcagcctcctctccccagggctcggtggtgggcccccacatgtcagtcaatatagtaaaccagcagaacacgagaaagccagttacaagtcaggctgtctcctccaccggggggtccatagtgatacacagccccatgggccaaccgcatgccccccaaagtcagtttctgatccctacatccctgtctgtttcaagcaattccgtccatcatgtacagacgatcaacgggcagcttctccagacgcagcctagtcagctcatctccgggcaagtggcctctgaacacgttatgctcaacaggaatagtagcaacatgctgcggactaatcagccctacacaggacccatgctcaacaatcagaacaccgctgtccatctagtgagtggacagacttttgcggctagtggctcaccagtgatcgcaaaccatgctagcccacagctggtaggggggcagatgcccctccagcaggcatcgccaaccgtgctgcaccttagccccggacaatcttctgtctcccaggggcgtccaggattcgcaaccatgcccagtgtcacttcaatgtctggaccctctcggttccccgccgtttcaagcgcgtcaaccgcccacccaagtctagggtctgccgttcagtccgggtcatctggttctaatttcacgggcgaccagcttacacagccaaataggacgcccgtgcccgtttctgtgtcacaccgtctccctgtctccagtagcaagagtacaagcacgttctcgaacaccccgggcaccggaacacagcagcagtttttctgtcaggcccagaagaaatgtttaaaccagacatcccccatctccgccccaaagaccactgacggattaaggcaagcacagatacctggtctcttaagtacaactctccccggacaggatagcggctcaaaggtcatttcggcatccttgggaaccgcacaacctcagcaggagaaagtggtagggtccagtcctggacaccccgcagtccaagttgagtcacactctggcggacaaaaaaggcctgctgccaaacagctgactaagggcgctttcatactgcaacaactgcagcgggaccaggcccacaccgtcacaccagacaaaagtcacttccgtagtttgtctgatgcagtgcaacgactcctgtcttatcacgtatgccagggttctatgcccacggaagaagatctgagaaaggtagataatgaattcgaaacagtggccacccagctgcttaagcggacccaggccatgttgaacaagtaccggtgtctgctgcttgaggatgccatgaggattaatccatctgcagagatggtcatgattgaccggatgttcaaccaggaagagcgtgcatcgctgtcacgggataagaggctagccctcgtggatccggaaggctttcaggctgacttttgctgttcttttaagttggataaagcggcccacgaaacccagtttggacgctcagatcagcatggcagcaaggcttcgtcctccctccaacctcccgcaaaggctcagggaagggacagagctaaaactggagtcacagaacccatgaaccacgaccagtttcatcttgtgcccaatcacattgtggtgtccgcagaggggaacatatctaaaaagactgagtgcctgggtagagcgctgaagttcgataaagtgggcttagtgcagtaccagtcaacaagtgaagagaaggcctccaggagggagcctttgaaggcctcccagtgcagcccaggacccgagggccatagaaaaactagcagtagatctgatcatggcactgaaagtaagctatctagcattcttgccgattcacacctcgaaatgacttgcaacaactcctttcaggacaaaagcctccgcaacagtcccaaaaatgaggtgttgcacacagatattatgaaaggctccggcgaacctcaacctgatctgcagctgaccaagtcactggagactaccttcaaaaacattctggagctaaaaaaggcaggcaggcagcctcaatccgatcccaccgtctctggtagcgtggagctggacttccccaacttttcccctatggctagtcaggagaactgcttagaaaaatttataccagaccacagcgagggtgtcgtagaaacagactctatcctggaagccgcagtgaattctattctcgagtgttag

SEQ ID NO: 32365 - DNA, 1566 bp, Artificial Sequence
  Description of Artificial Sequence: Synthetic coding sequence
atggaggcgtctgtgctttctcccacttcctgggagaagcggcgcgcttggctgcggcagagtagaaattggcaaacacaagtgttggaagaggaggcagccgcagctctccaggatgtaccggatcccgagccttcgtcactggacgacgtttttcaggagggaaaccccatcaacaagattgaagactggttacaggactgcggctacagtgaggaaggcttttcagaggaggctggtcaatttatctataatgggttctgctctcacggcacaagtttcgaagacgatctgaccctgggcgcggaggctacactgctcgctgccaacggcaaattgtttagcagatccttcttagaaacggcacgaccgtgtcagctgctggacctggggtgctcacttgcgtcttcatccatgacaggcgggaccaacaaaacaagttcaagcattagcgagattctggacaaggtccaggaggacgctgaggatgtgctcttctctttgggcttcgggcaggaggaccacaaggatacaagccggatccccgcccggttctttacaacgcccagccaagcaaagggaattgactttcagctgtttcttaaatcccaagtgaggcggattgagatggaggacccgtgcctcatgcttgcctcccggttcaagcaagtccagacccttgcggtcactgccgatgcttttttttgcctgtattcttatgtctccaagacccccgtgcagaagtttaccccaagccacatgttctggaactgtaatcaccccacggatgtgccaagcatccgcatcctgtcaagagagcctgagccacaatcaccacgagaccgattacgtaaggccattagcaaaatgtgcctgtatacatgcccacgcgacaggccccctccaccacacaacacacccaaacgcaactctctcgatcaggtggtcctagaggtaatggacaaagtaaaggaggaaaagcagtttctgcagcaggactctgatctagggcagttcagccaggaagaccctgtgccccctgctgagggaaagaaattaccaacaagcccatacccatgtgtgttttgctgcgaagaggagacacagcaacgcatgtctacagtcttggccccaagccagactctggactctaacccaaaggtcccgtgttgcactcactcactgccaatcgaggatcctcagtggtcgactgatccggcacagattcgccgggagctctgcagcctacccgcaacgaacaccgagacacaccccgcaaaggacgaaaccttttggaaacgtaaaagcagagctagaaagagtctgttccaaaagaatctgatgggccgcaaagtcaaatccctggacctttctataactcagcagaaatggaagcagtccgtcgatagacctgaacttcgcaggagcctgtcgcagcagccacaggatacctttgatttggaggaagtgcagagcaatagtgaagaagaacagtcacagagccggtggccaagtcggccgcggcacccccaccatcatcagacttttgcaggtaaggattcatag

SEQ ID NO: 32366 - DNA, 372 bp, Artificial Sequence
  Description of Artificial Sequence: Synthetic coding sequence
atgcccgatgccagtctgggcagcttgggaattacgtggtgcttcctggagagccccctggaggtatccagcggaaggttcggactggcacggctgttagggtcccaggatcatggagatgacccagccgaacgcggtcggacagcaacagatgcatggggaccttccaggtgggggcagagtccgggtaatggaggcggttactgcgacgcatcccctccatctgcgcttgcaccaggggaccgcgcgtgggctctgccagcctccccctctagcggcgctcctgcctctcagcattgctgcctggagaaggctggaaccaggactaaggcgtcacccgtctgggggcgggacggaaatacttggaattag

SEQ ID NO: 32367 - DNA, 1410 bp, Artificial Sequence
  Description of Artificial Sequence: Synthetic coding sequence
atgctcgagtcaatccgagtgacagagaaactgcattggcctgagcaggagttagctaagaagtccatactgaacgctgaggactctttgatcattgacaataagaggagtatttcacacctgtcctccggtgtcctcaaagatatatttacaaccggtacctctagctataatgtattgctgcagtccaaagaagaaaagaagtaccatagccagaagcagtctagctctacttacagcaaacggtgcagaaaaccttcaaaatccccgaacactagcagaagtaaagaccccagacgcatgaaagccctggtacctgtgacctcatcgggtacttggtactgcctggagcgacgacctgccgtttttgttacttcctcagtcagcagccccgtcaagttcacgcacgacatctccgtgacagggaacgggattgtgttgcctcctaagccgaagagtaaggtgaaatggtgccacttttctacgctacccaagccaaaaccccagctttctaggtccttcgaaaaaggggacgatttttccggcaaaaagttctgcatcctcacggccatcaagccaactaacctcgagaaagagaagttacgattctttaaatcagactatacctacaatccccagttcgagtacgccaaccctgccctaccctctgtactcgccaaacattcccatgcaagtgatcgttttcttaaacagatcgtcgttcacttgactgaagatctccttagtcgagcctcaatgacagttgtgaacgggtgtccgaccctgacgatcaatgtcagcaccgccagagaacactggctggagggcatgctccgtcatgagatcggtacccactacttcaggggtattaacaacctacagcagccatggaatagttggaccggaaggaagaagcacgaactgaaaccaaacaacccgaccgaggaggggcttgcaagcatacactctgtgctgtttaggaaggacccttttctgtggcgcgctgccctcctctactacacagtgtaccaggcttcgcagatgagcttctgcgagttatttaaggacattggcagatttgtgaaggatcccaacacgagatgggactactgtgttcgggctaagagaggctggactgatacttcgcagccaggctgtttcagtaaagatcaggtgtaccttgatggtatcctgcaaattctgcgataccgcgacacgatcgactttcacctgctaaccgctctcggcaaagtgtcctatgaggacgtagatcgtctgaaggggctcgccgtcaccgaaaacatgagggtaccacactttcttcaggaccacggccggtatatggaacatctcgagaaaatcatggaagtgaatgaactgacagatcgagaactgaaagatcttatttag

SEQ ID NO: 32368 - DNA, 69 bp, Artificial Sequence
  Description of Artificial Sequence: Synthetic coding sequence
ccctctagcacccagtaccatgtactggcatgcttacacttgctggtcgtgccatgtctcgcttggtag

SEQ ID NO: 32369 - DNA, 3933 bp, Artificial Sequence
  Description of Artificial Sequence: Synthetic coding sequence
atgctcctgaatggggactgcccggaaagtcttaagaaggaggccgccgctgccgagccacccagagagaatgggctggatgaggccggccccggtgatgagacaaccggccaagaagttattgtgatccaggatactggtttctctgtgaagatcctggctccaggcattgagccgttcagtttacaggtgagcccacaagaaatggttcaggagattcaccaggtcctgatggatagggaggacacctgccataggacttgcttttcattgcacttagacggaaatgtcttagaccactttagcgagctgcgcagtgtcgaaggcctacaggaaggctccgtgctgagggtggtcgaagaaccctataccgtgcgggaagcccgaatccacgtgcggcatgttagagacctcttgaagagtttggacccttccgacgcctttaacggcgtcgactgcaactctctgagtttcttatctgtgtttaccgatggtgaccttggagattcaggaaagcggaaaaaaggcttggagatggacccaattgattgcaccccacctgagtacatcctgcctggctctcgggagcgccccttgtgccctttgcagcctcaaaacagggattggaagccgctgcagtgcctgaaagtgctcaccatgtctggatggaatcctccaccgggaaacaggaagatgcatggcgatctaatgtacctgtttgtgatcactgcggaggatagacaggtgtcaatcactgcctcgactagaggcttctatctcaaccagagtacagcttatcatttcaatccaaagccagcgtccccgaggttcttatcacacagcctggttgagctgttgaatcaaatcagtcccacttttaagaagaacttcgccgtgctccagaagaagcgcgtccagcgacaccccttcgaacgcatcgctacaccttttcaagtgtactcatggactgctccccaggccgagcatgcaatggactgtgtccgcgccgaggacgcctatacatcccggctggggtacgaggagcacattccggggcagacacgtgactggaacgaagaactgcagaccacccgagaactgccacgcaaaaaccttcctgagagactgctaagggagagagcaatttttaaagtacattccgacttcaccgctgcagccacccggggagccatggcggtgatagatggcaatgtcatggctattaaccctagcgaagaaactaagatgcagatgtttatctggaataacatctttttcagcctcggcttcgacgttcgggatcattacaaagacttcgggggcgatgtcgccgcgtacgttgcccctacaaatgatctaaatggtgtcaggacttacaatgccgtagatgtggaaggtctgtatacactcggcactgtggttgtggactacagagggtatagagtgacagcgcagtcaattatacccggaatactcgaacgggatcaggagcagtctgtcatctatggaagcatcgatttcggaaagactgtcgtatcacatcctcgatacctagagcttctcgaacgcaccagtagacctcttaaaattctcaggcaccaggtactcaatgaccgcgacgaggaagttgagctgtgttcttcagttgaatgcaaagggataataggaaacgacgggcgacactacattctggatttgctgagaacctttccgcccgatctcaatttcttgccagtgccaggtgaggagctgcctgaggagtgcgcacgcgctggctttccaagggcccaccgacataagctgtgttgcctccggcaggaattggtggatgcatttgtagagcataggtacctactgttcatgaaactcgccgcactgcagttaatgcagcagaacgctagccaactggagaccccaagcagcctcgaaaatggtggaccaagctctttggagtctaagtccgaggatccccccggccaggaggctgggagtgaggaagaaggttctagtgcctccggcctggcgaaagtgaaggagctggcagagaccatcgcagcggacgacggcacagacccaaggtcccgcgaagtcattcggaatgcatgtaaggctgtgggatcaatatcctctacagcattcgacattcgattcaacccagatatctttagcccaggcagggtccgctttcctgaaagctgccaggatgaggttcgtgatcagaagcagctgttaaaagacgcagctgccttcctgctcagttgccagattcccgggttggtgaaagattgcatggaacacgccgttttgcctgtggacggcgccaccctggccgaagtcatgaggcagagaggcattaatatgcgctacctggggaaggtccttgaactggtgttacgttcccctgcacgccaccagctggatcacgtgtttaaaatcggtatcggggaacttattactcgcagcgctaaacatatattcaagacgtacctgcaaggcgttgagttaagcggactgagcgctgcgatctctcacttcctgaattgcttcctgagttcctacccaaacccagttgcccacctcccagctgacgaattagtctcaaagaaacgcaataagcggagaaaaaaccgccctcctggagcagcagacaatactgcctgggctgtcatgactccccaggagctgtggaaaaatatctgccaggaagccaagaattacttcgattttgacctcgagtgtgagacggtcgatcaggccgtggagacctatggtctgcagaagatcacacttctgagggaaatttccctgaagactgggattcaggtgctcctgaaggagtatagtttcgatagcagacacaagccagcattcaccgaagaggacgtattgaatatctttccggtggtgaaacacgtaaaccccaaggcatccgatgcctttcacttctttcaatctggccaggctaaagtgcagcagggttttttgaaggagggatgcgagctcataaatgaagctttgaacctgttcaataatgtctatggagcaatgcatgtcgagacttgcgcctgtctcagactgctggctaggctgcactacatcatgggagactatgccgaggcactcagtaaccagcagaaggccgtccttatgagcgagagggtaatgggcaccgaacaccccaacaccattcaagagtatatgcaccttgccctgtactgtttcgcttccagccagctctccaccgcactttccctgctgtatagagctagatatcttatgttgctcgtgtttggcgaggatcaccccgagatggctctactcgacaataacatcggtttggtcctgcatggggttatggagtatgacctgtcacttcggtttctggagaatgctctggccgtctctactaagtatcacgggccgaaagcccttaaggtggcgcttagccatcaccttgtcgctcgagtgtatgagtcgaaagctgagtttcgttccgccttgcaacacgagaaggagggatatactatctataagacacagctgggtgaagatcacgaaaaaaccaaggaatcatccgagtacctgaaatgcttgacccagcaggcagtggctttgcaacggaccatgaatgaaatctatcgcaatggcagttcggcaaacattcctcctctgaaattcaccgccccatccatggcgtccgtcttggagcagttgaacgtcattaatggtattctcttcattccactcagccaaaaagatctggagaacctgaaggcagaggtggccaggagacaccagctccaggaggcatccaggaaccgggatcgggccgaggagcccatggccaccgagccagctccagcaggcgccccaggtgacctgggatcccaacctccagccgcaaaggatccgtcaccaagcgtacaggggtag

SEQ ID NO: 32370 - DNA, 1518 bp, Artificial Sequence
  Description of Artificial Sequence: Synthetic coding sequence
atggttagtaaccactactttttgttatgcgtcaacttgccattgcgggaaatacatactcccggagccgtgcaagtgtcccgtaggactataagtagtaacagttttagtcctgaagtgttcgtgctgcccgttgacgtggaaaaagaaaatgcacatttctacgtggccgatatgatcatcagcgctatggagaagatgaaatgcaatatactgtcgcagcagcagaccgaatcctggtccaaggaggtaagcgggctgctgggctcagaccaaccagatagcgaaatgaccttcgatactaatatcaagcaagagtcgggttctagcacttcctcctatagtggttacgagggctgtgctgttctccaggtaagtcccgtcacagagactcgcacctatcatgacgtcaaagagatctgtaagtgcgatgtggacgaattcgtgatccttgagttgggcgattttaatgacatcacagaaacatgcagttgctcatgctcttcttccaagtctgtgacatatgagcccgattttaatagtgccgagctgctcgcgaaggagctatacagagttttccaaaagtgttggatcttgagcgttgtgaatagccagctggccggctccttgtcggctgccggcagtatagtcgtcaacgaggagtgcgtgcggaaggactttgagtcatccatgaatgtggtccaggaaataaagtttaagagccgcatacggggaaccgaagactgggctccgccacgcttccagattatttttaacattcatccacccctgaagcgagatttagttgtcgccgcacagaactttttttgtgccggctgtggcacgcccgtggaacccaagttcgttaagcggttgagatactgcgaatatctcggaaaatatttctgcgattgctgtcactcatacgcggagagttgcatccccgcacgcattctcatgatgtgggattttaagaagtattatgtgagcaacttttcaaaacagttactggactcaatctggcaccagccgatctttaacctgctgtccataggacagtcactgtacgccaaggccaaggaattggatcgcgtgaaggagattcaagagcagctattccatatcaagaagctccttaagacatgcaggttcgccaacagcgcactgaaagagtttgaacaggtaccaggtcatctcacagacgaactgcacttgtttagtttggaagacctcgtccggattaagaagggattgcttgccccccttctgaaggacatccttaaggcctccctggctcacgtggccggatgtgaactatgccaaggtaagggattcatctgcgagttttgccagaatacaactgtgatctttccattccagacagccacatgcagaaggtgttcagcttgtcgagcatgcttccacaagcagtgtttccagagcagcgagtgcccacgttgtgcacgcatcaccgcgagacgtaagctgcttgagagcgtggccagcgccgcgacatag

SEQ ID NO: 32371 - DNA, 366 bp, Artificial Sequence
  Description of Artificial Sequence: Synthetic coding sequence
atgcgacgatccttgaaaacatcacatttttctgaggagccttcaacctgtttgtttttaaaccaccggaatggctcgacagatcccacaatcatacttcatatcagtgagccaatgtttaacggagggaagcgcgaaatgcacggtaagcgaacccctcccttcctgctttcccttaaatttaaggacgtgtgctttggaatgccaagcctcttgccaattcatcggctgctgaagtcattgatctattcgaggcacatgtgtcttctgtgtccgaaatgcatcacctttctcctcgtgatggccgactttggttgcgtatgcgtgcgacatgcagtgaataacgagatgaaggcaattgcatag

SEQ ID NO: 32372 - DNA, 1518 bp, Artificial Sequence
  Description of Artificial Sequence: Synthetic coding sequence
aaatctgtccaaattcggactgaggccggcccaagactgcacatagaaccgccggtcgactattctgacgacttcgaactgtgtggggacgtcacacttcaggccaacaacacctcagaggacagaccccaggacactaagagtcctacgtcgacgaaaccatgtgggttcaatttttcccttctcaatgcgtgcggacacagtgacccatcctcttccgttgataaagaaagaattctcttaaccatacaggacgtaatggagcttcgccgttctctcgagctgtccgtgaacctgcagagaaagcagaaggattgctcttccgacgagtatgattccatagaggaggatattcttagtgagccagagccagaagatcctgcactagtcggccacccccgacatgatcggcccccaagctctggggactggactcagaaggatgtccatggggagcaggaaactgagggtaggagcagcccaggcccagatactttagttgtcctggaatttaaccctgcatcaaaatcccacaagagggaacgcaatctcagtgccaagcgcaaagacaatgccgaagtattcgtgccaacaaaaccagagccgaacctgacgccccaggcccctgccgtgtttccggaccaagagcgaatgtgtagccgaccagggtctcggcgagaaaggcctctcagcgccactaggaagactctgtgcgaagctgagtatccggaagaagatgcgagcgccgtcctgcaggctatccaggttgagaacgccgccctgcagcgggcattgctctcgcgcaaggccgagcaacctgcaagcccactccaggatgctgaaggcccccccgccaaaccgtggacgtcactgctagaagagaaagaagagaccctggaactgcttcctatcacaacagctacaactactcaggaaccggccggcgctgccggaggggctagagctatcaatcaagcgatggatcgcataggattgttagggagccgtcagcagcaaaaattgctgaaggttcttcaggccgtggagagcgactctgctcacttggggcgggtcgtctcccctacaaaggagcaagtgagtgataccgaagacaagcagcggatgcgtgccgatgagatcaaagacgcgatttatgtaaccatggagatcctgagcaactggggcaattcctggtgggtgggactcacggaggtcgagttcttcgacttaaacgatacgaagttatacgtgtctccacatgatgttgacatccggaatacagctacgccaggtgaactcggccggctggtgaatcggaatttagccggaaaaaaagatagctctccttggacctgcccctttcatccccctcttcaactattcttcgttatccggaacactcggcagctgggggatttccatctggcaaaaattaaagttaggaactattggactgcagatgggagtctgagcgcagcccaagccggcgtgcagtggcgggatcacgggtcactgtag

SEQ ID NO: 32373 - DNA, 612 bp, Artificial Sequence
  Description of Artificial Sequence: Synthetic coding sequence
aagccttatgcttgtaatgagtgtgtaaagtccttctgcgtgaagagttcgctcatcatccatcagcgaactcacacgggagagaagccttacaagtgtaatgagtatggaaagaccttccatcataagtcaacactaactgtacatcaaagaactcacggggaaaagccttacaaatgtaatgagtgccgcaagtcattttatatgaaaagccatctagcaaagcaccaccgaaagtacacaaagaaaccctatgaatgtaaacagtgcggcaagaccttccagaagagtcatctgatcgagcaccagaggacacatccaggagagatcccacatgaatgcaacaagtgcggtaagagcttctgttacaagtcccccttgaccatccaccagaggactcatatcgaggagaaaccctacaaatgctccaaatcagtcacgtatttctgcatgaaaagccacttgaccgtccaccagagaccacacaccaggaagaacccatttgagtgcaatgagtgtcgcaagatgttttacgtgaagagcaacctaatcaatcaccaacgaactcacactggggagaagccctacgagggcaatacctgcggcaagtag

SEQ ID NO: 32374 - DNA, 975 bp, Artificial Sequence
  Description of Artificial Sequence: Synthetic coding sequence
atggattgggacgatgaatatagccacaactctttcgacctgcattgcctcctgaattcattcccaggcgacctggagtttgagcagatattcagtgatatcgacgagaaaatcgagcaaaatgccgcaagtataaaacattgtattaaagagatccagagcgaaataaacaagcagtgcccgggtgttcagttacagactaccacagactgtttcgagtggctcactaactacaactactctaccagtgaaagcagctttatctcccatggggatctcattaaatttttcaagaccctccaagatctgctcaagaacgagcagaaccaggaagaaatgactttagacttgctctgggacctgtcctgccactcctcagtgtctttccctagcacactttctgggacatcattccattttctcagtcgcaccagtctgcactctgtggaagacaattcgtccatggatgtgaagagcatgtgggatgacatccgcttgcatctgaggagatttctcgttagtaagttgcaaagccacaacgagatcaacaacagccaacagaaaattttgctgaagaaacagtgccttcagcagctccttttcctgtacccagagtctgaggtgatcattaagtatcaaaatatccaaaacaagctcctcgccaatctcctgtggaactgctttccctcgtataaccgggacagcaatctggatgtcatcgctcacgggtatcagtccaccatgctcaaattgtacagcgtcatcaaagaggatttcaatactctgtgcgagatcttagctccctcgtccatggtgaaattcatcaaagaaacctacctggatactgttactgaagaaatggctaagtttcttgagaacttctgcgaactccaatttcgggagaacgccgtgagggtcgtgaagacaagcaagtcctcatccaagcaccgaggcgccgtccatgccttgggctag

SEQ ID NO: 32375 - DNA, 459 bp, Artificial Sequence
  Description of Artificial Sequence: Synthetic coding sequence
atgcccggcctggttttcttcaagtttgccaacctgggaggaggatggggttctcgtaaaatgctggagcccggtatgtgccccgccgagatgagcttaacacccttcgtgacccgttctctgaacctgctctgcttcagtgtgactcaccgagggcgaggcaaggataatccattacacttctttctccagctgttggctccatcggcttctgcctctctcggtctcggcagggagaccgggcccctcccttcaccgggactaagcccagggctgctgtccgaaaccttcgtcagcgagggccctctcctgacattacagatctcctggtgcggaacagagtgtctcatggacggtcaggggccgttaattcatctgcactcacagaacattcgcattagtttcggagcaacgcaacccccacttctgttggtgtacgagatccgctggaacagatag

SEQ ID NO: 32376 - DNA, 558 bp, Artificial Sequence
  Description of Artificial Sequence: Synthetic coding sequence
atgcatgggctctgcatggtgcctagcccccacgggcaccccggcatctccggtacctgttgcgcccccggacaggcccctgaccgacacccacttagcctctgcgcaccaacacctggacggaaaagacagcatcacctagtagcgtggcagccttgccccgcaccttcatgtctatggccacattggacacaacctccgagccgtgaagcctttgggtgcagggcaggcgcaggccgcgcccatccagtcgccggcgggacccaggagccctggcttcatctgtgttcaagacgcacatgtgggcagctgacacttcaacaggggtcggggccaaaatcactgacgcatcgggttctgagccccgaccgagccgtggattcatttccgtttcatcccggcacgtgttggcaggaactgcccggtccacatcccggggccgccacacctgcaccccccgcgactcccgggcacgagaaagtgcaaaattcatctggccctagtcacaacttcttggagctgagggactctttcttatctacaaacggagttaggtag

SEQ ID NO: 32377 - DNA, 3003 bp, Artificial Sequence
  Description of Artificial Sequence: Synthetic coding sequence
atgccgggcaagttgaaagtgaagatcgtggcagggcgccacttacctgttatggatagggcgtctgatctgacggatgcatttgtggaagtcaaattcggaaatactacatttaagacagatgtgtacctgaaaagcctcaatcctcagtggaatagcgagtggttcaaattcgaggtggacgacgaggatcttcaagacgaacccctgcagatcacggtcctggaccatgacacctactccgccaatgatgctatagggaaagtttacattgatattgatcctctgttgtattcagaggccgctaccgtcattagcggctggttccctatctacgacacgattcacggaatcaggggggaaatcaatgttgtcgtgaaggtcgatctcttcaatgacctgaatagattcagacaatccagctgcggcgtcaagtttttctgcaccaccagcatcccaaaatgctacagagccgtgattatccacggcttcgtggaagagctggtagttaacgaggatcctgaatatcaatggatcgaccgtatcagaacaccgcgggcgtcaaatgaggcaaggcagcggctcatttctctgatgagcggtgagttgcaacgaaagattggccttaaggtcctggaaatgaggggcaacgccgtggtcggatacctgcaatgttttgatctcgagggcgagtctggtcttgtggtcagggcaatcggcacagcgtgtacattggacaagttgagttctcctgcagcctttcttcccgcttgtaatagtccctccaaggagatgaaggagataccctttaatgaggaccccaatcctaatacccactcgagcgggcctagtaccccattaaaaaaccagacatacagtttttcaccatccaaatcctattcccgacagtcctccagctctgacaccgacctgtctctgactcccaagaccggtatgggttcagggagcgcgggtaaggaaggtgggccgttcaaggccctcctcaggcagcagacacagtctgctctcgaacaacgggaattcccgttctttaccctcactgcgttcccaccggggtttttagtccacgtgggaggggtggtgtcagctcgcagcgtcaagctgctcgacaggattcataatcctgacgagcccgagacacgagatgcatggtgggcagagatccgccaggagattaaatcgcacgctaaggctctaggatgccatgccgttgtggggtatagcgagagtacaagtatttgtgaggaggtttgcattctatccgcctctggcactgctgcggtgctgaaccctagatttctccaggatgggacagtggaagggtgcttggaacagcgtttagaggaaaatctacccactcggtgtggtttctgtcacataccttatgacgaactgaatatgcccttcccagcacacttaacctattgctacaactgccgtaagcagaaagtgccggacgttctgtttacgactatcgatctgccaaccgatgcaaccgtgatcggcaagggctgcctgatacaagccaggctgtgtaggctgaagaaaaaggctcaggcagaagctaacgcaacagctatatccaacctgctgcccttcatggagtatgaggtgcatactcaactcatgaataaactcaaattgaagggaatgaacgcactgttcggtcttagaattcagatcacagtgggcgagaatatgctaatgggtctggcaagtgccactggagtttacctggccgccctgcctacgccaggtgggatacagatcgcaggtaaaacccctaacgacggctcgtacgaacagcacattagccacatgcagaaaaaaatcaacgacaccattgctaagaataaggaattgtacgagatcaaccccccggagattagtgaagagattattggctctcccatacctgagccgcggcagcggagccgactgctccgctcccaatctgaaagctccgacgaggtcacagaactggacctgagtcatggcaaaaaggatgcatttgtactggagattgatgacacagacgccatggaagatgtccatagccttttgaccgatgtgccgcccccatccggtttctattcatgtaatactgagatcatgccaggcatcaataattggacctctgagatccagatgttcacaagtgtgagggtgatcagacttagcagtttaaatctgaccaaccaggccctcaataaaaatttcaatgacctgtgcgaaaacctgttgaagagcctttacttcaagctgcggtcaatgatcccttgttgcctgtgccacgtgaattttaccgttagcctccctgaggacgaactgatacaagtcactgtgacagccgtcgccatcaccttcgataagaatcaggcactgcagaccacaaaaacacccgtggaaaagtctctccagcgtgcgtctaccgacaatgaagagctgctgcaattccctctcgaactgtgtagcgactcactgccaagtcatccctttcctcccgccaaagctatgactgtggaaaaggcatcgccggtgggggatgggaatttcaggaatcggagtgcccctccttgcgctaattccaccgtcggagtcgtgaaaatgacacctctgtcctttatcccgggtgctaagattacaaaatacctgggcatcattaacatgttttttatacgggagaccacatccctccgtgaggaaggtggagtctctggatttcttcatgccttcatcgcagaagtgttcgctatggtacgagcccatgtagccgccctgggaggcaacgccgtcgtttcctacatcatgaagcagtgtgtttttatggagaatccaaataaaaaccaggcacagtgtctgatcaatgtgagcggtgacgctgtggtgtttgtgagagaaagtgaccttgaggtggtaagctcccagcagccaacaacaaattgccagtcatcctgtacggaaggcgaagtgaccacctag

SEQ ID NO: 32378 - DNA, 1215 bp, Artificial Sequence
  Description of Artificial Sequence: Synthetic coding sequence
atgttacgcgccattgcagaggaacggggccgactctccctccggcgcgaggtttgcggactgggatgctttaaggatgatcggatcgttttctggacatggatgttcagcacatactttatggaaaagtgggcaccccgccaagacgatatgctgttctacgttcgtcgaaaacttgcatattctggcagtgaatcgggggccgatggccgtaaggccgctgagcctgaggtcgaagttgaagtgtataggagagatagtaaaaaactgcccggcctaggggacccagatattgactgggaagaatcagtgtgcctcaacctgattctgcagaaactggattacatggtgacttgtgccgtgtgcacccgggcggatgggggcgacatccatatccataagaaaaagagtcaacaggtgtttgcgagccccagcaaacatcctatggactcaaagggcgaggagagcaaaatatcataccctaatatcttcttcatgatagactccttcgaagaggtgttttccgacatgactgtgggcgagggagagatggtctgcgtagagctggtagcttccgacaagaccaacactttccagggagtaatcttccagggatcaatcaggtacgaggcgctgaaaaaggtctacgataatagagttagcgttgccgctcgcatggcccagaaaatgtccttcggcttttataaatactctaatatggaattcgtacggatgaaaggccctcagggaaagggccacgcagagatggcggtgagtcgtgtgagcaccggtgacactagcccctgtggcactgaggaggattcctcccctgcttccccaatgcacgagcgagtgacctcgttcagcactccccccacacccgaaagaaacaatcgaccagccttcttcagcccctctctgaaacggaaagtgcctaggaaccggatcgcagagatgaagaagtctcacagcgctaacgattccgaagagtttttcagagaggacgatgggggggcagacctacataacgctaccaatctgaggtccaggagcctgagcgggaccggcagaagcttagttggcagctggctgaaactgaatcgggcagatggaaacttcctcctttacgcacacttaacttatgtaaccctcccgctccacagaattctgaccgacattctcgaggtccgccaaaagcctatcctgatgacatag

SEQ ID NO: 32379 - DNA, 2151 bp, Artificial Sequence
  Description of Artificial Sequence: Synthetic coding sequence
atggaagactgtttacacacttccagcgagaatctgtcaaagctggtgagctgggcacacagccatggcactatttgttcattgatcccaaacctgaagcacttactgagcgagggcagccatggaaacctcacggccatgtgggggtgttctgccggccatgcctaccactggccacttaccgccacgtgccgggctgggagtcaggagcgagtgtgctttcaggataaccgatcatttaacagcgattcaccctctatcattggtgtgccctctgagacacagactagtcccgtcgagcgctatcctggtcgacccgtcaaagcaaagctggattgcaacaggacacgtgattcgtgtgatttctcttattgtagcgagccgtcagaactggatgaaaccgtcgaggaatacgaagatgaaaataccttgtttgacatggtgtgcgagtcgtccgtgactgatgaagattctgattttgagccccagacgcagcgccctcagtctatcgccagaaagaggcccggcgtggttccttcgtctctgcacagttcaagccagacccagatggttgatgagtgtagtaatgatgtgatcattaagaaaatcaagcaggagattcccgaagactattacatcgtggctaacgcggaactgacaggcggcgtggatggccctgccctcagcctcacgcagatggctaaacccaagccccagactcacgctggtccctcttgcgtaggttccgccaaactgattcctcatgtcacgtccgccatctcgacagagctggatccacacggtatgtccgctagcccatcagtaatttctcgcccaatcgtgcagaagaccgcacgagtgtcattagctagcccgaaccgtggccctccgggtacgcacgggacgaaccaacaggtggccatgcaaatgcctgtcagcactagccaccccaacaaacagatttcgatccctctaagcgcgctgcagctgcccggccaggatgaacaggtagccagcgaggaatttctgtcacacctgccctcacaagtctcctcctgcgaggtggccctgtcgccaagtgtgaatactgagccagaggtgtccagtagccagcagcaaccgccagtggcccctgctattaccaccgaggcaaccgcacagtgtattccggcttactctaccaagttaaacaagttccccgtgttcaatatcaatgatgacttgaatgacctgtgtacgtctgcagtgtctcccaacaccactaaagcgaccagatacgctttgaacgtctggagatactggtgtatgaccaacgggttaaaggatcacactgatatcacaaaaatccccgccgtgaagcttaacgaacttctggaaaacttttatgtcacggtgaaaaagtctgacggatcagatttcttggctacgagcttgcatgcgatccggcgaggccttgatagaattctcaagaatgccggggtgggcttttccataacctcgtccacattttcctcttcaacaaagaaactgaaggaaaagctgtgggtgttaagtaaggcgggtatgagtggggctaggtcgcggaacatcgtctattttagcctatcagacgaggaggagatgtggcaagccgggtgcctgggggacgatagccccattacattgctgagcaccgttgtgaagtacaatagtcaatatcttaacatgagaaccctccaggagcacgcggatctcatgtacggggacatcgaactgctgaaggatccccagaatcagccttactttgccaggactgatagcgtgaagcgggagtctaggtccgggtccactagggtgtgccatggaaaaatttaccacgagcactcacggggccacaagcagtgcccatattgtctcctctacaagtatatgtacattcataggccacccacacagatggaggcgaaatctccattctacttgaccgcccggaaggaagcaaccgatatgggatctgtgtggtatgaagagcagagaatgggcctaagaagtctgagaggtatcgtccccaatctcgcaaagaaggtcaaattggaaaattgcgagaacttcacattcgtttctttcactcaggtgtcccggcggctgggctcccatagctgttgccagtag

SEQ ID NO: 32380 - DNA, 1605 bp, Artificial Sequence
  Description of Artificial Sequence: Synthetic coding sequence
atgaggaggcactctgagactgatgtagaggaacagacccaggagcttaaaaccataacacagctgcaggagcaatgccgggccctgcagattcagggcgtgaaggaaaatatggaccagaacaaggccacactggctttactgcggtctaacatacgcagaggcgcccaggactgggcccttgccaaaaagtatgaccaatggacaatctccaaagcctgtggaaaaaacctgcctttgcgcctggcacactgtcgatccacaatggaggtagtgagggagaagctccgcaagtatgtattcgaccgggtaaatatgcacaatctgctaatccatctagtcagaagacgagggcaaaagctggaaagcatgcagcttgaacttgatagcttgcggtctcaacctgatgccagcaaagaagagttgaggctcctgcagatcattcggcagttagaaaacaacattgagaagacaatgatcaagatcatcactagccaaaatattcacttgctgtacctggaccttctggactacttgaagacagttttggcgggctatccaattgagctcgacaaactccagaacctggtggtgaattactgctctgaactttctgacatgaagattatgagtcaagacgcgatgatgatcaccgatgaggtgaagagaaatatgagacagagagaagcaagtttcatagaggaaagacgcgcccgggagaatcgcttaaaccagcagaagaagctcatcgataaaatccacacaaaagagacatctgagaagtataggaggggacagatggaccttgattttccctctaatctcatgtccacggagacccttaagttgcgcagaaaggaaacctctacagccgagatggagtaccagtcaggggttaccgctgtcgtcgagaaggtgaagtccgcggtgcgttgcagtcatgtgtgggacatcacaagcagattcttagcccagagaaacaccgaagaaaacttggagcttcagatggaagactgtgaggaatggcgagtgcaactgaaagctctggtgaagcagctggaactagaagaagccgtactgaaattccgccagaaaccctccagcatttcatttaagtctgtcgaaaagaagatgaccgatatgctgaaagaggaggaagaaagacttcagttagcacacagcaatatgaccaaggggcaggaactgttgctgacaattcagatgggtattgataatttatacgtgaggctaatgggtatcaacctgcctgccactcagcgagaagtagtacttagtaatactcttgatctgaattctaaactcgcctattgtgaaggaaaactcacatacctggccgatcgggttcagatggtttctcgtaccgaagagggggatacgaaggtcagggatacactggaatcaagtaccctgatggaaaaatacaacactcgtatatcatttgagaacagggaagaagatatgatcgacacctttcaattccccgatatggaccactcctacgtaccctcccgggccgagatcaagcgccaggcccagcggctgattgagggaaaactcaaagcggccaagaagaagaagaagtag

SEQ ID NO: 32381 - DNA, 5520 bp, Artificial Sequence
  Description of Artificial Sequence: Synthetic coding sequence
atgtatcacatcgactgccgggaccagctggaacgtgtattcctccggctcggacatgccgagactgacgagcagctccaaaacataattagcaagttcctgccccccgttctcctgaaactgtcatcaacacaagagggggttcgaaaaaaggtgatggagctccttgtgcatcttaacaagcgaattaagtcacgacccaagattcagctgcctgtggagaccctgctggttcagtatcaggacccggcagccgtgtcatttgtcaccaatttcacaattatctatgtcaagatggggtatcctcggttgccggtggaaaagcaatgcgaattagctcctaccctcttaactgcaatggagggtaaacctcagccccagcaggatagtctcatgcatcttttaattcctaccctgttccacatgaagtaccccgtggagtcaagcaagagcgcatccccttttaatcttgccgagaaacctaagacagtacagctgctactcgatttcatgttagacgttctgttgatgccatacggatatgttctaaatgaaagccagagtagacaaaatagctcatcggcccaaggcagttcaagcaactcgggcggagggagcggcatccctcagcccccccccgggatgtctttctacgctgccaagcgagtgattggggacaatccatggacgccggagcagctggaacagtgtaaacttgggattgtgaaatttatagaagctgaacaggtgcccgagctggaggcagttttgcacttagttatcgccagcagtgatactcgacactcagtcgcaaccgccgccgatctggagttaaagtccaagcagtccctaattgactggaacaatcccgctatcatcaataagatgtacaaagtttacctaggcgatatcccgctgaaaaccaaggagggtgcggtcctgaaaccggaactcaagagggacccggtctctacgagagtcaaactaaaaattgtgcctcatctgctgcgcagccgccaggctgcggaaacattccccgcgaatatacaggtggtgtacgatggcctctttggtacaaacactaatagcaagctccgtaccttgtccctgcaatttgtgcatcacatctgcatcacttgccctgagattaaaatcaaacccctaggtccaatgttgctgaatgggctgaccaagctgattaacgaatacaaagaggaccctaaactcctgagtatggcctactccgctgttggaaagctgtcttctcggatgccacacctgtttaccaaagacatcgctctcgtgcagcagctatttgaagccctgtgtaaagaagagcctgagactaggttagcaattcaagaggctctttcaatgatggtaggagcatactctaccctggaaggagctcaacggacgctcatggaagccttggtggccagttatctcattaagcctgaagtacaggtgaggcaggtggcagtgaaattcgcttcaaccgttttcccttccgaccatatacctagcaggtacttgctgctgttggccgccggcgatccgagggaagaagtgcatggagaagcgcagcgagttctgcgttgccttcctggacgaaatagaaaggaaagtacatccgaacagatgcctagtttcccagagatggtttattatattcaggagaaggcctcacacagaatgaagacaccggtaaagtacatgactgggaccacagtcttgccattcaaccccgcagcctttggcgagatcgtgctttacctgagaatgtgcctggcacactcggcaggggtggtgcccaccagtcagtccctcgctgatatgcaggaccatgccccagccatcgggcggtatattcgtacactcatgagctctggccaaatggctccctcctcatctaataagtctggagagacgaacccagtacagatctacattggactgctgcaacagctgctagccggcgtgggggggttgccagtgatgtactgcctgctcgaagccgtctccgtgtaccctgaaaagctcgctactaaatttgtggataagacagagtggattaagtctctcatgaacaattcaaaagaagagatgcgggaacttgccgccctattttacagcgtcgtcgtctccactgtctccggaaacgagctgaaatccatgattgagcaactgattaagacaacgaaagataatcacagccctgaaatccaacatggatcgctcctagcgctgggcttcaccgtcggtcggtatctcgctaagaagaagatgcgcatgagcgagcagcaagatctggaaaggaacgcggataccctgccagaccaggaagaactgattcagtccgccacggaaacaatcgggagtttcctcgattcaacgtcccctttattagccatcgcagcatgcacagcccttggcgagatcggtcgcaatgggcccctgcccatcccctccgaagggtccggattcaccaagcttcatctggtagagtcactcctttccaggattccaagctcaaaagagaccaacaagatgaaagaacgggccatccaaacacttgggtatttcccagttggcgatggtgatttcccgcaccagaaacttcttctgcagggcttgatggatagcgtcgaagcaaaacagatcgagttgcaattcaccataggagaggctatcacttctgccgctattggcacgagttctgttgcagcccgcgatgcctggcaaatgacagaagaagaatacactcctcccgcgggtgcaaaagttaacgacgtagtaccctgggtgctcgacgtaatccttaacaaacacatcatcagccccaacccgcacgtccggcaggccgcctgcatctggctgctcagtttggtaaggaaactgagtacacacaaggaagtcaagagccacttgaaggagatacaaagtgctttcgtttctgttctaagcgagaacgacgagctcagtcaagacgttgcctctaaaggcctgggcctggtgtacgagttagggaacgaacaagaccagcaggaactggtaagcacattggtggaaacactgatgaccgggaaaagagtaaaacacgaggtcagcggcgaaactgtggtgttccaggggggagctttaggaaagacccccgatgggcaggggctgtccacctataaggagttgtgctccctggcttccgacctctcgcagcccgatttggtctataaattcatgaacctggccaaccaccacgccatgtggaattcccggaagggcgcagccttcggcttcaacgtgatcgccactagggcaggcgaacagctcgccccttttttaccacagttagtccctagattgtaccggtaccagtttgacccaaacctgggcattagacaggctatgacatcaatatggaatgccctggtcaccgacaaatcaatggtggataaatacctaaaagaaattcttcaggatctcgtgaaaaatcttacaagcaatatgtggcgcgtaagggaatcatcctgcctcgctctgaacgacctgttgcgagggcggcccttggacgatattatcgacaaattaccagagatttgggaaacactcttcagagttcaggatgatatcaaagaatccgtgcggaaggcggctgagctggctctgaagacattgtcaaaggtgtgcgtgaagatgtgtgatccagcaaaaggtgcggcggggcagcggactatagctgccctcctgccctgtcttctggataaaggaatgatgtccacagtcactgaggtacgggccctcagtattaacaccctcgtgaagatctcaaaaagtgcgggagccatgttgaaacctcatgcccctaagcttatccccgcacttctcgaaagtcttagtgtccttgagccacaggtcctgaattatctctccttgcgggccacggaacaggaaaaggctgctatggacagcgcacgactgtccgccgctaagtccagtcccatgatggaaactataaacatgtgtctgcagtatctggatgtcagtgtcttaggagagcttgtacctcggctttgtgagctgatcaggtccggtgtggggctgggtactaagggcggatgcgcatctgttatcgtgtccctgaccactcagtgcccccaggatttaaccccatattcagggaaactgatgtccgccctactcagcggattgaccgacagaaacagtgtaatccaaaaaagctgtgcattcgccatgggacacctggtccgcacttctcgcgacagctcgacagagaaactgctacagaagctgaatggctggtacatggaaaaagaggagcctatatacaaaaccagctgcgcgctgaccatccatgcaatcggcaggtactcccccgatgtactgaaaaaccatgctaaggaggtcttacctcttgccttcctcgggatgcatgagatcgccgacgaagaaaaatcggaaaaggaggagtgtaatctgtggaccgaggtttggcaggagaacgtgccaggaagctttggcggcattcgactatatcttcaagaactcatcaccatcacccaaaaagccctgcaatcccagtcgtggaagatgaaggcacagggggcaattgccatggcttctatcgctaagcagacaagcagcctggtgcccccatacctggggatgatactcaccgccctgctgcaaggcctggcgggtcgcacttgggcagggaaagaggaactgttgaaggccatcgcctgtgtggtgaccgcatgttccgccgagctcgagaaaagtgtgccaaatcagcccagcacaaacgagatcctccaggctgtgctcaaagagtgcagtaaagaaaacgtaaagtataaaatcgtggctatctcatgcgctgcagatattctgaaggcaacaaaagaggatagattccaggaatttagcaacatcgtaattcctttaattaagaagaattctctggaatctagcggagttagaaccacaaagaacgaggaggagaacgagaaggagaaagagttgcagctcgagtacctcctgggagccttcgaaagtttgggaaaggcctggccacgtaacgccgagacccagcggtgctatagacaggagctctgtaagctcatgtgcgagcgcctgaagctgtctacctggaaggtgcagttaggtgttctccagtcaatgaatgccttttttcagggcctaatgttactggaagaagagcacgccgaccctgaagcacttgccgaaatcctgcttgagacatgcaaatcaataacatatagcctggaaaataaaacatacagcagtgttagaaccgaggctttgtctgtgattgaactgttgctgaagaagctcgaagaaagtaaacagtgggagtgcctaacctctgagtgccgcgtcctgctgatcgaaagcttggctacaatggaaccagactcacgccccgagctccaagagaaggcagccctgctgaaaaaaactttggaaaaccttgaatag

SEQ ID NO: 32382 - DNA, 1524 bp, Artificial Sequence
  Description of Artificial Sequence: Synthetic coding sequence
atggtggccactggctgggctcgtcgctccggactgcaccccgctccacgccccctcaggggagcccaggaagcccttgcgaagaatctctggcgggaagagcggaatcggcccctcattctgtcctcactaatcatcaagaaactccactggccggaacaggagcttgctaagaagtcaattttgaacgcagaagactcgttgataatcgataataaaagaagcatctctcacctttcttctggagtgctgaaagacatcttcaccaccggaacatctagttacaatgtgctgctgcagtcaaaagaagagaagaagtaccactcacagaagcagtcatcttctacctatagtaagaggtgtcgcaagcccagcaagtcacccaacacctctcggtctaaagatccgagacgaatgaaggcactggtgcccgtgacctcttctggaacctggtattgtctggagcgcaggccagcagtattcgttacaagcagtgtgtcttctcctgttaaatttactcacgacatatccgttaccgggaatggaattgtgctgccacctaaaccgaagtcaaaggtaaaatggtgccacttctcaactctccccaagcctaaaccacagctgtctcgctcttttgaaaagggcgatgatttcagcgggaagaagttttgtattctgacagctatcaagcccaccaacctggagaaagaaaaactgcgattttttaaaagtgactacacctacaatccacagttcgagtacgcaaatccggcactcccaagcgtgcttgccaagcatagtcatgccagcgatcgctttctcaagcagatcgtggtgcacctgacggaagatctcctctcgcgggcgagtatgacagtcgtgaatgggtgccctacacttacaattaatgtgagcactgccagggagcattggttggaaggaatgctcaggcacgaaatcgggacgcactattttcggggaattaataaccttcaacagccatggaactcctggacgggtcgtaagaagcatgagctcaagcctaataacccaaccgaggaaggtctggcaagtatccatagcgttctattcaggaaagatcccttcctatggcgcgccgcattgctttactacaccgtctatcaggcttcgcaaatgtccttttgcgaactgttcaaggacattgggcggtttgtaaaggatcctaacactcggtgggattattgcgtgcgggcaaaaagaggatggacagacactagccagcccggatgctttagcaaggaccaggtgtatttggatggcatacttcagattttgaggtatagagatactattgacttccacctgctgacggcgttgggaaaagtttcttatgaggacgtcgaccgcctgaagggactagctgtcactgaaaacatgcgcgtgcctcacttcctgcaagatcacggaaggtacatggagcacctagagaagatcatggaggttaacgaactcaccgatcgggagctgaaggatctgatctag

SEQ ID NO: 32383 - DNA, 576 bp, Artificial Sequence
  Description of Artificial Sequence: Synthetic coding sequence
cagtccgggtttatggatttgcccaaggaaaaagtcggcagaaaagagcaggtcgagaaactagaactcggcttcattcagctgtctggggctactgacgggatgagggaatatatcactgaatatgagtcccagggagccgtgcctaacacaagacaccaggagaaagaagacattatcagactcgcacagaaagaggaggaaatgaaagtgaagctgcttgagttacaggagctcgtactgccattggtcggagatcatgaaggccatggcaaatttctgaccgctgcgcagaacccagctgatgagcccgcccccggcgcacccgctccccaagagctgggagctgcagacgagcagggggacttttacgaggtatcccttgacgacagcgaggagccagctccaggagcagctggcgaaggatctccacacgacaaccctacagctcaacagatcgtgcagctaccccccgttatgcaagatacccaggagcatcccggattaccagggaatccttgcgtgtccttcttttaccaggctgctgaaaatcgggaaatcaatatcattatctag

SEQ ID NO: 32384 - DNA, 375 bp, Artificial Sequence
  Description of Artificial Sequence: Synthetic coding sequence
atggaacatatgttactggcgaaccacacagacaaagcaaccttcaccggaacccagagacaaagatcttgcagtggtgccagtgtcagtcagccgagaccgttgaggggtaagctagtgggatattgggatcctcacagtcgacttttgtcaagaggcagagctttgggcagtgtttcagcacctagtactccgcgtggcagaggctggaaggccacatttgacggttgcatcctgcatgacgacctgctgaccaaagtacacgggttccaaagtttgatcggactacagcaacacctggcttgtggggactctgggtctctgatgaaaaactgccatgatggcaaccgaaataaccaacgcaaactgccatag

SEQ ID NO: 32385 - DNA, 1371 bp, Artificial Sequence
  Description of Artificial Sequence: Synthetic coding sequence
atggggaattccagaagtcgcgtgggccgctccttctgttctcaattcttgccagaagagcaggccgaaatagaccagctattcgatgccctaagctccgacaaaaactcacccaacgtgtcgtccaaaagtttctctctgaaagccctccagaatcacgttggggaggccctaccccccgagatggtcacccgactatatgatggtatgcgtcgggtcgatttgacaggaaaggctaaaggaccttcagaaaacgtgtctcaggagcaatttacagcaagtatgagccacctgctgaaggggaactcagaggagaagtcactgatgatcatgaaaatgatttccgcaacagagggacccgttaaagctcgcgaggtgcagaaatttaccgaagacctggtggggtccgtagttcacgtgctttcacaccgtcaggaactgcgggggtggactggaaaagaggcacctggccccaaccccagggttcaggtactggcagcccaattgcttagcgatatgaagctccaggatggcaaaagactcctgggtccacagtggctggattatgactgcgaccgggcggtcatagaagattgggtgtttcgcgtgccacacgtcgccattttcttgagcgtcgtgatctgtaaggggttcttgatcctgtgtagctcccttgacctgacgactcttgtgcccgagcgtcaggtcgaccaaggaaggggttttgaatcaatcctcgacgttctaagcgtgatgtatatcaatgcacagcttccccgggagcagcggcacagatggtgtttgcttttttcgtccgaactgcacggacatagcttctcccagctctgcggccacatcacacaccgcggtccatgtgtcgccgtgctcgaggatcacgataagcacgtcttcggcggctttgcgagttgcagttgggaagtgaagccccaattccagggagacaacaggtgcttcttgttctcaatctgtccgagtatggcagtgtacactcacactggctataacgaccactatatgtacttgaaccatggacagcagaccattccaaacgggcttggcatgggcgggcagcacaactattttgggctgtgggtggatgttgacttcggtaagggccatagccgcgccaaaccgacttgtactacctataactcccctcagctcagcgcccaggagaactttcaattcgacaagatggaggtgtgggctgtaggtgatccttcagaggagcagctggccaaaggcaacaagtcaattttggatgccgatcccgaagcccaggctttactggaaataagcggacacagcaggcattccgaaggtctcagagaggtgccagacgatgaatag

SEQ ID NO: 32386 - DNA, 438 bp, Artificial Sequence
  Description of Artificial Sequence: Synthetic coding sequence
atgggtccatggccacgggattggctggggaagggctggcgtttaggaagctgcgaggcccgggctggcgccaaagaagtttctgtgatccgccatggcgctcccaaccctgcacaatcacacttacacgtacaggctcgcgcccaggtgcactccgaggatgggcattcccttccccctgtggtagacggtgaggatgaagtgcttagtctgttggtattcgtccaggactctcaagagtgctgtcggcaagccgtccaagggaggcagggtcggggtgtgacgtggggcctgggactgccctcatatcatctcagaacattgctgtcaccggtgtgcgtgcccgctcgggaccagcgggcacccaggaaatgctgtgaggcagtcttggcctgcccactggtcgaaaccctcgtgacaaccttactgactcgatag

SEQ ID NO: 32387 - DNA, 1653 bp, Artificial Sequence
  Description of Artificial Sequence: Synthetic coding sequence
atgggctggagtgacctccagccagctatgggaggcgaagccgagcggttccaggcccagttagaggtgaagttggttacggggggcagccctgtggtctttaccggtaaccttactaggcaggtgggttcgaagctggccttttcagcctctctgagtcacctgctgagcgaccaggctaatgtaacagctctgctggaacgtaaagaagagaacggacggagagttgctgcactcggagcagagttgttcgtgccaggattggtcggattgagggcattgggcctgttgcagcaaagaggacagctgtggactaatagcctgagaatccagtatagcttgctggggcaggctaaacaggctgcacacgaatgttccacatcccagaaactccgagcagattccggctcagacggcgcctataggctggaactgcgccatgagctgcattgtacacagatacttgccttttctcacaaggttcagctgtggcacgaggaggacagtggccacctccactctcagctcgaggtatcctacggcaaacactgggataagaacagcaacaaaagacacctacgcgtttctcagaccttcaagaatgattccggtccagccttgagcaaccacttcatggagtttgtgctgcaggtaccagagaggcaggttgattgtagggtccagctctatcacctctcattgcgccttccctacgttgaatcgagcagtcaccttaaggtgcagtataatgggcggcccctttttgttgccggggggcagtggaaggacacgtctagggctacgttgtggaagtgggaaggcgctctgaatctggactctccttggctgatggtaagcgcggcgcatagactctactggcctcaccgggccgtgttccaggctgtgcttgagttaacgcttgggaaggcatggacgctgaaagacttggtagtgtcagtgggatgcaggagtcagggcccgaatagagagggtaagatccaagtgtacactgccgccacaacttacctgcgagtcagtactgtcactgtcctcgcacagagcttatttcattcttggtccgagcttgaatctgcttggaacgccgctgtccagggagaaattcacgcagagaatagcagggacaggaagatactgaattgttggcttaaggggccacagcaggaactgaatctgaccgccgcgtacaggcatttggagtggccccggaagactcaagtttccctgactgccgtaaggattggggcacaaggacagccaagaggactgcagctagagggcgaactagaagaacttaggcaggaccgcaccctgtatagaaagcgcggcgccctcttgctcaggcatcctctccacttgccgattccacagtctttgttactacaagaaactttcaccgcagatagaagacaccagcgatactctctggagaccagggtggtactcaatggccgggaggagacactccagactatggtattgggctgtcaggctgggcacccgtacgtctgtgcaggcctcatgcacccgtacgacggcaaggtaatccccaggaataccgaaggctgtttggtgacatggaaccagcacacatcactcacactgcttagtcggttggagagtggagttcagtag

SEQ ID NO: 32388 - DNA, 411 bp, Artificial Sequence
  Description of Artificial Sequence: Synthetic coding sequence
cgcagcagaacaggcccggtctcccttcagggtgacccaaagcaggcgccgtggagctcttcacagtcgaacagctccaggaagacactgtttctgtccctctgccctccttttcctacccagcctcaaattcatctgcatttcaccgagcatcgggcctcgtcacaccaggggggaccattcaagctgcaaatatgtctaagctcactgtattcaaacctgttgctgcattgtcactaccgcgaggtgcatcacatgagcgggcataggacggaaagcgccggcggccacctgttcctacctcaagatcttagatggaaaagccctgggctcggtgtttttgctgtgcagtctgtgtacgaacttgctagaaggcataatgtttctccattctattccggtcccccctag

SEQ ID NO: 32389 - DNA, 372 bp, Artificial Sequence
  Description of Artificial Sequence: Synthetic coding sequence
atggccctgctcgcgagcaacggctgcttcataaggtgcaacgaggccggcgatatcgaagccaaaagtaagaccgcaggcgaggaggagatgattaaaatcagatcttgtgccgagcgtgagaccaaaaaaaaagatgacatcccggaggaagacaaagggaatgttaagcaatgcgaaattaattacgtgaagaagtttcaatcattccaggagcacaagttgaaaatttctaaagaggattccaagattcttaaaaaggcccaaaaggatggctttttgcaggagacactgctggacagtctgggatatgagcatcgttggaagcgctggctgttgtactggatcaaggacatgtctagagacggctag

SEQ ID NO: 32390 - DNA, 291 bp, Artificial Sequence
  Description of Artificial Sequence: Synthetic coding sequence
gaagtccagctggtcgaaagtggcggaggtctcgtgcagcctggaggatcactgcgactgtcgtgcgcggctagcggcttcactttctctaaccattacactagctgggtgcgacaggcccccggcaaggggttggaatgggtttcctatagtagtggaaacagtggctacactaattacgcagactcggtcaaagggagatttacaatatcgagagataacgcaaagaacagcttatatttacagatgaactctcttagggccgaagacactgccgtgtattattgttag

SEQ ID NO: 32391 - DNA, 438 bp, Artificial Sequence
  Description of Artificial Sequence: Synthetic coding sequence
ggggagagcgaggatgtgacgcaatttttacaatcccataagaaaaccttgaccaacgagaaactgtttctcatggacggtaagcgaacctggttcttggaaatggagtccacccctggagaagacgcaatgaacacagtgaagatgacaacaaaagaccttaagtacgaccgctcactcatcgataaggcggggttcgagcgcaccgactcaaatttcgaaaggtcacacactgttggtaaaatgctcagcaatagtattatgtgttaccgggacatcttttacgagagggaatcccagctgatgcagcagacatcacttttgtcctacgagattgctattgccacccctaccttcagtaactattatccagactggagtgccccaataaatattgtggccagaccctccacatcgaagaagataatgacatgctag

SEQ ID NO: 32392 - DNA, 396 bp, Artificial Sequence
  Description of Artificial Sequence: Synthetic coding sequence
atgagaaagccacggcgggccggctgggagacactgagcagaaaagcgcccggcccatcggccggacttcgtccatcgcccgcgacatgcgatacgtgtcacttcccgattctgggagacgggaaggccacactccccttcgcaccaggtaaaacctcccgggtgccctcggacagcggtgtgttctcctcagatccacgcgcgaactggtcctccatcagaaactttcctagcgcaaaatgcgttggaatcgagttgcatgagtccttgagcacaagcgcagagtggctactgcgcggccgcggcggggcgctgccttggattgtgcggtgcctggctgccactgaccttctgctgcccgggaaaaagggtgtggagagctgtccagttggctag

SEQ ID NO: 32393 - DNA, 291 bp, Artificial Sequence
  Description of Artificial Sequence: Synthetic coding sequence
gaggtgcagcttgttgaaagcggtggcgggttagtgcagccaggagggagcctgcgactgtcctgcgcagctagcggcttcaccttctcgaacagatcgacgcactgggttagacaggctccgggaaaaggtctggaatgggtcggccacagtgtatctaaaaagaaaaagaaaaagaagaaaaagaaaaagaagggccgctttactatcagtcgagacgactccaagaatactctttacttgcaaatgaactccctgaagacagaagacactgccgtctattattgttag

SEQ ID NO: 32394 - DNA, 387 bp, Artificial Sequence
  Description of Artificial Sequence: Synthetic coding sequence
atgtactgccaggactccaatatctgcgctgtctttgcggttcaaggtgggaaggtggggcgaaaacacggaattaaaagagggagacggccctccataaggtctcccgcccagagagcgagaggcccctggatacatgaaagcaaacatccagctttcgcgaagcagcagataaaccttgagatgcccaatagccgcgctaccacagagttagcctgggtgtgttctagtacttcacgcaagaagaagtgggcaagatccctgacattgtccaccgcaccactttctccccctccttccttggtacactgcgaagattgcagttgcctccctggctgccacagtggtgacctgtacaatcttgctcctgcagagagaacatgttag

SEQ ID NO: 32395 - DNA, 2157 bp, Artificial Sequence
  Description of Artificial Sequence: Synthetic coding sequence
atgtcaagagggtattccgaaaataacaactttttaaataacaacaatcaaatggtgctcgacatgatactctatccacttattggcatccctcaaactatcaattgggagactattgcccgacttgtgcctgggctgactccaaaagaatgcgccaaacgattcgatgagctgaaatcttccggcagctctcctgtcgacaaccagtacaattcacttatggctgcgggcgaatctcctgtggaaactcttgcaacttatatcaaatcaagcctgcttgatattcatggcgagtttcaagagacacctgtcggacatgatgccgtatctaaaactggtcgccacagtatcgccagtacaaggaattgttcaagtgagagcgagaactgtaccacacataatggtggggagatgactgaggagtcagaagggccaaacatggttattcacgtttgtgacgaggccaagaatctgaaggaggacttcacctgcccaagagatctgcttatttcggagatgaaatactttgcagagtacctctctatggacgctcagcgatgggaggaagtggatataagcgtccattgcgacgtccacatctttaactggttgatcaagtacatcaagcggaacactaaagagaataaagattgtgaaatgccaacactggagcccggaaatgttatttccattttaatctcttccgagtttctgaagatggactccctggttgaacagtgtatccaatactgccacaagaatatgaacgcgatcgtcgccacgccatgcaatatgaattgtattaatgctaatctcctgaccagaattgcggacctcttctcccacaacgaagtggatgatcttaaagacaagaaagataaattcaagagtaaactgttttgcaagaaaatagagagactgttcgatccagaatacttaaatccagatagccgctcaaacgccgctacactgtaccgatgctgcctgtgcaaaaaattgctgacgaaagaaaccgaacgtagaattccttgcattccaggaaagatcaatgttgatcggagaggtaacatcgtgtatattcatatcagggataagacttgggacgttcacgagtatctcaactctctttttgaggaactcaaatcctggagagatgtgtattggaggctgtggggcacaatcaattggcttacatgttcccgttgctatcaggctttcctctgtatcgagttctctcactgtcagtatcactccgaaacagtggtgtatcctacagccgccagttcccttaacactgtcggcacagggatctacccctgctgtaatcagaaagtactgcgtttcgaccccacccagctgactaaaggttgcaaagtccgcgaccatatggtaacccttagagaccagggcgagggcggtgatctgccatcatgtccgactgcccgaatgcttgatgatctccacaaatatcgggatgtaatcgttgttccgttcagcaaggacaccgtgtcagacgtgggcgtgggcctttgtgatgaaaagggcatagaatgcgacgtgctcctggaacctaacacgccatggggacctaaaactggagagcttaatgcgtttctcagcctgaaaaactggacactgcaactgaagcaacagagtctgttcagcgaagaagaggagtacacgaccggatccgaagttactgaagatgaggtaggcgacgaggaggaagtttctaagaaacaacgcaaaaaagagaaacccaaaaaattcactagacagcccaaaaaacaggtcagctctccttgtgcccagcggaaagagaaagccctcgaaaagtcagcttctagagatgtgtcaccctttgtaatgtctatgcagaagaacaaatgggatgccactcgatctttaagattcaatcaggacgcccagagagaagacgaccagcgccggatgacagagataacagggcacctcatcaagatgcgcctaggagatctggaccgtgtgaaatccaaagaggcaaaggagtttgccgggggtatttattcccgcctggaggctcaaattaaggcttcagtgccagtaagcgctcgccagtctagtagtgagaagaatacaagatctaaatcccggttcggacagggccggccggcctag

SEQ ID NO: 32396 - DNA, 942 bp, Artificial Sequence
  Description of Artificial Sequence: Synthetic coding sequence
atgcaagaggctgatgcctccatcaagacagctgaaactaaagggaggacatggaagtatcaaaacatcgagccgggtggcggaccccagacaagtgggaaggggggattcggaagcctagtgcttgtctttctcggacaacgtgtcggctgtaatgagacagggtccatgaacctggagaagctacaaacacgcccaaatatgaccatcttcacaagaaataatatagccacaaatttttcaagctcaagcagcagcagttatttctcccctcctcctccccctgtgttgctgccactgctgctgctgctaccccagcttttctcgtcctcctcatcttcttttttctttagctttagtcccagtaccagccccctcgtatccccctgttttttcagtagctcttcctccttctgcttcagcgtgagtttactaccttcatctagccctactagcatgacaaaatttccaaaggccgttacaacgaagatcaagacagataagagggacctcatcaagctcaagggcttctgcacggctaaggagacaatcaaccgaactaataggcagccaatcgaatgggaaaaaatctttaccaattatgccagcaataaaggactgatatcgcgtatttacaaagaactcggccagagcgataagcagagacccaacaacccaattaagaaatgggccaaagacatgaacaggcatttttccaaagaggacattcaggtggccaacaagcacgaaaagatgctgagtacatcgctcattatagggaagatgcaaatcaaaaccaccgtcagataccacttaatgcccgcgcgcaaggcaaccatcaagaagtctgaaaataaccgatgttggcagggttgtaggggtaagggtacatttacccactgttggagcaagtgtaaactgaagtgtaagtgtaaaatgtag

SEQ ID NO: 32397 - DNA, 864 bp, Artificial Sequence
  Description of Artificial Sequence: Synthetic coding sequence
gtcttcttcctgaccggaattcctgggctggaaactcggcaaatttggacttccattcccttctgctgcctgtatgtgattgccatctctggcaacgggatgattctgttcgtcatcatcacggagtcgtccctccacgagccaatgtatcactttctgtctatgctgtcatttatggacctggggctgtgtctgtccacactcacaacgatgctaggcattttctggtttaacgcgcgtgaaatctccttcgatgcctgcatcggtcagatgttctttattcacggctttacattcatggaatcatccgtgctgctcgccatggcttttgatcggtttatcgcagtatgtaacccactcagatatgccaccattctgacaaacagcagaattataaaagtgggattcgccatcgtgctccgagggactactgcccttgtccctctgctcctccttctgaaacgactgagcttctgtagatcgcacgtgttgcaccacagctattgttttcatccagatgcgatgaaactgagctgcactgatacctggataaacagtgcgttcgggcttgcaatcgtaatatctactgcaggcttggactctgtgctgatcttgatctcatacgtcttgatcgtacgctctgtcctgtgtattgcaagtcccgaagaacagaagaaagctttcggaacgtgtgtgtcccatatttcagctgtcgctattttctacatccctatgatatcgctgtctcctgtgcatcgtttcgggaagcatgcaccacccctggtgcacatgctcattgctaacgtgtacttgctgatccctcccgtaatgaaccctatcatttatagtgttaagacgaagtag

SEQ ID NO: 32398 - DNA, 396 bp, Artificial Sequence
  Description of Artificial Sequence: Synthetic coding sequence
atgcgtaagccccgtcgcgctggctgggagactctgagcagaaaagcccccggtccaagtgccgggttacgcccatctccagccacttgcgatacttgccacttccccattttgggagacgggaatgccactctgccattcgcaccgggaaagacctcaagagtgccttccgatagcggggttttcagctcagatccacgggcaaattggagttccatcaggaacttcccatctgcgaaatgtgttggtatcgagcttcatgcgagcctgtcgacgtccgcggaatggctgctgcgtgggcggggcggcgctttgccatggatcgtacgatgcctcgcagccactgacctgttactgccaggaaaaaagggagtggaatcttgcccagtcgggtag

SEQ ID NO: 32399 - DNA, 5421 bp, Artificial Sequence
  Description of Artificial Sequence: Synthetic coding sequence
atggccacccgcgtggaggttgggtctatcacaccccttactgcagttcccggtctgggcgagatgggaaaagaagaaaccctcacacgaacttatttcttgcaagcaggggaggcaagcggagccccccccgctcgaatcctggaggctaagagcccacttagatccccagcaaggctgctgcctttgcctaggttagctcctaagcccttctctaaggaacaggacgtgaagtccccagtgccttctcttcggccgagcagcaccggaccctcccctagtggcgggttatcagaagaaccagccgctaaagatctggataataggatgcccggcctcgtggggcaggaggtggggagtggagagggacctcggacctctagtccactgtttaataaagccgtgttcctccggccaagcagtagtaccatgattctctttgagaccaccaaatctggaccagctttggggaaggcagtctccgaaggagctgaggaagccaagttgggggtcagtggtagccgtcctgaagtggccgctaaacccgctctgcccacacaaaagcccgccggcacgttgccacgtagcgcaccactgtcacaggacaccaagccacccgtgccacaggaagaggctggccaggaccacccaccgtcaaaggcatccagcgtggaggacactgccaggcctcttgtagaaccacgcccgcgcctgaaacgcagacctgtttcggcgatcttcactgaaagtatccagccgcaaaagcctgggcccggcgcagcagctacagtggggaaagtgcctcccacaccaccggaaaagacatgggtgaggaaaccccggcccctctctatggacctcaccgcaaggttcgagaacaaagaggcactcttgcgcaaagtggccgatgaagggtccggaccaactgctggagacatggcaggtttggaacgaccaagggccgcctcaaagctcgaccgagattgtcttgtaaaagcggaggcgccactccacgatcctgacttagacttcttggaggtcgccaagaaaatacgtgagcggaaagagaagatgctgtcgaaacctgagatgggaagtccacgcgctctggtgggggggtccagcggagtgaccccgagcaatgaccagtccccttgggaagaaaaggcaaaactggatccagagccagagaaagcggcagaaagccccagtccacgcctcgggcggggactggagctcgctgaggtgaagtcccgcgtggctgacggcgaagcagctgccggaggtgaatgggctagcagaagatctgtgcgcaagtgcatttcacttttccgcgaggactctaccctggctctggctgtggggtcagagagtccactcgcaacaccagcttcacctagcgccgcacctgagcccgaaaagggcgttgtgagtgttcaggaacgaatccgggggtggaccgccgaatcttccgaagcaaaacccgaagtcaggcgcagaaccttccaggcccgaccactgtccgcagatctgaccaaattattttctagttctgccagcagtaacgaggtcaaatacgagaaaagcgcagagttgtccggtgaatttccgaaagaaccaagagagaagcagaaggagggccatagcctggacggtgcatgcatacctcgtagtccatggaagccaggcacattgagagataagtctcgccagaccgaacaaaaagtcagtagcaaccaggacccagacagctgcagaggcggaagcagtgttgaggccccgtgccccagcgacgtgacacctgaggacgacaggtcttttcagactgtgtgggcgaccgtctttgagcatcacgtggagagacataccgttgcagatcaaagcgggcgctgtttgagtactaccccccccggcgatatggctcacgctcgcgtgtctgaaccgcgcccccggccggagatgggttcctggttggggcgcgaccctccagatatgaccaaacttaaaaaggagaacagcagagggttcgataatcctgagacggagaagttgggacctactacgctcctgaacggcgagctacggccttaccatactcctctgcgggacaaataccccctgtctgagaatcacaataataacaccttccttaagcatcttgaaaatcctccaacttcacagagaattgaacccaggtacgatatcgtgcatgcggtcggtgaacgggtgcactctgaagccatttcccctgctcccgaagaaaaagctgtaacgttgcggagtcttcgatcatggctctctctgaaggataggcaactctcacaggaggttactcctgccgatctagagtgcggtctcgaaggccaggccgggtctgttcaacgggcgtccctcatatgggaagctcgaggcatgccagaggcctcgggccccaagtttggagggaactgcccattcccaaaatggactggtggcgccgtcgtatctagccataaggcaaccgtggccgtctccgaggagcattgcgctccaggggccaccagcgtgagagcgattaaggccgctatctgggaatcccagcatgaaggcccggaaggggctcgatcaaagccgggcgtgggcgctcgtggacctcctcaaggttgtcccctcgaccccctgagccgcgccactaacggcccaagcgattcccaggctcggacccacccagacgcattcgccgtgcagaagggaccgttcatagttgcggcccgcgagggcgacccaggaccagcacaagtgcctcagcctgccgtaagaatgaggaaggctggggcaatggaccagaggatggatagatggcgaaggagaaccctgccgcccaacgtaaagtttgataccttctcttccttggttccagaagattccccgcatgtgggtcacaggcgtaccgactacgtcagtcctacggccagcgcgctgagaaagccccagctttcgcactaccgtgtggaaacacaagaagtgaatccaggagcgtctagagaccagacctcccccgcagtgaagcaaggctccccggtggagcccaaggctacgttttttgccgtgacttatcagattcccaacacccaaaaggctaaaggggtagtcttgagtggagcagagagcctccttgaacactcaaggaaaatcactcccccttcatccccacactccctaacctcaaccctggtgtccctaggccacgaggaagctctggagatggccgggtctaaaaattggatgaaaggtcgagagcacgaaaacgccagtatactaaaaaccctgaagccgaccgaccggcccagttcactgggggcgtggagtctcgatcctttcaatggacgaatcattgatgtcgatgccctgtggtcgcaccgggggagcgaggatgggcccagaccccaaagtaactggaaagaatcggctaataagatgtcaccttcagggggcgctccccaaactacacctaccctgcgctcacgacctaaagacttacctgtgagacgcaaaactgacgttatcagtgacacattccccgggaagattagggacgggtatcgatcatccgttctcgacatcgacgctttgatggctgagtatcaggaattatcgcttaaagtgcccggcgaggcacaggagcgcaggagcccgacagtggaaccgagtactctacctagagaacggcctgtgcagctggggggagtggaacagaggcggagaagcttaaaagagatgcccgatactggagggctctggaaacccgctagctccgcggagatcaaccacagtttcactccaggcttgggcaaacagctggctgagacactggagactgctatgggcactaaaagcagcccacccttctgggcactcccaccctctgccccctccgaaagatatcctggggggagccctataccggcagacccccgaaagaagacaggttttgctgaggacgaccgaaaagcctttgcctcgaagcatcacgtggctaaatgtcagaactacttagccgaaagtaaaccatccggacgtgaagatcccggctcaggggtgcgagtgagccctaagtcacctccgaccgatcaaaagaaggggaccccgcgcaagtctactgggcgcggggaggaggattctgttgcacagtggggcgatcaccccagagactgtggacgggttcccctcgatataaaacgcgcctattccgagaagggccccccggctaatattagggaagggctgtctatcatgcatgaagcccgtgagagacgtcgcgagcaacccaaaggccggccctcactgaccggagaaaacctggaggccaagatggggccctgctggtgggagagcgggacaggtgactcacacaaagtgttgcctcgggatctcgagaaggaagatgcaccacaggagaaggagcgacccttacagcaggtgtcacctgtggccagcgtgccctggaggtcccactctttctgtaaggaccgcagaagtgggccatttgttgaccagctgaagcagtgtttctctaggcagcctacagaacccaaggataccgatacccttgtccacgaagctgggtcacaatacggaacctggacagaacaatgccagagcggcgagtctctggcgaccgagtcccctgacagctccgctacatccacccggaaacaacccccatcgtcacgactctcttccctttccagccagacagagcccacatctgccggagatcaatatgattgttctcgcgaccaacgctccaccagcgtagaccattcctctaccgatttggagtctaccgacggcatggaaggccccccgccccccgatgcctgcccagagaaaagggttgacgacttctcattcattgaccaaactagtgttctggacagttccgcgctaaagacacgggttcagttatccaaaaggtcaaggcgccgggcacccattagccacagtctgagaaggagccggtttagcgagtcggaatctcgttctcccctcgaggacgagaccgacaacacctggatgttcaaggatagcaccgaggaaaagagccctagaaaggaggaatcagatgaggaggagacagcttctaaggctgaaaggactcctgttagccacccacaacgaatgccagcatttcccggcatggaccccgcagtgttaaaagctcaacttcacaagagacctgaggtagacagccccggggaaactccatcgtgggccccacagcccaagtcgccgaagagtcctttccagcccggcgtgctgggatcaagagtgctgcctagctctatggacaaagatgagcgtagcgacgagcccagcccgcagtggttgaaggagctcaagagtaagaaacggcagtctttatacgagaatcaggtatag

SEQ ID NO: 32400 - DNA, 741 bp, Artificial Sequence
  Description of Artificial Sequence: Synthetic coding sequence
atggctatcctgcccaaggtgatctaccggttcaatgctatccctattaagctgcccatgactttttttaccgagcttgaaaaaactactttgaaattcatttggaaccaaaaacgagcatgtattaccaagagtattttgcggcagaaaaagaaagccggtggtatcacactgccggattttaaattatactatactgcaacggtcacgaaaacggcatggtattggtaccaaaaccgggatatcgaccagtggaatagaactgaacctagcgagataatgccccacatctataactacttaatctttgataagccagacaaaaacaaacagtgggggaaagacagtttgagtaacaaatggtgttgggaaaactggttggctatttgtaagaagttaaagcttgaccctttcctgacaccttacactaaaattaatagcagatggatcaaggacctgaacatcagacccaagactatcaagacactcgaagagaatttaggaatcacaatacaggacattggaatgggtaagcacttcatgtccaaaactcctaaagctatggcaaccaaggccaaaatcgataaatgggatctgattaagctcaaatctttttgcacggctaaggagacaacaatccgggtgaacagacagcctactgagtgggagaaaatttttacaacttacagtagcgacaagggactcattagcagaatctataacgagctgaaacaaatttag

SEQ ID NO: 32401 - DNA, 63 bp, Artificial Sequence
  Description of Artificial Sequence: Synthetic coding sequence
attatgcctttgtatagttccagtggcgatcgcaccccgatctccaagaatccaactaagtag

SEQ ID NO: 32402 - DNA, 867 bp, Artificial Sequence
  Description of Artificial Sequence: Synthetic coding sequence
atgtacgtgtttcagctttttgactattactctgcttcaggcaccaccttactatggcaggctttctgggagtgtgtcgttgtggcttgggtttacggagccgatagatttacagacgacatcgcttgtatgattggataccgcccctgcccctggatgaaatggtgttggagttttttcactcctctcgtctgcatgggcattttcattttcaacgtggtgtattatgagcccctggtctataacaatacaaatgtctatccttggtggggagaagctatgggctgggcttttgtattgtcttctatgttgtgcatgcccctccaccttcttggctgccttctgcgcgctaaagggaccatggccgagtgttggaagcacctgacacagccaatctgggggctgcaccatttagaataccgagcccaggacgccgatgtgcggggcttgaccacacttacgcccgtatccgagtcatcgaaagtcgtggtggtagaatccgtgatgggtcaactgagcagccaccatcagctaacttccggcctttggggaaaaagacttcagtattcgatcctgggagtgtgggctgctaacctggcctgtagcggtttccccccctgtgcacttggctgggcgcaaccccaggaaggcacaccagatacagccccaactagccgacttaaagccgatgctttaccagccccgccagtcttctgtgtcgccgcgctgacccacgtgtgtctgtccagaccagttcccaggagactgagcgatcctaagaagggttttccagacacgcggacagaagcggggggtttgggcttgcgagaaggaggtggccctgctgggacattcctgctctgctag

SEQ ID NO: 32403 - DNA, 666 bp, Artificial Sequence
  Description of Artificial Sequence: Synthetic coding sequence
gcccggcgaagaggtgctgccgccgctctgtccagagcccgggtgtggggtcgtctatatccccagcctaagttacaggaggcagccccactgccgagaaggggctgggatggtggcggccatgtcggaggaggtggggatgctaggggccccagattggagggcgagagcctgccgcatccgcgcctcgcacccgcagcgccatcagcgtctcctgcgctcgctcacccattagtggctcaccctgctcgactggactcctctagaaaccctggcactggcatctatttcggtggatccgccgcgtggcgccccgggttgtctcgtgttagtcaggaccgctctccaaattccagcagaccactgagcttaagcgggatccctgcggatgttagcccgcctgccaagactagagaggagaagcgggagcctgcactgtggagtcgggagaaagaggaaggtgcaacggccctgcaggaccatggatgggagaaggaatggaggggcttcagaaccttcagtgtccggctgcatgtgccagtgtttatcagcggatctcaggccttggggtcttgggcccgtatcacatgctgccctcctctctggtcacggggatgtttctgcaaggaatcttccgggcgtgagtcaatggcttgcttaacctag

SEQ ID NO: 32404 - DNA, 1023 bp, Artificial Sequence
  Description of Artificial Sequence: Synthetic coding sequence
atggccagagatctgataggccccgctctgccccctggtttcaaggccaggggaacagctgaggacgaggagcgcgacccaagccctgtggcaggccccgctttaccacctaattacaaatcctcatcaagtgattcgagcgattcggacgaggacagctcgagtctgtatgaggagggaaatcaggagagtgaggaagacgattccggccctacggcccgcaagcaaaggaagaatcaggacgacgacgacgacgatgacgatggtttctttgggcccgctctgccaccaggctttaaaaaacaagacgatagccccccaaggccaatcattggtcctgccttacctcccggctttataaagtcaacccagaaatcagacaaaggaagggacgaccctggtcagcaggagacagacagctccgaggatgaagatatcattggccccatgccagccaaaggaccggtgaattacaatgtgactactgagtttgagaagcgggcccaaaggatgaaagagaaactgactaagggagatgacgattccagtaagcctattgtgcgcgaatcgtggatgaccgagcttccaccggagatgaaagatttcggtctgggcccaagaacatttaagagacgagcggacgacacaagtggggaccggtctatctggacagatacccctgctgatcgggagcgaaaagcaaaagaaactcaggaggcccgaaaaagctcttctaagaaggacgaagagcacatcctgtcggggagagataaacggttggctgagcaggtgtcaagctacaacgagtcgaaacgctccgaaagcttgatggacatacaccacaaaaagctgaagtccaaggcagctgaggacaagaacaaaccccaggagcgcataccttttgatagggataaggacttaaaggtgaatagattcgacgaagcccagaagaaggcgctaatcaagaagtccagagaactgaacactagatttagccacgggaaaggcaacatgttcctttag

SEQ ID NO: 32405 - DNA, 1200 bp, Artificial Sequence
  Description of Artificial Sequence: Synthetic coding sequence
atggaaagaaaaaatccttctcgggaaagccccagacgcctctccgccaaggtcggcaagggcaccgaaatgaagaaagtggccagacagctgggcatggcagccgccgaatcagataaggactctggtttttccgatgggtcaagtgagtgtttaagcagcgcagaacaaatggagtccgaggacatgctttccgcactcgggtggagcagagaggatcgccctcgacaaaattctaaaaccgcaaagaacgcttttcccaccctcagtcccatggtggtgatgaaaaacgtactggttaagcagggttccagctcaagccagttgcaaagctggaccgtccagccaagttttgaggtgataagcgcccagccccaactgttgtttctgcacccccccgtcccctcgcctgtgagcccttgtcacactggagagaagaaaagtgactctaggaattatctgccaatcctaaacagctacacaaagatagctccgcacccgggaaaaaggggcctgtccctcggacccgaggagaagggcacatccggggtccagaaaaaaatttgcaccgaaagactcggaccgagcctgtcatccagcgaaccgactaaggctggggcagtgccctcatccccaagcactcctgctccaccgtcggccaagctggccgaagattccgcccttcagggggtgccttcactagtggctgggggctctccgcagacactgcagcctgtcagctcttcccacgttgccaaagcaccaagcttgacgtttgcgagcccagcaagccctgtgtgcgcaagtgacagcacactgcatggcctggagtcaaatagtcccttgagccctctctccgccaattatagctctcccctgtgggccgcagaacatctgtgcaggagccccgatatctttagcgaacagcgccagagcaagcatcgcaggttccagaacaccctagtggtcctgcacaagagtgggctcctggagattactctcaaaaccaaagaattgatccgtcagaatcaggcgactcaagtggaactcgaccagctgaaagagcagacccagctgttcatcgaggcgaccaagtctcgcgccccacaggcctgggccaagctgcaggcttccctgacccctggtagctctaacaccgggagcgacctggaagcattctctgatcatccagctatttag

SEQ ID NO: 32406 - DNA, 315 bp, Artificial Sequence
  Description of Artificial Sequence: Synthetic coding sequence
acatgtatcagtttttttctctttttaaaaaaatccctggcattacttcctagactcgaatattctggaactatattggcacactgcaacctttgtctgctgggctcaagcaatagccatgccagcgctagccaggtggccggaatcactggcatgtgccaccacgtgtggctgatctttgtgtttctggtggagactggtttccaccacgtagcacaagccggcttggagcttctggtgtcctcttctagtccagctctcgcttctcagtcaacagaaatcacgggcatgtcccagtgcgcatggcccctctag

SEQ ID NO: 32407 - DNA, 303 bp, Artificial Sequence
  Description of Artificial Sequence: Synthetic coding sequence
tgtgaaactccccggcttcctgaaattgcactgcgggccctgcccaggcctggtgtgtccagcctggggaccatactctgtgtgccatccgttcctgtgggtcccatcgtgttaacctcagccacgccggaaagctctcgattcacgaggcctgcacctagcaccgtgcccgaggcgcatcggcacagccgcatattaagactagctcccgtgccatgtcgctgctatcgcccccccgcacccgctcatacgtcaaggtccactagtctgttttacgagtcaccctcgacctttaatgtgtag

SEQ ID NO: 32408 - DNA, 201 bp, Artificial Sequence
  Description of Artificial Sequence: Synthetic coding sequence
accagaaacttgtgggtgttcttcttctttttttttgaaaccgagagttgcagtgtagcccaggccggcgtgcagtgggcacaatctaggttaacaactgcttcccctggatgcaagcaattctcatgtctcagtttactctcttcgtgggactaccggcacgctcctccccacccggctaattattgcatcttcgtgtag

SEQ ID NO: 32409 - DNA, 261 bp, Artificial Sequence
  Description of Artificial Sequence: Synthetic coding sequence
gtaatttgccctccatggcccccgaaagttctcggcctccaggctaagtatcaccttcacaatcacaagttttttgtgctccgccgaagcctggccctgcttcctcgactcgagtgcagcggcgccgtgctggcacattgcaatctgtgtctgccctcgagctcaaactcccccgcttctgcttctagggttgctggaattacagggtcatgtcaccatactcggcttatcttttgtattttctcccgggagggggtgtag

SEQ ID NO: 32410 - DNA, 252 bp, Artificial Sequence
  Description of Artificial Sequence: Synthetic coding sequence
atatccgcccactgcaatctgtgcctgccagggtcgtcagactccagcgcctccgcatcccgaatcgcggggatcaccggagcccaccaccacacacggcttatatttgtctttttggtcgaaacagaatttcaccatgtaggccaggctggactaaagtggccccaagtgatacatccaccctggcctcccaaatgttgggattacaggcgtgaaccgccacgtcccgccctgtttttcaatttcttatag

SEQ ID NO: 32411 - DNA, 318 bp, Artificial Sequence
  Description of Artificial Sequence: Synthetic coding sequence
ctgctgccccggctggattgcagtggtaccatttccgcccactgtaatctgcccaggtttaaacgatttagctgcctgagactgccaacaggaataacgggggcctatcaccatacttggattatatttgctttcttggtcgaaaccggattccaccacgtgggtcaggcaggtctgaaattgcttaccagtgaacagttggggaatacaaagagccgttccaggccccccggttggagcgcaatggccccttcgtggctcaccgcctctagcgcttcccgtgttcatgtcatcctgttgcctcagcctcctgaatag

SEQ ID NO: 32412 - DNA, 348 bp, Artificial Sequence
  Description of Artificial Sequence: Synthetic coding sequence
atgtccaagtgctgcgctcaatcactaaacgtgccccacccatccgaagggtctgaaaatataactcaagactatctcgagaagaactggtacctgcagcgcaatacccagaacacagagattaaaggtcctgggggaaaggtgaacaatccgccccacccccgcctgacctttcccggagtcgtttctgagccaccagagggaggccgggtcccaaaagttctgaagttggctcccagcgctaagaatttagttaaggccacgaaaagtctgacaatcccaatgatcagtataaaacacccccccggagttcgcctttggagctggggacgccgctttatcacctag

SEQ ID NO: 32413 - DNA, 2436 bp, Artificial Sequence
  Description of Artificial Sequence: Synthetic coding sequence
atgaaggctcgaacacggccattacgtgcgtctcatgatatcgtgcctactataacccagggcagcagagatggccaccggtcgcctgcgcgggacccccggactacaccagcctgtcgggatagtttgcagaatgggcacacaagtgactcctcttcgggagagtctagcggcggccatcgcccacgccgcggcccctctccgtcccatgtccggtttgaggatgaatccgccagggaggcagagttcaggcatttagagcggttgcagcagcggcagaggcaggtgctgtccaccgtcctgcaggccgccgatcagggcccactgagatcaaaaccagacttggccgactatattaacggggccccgcggctgagagacgcgggtcagggcactttccacagattggtggggtcacttgaccgccgaggccacccagccccccccgctccgggatctgagcgaaggtgtcaggcctgcggttcatgtatagacgacccacggccagcccagggtaaggcaccacctgtccctcggacccttcaggaactgcaggcagcttgcggaatggaacgtgtgctgggaggcctctccagcccactccgccttttgccggctgagcctcggctgcacatggagtggatccgggagacacatatcggtgacaccgtgtgtccagctgaagtcgacagcgccttggactccaccgataatagcgacaactgtcgcaccgactcggaggaggctgggacatcacaggcaggctgggcctgcgggcggacgcaagggagctctccacgcctgaggttaagagggtctcgccctaggggtcataggtggagcaagaaggctgaagccgaactcccgtgggggttacaagcccagcagcatttaccccgcgccgatgatgtcgaagtcgagaacgaagtcaaagaaggcaggggtcatacccccgaaggaaccttgtttttgagagaggacgctaaaccaccagacctcgagctgaagagggtctcactggggcctcaatggcagcccggtccaggccttggcagccaccaaccgcacccgctggatagcaggacaccgtgtcggacagcttacgccacgaccgcaccaatgacccccgagagcagcggacctgggggacaagcgcaggttaccgaaagccacgagtccctggaaatcgtgtcccccagttcattgcagcagtcccatgccgagccatcggcgcctcatcaggcatggcagccaaccgcctcgctatgtccagagggttgggcaccgaccccaccccccagcagaaaaactaccagccccgtttcccaccgcaaggccgccctagcaggactgcttcgtctgggcgaccagaccgagccagtgggcatcccccggccccccagccgcagtgccgtcctgcgcacttgcgagctgccaccatcccagacccaaccctcccgaccccaggtccggcacccactcctcgccctgtctactaataactgtaacaattccgcgccaagaggattgcaggagccctatggtggggcggtgcacgagggccgcgtggaacggggaccatgcagcagagagcccgaacccccactggaaaatagcagagacggaggtcctcaggggttcttaggatcagcggacgttgctacaatcaatagtacggggatcaccctctcgcttagctctgaagaatcagaaagctctaaagagtcagaggggagcctgcaaagaacagggagtggaagcgggggtcacgtgctgtcacgtgcttctgcaggagctgggaccggaccagggagcccatctgccgcaccactagaccagaacaagaagagatcttcatctatcgcaagcactcttggactgaagaaactattttctgcacttggccagtcctcacggccgaagctgggaaaatcccgcagttactctgtagagcaacttcagcccgcgcccccaggactgacaagccagtctcgcgctccatccctacaatcactgcatccagtctcaccttcccaccagcgaagaaaagctgcctcgtttcagaaccttcattccttgctgtcttctaagggaaaccgctccagtctgtatctggtcgccggtccgggggaccacagcgccgccgggcgccccgccaaaactagcccccgacgcgctttgagtgtggaagatgtgggagctccatcacttgcgagaaccgtgggccgactggtggaggtgtttcctgacgggacatctcagctccagctccagcgctcccccgggggtaccttcggattctgtgtggcaagcggtaacggcaggccagatagtgggatgccctcaccactgccacaacctcacggatggggaggcctctccaaacaaggaagggccttctggttgtggagtgaagccttcctagtgttcggctag

SEQ ID NO: 32414 - DNA, 3573 bp, Artificial Sequence
  Description of Artificial Sequence: Synthetic coding sequence
atggagggaaccgaggcagccgcggctaaacccgctgggggttcccctcaggggcccaagaccggctctggaacggcttctcctgtggaaggcacatcagctgtggaatggtctgggcccgagcctcagctggacaacggtcacccaccgcgtccctggccctgccctcaggagaatcgcaccagctctctgatggcgccacaaccaccaagggtatggggagtacagctgcagggcccttcagtgctggagagtaaggttcgcgctctgaaggaaaagatgaccgtagctaagcagggcgttagcccttgcagtgcaagccaggaatggtcctctccaaagaagcctcagtgcaggcgcggaaaagcgggcagggcagggaccccctccgagggtagtttcttgcctggggcggtggtggcacctaggacccagaatctaccagacgggcagctagatgggtccatcaacgaggagcagccagccagggacggcgggcctaggctgccacggcctccagcccccggccgggagtattgcaatcgggggtcaccttggccccccgaggctgagtggaccctccccgatcacgatcgaggaccacttctgggtccgtcctcgcttcagcagagcccaatccacggggtgacccccggaaggcccggtgggccaggacactgcaacaaaatcatccatataccatccccacgcacaggccggagttatcctttccccgacggcgtggttactgaagcagatctggactccacgagcttgacaagtgaggaagtgtttgtcccaagaacagcgctgttaggcgagcggtggagggcaggagatctggaggccctaggtgcagggtcatcagtgctgtctctgtctgatcgtgttgagcggaatcgccttctccttcaggaaatgcttaacgtgagcggacaatccccacgcaaagtgggaaccccagcttggaccccatcctgggatacggccgccccagaaaggcctgtgggggacgtggattgggcatcaggcacatcactgcaggattccggacagaatcgcacagtggggcctaaccctgagcccgtgcttagcccaagacacgaggaagccacacatctccttcagcgtgccagaatgaaagccagaaccaggccactgagggcttctcacgatatagtccctactataacccagggtagccgggatggtcacagaagccctgcacgcgatccacggaccacacctgcctgccgggatagcctgcagaatggtcacacttctgactcttcttctggagagtccagtgggggccatcggcctcggagaggcccgagcccgtcgcatgtgagattcgaggatgaaagtgcccgggaggcagagttccggcatttagagcgattacaacagcggcaacgacaggtgcttagtaccgtgcttcaagcagccgaccaggggcctctccgtagcaaacccgatcttgccgattatatcaatggggcaccacgtttaagagatgccggacaggggactttccacagactggtgggttctctagaccgcaggggacacccagctccccccgcccccggaagtgagaggcgctgccaagcctgtggaagctgtattgacgaccctcgccccgcccaaggcaaagcgcctccagtgcccagaacgttgcaagaactgcaagccgcctgtggtatggagagagttctgggcggcctctcgtccccgctacgcttgcttcccgctgaaccacgactgcacatggagtggatccgcgaaacccacataggtgacacagtgtgccccgccgaggtcgattctgctctagatagtaccgataacagcgacaactgtcgaactgatagtgaggaggccggcactagccaggccggctgggcgtgcgggcgcacccagggttcttctcctcggctaagactcaggggctcccgacccaggggccataggtggtctaagaaagcggaggccgaactgccgtggggacttcaggcacagcagcatctgcctcgggccgacgacgtggaggtggaaaacgaagtgaaagagggacggggtcacacccccgaggggacactgttcttgcgggaggatgcgaagccacctgacctcgagctgaagagagtgagcctcgggcctcaatggcagccaggccctggacttggctcacaccagccccatcctttagattcacgtaccccatgtcggacagcttacgctaccacagctcctatgacccctgaaagctcgggccccggaggacaagctcaggtgaccgagtcccacgagtccctggagatagtgtcaccaagttccctccagcaatcgcatgccgagccctctgcaccccatcaggcatggcagcccactgccagtctgtgtccagagggatgggctcctacaccgcctccgagccgtaagacaacgagccctgtgagccatcgcaaggccgctctggcagggctgctacgtctgggcgaccagactgagcccgtcggcatccctaggccgccgtcccggagcgcagtattgaggacctgcgagcttccgccgtctcaaactcagccctcccgtcctcaggtcaggcaccccttactcgcactgagtacaaacaactgcaacaatagcgcccctcgaggactgcaggaaccgtacgggggcgccgtgcatgaaggcagagtggagaggggcccgtgttctcgcgaaccagaacccccactcgaaaatagtcgcgacggaggtccacaaggatttctaggttctgctgatgtggcaaccattaatagtactggcatcaccctatccctgtcaagcgaagaatcagaatctagcaaggaaagcgagggatccctacagcggacggggtctggctctgggggacacgtactctcccgggcaagtgctggcgcaggaactgggcctggtagccctagcgcagctccactggaccagaataaaaagaggtcctcaagtatagccagcacactgggcctgaaaaagctgtttagcgcgcttggtcaaagtagtaggcccaaattaggtaaatccagatcctattccgttgaacaacttcaaccagcccctccgggtctgacttcacagtcacgggcaccttccctacaatctctacatccggtttcacccagtcatcagagacgaaaagccgcctccttccagaatctccatagcctcctctcctcaaaaggtaacaggtccagtctatatcttgtggcggggccgggagaccattccgctgctgggaggcccgctaagacgagcccaagaagggctctctcagtggaagacgttggtgctccatctttagctcgcacagtcggacgactggtcgaggttttccctgacggtacttcccagctgcaactgcagcgctcaccgggcggaacctttgggttttgtgtcgcctccggaaatggcagacctgatagcggcatgccctctcccctgccacagcctcacggctggggaggtctgtccaagcagggtagggcattttggctctggagtgaggcgtttttggtattcggctag

SEQ ID NO: 32415 - DNA, 405 bp, Artificial Sequence
  Description of Artificial Sequence: Synthetic coding sequence
atgatcccagtgcgcggactgtggtactgctacctccaggtgaagaaggttcgcctgcgagaggcggaaaggctcggtcccaagtctcagtgtcctgccgaatgcggggctgcctcttggatctcatgggtgttgcagcatcagcagctgctagcaagcgaatgggccactaaggatggccggggcacatggggaagcaaaccaagctgcactgtccctgccttgtcggctacttctcagttactccaattgggacgactgaactctgacctccagttcgttcgccaaagggctaagaaatccgtgtcttcccctagcctgctgcagttctggtgctgtttatccagactatcatttcacgctctcaaccaaaagatcaacagcacaaatatcaacattacgtag

SEQ ID NO: 32416 - DNA, 1155 bp, Artificial Sequence
  Description of Artificial Sequence: Synthetic coding sequence
atgagtgctggaagcgcgacccaccccggagccggcggccggcggtctaagtgggatcaaccagcccctgctcctcttttattcttgccgccggccgcgcccggaggcgaagtgacaagttcaggcggatccccagggggtaccacagcagctcccagcggtgccctggacgctgctgctgcagtagcagctaagatcaatgcgatgctgatggctaaaggcaaactcaaaccgactcaaaacgccagcgagaagctacaggcgcccgggaaggggcttacatccaacaaatccaaggatgatctcgtcgtggcggaggtcgagattaacgacgtgcccctgacgtgccggaacctgctgacgcggggtcaaacccaggacgagatcagcaggctgtcaggtgccgcagtgtcgactcggggtcgattcatgaccactgaggaaaaggccaaggtcggtccaggcgatcgcccgctatatctgcacgtccagggacagacaagggagctggtcgatcgggcagtaaatcgtattaaggaaattattactaacggagtagtcaaggccgccaccggtacaagccccacttttaatggagccaccgttacagtttatcaccaacctgctcccatcgcacagttatcccccgccgtcagtcagaagccaccattccagtccggcatgcactacgtccaggataagctctttgtcggccttgaacatgcagtcccgacgtttaatgtgaaagagaaggtggagggcccaggctgttcctatcttcagcatattcagatcgaaacaggggccaaggtgttcctgcgggggaaggggagcggctgtatcgagcccgcttcaggaagggaggccttcgagcccatgtacatctacatttcgcatcctaagcctgaaggtctggcagctgcaaaaaaactgtgcgaaaacctgttgcagaccgtccacgcggagtatagccgcttcgtgaaccagatcaatacagccgttcctctgcccgcagcttcctccacttcattacggagtacaaagcatagtgcgacaagctgtttcatcagtacatggtcactcgccggcatcacatattggagccccacctgcgctaacactatccccgataatacgtctgctgcctcatcttag

SEQ ID NO: 32417 - DNA, 1695 bp, Artificial Sequence
  Description of Artificial Sequence: Synthetic coding sequence
atgtcagctgggtctgcaacgcacccaggcgctggcgggcgccgcagcaagtgggaccagccagcaccagcccctctactgttcttgcctcccgctgcccccggcggggaagttaccagctcgggaggatccccaggagggacaaccgctgcccccagcggtgccctcgacgccgccgctgccgtggcagctaagattaacgccatgctgatggctaagggtaagctgaagcctacccagaacgcgagtgaaaagctgcaggccccagggaagggtctgacctctaacaaatctaaggacgacctggtggtcgctgaggtcgaaatcaacgacgttcccctgacctgtagaaacttgctgaccagggggcaaacccaagatgagattagccgtcttagcggtgctgccgtgtccacacgcggcaggttcatgacaacggaagagaaagccaaggttggaccaggcgatcggcccctgtacctccacgtgcagggccaaacaagggagttggtggatcgagccgtaaacagaatcaaggagatcattacgaacggagtggtcaaggcggctaccggaactagcccaacattcaatggtgccacagtgacagtctaccatcagcccgcccctattgctcagctctccccagccgttagtcaaaagccaccctttcaatccggcatgcattatgtgcaagataagctgttcgtggggctggaacatgcagtccctacctttaacgttaaggagaaggttgagggacctggctgttcttatttacagcatattcagattgagacaggggccaaagtctttctgcgcggcaaaggtagcggatgcatcgagcctgcaagtggacgggaggcttttgaaccaatgtacatctacattagccaccctaagcctgaagggctggcagccgccaaaaagctgtgtgagaatctcctgcagacggtgcatgccgagtactcaaggtttgtaaatcagattaatacagcagtgcctttgcccggttacacccagccatcagccatttccagcgtccccccacaacccccttactatccaagcaatggctatcagagcgggtaccctgtggtcccaccaccccaacagccagtacagccaccctatggagtgcctagtatcgtgccccccgcggtgagcctggcccccggggtgttaccagctctgcccaccggagtgcctccggtgcccacacagtaccccattacacaggtgcagcctcctgcctctaccggacaatcccccatgggtggcccatttatccctgcagcccccgtcaagacggcactgcccgctggaccacagcctcaaccacagcctcagcctccactgccgtcacaaccccaagcgcagaagcgccgtttcactgaagagctgcctgacgagagggagtccgggctcctgggctaccagcacggaccaatccatatgacaaacctgggcaccggattttcatcacagaatgaaattgaaggggctggatccaaacccgcctcctcatctggtaaggagcgagagagggaccgccagctgatgcccccacccgctttccccgtcactggcataaaaacagagagcgacgagcgcaatggaagcggcaccctgaccggcagccacggagagtgcgatatcgcgggtggaacaggcgagtggctccgcctggtgtag

SEQ ID NO: 32418 - DNA, 1845 bp, Artificial Sequence
  Description of Artificial Sequence: Synthetic coding sequence
atgagtgctggaagcgccacacatccaggcgctggtggcaggcggagtaaatgggatcagccggctccagctcctttgctgttcctgccacctgcggcccccggcggcgaagtgacttcttccggcggcagccccgggggtacgacagccgccccatccggggctctggacgctgcagccgctgtcgcagcgaagataaatgcaatgctgatggccaagggcaagctcaagcctacacaaaacgccagtgaaaagcttcaggctccggggaagggtttaacctcgaacaagtcgaaggatgacctggtggtagctgaggttgaaataaacgacgtccccctcacatgtcggaacctgctcacccgcgggcagacccaggacgaaatatcccgcctctctggagcagcagtgtccacgagaggcaggttcatgactacagaagagaaggccaaagttggccctggcgatagacctctttatctccacgtacagggccaaaccagagaactcgtagatcgcgctgtgaataggatcaaggaaataattaccaatggcgtggtgaaggccgccactgggacatctccgacttttaacggagcgacagtcacggtgtatcaccagcccgcccccatcgctcagctttctcccgctgttagccagaagcccccctttcaatccggtatgcattacgttcaggacaaactcttcgtgggcctggagcacgctgtcccgaccttcaacgtaaaggagaaggtcgaaggtcccggatgttcctacctccagcacatccagatagagacaggggcaaaggtcttcctcagaggcaaagggagcgggtgcattgagccagctagcggacgcgaggcgtttgagccgatgtatatctatatatcgcacccaaagccggagggccttgccgccgcaaagaagctgtgcgagaatctgctgcagacagttcacgcggagtactctagatttgtgaaccagatcaacacagccgtgccacttcccgggtacacgcaacccagtgcaatttcctccgttccgccacaaccaccctactatccctccaacggataccagtccggctacccagtggtccctcccccacaacagcccgtccaacctccgtacggggtgccgagcatcgtgccacctgctgtgtctctggcccctggggtactgccggctttgccgactggggtgccacccgtgcccacgcagtatcctatcacccaggtgcagcctcctgcctctacaggccagagtcctatgggggggccttttattcctgcagcaccggtgaagacagcgctccctgcgggcccccagcctcaaccgcagccccaacctcccctgccttcccagccccaggcccaaaagcgtcgcttcacagaagagttacctgacgagagagaaagcggcctgctgggataccagcacgggccaatccatatgaccaacctgggtaccggctttagttcccagaatgagattgagggcgctggctccaaacccgctagctcatcgggcaaggaacgagagagagatagacagctgatgcctccgcctgccttccccgttacaggtataaagacagaaagcgatgagcgcaacggcagcggaacgctgactgggtcacatgattacccagccaaaaaaatgaagacaaccgagaaggggtttgggttggttgcatacgccgccgactcttctgatgaagaggaggaacacggagggcacaaaaacgctagcagcttcccccagggttggagcttagggtaccagtaccccagctcccagcctagagccaaacaacagatgccattctggatggcaccgtag

SEQ ID NO: 32419 - DNA, 1581 bp, Artificial Sequence
  Description of Artificial Sequence: Synthetic coding sequence
atgatccagtctcagatcagcttcgaggacgtcgcggtggatttcaccttggaggaatggcagttactcaaccccacccagaagaacctctatcgggatgtcatgttagagaattattccaacctggtgtttctggaagtttggctggacaaccctaaaatgtggctgagagataatcaagacaatctcaagagcatggagaggggacacaagtacgacgtttttggaaaaatattcaacagctcgatcaatatagtgcatgttgggctgagatctcataaatgtggaaccggagagaaatccctgaagtgccccttcgacctcctgattcctaagaataactgcgagagaaagaaaattgatgagcttaataagaaactgcttttttgcataaaacctgggcggactcacgggggaatcaagtactgtgactgttccacatgccgaaaatcttccaatgaagagccttggctcaccgcaaatcatatcactcatactggcgtttatttgtgtatggagtgtggaagattctttaataaaaaatctcagctggtgattcatcagcgtactcacacaggtgagaagccatatcaatgctcagaatgtggtaaagcttttagtcagaagagtcttctgactgtacaccagcgcacacactcgggcgagaagccacacggatgtagtgagtgccagaaagcattctccaggaagagtctcctcattctgcaccaacgcatccacaccggtgaaaagccttacggctgttccgagtgtgggaaagccttttccagaaagtcccagctgaaacgacaccagattacacacactatcgaaaagccttattcctgctcagagtgtggaaaagcctttagccagaagctgaagctgataacccatcaacgggctcacacaggtgaaaaaccctacccttgctcccactgtggaaaggctttcttctggaaaagtcagttgattacacaccagcggacacacaccgggaaaaagccttacggatgtggcgagtgtcagaaggctttcagccggaacagtcttttgattcggcatcagcgcatacacaccggagaaaaaccctatgagtgcaatgagtgcggtgaagcattcattaggaagccccagttaataaaacaccagatcacgcataccggtgagaaaaattataggtgttcagattgcgaggaagcttttttcaagaagtctgagctcattaggcaccagaaaatacatttgggcgaaaagccatatggttgcatccagtgcggcaaaaccttcttcggtaagtcccagctcttaacacaccatcgaacccacactggtgaaaagccatacgaatgctctgagtgcggcaaagcgttcacacagaagtcatctctgatatctcaccagcgcacgcacacgggcgagaagccatacgagtgttccgagtgtcgtaaaacgtttagtgaaaaatctagcctaatccaccatcagcgcacacacacaggggaaaaaccctttgaatgcagcgagtgtaggaaggctttcgcctggaagccacagctgctgcgccaccagcgcatttag

SEQ ID NO: 32420 - DNA, 4065 bp, Artificial Sequence
  Description of Artificial Sequence: Synthetic coding sequence
atgagttctacagccgatctcctggataccatcctcaaagcaattgaggaaaacataactaccgagaattcatgcagcctgctgatggccctggacacacttttgaacagtgacagcaccaaggagatgggtttcacctgcaagatacaggctctccgggataaattgtggatctttctggtgcagagtttctacgccgtgcggcacaccgagtcctggaagctgatgagtactgacgatcagcagaagattcaagctgccgccttcgataagggtgacgaccgaagactcgggaagaagcccattttcagctcttcccaacaacgaaagcaggtctcggattctggcgatatcaagatcaaatcttggaggggaaacaacaaaaaggaatgttggtcctacctctcgaccaataaaaaaatgaagtcagatgggctgggggctagtggacactcttcatccacaaacaggaactctatcaacaagaccctgaagcaggacgacgtaaaggagaaagacggaacaaaaatcgcctctaagataactaaggaactcaagaccggaggaaaaaatgtctccggtaagccgaagaccgtgaccaagtctaagactgagaatggcgataaagccagattagagaatatgtcgccaagacaggtagtcgagcgatccgccacagccgcagccgccgctacaggccagaaaaacctcttaaatggcaaaggcgtgcggaaccaagagggacagatatcgggcgcaagaccaaaagttctgacagggaatttgaatgtccaggcaaaggccaagccactaaaaaaggctacgggcaaagactccccctgcctatccatcgctgggcccagctctaggtccacagatagcagtatggaattctcaatcagtacggagtgcctagacgagcctaaggagaatggctctacagaagaggagaaaccctctggacacaaactgagcttttgcgacagtccgggccaaatgatgaaaaacagcgttgattccgtgaaaaattccactgttgctatcaagagcagacccgtgagccgagtcaccaatggtacatccaacaagaagtcaattcacgagcaagacactaacgtcaacaacagcgtgctcaagaaggtgagcggcaaaggttgctctgaaccagtcccccaagcgattctgaaaaaaagaggaacatccaacggttgtacagctgcgcaacaaagaacgaagtccaccccgtcaaatctgacaaaaacccagggtagccagggcgagagccctaatagtgtcaaatccagtgtgtcgtcccgacagtccgacgaaaacgtagcgaagcttgaccataacacaacaaccgaaaaacaggcccccaaacgcaagatggtgaaacaggttcacactgctctgcccaaggtgaacgccaagattgtggccatgcctaagaacctcaaccagtctaagaagggagagaccctaaataacaaggattcaaagcagaaaatgccccccggtcaggtgataagtaagacgcagcctagttctcaaagacccctgaagcacgaaacttccacggttcaaaagagcatgtttcacgacgtacgtgataacaataataaggactcagtgtctgagcaaaaaccacacaaacccctcattaacctggctagtgagatatccgacgccgaagcacttcaatcatcatgtcgaccggatcctcagaagcctttgaacgatcaagaaaaagagaaactggccctcgagtgccaaaacattagcaaactggacaagagtttgaagcacgagttggagagcaagcagatttgtctggataagtccgaaaccaaattccctaaccacaaggagaccgatgattgcgacgccgctaatatttgctgccacagtgtaggatccgataacgttaactcaaagttctactccaccacagcccttaagtatatggtgtccaacccgaatgaaaatagtttaaactctaatccggtgtgtgaccttgacagtacctccgcaggacagattcatcttatcagtgatagagagaaccaggtgggacgtaaggataccaacaaacaatcctctatcaagtgcgtggaggacgtctctctctgtaaccctgaaagaacaaacggcacgctgaacagcgcccaagaggataagaaaagcaaggtccctgtggaaggactaacaataccaagtaaactttctgatgagagtgctatggatgaggataaacacgctactgccgatagtgatgtgtcctccaaatgcttctccggccagctttccgagaagaactcacctaagaacatggagacatcagagtctccggagtcccacgagacaccagaaactcctttcgtgggccattggaatcttagcaccggcgtactgcatcagcgtgaatcccctgagtctgatactgggtccgccaccacctcgtccgatgacatcaaacctcggtctgaagattacgatgcaggaggttcccaggacgatgatggttccaatgacaggggaatctcaaagtgcggcactatgttgtgtcacgatttcctggggcgatctagtagcgacacaagcactcccgaggagctcaaaatttacgacagcaatctccggattgaggtaaaaatgaagaagcagtccaataacgatctgtttcaggtgaattcaactagtgacgacgaaataccaaggaagcgtcctgagatatggtcccggtccgccatcgttcacagtcgcgagcgggaaaatatcccccgagggtcagtccaatttgcccaggagatcgatcaggtcagtagctccgcagacgagacagaggatgaacgatcggaagcggaaaacgtagctgagaattttagcatttccaatccagccccgcagcagttccagggaattatcaatctggcatttgaggatgctacagaaaatgagtgccgagaattcagcgctacaaagaagttcaaacggtcagtgcttctgtccgtcgacgaatgcgaagaactgggatccgatgaaggcgaggtccatacgcctttccaggcatctgttgattctttctccccatccgacgtgtttgatggtatctctcacgaacatcacgggcgtacttgctactctaggttttcaagagagtccgaagataacatcctcgagtgcaagcagaacaaagggaatagcgtgtgcaagaacgagagtacggtactagacctgtcttcaatcgacagttccaggaaaaacaagcaaagtgtgagcgccactgaaaagaagaacaccatagatgtcctttccagcagatctagacagctgctaagggaagacaaaaaagtcaacaacggctccaacgtcgaaaacgacatccagcaaaggtctaagttcctcgactccgatgtgaaaagccaggagcgtccctgccacttggacttacatcagcgggaacccaattcagacattccgaagaattcgagcacaaagagcttagactctttcaggagccaagtgctcccacaggaggggccggtgaaggagagtcactctacgacaaccgaaaaggccaacatagctttgtctgccggggacatcgacgactgcgacacactcgctcagacccgcatgtatgaccatagaccctccaaaacactttcgccaatttatgagatggacgttatcgaagcctttgagcaaaaagtcgagtctgagacccacgttacggacatggatttcgaagacgatcagcactttgcgaaacaagattggacactcctgaaacagttgctgtctgagcaagacagtaacttggacgtgaccaactccgtacctgaggatctgtccctggcccagtacctcattaaccagaccttgctgctagcccgggactcgagtaagccacagggaattacccacatcgataccctcaatcgctggagtgagcttacaagtcctttagactcatctgcgtcgattactatggcctcattctcaagcgaagattgctctccccagggcgagtggactatcttggagctggaaacgcagcactag

SEQ ID NO: 32421 - DNA, 2364 bp, Artificial Sequence
  Description of Artificial Sequence: Synthetic coding sequence
atgggtgacccaggatcggagattatcgaaagtgtgcctccagctggaccagaggcatcagagagtacaacggatgaaaacgaggatgacatccaatttgtcagtgaaggtccctcccgtcccgtgttagagtacatagatctggtatgcggtgacgatgagaacccatctgcgtactatagtgacatcctgttccccaaaatgccgaaaaggcagggcgattttctccacttcttaaatgttaagaaagtgaagacagacacagagaacaacgaagtgagcaaaaatcactgtcggctgtctaaggcaaaggagccacacttcgaatacattgaacagcctatcatcgaggaaaaaccctcactgagtagtaagaaagagattgacaacctggtcctccctgattgctggaatgagaagcaggctttcatgttcactgaacagtataaatggctcgaaattaaggagggaaaactcggatgtaaggattgttccgccgttcggcatctcgggtctaaggcagaaaagcatgtacatgtgagcaaggagtggatcgcctacctggtcacacctaacggcagcaacaaaacaactcggcaagcatctctaaggaaaaaaattcgtgagcatgacgtctcaaaagcccatggcaagattcaggatttgcttaaggaaagtactaatgactctatctgcaatctggttcataagcagaacaataagaacattgatgcaaccgtcaaggtattcaacaccgtgtactcactcgtcaaacacaatagaccactgtcagatattgaaggtgctagagaacttcaggaaaagaatggcgaagtgaattgcctgaacacccggtattctgcgacccggatagctgagcatatcgccaaagaaatgaaaatgaagatcttcaagaatattatcgaggagaatgccaagatctgtattatcattgacgaggccagcacagtctcaaaaaaaactactctggtgatttatctgcaatgcaccatccagtccgcccccgccccagtgatgttgttcgtcgccctcaaggaactagttagtacaatcgccgagtgcatcgtcaacaccctgctaactacgcttaatgattgcggatttactaacgaatatctaaaagccaacctgatcgcattctgtagtgatggcgcgaataccatactcggcagaaaaagcggcgtggccactaagcttttggagaacttcccagaaattatcatctggaactgcctcaatcatcggctgcagctgtcccttgacgactctatatctgagatcaaacagataaatcacctcaaaatattcattgacaagatctacagtatttaccaccagcccaacaagaaccaaactaagcttttgggcacggtcgccaaggagctggagactgagattatcaagatcggaagagtgatgggcccaagatgggcagcgtgctcccttcaggctgctacggcagtgtggcacgcctatcccatcttatacatgcactttagtcattcatattctggcctagcgaaaaggttagcaaacattaacttcctgcaggacctggcacttatgattgatattctggaagagtttagcgtgctgtcaactgctcttcagtcccgcagcactaacattaagaaggcccaaaagctcatcaagagaacaatccgcgcactggagaacctcaaaattggaaccggaaagtacgagtcacagattgaggacctcatcaagagcgacaagttcaaggacataccgtttaataagaacaacaaatttaacgctctgccgagatcaattctgctggataacatcattcagcacatgaaccttcggctgctgtcagacagaaatcacgaagacatcttcaattactttgacctgctggagccgagtacttggccatacgaagagataacgtctccttggatcgccggcgaaaaaacgttgttccatctgtgcaagatactgaagtacgaggttgatcttaacgatttccgtgagttcgtgaataacaacatcaagagtaacaatgtatcaatcccaacaaccatctataaagccaagaaaattgttagcacaatcgcgattaattcagctgaagcagaaaggggattcaacctgatgaatatcatatgcaccagagtacggaatagcctgactatcgaccacgtgtctgacttaatgaccatcaaccttttaggaaaagagctggcagactgggacgcaacacccttcgttaaatcttggtctaattgtaaccatagattggctactgatactcgcgtgaggcagaagagcaccaaggtgttccatgagaaccagttggcgatttggaacctgaagtag

SEQ ID NO: 32422 - DNA, 636 bp, Artificial Sequence
  Description of Artificial Sequence: Synthetic coding sequence
atgcagctgggcgaacacacccatccgcagaagaatcccaagagcctagctggttgtttgttgcccaatccccacccgcaactccagctccgtggcaaacgtgcagccggcctgctcctgaggcgcaatccatggaggcacccacaagcacccgggggctcatcaacctgggctcctagcctgccacccattttggcccctcaggcctacctcaattttgccccccccactcccgtccctggcggttctcctgggactgaagctcagcccgtagccccagccaacgctcttggtagtcgatctaagctgaacctgacccaacctagctgcctgagttctgggagccacctgcccctccctttccccgctgggatgtgtccgcacccagccaacccaacctgggcactgcggaaaggcgccgaggtcccacaaggaccgcccctcagtcacactcggaaggcattgtgcctggcagccagcggtgtaggtgctttgctgctggaggttccacggcaccccgggtggggccagcaaagtgcagcgggattccagcaagtgtttcaagagggcgccgggacccactttccttccgtacgggtgcaaccggggcgggggaagctgcaaggccagcgatag

SEQ ID NO: 32423 - DNA, 1488 bp, Artificial Sequence
  Description of Artificial Sequence: Synthetic coding sequence
atgaaaaagagaaaggagttgaatgcgttgattggtctggctggagactctcggaggaagaaaccaaaaaagggaccatcttctcacaggctcctgagaaccgaacctccagacagtgattccgagagctccagcgaggaagaggaagaattcggtgttgtaggcaacaggagtcgcttcgctaaaggagattacctgagatgctgtaaaatttgttacccactgtgtggtttcgtcatcctcgccgcctgcgtagtcgcttgcgtgggtctggtgtggatgcaagtagccctgaaggaagatcttgatgcgctcaaagagaagtttcgtaccatggagtccaatcaaaaatcctctttccaggaaattcctaaactgaacgaggagctcctgtccaagcagaaacaactggaaaagatcgaatcaggcgagatgggcttgaacaaagtctggatcaacatcaccgagatgaacaagcagattagccttctgacaagcgccgtcaaccacctcaaggcaaacgtcaagtcagccgccgatttaatctctctgcccaccacagttgaaggtctgcagaagtctgtggcatcaattggaaatacactgaacagtgtgcatttggccgttgaggctctgcagaaaactgtcgatgagcataagaagaccatggaacttcttcagtcagatatgaatcagcatttcctcaaggagaccccaggcagtaaccagataattccctcgcccagcgcaacctccgagctcgacaataagacacactctgaaaacctaaaacaggacatcctgtacttgcataactcgttggaggaagtgaacagtgccctcgtgggctaccagcgtcagaacgacctgaaactcgagggcatgaatgagaccgtatctaacctgacacaacgagtgaatttgatcgaatcagacgtagtcgcaatgagcaaggtagagaagaaggctaacctttcattctccatgatgggcgatagaagcgccactttgaagaggcagtcgctagatcaggtcaccaatcgcactgacaccgtgaagatccaatcaatcaagaaagaggattctagtaacagccaagtcagtaaactgcgtgagaaactgcagctgatttccgccttaaccaacaaaccggaatctaaccggccacctgagactgcagacgaggaacaggtcgagtcatttaccagcaaaccctccgccctgcccaagttctcccagttcctcggggacccagtggaaaaagcagcgcagcttcgaccaatatccctgcccggtgtttccagcactgaagatctgcaggacctgtttagaaaaaccggccaggacgtcgacggtaagctgacttatcaggagatctggaccagcttgggcagcgccatgccagagccggagtccctccgcgcctttgatagcgatggagacggccgctattcctttctcgaattaagagtcgctctaggcatctag

SEQ ID NO: 32424 - DNA, 345 bp, Artificial Sequence
  Description of Artificial Sequence: Synthetic coding sequence
atgtgcggctgggaagattcacagaaacctagtgtccccagtcacggccccaagacgccgtcatgtaaaggagtgaaggctccacactcctcacgtccccgcgcctggaaacaggacctcgagcagtctctggcggcagcctacgtgcctgtggttgtagacagcaaaggacagaaccccgacaaattgcggttcaatttctacacttcccagtactctaacagtttaaatccgttttacactcttcaaaagcccacctgtggttacttgtacaggcgggatacggaccatactcgcaagcgcttcgacgttcctcccgctaacctcgtcctgtggcgaagttag

SEQ ID NO: 32425 - DNA, 324 bp, Artificial Sequence
  Description of Artificial Sequence: Synthetic coding sequence
atgtggctctccccttggagcacctgcccgcctcatccactccccagttgtttaactgcgtgctgttctcccgcccaccagccggtccgaggctcagcccagcccccagcttctgatctctgtacttgcgttacctgctgcagtggccctcacccaaactaccctccagcacatctgctgccaacctccagcctgccgatctgccccgggctgatttgttgcttactgacatgcctgctggtagattgcttcagcgctctcttgagtgcatgtgagacccgggatctgtcaccatggaaggctagaagagtattacttagatag

SEQ ID NO: 32426 - DNA, 2499 bp, Artificial Sequence
  Description of Artificial Sequence: Synthetic coding sequence
atgggtaccacagcttcaacggcccagcagaccgttagcgcaggcaccccctttgaaggcctgcagggcagcggcaccatggacagccgccactcagtcagcattcactccttccagagtacttccctgcacaattccaaggccaagagtataatcccaaacaaggtggccccagtcgtgattacctataactgcaaagaggaatttcagatacacgatgagcttctcaaggcccactatacgcttggacgactgtcggataatacccctgagcactacctcgtgcagggaagatatttcctcgtgcgcgatgtaactgaaaaaatggatgtactggggactgtgggttcatgtggtgctcccaactttagacaagtgcagggtggtctgaccgtttttggtatgggccagccgtccctgagtggcttccgcagggtgcttcagaagctgcagaaagatggacacagagaatgcgtcatcttctgtgtgagggaggagccagtcctattcctgcgggctgacgaagacttcgtgtcctacactcccagggacaagcagaacctgcacgagaatttgcaggggcttggtcccggggtaagagtggagtccctcgagctggccatccggaaagaaatacacgactttgcacagctcagtgagaacacctaccacgtgtaccataatactgaggacctgtggggtgagccacatgctgtggctatacatggcgaagacgacctccatgtaactgaagaagtgtataagcggccattgttccttcagccgacttaccgttatcataggctgccgctcccagaacagggcagtcctctagaggcccaactcgacgcatttgtcagcgtcttgcgggaaactccctcactcctccagctgcgggacgctcatggtccaccacccgcactcgtgttctcttgtcagatgggagtcggaagaactaacctggggatggtgctggggactctgatcctcctgcacaggtcaggcactacatctcaacccgaggccgctccaactcaggcgaagcctctgcctatggaacagttccaggtcatccaatcatttctgcgtatggtgccacaagggagaaggatggtcgaggaagtggatagagccatcacggcgtgcgcagaactccatgacctaaaggaggtggtcctcgaaaatcagaagaagttagaaggcattcgacccgaaagccccgcccagggttccgggagcagacacagcgtgtggcaaagggcgttatggtcattggaacgatacttttatcttattctctttaattactacctccacgagcagtaccctctggcattcgccctctccttcagtcggtggctctgtgctcaccccgaactatacaggctccctgtgacactctcctccgccgggcctgtcgccccacgagacttgattgctcgaggatcactgagagaggatgacctggtgtcacccgatgctctgagcactgtaagagaaatggacgtggccaatttccgccgtgtgccaaggatgccaatatacgggaccgcccagccgtcagccaaagcactgggatccatcctcgcatacctcacagatgctaagcgtcgattacgaaaggtggtctgggtgtctctgagggaggaggccgtgcttgaatgcgacggtcacacgtactccctgcgctggcccggcccccctgtagcacccgaccagctggagaccttagaggcacagctgaaggcccatttatcagagccaccaccaggcaaagaaggacctttgacataccgatttcagacttgtctaaccatgcaggaggtgttttcgcagcacaggagagcctgccctggactgacataccatagaattccgatgcctgacttctgcgccccccgcgaagaagatttcgaccaactgctggaggctcttagagccgccctgagtaaggaccctggcaccggattcgtgttctcttgcctgtccggtcagggcagaacaactacagctatggtcgtggcagtcctcgccttttggcatatccaggtcgtcatgaaagtcgtgcagctgctgccagatggacaccgcgtgaaaaaagaggttgacgcggctctcgacactgttagcgagactatgaccccaatgcactaccacctccgcgaaatcattatatgcacttataggcaggcaaaagccgcgaaggaggctcaggagatgaggagattgcagctccgttctttgcaatatctcgagcggtatgtgtgtctcattctttttaacgcctatctgcacttagaaaaagccgatagctggcagcgcccattcagcacctggatgcaggaggtggccagcaaggctggcatttacgagatactcaacgaactgggcttccccgagctcgagtctggggaagaccaaccttttagccgattgcggtaccgctggcaggagcagagctgtagcctggagccttctgcccctgaggaccttctctag

SEQ ID NO: 32427 - DNA, 1428 bp, Artificial Sequence
  Description of Artificial Sequence: Synthetic coding sequence
atgccttgccccagtaggaacacctcaagcccagagccacccactcccggcctgaagttttctttcctgagaggccagcgacagccgagtgtcacccccgagaaggcttcactgcagcacaatgggccttggaaagttctatgcagtctgtactctccgaagccgaatagggcaaagagcctgggaaaagcaggcactactcagaccaagacttccgggccggccacggccccttctcccctgacggaggaaaaagccgccttgcccgaggccagtgcaggaagtcccgagcgtggtcctaccctggaagaggaaccccctgggccagagcccagaattggggctcttggagtcaaagtttttagatctcgcattgcttgtctacccggagggagggatcgggccgggaggcccctcttgctcgtatccacaacagaaggcgcttgggaagctccttggtgtaccgtgtctgaggtgacaaagctcctatcatacctctgtacaataccgcggccagaggataaagcaaagggtctggcggttttaattgatgccagacgccaaccgcctcagcccggactggttagtgcactccaggcgactcaggcacaggtgccggcatccatcagagccattttgttcctgggagaaaaagaggcggccctacagctgcaaaccctcccagacgtgcagaaactcgatccctttcttgccgatctgcatcaggccagtagcctattacaggcctccatcgaggagttcgagaaagccgaccctccgggagggatgcaagaggctacccggtgcctgagcaaaagcaaagagctgatggaggccgtcctccgcgatcccgggttgcttggcctgcagcgggagggaggggccaccttggcacggctgcaacacgatgcgtctcggctggacttttccccggacgtgcgctcccaccttgcagccgcaaccgccctgtatagtttggtggacgaacagctacacgtgctggtgaccgccagtaacagcttactggggaaattagagctgagagtccgtcttggcaggctggaagctgcaattcaccaagtgtctgattggatggaacaggaaggccgcaggtgtcttcaatcactgacacctaaggacggcagtttggagactgtggagaaggctcatgcagagttcgaaaacttctttctgcaggcagctgcacagtaccggcgaggccttgagctttctaagcaggcagcccaattgggcgccaccgcgcggggagctggcgaggcagagcgggccgaattcccggaattagcagcctttgcttccacgcagcgggcttttcaagcggagttaacccacttctacatggccgctgagcgtcagaggaccgaccttgaaacgctcctccacctacaccgcttctgtaaaagatag

SEQ ID NO: 32428 - DNA, 480 bp, Artificial Sequence
  Description of Artificial Sequence: Synthetic coding sequence
atgcaccaaacccacgcgatccagcggctggaagtgctcccttcctttagcaatgagtcacccacctcacgggagacatccgaatcttggaccaaccaagacgatattttctatgcctatgcatcgatgtctcccggcgccgagcacagggggacaacacagctcttacgttttcagctggctccaattaagaagctcgagggttctttgcagactcattttcttctttcctccctgcaccctaggatgacattcccgggtcgggccggcgggggggaggcgggaagtcgacctccccgccggccgtgggcggggatcttgatactgcaacttccctccacacggggtggaaggaggagtggccatggagccgttcggagctggggcccttggaaagtggtggccgagcagcctgtagggggaaccgatcctcccgcgcacggtggaagaggacgcccatccccaaacgaaaacacatag

SEQ ID NO: 32429 - DNA, 3108 bp, Artificial Sequence
  Description of Artificial Sequence: Synthetic coding sequence
atggtagtctttgtgggccggcgcctgcccgcactgctgggcctcttcaaaaaaaagggatccgctaaagcggaaaacgacaagcatctgagcgtgggtcctggacaggggcccgggagcgcagtcgatgaacatcaggataacgtgtttttcccgagcggcaggcctccccacctcgaagaactacatactcaagcccaagaggggcttcgtagtctacaacatcaggagaaacagaaattgaataagggtggatgggatcacggcgatactcagagtattcagtctagcaggactggcccagacgaagacaacatctccttttgttcacagacgaccagctatgtggccgaaagcagcactgcagaagacgccctgagcattcgctcagagatgatccagcgtaaaggaagcacttttagaccgcacgacagctttccaaagtcggggaagagcgggcgccgacgccgggaacggcgaagcactgttcttggattgccacaacacgtgcagaaggagcttggactccgaaacgagcgagaagctcccggaaccccacgcgcacctggggcgagagacgccgttcgaatccccacagtggatggtagaccccggggaactagtggaatgggggcccgggtctcgctgcaggcactggaagctgaggctgaggccggggctgaaaccgaagccatgctacagcgccatattgatcgtgtttacagggacgacaccttcgtcgggaggtctactggaacccgtgccccccctctaacaaggcctatgagcctggcggttcctgggctgacaggaggcgccgggcccgcagaaccattaagtcccgcaatgtcgatcagccctcaggccacgtatctgtcgaagctcatccctcacgccgtcctgcctccgacggttgacgtggttgccttggggaggtgttctttgcgcaccctgagccgctgctctctgcatagtgcttctccggcctccgtgcgcagcctcggtaggttctcttccgtgagctccccacaaccaaggtcccggcacccatcttctagctcagacacctggtctcacagccagtcctcagatactatagtgtccgatgggtctacccttagtagcaaaggtggaagcgagggccagccagagtcaagcacggcttctaactccgtggtcccaccaccgcaggggggcagcggacgcgggagtccctcagggggttccacagctgaggcttccgacacgctgagcattcggtcatccgggcagttgtctgggcgaagcgtgtctctgcgtaagctcaaacgtcccccgccacctcctcgccgcacccactcccttcaccagagaggccttgccgttccagacggtcctttaggccttcctccaaagcccgagcgcaagcagcagccccagcttcctaggccgccgaccaccgggggctctgagggcgctggcgctgctccttgtccgccaaacccagcaaattcttgggtcccgggcctgtctcctggaggaagcagacggcctccccggagcccagaaagaacactgtcccccagctccggctatagctcacagtcgggaaccccgaccctgccccctaaaggcttggctggacctcccgccagcccgggcaaagctcagccgccgaagccagaacgagttacatccctgaggagccctggggcatcagttagttcgagtctgaccagcctctgtagcagctcttccgacccagcgccctcagatcgtagcgggcctcagatcttaaccccacttggggatcgatttgtaatcccaccacatccaaaggtccccgcccccttttctccgcctccttcaaaacctaggtcccctaaccccgccgcccctgctctcgccgctcccgcagtggtccctggacctgtcagtacaaccgatgcttcacctcagtcccccccaacacctcagactaccttgacaccgctccaggagagtcccgtgatttccaaggaccagagccccccgccctctcctcccccgtcctaccacccaccaccccctcccaccaagaagcccgaggtggtggtggaggccccttctgcgtctgagacagcggaagagccccttcaggatcctaactggcctccacccccaccaccggccccagaagaacaggacctgtccatggccgatttccccccacctgaagaagccttcttctccgtcgcttcaccagagcccgccggacctagcggcagccctgagctggtgtcaagtcctgccgccagctctagttctgctaccgctctacagatccagccacccggcagtcctgatccccccccggcaccaccagcgccggcaccggcatcgtcagccccaggccatgttgcaaagctgccgcaaaaggaacccgtgggctgcagtaaaggtggcggtccaccacgagaggacgtcggggcaccgctggtgacgccctcccttctgcaaatggtccggctgaggtctgttggcgctcccggaggggcccctacgccggccctcgggccctcagctccacagaaaccattgaggagagctttgtccgggagagcgagccctgttccagccccaagttcggggcttcatgctgctgtacgtctcaaagcttgcagcctggcagcctcagaagggctgagtagtgcccagccaaacggcccaccagaggccgaacctagacctccacaatcccctgccagtactgcatcatttatcttctctaaagggagccgcaaactgcagctcgagcgacccgtgtctcctgagacacaggcagatctgcagcgcaatctggtagctgaactcagatcaatctctgaacagcggccaccccaggcccctaaaaaaagtcccaaggctccaccgcccgtagcccggaaaccaagcgttggagtcccgcctcctgcctcaccatcgtatccgcgtgctgagcctctcactgccccccctactaatggcctgcctcacacccaggaccggacaaagcgggagctcgccgaaaacggcggggttctgcagctggtggggcccgaagagaaaatgggactgccgggatcagactcccagaaagagctggcatag

SEQ ID NO: 32430 - DNA, 240 bp, Artificial Sequence
  Description of Artificial Sequence: Synthetic coding sequence
atgatctttacccctttcctgccgccagcggacctttccgtgtttcaaaatgtcaaggggctgcagaacgacccggaggagtgggttgccgtatccgacgcgactgaagacccgagcggtggaacaggcttgccacgagagccagctctgctgagagggtcttggcgttccaggttccagcgggctcttgcctgtttcacgaagtgctttcgcggcggttaccgagctctcggtatatag

SEQ ID NO: 32431 - DNA, 228 bp, Artificial Sequence
  Description of Artificial Sequence: Synthetic coding sequence
atgatttttaccccattcctccccccagccgatttaaacgtgaagggactccagaacgatcctgaggagtgggtggctgtttcagacgcgactgaagacccttctggtggcacaggactcccccgcgagcccgctctcttgcggggttcttggcgaagtaggttccagcgcgccctggcttgtttcacaaaatgttttcggggaggatacagggctctgggcatctag

SEQ ID NO: 32432 - DNA, 2217 bp, Artificial Sequence
  Description of Artificial Sequence: Synthetic coding sequence
atggaagattgcctccacacctcctcagagaatctctccaaactggtttcctgggcccatagtcacggtacaatctgcagcctgatccctaacctgaagcatctgctttcagagggaagccacggtaatctgaccgcaatgtggggctgctccgccggccacgcataccactggcctctcactgctacctgtagggctgggtcccaggaacgcgtgtgctttcaggacaaccgttctttcaactcagattcccccagcatcataggagtcccaagtgaaacacaaacatcgccagttgaaaggtatcctggccgcccagtcaaagccaaactcgattgtaatagaacacgcgactcatgcgatttctcttattgttccgagccttctgagctggacgaaaccgtggaggaatacgaggacgagaacactctgtttgatatggtttgtgaatcttccgtgaccgacgaagacagcgatttcgagccgcagactcagagaccacagtcgatagcacgcaaacggccaggcgtcgtaccttcctcactgcacagcagttcccaaacgcagatggttgatgaatgttccaatgatgtcatcataaaaaagatcaagcaggaaataccggaggattattatatcgtcgcaaatgcagagcttactgggggcgtggatggcccagctctgagcctgacccaaatggctaagccgaagcctcagacgcatgccggtccctcatgcgtaggtagcgccaagttgatcccacatgtgacaagcgccatcagcacagagttggatccacatggaatgagcgcgtccccgagcgtgattagcaggcctattgttcagaaaacagctcgcgtctcacttgctagcccaaaccggggcccgcctggaacccacggtaccaaccaacaggtggcaatgcaaatgcccgtgagtacctcccaccccaacaagcaaatcagcatccctctgagtgcactgcagctaccaggccaggatgaacaggtggcttctgaggaattcctgtcccacttacccagtcaggtctctagctgcgaagtcgcactgtcgccgagcgtaaacaccgagccagaagtgagctccagtcagcagcagcctcctgtcgcccccgctattaccactgaggcgacagcccagtgcatacccgaccaggacgaacgcgccgctgaattatcgcgagagcagaacgagaagaccatcaggagcacacagactgcattgagaaactttcgggaattcttgatctccaagtatccctctgaaacgcgcgagatctacgtgatcccttgcaaggagttggatgcctatcttgccagttttttcgtggatgctcgacagaaagatggctccgaatatgaacccaattctctcgcgaactaccagtgtggcttggagcgatatctgaaggaacacaggtatggttattcaattaccagagacaaggagttcaagcgaagccaggaggccctgaagcagaaacaaatcgagttgaggtgcaagggtaaaggcaacaaacctcacaaatcaatgaaactcacgttcgccgatgagctgattcttcggaaaaggggcctgctctctagatataatcccgaggggctcctcaatctcgtgtggttaaataatacaaaggctttcggtcactgcaccggctttcacggatccactttaaaatggggcgacattcgcctgagggttaccgagacgggactggaatacttagagtggatgggacaggacaccggagatttaaacgcaaagaccaagagaggtggcaccgactcccgagtttatgctacacaacacgcccctcagacctgtcctgtgcaagactacaaggagtatgcccaacgccgcccccctgctatgaggtacgaggacgcccccttctacctgtcgatcaagccagtcgtgaatttagccgctctgcactggtacaactgtcaggccttgggaaaaaacaaacttgccaagatggtgaaaaccatgtgcgagaagggcaacatccccggtcggaaaaccaacttttctgtttatcagtcctgctctactctctctgaagcacagagtaaccaactggtcctgatatgtaacaacctgtcacagcaagccgctcaatctgtcgccggtcacagcaataatggcaattttattgtctctgcgtcatatgattccagctcagacacagcatag

SEQ ID NO: 32433 - DNA, 390 bp, Artificial Sequence
  Description of Artificial Sequence: Synthetic coding sequence
atgaaggctcagggtgctatagccatggcttcaattgccaagcagacatcctctctcgtccctccctatctgggaatgatcctcaccgcactgttacagggactcgcggggagaacttgggccggaaaggaggagcttcttaaggcaattgcctgtgtggtcaccgcctgcagtgctgagctcgagaaaagtgtgccgaatcagcctagtacaaacgaaattctgcaggccgtgctgaaggaatgctccaaggaaaacgtcaagtacaaaatcgtcgcaattagctgcgctgcagacattctgaaggctacgaaagaagatagatttcaagagttttccaacattgtgataccacttatcaaaaaaaagacgttggaaaacctggagtag

SEQ ID NO: 32434 - DNA, 390 bp, Artificial Sequence
  Description of Artificial Sequence: Synthetic coding sequence
atgaaggcccagggagctattgccatggcctcaatagcaaaacagacgtcgtcacttgtgccaccttacctaggaatgatactgacagctctgctacagggtctggccgggcggacatgggcgggcaaggaggaattactcaaggctatcgcttgcgttgtgaccgcctgctcagcggaattagagaaatccgtccccaatcagcccagtaccaatgagattctgcaggctgttctgaaagagtgcagcaaagagaacgtgaaatataaaatcgtggccatttcctgtgctgcagacattctcaaagcaaccaaagaagaccggttccaggagttcagcaatatcgtcattccactgatcaaaaaaaagacattggaaaatctggagtag

SEQ ID NO: 32435 - DNA, 465 bp, Artificial Sequence
  Description of Artificial Sequence: Synthetic coding sequence
atgtgcacagtggcccatacctgcatcgaacacatgtgcacctacatgcgcctccaccctctcgcgcatccccacacctgcgccctggctcccatttgtacacatgttcacacactggctcacatgtgtatctgccgcaatgcccctctgcacctttgtgacacacctgctcacctacatactcccatttgcattcaagcacagacccactctcatacttttgcgcataccgccacgaacttgcataagcagcacctgtacaccgatacttatcccttcgtgccgattcagtgtaccctgacccacctacacacagccgtgctcgcccatactttcgctcatactcatttgcacacatgtacacatactactcacctctcagtgcagcatacctatctgtgtgcctacatgcacatctgtacctgcactcaacagtggcacactctgctgtatcactcaccttag

SEQ ID NO: 32436 - DNA, 126 bp, Artificial Sequence
  Description of Artificial Sequence: Synthetic coding sequence
agaaagaacggacagcaacagccaaggggcagaccagggagcgcgagacctcctgcccaaccacccgaatgtggtgccgatcagagagtaactctgcttacaggtgatcccgtttctgccgcatag

SEQ ID NO: 32437 - DNA, 372 bp, Artificial Sequence
  Description of Artificial Sequence: Synthetic coding sequence
atggttgatggccgtactaggactattatcaacgatatttttttcactgaacctactcctgagatgtctagtctgcccgtccggagccactctagtctgtcgctgaacttggtcagtctcatggtgatttgtcgcggcatcatcaagcttgttatccacttccgcatgtactgccccccacgattgaaggccaagcatatcgaacccaccctgcggcctgtccctctgaaagagctgagaatatcccactggcctaacgaatgtataagacatagtgcctcagttcctatggctacaggcgcaaacgggcttgaaacaaaagatgagacaaaacggaatgctgaaaagtgcgcctgtagcgtgttcttgtag

SEQ ID NO: 32438 - DNA, 372 bp, Artificial Sequence
  Description of Artificial Sequence: Synthetic coding sequence
atggtggacggcagaacccggacaattatcaacgatatattttttacggagcccaccccggagatgtcttcattgccggtgaggtctcatagttctttatctctgaacctagtctcgctgatggtgatttgcaggggaattataaagctcgtgattcatttccgtatgtactgtcccccacgcctgaaggccaaacacatcgaacctacactgcgtccagttccactgaaagaactccgcatcagtcattggccaaacgaatgcattcgccactccgcctctgtgcctatggctacaggagctaacggcctcgaaacaaaagacgaaactaaacggaatgccgagaagtgtgcctgctccgtgtttttgtag

SEQ ID NO: 32439 - DNA, 423 bp, Artificial Sequence
  Description of Artificial Sequence: Synthetic coding sequence
atggactgtaagtctccgaaaagagctaacatctgcccacacttaccggggggcggcctgttcagcaccccacctagtcaggccgcttggagaaccctcttaactgcgctatgcttcccgggaccaacttgtacagggcctatgagagaggggcctcgcgccgtgtacaacccccctcgagcacataggaactcttcagacaattgtgtgatgaagcacctgctgtgtgctggcgacaaaaacggtacaagacgccacgctcttccaagcccacttgaagggtcctttcagcctgggcgccaaatccctccaccccagacacctagtaccgacccgcagacgcttccgctctcctttagaagcttactgcgttgccaccagctctgcgccgcctcgttacctcccagccttaagttgccttag

SEQ ID NO: 32440 - DNA, 423 bp, Artificial Sequence
  Description of Artificial Sequence: Synthetic coding sequence
atggactgcaaaagcccaaagcgcgccaacatctgccctcacctcccgggaggcggcctcttctcaacccctccttcccaggctgcctggcgaaccctgctcacagcactgtgtttcccagggcctacatgtaccggacccatgcgcgagggaccaagggccgtgtacaacccaccaagagctcaccgaaacagcagcgataattgtgtgatgaagcacctgctctgcgccggggataaaaatggaacaagaagacatgcccttccctcacctctggaaggctcttttcagccgggccggcagatcccgcccccacagacacccagtacagatccccagactcttcccctcagctttagaagtcttctcaggtgtcatcagctgtgcgctgcatcgttacccccttctctgaaactcccctag

SEQ ID NO: 32441 - DNA, 651 bp, Artificial Sequence
  Description of Artificial Sequence: Synthetic coding sequence
gcctggaccgtcagcgggctccttagcgccgcattcgaaccagaggtaccagcttccctgtcacaaaagtctgaccacagaagttctctcccatcgagccccagcctccccctgagtaaaacactagcagtcgcctatgaccccgaagactcttccgccgccaattggtgctttggactgtgtgcggtgccagggccagcatcactggatctaggccgcccctggccagtcgaggaggcccaggttaaagcgggaggttgttgctggctgtccagtttgctgctggaagtcagtgcttccctcaggatgggacgcaccgatccattgactgggttacagtccttggaaggatccatcgggcagggtaatgggggccacgtgacttcctgcagggctccttgccataggccaaaagagcagctgtgtccgctgtccgtcgggggtcctggcggtgaagtcgatcgccatctgcctcccacagggatatggcagcaggagcccggcctgctgtgtaagaagggcagaccaaaaggggaacagtggcccatcaagactctggagaacaaacatccatttccaaggtggttacaaatcattacatcttgcaagtccactccaggggagcagctgactttcatcagcctcagctag

SEQ ID NO: 32442 - DNA, 720 bp, Artificial Sequence
  Description of Artificial Sequence: Synthetic coding sequence
ccccagatgagcgcggtgtatactcctccatctgtctccactcatcagatgccacggaaccccaacccccagcagcgaccacagatgtccgcagtctacacaccacggagcgcccctacacgctgccctcagatgagcgcggtctataccccaccctctgcacctaccgatcagatgccacggaatccaaatgcgcagcagcgcccacagatgtcggccgtctacacacccccctccgcccctactgatcaaatgcccagaaaccctaatccccaacagcgaccccagatgagtgctgtgtatacacccccaagcgctccgacggaccagatgccacgtaaccctaaccctcagcagcgtccccagatgtcagccgtctatacgcccccctctgctcccactgaccagatgccaagaaatcccaatcctcaacagcgaccgcagatgtccgctgtgtacgctccaccaagcgcccccacggaccagatgcctcgtaatcccaatccacagcaaagaccgcagatgagcgccgtatatgcgccaccttctgcacctaccgaccaaatgccccgaaacccgaatccccagcagaggttacaaatgtcagcagtttacgcccctccttcagcacccactgaccaaatgcctaggaacccgaacccacagcagcggccacagatcagcgcacccagatgccaattaagcattaggcaccggtag

SEQ ID NO: 32443 - DNA, 240 bp, Artificial Sequence
  Description of Artificial Sequence: Synthetic coding sequence
atgaagcttgctaaaacagcagttctcgacccagcaacctataccagcttttccccaggcctctccacgtgctccagctctcagcctcccggcgaccgtaggaaggggttactaggctgtgtgggcagtggtcattgccccctccctacgccggcacagttccccaaggttcagaggccacctacacttttgggaggaaagaacacctcaactcagaccaccttgcacccagttatttag

SEQ ID NO: 32444 - DNA, 369 bp, Artificial Sequence
  Description of Artificial Sequence: Synthetic coding sequence
gacccagggtccctgcgctgtccagtttgcctgagcatggagggctgcctggaaggaactactgaagagatctgccctaagggcacgacccactgttacgatggcctgttgagactgcgcgggggcggaatttttagcaatctgagggtgcagggctgcatgcctcagcctgtatgcaatttgctgaatggtacccaagagataggtcccgtggggatgaccgagaactgtgatatgaaagatttcttacagcttaagcctgtaggcctgttggaagaacacaacgtcggggagaaggaaagggggcagggacaacaccagtgcgtacagcttgactggcagaagagggcagccactggagttagctag

SEQ ID NO: 32445 - DNA, 456 bp, Artificial Sequence
  Description of Artificial Sequence: Synthetic coding sequence
atgcatgccggaaaaaggtctcctctgactcagagtatttcgtgtgtgtgcctgcctgaattgggggccttgtgggagattgaaagcgctcgagtgaatcttcgcgtctccgggagagaggcctctcgcgaaatggagtcttcaccgcgtccacacaggattgctggggttaagagattcctgaagcacgcaggcaaatggagtctgcgctggttcctgagtcctaggtggattcttcaatttcggcgctgggcccggaagtggtctcgtttcactcgctcgtctttccaggtgaggtgggcagcggtgcctgccggaaagtgtagccagcatcagggcctcagtgctgtggcaacggcatcccccggggtcttttgggaaatggaatttgatgtgtcgagtcctctgaccgagggcgccgggtccccaatgtcatctaagcacgcaggtgagtag

SEQ ID NO: 32446 - DNA, 366 bp, Artificial Sequence
  Description of Artificial Sequence: Synthetic coding sequence
atgatcgattcacctagaaaagagggagccctcagtccccctttaggcggctggcgcctaggagacagacggtgcgccggcggcaagagaactgagcggagaactcctgagaagctgtggggcatccgcggcgaaaaggaaggcgtgaagagggaaggccgactgtctcgcggcggcggtgcaggagcaggagcaggcgctggtggagtgaccgccccccgcccccccttgcccgctctccattccgcggcgcccggcctgcctcctccgccacccccccctcctccaccgcctccacttcctccaccacccggggtagccggctgcggccagaatcggtcgcccaatagagctgccggggagtag

SEQ ID NO: 32447 - DNA, 726 bp, Artificial Sequence
  Description of Artificial Sequence: Synthetic coding sequence
atggctcccgcgaccgacacggcctggctgcccccacacccagaaatccaacttcgtctgctctgtccgggagagacgtacggaaagctaatgggcggcagcccaagcgccggacccacaacccagtcacagcctcatgccctccgtccggggctgagggggagaggaggctggtggccgcagcccttctggatccattcacctccactgactcacagtgtaggaacatttatctgcttagatggcctcgtgtgtgccctcaccgcccctggcctcggtgtaggactgacgcccgccccctggaggcccccaggccagtcccggatgctcgaaggacatggcccttggccgacccctgggagtagaccaggtccaacgtgcgtgtgtctcttaacccctgcatccagctctctacggccatgcctctctgataggggaacatgcccaggtgccccccagggcgcagtggggacctgtcgggccagtccacagagtccatgtcatcgtcacccttcactgagatcagggctagagtggacgcaacccccagatcaggaccaaggactgctcacgccaggcagtccgcccctggtgagcggcgttactcagaccccatggaccagtccattctgccctcctcgacctactccttgggtaggagcagcctttaccgcggccaatccgtgtccgccagcacccaccgcctcttccgtcaccgggctttag

SEQ ID NO: 32448 - DNA, 714 bp, Artificial Sequence
  Description of Artificial Sequence: Synthetic coding sequence
atgcccgtccacccagcctggctgggcagtgcctgtctgccacacgcctcacatggtcctgccccacagtcctccgtgggtggtctcttggtgtcagtaaaatctcctcccggcgatgtacatgccgccagagcctgtgcgcctggaaggcactcaggcgaggggcctccgcaaggtaatctttccccttcatgcccggctgaggctggccacggatgtgccagcactggccgccaagtgggagtttcaggtgcaggcagttcaccgtcaggacccgccccttgcgtgaaatgctcagcatgggtaggtacgtgctttcctctgtcattactgcaggccgccggcggacccgctgggagtccgaacggtttctgcccagaaccttgggctcccgaccacgcccctactctgcacggccttaacaaatctctgtgtcagggacccagaagcggcggggctcagcgtaagccgagggcccacaccggggaaggtgttagtggtcttggtttaacccaaccccgcttgagcagcagtctgcggatcagctggcacctgctggcttgtgtggccacacaagtcggttgtgcatgccggctgcgtgaaaagaccctcggtgaagattacgtgtcagcctttctgccaagcaccggcccttcttgggcccactgcgatcagactatgtgcaagtccactagagagtctggccggtcatag

SEQ ID NO: 32449 - DNA, 966 bp, Artificial Sequence
  Description of Artificial Sequence: Synthetic coding sequence
atggtgtcccagtcaactgtgaggcaggacagccccgtggagccgtgggaggggattagcgatcattctgggatcatcgatggctccccccggctcctaaacaccgatcacccgccttgccagctcgacatacgcctgatgaggcataaagccgtgtggatcaacccacaagacgtccagcagcagccacaggacctccagagccaggtgccggctgcaggaaattccggaacccacttcgtgaccgatgcagcctccccctctgggccaagtccaagctgtcttggcgacagcttggcagagacaaccctaagtgaggacacaacagatagcgtgggctctgcgtcaccccatggaagcagcgaaaagtccagcagcttctctctatcctcaaccgaggtccacatggtccgccctggctacagccacagggtcagcctccccacaagtccaggaatcctggcaacgtccccttaccccgagacagactccgcattcttcgagcctagtcacttaaccagtgcagccgacgagggggccgttcaggtctcccgtcggacaatcagttcaaactcattctctccagaggtcttcgtgctgcccgttgatgtggagaaggagaatgcacacttttacgttgctgacatgatcatttccgcaatggaaaagatgaagtgtaatattctctcccagcagcagaccgaatcatggtctaaggaggtcagtgggttgctgggtagtgatcagccagactcagagatgaccttcgacacaaatataaaacaggagtcagggagctcgacatcctcttattccgggtacgaaggatgcgccgtgctgcaagtttctcctgtgacagagactaggacctatcacgacgtgaaagagatatgcaaatgtgacgtcgatgagttcgttattcttgtgagcttgatgagccagaccagcattctgcagaattattag

SEQ ID NO: 32450 - DNA, 1788 bp, Artificial Sequence
  Description of Artificial Sequence: Synthetic coding sequence
atggtctcaaaccactatttcctgttgtgcgttaatcttcccctgagggaaatccatactcccggcccatccccctcctgtttgggtgattctctcgccgagactaccctttctgaggacaccacagattccgtgggctctgctagcccgcatggctcctcagaaaagtctagctccttcagcttgtccagcacagaggttcacatggtcagaccaggttacagtcatcgagtctctctgcccacatcccctggaatcctcgccacatccccttatcccgagacagacagcgcttttttcgaaccctctcaccttacctctgccgcagatgagggggccgtgcaagtgtccaggcgcacaatcagttctaactcgttctccccagaggtcttcgtgctgccagtggatgttgaaaaggagaacgcacacttctatgttgctgatatgatcataagcgctatggagaagatgaagtgtaatattctgagccagcagcagactgaaagttggagtaaagaagtgagcggtctccttggaagcgatcagcctgactccgagatgacttttgacactaacataaagcaggagtcaggctcttcaaccagctcatactcgggttatgagggttgtgcagtgctgcaagtgtccccagtgacagaaactcgcacttatcacgatgttaaagagatttgtaaatgcgatgtcgatgaattcgtaattctggagcttggggactttaacgatatcaccgaaacctgttcttgttcctgtagcagctctaagtccgtcacctacgaacctgactttaactctgcagagcttctcgccaaggagttgtaccgggtctttcaaaaatgctggattcttagcgttgtgaatagtcagctcgccggatctctgtccgccgcaggatctatcgtggtgaacgaggagtgcgtgcgtaaggatttcgaaagcagcatgaatgtagtccaggagataaagttcaaaagcaggatacgggggactgaagactgggctccgccaaggtttcagattatattcaatatccacccacccttgaagcgagacctagtggtggccgctcagaacttcttttgtgcgggctgcgggacacccgtggaaccaaaatttgtcaagaggctaaggtattgtgagtacctgggaaaatacttttgcgattgctgccactcttatgccgagtcttgtattccggctcggattttaatgatgtgggacttcaagaagtattacgtcagcaatttctctaagcagttgctagattcaatttggcaccagcctatttttaaccttttgtccatcggccagtccttgtatgctaaagctaaggagcttgacagggtgaaggagatccaggagcagctttttcacataaagaaactcttgaagacttgtagattcgccaactctgccctcaaggagttcgagcaagtacccgggcacctgacagatgagctgcatctatttagcttagaagatctggttcggattaaaaagggccttctcgcaccccttctgaaagacatcctcaaagctagtttggcccatgtcgccggttgtgagctttgccaggggaaaggatttatctgtgagttctgtcaaaatacaactgtgatcttcccatttcagacggctacctgtcgccgctgctcagcttgtcgtgcatgctttcacaaacaatgctttcagtcatctgaatgccctagatgcgcccggatcacggctcgaagaaaactactcgaatcagtagctagtgccgcaacatag

SEQ ID NO: 32451 - DNA, 1908 bp, Artificial Sequence
  Description of Artificial Sequence: Synthetic coding sequence
atggtttctcagtccacggtgcgacaggactctcctgtcgagccctgggaaggcataagcgatcatagtggaatcattgatggttcccctcgactgctgaacactgaccatcccccgtgtcagttggacatccgacttatgcgtcataaggctgtgtggatcaatccccaggatgtgcaacagcaaccacaggatctgcagtctcaagtgcctgcagcaggaaacagtgggacccatttcgtgaccgatgccgcctccccatctggtcccagcccgtcgtgccttggggactcacttgccgagactaccctgtcagaagatactaccgactccgttggctccgcctccccccacggaagttcagagaaatcctcctctttctctctatcttcgaccgaggttcacatggttcgacccgggtatagccacagggtaagcctcccaactagccctgggattctggccactagcccttatcccgaaacagactcagcattttttgaaccatcccacctcaccagcgccgccgacgagggggctgtccaagtcagtaggcggacaattagttccaattcattcagtcccgaagtattcgtcctgccagtggatgtggagaaagagaatgctcacttctacgtcgctgacatgattatcagcgccatggagaaaatgaagtgcaacatcctgagtcagcagcagacggaatcttggtccaaagaggtgtcaggccttctgggtagtgatcagccggacagcgagatgacatttgacaccaacattaaacaggagtccggatccagcacaagtagctactcaggatacgaaggttgcgcggttctacaggtgtcacctgtcacggagaccagaacataccatgatgtgaaggaaatctgcaagtgcgatgttgacgagttcgtgatactcgagctgggggactttaatgacattactgaaacctgtagttgcagctgctcatccagtaaaagtgtcacgtatgaaccggattttaactctgcagagctgttagctaaggagttgtaccgcgtgtttcagaaatgctggatacttagtgtcgttaacagccagctcgctggctccttatccgccgcaggcagcattgtggtgaacgaagagtgtgtgcgtaaagacttcgaaagtagcatgaacgtcgtccaggagattaaatttaagagcagaattagggggactgaggactgggcaccaccccgcttccaaatcatttttaatatccatcctcctttaaagcgggacctggtcgtggccgcccagaacttcttctgtgccggatgcgggacacctgttgagccaaagtttgttaagcgtctccgttattgtgaatacctgggcaaatatttctgcgactgttgccatagctatgccgagtcctgtattcctgctcggatcctgatgatgtgggatttcaagaagtactatgtctcgaacttcagcaagcagttgttagactccatatggcatcagcccatttttaatcttttgagcataggacaaagcctgtacgcgaaggcaaaggagctggatcgggtcaaggagattcaggaacagctcttccacattaagaaactgcttaagacctgccgattcgccaacagttgcgtgaaggaacgcgccctgttcgtgaatttcgcccggattcggctgtctagctctcacttccgacagcaacacgtggaggacgtacagcgggcgggcctagcttttactaactctgcttcttctcccccatctgcccccggcgtgaggggatctcagagaggggaaaacttctggaaagtgtggccactccaacagcacgatgcgcctgaatattgcgaaaaagattgcagtacttgcctgatgatcactccaatctgcgtgtactattggtag

SEQ ID NO: 32452 - DNA, 1908 bp, Artificial Sequence
  Description of Artificial Sequence: Synthetic coding sequence
atggtcagccaatccactgtgcgccaggattccccagtcgagccttgggaagggatcagtgaccacagcggtatcatcgacggctcgcctcgcctgctaaacacagaccatcccccatgccagctggatatccggttaatgagacacaaggccgtatggatcaacccccaggacgtgcagcaacaaccacaggatttacagtcccaagtgcccgctgccggcaactccgggacgcatttcgttacggacgcagcctctccctcaggcccgtccccatcctgcctgggagatagcttggcagagacaacactgtcagaggataccacagactccgtgggctccgcatctccacacggcagttcggagaaatccagtagtttcagtctgtcatcgaccgaggttcacatggttcgacccggctatagtcatcgggtgtccctgccaacttcacccggaattctggctacctcgccttaccccgagacagattcagccttttttgagcctagccacctcacctcagccgctgatgagggcgccgtacaagtgtcccgccgaacaataagctccaactcattttctccggaagtttttgtcctgccggttgacgttgagaaggagaacgctcacttctacgtggctgacatgattattagcgctatggagaagatgaaatgtaacattttaagccagcaacaaactgagagttggtctaaggaggtatcgggacttctgggttcagatcagcccgatagcgaaatgacattcgacacgaacattaaacaggagtctggtagctccacctcatcttacagcggatatgaaggttgtgccgtgctgcaggtttcccctgtgaccgagactagaacataccacgacgtgaaagaaatctgcaaatgcgacgtagacgaatttgtgattcttgagctgggggattttaacgacatcactgaaacatgctcatgcagttgctctagcagcaaaagcgtgacttacgagcccgatttcaactctgctgaacttctcgctaaggagctgtacagagtctttcagaaatgttggatcctctcagtcgtgaatagccaactcgcaggatccctaagcgccgctgggtccatcgtggtgaacgaagaatgtgtcaggaaagacttcgaatcatcaatgaacgtcgtccaggagatcaagtttaagagtaggattcgaggtactgaagactgggcaccgccacgctttcagataattttcaatatccacccgcccctgaaacgagaccttgtcgtggccgcccagaactttttctgcgccggatgtggtacaccagtcgagcctaaattcgtaaaacggctgcgttactgtgagtaccttggcaaatacttctgtgactgttgtcactcctacgccgaaagctgcattcctgcacgtatcctaatgatgtgggactttaaaaagtactacgtaagcaattttagtaaacagctgctggacagcatttggcatcaaccaatcttcaatcttcttagcatcggtcagtccctgtatgccaaggcaaaggagttggacagagtcaaggagatccaggaacaactgtttcatattaaaaagctcctcaagacatgtcgctttgctaatagttgtgtgaaagagagggcactttttgtcaactttgcccggattcgcctatccagttcccatttccggcagcagcacgtggaggacgtgcagcgcgcaggattagcatttacaaactccgcatcatcccccccctctgcacccggggtgcgcggctctcagcggggcgaaaacttttggaaggtctggcccctgcagcaacacgatgctcctgagtattgtgaaaaggattgctcaacctgtctgatgatcacgcctatctgcgtgtactactggtag

SEQ ID NO: 32453 - DNA, 396 bp, Artificial Sequence
  Description of Artificial Sequence: Synthetic coding sequence
atggacagcactcacccccagcactgcgcctgtaactcacagatccgtccacggtgggattgtgtcgctcactgcttcctatgggcacctggtttgccatctagggatgatcctggcgctgacaagggagaggcctccggcggcgtcggaacggtgagtctgacactgagccaacctagggagcgatcactgcaagtgaaaaaggtgttcgtgaagggcatgaaaaaagaacgtgctcttggagagggagctgcatggtggcagtctcagcggctcgtgagccccgggaagcatgaccgggtgtccacccaccggaaatcccagtccgtctttaccggtgtgagcgcaggtgacaagcagtttaccactaccttctctatagtgtttaccatttag

SEQ ID NO: 32454 - DNA, 1023 bp, Artificial Sequence
  Description of Artificial Sequence: Synthetic coding sequence
atggcacgggatctcatcggtccggcactgccacccggattcaaggctcggggaaccgcagaagacgaagagcgtgatccgtccccagtcgctggtcccgcacttccacccaattataaatcttcatctagcgatagctctgactccgacgaggattcatcgtctctttatgaagagggcaaccaggagtctgaggaggacgacagtggtccgacagcccgaaagcagcgcaagaatcaggacgacgatgatgacgacgacgacggcttcttcggaccggctctgcccccagggttcaaaaagcaggacgactcgccccctaggcctattataggcccagctctgcccccgggttttattaagagtacacagaagtctgacaagggacgcgatgacccaggccagcaagaaacagattcctcagaggacgaggatatcatcggcccaatgcctgccaagggtccagttaattataatgtcactaccgagtttgaaaaacgagctcagaggatgaaagaaaaactcacaaagggcgacgatgacagctcaaagcccattgttcgagaatcttggatgacagagttgccacccgaaatgaaagatttcggcctgggaccccgcacctttaaacgaagagcagatgacacatccggggacagaagcatatggacagatactcctgcagacagggagagaaaggctaaagagacacaggaggctcgaaaaagctcgtctaaaaaagatgaagagcacatcctctccggccgagacaagcgtcttgcagagcaagtttcatcgtacaatgagtctaagaggagcgagtcgctcatggacatacaccacaagaaactgaaaagtaaggctgctgaggataaaaataagccacaagaaaggattccttttgatcgtgacaaagatttgaaggtgaaccggttcgatgaggctcaaaagaaagcattgatcaaaaagtcacgggaactcaatacgagattcagtcacggaaaaggaaacatgttcttatag

SEQ ID NO: 32455 - DNA, 423 bp, Artificial Sequence
  Description of Artificial Sequence: Synthetic coding sequence
atgtggccgttccgacttcggtgtccaatctatttcaagactcgcctgctttacagctccagccaggacgggtttttatctagtagcaccaattattataaccaccgaacgtatccagggctggtcaattggttgtttgtgctcacagagcctgagctcactggcgagctgggtgacgacgatcggaagggtatgcatactggtggcattattcgatggctgggaagaccatccagccagctgaaacctatcttccatgcggaggaaagacgggttcctcctccacccgagagactggtggggagggcctccccccgcgaacaggctacggtgtttaagcggatttgtgcgccactgcacgccgaggtcttttgcagagcaggtctgtgcgcatgccaccctgattgcactgcagcggggtag

SEQ ID NO: 32456 - DNA, 408 bp, Artificial Sequence
  Description of Artificial Sequence: Synthetic coding sequence
atggtcgccacctggggaggacggcagctgctgccacaatgttccgggccgcccttgactccaggtagccccgctcctagcgtggcgcaggcttcgaggccagctccaccgtctccccgaaagacctcccccgggcccccacagccttcagcttccccttccctgccattttcacccctgttggcaggctgttctcgcctgctgcctgtcttggccccatccttatcctcagtgcaccggtgcccacttggtgcgcgtgccagtcgactgccatggaaacttgaggctggcacatcctcctccggagaccgacccctgtgtttgcactccgggcagcgaggggcctgcctgaccgacgagcagggtagcaccctgagtccccggcagaggagaggccctggcaagtag

SEQ ID NO: 32457 - DNA, 474 bp, Artificial Sequence
  Description of Artificial Sequence: Synthetic coding sequence
atgctgagtgttagcagaccctgcttctcacagggcgctttccttgggcgcaccctgggatccgtgtgggctcaaggaggatctcgactccccctatgtttctggtatagaatccgatgtggtcggcctgccgtggtccacatcggcggggagggagctcggtgggaaaaaggtgctaggggaaggaaggagcaccgcttacggaggagcgatctcggatcacgcccagtgccgttcctggctcaggggattccagatatcgtgattcgtttattatgtctctctgcaggctccgccagttcccatcaagcaagcgacccactttctagcgccgccgctaccctcgcagctgagctcgattgggctctggtttctcagaagtctagtgaagatcttgcgccgcccagtctgctcctcaactgcatttccttcctgataactcagtgtccccaccctcggtggctccccggctag

SEQ ID NO: 32458 - DNA, 627 bp, Artificial Sequence
  Description of Artificial Sequence: Synthetic coding sequence
atgtcccctacaaaggactctcatcctagcccccatttcccgcgagactctggcattcatgcccctacgcctcctgatagtggggctctgaccctctctcccccagtctcccaaggcccaggagtgggtccaagaaccggccgcggcaataggctttgccgtcctccagggcgctcagcagcccgtagcttttgcctgctgccagggccgcccctaggaacaggcgccctcggctctccgcgcgccgcccagggcctcggattcaggggcagtggtcagagagcaagacacaatagctttacctctccaagcccccccggggcgcatcatccgctgggaacacacactcgggcgctgccacccccccttgcccgctgtccatgcgctgctctactagctggaagagaatgtcatggggggccttcgcccgccgctccaaggcccctaccagggacgtccctgacatggccatcaagggcccctctgccacgcccccctccacgggagcgccagggtcccggggacagatcacccagccccagtgcaccatcctgtcctggtgtcggagcctcctccccaaggcgcaggaaacccagagaggccgctggcctaacaccggacggctag

SEQ ID NO: 32459 - DNA, 1248 bp, Artificial Sequence
  Description of Artificial Sequence: Synthetic coding sequence
tacgacgcggtgccaattcagagctctgtcgttctgtgctcctgcccgagtccctccatggtgagaacccagaccgagtccagcacccccccagggatcccaggaggatctcgccagggtccggccatggatggaaccgctgccgagccgcgaccaggtgctgggtctttgcagcacgcacagccacccccccaaccaaggaaaaagcggcccgaggacttcaagtttgggaagatattgggggagggctctttctcgactgtggtactggcgagggagcttgctaccagtcgtgagtacgcaattaaaatactggagaaacggcacattatcaaggagaataaagtcccctacgttacacgagagcgcgatgtgatgtctcgcttggaccacccgtttttcgtgaagttatatttcacgttccaagacgacgagaagctctattttggactgtcctatgctaaaaacggcgagctactcaagtacattcggaagattggaagtttcgacgagacgtgcacccggttttatacagctgaaatcgtaagcgccttggagtacttacacggaaagggaattatacatcgcgacttgaagccagagaatatcttgctgaacgaggatatgcacatccagataactgactttggcacagctaaggtcttatctccggaatcaaagcaagcaagagctaacagcttcgttggtaccgcccagtacgtttcccctgagctgttaactgaaaagtcagcctgcaaatcttcagatctttgggcccttggctgtattatctatcagttggtcgccggcttgcccccatttagggccgggaacgaatatctgattttccagaagatcattaaattggaatatgactttcccgaaaagttctttcccaaggccagagacctggtcgagaagttgcttgtgctggatgcaactaagcgattagggtgtgaggaaatggaagggtacggcccactgaaagcgcatccattctttgaatcagttacatgggaaaatctgcaccaacagactcctccaaagctgactgcttatctgcccgctatgtccgaggacgacgaagactgctatggaaatgtttcctggccagggtggcgtgcacggcaggtggcgctgggcccgccatgcactgggctccacgccagagcccctgatccaagggtgatctgcagccgcaaagggcgcgtgtctgtgccattgcggcaggcctgctggtggctgtag

SEQ ID NO: 32460 - DNA, 1734 bp, Artificial Sequence
  Description of Artificial Sequence: Synthetic coding sequence
atggctgacgtggcggggccctccaggccgtcagccgccgccttttggtcacgggatttctccgacgaagagcaatctgtagtctacgtgccaggtatttcggctgagggaaatgtacggtcacgtcacaagctgatgtcacccaaggccgacgtgaaacttaaaacgtccagagtcacagatgcttctatctccatggagagcctgaaaggtacaggcgatagcgtggatgaacaaaattcttgtaggggtgagatcaagtccgccagccttaaggatctttgcttagaggataaacggcgtatcgcaaatctgatcaaagaattggcacgcgtctcagaagagaaggaggtcactgaggaaaggctaaaagccgaacaggagtcctttgagaagaagatccgacagttggaggaacaaaacgaactcataataaaagaaagagaagccatcaagctccaatatagagagtgtcaggaattgctgagtctgtatcagaaatatttgtccgagcaacaggaaaagttgacgatgtcactcagcgaactaggcgccgctcggatgcaagaacagcaggtttcttccagaaagtccacactgcagtgttcgagtgtggaacttgatggctcctatctgtccattgccagacctcagacttattatcagactaagcaacggcctaaaagcgctgtccaggacagtgccagtgagtctctgattgcatttagaaataactcccttaaacctgttacacttcaccaccccaaggacgatctcgataagatccccagtgagacaaccacctgcaactgtgagagccctggcaggaagccggccgtccctactgaaaagatgccccaggaagagctgcatatgaaggaatgcccacacttaaagccaaccccctcccaatgctgcggacaccgactagccgccgacagggtgcacgacagccatcccactaatatgaccccccagcatccaaaaacacacccggagagttgtagctactgccgcctgtcatgggcatcactggtgcacgggggcggtgccctacagcctattgagacactcaagaaacaaatctctgaagatagaaagcaacagctcatgctgcagaagatggaactggagattgagaaagaacgtctccaacacttgctggcccagcaagaaactaaattgctgctgaagcagcaacaactccaccagtctagattagactataattgcctcctgaagagcaattgtgatgggtggttgctcggtacgagctcatcaattaagaagcaccaggaccctcctaatagtggagagaatcgcaaggagaggaaaacagttggctttcattcacacatgaaggacgacgcccagtggtcatgccagaaaaaagacacctgccggccacaaagaggaacagtgaccggggtcaggaaggatgcctctacttctcctatgcccaccgggtccctgaaggattttgtcacaacggcctctccatctctgcagcatacgacctcaaggtacgaaacatccttactggaccttgtccagtctctttccccaaattcggctccaaagccccaacgttatccctctcgggaagcaggagcttggaatcacggcaccttcaggctaagtcctttaaagtccacccggaagaagatgggcatgcacaggacaccggaggaactggaggagaaccagatcctcgaagacatctttttcatctag

SEQ ID NO: 32461 - DNA, 600 bp, Artificial Sequence
  Description of Artificial Sequence: Synthetic coding sequence
atgctccccgtgcaacgtcgcaagctcgaccctctcctgaagaaatatagacaccataagaaggcgactcgcactaaaagaagaagaaaagaaaaaatggaggcacagtgcagcccagtgcccccaacccctagtaccccacctcagagcgaagaggacgaggcagtggataagaaaccaaccctgctgtccgcccaggaagatacgccggacctcctgcatgaggatcgtctccagtatttgcaggaagaagggtcaggcgtgatgcaccaggagtgccaaattcaatcctgtgaactttccgtggcccagaagccacggccctcctcaccagcggtcacctcattagcatctccccccctctgtttcggctcattcctgagttgtgtctgccagaccttctctagaagcaggaagcagaaacccccccggagaaaaggcaacaaccaggctgaggctggtggtgatgctgaggtgcttaggcctggacccgccaagcccgaactctcgctgagtaaaacttgtagccacctgaaatcgattgagctgtcattcgtcttctcctttattgttctcagtgtgtgtcactgttccagttag

SEQ ID NO: 32462 - DNA, 6618 bp, Artificial Sequence
  Description of Artificial Sequence: Synthetic coding sequence
atgcctttgtttttctcagcgttgctggtgctgctactcgtggcactctccgctctgttcttgggccgttggttggtcgtccggctggccacaaagtggtgtcagcgtaagctccaggccgaactgaaaatcgggagtttcaggttcttctggattcagaacgtatctctgaagtttcagcagcatcagcagacagtggagatagataatctgtggatctctagtaaactcttgtcccatgatctccctcactacgtagccctctgtttcggagaggttcgcataagaaccgatctgcaaaaggttagcgatctgtcagccccctttagccagagcgcaggcgtcgaccaaaaagagctgagcttttccccctcattgctaaagatattctgccagctgttttccattcacgtggacgccatcaatatcatggtcctgaaagttgacaccagcgagagcctctggcatattcagatttcgagatcccggttcctgttggactctgacggaaaaagactgatttgcgaggtgtcactatgtaagattaattctaaagtgctgaagagcggtcagctcgaggacacctgtttggttgagttaagcctcgcgttagatctgtgccttaaagttggaataagcagccgccacttaaccgccatcacagtggacgtctggactctgcatgctgaactgcacgaaggcctgttccagtcacagcttctgtgtcagggcccgtcgctggcctccaaacccgtgccttgctctgaggtgacagagaaccttgtagaaccgaccctgccggggttgtttttactccagcagctccctgatcaggtgaaggtgaagatggaaaatacatccgtcgtactatccatgaattctcaaaagaggcacctgacatggaccctgaagctactgcagttcctttaccaccgcgatgaggatcagctgccccttcgcagcttcacagccaattctgacatggcccagatgagcaccgaactgctgctggaggacggactgctcctctcccagtcacgacagagaatcgtttgtcttaactccctgaaggcctccgtccaagtgacaacaatagacctgtctgctagtctggtgcttaatacgtgtatcattcactacagacatcaagagttctcccattggctccatttgctcgctcttgagacgcagggttcctcttcccccgtcttaaagcaaagaaaaaaacggactttcccgcaaatccttgcccccatcatttttagtacgtctatctcgaatgtcaatatctcaatccagctgggggatacaccaccctttgctttgggattcaactcaatttctctggactatcagcacctgcgtccacagtccatccatcagcggggcgtgctgactgtggaccatctgtgctggcgcgttggaagtgacagtcacatacaacgggccccacatccacccaacatgcatgtgtggggagaagctctggtgctggattcatttacattgcaggggtcttacaaccagcctctagggctatcttcaacgcagtccgacaccctgttcttagactgcacaatccggggcttgcaggtggaggcatccgacacgtgtgctcagtgtctcagtcggatcttgtccctcatgggtccacagtccggtaagtccgccgtgtcccgccacagctcattcggagaatcggtgtctttattgtggaaagtcgacctgaaggtggaagacatgaaccttttcacactcagcgcactggttggggcgagtgaggtgcgcctggacaccctcacaattttgggatctgcagagacttctactgtgggcattcagggcctcgtccttgccctcgtcaaatccgtcaccgaaaagatgcagccctgctgtaaggcccccgatatccctacgccggtgctatcactgagcatgttgtccataacttaccattcctccatcaggtccctggaggtacagtgcggcgcaggactgacactattgtggtctcctcctgatcacatgtatctgtatcaacacgtgcttgccacattacagtgtcgggacctgttgagggcgactgtatttcccgaaacagttccgtcattggccttggagacctctggaaccacctccgagctggagggccgggcacctgagcctctcccgcctaagagactactcaatttgaccctggaagtttccacggccaagctcactgcctttgttgccgaagataagttcataacactcgcagccgaatcagtgtctcttagccgacacggcggtagtctccaagcttattgtccagaactggcagctggcttcgacggcaactctattttcaacttcaaagaggtcgaggtgcagctgctgccagaggtggaattcccctatcagtacgatttcagtaggactttagacgaggctgtcggtgttcagaaatggcttaagggactgcaccagggcacgcgggcgtgggccagccccagtcccgtgcctcttcccccagacctacttttgaaagtggaacatttctcctgggtgtttttggacgacgtcttcgaggtgaagttgcatgacaactacgagctcatgaaggatgaatccaaggagtcggcaaagcggctccagttactcgacgctaaggtcgcagcccttaggaagcagcacggggagctgctgcctgcgcgcaagatcgaggaactttatgccagtcttgagcggaaaaacattgaaatctatatccaacgctcccgcaggctctatgggaacacacctatgaggcgagcgctactgacctggtctctggctgggctcgaattggttgctctggctgacgcctccttccatggccctgagcacgtggtcgagcaggttcaagaactggaccccggctcaccgtttcccccagagggcctcgatctggtcatccagtggtgccggatgctcaaatgtaatgtaaaatctttcttagtgcggattcgggattatccacgctacctttttgagatcagagactggagactcatgggacggctggttggaaccgagcagagcggccaaccctgttcccggcgaagacagattctgcaccttgggctcccctgggggaacgtggccgttgagcggaatatgccacctcttaagttctaccacgattttcactctgaaattttccagtacaccgtcgtatggggaccatgctgggatccagcctggacactgattgggcaatgcgtggacctacttactaaaccaagtgcggatccaagccctcctttgccatggtgggacaagtccagactgctttttcatggtgattggcatatggacattgagcaggctaacttacatcagctggctaccgaggatccctataatactaccgaaaacatgcattgggaatggtctcatttgtctttccattggaagccgggccagtttgttttcaagggagacctagatatcaacgtacgcaccgcaagtaaatacgacgactgttgcttcctgcacctgcccgatctctgtatgactctggacctccaatggctgtgccatggcaatcctcatgaccaccactctgtgacactgcgggcaccggagttcctccctgaggtgcccctcgggcagcttcacgattcttacagggcatttcgttcggagaacttgaacctttccatcaagatggatttaacaaggcactctggcactatcagtcagccccgaatcctcttgtactccagcacccttaggtggatgcagaacttttgggctacttggacctcagtgactcgtcccatctgccgcggcaagctgtttaacaatcttaagccatccaaaaaaaaactgggtcaacattataagcagctgtcctacacagctctgtttcctcagcttcaggtgcattattgggccagttttgcacaacaacgtggcatccagattgagtgttctcagggccatgtgttcactcgaggcacccagcgactgatcccgcaggctggtaccgtcatgagacgattaattagtgactggtctgttactcaaatggtctcggacctgagccaggtgaccgtgcatctcatggctagtccgacagaggagaatgctgatcattgtctggatccgctggtgactaagacacacttactgtccctgtcttccttgacataccagcgccacagtaatagaacagcagaagaggaattatccgctagggatggagatcctacgtttcacactcatcaacttcatcttgtagatctgcgcattagttggactaccacaaaccgcgacatcgcatttggcttatacgacggctataagaaagccgcagttctaaaaaggaatctgtctactgaggctctgaaagggctgaagatcgatccacagatgcccgccaagaagcccaaaagaggagtgccgaccagcgcctccgccccgcctcgcgttaacaccccatccttttcaggccagcctgacaaggggtcaagtggaggtgcatacatgttacagaaattgatcgaagagaccgatcggtttgtcgtattcacagaagaggagagtggcatgtccgatcagctgtgtggcatcgccgcatgtcaaacagacgacatttacaatcggaactgcctaatagagttggtcaattgccagatggttctgaggggcgcagagacagagggatgtgtgatcgtcagtgccgccaaagcccaactgttacagtgccagcaccatccggcatggtacggtgacacgctcaaacaaaagacgtcctggacatgcctgttggatggcatgcagtactttgcaaccacggagagttctcccacagagcaagacggccggcaactatggctcgaggtgaagaacattgaggaacaccggcaacgcagccttgactcagtgcaggagctcatggagtcagggcaggcagttggcggcatggttacaacaacaaccgattggaaccagccagccgaggcccagcaagctcagcaagttcagcgcattatctcccggtgtaattgtcgcatgtactatatttcctacagccacgacatcgaccccgagctcgccacccagattaaaccccctgaagttctggagaaccaggaaaaagaggacctcctgaagaaacaggagggcgcagtagacacgtttaccctgattcaccacgaattagaaatttccaccaacccagcacagtacgcgatgatcctggacatcgtgaacaatctgctgcttcatgtggaaccaaaacggaaagaacacagcgagaagaaacagagggtgagattccaactggaaatttccagcaatcccgaggagcagcgctcttcaatattacacttacaggaggcggtcagacagcatgttgcccagattaggcagttggagaagcagatgtacagtattatgaagagcctacaggacgatagtaaaaatgaaaacctactcgacctaaatcaaaagctgcagctgcagcttaaccaagaaaaggcaaacctgcagctggagtctgaggaattaaacatattaattaggtgctttaaagacttccagttacagagagccaacaaaatggagcttcggaaacaacaggaagatgtgagcgtcgttcgcaggacagagttctattttgcccaggcaaggtggaggctgaccgaggaggacgggcagctcggaatcgcggagctggagctgcagcggttcttgtatagcaaagtcaataagtccgatgacaccgccgaacacctcctcgagctcggatggttcaccatgaataacctgctccccaacgcggtctataaagtggtattaaggccacagtcctcatgtcagagtggccgtcagctcgccctcagattgtttagcaaagttcgtcccccagtgggcgggatatctgtaaaagagcatttcgaggtaaatgtcgtgccgttgaccatccagctgacccaccagttcttccacaggatgatggggtttttctttccaggtcggtcggtggaggatgatgaggtcggcgatgaggaggataagtccaaactcgtcacgacagggatcccggtcgtgaaaccccgccagttgatagctaccgatgacgccgtgcccctggggcccgggaaaggtgtggcccagggactaactcgtagtagcggtgtgcgacggtcttttcgtaagtctccagagcaccccgtggatgacattgacaagatgaaggaacgagcagccatgaacaatagctttatttatattaagatcccccaggttccgttgtgcgtgtcatacaaaggcgaaaagaatagcgtcgattggggcgacctgaacctagtcctgccctgcctggagtatcataacaacacatggacatggctggacttcgcaatggccgtaaagcgagactctcgtaaagctttggttgcccaagtgattaaggaaaagctgaggttaaagagtgccaccggctcagaagtacggggtaagctagaaactaagagtgatctaaacatgcagcagcaggaggaagaggagaaggccagacttctcataggcctaagtgtcggagacaaaaatccagggaagaagtcaatctttgggcgaagaaagtag

SEQ ID NO: 32463 - DNA, 2130 bp, Artificial Sequence
  Description of Artificial Sequence: Synthetic coding sequence
atggatcaaaagctgagcaagctagtggaggagttaacgacaagtggagagcctcgtctgaatcccgaaaaaatgaaggagctgaagaaaatctgtaagagcagcgaagaacagctgtcccgtgcgtacaggttactgatcgcgcagctcacccaggagcacgcagaaatccggctgagtgcatttcagatcgtcgaggaactgttcgtcagaagccaccagttcaggatgctggttgtatcaaatttccaggagtttctggagctgacgctgggcaccgaccctgcccaaccacttcccccaccaagagaagctgcccaacgcctgagacaagcaactacacgcgctgttgagggatggaacgagaagttcggtgaagcatacaagaaactcgccctcgggtatcatttccttcgccataacaaaaaagttgattttcaggataccaacgcgagatctctcgctgaacgcaaacgggaagaagaaaaacagaagcacttagacaagatataccaagaaagggcgagccaagccgaacgagagatgcaggagatgagtggggaaatagaatcatgtttaaccgaggttgagtcctgtttccggctgttggtccccttcgacttcgatcctaaccctgagactgagtccttagggatggcatctggcatgtcagacgcgctccggtcttcttgcgccggacaggttggcccatgtcgatccgggactcccgatcccagggacggggagcaaccgtgttgtagcagggacttgccggcatcggctggacacccccgggccggcggcggggcccagcctagccagacagcgacaggagacccctcggacgaggatgaagactctgacctggaggagtttgtgagaagtcacgggcttggctcccataaatacactctggacgtcgaactctgttcagaggggctgaaggtgcaggagaacgaagataaccttgccctgattcatgcagcccgcgacacgctgaagctgatccgtaataagttcctgccagcagtttgtagttggatacaacgctttacccgcgttggtactcatggcgggtgtctgaaacgggccatcgatttgaaggccgaactggaactagtactccgtaaatataaggaactggatatagagccagaaggaggggaacggcggcgaaccgaagcgctcggagatgcagaggaagatgaagacgacgaggactttgtggaggtgcccgagaaggagggttatgagccgcacatccccgatcatttgaggccagagtacgggctcgaggccgcccccgagaaggacactgtcgtacgctgcctgaggacaagaacacgaatggacgaggaagtgagcgatcctacttccgccgcggctcagcttcggcagctcagagatcatttaccccccccttccagcgcgtccccatctcgggccctccccgagccacaggaagcacagaagctagccgccgagagggcaagggcccccgttgtcccgtatggtgtggatctgcactactgggggcaagaattgcccaccgccgggaagatcgttaaaagcgatagtcagcacaggttttggaaacctagcgaagttgaagaggaggtcgttaacgctgacatttccgagatgctcagaagtcgacatataacgttcgcaggcaagttcgagccagtccagcattggtgtcgtgctcctagaccagatggacgcctatgcgagcggcaggaccggctcaaatgcccttttcacggcaaaattgtgcccagagacgacgaagggcgacctctggatccagaagatcgagccagagagcaacgaagacagttgcagaaacaagagcgtcccgagtggcaagatcccgagctaatgcgggatgttgaggcagccaccggccaggatttgggatcgtcacggtattccggaaagggcaggggaaaaaagcggcgatatccgagtctaacaaatctgaaggcccaggcggataccgcccgggcccggatcggtcgtaaggtgttcgctaaagccgccgtccggagagtcgtggccgccatgaatagaatggatcagaagaaacacgagaagttttccaatcagttcaattacgctctgaattag

SEQ ID NO: 32464 - DNA, 1989 bp, Artificial Sequence
  Description of Artificial Sequence: Synthetic coding sequence
atggtctcccagtcaacagtaaggcaagactctccagtggagccatgggaggggatttctgaccactcagggatcatagacggcagcccgcgcctgctgaatacggaccatcccccttgccagctggacatccggctaatgaggcacaaagctgtctggattaatcctcaggacgtacagcagcaacctcaggacctgcagagccaggttcccgcagcgggcaatagtgggactcatttcgtcactgatgctgccagccccagcggcccatcacctagctgcctcggagatagtctcgccgaaaccaccctgtccgaggatacaaccgacagcgtaggcagtgcgagcccccacgggtcaagcgaaaagtccagctccttttcgctcagctccacagaggtacatatggtgaggcccggttattctcatcgagtctctctacccacttcacctggcatccttgctacttccccataccccgaaaccgattctgctttttttgagcccagccacctcacctctgccgctgacgaaggcgccgttcaagtgagccgtagaaccataagctccaatagttttagccctgaggtgtttgtcctgccggtggacgttgagaaggaaaacgcacatttttacgtggccgatatgatcatttccgctatggagaaaatgaaatgtaacatcttaagccagcagcagaccgagtcatggtctaaagaagtgtccggactgctgggttccgaccaaccggacagcgagatgacttttgatacaaacataaaacaggaatccgggagctcaacgtccagctattcgggatacgaaggttgcgctgtgttgcaggtgagtccagttactgagacaaggacgtatcacgacgtcaaagagatttgcaaatgtgacgtggatgaattcgtcatcctcgaactcggagattttaacgatattaccgagacctgttcctgttcctgttcttcctctaagtccgtcacttatgaaccagacttcaatagcgcagagcttctggctaaagaattatatcgggtttttcagaaatgttggatcctcagtgtggtcaactcacagctcgccggaagcttgtcggctgccggaagtatcgttgtgaacgaggagtgcgttcggaaagattttgagtcctctatgaacgtggtccaggagatcaaattcaagagcagaatccgaggcacagaggactgggctccccctaggttccagatcatctttaatatacatcctcccctaaagcgtgacctggtcgtggctgcccagaattttttctgtgctgggtgcggtacacccgtggagcctaaattcgtgaaaagactaaggtattgtgagtatctcgggaagtacttttgtgactgttgccactcctacgctgaatcatgcattcccgctcgtattctcatgatgtgggacttcaaaaagtattacgtgtctaattttagcaagcaactgctggacagcatatggcatcagcccatttttaacctgttgtccatcgggcagtctctatatgccaaggccaaagaactcgatcgcgtcaaagaaatccaagagcagctcttccatatcaagaagctcctcaaaacctgtcgctttgccaattcagcattgaaagaattcgagcaggtgccgggccaccttacagacgaactccatctcttctctctggaagacctggtccggatcaagaaaggattgctggcacctcttctgaaagacatacttaaggctagcctcgcacacgttgccggatgtgaactgtgccagggtaaaggcttcatctgcgaattttgccaaaacactacagttatttttcctttccagaccgctacatgtcggcggtgctccgcatgcagggcttgctttcacaaacagtgcttccagtccagtgagtgccccagatgtgcaagaatcaccgcccgcagaaaattgctggaaagcgtcgcatcggccgccacttag

SEQ ID NO: 32465 - DNA, 552 bp, Artificial Sequence
  Description of Artificial Sequence: Synthetic coding sequence
aacatgaacagatacagctttatgctgtctggaaatcacctgctcttccaccttctattgtggcctgcacagacggcccgactcctcaaacatatctttccaactggctcatgtaagctacgcgatgttgcagaacatctcctacagtgcccacaaaccggacacgagtgctgcaaagctcagaacagggcgaatttagtggaggggtggttttctcagaacactcagcggggaccatcacatgacggggttgcagagttccatatgtcgctcaccgtgagctgccccgatccaacaccgtccactgatccccaagggcgacacaaccgtgagcccatcctgggacgggacgatgattttatgtgtaaacaagtgaagttccggatgtgcgttgttggccgtgatggaaacgcgcagtcgtctgttcggtacaccgggcccctttacaggcgcaaaattcgcaccgagttcctttttgttgtgttcctcctggagacaagagaactgaagccacaggtgaacaaaaatgtgcagggcaccaggccatcctag

SEQ ID NO: 32466 - DNA, 171 bp, Artificial Sequence
  Description of Artificial Sequence: Synthetic coding sequence
atggccattctaaagatgggccccaaaatagtcctagagtggtccgggggccaccctagcaaagaccctagttcttactacctaatcatcttgcataaagacacgtcttcaacccttgtagactgccactttcaacaccacaacctgcacaaagtgggattcttatactag

SEQ ID NO: 32467 - DNA, 600 bp, Artificial Sequence
  Description of Artificial Sequence: Synthetic coding sequence
ggccgggcggccagacgtcaccatgattcatgcgaagatgcagcactcccaggccggagcgatctgtgtcgtgccctgcacccagcgcggccagctgcccgcggcggaagacctgctgatggcggctgccccgcagtccctgcagagggcctgtggaggcacctgcagcaagtgggggccgcaacccatcctcatttgatgagaggcccaagcttgagttgggcaattccagccactcaccccctcggcgcagcccctctcggcaacccgggccctggggagccgatatggctcccctgtgtggggggcgccgaagtgagggcccagctgggctccttctacagctgggaaagtaaatctagccttccctcgaccccactatcactcctcgtgtcatgtggcggcagcgccctaactacgcatgcttttccaccaatcggagggcctattccgagtaggtttcccgccgctaataaataccttccatctagcgcaagggtacaagggtccgtggggatatccatctatcccgctactgataaagcaacatacctgagcacttggagcgctcactccggccgcagagaaaggccaaagtag

SEQ ID NO: 32468 - DNA, 216 bp, Artificial Sequence
  Description of Artificial Sequence: Synthetic coding sequence
atgaagatcgtgcacgttaacgtcatgggcgtaggcggatggggtgccgttttcctggacatgtggcatgttactcaggagagcaagcgtcctattatatccaagatgccggcctggattttcccctgtcatcccctggatgagcagacataccacatggcgctcaatgctgccacatttcccaagaatgccacatggattggaccgctgtggtag

SEQ ID NO: 32469 - DNA, 147 bp, Artificial Sequence
  Description of Artificial Sequence: Synthetic coding sequence
atgtccgattttcccgtccattccaaatatttccttataagcagcctgcaagtgcttaagatgcacaaaaaagacttcaccagtcaggtgctgctccgcatttacttcgacttgatctgcatgctagttaagctgcacgtcctgtag

SEQ ID NO: 32470 - DNA, 861 bp, Artificial Sequence
  Description of Artificial Sequence: Synthetic coding sequence
atgtcccttcctatcgggatctaccgtcgggcagtctcttatgacgatacacttgaggacccggcccctatgaccccaccaccttccgacatgggtagcgtgccatggaaacctgtaattcctgagagaaagtaccaacacctggctaaggtggaagagggcgaggccagtcttccatccccggctatgacgctgtcctccgccatcgattccgttgataaagtgccagttgtaaaggccaaggccactcacgtgattatgaattcgctgataacaaagcagactcaggagtcaattcaacacttcgagagacaggctggattgcgcgacgcaggctatacaccacataaaggcctgacaacagaagagacaaaatacctccgagtcgcagaagctttgcacaaactgaaactgcaaagcggagaggtgactaaggaggagagacagcccgcgagcgctcaaagtacccctagtactaccccgcacagctctcccaagcagcgccccagaggttggtttacctctgggtcctccacagccctgcctggtccgaacccgagcacgatggactcagggagtggcgacaaagacagaaatctgtcagataaatggtccctcttcgggccgaggagtttacagaagtacgactccggttccttcgccacccaagcgtatcgtggagcacaaaaacccagccctctagagttgataagagcccaggccaatagaatggcagaggaccccgccgccctgaagccgcctaagatggacattccagtcatggagggaaaaaaacagccaccgagggctcacaacttgaaacccagggatctgaacgttttaactccaacaggtttctag

SEQ ID NO: 32471 - DNA, 3240 bp, Artificial Sequence
  Description of Artificial Sequence: Synthetic coding sequence
atggatgacgacgatgactcctgcctactcgacctgattggtgaccctcaggcactcaattattttctccacggtccttccaataagtcgtcaaacgatgacctgacaaatgccgggtattctgctgccaattccaatagcatattcgcaaacagctctaacgccgaccctaagagcagcctgaaaggtgtgagcaaccagctgggggagggcccctctgacgggctgcccctgagttcctctctgcagttccttgaggacgagttggagtcctctcccctgcccgacctgaccgaggaccagccatttgatattctccagaagagcttacaggaggccaatatcacagaacagacattagccgaggaggcgtatctggacgcctcaataggaagctcgcaacaattcgcgcaggctcagctgcaccccagtagctccgcctccttcacccaggcctcgaatgtgtcaaactatagtggccagacccttcagccaattggcgttacacatgttcctgtaggtgcctctttcgcttcgaatacagtgggtgtgcagcacggcttcatgcaacacgtaggaatttcagttcccagtcagcatttaagtaattcctcgcagatatccgggtctggacagatccaactcatcggttctttcggaaatcacccctcgatgatgactatcaataatttagacggaagccagatcatcttgaaggggagtggacagcaggctccaagtaacgtatctggcggcttattggtgcatcggcaaacaccgaatggaaatagtctctttggaaactcatcctcatccccggtggcacaacctgtgacggtgccttttaactccactaatttccagacctcactgccagtgcataacatcatcatacagagagggctggccccgaatagcaacaaagttcctatcaacattcagcccaagcccatacagatgggccaacagaatacgtataatgtgaataacttagggatccagcagcaccatgttcaacagggcattagcttcgcgtccgcatcaagtccccagggaagtgtagtaggaccacatatgtcggtaaatatagtgaaccaacagaatacgcgaaagcccgtgaccagccaagcggtgtcaagtaccggcgggtctattgttatccattcccccatggggcagcctcacgcccctcagtcccagttcctaatccctacctccctgtcggtcagctccaattccgttcaccatgtgcagaccattaacgggcagctgctgcagacccagccttctcaacttatttctggccaggtcgcgtccgaacatgtcatgctgaatcgtaactccagcaatatgcttaggacaaatcaaccatataccggccctatgctgaacaatcagaataccgccgtccacctggttagcggacagaccttcgcagctagcgggtcgccagtgatagccaaccatgctagtccccaactggtcggaggacaaatgcccctgcagcaggcttctccaacagtgctccaccttagtccaggccagtcctctgtctcacagggccgacccggatttgctacaatgccctctgtgacgtcgatgagcggcccctcccggtttccagcggtgtcgagtgcatctacggcacaccctagcctgggaagtgctgtccagtctggttcatcaggatcaaacttcactggtgatcaactcacacagcctaaccggactcccgtacccgtgtcggtttcccaccgcttgccggttagcagctccaagtcaacttcaacattcagcaatacccccgggaccggtacacaacaacagttcttttgtcaggcccagaagaagtgtttgaaccagacgtccccgatcagcgcccccaagacaacagacggtctcagacaggcccagatcccaggacttctatcgaccaccctcccaggtcaagattcaggcagcaaagtgatttctgcctcactcgggacagctcagccccagcaggagaaggtcgttggctccagccctggacatccggcagtgcaagtagaatcccacagcggtggacagaagcgacccgccgcgaaacagttaacgaaaggcgcttttatactgcagcagctacagcgcgatcaggcccatacggtcacaccagataagagtcactttcggtctttgtccgatgcggtccaacggctgctcagctatcatgtgtgccagggcagcatgccgaccgaggaggatctgaggaaggttgataacgagtttgagacggtggcaactcagctgttaaagagaactcaggccatgctgaacaaatataggtgcctcttacttgaagacgcaatgcggatcaatccatccgccgaaatggtcatgatcgaccgaatgtttaaccaggaagagagggcttcactgagcagggacaagcggcttgccttggtcgacccagaaggctttcaggccgatttttgttgcagcttcaagctcgacaaagctgcccacgaaacccaatttggccggagtgaccagcacggatccaaggcgtcttcaagcctccagccgcctgccaaagcccagggaagggaccgggcgaagactggagtgaccgagcctatgaaccacgatcagttccatctggtccctaatcacattgtggtgagcgccgagggcaacatttcgaagaagacggagtgcctgggcagggctctgaaatttgataaggttggactggttcaataccagtctacttccgaggagaaggctagcaggagagagcccctaaaagcatcccagtgctcgcctgggcctgagggccaccggaagacctctagtagatctgatcacggtaccgagtccaagctgtccagtattctggcagattcgcatcttgagatgacctgcaataacagctttcaggacaagtccctgcgcaactcccccaagaatgaagtgctgcacaccgatatcatgaaagggagtggagagcctcagcctgaccttcagcttacaaagtcactggagaccaccttcaagaacatcctggagctcaaaaaggcagggcgccagcctcaatccgatcccaccgtatctgggtccgtggagctagactttcccaattttagtcctatggctagtcaagaaaactgcctcgaaaaattcatccctgaccatagcgaaggggtggtggagaccgactccatactggaggccgctgtgaactctatcttagaatgttag

SEQ ID NO: 32472 - DNA, 3240 bp, Artificial Sequence
  Description of Artificial Sequence: Synthetic coding sequence
atggacgacgatgacgactcctgtcttttggacttgatcggtgaccctcaggccctgaattattttcttcatggcccgtctaataagtcctctaatgatgacttaactaacgctggctattccgctgcgaacagcaacagcatttttgctaacagctccaacgcagatcctaaaagctccctgaagggcgtgtctaatcagctgggagagggacccagcgatggcctgccattgtcttcatcactccagtttctggaggatgaattggagagctcacccctccccgacctgaccgaagaccagccattcgatattctccagaaaagcctgcaggaagccaacatcacagagcagacactggccgaggaggcataccttgatgcgtctataggtagttcccagcagttcgcgcaggcccagctccaccctagcagcagtgccagcttcactcaggctagtaatgtgtctaactacagcggacagaccctgcagcccattggtgtgacccacgtacccgtcggggcttcttttgcctccaacaccgtgggggttcagcatggctttatgcagcatgtcggtatcagtgttccctcccagcatctgtctaatagctcccaaatatctggatcaggccagatacagctcattggtagtttcggcaatcacccatccatgatgacaatcaataacctcgatgggtcccagatcattctgaagggctcaggacaacaggcaccatctaatgtgtccggtggcctgctggtccatcgtcagaccccgaacggcaatagcctctttgggaactcctcttcatctccggttgcacagcccgtgacagtgccatttaattccaccaactttcagacgtcattaccagtgcacaacatcatcatccagagggggctggccccgaattctaataaggtgcctatcaacattcagccgaagcccattcaaatgggacagcaaaatacttataacgtcaataacctcggaattcaacagcaccacgtccagcagggaatttcttttgcttccgccagttcacctcaagggtcggtggttgggccccacatgagcgtcaatatcgtaaatcagcaaaacactagaaagccagtgactagccaggcagtgtcttccactggcggaagcattgtgatccattcacccatgggccagccacatgcgccgcagtcacagttcctgatcccgacatccttaagtgtgagcagtaattctgttcaccacgttcaaactataaacgggcaactcctgcaaacacaaccctcgcagctcatcagtgggcaggtggcttctgaacacgtgatgctcaatcggaattcgagtaacatgcttcggacgaatcaaccatatactgggcccatgttgaacaaccaaaacactgccgttcaccttgtgagtggacagacctttgctgcctccgggtcaccagttattgccaaccacgccagccctcaactcgtggggggccagatgcctttgcagcaggcgtcccccactgtcctgcatctgtcccctgggcagagcagcgtctcccagggcagaccgggcttcgctaccatgcctagcgtgacaagtatgtctggcccttcgcgctttccagccgtctcctcggcctctacagcacatccgagtctaggaagtgccgtgcagtctgggtcctcgggctcaaactttactggagatcaactcacccagcccaacagaactccggtgcccgtgtccgtatcccatcgactgcccgtgagctcgtccaagagcacctcaacctttagcaacactccagggaccggcacgcaacagcaatttttctgccaggcacaaaaaaaatgtcttaatcagacttcccccatctctgcccccaagactaccgatggattgcggcaggcacagatccctggcttgctgtccacaactctcccaggccaggatagcggatctaaggtgatatctgccagcctagggactgctcagcctcagcaggaaaaggtggtcggcagttcccctggccaccctgcagtgcaggtggaaagtcatagcggaggacagaaaagaccagctgccaaacagctgacaaagggggccttcattctgcagcagctgcaacgcgaccaggctcacactgtgacaccagataaatctcatttcagaagtctttctgatgctgttcagagactgttatcttatcatgtatgtcagggctcaatgcctacagaagaagatctcaggaaggttgacaacgagttcgagaccgtggccacccaactactgaaacgtacgcaagccatgcttaataagtaccgttgtttattgcttgaggatgccatgcgaatcaatccgtcagccgaaatggtcatgatcgacaggatgttcaatcaagaggagcgagcctctttgagccgggataagcgcctcgctcttgtcgatcctgaaggatttcaggcagacttttgttgttcttttaaactggacaaggcagcgcatgagacgcaatttggacgctctgatcagcatggatccaaggcgagctctagtcttcagcctcctgcaaaagcccaggggcgtgatagggccaagaccggcgtcacagagcctatgaatcatgatcagtttcatctcgtgccaaaccatattgtagtttctgccgaaggtaatatcagcaaaaagacggaatgtctgggtagggcactgaaatttgataaagtgggcctggtgcagtatcaatcaacctcagaagaaaaagccagtcgtagagagcctttgaaagcatcccaatgttctccaggccccgaaggccaccgcaagacttcgagtcgcagcgatcatgggacggaatccaaattatcctcaatattggccgactctcacctcgaaatgacatgtaataactcattccaggacaagtccctcaggaactctcccaagaatgaggtcctccacaccgatatcatgaaaggcagcggcgaaccccagcccgatcttcagttaactaagagcctggaaaccacgttcaaaaatatactcgaattgaagaaagcagggcgtcagcctcagtctgatcccactgtgtccggctccgtagagcttgacttcccaaatttttcccctatggcaagccaggaaaactgcctcgaaaagtttatacccgaccactcggaaggagtggtagaaacagattctatcttggaggctgccgtgaactccatactagaatgttag

SEQ ID NO: 32473 - DNA, 792 bp, Artificial Sequence
  Description of Artificial Sequence: Synthetic coding sequence
atgtggccacagccctgcttaccaccacacccaactatgttagaggaaacccagcagtctaaactggcagctgcaaagaaaaaactgaaggaatatcagcagcggaactctcctggagttcccgctggcgtgaagatgaagaaaaaaaatactggcagctctccggaaacagccacatttggaggatgtcattcacccggggctagcagatatcaggagctagagctggcactggatagctcatcagctattatcaatcagttgaatgaaaacatagagagccttaagcagcagaagaagcaagtggaacaccaacttgaagaggagaaaaaaactaattccgagattcataaggcacagatggagcagctggaagccatcgatattctgaccctggaaaaggctgacctgaagaccactctgtaccacaccaaacgggcggcgagacacttcgaagaggagtctaaggacttggccgggagactgcagtattctcttcagcggatccaggaactcgaacgggctcttagtgctgtgtcaacccagcagcaagaggaagatagatcttcatcctgccgcgaagcggtcttgcaatggaggttacaacagactataaaagagcaggccttgctcaacgctcatgtgacccaagtcactgaaagcctgaaacaggtacaattggagcgcgacgagtacgcccagcacattaaggaggagcgtgccaggtggcaggaacggatgtggaaaatgtctgttggattgagcccccatccccgccatcctcagcagtag

SEQ ID NO: 32474 - DNA, 60 bp, Artificial Sequence
  Description of Artificial Sequence: Synthetic coding sequence
tggatctttatattcaagtgcagtgtgatgtatgtccacttcttcttcgccttcttctag

SEQ ID NO: 32475 - DNA, 618 bp, Artificial Sequence
  Description of Artificial Sequence: Synthetic coding sequence
atgaactcttggccctggttgtttgattccaacttctgctctgccgttgagattatcttggagccagaaaagaagatcccaaacagcacccttcatttctgcgaagaactggtgcccaatagtggatctctctttggaaagaacatatgttgcgggaaacagtgctgtatctgcgacttgaagtccctgttagaactggaccgtgacggcgaatttcagcccgaaaggccgaaaaatagttgtcccgctctgctcaacgccatcagtcgtaggacaagcatattcccccctcccacctctcttttactgcctgtcactttggccagttctcagtgctgttgggccacgtccggctctgccggtggccgggggattgcaccaactcctggcgggcagccatgtggctcatctagaaagtctggcagttcatgcgcttggcgctggtctcctagcggcgggagcccatggccctgtagtagggctggaggcgcctggcgtcgacttggtaccagtctcgacacacatcctgctggatctagagcctgtcgcgccgttcaccagctggctggagagtccccaactccacgtcaggcaaggcggcccccattcccgacgtag

SEQ ID NO: 32476 - DNA, 219 bp, Artificial Sequence
  Description of Artificial Sequence: Synthetic coding sequence
atggagaagtggaagctgggcagacagatccagccaccatggccgctggctcacgcgcggggcagctggatggccctgccccgatccgagcagttaggtacaggcggggaccaggactggcagctgcagggccacacacgcgccaccgagaccaaagagaacttccagaaggagtcaatggttaaatccctcaggatgcagcggagacagggcgaatag

SEQ ID NO: 32477 - DNA, 312 bp, Artificial Sequence
  Description of Artificial Sequence: Synthetic coding sequence
atgaagctgaagagtctctttggcgaaatcaccttcacctttggaataagcaaggagaaattgaagattctagacgatttaacattgctgccattgcttgtgaagcaatacaagatgctgtggtcctacaagttaccagggagcggcatcgtgatatggagcacgtttcatgctgtcatggactctgaatggcgaaggcagaacgctgaattgaacctgataacaaataagcacttcctcaagaacctacagagcaaacatttggacgtgaagatcttaaaaacaaagaataagctcgtcgagggcatttag

SEQ ID NO: 32478 - DNA, 69 bp, Artificial Sequence
  Description of Artificial Sequence: Synthetic coding sequence
gacggcaagatcatgctccacgtttgctgcatatccctctgtagcgtgctcgtctggaagtttccctag

SEQ ID NO: 32479 - DNA, 237 bp, Artificial Sequence
  Description of Artificial Sequence: Synthetic coding sequence
gtgctgttattcatattttacctgcttatctttatgttttccttcttcgaaaccagatcgcatagcgtaacccaggcaggcgtacagtggcacgaccattcttctcttcagccgcaactgccgggcctcaagcagagccctacctctgcatctcaaagctcttgggaccacggttgcgcaccccgtcaccccatacatctcccccaaactccaaaagttctcggattgcaagtctag

SEQ ID NO: 32480 - DNA, 297 bp, Artificial Sequence
  Description of Artificial Sequence: Synthetic coding sequence
ctggagtgtagtggaaccgtcctagcccactgtaacctgtgcctacttgcttcacaggctgccgggatcactggaacatctcatcacgcacaactcatcttcgttttcctcgtggaaacctggttccaccacgtcggccaagctgggctagaactcctgactagcggggatccgcccgctagcgtatcagagaacgctggcattacaggcgttagtcaccgggcatggccaggcccacaattttttaacctggagcagggattctccatgctggtaagactagtgtcaaattcctag

SEQ ID NO: 32481 - DNA, 453 bp, Artificial Sequence
  Description of Artificial Sequence: Synthetic coding sequence
cgtaatcggatccagtacaatcagtcccaaaaagacatcctgcagtcatggttccagcacgatcctttcccggataaggccgcacgcgaacagctggccaaagaaattggggtcccagaatcgaacatccaagtgtggtttaaaaactatcgggtcaaacagaggaagttggactacaagtgttttagtgagaaagaccagactcagggccatgaccagtctcagcatcttacccaagagtacctgcctaaggaggcacgccagaaacagaccttcattacctggacccagaaaaatcgcctcgtacaggcatttgaaagaaacccctttcccgatattgccactcgaaaaaaacttgccgaacagactgggctgcaggagtctcggatccagatgtggttccagaagcagagatcgctctatctgaagaagtctcgcatggaaccgatgtag

SEQ ID NO: 32482 - DNA, 3651 bp, Artificial Sequence
  Description of Artificial Sequence: Synthetic coding sequence
atggccgccatggccccaggaggctccggctccgggggtggagtgaatcctttcctaagcgacagtgacgaggatgatgatgaggttgccgctaccgaggagagaagagcggtcctccgcctaggagccgggtctgggctcgaccccggttcagccgggtcactatccccccaagacccagtggcgctgggaagttctgctcgacccggactgcccggcgaggcaagcgctgccgcagttgctctggggggcactggagagactcctgccagactaagcattgacgccattgcagcccaactcctgcgggatcagtacctgttgaccgctctggagctgcacacggaactcttggaatccggtagagagttgcctagacttagagattactttagcaaccctggcaatttcgaacgccagtccggcaccccgcccggtatgggtgctccaggggtacccggagcagctggtgtcggtggagctggaggcagggaaccttctacagcatccggcggcggccagctgaaccgcgccggctccatttccaccttggactcgctggactttgcccggtacagcgatgacggtaacagggagaccgacgagaaggtcgctgttttggagtttgagcttagaaaagctaaagagaccatacaggccttacgggcaaatctgactaaagcagccgagcacgaggtcccattgcaggaaagaaagaactacaagtctagccctgagatccaagaacccatcaaaccattagaaaaacgggccctaaactttcttgtaaacgaatttctgcttaaaaataattacaagcttacttcaataacgttttctgatgagaatgacgaccaggactttgagctatgggatgacgtaggactcaatatccctaaacctcccgacctgttacaactttatcgcgatttcggaaatcaccaggtgacaggtaaggatttggtagacgttgcctccggagtcgaggaagacgaactcgaggccctaactcctattatatccaacctgccccccactctcgagacccctcagccagccgagaattccatgttagtccagaagctcgaagataagatatcgctccttaactctgaaaaatggagccttatggagcagatcaggagattgaaatctgaaatggactttcttaagaacgagcatttcgcaatacccgctgtttgtgactccgtgcagccacccctggatcagctgccccacaaggactcagaagacagcggccagcacccggatgtcaacagctcagataagggaaagaacactgatattcatctcagcataagtgatgaggcagatagcacaattccaaaagagaactcgcccaatagctttcccagacgcgagcgcgaaggcatgccgcctagtagtctgtcatcaaagaagaccgtccatttcgacaaaccaaataggaaactgtcaccagccttccaccaggcccttttgtcattctgtagaatgagcgctgatagtcggcttgggtatgaggtgtctcgcatagccgatagcgagaagtctgtgatgctgatgttggggaggtgtctgccacacattgtcccaaatgtgctgctcgcgaagcgcgaagagttgatcccattgattctgtgtaccgcctgtttgcaccccgaacctaaagaacgggatcagctgcttcatatactgttcaaccttatcaaacggccggacgatgagcagcggcagatgatacttacagggtgtgtcgcatttgctcgccacgtgggaccaacgcgggtggaggcagagttgttgccccagtgttgggagcagataaaccataagtaccctgagcgaaggctgctggtcgcagagagctgcggagccctcgccccgtacctgcccaaggaaatccggtcttccctggtgttgtcaatgcttcagcagatgcttatggaagacaaagcagacttagtgcgggaagctgtcatcaagtccttggggataatcatgggatatatagacgaccccgataaatatcaccaggggtttgagttacttctctccgcgcttggggacccaagtgagcgtgtcgtgagtgctactcaccaagtgttcctgccagcctatgctgcatggacaactgagctaggcaacctgcagtcacatctgatcttgacactgctgaacaagatagagaagctgctgagggaaggcgagcatggactggacgagcataaactccatatgtacctgtccgccctccaaagtttgatcccatcgttgtttgcgctcgtcctgcagaatgccccattctcatccaaggcaaagcttcatggcgaggtaccgcagatcgaggtgacacggttcccacgacccatgagcccactccaggatgtatccacgatcatcgggagcagggaacagcttgcggttctgctgcagctctacgattaccagctggaacaggagggaaccacagggtgggagagtttgttatgggttgtgaaccaactcctccctcagctgatcgagattgtagggaagattaatgtcactagcactgcctgcgtccacgaattttcccgatttttctggcggttgtgtcgtacatttggaaaaattttcacgaataccaaggtcaaacctcaatttcaggaaatcttgagactatccgaggaaaacatcgatagctccgcagggaatggagtgctcacaaaggcaaccgtcccaatttacgcaaccggtgtgctgacctgttacattcaagaagaggatcggaaactgctggtgggttttttggaagatgtgatgaccctgctcagcctcagccacgcgcccctcgatagcctgaaggcaagttttgtcgagttaggtgctaatccagcatatcacgagctgctcctaacagttctctggtacggcgtggtacatactagcgcattggtcaggtgtacagccgcccggatgttcgagttaacgctgagaggtatgtcagaggcactcgtggataagcgggtggcgcctgctctggttactctttcttccgatccagagttcagcgtcaggattgcaacaatcccagcgttcggcacgattatggagacggtgatccagcgcgaattgcttgaaagagtgaaaatgcagctggcttcatttcttgaggatcctcaatatcaagaccagcattccctgcacactgagataatcaaaacgtttgggcgggttgggcctaacgctgaaccccgctttcgtgacgaatttgtcatccctcacctccacaaactcgccctcgtcaataacctgcagatcgttgactccaaacggctagacatcgccactcacctctttgaagcctacagcgccctatcttgttgcttcatttccgaggacctcatggttaatcactttctgcctggtctcagatgcctgcgtaccgacatggaacatctgtcccctgaacacgaggtcatcttgtcgtccatgatcaaagaatgcgagcaaaaagtggagaataagactgtacaggaaccacagggctctatgtccatcgctgcttctctggtgtctgaggacactaagacaaaattcctgaacaaaatggggcagctgaccacatctggggccatgttagcaaacgtgttccagaggaagaaatag

SEQ ID NO: 32483 - DNA, 435 bp, Artificial Sequence
  Description of Artificial Sequence: Synthetic coding sequence
atggagagggcatcagggctgtcccctggcggaggcctgggggcaacaagtaggcagatgtcccctggcactcagttggcaaatcccccagaccatggtgacaaagattgtctcggaaggatcagcccaggctctggaaaacagattcaggccgccgggcagctgcctggccctccaacctcactggctccagcccaaggaagactcaggagcctcacaccctggggcctacagacgccagagcactctgagcctgaggggataggacacctgcaggccgccacagaagctgttctgcctcattctacccaaaacttgatcacgaaacgaaatctgatggtacaggcgcgggtccagtggagagatttggggagtttaaaaccacctcctccaaggtttaaacagttcagttgcttttctcttcccagcagttag

SEQ ID NO: 32484 - DNA, 177 bp, Artificial Sequence
  Description of Artificial Sequence: Synthetic coding sequence
cccgggggcgccgccgcagccgccagtgttatggcccctagacgcgggagatgcttttgcacgtccatttgtgggggtagaggtgccaggccacaactccccaggacttgcggtgacgggacacaacattgcgggaggggtaagccggcactagccgccgccgaagaatggccgtag

SEQ ID NO: 32485 - DNA, 294 bp, Artificial Sequence
  Description of Artificial Sequence: Synthetic coding sequence
atgggttccatcccaagtaagccttgtaacaaccccgaagggcccttactacaaggcatggaagcggcagattggaccggcattggcgtgtgtctgccccctggtggcgcccgtggacacatctactgctgtaccagactgtgtcaccagcgcgctgcctccgcccacagatctctgcttctccctcggacggtgcagactggcgggaccgagcgggagaaacctgggcctggccagagaaagcgcggcgctcactgcagtgcttgtaagagatccagcactaggccttcgtag

SEQ ID NO: 32486 - DNA, 504 bp, Artificial Sequence
  Description of Artificial Sequence: Synthetic coding sequence
atggacctcatcaaagttctctatgttaagaaaccgttaatttttcccatgtacctgatttataagcacgagaatctgattctggagcgaaatccgctagatgtcaggtcagttgtgatggtgtccgtcatccctttgaccttcgacatcatgagagagctgacattagaaaagaaccctatgaatgtcaaaaatgtggtaaagccaagtgatatagtggtcccttacgagaacatgacagagctgatcctggagaggaacccgatgtcagtgagaatcattggcaagtgccttgtgatgcccattatattcgtagccatcaaggaattgactccagaaaggaatcctatttcgaaggattgcggaaaagcttttcgcagcagcagtttctgtcagcaacataagagtactcataccggggagaagccgtatgaatgtaagaagtgtgggaagaccttccgcttttactccagcctccccaagcataagcgcactcacacctag

SEQ ID NO: 32487 - DNA, 408 bp, Artificial Sequence
  Description of Artificial Sequence: Synthetic coding sequence
atggtcgcaacatggggaggcaggcagctgctgccacagtgtagcggccctcccctgacccctgggtcgcccgcccctagcgttgcgcaggcctctaggccagccccaccctcaccacgcaagacctcacccggaccccctcaaccctcggcaagcccaagtctgccatttagccctctactggcaggttgttccagattactgcctgtattggcaccttcactctcaagcgtccatagatgccccttgggggctagggcgtcccggctgccttggaagcttgaagccggcacaagttctagcggcgacaggcccttatgtctacatagcgggcaaaggggcgcttgtttgacagatgagcagggcagtaccctatccccacgccagcggagagggccaggcaagtag

SEQ ID NO: 32488 - DNA, 5529 bp, Artificial Sequence
  Description of Artificial Sequence: Synthetic coding sequence
atggagctgatgttcgctgagtgggaggatggcgagaggttttcattcgaagactctgatagattcgaggaggattctctgtgcagcttcatatcagaggctgaatccctgtgtcaaaattggaggggatggcgaaaacagtcggccggacctaactcacccaccgggggcggcggtggaggaggatccggagggacacggatgagagacgggctggtgatccctttggttgagctttccgccaagcaggtagcatttcatatcccgttcgaagtcgtggagaaggtttacccccctgtacctgaacagctgcaactgagaattgctttttggagttttcccgagaacgaagaggacatcagactgtactcctgcttagccaatggaagcgccgatgaattccagcgcggggaccagctcttccgtatgagagcagtcaaggatccactgcagatcggattccacctcagtgccaccgtcgtacctccacaaatggtgccacctaagggagcttacaatgtggctgtcatgttcgatagatgtcgcgtcacatcctgttcctgcacctgcggcgccggggctaagtggtgcactcacgtcgttgctctgtgcctctttaggatccacaatgcttcagctgtgtgtctcagggcccccgtgtcggagtccctcagccggcttcagcgcgatcagttgcaaaaattcgctcagtatctgattagtgaattgcctcagcagattctgcccactgctcaacgcctgttagatgagttgctctcctcacagtccacggcgattaacaccgtttgcggcgctcccgatcctacagctggcccctctgccagcgaccagtccacttggtacctcgacgaaagtacgctcactgataacataaaaaagactttacacaagttctgtggaccaagcccagtggtctttagtgacgtcaacagtatgtacctgtcttcaacagaaccccccgcggccgcggagtgggcgtgcttactgagacctctcaggggtcgggaacctgaaggcgtgtggaaccttttgtctattgtacgggagatgtttaaacggcgggactcaaacgccgcacctctgctcgaaatcctgaccgaccagtgtctgacatatgagcagattaccggttggtggtattccgtgcgtacctcagccagtcacagctccgcatcagggcacaccggcagatctaatggccagtcggaagtggctgcccatgcttgtgcttcaatgtgtgacgagatggttaccttatggcggttagcggttctggacccagccctgtcccctcagcgaaggagagaactttgcacacagctcaggcagtggcagctgaaagtgatcgagaacgtaaagaggggacagcacaaaaagaccttggaacgcctgttccctgggttcaggcccgccgtggaggcatgttacttcaattgggaagaggcctatccactgcccggcgttacctatagcgggactgaccgtaagctggctctctgttgggctcgggcacttccttcacgccctggagcatcaagaagcggcgggctggaagagtctcgagatcgaccacgtcctctgcctaccgagcccgctgttcgccccaaagagcccgggactaagagaaagggtctgggggaaggagtgccgtcaagccagcggggtcctcgcaggctgtccgccgaagggggagacaaggcactccataagatggggccaggcgggggtaaagccaaggccctggggggggccgggtctgggtccaaagggtcggccggaggcggtagcaaaagacgcctttctagtgaagattcctcccttgaaccggatctggccgagatgtcacttgatgactcctctctggcactgggcgccgaggcaagtacttttggcgggtttcctgaatctccaccaccttgcccactccacgggggtagccgtggtccctcaacttttctgcctgagccgcccgacacctacgaggaagatggcggcgtgtattttagcgagggtccagaacctcccaccgccagcgtaggaccacctgggctactcccaggggacgtctgtacacaggatgatctgccatctacagatgaatcggggaacgggctgcctaagactaaggaagccgcaccagcggtcggggaggaagacgatgactaccaggcttactacctgaacgcccaggatggagccggtggtgaggaagaaaaggctgagggtggggccggagaggagcacgatctgttcgcaggcctgaagcctctcgaacaggagtcccgtatggaggtgctgttcgcctgcgctgaggcactccatgcacacgggtatagcagtgaggcatcacgtttaactgtcgaactggcccaggaccttctagcaaatcctcctgacctcaaggtggagccaccccctgctaagggaaagaagaacaaagtgtccaccagcagacagacttgggtagccacaaatactttgtcgaaagcggctttcctgttgactgttctgagtgagcgcccagaacaccacaatttagccttccgtgttggcatgttcgcccttgagttgcagcgacctccagcatcaaccaaggctctggaagtgaagctggcataccaagagtccgaggtcgccgcactcctgaagaagatccccctgggcccatctgagatgagcaccatgagatgccgagccgaagagctgagggaaggaactctgtgtgactataggcccgtcctgcctctgatgctcgcctcctttatttttgacgtgttgtgtgctcccgtggtgagtcccactggcagtcgcccaccctcacgcaactggaatagcgaaaccccgggagacgaggaactgggattcgaggcggccgtagctgcgctagggatgaaaaccactgtttctgaggctgagcacccactgctgtgtgagggaacaaggcgggaaaaaggagacctagctctagctctgatgattacatacaaagacgaccaggcaaagctcaaaaaaatacttgataagctgttggaccgcgagtcacaaacacataaaccacagaccctaagctccttctactccagcagtcgccccacaacagcatcgcagaggtcaccgtcaaaacacgggggtccttccgctccaggcgctctgcagcctctcacaagcggctcagctggacccgcccagccgggatcagtcgccggtgccggccccggacctaccgagggattcaccgaaaaaaatgtacctgagtcctcaccgcattctccctgtgagggtcttccaagcgaggcagcactcaccccgagacctgaaggaaaggtgccatcgagactcgccctcggctctaggggcggttataacggtaggggatggggatcacccggcagacccaagaagaaacacaccggcatggcctctatcgattcttcagcaccggagacgacgagtgatagctcccctactcttagcagaaggcctctgagaggcggatgggctccaacatcttggggcaggggacaagacagcgacagcattagctctagctcgagtgacagcctcggctcctcatcctcttctgggagccgcagagcctccgctagtggaggtgctcgggcaaaaaccgtcgaagtcggtcggtacaaaggaagaaggccagaatcccacgccccacacgtcccaaatcagcctagcgaagcagctgcacatttctacttcgagttggctaaaacagtactcatcaaggccggaggcaacagttccacttctatcttcactcacccctccagttcaggaggacatcaaggaccccaccgcaacttacacctgtgcgcctttgaaattgggctttatgcacttggtttgcataacttcgtgtcacccaattggctctcacggacatattcatctcatgtttcctggatcacaggtcaggctatggagatcggatccgctgctctaaccattttagttgaatgctgggacgggcacctgacgcccccggaagtggcttcactggccgatcgcgctagcagagccagagactccaatatggtccgcgcggccgccgagttggctttaagttgtctgccacatgcacacgctctcaaccctaacgaaattcaacgggcactggtgcagtgtaaagaacaggacaatctgatgttggaaaaggcatgcatggcagtcgaggaggccgctaaagggggcggtgtgtatccagaagtgttgtttgaagttgcccaccagtggttctggctctatgagcaaaccgccggtggtagcagcacagcacgagagggcgctacgtcgtgctcggccagtggcatccgagcggggggagaggccggacggggcatgcccgaaggcagaggcgggccaggcactgagcctgtcactgttgccgcagccgctgtcactgcagccgccaccgtagttcccgtgatctccgtgggcagcagcctgtatccaggccccggactggggcacggtcattctcccgggctccatccctatacagccctgcagccacacctcccgtgctccccacagtatttgacacacccagcccatcccgctcaccctatgccacatatgccacgcccagccgtatttcccgtcccatcctccgcttacccccagggcgtgcatcctgccttcctcggggcccagtatccatattccgttactcctccgagtctggccgcaacagctgtgagttttcccgttccctctatggctccgatcacagtgcacccttaccataccgaaccaggactacctctccccacatccgtcgcctgtgaactgtggggccagggcacggtgagctccgttcatccagctagcacattcccagccattcagggcgctagcctgccagcactcaccacccagccttctccacttgtctcgggcggtttcccccctccagaggaggagacacactcccagcctgtgaatccccattcattgcaccaccttcatgcggcttatcgggtgggcatgctggccctggaaatgttgggacgcagggctcacaatgatcaccccaacaacttctctagatctcctccatacacggacgatgtgaagtggcttctggggcttgccgcgaagctgggagtgaactatgtccaccagttttgcgtgggggccgctaaaggcgtgcttagcccttttgtcctacaggaaattgttatggagacgttgcagcggttatcacctgcccatgcccacaatcacctgcgagctcctgctttccatcagctcgtccagcgctgtcagcaggcctacatgcagtatatccaccacaggttaatccacctgacgccagctgattatgacgatttcgtgaatgccatacggagcgctagatctgctttctgtctcactccgatgggaatgatgcagttcaatgatatcctgcagaatttaaaacgctctaagcagacaaaggagctttggcaacgcgtttcgctggagatggctacattctcgccctag

SEQ ID NO: 32489 - DNA, 87 bp, Artificial Sequence
  Description of Artificial Sequence: Synthetic coding sequence
gacgccgtcatcctgttcagtgtttggaggctgaaaaaaaagagcagggttttgttcttcatctacattatagcaatttccgtatag

SEQ ID NO: 32490 - DNA, 111 bp, Artificial Sequence
  Description of Artificial Sequence: Synthetic coding sequence
atggaggagaccgagtcgggctctgggcgcaaggagagaaggtggctgggtgctgtcgcgcacgtgtgcaacccttcaacgctcggaggacaggtgggtagaatcatctag

SEQ ID NO: 32491 - DNA, 495 bp, Artificial Sequence
  Description of Artificial Sequence: Synthetic coding sequence
atggggcaaaaaaagacaatgggtacggagcgaagtagaggaggaaagaggggcccccaaccaggagctgagcggcccgaagagcccggcgccaccttctctaagaaaccccctgagggcgcccgggcgcctaggtgcctgagccgaccgacggcccctaagtccggcgcctgcttggctcggaggaggccccctggctcgccgtgttcgattcgcgacgcccctttccatacgggcgatgacaggtttctagctagggagaatttcccgaacgttctgcagcccttacctcggatgttcgccgtgcagcaagccgcggattttgagtcgcagtgcccaagacgctgggactcccgcaagcggccctcagaagggctgccatctgcgggctggggccgttggagaggtagacccatccatctcggcctgtgggtgagtgggtctgtgaggagaaaggtaagtggctcgcacgtgagtcggtctcttcatttgtag

SEQ ID NO: 32492 - DNA, 1143 bp, Artificial Sequence
  Description of Artificial Sequence: Synthetic coding sequence
gtccatcaggaaatccacacgatcgaaaaaacatttgagtgtagtcacgggaaaaaaagcttctgtcaggaatcccactttaccgagcaccacagaacatgtacccgggagaagccatgcgagtcttctgattgtaagaagaggttctgccattcctcagtattacgcgtgcatcaacggactcacaccggcgagaaaccttatgagtgcaaagagtgtaggaaaagcttccacgtgaaacccaacctgaccaagcatcagaagacacatataggcgagaaacctttcaaatgtaccgcgtgcggtaggacattttttcagcagtcgaccttaaatgtccaccaacgaacacacacaggcgagaagccttgcgggtgtaatgaatgtgaaaagtccttctacaacaaagatgcactgatcattcaccagcgaactcacactggagagaagccatataagtgcaatgagtgcgaaaagagctacctcaagaagtcgcatttaaatattcatctaagaaatcacacgggaaagcgccctcacgtctgtaacgagtgcggcaaggccttctctatgaagtcaacactgaccgtccatcagcggacgcacggagagaagccctacaagtgcaacgagtgtcgcaagtccttctatatgaaatccgcactgtcccaacaccaaaggattcacatatgggaggagcactgcgagtgcaaggaatgtggcaagacttaccagagatcccatctcgccaagcatcatagaaaatataccaaaaagccctatgagtgtaaacaatgtggaaagaccttccagaaatcccacctgattgaacaccagcgtacccaccccggggagattccgcatgagtgcaataagtgcggcaagtccttttgttataagtctccgctgaccatccaccagaggacacacatcgaggagaagccgtacaaatgcagcaaaagcgtgacttatttctgtatgaaatctcacctcacagtccatcagcgcccccacacccgcaagaaccctttcgagtgcaatgagtgcagaaagatgttctacgtgaagtcaaacctgatcaaccaccagagaactcatacaggcgaaaaaccctatgaaggcaacacctgcggaaagagctag

SEQ ID NO: 32493 - DNA, 585 bp, Artificial Sequence
  Description of Artificial Sequence: Synthetic coding sequence
atgcccgcgccccgcttcttatattctctgcggaattacgagccaatgaaacctctttttttcataaactaccccgtttcagatatggagttgcctgtgcgttcctcaaccgttacattgctgcctgctcctctccctcgtcgggggagtgtgaagaccttcctggctccctccaaatcctactttcctgaggaggagagggccctgttaaaatcctctcacgctttctgtacggggctttggccttggcgcagagattttcaactcccacaatgccatttagccctgggcctgctgccaggtgaacgcagcgttaggctcccaagatttctggccgtactaaaagaattgtctgccacggcatccttcaccctggcttcagaggcgattccattcctatcatcattcccgttcccctggaatcttctcttaccctcagtgttccaagctttgccacagaaatggcagtttaaggccgatttcctgctggaatgcaccctctccgttaaagaagccttccatcaggagtgtggcgccggggttagtctggccaacgggctaaacaaaggactcaggacgggatag

SEQ ID NO: 32494 - DNA, 6312 bp, Artificial Sequence
  Description of Artificial Sequence: Synthetic coding sequence
atgtctgtgccgggcactcccggcgcaatggaacccgctggcgaagaagaacgcccgcctccagcggctgagggtgaagacgacgaagaggaagtggctgcagccgctcagacgtctggccctgcgcatggtcgctccgcctcgtccttggaagatgccgacgaccaggaagaagaaatggaagccatggtaattggcggggggtgttgtaaggagcaagagctgacctacgagctccagcagggatacaggattctgggagaatttctgcaagagaagcatcgcggactgactgctcctttcctgcagcccctcggcggcgtggccaccgcagaggaggaagtggcagaaggcccccgatccggaggtaggggcggaagggcctttccccagcaacctgggcagggaatgtgtctattgcaaatggaagaaaaattcgcctcaggacagtatggaggtataacggaatttgtcgcagactttagattgatgctggaaacgtgttatcgtctgcacggtgtggaccattggatatccaaacaagggcagaagcttgagatgatgctggaacagaaactcgcactattaagtcgtcatctacgggagaagacgacgatcgcagtcacatcgcggggatattacggcctggaagatgagaaagggactgcctgtaccagcaccagaagaagatctacgcctcgtagcctagctggcctcaccagtggggtgttcgagtctatcatggtacaggtattacgccaggaagagcagcttcgggcgaaggaggagaaacggctgcgcgagcaggagagaaaagaggccgaagaggccagccaaaaggagattgaggaatgggagcggaagctacttgcacaagcagctcccacatgtatggaaaccatgtgggagatcccagcaataggccacttcctttgcctcgcccaacagatcttgaatctgccagagatcgtcttctatgagctagagcgctgcctgctcatgccacagtgtaatgcttttttgagcaagattatgacctcattactgtctccacctcatagaagacccacccttcacaggcgacccaccctcccttataggacgtgggaagccgccttgcgccaaaaggtgcagcagtggtataccgctgtaggccagacagagaaccccgacaattgtgcggagaagctgggcctgtgcccccaattctttaaagtgttgggcgaagttaacccccttgaggagaagccattccacgagctccctttttatcaaaaagtctggctgctcaagggcctctgcgatttcgtgtatgaaacacagaaagaggttcaggatgcagtgcttggacagcccatacacgaatgtagagaagtgatcctgggctacgactatctggagaacgcatatgtgcattttcctcagttctgtggtgctgacgttagaatatataagcagaggcctttccaagctcctgaattcccaatacctcccatcaagatccaacgggtgccccggattaaactggagaagctaaaatgcgattacgtcagcacttccaatggcgagcaccggtgcagtcgggactctctcccatcctcttttaagaaagagcaagaaaataattttgatccggcttgctgtcccgcaaaaatgattctggataatcacgatatctccgtggagatgggcgtgaagagtaattacgagatccgtatccgcagaccgtgcgaaattaaaaagactgactgttgcaaggagaacctggagaaaccaagaagccccggggaagtcaccggcttcggcgaacccctgtcacctggcgagatcaggttcattgagaatcaggagaagtatggagaagcttctaggattaagattgaaccgtcacccctgaaggagaacactctgaagtcgtgtcaaatacatgtcaacgggagccattctgaccatccagagattaattgtcataaggtggtgcgagacatcctgctggaacagtcactgcaaagccacaaaaagttaaaactgactaaaatgcgcgctaagaagaaaaagaagaaaaaaaagaaactcaaggatgtgttgaatgaaaatctgcagaggaaacgggaaggcctgcacagcctggcttttaagtcgtataagcccgagatccagaacaagttactgattattaagaaaaaggccaaacataagaagcataagtccggtaagaaatccgtttcaaagaaggccattactaagaaaagaaagacagtgatcaagagccccactgtgccagaattccaacttatttgcacaaacttagatgagctcagggaactcattaccaaaatcgagaatgagctcaaggatctggaaaacagcagaaagaagagtggtaaatggtatcataggagacaggcagttaaggagctgcattccacccttatacggcttctgaacgagctgctgccctgggagcctaagctgatgaaggcatttcaacgcaatagatctcgcctgaagaaagattacgatgactttcggagacagccagatcatgacacctttaatcgggaactctggacaacagacgagggagagggtgatctgggcaaggattctcccaagggggagatcagtaagagcattgattctacagaacccctagatatccttgagaaggatcatttcgactcagacgatatgaagttgagcgaaattgatttccctatggccagatccaagttgcttaagaaagaactgccttctaaggacctgcctaagacactcctgaagaccctaaaaagacagagtaagcagaccgactatgtagatgactctacaaaagaactgtcaccaaggaagaaggctaaactttctacgaatgagactacggtggagaacctggagtccgacgtccagattgattgcttttcagaatccaagcatacagagccatctttccccgagtcttttgcatccttggattctgtcccagtttcaacactgcagaagggcacgaagcccattcaggcactactggcaaaaaatataggcaacaaagtcaccctgactaatcagttgcctccatcaacagggcgcaatgcgctcgcagtcgaaaagcctgtgcttagtccaccagaggcttcacccattaagccggcactaacctgtcataccaataccaagggcccactccagatggtgtataagatgccctgcggccagtggctaccaatcgacctgcagaattctagtgtgaaaatccaggtccagcccatggtggacccaaagacaggagaaaagataatgcagcaagtgctgattttgccgaagaatttcgtgatccagcataaggaagggaaggccgttgccaaagaagtccctccacttcaacagaaaggaactgaacaacattgttcttctttcccccagaccaccaacataaacagctccttagctagtgtctttgtgaatagccccggaactgttagtacccaactccccaacaccgcgtttaataagaccatcacccccctgtctaacatcagcagcgcgagaccccagccactgtcccctgtgacatccgtctcgaacttgcttacaccaagcgtcaagacctcccaaagcgaagcgggcaaagctaaaaatgccgtgtcagccgccactttctcacttcccagtgccagccccaccatttccagcacagggcagcccctctcgtcgactactacactgaatgggtcgacaaatccagggtcttcgtttaattgtttcgcccaacagactgcggattcttccgaggccaagcaggagctgaagaccgtgtgtatcagggacagccagtcaatcctggtccgtacccggggaggaaataccggggtggtgaaggtgcaaactaaccctgaccagaatagccccaacacagtatcctcttcctccgtttttacattcgcccctcagttgcaagcattcctagtgcctaagtcaaccacctcgagctcagctttttctcctgtggccggcaccacaaccactagctcactttccccgttcagccagaccccaacgtcagtgtccattcctgccagtttcgccccgagcatggggaaaaatctgaagctgactctgggacacaccacaggctctggagaccttggccacgtcattgataagactagccacatgccttctagcccgctgaaatctagcatctgctcttccacattgttgcctagcaccacatctagttcagtgtctgtcatctcaattagcgccgcaaatttcggccagaacaatgctaatattatccacaccccaacaaagcagcaacaggtcgactacatcacgaagtcatacccagtcacaaggtctgaggctacagctgcaaccaacggcgatgtgatttctgggacacccgtgcagaagctgatgctggtatccgcccccagtatccttagttcgggcaatggaactgccatcaacatgacgccagccttaaccagcaccggtgtgagtgctcagaagctggttttcatcaatgcgccagtgccttctgggacgtcaacacctacgcttgtggccgagagcttgaagcagaccctcccgcctcctcttcacaaggcgtacgtgaaaactcccgaacaacctcaaatagtgctgatcccgagcactgtcggtacacccatcaaaatcaattccagtccagcagtctcacaaatcaaggacgtgaagattggtctgaacatcggacaggcaattgttaacactagcggcaccgtgcctgcaatccccagcatcaacattctccagaatgttactcccaaaggtgaggacaagtcttctaagggctacatcttgcctcttagcacctctggaaactccgtccctgtgagctccaactttgtctcccagaatattaccccagtcaatgagtctgtggtttcctctgcacgcgcagttaatgtgctgagcgtaacaggagcgaacttgtcactggggtctttccccgtcacttctgcgtcagcaagtgctggagctcaaccaccagttctggtctccggaaatgacacctcttctagaattatgcccatcctatcaaaccggctttgttccagctccttaggtaataccgtagctatcagcacggtcaagaccggacacctcgccagttccgttttaataagcaccacccagccggtcgtttcacctaagtgtttaacttcggctctgcaaattcctgtcacagtcgccctaccgaccccggctactacaagccccaaaatcattaacactgtgcctcattccgcagccgtgcccggcgcgaccagaagcgtctcaatctctaaaagacagtcgcggacctccttacagtttcattccccaggaatctccacaacagtaccaaccaacgtcaatactaacaagccacaaaccgaacttagctcactttcgacatctcccgggaagattacaaatacctctaattttgcatcactgccaaaccaacaggccttagttaagacccctagttactcttccgcgcccggcggaaccacaattcatactgctagcgccccttctaacgtcacaagcctcgtggggagccagttctccgagccatgtatacagcagaaaattgtgatcaacacttctaccccgctggcaccagggacacagataatgatcaacggcacccggttcatcgtcccacctcaaggtctcggagccggctcccatgtgctgctgatcagtaccaatccaaagtacggtgcaccactggtgctgaattccggtcagggcatccaatctacccctattgacaacagcgcccagaagattacccttgcttcaaacaactcactctccggccagccattacagcaccccctgcgctcacctaccaaatttattaattccttcggtaacgcgtctagcatacctacagtgcatacatctccacagctgataaacaccactgccaaggtacccgttccgccaccggtgcctactgttagtctgacctctgtaatcaaaagtcctgccacgttactggcaaagacctctttggtgtcagccatctgtccgagtaaccctcccctgccatccagtacaagcgttttccaccttgacccacccgtgaagaagttgttagttagtcctgagggcgcaatcttgaacacgataaacacaccagcctcaaaagtgtcttccctgtctcccagcctatcacagattgtcgtgagtgcgagccgctccccagcctctgtgttcccagcatttcagtcgtcaggccttgaaaagcccgaccgtgctgcaagttag

SEQ ID NO: 32495 - DNA, 342 bp, Artificial Sequence
  Description of Artificial Sequence: Synthetic coding sequence
atgcacaccgtgccatggggggttgactttgctctcatcgcaatgaagaactttatcagccagtggagctccttttttaggagtgggatgggcaaatcacaaaccggctatctgccccgggtgccaagggagcagccctttgccgctggcctgtgggggctcgccgcagcattatctcatctagccgttaatgcgttttctctgctctgcccacctctccctaagacatcttgttccttgaacccacacggggacgttgagtcgcgcaaagtgcacgcgactgtcgagaacgtgtatatctccgcactaaacttaccttgggttagggttaagtggtgctag

SEQ ID NO: 32496 - DNA, 66 bp, Artificial Sequence
  Description of Artificial Sequence: Synthetic coding sequence
aggggcgccgacagggagagattcgcacgttgtgtgatcttggtcacccaggaagccgatgcttag

SEQ ID NO: 32497 - DNA, 243 bp, Artificial Sequence
  Description of Artificial Sequence: Synthetic coding sequence
atgtgcctgatatcactctgtgtgagtttcacctctgtgaacaagagagagcagaacaagcctaagatcctcatcttgctcaagaaaagacttagtggatgttttattaaagaggcaagagggacccggctcaagggcaaccagctggccgtaaccaaggcccgtgacgacggcggtttagctgaagatggtgacagcggagggggcaaagtgatcagattttggatatacttcgaaggctag

SEQ ID NO: 32498 - DNA, 417 bp, Artificial Sequence
  Description of Artificial Sequence: Synthetic coding sequence
gctggcgggagaccacatcagccagcttcccttccccctggcaacccccagttagctgccctttccctggaacagctcaagagccaggcccctatggataccaagccagcataccagaatccaaggcgcaaggcggagcacagcgtgagcgtgcacttggacgaacaagactggaaccctactatgcataaatccctgctcggcaacgaccagacccagtcagaggtgcagtctgggacactagaggcaggagtcgacagggtgatcagccaaacggtcgaccctaaactgaatcacattctgcgaccgccagtcgaaggagctatccatgagtttctggaagccaggaagaaatcctcatctgcctcatcccctactagagctcagagagctaggacccttcagctctacccttag

SEQ ID NO: 32499 - DNA, 84 bp, Artificial Sequence
  Description of Artificial Sequence: Synthetic coding sequence
tgttggggtttttactacatcctgtatctgttatatatcatttacctctacaatatttatattcttaaaacacgttcctactag

SEQ ID NO: 32500 - DNA, 108 bp, Artificial Sequence
  Description of Artificial Sequence: Synthetic coding sequence
atagtgctgcttttatttatttgctttctctccaaactgaactttactgtgttggagaagttccctaaatctactttcctctgcaaaatccagcacgagagcctatag

SEQ ID NO: 32501 - DNA, 570 bp, Artificial Sequence
  Description of Artificial Sequence: Synthetic coding sequence
atgtgcgcaaagcggttgagagggccttttcggatcttcctgcctctccgcaagtactcatttttcccctcacaggtggcccagccatttgccagcgccgcggttgcccaggcactgctctcctcccctggtactaatttgcagcagaccctggtaggaggattgagactccggcatggatcagtcgggggagctcagtgggtggtcaaagctgcatgtccatgggagccccaagatgtggcatgttgtggaggctttacagtgactgctcgcatcgcagcatgtgtcctcctatgtctttgcgagcatatgtacacaccatctgcccacgctagaatgacatttgggaccgagcatctactgctctggccagctcagagaagggcagacccacggaccgcggcccctataaggctgcaccagggtcagctcgatccttcacgtgaccccgagaatctgagagcctgggccgtgggctcctgcagggctggagtggaactccacggaagtccagttcacctccatatgagagccggtcagcacataagcatgttcgctggagtcgcatag

SEQ ID NO: 32502 - DNA, 3285 bp, Artificial Sequence
  Description of Artificial Sequence: Synthetic coding sequence
atggccgctagagcaccgcctgctgccccagctgcagaagagccgggcaatccaggtggcccaccaaggaggaagaagtcccgctctggggcctccgggttacggcgggctttcagttggctgcgcgggaaacgcagaaaaaaaaaggcagcaggggccgagggcgccgaacccgccgcccctcgggctaaaaaggccgaagataaggccaagagggcaaagggtaagggtcggggaagcgctaaggcagaaaatgacaagcatttaagcgtgggcccgggccaggggcccggcagcgcggttgatgagcatcaagataatgtgttttttccctctggtaggcccccccacctggaggaactacatacccaggctcaggagggccttcggagcctgcagcaccaggaaaagcagaagctgaataaaggcgggtgggaccatggggatacccagtcaatacaatcttcacggaccggtcctgacgaagacaacatcagtttttgcagtcagaccacttcatacgttgccgagtctagcacggccgaggatgcgctctcaattaggagtgagatgatccagaggaaaggtagcacgttccggccgcacgactcattcccgaagtcagggaagtcaggccgaagacgtagagagcggcgcagtaccgtccttggattaccacagcatgtgcagaaagagctgggcctcagaaatgaacgggaggcccctggcacccctcgcgctccaggggcacgcgacgccgtgagaatacccactgtagacggcagaccaaggggtacgtccggaatgggcgccagagtgtccctccaggccctagaggcagaggctgaggctggggccgagactgaagcgatgctccagcgtcatatagaccgggtgtaccgggatgacacgtttgtgggcagatcaaccggaactcgcgcgccacccctgacacgccctatgtccttagccgtgcccggtttgacaggaggagcagggccggcagaacctttatcacctgctatgagcataagccctcaggcaacttatctgagcaagctgattccgcacgccgttctgcctccgacagtggatgtcgtggcccttggccggtgcagtttgagaaccctcagcagatgtagtctgcattcagcaagccccgcttcagtaagatctctggggcggttttcttcagtctcatccccccagccacgctccaggcacccatcaagtagcagcgatacctggagccactctcaatcatctgatactatcgtatcggatggtagtacgctgtctagtaagggcggctcagagggccaaccggaaagcagcaccgcatctaattcagtggtaccccccccccagggcggctctggtcggggatccccttctggtgggtccactgctgaggcgagtgatactctctccatacggagctcaggccagctgagtggacgatcagtgtcactgaggaaactgaagcggcccccccctccgcccaggcgcacccacagtctacatcagcgggggctggccgtccctgatggccctctgggattgcctccaaagcctgaaaggaagcagcagccccagttgccgaggccccccactaccggagggtccgagggagcgggcgctgccccatgtccaccaaatcctgccaattcttgggtgcctggcctgagcccaggggggtcgcgtcgaccaccgcgcagtcctgaacgcactttatccccgagctcaggttactcttcccaatcagggacccctactctgccccccaaggggttggcaggacctcctgcctctccggggaaagcccaacctcccaagccagaaagagtcacctctctacggtcgcccggcgcgtccgtgtccagctcccttacgagcttgtgttccagctcatcagacccggcaccatcagataggtcagggccgcagattttgaccccacttggagaccggttcgtgataccaccccatcctaaagttcctgcccccttcagcccaccgccctctaaaccaaggagtccaaatcccgctgccccggccctagctgccccggccgtcgtgcctggtcccgtgtccaccaccgacgcatctcctcagagtccgccgacacctcagacgactttgacccccctccaggagagccctgttatatccaaagaccagtcaccccctccatcccctcccccaagctatcacccccccccaccaccaaccaagaaaccggaggtcgtggtggaggcgccatccgcctcagagaccgccgaggaaccacttcaggaccccaattggccaccacctcccccaccagcccctgaagaacaggacctcagtatggccgacttccctccgcctgaagaagcattcttttctgtcgcctcccctgaaccagcagggccctcgggctcccccgagctagtctcgtccccagccgccagctccagctcggccacagcacttcaaatccagccaccgggaagccctgatcccccccctgccccacccgcccccgcccctgcttctagtgcccctggccatgtcgctaaactccctcagaaggagcccgtgggttgcagcaagggaggtgggccaccgcgggaggacgtgggagcgcctcttgtcactccttcgctgctgcagatggtcagacttcgttctgtcggcgctcctggcggagcgcctactcccgcccttggaccgtccgccccccagaagcccctgcgtagagctttgtctggccgtgcatctcctgtgccagcccctagcagcggtctgcacgccgccgtgcgcttgaaagcttgctccctggcagcttcagaagggctaagcagtgcacagcctaacggccccccagaggcagaaccacgtccacctcaatcaccagctagcacagctagttttatattcagcaaaggctcccgcaaacttcagctagaacgccccgtttccccagagactcaggcagatttgcagcgtaacctggtggccgaactccggtcaataagcgagcagcgccccccccaggctcccaagaaatctccaaaggcgccaccacctgtggcacgtaagcccagcgtcggtgtgcctccgcctgcctcacccagctaccctcgggccgaaccccttactgcacctcccacaaacggcctgcctcacacccaggataggaccaagcgcgaactcgccgaaaacgggggggtgctccagttggtgggccccgaagaaaaaatgggactgcctggatccgatagtcagaaagagctggcctag

SEQ ID NO: 32503 - DNA, 942 bp, Artificial Sequence
  Description of Artificial Sequence: Synthetic coding sequence
atggagtactactactgcccttcattgctgaaattgctgcgatatctgtgggatcagctcaagcagtgtttttcgcgccaacctacagaaccgaaagacaccgatacgcttgtgcatgaagctgggagccagtatggcacctggactgaacagtgtcaaagcggagaatccctcgcgactgagtctccggatagcagtgccacttcaacccgcaagcaacccccttcatcacgactgtcatcactcagctcccagactgagcctacgtctgccggcgaccagtatgactgtagccgcgaccagagatcaacatcagtggatcacagcagtacagatctggagtcaaccgatggtatggaaggacctccgccccccgatgcatgtcccgaaaagcgggttgacgatttttcttttatcgatcagacctccgtgctggactcctccgcattgaagacccgggtccagctcagtaagagatcaagacggcgggcacctattagccacagcctcagacggtcccgcttcagtgaatccgagagtcgttcccccttggaggacgagacagataacacctggatgtttaaagatagcacagaggagaagtctcctcgtaaagaggaatccgatgaggaagaaaccgcgtctaaagctgagcgaactcctgtgagccacccacagcggatgcccgcattcccaggaatggatccagctgtcttaaaagctcagttacacaagaggcccgaggtggattcccccggcgagactccgtcatgggcccctcaaccgaaaagccctaagagcccttttcaacctggcgtgcttggatcacgggtgctcccttccagcatggacaaagatgaaaggtcagatgagccatccccacagtggctcaaagagcttaaatccaagaagaggcagagcctttacgaaaaccaagtgtag

SEQ ID NO: 32504 - DNA, 1170 bp, Artificial Sequence
  Description of Artificial Sequence: Synthetic coding sequence
tgcgaaaagagcacttttttcaagcaccaaaaaagaactcacacagtggaaaagacctttgagtgttctcatgggaaaaagtccttctgtcaggagtcccacttcacggagcaccaccgaacttgcactcgagaaaagccatgcgaaagcaacaaatatgggaagacattccatcagaagcgttccttcatccatcaccagagaactcacacgggagagaagccctatgagtgtaaggaatgtagaaaaagtttccatgttaagccaaacttaactaagcaccagaagactcacattggagaaaagccgttcaagtgtacagcctgtgggcggacattcttccaacagtctacccttaatgtgcaccaagggaagcacaccgaagagaagccatacaagtatacagagtgtgaaaaaagcttttataaaagcgtgctaattatccatgagaggacacacacgggcgaaaagccttgtggatgtaatgaatgcgaaaagtcattcgaggttctaactacactagtgattcaccaaaggacccacacgggcgaaaagccatacaagtgtaatgagtgcgaaaaatcatatttgaatcttaagtcccacctgaatatacatcttcggaaccatactggaaagaggccccacgtttgcaatgaatgtggaaaagctttttccatgaagtctaccctgaccgtgcatcagcgtacgcatatgggaaaaccatataagtgcaacgagtgcagaaagtcattctacatgaaaagtgccctgagtcagcatcagcgaattcatatctacaagaaaccatacgagtgcaagcagtgcggaaaaacttttcaaaaaagtcatctcattgaacaccagcgcactcacccgggagagatccctcacgaatgtaataaatgtggtaaatcattctgctacaaaagccccttgaccatccatcagcgcacgcacatagaagagaagccatacaaatgctcgaaaagtgtgacatatttttgcatgaagagtcatcttaccgtccatcagaggccccatactcgtaaaaatccatttgagtgcaacgaatgcaggaaaatgttttacgtcaagtccaacctcattaaccatcagagaacacatactggcgagaagccctacgaagggaacacttgcggtaagtag

SEQ ID NO: 32505 - DNA, 96 bp, Artificial Sequence
  Description of Artificial Sequence: Synthetic coding sequence
atgtcggaaaagactggggagccggccgctgaaaatcgggacaaggaggcctcagtggcaggggcacaaattacactacagacccagactccctag

SEQ ID NO: 32506 - DNA, 2157 bp, Artificial Sequence
  Description of Artificial Sequence: Synthetic coding sequence
atgtcacggggatattcggagaataataatttcctaaacaataacaaccagatggtcttagacatgattctgtaccccctcattggcataccccagaccatcaactgggaaacaatcgctaggctggtacccggtctgacgccgaaggagtgcgccaagcgattcgacgagctcaaatcttccggcagttcccccgtcgacaaccagtataactccctaatggctgccggggaatccccggttgaaacactggcaacatatatcaaatcctccctgctggatattcatggagagttccaggagacacccgtgggtcatgatgccgtgtccaagactggtagacacagcatcgcaagtacaagaaactgctcatccgagagcgaaaattgtacaactcataacggcggggagatgaccgaagagagtgaggggccaaatatggttattcatgtgtgtgacgaggccaaaaacctaaaggaggactttacttgcccaagggacctgctaatttccgaaatgaagtacttcgccgaatacttgtcaatggatgctcagcggtgggaagaggttgatatttctgtacactgtgatgtgcacatttttaattggctaattaagtacattaagaggaacacaaaggagaacaaggactgcgagatgcccactctcgagcccggcaacgtgatctcaattctgatcagctcagaattcctgaagatggactccttggtagaacaatgtattcagtattgccacaaaaacatgaacgctatcgtggccacgccttgcaacatgaattgtataaatgctaacttactaacccgaatcgcagacctgttttctcacaatgaggtcgacgatctgaaggataaaaaggacaaattcaagtcaaaactgttctgtaagaagattgagcggcttttcgacccagaatatctgaatcccgattccagaagtaatgccgccactttatatcggtgttgtctctgtaaaaaactcctcactaaagagaccgaacgacgtataccctgtattccagggaagatcaatgtggacagaaggggcaatatcgtgtacattcacataagagacaagacctgggatgtccacgaatacctgaatagcctgttcgaggagctgaagtcgtggcgcgacgtgtactggaggttgtggggcacaatcaactggctcacctgtagtagatgctaccaggctttcctgtgtatcgaattctcccactgtcagtaccattctgaaacggtggtatatccaaccgctgccagctccttgaacaccgttggaaccgggatctacccatgttgtaatcagaaggttctgaggttcgatcccacccagctgacaaaaggctgcaaggtcagggatcacatggtgaccctcagagaccagggagagggtggagacctcccatcctgtccgactgccaggatgctggacgacctccataaatacagggatgtaatcgttgtcccctttagtaaggatacagtctccgacgttggcgttggtctgtgcgatgaaaaagggattgaatgcgacgtcctattggaacctaacaccccctgggggccaaagacgggcgagctgaatgccttcctgtcccttaaaaactggacactgcaactgaagcaacagtctctcttctcagaggaagaagaatacacaacgggaagtgaggttacggaagacgaggtaggagacgaagaggaggtatcgaaaaagcagcgcaagaaggagaaacctaaaaaattcaccaggcagcccaagaagcaggtgtccagtccctgcgctcagcgaaaggagaaggctctggagaagagtgcctcccgggacgtttccccatttgttatgagcatgcaaaaaaacaagtgggacgccacgagaagcctgagatttaaccaggatgcccagcgggaagacgaccagcggcgcatgaccgagataactggccacttgatcaaaatgaggcttggagacctggaccgcgtgaaaagcaaagaggcaaaggaatttgccggaggaatttatagccggctcgaggctcagatcaaggcctctgttcctgtgagcgcccgacaatcttctagcgagaagaacacccggtctaagagtcggtttgggcagggacgtcctgcctag

SEQ ID NO: 32507 - DNA, 5130 bp, Artificial Sequence
  Description of Artificial Sequence: Synthetic coding sequence
atgcgggctggatggacgccaaggggcttcagtgcctttcatgctagcctgcttcctggccgccatccatatctggctcaccttggcccccgtgaccgtggcgcccggattggttcacgtgcctacagccagggctgttgttcttgtctctggctgacgtataagggaaaaaaagaggggtcaaccaagggcgagctgggcccagccgcagtgacagacctcgaaatcccttcttattccagaggtttcctgccctgcaccccacggttccctactacgtggtgccggggacccgggtgcttttgcgggaccgctgttatcgcagggaacttgggggatctggcccgcatcgtgggcccgagccatcatgcttcgcagctgctgttgttacaggaacaggactccggaaaccacccgactatggctgaatccctcagcgaaatctctgacagcctggatgtgcttgaagcgggagatgagggaaaaaagaaatgcaagttcaaagcactgaaatccttttttgttaagaagaaggagaaggaagccgaggacacccaagaggaagaaatgcttgagctcagcctgtcctccagtaacattaatattagctcccttcagccagtacgtgaaaaccaaccaacaaaagctcgggcgaagtccagcatgggatctaaagcactgagccatgattctatctttatgctcggccccgaacctgagcggagcgcaagcaaaatgtttccttccatggaccctcagcgcgggaggcctcagcagcgatcacatattagcaggacgctgcctaaacctcgctctaaggtacctggcgtcgtctccggtgccatgtccggggctgtgctgcaaaatgtgcccacttcagccgtgtgggttgcaggcccaaaaatcacggaaaatcccccctctcggcggcgacggctgtcaattatacctcccgtgattcagcctgaaattatctcgaaaaatttggtggaaataagcctcgacgacgagtcccctaaaaatccacagaaaaaggctctgccacacaaaagtctgaccgctacccaatcatttagtgaattaagcagcggccccgactgctcccagtccctgaccgcttttgcgaccctcgcctctaccagttctactcagctgccaataggcttttccacccctgctactactcaaggttgtctcgactcctcggccgcgcgccataagatgacattgaaccctcgaaaacagaagaagaatctgcaggtgataataagaggattgccagtttggttcagccacttccagggaatccttgagggcagtctgcagtgcgtgacccaaactctggagacaccgaatctagacgaaccgctgcctgtcgaacccaaggaggaagagcctaacctgcctctagtgagtgaagaagagaaatctatcacaaagcccaaggaaataaacgaaaaaaagttgggcatggattccgccgacagcagctcccagaaacagaacaacaagaccgagatgtacgacaaaaagactactgatcaggccccaaataccgatgctagccgtagtcagggctacccaatgtcagccgcatacggcaggcggtggcgccgtaaaggggcatccgtgagtggacttagtggctgtgaattcaagggaagaagtctgaagcagtcctctgaaggttatggccttggggatagagccgggtcctccccaaccaataaaacagctcgtaatgtgccttttagccatctgtcgctggagaaggataacatggagcagcccacaactagtcagccagaaactacaactcctcagggccttctcagcgacaaagatgatatgggtaggagaaatgcaggcatagacttcggctcaaggaaagcatccgccgcccagcccattccagagaatatggataatagcatggtgagtgatccccaaccatatcatgaagacgccgcctccggggcggagaagactgaggcacgcgcatctctgtccctgatggtggagagtttgagcacaacgcaagaggaggccatactttctgtggcagccgaagcccaggtttttatgaacccatcccatattcagctcgaagaccaagaagcattctcatttgacttacaaaaagcacagtcaaaaatggaatcggcccaggatgtgcagactatctgtaaggaaaaaccaagcgggaatgttcaccaaacatttaccgccagcgtgttaggcatgacgtccaccaccgccaaaggagacgtgtacgctaagaccctgcccccaaggagtcttttccagtcttctaggaagccagacgcagaggaggtatcaagtgatagcgaaaatatacccgaggagggtgacgggtctgaggagctggcacatgggcatagctcccaatcactgggaaagtttgaagacgaacaggaggtgttttccgaatcaaagagcttcgtggaggacctgtcctcctctgaagaagagttggacttgaggtgcttgtcccaagcactggaggaacctgaagatgctgaagtctttaccgagagttcatcatacgtggaaaagtacaatacatccgacgattgcagcagttcggaagaggacttgcctcttaggcaccccgcccaggccctcgggaagcctaagaaccagcaggaggtgtccagcgcctccaacaacacccctgaggagcagaacgattttatgcagcagttgccatctagatgcccgagtcagccaatcatgaatccaacagtgcagcagcaggtccctacttctagcgtgggcaccagcatcaagcagtctgacagcgtagagcccatccccccacgccatccattccagccatgggtgaaccccaaggtcgagcaggaagtgagctcctcccctaagtccatggctgtcgaagagagtatctcaatgaagcccctaccccccaagcttctgtgccagcccctcatgaatcccaaggttcagcagaacatgttttccggaagcgaagatatcgctgttgagcgcgtcatctccgttgagcctctcctgcccaggtactccccccaatctctgactgaccctcagatccgccagatctcagagtcgactgccgtcgaagaagggacatacgtggaaccattgccccctcgttgtttgagccagccctcagaacggccaaaatttcttgacagtatgtccacaagcgcggagtggtctagccctgtggcgccaactcccagcaaatacacttcccccccttgggttacccccaagttcgaagagctatatcagttgagtgctcatcctgaaagcaccaccgtggaagaggatatctcaaaggagcagttgctgccaagacacctgtcccaattgacggtcgggaataaggttcaacagctgtctagcaactttgaaagggccgccatcgaggcagatatttccggcagtcctttacctccccagtacgccacacagtttctcaagaggtccaaggttcaggagatgacttcacgcctcgaaaagatggccgtggaaggaacatctaataaatctccaattcccagaagacccactcagagctttgtgaagtttatggcccaacagattttcagtgagagctccgcactgaaacgcgggtctgacgttgccccactccctcctaaccttccaagcaagagcctctctaaacccgaggttaaacatcaggtgttctccgattccggttccgccaatcccaagggcgggatcagctctaagatgctgccaatgaagcatcctctgcagagcctgggtcggccagaggacccacaaaaagtgttcagttattcagagagggctcctggcaagtgctcatcctttaaggagcagctgtctccccgacaactctcacaggccttgagaaagccagaatacgagcaaaaggtcagccccgtctcggctagctcaccaaaagagtggagaaacagtaaaaaacagcttccaccaaagcactccagccaggccagcgatagaagtaaatttcaaccccagatgtcatcaaaaggacctgtgaacgttccagtgaaacagtcttcaggcgaaaaacaccttccgtcctctagcccctttcagcaacaggtacactcctcttcggtaaacgccgccgccaggaggtctgtgttcgaatctaacagcgataattggttcttaggaagggacgaagctttcgccattaaaacaaagaaattttctcagggcagtaagaaccccataaaatcaataccggctccggcgacgaaaccaggcaagttcactatagcccctgtaagacagacttcaacctccggtggtatctacagtaagaaggaggacctcgagagtggcgatgggaacaataaccagcatgctaacctgtctaatcaggatgatgtggaaaagctgttcggagtaagattgaagcgagcacctcccagtcagaagtacaagtcggagaagcaagacaactttacccagttagcctctgtacccagtggaccaattagctctagcgtgggcagggggcacaagatccgcagcacatcccaaggccttctggatgcggccggcaatctgaccaaaatctcatatgtagcggacaagcagcagtctaggcctaaatctgagagcatggctaagaaacagcctgcatgcaagactcctggaaagcctgccgggcagcaatctgattacgcggtaagtgaaccagtttggatcaccatggccaagcagaagcagaagagcttcaaggctcacatcagcgttaaggagctaaagactaagtcgaatgctggcgctgatgccgagactaaggagcccaaatatgagggggcgggttctgcgaacgagaatcagccgaagaaaatgtttacttcatctgtgcacaagcaggaaaagaccgcccaaatgaaacctcctaagcctacgaagagtgtggggtttgaagcccagaaaattctgcaagtgcccgctatggagaaggagactaagaggagttccacactgcctgcaaagttccagaaccccgtggagccaatcgagcccgtttggtttagtctggcgaggaaaaaagccaaggcatggtcacacatggcggagataacacagtag

SEQ ID NO: 32508 - DNA, 5421 bp, Artificial Sequence
  Description of Artificial Sequence: Synthetic coding sequence
atggccacacgtgtggaggtgggctccatcaccccactgaccgccgtgcctgggcttggagaaatgggtaaagaggagaccctaacgagaacctatttcctccaagccggagaggcaagtggggcaccacccgcgagaatcctggaggccaaaagccccctcagatcccccgcccgcctcctgccgctccctcgcctagccccgaagccattctctaaggagcaggatgtcaaatctcctgtgcctagtctacgcccatcaagcacaggcccaagcccttccggtggactgtccgaagagcctgcggccaaagatctcgataaccggatgcctgggctcgtgggccaggaggtcggcagcggtgagggcccgaggactagctctcctctattcaataaagccgtatttctgcgcccctctagttccactatgatattgttcgaaaccacgaagagcgggccagcacttggaaaggccgtcagtgaaggagcggaggaggccaaactcggagtgtcaggatcaagacctgaggtggccgccaagcccgcattgcccacgcagaagcctgccggaaccctaccccgttctgcaccacttagccaagacacaaagccacctgtcccgcaagaggaggccggccaagaccaccctccatccaaggctagcagtgttgaggataccgcccgacccctcgtggaacccaggccgagactaaaacgaaggcctgtaagcgcgatcttcacggagagtatccagccacaaaaacccggacctggagcagctgccaccgtgggtaaggtgccccctacgcctccagaaaagacttgggtgaggaagccacggcccctgtccatggacctgaccgccaggtttgagaacaaggaagcattactccgtaaagtagctgatgagggttctggacccaccgctggggatatggctggcctggagagaccgcgggctgcctctaagctggatcgcgattgtctcgtaaaggccgaagcgcccttacatgacccagatttggactttttggaggtggctaaaaagattagagagcgtaaagagaaaatgttgagcaagccagaaatgggcagccctagagccctggtcgggggcagctctggcgttacgcccagtaacgaccaaagcccctgggaagaaaaggcaaaactcgatcctgaacccgagaaagccgccgaatccccctcacccagactgggccgcgggttggagctggcagaagtgaaatctcgcgttgcagatggggaagcggccgcgggcggggagtgggcatcccgccgttctgttaggaaatgcatatctctgtttcgcgaagacagcacactcgccctggccgtggggtccgaatcaccccttgccacaccagcttctccctccgctgcccctgaaccggagaagggagtggtgtctgtccaggaaagaatccgtggttggaccgctgagtctagtgaggcaaagcctgaggtccgcagacggacattccaggcgcgtcctcttagcgccgacttgaccaaactctttagtagctctgcaagcagcaatgaggtgaagtatgaaaaatcagccgagctgagcggagagtttcctaaggaaccgagggagaagcaaaaagagggccactccttggacggagcctgcattccaagatcgccttggaagcctggaaccctcagagataaatcccgccagactgaacagaaagtgagcagtaaccaggaccccgactcatgtcgagggggatcctctgtggaggctccttgcccaagtgacgtaacacccgaggatgacagatcatttcagactgtctgggctaccgtatttgagcatcatgtggagcggcatacggtggctgaccagagcggacgctgccttagcaccacgccccctggggatatggcacatgcacgggtcagcgaacctaggcctcggccagaaatgggatcatggcttggtagagatccgccggacatgacaaaattgaaaaaggagaattctaggggtttcgataaccctgagacagaaaaactgggccccactacgttgttgaacggagagttgcggccctaccatacaccattgcgggataaataccccctctcagagaatcataataacaatacgttcttaaagcacctggagaatccgccaacatcacaacgaatagaaccaagatacgatattgtacatgccgttggagagcgggtgcactccgaggcaattagccccgctcctgaagagaaggctgtaaccttgcggtcccttagaagttggctgtcactgaaagatcgccaactcagccaggaagtcacaccagctgatttggagtgcggcctcgaagggcaggctggctcggtacagcgtgcctctctgatctgggaagccagaggtatgcctgaagcctcgggtcccaaattcggcgggaattgcccctttcctaagtggaccggaggcgcagttgtgagctcccataaggccaccgtggccgtgagtgaggagcattgtgcacccggagcaacctccgttcgggcgattaaagctgccatttgggaatcccagcatgaaggaccggaaggcgctcggagtaagccaggagtcggcgccagggggccgccccaaggctgtccactggatcctctctcaagggcgaccaatggaccctctgacagccaggcgcggactcaccctgacgccttcgctgttcagaagggcccattcattgtcgccgcacgtgaaggtgaccccggtcccgcgcaggttccccaacccgccgtgcgtatgagaaaagccggagctatggaccagagaatggatagatggagacgtagaacactgccccccaacgtgaagtttgacaccttctcaagtcttgtgcccgaggactcacctcatgttggtcacaggcgaacagactatgtgtctcccacggcctccgcactgagaaaaccacagctgtcacactacagagtcgaaactcaagaagtgaaccccggagcttccagggaccagacatcgccagcagtgaaacagggctccccagtcgaacctaaggccactttcttcgcagtgacgtatcagataccaaacacccagaaggcaaaaggagttgtactgagcggtgcagaatcactgttggaacatagtcggaagatcacaccaccctcgagtccacattctcttacttcaactctggtttcacttggacacgaagaagcacttgaaatggccggatcgaaaaactggatgaagggacgtgaacacgaaaacgcttccatcctgaagaccctcaagcctactgacaggcccagcagtcttggagcctggagcctggatcctttcaatggaagaatcatcgatgtcgatgctttgtggtcccaccgcggcagtgaagatgggccacgcccccaaagcaattggaaagagtcggccaacaagatgtccccatcgggtggggccccacagactacccccaccctgcgctcgcggcccaaggatctgcccgtgaggcggaagaccgacgtgattagcgacacgttcccggggaaaattcgcgacggctataggagcagcgtgctggacatcgacgctttgatggctgaatatcaagaacttagcctgaaggtgccaggcgaagctcaggagagaagatccccaactgttgagcctagcaccctacctagggagcgaccagtgcagttgggtggtgtggagcaacggcgaaggagtctaaaagagatgccagatactggcggtctgtggaagccagcaagcagcgccgaaataaatcattcctttacacctggcctggggaagcaactggcagagacattggaaaccgccatgggcacaaagagcagtcctcctttctgggcccttccccctagtgccccgtcagaacgctaccccggaggatctccgatccctgccgatcctcgtaagaagacaggcttcgccgaagatgacagaaaagccttcgccagtaaacaccatgtggccaaatgccagaactacttggcagaaagtaaaccgagcggtcgggaggaccccgggagtggcgtcagagtatcccccaaatctcctcctacggatcaaaagaaaggtacgcccaggaaatcgaccggacggggagaggaggacagtgtggcccagtggggcgatcaccctcgggattgtggccgagtacccttggacattaagcgtgcttatagcgagaagggccctcccgccaatatccgtgagggcctgtccatcatgcacgaggccagagaacgccgacgggaacagccaaagggtagaccctctctcaccggcgagaatctggaagctaaaatgggaccttgttggtgggagtcaggaactggagattctcataaagtgctaccacgagacttagaaaaggaagacgctcctcaggagaaggaacgtcctcttcagcaggttagccctgtcgcaagcgttccatggagaagtcattccttttgcaaagatcggaggtcaggcccattcgtggatcaactaaagcagtgcttctctcgccagcccaccgaacccaaagataccgacaccttggtacacgaagcaggctcgcagtacggaacctggactgagcagtgtcagagcggtgagtctctcgcaaccgaaagccccgatagttctgccacatctactcgcaaacagcctccctcaagccggctgtctagcctgagctcgcagacagagcctacgtcagctggggatcagtacgactgttcacgcgatcagcgtagcacttctgtggatcatagttcaaccgatctggagtcaactgatggaatggaagggccaccaccgccagatgcttgccctgagaaacgtgtggatgacttctcctttattgatcaaactagtgttctggactccagcgcactcaaaacacgggtccaattatctaaacgatctcgacgcagagccccaatcagccattcactgaggcgctcacgtttttcggagtctgagagtagatcacctttagaggatgagacagataatacctggatgtttaaagattctacagaagaaaaatctccccgcaaagaggaaagtgatgaagaagaaaccgcaagcaaggccgaaagaacgcctgtttcgcacccacagcgaatgcccgccttccctggaatggaccctgccgtcttgaaggcccagctccacaaaaggcccgaggtggatagtccgggagaaactcctagctgggccccacagcctaaatcacctaaatcaccattccagcccggtgtcctggggtcccgcgtgctcccctcatctatggacaaagacgaacgctcagatgagcccagccctcagtggctcaaggagctaaagtcgaagaagaggcagtccctgtatgagaaccaggtctag

SEQ ID NO: 32509 - DNA, 4230 bp, Artificial Sequence
  Description of Artificial Sequence: Synthetic coding sequence
atggaatccgatcgcttaatcatttctctccccagggttaagtggacagaggccgcgctcaccatggcctcccagctccaggaaaaatgtattgcttttatcgtagacaattttagtaagatcattcagtccgaaaactttgccctactgctgcagtcacaggcaatgtcttccaccgcagatcttctcgataccatacttaaagccattgaggaaaatattactaccgagaattcttgcagcctgctgatggccctcgacacgcttctaaactcagattcaactaaggagatgggtttcacgtgtaaaattcaagcacttagggacaagctctggatcttcctggtgcagtctttttacgctgtgcgccacacagagtcctggaagctgatgtcaacagatgatcagcagaaaatccaggctgctgcgttcgataagggcgacgaccgaaggttgggcaagaaacccatttttagcagcagccaacagcggaagcaggtgtctgattcgggcgatataaagataaagagttggagggggaataacaaaaaagaatgctggagctaccttagcacaaacaaaaagatgaagtctgacggcctcggcgcttctggacatagtagttctacaaacagaaattccatcaataaaactctcaagcaggatgacgtgaaagagaaggacggcactaagatcgcctctaagatcaccaaggaacttaagaccggtggcaaaaacgttagcgggaaacctaaaacagtcaccaagagtaagacagagaatggcgataaagcccggctcgagaatatgtcccccaggcaggtagtagagaggagcgcaaccgccgcagcagctgcaacaggacagaaaaatctcctaaatggaaaaggagtacgtaaccaagaaggccaaatcagcggtgcgcggccaaaggtactgactgggaacttgaacgttcaggccaaagcgaagcctctcaaaaaggctaccggcaaagatagtccatgtctgtccatcgcggggccatctagcaggagcaccgacagtagcatggagttcagtatttctaccgaatgcttggacgaaccaaaagagaatgggtcaacagaggaggagaaacccagtggtcacaagttgagcttctgtgactcccctgggcagatgatgaaaaactctgttgacagcgtgaagaattcaactgtggccatcaaaagccggccggtgtcgagggttacaaatggaacctctaataagaagtctatacacgagcaagacacaaatgtcaacaattcagtactcaaaaaggtctcaggaaaagggtgcagcgagcctgtaccccaggccatactgaagaagcgcgggacctcgaatggctgcactgccgcgcagcagcgtactaaatcgactccaagtaacctgacaaagacacaaggaagtcagggtgagtccccaaacagtgtcaagtcttctgtgtccagcaggcagtctgacgagaatgtcgccaaactcgatcataatacaaccaccgaaaagcaggcccccaagaggaaaatggtgaagcaggttcacaccgccctgcccaaagttaacgctaagatcgtagccatgcccaaaaacctgaaccagtcaaagaagggagagaccctgaacaataaggatagcaagcagaaaatgcccccgggccaggtgattagcaagacacagccttcaagtcaaagaccgttgaaacatgaaacatccacagtgcagaaaagcatgtttcacgacgtgagagacaacaataacaaggattccgtgtccgaacagaaaccgcacaagcccctgattaacctggcctcagaaatttcggatgctgaggcactgcagtctagctgccgccctgacccacaaaagccactgaacgatcaagaaaaggaaaagttggctttagaatgccagaacatctcaaagctggataaaagtctcaaacatgaactcgagtctaagcagatctgtctggacaaaagcgaaacaaaattccctaaccacaaggaaacagacgactgcgacgccgcaaacatctgttgccactctgtaggttcagataacgtgaactcaaagttttattctaccaccgcactaaagtatatggtttccaaccccaacgagaattcccttaacagcaaccctgtctgcgacctggactcaaccagcgctggccaaatccacctcatttccgacagagaaaatcaagtcggtcgcaaggacactaacaagcagtcatccatcaagtgtgttgaggacgtcagcctgtgtaaccctgaacgtactaatggtaccttgaattctgcacaagaagacaaaaagtcaaaagtgccagttgaaggtttgacaataccaagtaaattatctgatgaaagtgccatggatgaagacaaacacgccacggcggactccgacgtgtcatcaaagtgcttttccggccagctctctgagaagaattctcccaaaaatatggaaactagtgagtcacctgaatctcacgaaacgcccgagacgccgtttgtcgggcactggaacttatctacaggcgtgcttcaccaacgggaaagccccgagtccgatacaggatctgccactaccagttccgacgacatcaagcctaggtccgaggactacgatgcgggaggttcacaggacgatgatggttcgaacgatagaggcataagtaagtgtggcactatgctgtgccacgatttcctgggccggagctcatccgacaccagcacccctgaagagctcaaaatctatgatagcaacctgcgtattgaggtgaaaatgaaaaaacagagtaacaacgacctcttccaggtaaacagcacctccgacgacgaaatcccacgcaaaagacctgagatctggtcacgttcagcgattgtacactcccgcgagagagagaatattcccagaggcagtgttcagtttgcgcaagagattgaccaagtgtccagttctgccgacgagacagaggacgaacgttcggaagcagaaaacgtggcagaaaatttcagcatttccaatccagcaccgcaacagttccagggtattatcaatcttgctttcgaggatgccacagaaaatgaatgcagagagttctccgccaccaaaaagtttaaaaggagcgtactgctttctgtggatgagtgcgaagagctggggtccgatgaaggcgaggttcataccccgtttcaggcgtctgtcgattccttcagtccgtctgacgtgttcgatggaatcagccatgagcatcacgggagaacgtgttactcccgttttagtcgagagtcagaggataacatactcgagtgtaagcagaataagggcaactctgtttgcaaaaacgaatcaaccgtcctcgacctgtcctccatagattcctcaaggaaaaataaacagagtgtgtctgctaccgagaagaagaataccatcgacgtgctgtctagccgctcccgacagcttctgagagaggataagaaggtcaataacggttctaacgtcgagaacgacatacagcaacggtccaagttcctggattctgacgtcaaaagtcaggagcggccttgccacctggatctgcatcagagagaaccgaattccgacattcctaaaaacagctcaaccaagagcctcgacagtttcaggtcccaggtcttgcctcaggagggccccgttaaagaatctcactcgacaactaccgaaaaggcaaatatcgcgctatctgctggggacattgacgactgtgacacgctggcacagacgaggatgtacgatcatcggccatccaaaactttgtcccccatatacgaaatggacgttatagaggcctttgaacagaaggtcgagagtgagactcacgtgactgacatggatttcgaggatgatcaacactttgccaaacaggactggacacttctgaagcagctgctctcagagcaagactctaatttagatgtcacaaactcggtgccagaggatctatccctggcgcaatacttgatcaaccagacactcttgctcgcgagagactcctccaaacctcagggaatcactcacattgataccctgaatagatggtcggagctgaccagtccattggattcatcagcctctatcaccatggctagtttctcctctgaggattgttctccccagggggagtggaccatcctggagctggagacacaacattag

SEQ ID NO: 32510 - DNA, 369 bp, Artificial Sequence
  Description of Artificial Sequence: Synthetic coding sequence
tctcacatcatgttgaataacgggaccaaaacagatatgctcggcttgggaacttggaagtccccccccggccaggtggctgaagcagtaaaggtcgcaataaatactgtgtataggcatattgattgttcacacgttcatcagaataaagatcaggagcagctcaaggagcaggtcgttagacgtgaatggctattcatcatatcaaagccttggggtatttgccatcgaaaatgtctcgtgagaggctcctgtcgcaaggtactgtctggactggagctcgattatctcgacctccacctaattcactggccaaccggatgtcacccaggcaaagagttttcatttctggatgagagcgggaattag

SEQ ID NO: 32511 - DNA, 3339 bp, Artificial Sequence
  Description of Artificial Sequence: Synthetic coding sequence
taatattaccttaatgcccaggatggagcaggcggcgaggaggagaaggcagaaggcggagccggggaggagcacgacctgttcgcaggccttaagcctctggaacaagagtcacggatggaggtcctattcgcctgtgctgaggccttgcacgcccatggatactcaagcgaagcctccaggctcacagtcgagctggctcaggacctcttggctaaccctccagacctcaaggtcgaaccacctcccgccaaaggaaaaaagaacaaggtcagcacctctcgtcaaacctgggtggccacgaacacgttaagcaaagctgcgtttttgcttactgtgctgagcgaaagacctgaacatcataacctggccttccgcgtgggtatgttcgccttagaacttcagagacctcccgcttcaaccaaagcgctcgaagtgaaactggcctaccaggagagcgaggtcgccgcacttttaaagaaaatccctttaggcccttccgaaatgtctactatgcggtgccgtgccgaagagctgagagaagggactctttgcgattacagaccagtactacctctcatgctggcctcctttattttcgacgtcctctgcgcaccggtagtgagccccacaggaagccgcccacctagccggaactggaatagcgagaccccaggcgacgaagagctaggcttcgaggccgccgttgctgctctcggcatgaagacgacagtctcggaagctgagcatccactgctctgcgagggaacccgccgcgagaagggagatctggccctggccctgatgattacctataaggatgaccaggccaaattaaagaagatccttgataaactgttggaccgagaatcacagacccataaaccgcagaccctgagcagtttttactcatcgtctcgtcccacaaccgcatcccagcgcagcccctctaagcacggggggccttcagccccaggcgcactgcagccacttacatctggcagcgccggtccagcacagcctggtagcgtcgctggggccgggccaggccccacagaaggctttacagagaagaatgtcccagagagttctccacacagtccctgcgaaggactgccctccgaagctgccctgacacccaggcctgagggaaaagtaccgtcgcggcttgctctcggcagccgcggcggctataacggacgagggtggggctcccctggacggccaaaaaaaaaacacactggcatggcgagtatcgacagtagcgcccccgaaaccacctcagactcgtctcccaccctgagtagacggccacttcgcggcggctgggcgcctaccagctggggcagagggcaagatagcgactctatctcctcatctagtagtgatagtctgggttcttccagttcctcaggatcccgccgggctagcgccagcgggggggcgcgtgctaaaactgttgaggtggggcgttacaaggggcggcggccagagagtcacgcccctcatgtgcccaaccaaccaagtgaggccgccgcccatttttactttgagctggccaagaccgtgctgatcaaggcgggggggaattctagcacatccatcttcacccacccctccagctcaggaggacaccagggaccccatcggaacctccacttatgcgctttcgagattggactgtacgctctcggcctccacaatttcgtgagccccaattggctgagtcgaacatactctagtcatgtgtcatggatcactgggcaggcaatggaaatcgggtcggcagctctcaccatactggtggaatgttgggatggccatttaacgcccccagaagtcgcttctcttgctgatagggcttcaagagccagggactcaaacatggtacgagcagcagcagagctggcactatcctgcttacctcacgcccacgcgctgaatcctaacgagattcagcgggccttggtgcaatgcaaggagcaggacaacctcatgctggagaaggcctgtatggcggttgaggaagctgcaaagggcggcggggtgtatcctgaggtgcttttcgaagtggctcatcagtggttttggctttacgagcagacagcaggagggagttcaacagcccgggagggagcaacttcctgctcagcgtccggaatacgagccggcggggaggctggacgcggcatgcctgaaggccgtggcgggcctggcacggaaccagtcaccgtggctgccgctgcagtgactgccgcggccaccgtcgttcccgtaattagtgtgggatcttctctgtaccctggacctggacttggccacgggcatagtcctggcctgcatccgtacactgccctccagccccacttaccttgctccccccagtacctaacacaccccgcccaccccgcccaccctatgccacatatgcccaggcctgcagtcttccccgtgcctagttctgcgtacccacagggggtacacccagccttcttaggggctcaatacccctacagcgtcaccccaccgagtctcgcagcaaccgccgtttcttttccagttccttccatggcacctattaccgtgcatccttaccatactgagcctggtcttcccctgcctacctcggtggcttgtgaactctggggccagggaaccgtgagcagtgtgcaccctgcaagcacattcccagcaatccagggcgcgtccttacctgcactgacaactcaaccaagccctctcgtctcgggggggttccctccgcccgaggaggaaactcactctcagccagtcaacccacatagtctacaccacctgcacgctgcttacagagtcggaatgttagcgttggaaatgctgggtaggcgggcccacaacgatcatcccaataacttcagccggagccccccatatacagatgatgtgaaatggctacttggcctcgcagctaaattgggggtgaactacgtccaccagttttgtgtgggggcagccaagggcgtgctctcccccttcgtgctgcaggaaatagtaatggagacacttcagaggttatctcctgcccacgcccacaatcatctgcgcgcacctgcgtttcatcagctggttcagcggtgccagcaggcctacatgcagtacatacatcatcggttgattcatctgacgcctgccgattatgacgatttcgtgaatgccattcgaagcgctcggtcagcattctgccttacccctatgggaatgatgcagttcaatgacattctccagaacctgaaaagatccaagcagaccaaagaactgtggcagcgcgtatctctggaaatggccacgttctcaccttag

SEQ ID NO: 32512 - DNA, 660 bp, Artificial Sequence
  Description of Artificial Sequence: Synthetic coding sequence
ctggagaaggaagagaaaaatccgaataccgaattctaccttaaaaacctggtcctgaccacactgaatctgtttgtcggcgggactgaaacggtaagcactaccctgcattatggcttccttctgctgatgaaacacccagaggtggaggcaaaagtgcacgaaatcgatagagtcatcggcaagaaccaacagcctaagttcgaggatcgcgccaagacattgtatacggaagctgtcattcacgagattcagcggttcggtgacctcctgccgatgggggtgtccagaagggtcaaaaaagataccaaattccgtgactttttccttagcaaaggcattgaggtgtttccaatgcttggcagtgtgttgcgggacctcaggttcttctccaatcccagggacttcaaccctcaacactttctcggagagaaagggcaatttaagaagagggatgcgttcgtgccattctccataagacgcagaaattgcttccgggagggtttagccaggatggagctgttcttgtaccttactacaatcatgcagaactttaggtttaaaagccgacagagtcccaaggatattgtcgtctcccctaagcacgtgggttttgtcacaatccccaggaattataccaagtgctacctcccatgctag

SEQ ID NO: 32513 - DNA, 132 bp, Artificial Sequence
  Description of Artificial Sequence: Synthetic coding sequence
acagatttcctgagaacacaacccacacgaacgcgcgtgaataagcaaccactccttctcactctatccttgttcaaactgtcgttgcagctggacgcacgcattaccttcggcgcagagtctcccggctag

SEQ ID NO: 32514 - DNA, 375 bp, Artificial Sequence
  Description of Artificial Sequence: Synthetic coding sequence
atgactctgaatgagcatgcagcattcaagcatctgtttaataaagcgcacctggccccgccacttattcatctgaccttgtcaggacactcaacttgcttcagggagcatagggttggcggcaaggtcacagaccagcaggatccgaaagccgaggagttctttctcgtccaaaataagatgaaatctctgccctgcctgccactgagcacccagactcagcagcccagcgattttagcatcttcagccctccctttcctcccttctactctaccaaacctccactgagttcatggccagtgcttaacgagttgctgggaacaccgccccgctggggagggggacgggctgaagggctgctgaccagtcagtag

SEQ ID NO: 32515 - DNA, 621 bp, Artificial Sequence
  Description of Artificial Sequence: Synthetic coding sequence
ctggggatcagtctaggaatcgatcaggattcagccgcctttctcttaagcactatggccatcgccgaggtgttccgccgaattggcgccggctttgtcctgaaccgtgagcccatccgtgttatctatatagaactcatttgtgtgattctcctgaccgtgtccctgttcgcattcacattcgctcgcgaattctgggggttgatgagctgctcggtatttttcggatttatggtcggcactaccggcggcactcatatacccttgctcgctgaggatgacgtggtaggaattgaaaagatgtcctctgctgctggagtatacatattcatccagtcaatagcgggattggcgggccctcctttagccggcctcctcgtggaccagagtaagatatattcccgcgcgttctatagctgtgctgcaggaatggccctcgcagccgtgtgcttggcactggtacggccgtgcaagatgggcctgtgccaacaccaccactcaggcgaaaccaaagttgtgtcacaccgggggaagacacttcaagatattcccgaggattttctcgagatggatctggctaaaaacgaacaccgagtgcacgtacagatggaaccagtatag

SEQ ID NO: 32516 - DNA, 582 bp, Artificial Sequence
  Description of Artificial Sequence: Synthetic coding sequence
atgaacatcttcatgacctttgtgattaacgtgctgcgaaaaaacctctttcatgggttcatggttatcacccaggctcccgtccggattctgcccagccaggagcgaattaggaccccctgccactcccctgctatcctgttgagcagctgtcgtgttttatcagggaataactgtatcatggccgccctgacaagcgtgattaaacgcaatctattattttttcggctggatctgttcccactgtggctgatctttctctatattgtgaagatgggagactttccaagcgcaccgacccacctgaatacagcagcgatttgcacttgcctgttgcccattcctctgggtactcactctgaccttctgtcagtcagttgttcctggttccatcttttcgagaaaggcccacccctatcatataaacacctcgtgcggcaggtgcatccactgatgaacgcagacacagcagccggtggtttcgtttacacctgtaaagataaacttagatcactgttattcggagaagtcaaagaagacggtaacgggtgcttcatatgcatgagtctggagcagtgctag

SEQ ID NO: 32517 - DNA, 99 bp, Artificial Sequence
  Description of Artificial Sequence: Synthetic coding sequence
gatacggaaaatagccctggcgagctcagtttaagccgcaagaccgaggcccagagaggagaggctattcatccacaatctcattcacgcgacgggtag

SEQ ID NO: 32518 - DNA, 915 bp, Artificial Sequence
  Description of Artificial Sequence: Synthetic coding sequence
atggttgccaccggctgggcgcgaaggtccggacttcacccagctcccaggccattgagaggagctcaggaggcattggcaaagaatctttggagggaggagaggaatcgcccccttatactgagttccctcatcatcaaaaaattgcactggcccgagcaagagctggcaaagaagagcatcctaaatgcggaagattctcttataatcgataataaaagatcaattagccacctcagtagcggggttctcaaagatatctttaccaccgggactagctcgtacaatgtcctattgcagagtaaggaggagaagaaataccactcccagaaacagtcttcgtcaacatattccaaaagatgccggaaaccatctaagtcgccaaatacctcacgtagcaaggatcccaggcgcatgaaggccttggtaccagtcaccagcagtggcacctggtactgcttggaaaggagacctgcagtgtttgttacaagctctgtgagctctcctgtcaaatttacgcacgatatctccgttacagggaatggtatcgtgttgcctccaaagcccaagtccaaagtcaaatggtgtcatttttcaaccctccctaagcctaaacctcagctgagccgctctttcgaaaaaggcgatgatttctccgggaagaaattttgtatcctgactgcaattaagcccacaaatctggagaaggaaaaactgagattcttcaaatctgattatacctataacccccagttcgagtatgcaaacccggccctgcctagcgtgctcgcgaagcatagccacgcttctgatagattcctaaagcaggtgaaatgtcattttaacagcggctcatccttcctatgcactaagacgatcatttgtgacctgatttctaagaataaagatatttag

SEQ ID NO: 32519 - DNA, 402 bp, Artificial Sequence
  Description of Artificial Sequence: Synthetic coding sequence
atgggccaggatgccggcaggctgcaaagaaggtcacgtgtgggcttcggcgagaacggtgcttgcaggaaagagaggcagaaactggctctggaaggatccaagaaaggcccatggaaggggcggagcggggataggaagggaaatagtaagggacaggaggagttaggcaggggggccagggtgaatacggagtggcccatgccgaggatgagagactggaaagaaaggcgggggccctcaagggaggaggctcacaagagtctgggacggcagggcatgggtttgcaacgcggcgagggcgttcgcgcggtggccgctcgagtgctgtgtcatccatgcccactgagccgcgggctacagcacaaccgcggcgataggttcgtctggggacaagtttag

SEQ ID NO: 32520 - DNA, 255 bp, Artificial Sequence
  Description of Artificial Sequence: Synthetic coding sequence
atggttttagccagcttcacacagaacatgaacatcaagtgttgcgagtttgtatgccaggtggttcagaagtatattatcaacaatctggtgaagaagagaaattgcgaaccctcatggtcagtctattccatcctatgcctgtacgtcatctttagttctaataggtttataataatagggttcactaagcggtcacggaagaagtccgagggcgaaatcgcatctaccgccctccaagctaccagcggttag

SEQ ID NO: 32521 - DNA, 156 bp, Artificial Sequence
  Description of Artificial Sequence: Synthetic coding sequence
ctgaagcctggcttttttctgagcttcttcatctccatgacctaccttttttcctttttttttttcggaaagtcctttcgctccctactgggcgaaggcttttcgttgtgtctttccctctctctgacccacacgcacactcatactcactcatag

SEQ ID NO: 32522 - DNA, 438 bp, Artificial Sequence
  Description of Artificial Sequence: Synthetic coding sequence
ggtgagtcggaagatgtaacgcagtttctccagtcgcacaaaaaaaccctcacaaacgaaaaacttttcttgatggacggcaagcggacatggttcctggagatggagagtacccctggagaggacgcaatgaacaccgtgaagatgacgactaaggatctgaagtatgatcggtcgctgatcgataaggcaggctttgagcgcaccgattccaattttgagagatctcataccgttggcaaaatgctgagtaactctatcatgtgctacagggatatcttctacgaaagagagagccagcttatgcagcagacctcccttctctcttatgagattgcgatcgcaacacctactttcagtaactattacccagactggagtgctccaatcaatatagttgcccggcccagtacatcaaagaaaattatgacttgttag

SEQ ID NO: 32523 - DNA, 3144 bp, Artificial Sequence
  Description of Artificial Sequence: Synthetic coding sequence
atggcccactgcggacagctcactaattggctgtgtctggcctgggagcgcaaggaaagtcctgattttctgagtatttttctgaggtatatcgatctgacaccaaaattgcacaagatctgttccgataaaacgattacacagaagacccactgcctgctgcctttgatcagttccgctctttcatctatagtgctgatccagggttggtggcagaaaaccgctcataagtacgcttacaaaggggctaagcatattgagcagcagaacccacagagccggcacaggcccagacctgccggcgctctgccccagatctcccgagacagtagacagcggtgtctcctgctgcgcttcctggttcggcctagagggttctctttctccttcgcagaacctgccgcagcctttcctggggcaaccgcgatggctgcatctctgtcggagagactgttctcacttgaactcctggtggattgggtgcggttagaagccagactcttaccatcaccagctgccgccgtcgagcaggaggaggaggaagaagaaaaagaacaaggcgaggccagctcccctcgaggtctgtgccctgccgtggcgtttaggctactcgatttcccaacactgctggtgtaccctccggacgggccaggcgcaccagcagcggagccttggccaggcgtcatccgatttggaaggggtaaatcctgtctgttccggctgcagccagctacgctgcactgcaggttattgagaaccccactcgctaccttgttactgcaactgcctccgggccgtccgaccccgacaccgcagcttttgggggcttgtgacattagcctcgctactgccgcacaccgcgtggtaggccccgcagcctcaggttgtagccaccgccatcgcggccgctttcccctgcataatagagttggcgaaagaaccggcgacatagccctggcataccgactaacagatctcggctcccgcttgttatcccagctcgagaggcccctgaccttcaccagaactggtggcggtgccgaagtgagcccccagacccagcaagaacggcagcagctgcagcaaccggcctcccagcccagtcctaaggaagcggacaagcctctgggcgagttagagattcctgaggctcaaaaagatttgaaagaaatggtcaaatctaaggcagagtgcgataacgtagggagcgtggagaatggtaagacgaatagtgtcgtaacatgtagtggagccggtaacggcagaaacgtgagctctctcaacgaggaagtgaccgagctcgacatggagactaacatcttctgtccccctcctctctactacaccaaccttactcaggagaaaccaccccctgctcaagccaagatcaccattgaaccacaaatgaatgctccagaggaaatggacgacgcctcacctgaaaagaagagggtcaatcctcccgctcaccgatcttgtttgaagcacccctcctctgcagctcacgagcacccccctatgcttgtgaacccaccccacattcaaaatattggagctactaaccagacatgccaaaccgagcaaaataggattaacaccattcgccagctcccactgctgaatgcactcctcgtggaactgagtctgctatacgatcagccagtgacttccccggcccacatccatccacatctcgcctggctgtatcggaccgaagataaaaaatctcctgagtccagcgctaagtccacgtgtcggtccgaggcgaaaaaggacaaaagaagtgtgggaggatgcgaaaagtctgtgagtctgcagtacaaaaaaaatcagattgagaactacaaggaggacaaatacagcgagaagtcttcaggcgcattgcacaagcgcgttccaaagggccgtttgctgtatggattgacaaacacactgcggcttcgcttgaagctgactaatcccgatatgttagttgtgcacgaaaagagggaactttacaggaagaggcagtctcagatgctcgggacaaaatttcggataccgagtagtaaggtgaaactcctgtctagtgccgagcaatcccagaaacctcaactcccagaagacaaataccttgattcagacgccagcttcactgagaactcagatacatcacgccagatcagcggcgtgttcgacgagccatcaacttcaaaggagacaaagttgaagtacgccacagagaagaagacagtggattgcagtaaaaataggattaacaacgtgtcactagaggaggttgtgtcccctgccaactccattatcccagagcggctcacccccactaacattcttggcggcaacgtagaaatgaaaatccagtctccctgcgtgtttcagcaggatgctgtggtggatcgcattgttgacaaggagattgacattcgacaggtgaagacaacagacaacgacatcctgatggccgatatctcagacaaacggacggggaaaaatagttgttacgaaaatatctccgagctgaaatatagcgatgacctctccagcccttgctattctgaggatttttgcacatctgaggatacatcacggagtttcaaggcacatgacagctcctcccggactgagaaccctaaacactcacaatataccagcaaatcctcagacacaggagtgtcaaaaaaaaagaactcttccgacaggtcaagtatcttatcccctcccttcagcgctgggtccccggtccactcttaccgcaagtttcacatcagcaagacccaggacaaaagtctagaagaagccagtagcataagcgccagtgaccttagctccacacattggaccgagcagaaggaaaatcaaatcgatcagaacagcatgcacaacagtgaaattacaaagagagctcaagacatttctgtaaagaccaggtcatcctggaaatccctggaaaaaagccagtcgcctcaaaccagccaggtgtccagctacttgccctccaacgtctccgagctcaatgtcttagactcttcgacttccgatcattttgaggaaggtaacgatgatgtgggatctctgaacatcagcaagcaatgcaaagatatctgtgaattagtcattaacaaactaccagggtacacaatgtag

SEQ ID NO: 32524 - DNA, 561 bp, Artificial Sequence
  Description of Artificial Sequence: Synthetic coding sequence
aggtctctgctaaaagagctggaaaatacgaaggaccacaccctcctgctggagaagaggctgaaaaaattgtccagggaaggtagttcacaccacctgccacgacaagtacgtccagggcccgtgtacaagcccgcacctgcaaggaaccatcggccacgggggggccgaggaaaagctagccccacctctttccatgtctccccaagagcaccactggctcctctagcttctatgcctagttccgtccccaagacctccatcgaatcacttggaagcccttcctctctttccagcagtcaagcctccgagcctctgtgtccattgaaacatcccagccacagaccaccagcttctaccctctccccaaatttgacctcttccactgagtcccttggtctgctgagtagggagaccccccatgctggtcgacgcagacaagggtctagattcccccaacccggctgcgctaacgccgcggggaggacgcgtcatcagaaccccagacattcacatggccatcgcatatcggatatccacgagcagctgggcatctcatag

SEQ ID NO: 32525 - DNA, 405 bp, Artificial Sequence
  Description of Artificial Sequence: Synthetic coding sequence
atgcgcgagccaatttatattcattccaccatggtgtttctcccatgggaactgcatacaaagaaaggcaagatggctttgctcgcaagtaatggctgcttcatcagatgtaatgaagccggagacatagaggcaaaatctaagacagccggtgaggaagagatgataaagatccgatcctgcgcagaacgagaaacaaaaaaaaaggatgacatacctgaagaggataaagggaacgtaaagcagtgcgagattaactatgtgaaaaaatttcagagcttccaggagcacaagctgaagatcagtaaagaggacagcaaaatcctcaagaaggcacaaaaagacggattcctgcaggaaacactattggatcgtgttgctgttatagcatgcctccacctttag

SEQ ID NO: 32526 - DNA, 447 bp, Artificial Sequence
  Description of Artificial Sequence: Synthetic coding sequence
atggagcacatgttgctagccaaccatactgataaggctactttcactggcacacagagacagcggtcgtgtagtggagcctccgtttcgcagccaaggcccctgagggggaagttagttgggtattgggacccccactcccggcttttgagccgggggagggctctcgggagtgtttcagccccatccacgcctcgggggcggggatggaaggccacctttgacggctgtatactgcatgatgaccttctgaccaaagtccatgggttccagagcctcatcgggctccagcaacacctcgcctgcggagatagtgggtctttaatgaaaaactgccatgatgttagaaagtccttgtctgagcggggttggggggcagcatgttggggaggaggcggcgtggccagtagagagaagctgcatcccctcgccgaatcaggtacttag

SEQ ID NO: 32527 - DNA, 1296 bp, Artificial Sequence
  Description of Artificial Sequence: Synthetic coding sequence
atgtggccgcagccacatctgcccacacacccacaccttccgacgcacccacacctgcccacccacccccacctgcctacacaccctatgatgagtaaggaaacccgacagagcaagttggccgaagccaaggagcaactgacggatcatcacccccagacaaaccccagcgtggggacagccgcctctgatacaaagaagaaaaagatcaataacggtacgaatcctgaaacgaccacaagcggtggttgccattctcctgaagacgaacagaaggcttcccaccaacaccaggaagccttgcggcgagaactggaagcccaagtgcacacaatcaggattttgacttgccaaaaaaccgaacttcagatggccctttactactcgcagcatgccgtcaagcagctcgaaggcgaggcaagagacctcataagcaggctgcacgattcttggaaattcgcgggagagttggagcaagctctgagcgccgtggccacccagaaaaaaaaggctgatcgatacattgaagagctgaccaaggaaagagatgccctttcgctggagctataccggaataccatcacagatgaagagctgaaggagaagaatgctaaactgcaggaaaaacttcagctggtcgaatccgaaaaatccgagattcagctgaatgtgaaagagctgaaaagaaaattggagagagcgaagctgcttttaccgcagcagcaattgcaggcagaggccgaccatcttggcaaggagctgcaaagtgtcagcgcaaagttgcaagctcaagtggaagagaacgaactctggaaccgactgaaccagcagcaggaagagaaaatgtggaggcaggaagagaagatccaggaaagggaggagaaaatccaggaacaggaggaaaaaatcagggaacaggaggaaaagattagggagcaagaagaaatgatgcaagaacaggaggaaaagatgggtgagcaagaagaaaaaatgcaagagcaagagaagatgaggaggcaggaagaaaagattcgggagcaggaagaaaagatcagggagcagaaagagaagattagggagcaggaagagaagatctgggagcaggaagaaaagatcagggagcaggaggagatgatgcaagagcaggaagagaagatgtgggaacaggaggagaaaatgtgtgagcaagaagagaagatgcaagaacaggaagagaaaatgaggagacaggaagagaaaatgagggaacaggaagttaggctacgccagcaggaagagaagatgcaggagcactag

SEQ ID NO: 32528 - DNA, 1701 bp, Artificial Sequence
  Description of Artificial Sequence: Synthetic coding sequence
atgaaaatgcaaaaagggaatgtgctcctcatgtttggtctgcttctgcatctggaggctgcgacgaatagtaatgagacgtctacttcagctaatacaggatctagtgtgatctcaagtggggcgtccactgccacaaacagcgggagctcagtgacttcatctggagtttcaaccgctacaatctctgggtcttccgttaccagcaacggagtttccatcgtgacaaacagcgaattccacacgacttccagcggcatctctaccgcaacaaactctgagttcagcactgtgtcttccggtatttcaattgcaactaactccgaaagcagcactacctcgtctggcgcctccaccgcaacgaattccgaaagctccactccgagcagcggcgcaagcacggccactaactctgactcaagcactaccagttcaggcgcaagcaccgccaccaatagcgatagctctacaacctcatcagaagcttcaactgccaccaatagcgagtcttctacaacttcttccggtgcttcaacagtaactaactctgaatcttccaccgtgagtagcagggcttctacagccacaaattccgagagttcgactacctcgtctggggcatccacagctactaattctgagtcacgtaccaccagtaacggcgccggtaccgcaacaaacagtgagagttctaccacctctagcggagccagcacggcgaccaatagcgagtcctcgacacccagtagcggcgccggtaccgctaccaattctgaaagctccactacctcttccggcgcgggcactgctaccaactccgagtcctcgactgtctcatcgggtatttctacagttaccaacagcgaatcgtccaccccatcaagtggcgcgaatacggccactaactctgaaagtagcacaaccagctccggcgccaacaccgcaaccaattctgattccagtactaccagtagcggagcaagcaccgccaccaactctgaatcttcaacaacttcctctggggcttctactgcaaccaacagtgagtcatcgacaacaagctccggtgcctccacggccactaattccgggtcaagcaccacttcttccggcacaagcaccgcaacaaatagtgagagttccaccgtgtcatcaggggcttccacagccacgacttccgagagttctaccaccagctctggggcttcgacagctaccaacagcgagagttcaaccgtctctagcggggcaagtaccgccactaacagcgaaagcagcaccacaagctccggggccaacacagcaaccaacagcggcagctcagtgacctctgcaggatctggaacagcggcactcacaggcatgcacaccacgtcacactcggccagcaccgcagtgtccgaggcaaagcctggcggtagtctggtaccctgggagattttccttatcacgctagtttcggtggtcgcagcagtgggcctgttcgccgggttgtttttctgcgtcaggaacagcctttccttaaggaacacattcaatacagccgtctatcatccccacggcctgaaccacggccttgggcctgggcccggcggcaaccatggggctccccacaggcctagatggtcaccgaactggttctggcgaagacccgtttcttccatcgcgatggagatgagcggacgaaacagcggtccctag

SEQ ID NO: 32529 - DNA, 183 bp, Artificial Sequence
  Description of Artificial Sequence: Synthetic coding sequence
aaaggctgggtgagccatctgttcctcgcgcccacaaacttcgaagagttcacagctccagccacccccccacattgttcccaatgtctgcggtccaattgttcgacgtgggccaccgcagcaattatagaacgaagcttacaggtgccgtttttatacttgagtacgccaggtgggcactag

SEQ ID NO: 32530 - DNA, 399 bp, Artificial Sequence
  Description of Artificial Sequence: Synthetic coding sequence
atgtcccagccctggctatactctcagtgtatcatctcaggaaaaccctctgaggaagcagccggagaaaatggctcaatctccgccgctctcaggccattactgcttgtggccgacgtccccgtattggggtacctatgtccctcttccgtaagctccggcgtctgcgaagccaagctgctgggttgggggctgggcggtgttagcgcggcacccgaggcgaaaacgaaggccgaggctgaagctgaggctgaggctacattggtgagaaggaagctccaggttgagaaattggttgacagggatctggacctgaccgtgatactcatggttccgatgccttccgcgagaagacccccagctttagccaccaccggatcctgttccccccctggatag

SEQ ID NO: 32531 - DNA, 1395 bp, Artificial Sequence
  Description of Artificial Sequence: Synthetic coding sequence
atgcggcgtcacagtgagaccgatgttgaagaacagacccaagaactgaagacaatcacacagttacaagaacagtgtagagccctccagatacagggcgtgaaggagaacatggaccagaacaaagctaccctagctctgttacgatctaacatccgacgcggggctcaggattgggctctcgcgaagaagtatgatcagtggacaatctccaaggcgtgtgggaaaaatctgccgctcaggctggcacactgtcgtagcacgatggaggtggtgcgagagaaactacgaaagtatgtattcgatagagttaacatgcataatcttctgatccatttggtcaggcgcagggggcagaaactggagtccatgcagctggagttagacagcttgcggtcccaacctgacgccagcaaggaggaactgcggctgctgcagattatccgacagctggaaaataatatagagaaaaccatgattaaaatcattactagccaaaacatccatctgctgtacctcgacctgcttgactacttaaaaacagtcttggctgggtaccctattgagctagacaagctgcagaatctggtggtcaattactgttccgaactatccgacatgaagataatgtctcaggacgccatgatgatcacagatgaagtgaagcgcaacatgcggcagagagaggcaagcttcatcgaagaacgcagagctagggaaaataggctgaaccagcaaaagaaactcatcgacaaaatacacaccaaagagactagtgagaagtataggcgcggtcaaatggacctggacttccctagtaacctaatgtccacagagacgctgaaactccgccgcaaggaaaccagcacagccgaaatggagtaccagagcggggtaacagcagtggtggagaaagtgaagtccgccgtcagatgtagccacgtctgggatatcacatcccgattccttgctcaacggaatacagaggagaacctggagctacagatggaggattgtgaggaatggagagttcaactgaaagctctggtgaagcagctagagctggaggaggccgtgcttaaatttcgacagaagccttctagcatctcttttaagtcggttgagaaaaagatgaccgatatgcttaaagaagaggaggagcgtttgcaactcgcccatagcaacatgaccaaagggcaggagctgttgctgacaatccaaatgggtatcgacaatctttatgtgaggctgatgggcattaacttgccggctacacaggtgcccggtgtgaggctctcatgccacacccccggcccctgggccggtcctgaggggcgccaggcgcaaagattaatagagggcaaattgaaagcggccaaaaaaaaaaaaaaatag

SEQ ID NO: 32532 - DNA, 381 bp, Artificial Sequence
  Description of Artificial Sequence: Synthetic coding sequence
tcaggttccccagccggcctgttaaagggcgattcaaaaaaaccgagccagagaagggtcaaacgacaaccttactctacgaccaaggtcacgtccggttctacttttaacgagaacactcgacgctatgctgtgcatactaatcagtgtcggcgcccgcatgggtctagagtgaaaaaaaagcgctacccccaggaagacgattttcaccacaccgtgttctccaatctggagaggttggataaactgcaaccaacactcgaggcctcggaagagagccttgtgcataaagacaggggcgacggcgaacgcccagtgaatgcaagggttgtccaggtggctcctcttcgtctcgaatcccggatttcaatcggggagtag

SEQ ID NO: 32533 - DNA, 1314 bp, Artificial Sequence
  Description of Artificial Sequence: Synthetic coding sequence
atgtggccccaacctcatctgccaacgcatcctcaccttccaacacacccccacctccccactcatccacacctgcctacccatccccacctgcctacacatcctatgatgtccaaagagacaaggcagagtaaactggcagaggccaaagaacaactaactgatcatcacccacagaccaatccaagcgtgggcaccgcggcatccgatacaaagaagaaaaagattaataatggaaccaatcctgagactacaacgtccggtgggtgccattctccggaggacgaacagaaagcatcccaccagcatcaggaggcattgagaagggagctcgaggctcaggtccaaactataagaatccttacttgtcagaagaccgaactccagatggctttgtattattctcagcacgccgttaaacagctggaaggggaggccagggatcttatttccaggctacatgactcctggaagtttgctggagaactggaacaagcgctttccgccgtggcgacccagaaaaagaaagcagaccgatatattgaagagttgaccaaagaacgcgacgccctatccctggagctctaccgcaataccattaccgacgaggaacttaaggaaaagaacgctaagctacaggaaaagctgcagttggttgagagcgagaaaagcgaaatccaactgaatgtgaaggaactgaaaaggaaactggaacgcgccaaactccttctgccacagcagcagctacaggctgaagcagaccatctgggtaaagagttacagagcgtgagcgcaaaactgcaggcccaggttgaagagaatgagctgtggaacaggttgaaccaacagcaagaagagaagatgtggcggcaggaagagaagatccaggagagggaggagaagatccaggagcaagaggagaaaataagagaacaggaggaaaaaatccgcgagcaggaggaaatgatgcaggagcaagaagaaaagatgggggagcaggaggaaaagatgcaggagcaggagaaaatgcgtcgacaagaagagaagattcgagagcaggaggaaaagattcgcgagcagaaagagaaaatcagggagcaagaggaaaagatctgggagcaagaagaaaaaatacgagagcaagaggagatgatgcaggagcaagaagaaaagatgtgggagcaggaggagaagatgtgcgagcaagaggaaaaaatgcaagagcaggaggagaagatgagacgacaggaagagaaaatgagagagcaggaagtgcggttgcgacagcaagaagagaagatgcaggaacactag

SEQ ID NO: 32534 - DNA, 597 bp, Artificial Sequence
  Description of Artificial Sequence: Synthetic coding sequence
taaactagtcggcagacctgggtggccacaaatacccttagcaaggccgcttttttactgacagtgctctcggagcgccctgaacaccacaacctggcatttagggttggcatgtttgccctggagctgcaaagacctccagcttctaccaaggcgcttgaagtgaagcttgcttaccaggagagtgaggtggcagcactgctaaaaaaaatccctctgggtccatccgagatgtcaactatgcggtgccgggctgaggaacttcgagaaggaaccttgtgcgattaccgaccagttctcccactgatgcttgcatcttttattttcgatgtgctgtgtgcaccggggagccgtcctccctctaggaattggaatagcgagactcctggagacgaggaactggggttcgaagccgctgtggctgctttgggaatgaaaactactgtctctgaggcagagcatcctttgctgtgcgagggcacccggcgcgagaagggggacctggccctggctctgatgattacgtataaagatgatcaagccaagctgaagaaaccaggacagcagagtgagacccttagtctgaagaagaaatag

SEQ ID NO: 32535 - DNA, 4188 bp, Artificial Sequence
  Description of Artificial Sequence: Synthetic coding sequence
atgtatcccatttgcactgttgtggtggacggtttaccctctgaatcttccagctctagctacccgggtcccgttagtgtatcggagatgagtctgcttcacgctctgggcccggtccagacgtggctaggtcaggaattggagaaatgcgggatcgacgcaatgatatacactcgttacgttttatccttgctgctccatgattcctacgactatgatctgcaagaacaggagaacgacattttccttggctgggaaaagggggcctataagaagtgggggaagtctaagaagaagtgtagcgatctgaccctcgaggaaatgaaaaagcaggctgctgtgcagtgtctccggtcagcctccgacgaatcttcgggcattgaaacgctcgttgaggagctctgtagccgtcttaaggacttgcaatccaagcaggaagaaaagatccacaaaaaactggaaggcagtccctcacccgaagctgaactttcacctcctgccaaggatcaggtggaaatgtactacgaggcctttccacccctgtccgagaagcctgtttgtttacaagagataatgacagtttggaacaagagcaaggtctgttcttactcgagttctagctctagcagtacggcgccacccgccagtactgacacttccagcccaaaagactgcaattcggaaagtgaggtgacgaaagagagatcaagcgaggtacctacaacagtccatgagaaaacgcaatcaaagagcaagaacgagaaggaaaataaattctccaatggcacaattgaggagaaacctgcactgtacaagaaacagataagacataaacccgaggggaagattcggccgagatcctggagtagtggcagctccgaggccggatcaagcagctccggcaaccaaggtgaattaaaggctagcatgaagtacgtcaaagtgcggcataaagccagggaaatacggaacaaaaagggtagaaatggccaatctcggctgtctctgaagcatggcgagaaagccgagagaaacattcacacaggcagcagtagctctagctctagcggcagtgtgaaacagctgtgcaagcgcgggaaaaggccactcaaagaaattggccgcaaagatcccggatctactgaagggaaagatctgtatatggagaaccgaaaagataccgaatacaaagaggagcctttatggtacacagaacccattgctgagtattttgtgcccctaagcaggaagagcaagctggagactacataccggaatcgtcaagacacatctgatttaactagtgaagccgtagaggaactgagcgagtccgtgcacggactctgcatctctaacaacaacctgcataagacttatctggccgctggcacttttatcgatggccactttgtggaaatgccagcagtgatcaatgaagatattgacctgaccggcacctctttgtgcagcctgccagaggacaacaagtatctagatgacatacacctctcggagctgacacatttttacgaagttgacatagatcagagcatgcttgaccctggcgcaagtgaaactatgcaaggcgagtctcgtatcctgaacatgatccggcagaagagcaaggagaacacagacttcgaagctgaatgttgcatagtgttggatggcatggaacttcagggagagagggcaatctggacagatagtactagctctgtgggcgccgaaggcctgttcttgcaggacttagggaatctggcccagttctgggagtgttgttcttcttcttccggggatgcagatggggagtccttcggcggcgatagccccgtgcgtctctctccaatcctcgactctactgtgctgaactctcacctcctggctgggaatcaggagctgtttagcgacatcaatgaagggagcggcatcaattcgtgtttctcagtttttgaggttcagtgtagcaattcggtgttaccttttagtttcgagacgttgaacctgggaaatgaaaacacagacagctcggcaaatatgctggggaagacccagtcaaggctgctcatctggaccaagaattcagccttcgaggaaaacgaacactgtagcaatttgagtactcggacctgttctccctggtcccactcggaggaaacccggtccgataacgagactttaaatattcagttcgaggaatccacccagttcaacgccgaagatatcaattacgtggttcctcgcgtttcttctaattatgtggatgaggaacttctggattttctccaggatgagacatgccaacagaattcccgaactctgggggagattcctaccctggtgttcaaaaaaactagcaaactggaatccgtgtgtggaatccagttggagcaaaaaacagagaataagaacttcgagaccacccaggtgtgcaacgaatcccctcacggagatggctattccagcggcgttatcaaggacatatggactaaaatggccgacactaacagcgttgctaccgtggaaatagaaagaactgatgctgaactcttttctgctgacgtgaacaattactgttgctgcctggatgcagaggcagagctggaaacactgcaggaacctgacaaggctgtacgccgcagcgaatatcatctatgggaaggacagaaagaaagtctggaaaagagggcattcgcctcctctgagctgtcgaacgtggacggtggagattatacgaccccttctaaaccttgggacgtggctcaggataaggagaacacttttatccttggtggcgtgtacggtgaattaaaaacattcaacagtgatggagaatgggctgtggtccctccttctcatactaaaggcagtctgttacagtgcgccgcttccgacgtagtcactattgcagggacagacgtgttcatgactccaggaaatagcttcgcacccggccatcggcagctgtggaaacctttcgtgagcttcgagcagaacgaccagcccaagtcaggcgagaacggattgaataagggcttcagctttatcttccacgaggatctactgggcgcctgtgggaattttcaggtggaggatcccggcctggaatactctttcagcagcttcgacctgagtaacccttttagccaagtgctgcacgtagaatgttcttttgagccagagggcattgctagcttctcgccaagttttaaacctaagtctattctttgttccgattcagactcagaagtgttccaccctcggatctgtggggtggataggacccagtaccgcgcaatcagaatctcccctcggactcactttcgacctatctccgcctccgaattgtcccccggtggaggatctgagagcgagtttgagagcgagaaggacgaagcgaatattccgatcccgagccaggtggacattttcgaggatcctcaagcagaccttaagcctctggaagaagatgccgagaaggaaggacactattacggaaaaagcgagctggaaagcggaaagtttctgccacggttgaagaaatctggcatggagaaatctgcccagacctctttagactcacaggaggaatctacaggaatcctcagtgtgggaaagcagaatcagtgcttggagtgttccatgaacgagtctctggagattgatctagagtcatccgaggcaaattgtaaaattatggcacagtgtgaagaagaaataaacaatttctgtggatgtaaagcgggctgccaatttccggcgtatgaggataaccccgtttcaagcgggcagctagaggaatttccagtgctgaacaccgacattcagggcatgaatagatcccaagagaaacaaacttggtgggagaaggccctctactctcccctattcccagccagtgaatgcgaggaatgttacacaaacgccaagggagagagtggcctggaagagtacccagacgccaaggagaccccctctaatgaggagcgtcttctggattttaaccgggtgagttccgtctacgaggcccgatgcacaggggaaagagacagtggtgcaaagagtgatggttttaggggaaagatgtgttcctcagcctcctcaacaagtgaagaaacaggaagtgaaggaggaggtgagtgggttggaccttccgaagaagaactcttttcccgcacccacctttag

SEQ ID NO: 32536 - DNA, 366 bp, Artificial Sequence
  Description of Artificial Sequence: Synthetic coding sequence
atggaattcgtgctgagttgggtcttcctggtggcaattctgaaaggtgtacagtgcgaggtgcagctggtacagtcaggggggggcctggtgcatcccggcgggtctctcaggctgagttgcgctgggagcggctttactttctcatcatacgcaatgcattgggtgagacaggcacccggaaagggtctggaatgggtgtctgcaattgggactggcggggggacttattacgcagattctgtgaaagggcgatttacaatatccagggataacgctaagaactccttgtatctgcagatgaactcactcagagccgaggatatggctgtttactactgtgcgagggacaccgttcgcggctag

SEQ ID NO: 32537 - DNA, 777 bp, Artificial Sequence
  Description of Artificial Sequence: Synthetic coding sequence
cggtccctgctcaaagaattggagaataccaaagaccatactctgctgctggaaaagagactgaaaaagctgtcccgggaagggtcaagccaccatttacctcgccaggtgcgcccaggccctgtgtacaagccagccccagctaggaatcatagacctcgcggcgggcgcggaaaagctagtccaacctcttttcatgtttcaccaagggccccgctggcgcctttggcaagcatgccaagcagcgtgccaaaaacctccatcgagagcttggggagtccaagctcactgtcatcctcgcaggcatctgagcctctgtgccccctaaaacatccgtcacatagaccacccgcgtctactctgagccccaacctgacaagctctaccgagagcctgggatacctgagctccctgtcttcctcccaaccgcctgagccgctaaggccccttgagtgtccctcccacaaaccttgtggaagaagtctgccacgtcgccgaaacccaggctgggtcagctggtcggattctatgcaggctgactctgaaacggatgccattatctgcccaatgtgcaaggccccggagcgatcatgtcctcacacatggtgggttccatcctcccctagagtcatcagaggagtcgggcggtgctccgaccctaacctggggcttagctggaggcaggaggcagctcgtgcctggtgccattgtacttcgtcccagtatccgttcaagcacccaaatctgcccactcatctgccgaaggctagcttctag

SEQ ID NO: 32538 - DNA, 2253 bp, Artificial Sequence
  Description of Artificial Sequence: Synthetic coding sequence
gactatgcacataccctcacttgcgtaaccgaaagggagaagtttatcgttcccatcaaggcacgtggtgcccgggctatattggacttcccggacaagctgaacttttccacctgcccggtgaaatattccacccaaaagatcctgctggtgcgcaacatcggcaacaagaacgctgtcttccacatcaaaacctgtaggccattcagtatagaacccgctatcggaactctgaacgtaggggagagtatgcaacttgaggtcgaatttgaaccacagagtgtcggagatcactccgggcgcctgattgtatgctatgataccggtgagaaagtcttcgtttccttatacggggccgccatcgatatgaacattagactcgataagaatagcctgacaatagagaaaacctacattagcctagccaaccaacgcactatcacaatccacaataggagcaacattattgcacatttcctgtggaaggtgttcgcgacccagcaggaggaggatcgcgagaagtatcgggcttgtgacgatctgatcaaggaagaaaaagatgagaccgacgaattctttgaggaatgtatcactgacccattactgcgcgagcacctgtcagtgctttctcgcacttttgcaaatcaaaggcgactcgtccagggtgattcgaaactatttttcaacaacgtgtttaccgtggagcccctggagggcgatgtttggcccaatagcagcgccgagattacagtctacttcaacccgctggaggcaaagctctatcagcagacgatatactgcgatatccttggacgggagatcagactccctctcaggatcaaaggagagggaatgggaccgaagatccacttcaattttgagttactggatattggtaaggtctttacgggctctgcacattgctacgaagcaatcctgtacaacaaggattctattgacgccctattcaacatgacccccccaaccagcgccttaggggcttgtttcgttttttccccaaaagaaggaattatagagcctagcggcgttcaggcaattcagatttccttttcatcaacaatccttgggaatttcgaggaggaattcctggtgaatgtcaatggaagccccgagccagtgaagcttacaattcgcggatgcgttataggcccgactttccacttcaacgtgcctgcattgcactttggggacgtgtcattcggctttcctcacacactgatatgttcactgaacaacacatcactaattccaatgacttacaagctccgcattcccggagatggactgggacacaagagcatatcctattgtgaacagcacgtcgactataaaaggccgtcttggactaaagaagagatctcttccatgaagccaaaagagtttacgatcagcccagactgcggcaccattcgcccacaggggttcgccgctatcagggtgaccctgtgttctaacaccgtgcagaagtacgagctagctctggtggttgacgttgagggaattggcgaagaggtgttagcgctcctcattgcggctcggtgcgttgtgcccgctctccacctggtgaataccgaggttgactttggacattgttttctaaaatacccatacgaaaagaccttgcagttggccgaccaggacgacttgcccggattctatgaggttcagccccaagtctgcgaggaggtgcccacagtgttgtttagtagccctactccatctggcgtgataagtccatcttcgactatccacattccgcttgtgctggagacccaagtgaccggcgagcaccgatccaccgtatacatctctattttcggcagccaggatccaccattggtgtgccacctcaaatcagccggtgaagggcccgttatatacgttcatcccaatcaggtagatttcggcaatatttatgtgttgaaggacagctcaaggatacttaatctgtgtaaccagtcatttatccctgctttctttcaggcacacatggcccataaaaaatccctatggacaatagagccaaatgaagggatggtgccccctgaaaccgacgttcaattggccctaactgcgaacctgaatgacacgctaactttcaaagattgcgttattctggacatcgagaatagcagtacctaccggattcctgtgcaggcctccgggacaggttctacaatcgtgtctgacaagccgttcgcccctgagctgaatctaggcgcgcatttttag

SEQ ID NO: 32539 - DNA, 294 bp, Artificial Sequence
  Description of Artificial Sequence: Synthetic coding sequence
gaggtgcagcttgtccagagtggcggaggcctggtccagccaggcggatcattgagattatcttgtgcgggtagtggtttcactttttctagttacgcaatgcactgggttcggcaggcgcccggtaagggcttagaatgggtatcagctataggcaccgggggcggaacttattatgcagactctgtcaaaggtaggtttacaatctctcgcgacaatgcaaagaacagcctctatcttcaaatgaactccctgcgggccgaagacatggccgtctactattgtgcaaggtag

SEQ ID NO: 32540 - DNA, 714 bp, Artificial Sequence
  Description of Artificial Sequence: Synthetic coding sequence
tgaacctatcatcgaatccccatgcccgacttctgcgccccgagggaagaggactttgaccagctgctcgaggccttgcgcgccgctttatccaaggatcctggcacaggttttgtattttcatgcttgtcaggacaggggcgcaccaccactgctatggttgtggcagttctggctttttggcacattcagggattcccagaggttggagaggaagaattggtgtcagtccccgacgctaagttcactaaaggggagttccaggtggtgatgaaggttgtccagctgcttccagatgggcaccgagtcaaaaaggaggttgatgccgctttggacactgtgtccgagacgatgactcccatgcactatcacctgcgcgagattatcatctgtacctaccggcaggccaaggccgcaaaagaagcccaggagatgagacgactacagctccgctccctccagtatcttgagagatacgtatgtctgattctgttcaacgcctaccttcacttggaaaaggccgatagctggcaaagaccgttctcaacctggatgcaggaagtagcttccaaggcaggcatctacgagatcttgaacgaactggggttcccagagcttgaatctggggaagatcaaccctttagccgcttgcgctatcgttggcaagagcagtcttgcagtctggagccctccgcccccgaggacctgctgtag

SEQ ID NO: 32541 - DNA, 648 bp, Artificial Sequence
  Description of Artificial Sequence: Synthetic coding sequence
tacggcgtgtgcagcgttggactggaatggctggcttacttactggtgccatacagcctcggggcatccgctaccagcctactggggctgctgggactgtggttgccccgccccgtgcctttagtggccggggctggagtgcaccttctgttaacgtttatactgttcttctgggcaccagtgccccgggtgctccagcacagttggattttgtatgtggccgcggctctttgggtggtgggctcgagcctgaataagactgggctgagcacccttctggggatcctctatgaggataaagagcgccaggatttcatcttcaccatttatcactggtggcaagcagtcgccatatttactgtctatctcggaagctctttgcatatgaaggctaaactcgccctgctactcgttactcttgtagctgctacggtatcctatctgagaatggaacagaagctacgcagaggcgtggcccccaggcagccccgtatcccccgccctcagcacaaggtgagaggatatcgctatctggaggaggacaactcagacgaaagtgatgcagaaggagaccttggtgatggagaagaggcagaggccgaggccccccccgccgggccaagacccggccctgaaccagctggctag

SEQ ID NO: 32542 - DNA, 3828 bp, Artificial Sequence
  Description of Artificial Sequence: Synthetic coding sequence
atggattgggatgacgaatacagtcataactccttcgacctgcactgcttactgaactcttttccaggggacttggaatttgagcagatatttagtgacattgacgagaaaattgagcagaatgcagcctccattaagcactgcatcaaggaaatccaatccgagatcaacaagcagtgccctggcgtgcagctacagacaaccacagactgctttgagtggctgacgaactataattacagtacttccgaatccagtttcatcagccacggtgatctgattaaattcttcaagaccctgcaggacctgcttaagaatgaacagaaccaggaagagatgacccttgacctgctctgggatctgagttgccattcaagtgtgagtttcccatccacgctctcgggtacctcttttcatttcctgagtaggacatcactccacagcgtggaggacaatagtagcatggacgttaagagcatgtgggacgacatccgacttcatttacggcgctttctggtgtccaaactacaaagccataacgagatcaataactcccagcagaaaatactgctcaagaagcaatgtctacagcagctcctcttcctttacccggaatcagaggtgatcatcaagtaccagaacattcagaataaactcctggccaatcttctttggaactgtttccctagctataaccgagatagcaatctggacgtaatagctcatggttaccagagcaccatgctgaaactctactcagtgatcaaagaggatttcaataccctgtgcgaaatcctcgcaccttcctccatggtgaaattcatcaaggagacctacctggacactgtaactgaggaaatggcgaaattcctcgagaatttctgcgagctccagttccgcgagaacgcagttagagtggttaagacctccaaatccagctccaagcaccggggtgctgtgcatgcactggtgacaaccgaatgcccccaaaaagggaggaacttctcgctcccactggataaagtggagttcctttcccagctgataaagtcatttatgaagctggaaaagggtgtccaggagctatttgatgagatccttctgtctctgaagatcactcgggatacttcaggtatactcgaaaaatcagatagagaggtggtgatggaaaaaccaagagccaacgagacaaacattcccagcgaacagagtcttcccggaaaagaggccaccttgctggactttgggtggcggagcgcctttaaggaagtgagtttacctatggcccattgcgttgtgactgccattgagggttttagcaccaaaattctgcagcaggaacagaacgagagatctagcgccgttagctatgctatgaacctcgtaaacgtgcagcaggtttggcaggattcgcatatgtttcccgaagaggagcagccaaaaaagattggcaaattctgctctgacataatggagaaactggatactatgcttcccctggccctcgcgtgcagggatgactcctttcaggaaatccgggccaatcttgtcgaggcctgctgtaaagtcgcaactgccgtcctgcagagactacaggaaagagctaaagaagtgccctccaaagctccactgaagaacctgcacacttacctctctactgccgtgtacgtcttccagcacttcaaacggtatgataacctgatgaaagaaatgacgaagaaacccatcttcctcgtcctcgttcagaggtatcaggagttcatcaacacactgcagttccaggtgactaactattgcgtgagggtgtgtgctacaagtattttacaagatgccgagtcccatcattgggacgattacaaggcgttctatgaaggcgaaaggtgtagcttcagtattcagatgtggcattatttctgctggagcctgcattacgatttatggacaattctacctcccaagttggcacaggaaatcctggttgaggtgctcgagaagtctctgtcactgctggcctcacgctacgcccgcgctcacccaagtagaaaaagaaccccacagctgcggctggatgtcacgacaatcctaatttgcactgaaaatatgctgtggagcgtgtgcacctccgtgcagaaacttttgaatcctcatcaacatactgatgataagatcttcaagatccatactcactgcaacaacctctttacgacattggtgatactgactagccccctgactgagctgtacaaaacgtttcagcatggcctggacgaatcggcatctgattcactgaagtcctttttcaaacagcccttatactgggtttcctgcataagccacttttatcccagcttactccggacccctagcgctggggggctgaaggctgaagggcagctcaaactgttgttgagccagccacggtgtaattggaatctgctgctcgaaacccttctccaccatgatgggcttctcctgcgcatccttctcaaatcctccaaacaggtctccgacactgagaacaatctgaaccaggggccaagtctcatggaggccatctttaagatcctttaccactgctccttttctccccaaaccttcgccaacgtgtttgtgagttatatggaagaggaacagctgtgggatttcttgtacaatattccggttagcacttgcgtcgagtatgagctcgaggtaatccgctgtctcagactggcactcaccgacgccataaaagacacagtacagcagatagtgtctgtgatgtcttcccgacgcaactgcgaaaccaaccttaataagcacatcgtgcctgactgcctattagagagcatgccaaaagagtggaactatagcccaaaggagacaaacagaaaagagtcatgcaagagctttactcggctcacagctcaagctgtgtccatagtcatttccaagttaccgacagtcattgcctgtctgccaccgcccgtgaagtactttttcttcctttcagagaggaagatgtcgaagaagttcgtcgaactcaagaaagccgggctgcttgtctggaacctcatcgtaattatttgcaggattttcgaggacggcaacacagttgaacttctgacaggagcatccttagatagatggtccaaagaaaaactggggctgatctgcatgtgcctcaaaagcatcatgggagatcagaccagcattcataatcagatgatccagaaagtgattcaatccatcgaacagcagaagccaaactggattgagcggcaactcttgaaagcgcgtaaattgagcactgaatgcgcttttatgactatcgagaagagcaccgcgttacaagagggagatgtggcacttgagctgactgaacagaagatcaacactatggtgctcgacttgtgtcacaaaccaggcgggcgcgaatatctgagacagatctatcatattatgcaacttaatgaagaatacttaaaagagcaactattttcgatgaactcctctgaggaaaagcctctacctatacggccccttaagactactctcagaagtatcgaagatcagccatccgcttttaatccattccacgtttacaaggccttctccgaaaacatgctggaccagtcagctatcactaagtggaattggaactgggcgaaattactacctaactacctacgcttggacaagatgactttcagcgttctgttgaagaaccgttgggaaatgaaaaaagacgagactctcgaggaagaggaaaaggccattctggagcacctcaagcagatttgcacaccgcaaaacagttcagccagcgataatatcgaggagcagtag

SEQ ID NO: 32543 - DNA, 132 bp, Artificial Sequence
  Description of Artificial Sequence: Synthetic coding sequence
aggctccgaagccgccctcaggctgggggggcggggtccgcggcagcttgtggtcctgggcagggacgtttccgccgcgccgctccacgcccctcttcttcacgtgtgtgcggacagagaacttcacggtag

SEQ ID NO: 32544 - DNA, 585 bp, Artificial Sequence
  Description of Artificial Sequence: Synthetic coding sequence
atggtgacatggtcccactccaattccaataaggagctaaagcaggaaaattctgcacttgccgagcagctgcaggtagtcttgatagataaagctggaatgcaatgcgatttggaggagctaaagaagaaactagagctcacagagctgactctgcagcagctcagtagctggtgtgaagctccagacgctaatcaacagctgcagcagccaacggacgagagagcacagcttgaagcccatctaggacaagttatggaatggttgaaatacctgcagatggagagggaacagtacgcagagtacctacacggagaatccgcgatgtggtggcagcgcatgcgagagatgtcggaacaagttcatacgctgcgagaggaacgagtgcacagtatgtcacgggtgcaggaattggagaccatcctagctgagttgcgaaatcaacttaacccctgtccccgcagtttgcaacagggtccgccaaaatggtctcggagttacaagcagcgcctcagcacctgtggccgctcctggcggatttggcaagattcttttaaacctaagtggaagaaaatgagggcttag

SEQ ID NO: 32545 - DNA, 879 bp, Artificial Sequence
  Description of Artificial Sequence: Synthetic coding sequence
atgatgttctactggttgctctctatcgtcggccggcagcgcgccagccctggctggcagaattggtcaagcgctcggaacagcgcgtccgccgccgaggcaaggtcaatggccctccctacacaagcccaagttgtggtttgcggcggtggcatcacgggcacatctgtggcccatcaccagtctaaaatgggctggaaagacattgtgcttcttgaacagggacgcctggccgctgggagcacgcggttctgcgcaggcattttgtctacagcaagacaccttacaattgaacagaaaatggccgattattcaaataaactgtaccaccagctggaacaggagaccggtatacgcaccggttataccaggacagggagtatcttcctggctcaaacacaggaccgcctgatttcacttaagagaatcaatgcaggactgaatgtgatcggaatcccatccgaaatcattagcccgaagaaagttgctgagttacaccacctcctcaacgtgcacgacctcgtgggagccatgcacgtccccgaagacgctgtggtgtcgtcggcggacgtcgccctggcactggcgagcgcggcctcacaaaacggggtgcaaatctatgaccgaacatccgtactgcaggtgatgggaaagaaggggcaagtcaccggcgtagagaccgacaaggggcagatcgagtgtcaatattttgttaattgcgctggacagttattatggatgctgatggaagaatttattttcggcacaggaagagtagcaagctgcttaggggccctgaggcggacgcagaaccagtttagtctacgggccaggacttcgtggaggttccggatttaccgtgggctcggaagtttgtag

SEQ ID NO: 32546 - DNA, 1989 bp, Artificial Sequence
  Description of Artificial Sequence: Synthetic coding sequence
atggtgagtcagtcaactgtaagacaagattcccccgttgaaccttgggaaggcatttccgaccattcaggcattattgacgggtcgcccagactgttgaatactgatcaccccccatgccagctagacatcaggctgatgcgacacaaagccgtgtggatcaacccacaggacgtgcagcagcagccacaggacttgcaatctcaagtgccagcagccggtaactcgggcacacactttgtcactgacgcagctagcccatcgggaccctctccctcttgtctgggggattctctagctgagaccacactatctgaggacactacagatagcgttgggagtgcttcaccccacggctcttcagaaaagagcagtagtttttctctgtcttcaactgaggtgcatatggtccggcccggttactcccaccgggtcagccttccaacgagcccaggcatactcgccacaagtccatacccagagactgactcagcttttttcgaaccatcacacctcacgagcgcagccgatgaaggagccgtccaggtgagtaggcggacaatctcctccaactcttttagtcccgaagtcttcgtgctgccagtcgacgtcgaaaaggagaacgctcatttctacgttgccgacatgataattagtgccatggagaaaatgaagtgtaacatcctctcacagcagcaaactgaaagctggtctaaggaggtgagcggcctgctgggatctgatcagcctgattctgaaatgacatttgataccaacattaaacaggaaagcggctccagcacttcatcttattctggctatgaagggtgtgcggtgctccaggtaagtcctgtgaccgagacccggacatatcatgatgtgaaagagatctgcaagtgcgacgtcgatgaatttgtgatcctagagctgggcgacttcaatgatattaccgaaacatgctcgtgtagctgcagcagttcaaagtcagtaacttacgagcccgacttcaactctgcggagctgctcgcaaaagaactttatagagtttttcagaaatgttggatactgagcgttgtaaatagtcaactagctggctcactgtctgccgctgggtcaattgtggtaaatgaggagtgtgtcagaaaagactttgagtctagcatgaatgtcgtacaggaaattaagtttaagtcaaggatccggggaaccgaggactgggcgccccctcggtttcagatcatcttcaatatccacccccctctcaaaagggatctggtggtggcagcccaaaacttcttctgtgcaggatgcgggacgcccgtggaacccaaattcgttaagcgccttagatattgtgagtacttggggaaatatttttgcgattgctgtcacagctacgcggaatcctgcattcccgcccgtatcctgatgatgtgggactttaaaaagtattatgtgagcaatttctccaagcagcttctcgattctatctggcatcagcccatttttaacctgctcagcataggtcaatccctgtatgccaaggcaaaagagctcgaccgcgtgaaagaaatccaggagcagttgttccatatcaaaaagctgctgaagacttgtagattcgccaattctgcactgaaggaattcgaacaggttccagggcacctcaccgacgagctccatctttttagtctggaggatctcgtcaggattaagaaggggctgttggcccccttgctgaaagatattcttaaggcatcccttgctcacgtggcaggatgcgagctgtgtcagggcaaaggattcatatgtgagttctgccagaatactacagtaatatttccgtttcagaccgcaacttgtcgtcggtgcagtgcctgcagggcttgctttcacaaacagtgctttcagtctagtgaatgccctcgctgcgctagaataaccgctcggagaaagctactggaatccgtggcctcggcagccacttag

SEQ ID NO: 32547 - DNA, 297 bp, Artificial Sequence
  Description of Artificial Sequence: Synthetic coding sequence
gtctgtggtagcacacaggagaagaccgtgttcagactggaggccatgcttgagaggaccgccggtgtacagtcaaaggaggccgcactcgaagaggaggccgtgctgaaggtggaggatatcatggctgaggtagaggtggtggttgaagtcgaggttgttgtggaggtcgagcctgacgtgggctggcagaaagaagggcaacgagctcagccaggcccgggtccttcaacgccgggaccatcaatggatagcctcgaggtgcttcatctcgaactgggctccgtgaacgcctag

SEQ ID NO: 32548 - DNA, 459 bp, Artificial Sequence
  Description of Artificial Sequence: Synthetic coding sequence
atgctgttctccttcgaacacaaggctgtggcattaagcgccacaaggagggcaacgccgaggccccagccctgggtactgggacttcagggccgggggggggaaggggacgcccggacctgcggcgccgggcgcgaacggggactacccggacccgctctcgacacagaaccccggtgggaccctagaaggttgtgcgaggccctccgcgctcctggaaggcgtctcgaaggggccggacagccacctgccactagtggtggtccagcaacatccggccgctctaaagagccatggggacacatcagcgggtgtggcgatccacctggcgccttccggggaagtggacgcatatgccaggggaccagcggcgctagaccctgcttttgccgcgcgcccggttacccttggatggcagccttatgccctcggaggagacctggtcggcactccggctag

SEQ ID NO: 32549 - DNA, 441 bp, Artificial Sequence
  Description of Artificial Sequence: Synthetic coding sequence
cctggacctccagggcgcccaggtaaacctggctttcccaagccagggggtccgggagggcctgctatcccgggcgcacccggacggcccttcgtccctggaatacctggctggcccggagccccagccgctcccggatttcctatgccgagcgggccgcgaagccctggcggcccgtgggggcccggaggccccattggcccaatcagtcctggcccggggataccgggcgggcccggtggcccccgagggccgggacgccctgccggtccaacctctccatttggcccttacggccctttgagccctgggtttcctggatccccagggacccccggcttccccaccgcggacggaccgggaggacccggcaatccgggctctccctggtcccctggccttccctacccccgcggacccgccggtccaggcggaccgtag

SEQ ID NO: 32550 - DNA, 84 bp, Artificial Sequence
  Description of Artificial Sequence: Synthetic coding sequence
gtgcccccacttcactcaagtctgggtgaccgggcgcgctttttaaggccatgcctcaagaagaagactaagaaaaagcggtag

SEQ ID NO: 32551 - DNA, 3063 bp, Artificial Sequence
  Description of Artificial Sequence: Synthetic coding sequence
cagctcaggagatccgaactggaacactccgtcgacctcgaagaggcccttggcagactagaagcagcggaggaacgttctaccggactgtgtcaggtaaatgcactgttgcgcgagcagttggagcatatgaagaaagccaatgatgccctggggagggagctggcggggatgactggatccgtccagcgactccagggcgagctggagcttcgcaggtgggcccagaggcaggagccgtcgcgaacgaggagcggaggactggggcagccccgggatctgctcctgctgtggcgccaggccgtggttcttggcacagacttggcagaactgcgcgttgctacagagaggggccttgctgacctccaggccgacactgccagaactgcccggcgcctccatacggcttgcctaaacctggatagcaacctgagactgtctgccagttctacagcctcgaccttggggcagcagctgcgggacaaagccggtgagatgcttcaattgcaggggaggtgggatgccgagaaggtcgccctacaggcccgactgtcagaacagacactcctggtggagaagctgacagaacagaacgaacagaaagccaagacaatcgcggcgctgcggaccgacctgcagaacctggtggggggacaagacgggggaggctgtgtggccggcgtctgtcacccgtgttcgggcgtatcccctgctacaggatcactggtggctcaggaagacgctaggtgtctcgagctggcaggcagcagcattacggaactgggtgagccacgaagacctctgagatcccctcaacgcgccaccagtccccatcagggtgccagccccccccatatttgttcccctgcaactcttgaccctgcactgcaggcaatgcgggctgcaatcgaacgaaggtggagaagagagcaggagttgtgtctgcagctgaagagttctcaggctttagtggccagcctgcaggagcagctgagcgagagtcggagggaattatgggccgctcagaagctgcagcaagagcgggcaagagaacaggcccgggagcgcgaagccctgcggggccagctggaagcccaacgtttagaggtacaacaatgtagggcgtcatgtaaactcctgggaagggagaaggctgctctggaaatggtggtggaggaactcaaggggaaggccgatgccgcggacgccgagaagcagggcctggaagcagaggccgctgaactgcagcggtctctattattacaggctgaacgccgggaggaattggccctgcgtcgggaaaggtcctgcagggccctggaaacgtcccagggtcgcctgcagcagctcgaagaaaaggttagtggactacgagaggaactggccagcgtccgcgaggcactgagcaccgcccaacttcaacgcgacgttgtggagtccgagcgggaggggctgcggtccgccctggcccgcgccgaatgttcaaacgcagacctggagctgctggttcggcgcctgaagtctgaaggcgtagagcagcgcgactcccttgccgcaatggccgcattgatggaaggcctagcacaagacaagagtgcactgaaccatctcgctctgcagctagagcaggagagagaccagctgcgtgaacagcggaaaacactcgaacaggagcgcgccagagctggcgaacagttagctcaggccgaacagcaactggcgttggagagagccgaaagacggggcctgcagcaggcttgtggcaggctcgaacagcgacaggagcagctcgagggacaggctgctttgctgggccgcgaaaaggcgcagctgcaagaacaggtcgggcaggtgacttgtcaaaaacaggctctggaagagcaactggcccagtcactccaagaccaagaagcccaaatgggcacgctacagcaggccctgcagggtaaagatgcactcagcgaggagcgggcccagctcctggccaagcaggaagcactcgagcggcaaggtagattggcggcggaagaagccgcggatctgagagtcgagcgagactcattagaatcttctcttctggaagcccaacagttagcaactaaactgcaggaacagctggaagaagaggcccggtccgccggtctggcaagacaggccttacaggtggaaatggagcaactgcaatccgactgggaggttcaggaaatgaaattgcgacaggataccgtgcggctgcagcgccaggtcgcacaacaggagagggaggcgcagagagctctggagtcccaagccctcgcccatcgcgaagctttagcacagctgcaacgcgaaaaggaaacactgagtctgaccctggccgaggagaaagaagtggcaagatgccagctggagcaggagaaagaactggtgactaaatccgctgcagagagagaggccctgaagggcgagattcagtctcttaaacaggaaagggatgaaagtttgttgcagttggaacacaagatgcaacaggcactttcccttaaagagacagagcgttctttactgagtgaagaattaagccgggccagaagaaccctcgagagagtgcagcaggaggctcaatctcaacaggagcaggcacaagctactatcagcgcaaccactgaggagttgaaggccctccaggcccagtttgaggacgccatcacggctcaccagcgcgagacaacagctctgcgcgagtccttacaggatctagctgctgagcgcggcgatgtcgagagggaggccgagagactccgggcccagttgactgtagcacaggagggcttggctgctcttaggcaggagctacagggcgttgaggagagccgggaaggattacatagggaagcccaggaagcaagacgagcactttcagacgaagcgcgagagaaggatgtgcttctcctgtttaactccgaactgcgcgccactatctgtcgcgcggagcaggaaaaagcatcctttaagaggagcaaggaagaaaaggaacaaaaactcctgatactagaggaagctcaggccgccttacaacagtag

SEQ ID NO: 32552 - DNA, 1395 bp, Artificial Sequence
  Description of Artificial Sequence: Synthetic coding sequence
taagccctgtgttgggcgcgtgcactgccatcacggcccggcgcctcccgctccgggggactcgaggagtccagggatcggccacgcccactgccaaccgagcctgcagtgaggcctaaggagccaggtaccaagcgaaagggcctgggggaaggggtcccgtccagccaacgtggacccagacgcctgtccgctgaaggcggcgataaagccctccataagatggggcccggtggcggaaaagccaaagcactggggggggcgggaagcgggagcaagggatcagctgggggagggtccaaaagacgacttagtagcgaagattcaagcctggagcctgacctggctgagatgagcttggacgattcttctctcgccctgggcgctgaagctagcaccttcggtggattccctgaaagtcctcctccatgtccactacacggcggatcacgcggtccgtccacatttctcccggagccccctgatacatacgaggaagatggaggcgtttatttctccgaaggtcccgaaccacccacagcaagtgtgggcccacctgggctgctgcccggcgatgtttgcactcaagatgatctgccctctaccgatgaatctggaaatggtctccccaaaacaaaagaggcggcccccgctgtgggggaagaagacgatgactaccaggcgtactatttaaacgcacaggacggggccggcggtgaggaggagaaggccgaggggggggcaggcgaggagcacgatctgtttgctggcctgaaacccctggaacaggagtccagaatggaggtgctgttcgcctgcgccgaggccttacatgcgcatggttacagttctgaggctagccgcttaaccgtggagttggcacaggacctgttagccaacccccccgatttgaaggtcgagcctccacccgctaagggtaagaaaaataaagtatctacaagccgtcaaacatgggtggcaacaaacaccctatcgaaggccgcattcctactgaccgtgctgtctgagcggcctgaacaccataatctggccttccgggttggaatgttcgccctggagctccaacggccccctgcatcaactaaggcgctcgaagtgaagttggcctatcaggagagcgaagtggccgccctgctgaaaaaaattcccctcggcccatccgaaatgtccacgatgaggtgccgtgccgaggagctgagggaaggaaccctctgcgattaccggcccgtgttgcctctgatgctggcctctttcattttcgacgtgctctgtgcccctgggtctcgtccaccgagccggaattggaactctgagactcctggagatgaggaactggggtttgaggcagcagtggccgcgctgggggaatcttag

SEQ ID NO: 32553 - DNA, 3909 bp, Artificial Sequence
  Description of Artificial Sequence: Synthetic coding sequence
tgaccttcagcttccgaccagtcaacctggtacttagatgaatctactctgactgacaacatcaagaagaccttgcataaattttgtggtcctagtccagttgtattcagcgatgtgaactccatgtacctgtcaagcacagagccgccagctgccgctgagtgggcatgcttattgaggcctctcagaggacgggaaccagagggtgtctggaacctcctgtccattgttcgggagatgttcaagaggagagactctaatgcggcaccacttcttgaaattctcaccgatcaatgtctgacttatgagcagatcactggctggtggtactctgtgaggacatcagcaagccactcatccgcatctggacacaccggcaggagtaatggccagagcgaggtggctgcacatgcttgcgcgagtatgtgcgatgagatggtgaccttgtggaggcttgccgtcctcgacccagccctcagccctcagcggcgcagagagctgtgtacccagttgcgacaatggcagctcaaggtaatcgaaaatgtgaagcgcggtcagcataagaaaacgctggagaggctctttcctggattcagacctgctgttgaggcttgttattttaattgggaggaagcttatccgttaccaggcgtcacgtactctggtactgaccgcaagctggccctatgttgggcacgcgcattgccatcacggcctggtgcctccagaagcggtggtttggaggaatctagagaccggccccggcctctcccaactgagccagccgtacgccccaaagagcccggaacgaagcggaagggcctgggcgagggagtgccttccagccagagaggcccacgccggttgtccgcagagggaggagataaggctttgcacaaaatggggcctggaggtggaaaagcgaaagctctggggggagcagggtcaggatcaaagggcagtgctgggggcggctctaagcgccgtttgagtagcgaagactcctcgctggaacctgacctagcggagatgtctctggacgatagctccctggctcttggtgctgaagctagtaccttcgggggattccctgaatcacccccaccgtgtcctctccatggggggagtaggggacctagcactttcctgcccgagcctcctgacacctacgaggaggatggcggggtttatttcagtgagggccccgagcctccaaccgcctcagtagggcctccggggctacttccaggggacgtatgcacccaggatgatctgcctagtaccgacgaatcaggaaatggtctgcctaagactaaggaggccgcccctgccgtgggggaagaagatgatgactatcaggcatactaccttaacgctcaggacggcgccgggggggaggaagaaaaagccgaggggggtgctggtgaggagcatgatctgtttgctggtctgaagcccctggaacaagagtctagaatggaggtgttgtttgcctgtgccgaagcactccatgcccatggctacagctcagaggcctctaggttgacagttgaacttgcacaggacctgctagccaatccacctgatctaaagggcaagaagaataaagttagtacttctagacaaacctgggtcgctaccaatactctcagcaaggccgcttttctgctcactgtgctctccgagcgacctgaacatcacaacctcgccttccgggtggggatgttcgccctcgagctgcaacggccaccggccagcaccaaggccctggaggttaagcttgcctaccaggaaagtgaggttgcagccctgctcaaaaaaatcccattgggcccttccgaaatgtccaccatgaggtgccgtgctgaggagttgcgggaagggacactgtgcgactataggcccgttctgccactgatgctagctagtttcattttcgacgttctgtgcgcccccggctcaaggcctccttccaggaattggaactccgaaacccctggagatgaggagctgggctttgaagcagcagtggctgcgttggggatgaagaccactgtttctgaggccgaacaccccctgctgtgtgaaggcacccgcagggaaaagggggacttagctctggctctcatgattacttacaaagatgatcaggctaaactcaagaaaattttggacaaattgctcgatcgcgagtcccaaacgcacaagccccagacccttagctccttctactcctctagcaggcctacgactgccagccagcggtctcctagcaagcacggaggcccgagcgcccctggggcccttcagcccctaacttccgggtccgccggacccgcccagcctggaagcgttgccggggccggaccgggacctacggaaggcttcaccgagaaaaacgttcccgagtcgagcccacacagtccttgcgagggattgccctccgaagctgcgctcacccctcgcccagaggggaaggtcccatccaggctggccctcggaagcaggggaggttacaacggcagaggatggggaagtccaggtagaccaaagaagaagcacacgggaatggcttccattgactcttctgccccagaaacaactagcgatagctcaccaacactttcccgccgacccctgcgcgggggttgggctccaacaagctgggggcggggtcaagactctgacagcattagctcgagcagcagtgacagtctggggagttcctcatcttctggcagcaggcgggcatccgcctctgggggagctcgggcgaagaccgtcgaagttggacgatacaagggcagacggccagagagccatgccccccacgttcctaaccagccctccgaggctgctgcacacttttatttcgagctcgccaaaactgttctgatcaaggccgggggcaacagttctacctccatcttcacacacccttcatcatctggagggcatcagggaccacatcgcaacttgcacctatgtgcctttgaaataggactctacgcactgggactgcataatttcgtctcgcccaactggctaagccggacatactcatcccacgtctcctggataacggggcaagcaatggaaatcggatccgccgccctgactatcctggttgaatgttgggatggtcatctgaccccaccagaggtggccagtctggcagacagggcatctagagcacgcgattctaacatggtccgggccgcggccgagctcgctctgagctgcctgccacacgcccatgcgctgaaccctaatgagattcagcgggccctcgtgcaatgtaaggagcaagataacctcatgctagaaaaagcctgcatggccgtagaggaagccgccaagggcgggggtgtataccctgaagtactgttcgaagtcgctcaccagtggttttggttgtatgaacaaacagccgggggatcctccaccgcaagggagggcgccacttcttgcagcgcatcaggcattcgggctgggggagaagcaggtagaggcatgccagaaggccggggcggcccaggcacggagccggtcactgtggctgctgccgccgtgacagccgctgccactgtggtgcccgtaatttccgtggggagtagtctctacccaggccccgggttaggacacggacattcaccaggcctccacccctataccgccctgcaaccccacctgccatgtagtccacagtatttgacccaccccgcccatccggctcatcccatgccacatatgcccagaccagctgtgttccctgtaccaagcagcgcttatcctcaggtgcgccccgtgttctgttggggtgtgcggcatggtaagatcctgggaatccacagaggactggagtgggtgctctgggagtataactggtctgtcggcgaatcctggtag

SEQ ID NO: 32554 - DNA, 327 bp, Artificial Sequence
  Description of Artificial Sequence: Synthetic coding sequence
ccgagctgtgtcccggtgctgaagggagctcatgcggcggactcatctagatcaaaatggccagctctcatgggaaccggacggaagtccttcggggcttttctgtttcaccattctttttcctggggctggaaactcatcagcatctcttttggcgacctgaatcctttccctgtgaggcaaatacgaaaccggcgtgcctatcacttggagaaggtgaggctagaactcactgagttggaggccattcgagaggacttcctccacgaaagggacacctctccagataaaggagagctggtttccgacgaggaggaggacacttag

SEQ ID NO: 32555 - DNA, 3930 bp, Artificial Sequence
  Description of Artificial Sequence: Synthetic coding sequence
atgctgttaaatggagactgtccagaatctctgaaaaaagaggctgcagctgccgaaccaccacgcgagaacgggctggacgaggccggtcctggtgacgagacaaccggtcaagaagttatagtcatccaagacaccggcttctccgtgaaaattcttgcaccaggaatcgagcccttctcgctgcaggtctctcctcaggagatggttcaggagatacatcaggtgctgatggatcgtgaggatacgtgtcaccgtacctgcttttccttgcatctggacggaaacgtgctggaccacttctctgaactgcggagcgtggagggattacaggaaggctctgttctcagagtggtcgaagaaccgtacacggtccgtgaagctcgcatccacgtccgccacgtgagggacctgctcaagtctctcgacccaagcgatgctttcaatggcgtggactgtaattctctgagttttctgtcagtgtttaccgatggcgatctgggggattctggaaagaggaaaaaggggttggaaatggatcccatcgactgtacacccccagaatacattcttcctggtagccgcgagcggccgttgtgtccactgcagccgcaaaatcgcgactggaaaccacttcagtgtcttaaggtgctgaccatgagcggctggaaccctccacctggaaatcggaagatgcacggcgacctcatgtacttgttcgtcattacagctgaagatagacaggtatccattacggcatccactaggggattctacctgaatcaaagcaccgcctatcacttcaatccgaagcctgctagcccacggttcctttcgcattcccttgtcgagctgttaaatcagatctctccaacattcaagaaaaacttcgctgtgctgcaaaagaaacgcgtgcagcggcatccctttgaaaggatcgctacacctttccaggtatattcctggacggctcctcaggccgaacatgcaatggactgtgtccgggcagaggacgcttatacaagcagactagggtatgaggagcatatccccggtcagaccagggactggaatgaagagctacagaccacccgggaactccctcggaagaatcttccagaaaggttgttaagggaacgcgctatttttaaggtgcactccgatttcacagctgcagctacacggggcgccatggcagtgatcgacggaaatgtgatggcaatcaatcctagcgaagaaactaaaatgcagatgtttatttggaataatatcttttttagtttgggattcgatgtccgggaccactataaggacttcggaggagatgtcgctgcatacgtggccccgactaatgatttgaacggggtgcgcacctacaacgctgtggacgttgagggcttgtataccttagggaccgtggtcgtggactaccggggttacagggtgaccgctcaatctataattcctggcattctggaacgcgaccaagagcaatccgttatttatggctctatcgatttcggtaagactgtggtgagccacccaaggtaccttgagctgctggaaaggacttcaaggcccctcaagatcctgcggcaccaggtgcttaatgaccgagatgaagaggtggagctgtgttcttctgtggagtgcaaaggaattatcggtaatgacggaaggcattacatcctggatcttctgaggacctttcctcctgacctaaacttcctccccgtgcctggagaagagctaccagaagaatgcgcaagggctggctttccgcgcgctcatagacacaaactctgctgcctgcggcaggagctggttgacgcattcgttgaacaccggtatttactcttcatgaagctggcagccttacaactcatgcagcagaacgccagccagctggaaacacccagttcgctggagaacggcggcccatcctcactagaaagcaaatcagaagatccacccggtcaggaggcggggtccgaagaggaggggtctagtgctagtggtcttgccaaggtgaaagagctagcagagacaatcgccgctgacgatggaactgatcccaggagcagggaggtgatccgtaatgcgtgtaaagccgtcgggtctatcagctccaccgcatttgacatacgattcaatcctgacatcttttctccgggtgtgcgcttccccgaatcctgccaggacgaagttagggaccagaagcagttactgaaagacgctgccgcattcttgcttagttgtcagattcccggtctggtgaaagactgtatggaacacgctgtactcccagtcgacggggcaactctggccgaggtcatgagacagcgtggaatcaatatgaggtatctaggtaaggtcttagagcttgtccttagaagcccggctagacatcagctcgaccacgttttcaaaattggcatcggcgagttaattactagatctgctaaacatatctttaagacttacctgcagggggtggagttaagcggtctgagcgctgcaattagtcattttttgaactgcttcttgtcttcctatcccaacccagtggcccacctacctgctgatgagctggtatctaaaaaacgcaacaagaggaggaagaatagaccccccggtgctgcagataacaccgcatgggcggtgatgactccccaagagctatggaaaaacatctgccaagaggcaaagaactattttgactttgaccttgaatgcgagacagttgatcaggcggtggaaacatacgggctgcagaagattacactactccgagaaatctccttgaaaactgggattcaggtgctcctaaaggagtatagttttgacagtcgccacaagcccgcttttactgaagaggatgtccttaatatctttccagtcgttaagcatgtgaaccctaaggctagcgacgcattccacttcttccaaagtgggcaggccaaggtccagcagggctttcttaaggaagggtgcgagttgatcaacgaggctctaaacctatttaacaacgtatacggtgcaatgcacgttgagacatgcgcctgccttcgcttgctggcacgcctgcactacataatgggagattacgcggaagcattgtccaaccaacagaaggcagtgcttatgtcagagagagtgatggggacagagcaccctaatacaattcaggagtacatgcacttggccctgtactgtttcgcttcctcacaactatccactgctttaagtctcctctatcgggcccggtatcttatgctacttgtttttggggaggatcacccagagatggccctgctggacaataatatcggcctggttttgcatggtgtgatggagtacgacctcagtctgagatttctggaaaacgccttggccgtttctacaaagtaccatgggcctaaggccctcaaggtcgctctatctcaccaccttgtcgccagagtgtatgaaagcaaggccgaatttcgctctgcccttcaacacgaaaaagaaggatacacaatttacaagacgcagttgggtgaggaccacgagaagactaaagagagcagcgagtatttaaagtgtctgacacagcaagccgtggcccttcagcggacaatgaatgagatataccgtaacggttcctctgctaacattccacctttaaagttcaccgcgccgagcatggcaagtgtcctcgagcagttgaacgtgatcaatggcatcctcttcatccccctatcacagaaggatctagaaaacctaaaggccgaagtggcgcgcaggcaccaactgcaagaagcctctagaaatcgtgaccgcgctgaagagccgatggcgacagagcctgcccccgcaggagcccctggggacctcgggtcccaacccccagctgccaaggatccatctccatctgtccaaggttag

SEQ ID NO: 32556 - DNA, 459 bp, Artificial Sequence
  Description of Artificial Sequence: Synthetic coding sequence
gaaggctcgatggatagcctctacgagcccatccccgaacagcaggctaaccaggaaaatatgagcagcaggaccgattccccaattccccctttcggggaaagcgagcagacacctaacaatctcttcgtgggtgtttcgaacttggagaacgccaagccaaagaagcgaaagctgttccgccgttttatgagcgagaacaaaatcttcgagggcaagaccgtcaatgacaaaatctggcaggagcacagtaagcacaaaaatgattctcatattaggagaccctgtcaattgaaagatctgaacgaaaacgattttctaagcaacaacatccacacttatcagggcaagacgcttcagggcacttcgtaccaggtgacttccgagtgttggtccccatttcactaccagcgtcatgttgagaccaccgtggatgagttggcacaggagttcatgtag

SEQ ID NO: 32557 - DNA, 840 bp, Artificial Sequence
  Description of Artificial Sequence: Synthetic coding sequence
atgcctcaggaagaactacacatgaaagaatgcccccatctgaagccaacgcccagccagtgttgtggccaccgactggcagcggaccgagtgcatgactctcatcctactaacatgaccccccagcatccaaagacacatcccgaatcttgcagctactgcaggttgagctgggcttcacttgtgcatgggggaggcgctttacagccaatcgaaacactgaagaaacaaattagtgaggatcggaaacagcagctgatgctgcagaagatggagctagagatcgagaaggagagactccaacacctcttggctcaacaggaaaccaaactcttgctcaagcagcagcagctgcaccagtcccgtttagattataactggctcaaggctcaggccctatttaagtcccgcgagttggtggccgagaagcaactcaccaagcctcaggaactcaagctcgacatgaacggctcagatagcggcccctctctcttaaagagcaactgcgacggctggttgctcgggactagcagctccattaaaaagcaccaggaccccccaaattccggcgagaatcgcaaagaacgcaaaacagttgggttccactcgcacatgaaggacgacgctcagtggtcttgtcagaagaaagatacgtgccgcccacagcggggaacagtgaccggggtcagaaaagacgcgagtacaagccccatgcctacaggcagcctgaaagactttgtcactacagccagcccaagcctccagcacactacgagcaggcctggaatcagtaccaagatctgtttcctgtcaaatcactttttcattttgttttcctag

SEQ ID NO: 32558 - DNA, 399 bp, Artificial Sequence
  Description of Artificial Sequence: Synthetic coding sequence
atgtcttttgaatatcggcattacaaacgggaggcaaaaatttgtacctgtcgggggggatgggctcacgtgcttttatgcatcggggtatcacagggcgcctgcgctgaacacctgccacaccggcccgccgtcgagaaagacgtgccaggtgctggagaggtactgttcatgtgcagctggaggatctttcctgtggcctctgcatccccctcaagcagcattagcggcctggccggccactctgtgtttctggtacctggcttggccgctcacccggggtcccattctgatcagccacccggcgtaccttcccgtcggaagtctagattggaacggtggtccccctcagtctcgagatctacaagcccgcccacagaggccccattctgtctgtag

SEQ ID NO: 32559 - DNA, 1254 bp, Artificial Sequence
  Description of Artificial Sequence: Synthetic coding sequence
atgaaggctctggtccctgtgaccagctctggcacatggtattgtctggagcgtagacccgccgtcttcgtaacctcaagtgtgtcaagccctgtgaaattcacccacgacatcagcgttaccggaaacggaattgtgctcccaccaaagcccaaatcaaaagtgaagtggtgtcattttagcaccctccccaagccgaaaccccagctgtcacgcagctttgaaaagggcgacgatttcagcggcaagaaattctgtattctaacagctataaagcccacaaacctggagaaagaaaagctgcggtttttcaagagtgattacacgtataacccccagttcgaatatgcaaatcccgcactgccgtctgtcctggcaaagcacagccacgcctctgaccgattcctcaaacaaagtatcaacataatggaacttaccttacaaaaatacgggtcttatgaaaagtttgagcaagccaccggtggatcactattgtctaaaacgcgtatatggtcccacgtacgcaagtatatgatgaaagaaggttgcttaggcgagatagtggtacacctgactgaagatttgttatcgcgagcaagcatgaccgtggtaaacggttgccccactctgactattaacgtcagcaccgctagagagcattggcttgagggaatgctacgtcacgagattggtacccactactttcgcggtattaacaatctccagcaaccatggaacagttggacgggcagaaaaaagcacgaactgaaaccaaataaccctaccgaagagggactcgcatcaattcattcagtgctgtttagaaaggatcctttcctatggcgtgccgccctgctctactacacagtttatcaggccagccaaatgagcttctgtgaactgttcaaggacatcggccggtttgtgaaggatcccaatacgcggtgggattactgcgtaagagcaaaacggggatggacagacactagccagcctggttgcttctccaaagaccaggtctacctggatggcatactgcaaatactccggtatcgggatactatcgatttccacctcctgaccgccttgggcaaggtctcgtacgaagacgtcgacaggttaaagggcttagcggtgaccgagaatatgagagtacctcacttcttgcaggaccacggccgatatatggaacaccttgaaaaaatcatggaagtcaacgaactcaccgacagggagctgaaggacttaatttag

SEQ ID NO: 32560 - DNA, 627 bp, Artificial Sequence
  Description of Artificial Sequence: Synthetic coding sequence
ataacgccaaccccaccacccccccccagatcacgagagaaggaaagtccccgggtggccgctagggtcgtggtgccagtgcgttcgcgcgagcgtgttctgacgtccatgggattgacaggcgtcgagggtcgaggatgccggtactccggatgcaagatgtggccagtccgggcagtgtccatcttctccacactcataggccgccgcctcgcttggagaagggggtctgaaggaggcactgcatgcactaaggggctcgtgctgccagccggcgatgagcccggccctggccccgaactcttccctgagagcgccctggtccaggccgggtccgctcctccaccccctcctcctcctccccctccccctctgtgtttactgttgctccgcgccgagagcgagggagccgttctgatgactcacccccgggcatgggagcaacgcggagggggtctccgtgaggcccgtggtgggctgggcgcagcacgctccccccgagaacaggaacaacgagaagaggaagagctggcacgtagacccagggctccgtccgccccctccagacgcctcgaacctgacgcaagcaatccaggctggcctgccgcggagccttggcccggctag

SEQ ID NO: 32561 - DNA, 537 bp, Artificial Sequence
  Description of Artificial Sequence: Synthetic coding sequence
atggtgagtcagagtacagtcagacaggactcccccgtggagccctgggaagggatcagtgaccactctgggatcattgatggctccccccggttactgaataccgatcacccaccctgccagctggacatacggttgatgcggcataaagccgtctggatcaacccccaggatgtgcagcagcaacctcaagatctacaaagccaggtgcctgccgcaggcaactctggtacccacttcgtgacggacgctgcctctccgagcggacctagccccagttgcttaggtgacagtctggcggaaaccacattgtctgaagataccactgactccgtgggttctgcatctcctcacggaagtagcgagaagtcgtcttcattcagtctgtcgagcacagaggttcacatggtgcgcccaggttactctcaccgagttagtcttcctacatccccaggaattttagcaacatctccctacccagaaactgactcggccttcttcgaaccttcccacctcacttcggcggctgatgaatag

SEQ ID NO: 32562 - DNA, 207 bp, Artificial Sequence
  Description of Artificial Sequence: Synthetic coding sequence
gtggctgcagtcactgagcgcacaagcgggaatcttagcgcctcatcggtcaaatgtgaccataaatatcgagtgcccggcagtgcccgggatcgtagccactacgtggaccgagcaggcctcaagcttctggcctcttcatctccgccagctgcaacaagtcagcagcattggaacgacagacgtacacccttgaacatccattag

SEQ ID NO: 32563 - DNA, 1554 bp, Artificial Sequence
  Description of Artificial Sequence: Synthetic coding sequence
atgcttgaatcaatcagagtcaccgaaaaacttcactggccagagcaggaacttgccaaaaagtcaatccttaatgcagaggatagcctcatcattgataacaaaagaagcatctcccacctctcttccggagtcctgaaagacatttttaccacaggcaccagctcctacaacgtgctgcttcagagtaaggaggagaagaaataccattcgcagaagcagagttcttctacatactccaaaaggtgcaggaaaccttcaaagtccccgaacacctcccggagtaaggatcctcggaggatgaaagccctcgtgcctgtcacctcttcagggacttggtactgtctggagcgaagaccagctgtcttcgtaacatcaagcgtttcttcgccggtcaagtttacccatgatatatcagtgacgggaaatgggattgttcttcccccgaagcctaagagtaaagtgaaatggtgccatttctccacactgccaaagcccaaaccacagctgtccagaagcttcgagaaaggagacgacttctcaggcaagaagttttgtattctcacagccattaagccaacgaacttggagaaagaaaaactccgcttctttaagagcgactatacgtataacccacagtttgagtacgccaacccagccctcccctccgtcctggcaaagcactcacatgctagcgaccggtttctcaagcagtctataaacataatggaactcaccctgcagaagtacggttcctatgaaaagttcgagcaggcaacaggaggctccctcctcagcaaaactagaatatggagtcatgtgagaaaatatatgatgaaagagggatgcctaggggagatcgtagtgcacctgaccgaggatttactttccagagcaagcatgaccgtggtaaacggatgtcctacacttactatcaatgtttccactgcacgggagcattggctcgagggcatgttgagacacgagatcggcacccattattttcgagggatcaataacctccaacagccctggaatagctggaccgggcggaaaaagcacgaactgaagcccaacaaccccactgaggaagggctggcttctattcatagcgttctgttccgtaaggaccctttcctctggagagcggcattgctatactatacagtgtaccaagcctcacagatgtcattctgtgagctgtttaaagatataggcagattcgtgaaagatcccaatacacgctgggattactgcgtgcgcgctaaacgaggctggaccgatacatctcagccaggatgcttcagcaaagaccaggtgtacctggatggcatacttcaaattctgcgctaccgtgataccatagacttccatctgttaaccgccttgggaaaggtgagctatgaggatgttgataggttgaaggggctggccgtgaccgagaatatgagagtgccacactttctccaagaccacgggcgctatatggagcatctggagaagatcatggaagtcaatgagctcaccgatcgcgagctaaaggacctgatatag

SEQ ID NO: 32564 - DNA, 438 bp, Artificial Sequence
  Description of Artificial Sequence: Synthetic coding sequence
ggcgagagtgaggacgtcactcaattcctgcagagccataagaagactctgacaaacgaaaagctttttctgatggatggcaagcgcacctggtttctggagatggagtcaacaccgggcgaagacgcaatgaataccgttaaaatgaccacaaaagacctcaagtacgataggagtctaatcgataaggcaggatttgaacggactgactccaattttgagcggtcacacaccgtgggcaagatgctgtcaaatagtattatgtgttacagggatatcttttatgagagggaatcccagctcatgcagcagaccagcctcctcagttatgaaattgctatagcgacaccgaccttcagcaattactaccctgactggtcggcccccattaatattgtcgctcggccatctacctcaaagaaaatcatgacgtgctag

SEQ ID NO: 32565 - DNA, 1695 bp, Artificial Sequence
  Description of Artificial Sequence: Synthetic coding sequence
atgctcatgtggcctcaacctcacctccctacccaccctcatctacccactcacccacacctccccacccacccacacctccctacccaccctatgatgagtaaggaaactagacagagcaagctagcggaggcgaaagaacagttgacggatcaccacccccaaacaaatccctccgtgggaaccgcggcaagtgacactaagaagaagaagattaacaatggcaccaaccctgaaacgactacttcaggcgggtgccattcccctgaggacgaacagaaagccagtcaccagcatcaggaggcactgcgaagagagctcgaagctcaggtccacactattagaatccttacatgtcagaagacggagctgcaaatggcactgtattattctcagcacgctgtgaaacagctggagggggaagctcgcgacctcattagccgactgcacgactcttggaagtttgccggagagctcgagcaggcactctccgcagttgctacccagaagaagaaagcagataggtacatcgaggagttgacaaaagagagagacgcactgagcctcgagctgtatcggaataccatcacggacgaagagctgaaggagaagaatgccaagttgcaggagaagctccagctggttgagtccgagaagagcgagatacaactgaacgtgaaagaattaaagcgaaagcttgagcgggcaaagctactgctgccacagcagcagttgcaggctgaagcagatcacttgggtaaggaattgcagtctgtgtcggctaagctacaagcacaagtggaagagaatgaactgtggaatcgcttgaaccagcagcaggaggaaaaaatgtggcggcaggaggaaaaaatccaagagcgagaggaaaaaatccaggagcaggaagagaagatcagggagcaggaagaaaagatgaggaggcaggaagaaatgatgtgggagaaggaggagaagatgcgcaggcaggaagagatgatgtgggagaaggaggagaagatccgggaactcgaggaaaaaatgcacgagcaagagaaaatccgggaacaggaggaaaaacggcaggaagaagagaaaatcagggagcaggagaaacgtcaggagcaagaagctaagatgtggcggcaagaggagaaaattcgcgaacaggaggagaagatccgcgaacaggaagaaatgatgcaggagcaagaagaaaagatgggggaacaggaagagaagatgtgggaacaagaggaggaaatgcaggagcaggaggagaaaatgcgccgccaggaggagaagatacgcgagcaggagaaaaaaatcagagagcaggaggagaaaattcgagaacaagaagagatgatgcaggagcaggaggagaagatgggtgaacaggaaggaaaaatgtgtgagcaggaggccaagatgcaggagcaagaggagaagatgcgcagacaggaagaaaaaattcgggagcaggaaaaaaagatacgtgagcaagaagagaagattcgcgagcaagaggagatgatgcaagaacaggaagagaagatgtgggagcaggaagaaaaaatgtgtgaacaggaggaaaaaatgcaggaacaggaggaaaagatgagaagacaggaggagaagatgagagagcaggaagtgagactgagacagcaagaggagaagatgcaggaacattag

SEQ ID NO: 32566 - DNA, 744 bp, Artificial Sequence
  Description of Artificial Sequence: Synthetic coding sequence
ggcatcgtgggagggcataatgcccccccaggcaagtggccatggcaagtgagcctcagagtttattcatatcactgggcctcctgggctcacatttgcggaggctccctcatccatcctcagtgggtcctgaccgccgcgcactgtattttttggaaggatacagaccctagtatatatcggatccatgcgggggatgtttacttgtatggtggccgagggctgttgaacgtgtctcgcattattgttcatcccaactacgttactgccggcttaggagccgacgtggctcttctccagcttgaaccacacgacctcagcaacgttagaacagtaaagctgtcgccagtgtcattggaattgactcctaaggaccagtgttgggtcaccgggtggggcgccattaggatgaaagagtctcttcctcctccctaccgactccagcaggcgtctgtgcaggtactggagaatgctgtgtgcgaacagccgtaccgaaacgcaagcggacacacaggggatcgacagctgatcctggacgacatgctatgtgctgggagtgaaggaagggacagctgttatggggacagcgggggtcccttggtgtgcaggctgaggggaagctggagactggtgggagtggtcagctggggctacggatgcactctgcgagactttccaggtgtgtatacacacgtgcagatttatgtcctttggatactgcagcaggtgggcgagttgccctag

SEQ ID NO: 32567 - DNA, 540 bp, Artificial Sequence
  Description of Artificial Sequence: Synthetic coding sequence
atgggctcatggcattgggaatggtacggagctcctaccagtactttgagcctgggctgcttactcttgcctggtgagaaatggaccttcctcattctgccttcccattacgggaccactacccatgcacactctctgcaggggtgcgtggaaaggcagtggcaggattcaaaacaattggctataagtccgggccccacattactgaggagcgagtacgtcggtagcctcagtccagtctgttcctcgctgacccaggttcaccgcgtcccatggggccaacatagagcgtgtccagtcatgctgcttgtttttactaaatggctgcaaagatacctgcactttgaaaagcccgcagagccagcctctgtggggcaagatccagacttcttcggaaaatctgaaggtgagcgggcaacctgcctgctgagcaggtcttgcctgtatctcgcatctgtatgcaatctgcgggagaacgatagctgcatgggtaggagcggggggacaggaaagtcagatctccccggaagctgccgttag

SEQ ID NO: 32568 - DNA, 84 bp, Artificial Sequence
  Description of Artificial Sequence: Synthetic coding sequence
tttcccagcttcgacatctcttttttcctgttcatatacctgtttaacagttcccattcacctgatagggtgagcctgtgctag

SEQ ID NO: 32569 - DNA, 1161 bp, Artificial Sequence
  Description of Artificial Sequence: Synthetic coding sequence
atgggtgtcggctgtttcaaagatgacagaatcgtgttctggacttggatgttctcaacatacttcatggagaagtgggccccacgacaggacgacatgttattttatgtgaggaggaagctggcctattctggcagtgagagtggagctgacgggcgtaaggccgctgagcctgaagtggaggtggaggtgtaccgccgcgactctaagaagctccccgggttaggggacccagacatcgactgggaagaaagcgtatgccttaacctgatactgcagaaattagactacatggtaacatgtgccgtttgcacgagggcggatggtggcgacattcacatccataagaaaaaatcccagcaagtctttgcctctccttcaaagcatccaatggatagcaaaggggaagagtctaaaatttcataccccaatatcttcttcatgattgactctttcgaggaagtttttagcgatatgacggtcggtgagggcgagatggtttgcgtcgagctagttgcatcagataaaactaacaccttccaaggggtgattttccaaggctccattcggtacgaggctctaaagaaggtctacgataatagggtttctgtcgcagcgcggatggcgcagaagatgagcttcggtttttacaaatatagtaacatggagtttgtgagaatgaagggcccacagggcaagggccatgcagagatggctgtttccagggtttccactggtgatacgagcccatgtggcaccgaggaggacagcagtcccgcttcacctatgcatgagagggtaacctcttttagcaccccccctacccctgaacgaaacaacaggccagcttttttttcccccagcttgaaacgaaaagtacctcgtaaccgcatcgcagagatgaagaaatcgcactctgccaacgattctgaggagtttttccgcgaggatgacggtggggcggatctgcacaacgcaacgaacctgagaagcaggtccctgtccggaactggccggagcttggtgggaagctggctcaagctcaatcgcgctgatggcaatttcttgctgtacgcccacctgacgtacgtgacactgcctcttcatcgcattctcacggacatcctggaggtgcgacaaaagcccattctgatgacatag

SEQ ID NO: 32570 - DNA, 393 bp, Artificial Sequence
  Description of Artificial Sequence: Synthetic coding sequence
tggaaaccccagcactccttcttctttctgctgctcctctggctacctgatacaacgggggagatcgtaatgacacaatcacctgctactctgtccctgagcccaggggagcgcgccacattgagttgccgcgcttcccaatcagtgtccagcagctatttgagctggtatcagcagaaaccggggcaggcaccgagactgctgatttatggcgcatccacaagagccacaggtattcctgctcggttctctggcagcggtagtggaaccgattttacgctgacaatctcttccctgcagccggaggacttcgccgtctattattgccaacaagattataacctccctcctactgtgatacagcacgagacgaagacttcaactcggccatag

SEQ ID NO: 32571 - DNA, 696 bp, Artificial Sequence
  Description of Artificial Sequence: Synthetic coding sequence
atggctaagtgggtacccgctctcctgctcagaagggtccctctcttttcactgagatttcggcccgcttcctccacttttcttcctgtgctggcggccaccgaacccgcagtttctgtgccctcaggcgatctctccatgcccgtcaagactcgagcagagggggaggatgatggatttggcgaggccggcgatccacggcgcttgctagaaaggccatggcgattcaggggatgcctaccgggtaaaggcaatagggatgtcggcttcgagggaaccgagggaccgacgtcgactaggcccgagtgggtgtggtcatgcaggtgctgcctcgggtgtcgcgcttctacccgggagcgggtgacctccccagtccgggccgctggccctcagcctaggtttacagacagggaaacggaagcagctgcagggaccctggctcacatgggctttgccccccccacttccttctcccatttcacagatcaggaactgcgcgactgctcctcactggagtgcctgggtgttgtcgaaggagatccccacgttctctgctcaacactgtctctttcacgacctagtcctagcgctaccctcaccttgctgctcgccagttcttgcctgctcgcccccgccccaccttcttttatcctcttactgttcaccttgattgccccggacttgccccacagctag

SEQ ID NO: 32572 - DNA, 276 bp, Artificial Sequence
  Description of Artificial Sequence: Synthetic coding sequence
atggaaattgcacattacgcaaaggtgttcacagccgacggccatctagggtgctatattctcgctacgatgaattaccattccgcaaagcattgcggaagctgcctccagagccagctctgcaaacgcttgaaacaagaagatagactcagcccaggctttcaagggcagctcggccagcatagcgagacctcaagccttaagacagtcatcggacccctggcgcccagctgtcacctggcagatatgaagaactggagatggcaacagtggtag

SEQ ID NO: 32573 - DNA, 492 bp, Artificial Sequence
  Description of Artificial Sequence: Synthetic coding sequence
atgtgcaccgttggcggaaacgtgtccgaggacgcatgctacggcgaacccctggaattccccgaaaacaccaaaaacagagctaccctgggaagctcttctcccacggcagggcacacaccccagaggaaagagattagaatctcaaaaatgtatctccacatccctattcactgctccactacatataatgggcgtgacctcgaatcgacaagtgttccaatcaaccgcaggactgacaagaagaacgtcgtacggagacactccggatactgttcagccagggaggaacggaatccggtcatttcagccgcctggatgtctcttgaggaactcggaaaatctgctcgttgtcggaagaccaatacaccaggctcccatacctctgtcggggctaagaaggccgagttgaaggcagttgtgatggactgctggttacccgagtccggggagggtgtgcgggttcgagcccgccgcgaaaacaaattgtag

SEQ ID NO: 32574 - DNA, 489 bp, Artificial Sequence
  Description of Artificial Sequence: Synthetic coding sequence
cacaaaaacacctacatccggacttatatacatatttgtgtgtacattagaacctacatacacatatgcgtttacgcatatgtgtatacatacatgtgcgtatgcgtcagaatctacatatacgtgtgcatgcgcacatacatccacatttgcgtctatgcttacgtgtacaaatacatgtgcgtgtgcgtacggatttatattcacacgtgtatgtacatatatacttatatctgcatgtacataatgtgcatctatgtgcgtacttacatctatgtttacatctgcacctgtatccacatatgcgtgtacatgtatgtccatatttatggctacatatgtacttacatccacaggtacggctatatttgcacttatatccatatatacgtttacacgtgtaaatatatccacatatacgggtacacatgtatgtacatccacatctacggttatacctacatgtatatgtacgtttgcatcttttag

SEQ ID NO: 32575 - DNA, 345 bp, Artificial Sequence
  Description of Artificial Sequence: Synthetic coding sequence
gtgctctgtctgttctttttcttttttcttcgcagatctttggctctcctaccacgcctggagtgcagcggcgctatatgggcccattgtaagctttgccttcctggatcccgacattcacctgcctcaccttcacgggttgccggtacaaccggtacctgccatcacgcacagttaatcttcgtgtttcttgtggagacaggttttcaccatatcggtcaagccggattggaactgctgactagcggtgatccacctgccctcgccagtcagtctgcaggaataacaggaatgtcacaccgggcccagcctatgtgggacctgtctggtctgattagattatag

SEQ ID NO: 32576 - DNA, 273 bp, Artificial Sequence
  Description of Artificial Sequence: Synthetic coding sequence
gggggggccaaggaggagccgaaacgaaggtctgctcggctgtccgccaaacccccagccaaagtggaagccaagccaaagaaggccgccgccaaagataaaagcagcgataaaaaggttcagacgaaaggaaagcggggagctaagggaaaacaaacagaagtagctaaccaagaaaccaaagaagacctacctgccgagaatggtgaaacaaaaaccgaagagtctcctgcttcagacgaggcgggtgagaaggaagctaaatctgactag

SEQ ID NO: 32577 - DNA, 1026 bp, Artificial Sequence
  Description of Artificial Sequence: Synthetic coding sequence
taagctgaaagattcgtgcccgctctgtccctcggagattggccccggtctcccctcgccccgcgctgttgggcaagacccggacctgtatcatttccgggactgagattctccccaggcacggcagctttaagtgctcccgccactccctcacctggttcaccactgaggcctcgcgcctctccgcagcctcccgctgggggcccaggccccggctcggcaggaggagaccctgccccaggcggcgcaggcccgatggagctcatgtttgctgaatgggaagacggagagcgcttctccttcgaggattccgataggtttgaagaggacagtctgtgtagctttatctcagaagctgagtcgctgtgtcagaattggcgggggtggcggaagcaaagtgccggacccaattctccaacaggaggcggcgggggtggaggaagtggtggaacgcgaatgagggacgggcttgtgattccgttagtggaactgagtgcgaaacaggtggccttccatatccctttcgaagtagtcgagaaagtgtatcctcccgtaccagagcaacttcagctgcgcatcgccttctggtcgttcccagagaatgaggaggatatacgactgtacagttgtctggctaatggctcggctgatgaattccagcgaggggatcaactgtttcggatgagagccgtcaaagatcctctgcagataggatttcatctttcagcgactgtggtgcccccccagatggtacctccgaagggtgcatacaacgtggctgtgatgttcgaccgttgcagggtgacatcttgctcatgcacgtgcggggctggtgctaaatggtgtacccacgtagtcgctctctgtttgttccggattcataacgcatctgccgtgtgtctgagggcaccagtgagtgagagtcttagccgactgcagcgtgaccaactccaaaaatttgctcaataccttatctcagaactccctcagcaggtgggcgaggtaggcaccccgtcgtgcaattag

SEQ ID NO: 32578 - DNA, 426 bp, Artificial Sequence
  Description of Artificial Sequence: Synthetic coding sequence
atgctgcacagcatgcggttcctgaggactgattctgcctccgccgatccaggaaatcttaagtattcttcatcccgggacagaggcgggagcagttcctacggtctgcagccttccaattcagctgtggtaagtcgacaaagacacgacgatacgagggtgcatgcagacattcaaaacgatgagaaaggtggctattcagtgaatggcggtagtggtgagaacacctatgggcgtaagtccctcggccaggaactgagagtgaacaatgtgacaagtcccgagtttacatcggtgcagcacggtagcagagccctcgccaccaaggatatgcgcaagtcccaagagaggagtatgtcctactgcgacgaatccaggctgagcaatctgctccggcgtatcactcgagaggatgacagggactag

SEQ ID NO: 32579 - DNA, 321 bp, Artificial Sequence
  Description of Artificial Sequence: Synthetic coding sequence
ctagagtgtagtggcagaatctccgcacactgcaacctgcatttgcttgggtctagcgactcacctacttccgcttctcaggtggttgagataactggcacataccatcatgtgtccctgaacttcgtattcctggttcagatgggcttcaatcacgtggtgcaggcgggcttggagctgctgacctcgggaaacccgccatcgtcagccagccaatcagcagggatcaccggggtgtctcaccacgcctggccctttccgtttaacttcgcggagcggcaaggcctgaccatgctccccagactggtgtcgaattcttag

SEQ ID NO: 32580 - DNA, 324 bp, Artificial Sequence
  Description of Artificial Sequence: Synthetic coding sequence
atgggacgggatgctacacggattggcgagcgcctgcagggcgaaggtaacttccagttgaacttcgtgacgatctcctccaaactgaaagtgagttggaccgagagcggaaagggcgtcacacaagagagaaggtactctactgagactggagccgggggagaggcgcagattctgaaggccgcatgttttctgagtggggaagcctggagcttacgtcaggttttttctcctgcccaccggctcccaggcaataagctatccgccattggagtccactcggagtctgaaactagcctctccggttgcgtgggcgccggctag

SEQ ID NO: 32581 - DNA, 354 bp, Artificial Sequence
  Description of Artificial Sequence: Synthetic coding sequence
tgagctgggcgcagagggcgtactacaccccagacgctcgaatttccaggcgcccagaccctggccataagccgcggatgtcggtgcgccagtcctcgacgaggacggggaggctggtggtcactgacggcgagagtgctttatattaccaacaaggccggcacctttcccttcctgctgggcaaatatttggaagagaagctcttggggaactgggttgaaaccagattccgccacatcgactgggccggattggagctccttagttctagtaacagaccctcgctgaccagtcaaagtgcccggataacgggggtcaaccatagggccaggccctatttcctgtctaaatag

SEQ ID NO: 32582 - DNA, 240 bp, Artificial Sequence
  Description of Artificial Sequence: Synthetic coding sequence
atgaaattggctaagaccgctgtcctcgatccagcaacgtataccagttttagccctgggctcagcacctgctcgtcttcccagccaccgggcgaccgtcgtaaaggactgctcggttgtgtgggctctggccattgtcctctacccacgccggctcagttccccaaagttcaacgtccccccactcttctcgggggaaagaacacctccactcagaccacacttcaccccgtgatatag

SEQ ID NO: 32583 - DNA, 783 bp, Artificial Sequence
  Description of Artificial Sequence: Synthetic coding sequence
gtatgtggctccacacaggaaaaaaccgttttccgccttgaggcaatgctggaaagaaccgccggagtgcagtctaaggaggccgcgctggaggaggaggcagtgttaaaagtggaggacattatggccgaggtggaagtggtcgtagaggtggagcctgacgtaggctggcagaaagaggggcagagggcgcagcccggaccaggaccaagtacacctggcccttccatggattcacttgaggtcctgcacctggagttgggttctgtgaacgctccgggccaccgggctactaacaagcagaagaagaagaaggagagaaaggaaaatcccaatctgtggaaaccagggtccacattgcaaaaaccaccgcagctgtggcgctgtttgctggcgcgacagaatgaaatgagtgcttgggtaggaaagcatgctgaggtgctcctgtgctacgtgatggacctccaggtggaggagctgtcccatcccgggtaccgctggcaaatgatctcttttcaccctaacctctatttccatagtgagattattatgaaagagcactgcgtgggtatcctaggctaccgagtctctcactcgacagccgtgcagcggttctgggatcatgagggccaagcgtcatcttgcagacaatacactagctacctgtcgtctttcagttgtctcgccgagcatgattgtccaggctttggcaggatcgccgaatcaactcgaagttctgcacgcgcctgcggctccatcttctgttctacgactcaggggtag

SEQ ID NO: 32584 - DNA, 288 bp, Artificial Sequence
  Description of Artificial Sequence: Synthetic coding sequence
tcacttcctgaggccctggtgcagccgggcgggagccttcgcttgtcttgcgccgcaagcggctttacatgctccaacgcatggatgagctgggtgcggcaggcacccggcaaaggcctcgaatgggtcggccggatcaaatccaaggcaaacgggggcactacggactatgccgcgcctgtcaagggaaggtttaccatttctagagtggatagcaagaataccctgtacctgcagatgaattccctgaaaacggaggacactgccgtttactattgcacaacttag

SEQ ID NO: 32585 - DNA, 657 bp, Artificial Sequence
  Description of Artificial Sequence: Synthetic coding sequence
tgacacgtcgtggctctgtgcttgttccggattcataatgcttcggctgtttgtctgagagcccctgtctctgagtctctgtcccgactgcagcgcgaccagctgcagaagtttgctcagtatctcatctcagaactacctcagcagatcttgccaactgctcagagactgctcgacgagctcttgagcagtcagagcaccgcaattaataccgtctgcggagctccagatcccactgccggtccctccgcctccgaccaatcgacctggtatctggacgaatccactttgactgataatataaagaaaacattgcacaagttctgcggcccatctcccgtagtcttctctgacgtgaactccatgtatctgtccagcaccgagccaccagccgctgcggagtgggcctgcttgctgagaccactgaggggcagagaacctgaaggcgtgtggaatctgctcagcattgttcgcgaaatgtttaaaagacgcgactctaatgccgcgcctttacttgaaatattgacagaccagtgcctgacttatgaacagataacaggttggtggtatagtgttagaacctctgcatctcatagctcagcatcaggccacacgggcaggtctaatggacagtcggaagtggccgcacacgcatag

SEQ ID NO: 32586 - DNA, 120 bp, Artificial Sequence
  Description of Artificial Sequence: Synthetic coding sequence
cagaaaggcggcgtggagggaaaatggcaggccgatgcagtgctgtcttggtgccccctggcctttgcagttgtgccctccaaacaactttcggagctctggtacatttgttcagactag

SEQ ID NO: 32587 - DNA, 2157 bp, Artificial Sequence
  Description of Artificial Sequence: Synthetic coding sequence
atgtctcgaggctacagtgagaacaataattttctgaataataataaccaaatggtgctggacatgatcctctatccacttattgggattcctcaaactataaattgggagacaatcgctaggcttgttcccggcctgactccaaaagagtgcgcgaagcggtttgacgagctgaaaagctctgggtccagccccgtcgataatcagtataactcccttatggcagctggtgagtcacctgtggagactcttgctacctacatcaaatcctcgctgctggatattcacggcgagtttcaggagacgccggttggccatgatgcagttagtaagactgggcgccactcaatagcttccaccagaaactgctcctccgagtcagaaaactgtaccacacacaatggtggggagatgactgaggaatcagaggggcctaatatggttatccacgtgtgtgacgaggcaaagaatctgaaagaggattttacttgtccacgggatctgttaatctccgagatgaagtactttgctgaatacctgagtatggacgcccagcgctgggaggaagtggacatatcagtgcactgtgacgttcatatattcaattggctcatcaaatacatcaagcggaacacaaaagagaataaagactgcgaaatgccaactttggaaccggggaacgttatcagcatcctgatttcaagtgagtttctgaagatggacagtttggtcgaacaatgtattcagtattgtcataaaaacatgaacgccatcgtggccacaccctgtaacatgaattgtatcaacgctaacttactgactcgcatcgcagatctgtttagtcataatgaagtcgacgacctcaaagataaaaaggataagttcaaaagcaaactcttctgcaagaagattgagcgtttgttcgatccggagtacctgaacccggattcacgatctaatgccgctaccttatacagatgttgtctgtgtaaaaagctactgactaaggagaccgagcgtagaataccttgcataccgggaaaaattaacgtcgataggcgtggcaatattgtttacatccacatccgggacaaaacttgggacgtgcatgagtacctgaatagtctgtttgaagagctgaagagttggagagatgtctattggagactgtgggggacaataaactggctgacctgttccagatgctaccaagcattcctgtgcatcgagtttagccactgccagtaccacagtgaaactgtggtctatcccactgccgcttcatcactcaataccgtcggtacaggtatttatccatgctgcaatcaaaaggttcttcgattcgatcctacacagcttaccaagggctgtaaggtcagagaccatatggtaactttgcgggatcagggggagggcggagatttgcctagctgtccaacggccaggatgctggacgacctccacaagtacagggacgtgattgttgtccccttctctaaggacacagtgtctgatgtcggggtgggactctgtgacgaaaagggcattgagtgcgacgtgcttttggaacctaacaccccctggggccccaaaactggcgagttaaatgcttttctctctctgaagaactggaccctgcaactgaaacagcagtcactgtttagcgaagaggaggaatatactaccggttctgaggtgaccgaagacgaagttggggacgaagaggaggtgtccaaaaaacagaggaaaaaggagaaacccaagaagttcacccgacagccaaaaaaacaggtgtccagcccatgtgcccaacgcaaggagaaggctcttgaaaagtccgcctcacgggacgtgagtccctttgtgatgtctatgcaaaagaataagtgggatgcgactcgttccctgcgcttcaaccaggacgctcaacgggaagacgaccagcgcaggatgaccgagatcaccgggcacttgatcaaaatgcgactcggcgacctcgatcgcgtgaagagcaaagaggctaaggaattcgccggtggaatctacagtcgactggaagcacaaataaaagccagtgtgcctgtatcggccaggcagtcctcctccgagaagaacacccgaagcaaatctcgctttggccaggggcggcctgcttag

SEQ ID NO: 32588 - DNA, 537 bp, Artificial Sequence
  Description of Artificial Sequence: Synthetic coding sequence
gaattgtcatcacaaaaaacaggcggcaatctggatagacacaccgcaagcaagccaactgctctgcttcagccaggccctgggtggcaacggggggcagcatgctgcctacaaatcctgcctgagtcaagagtttgtttcccaaccggactgccgttagcacgaaaggtgacaaaattgagttgggtcggttacaagttacagggacgagaactgcagtggcccgtttaccgagaggaacttgaactggaaaggctgttgtggagacggcggccaggagaccgggacctgagaagaacaggggaccttcgtctcggtgagagagacctgcttctgatccgcgggggggatttgaggcatatcggagggggcggaaacatccttctgggcggcctgaacctcctcgggggcggtctgggccagggggcctccactgccgtggccgtgataagctggccaagcatttgtcctcccccttccatgtgcttttcagctttttcagctagctcgggttttagcaacagcacgtacgcctag

SEQ ID NO: 32589 - DNA, 1713 bp, Artificial Sequence
  Description of Artificial Sequence: Synthetic coding sequence
atgctcatgtggccacagccacacctgccaacccatcctcacctgcccactcaccctcatctcccaactcacccccacttacccacacatccccacttgcctacccaccccatgatgagcaaagaaactcggcagagcaaactcgctgaggctaaagagcagttgaccgaccaccaccctcagaccaaccccagcgtgggcaccgctgcgtcagacacgaagaaaaagaaaattaataatgggacaaatcctgaaactactacctccggaggttgccactcccctgaagacgagcaaaaggcttcgcatcaacaccaagaggccctccgcagagagcttgaggctcaggtgcagaccattaggatcttgacctgtcagaagactgaactacagatggccttgtactatagtcaacacgcagtgaagcagctggaaggtgaggctagggatctgatctcccggttacacgatagctggaagtttgcgggagagctagagcaggctctgagcgcagtggcaacccagaagaaaaaggccgatcgatacattgaagaattaaccaaggagcgcgacgcgctttctctggagctgtatcgcaacaccattaccgatgaggagctgaaagagaaaaatgccaagttgcaggaaaagctgcaattagtcgagtctgaaaagtctgagatccagctcaacgtcaaggaactgaaacgtaaactggagagagccaaacttttgcttcctcaacagcagctgcaggccgaggccgaccatctgggcaaggagttacagtccgtatcagctaaactgcaagcccaggtggaggagaacgagctgtggaatcgcctaaaccagcaacaggaggaaaagatgtggcgccaggaggagaaaattcaggagagagaggagaaaatccaggaacaagaggaaaaaatcagagaacaggaagagaaaatgcgccggcaggaagagatgatgtgggagaaagaagagaaaatgcgtcgccaggaagaaatgatgtgggagaaggaggagaagatacgcgaactggaggaaaaaatgcacgaacaagagaagattcgtgagcaggaggagaagagacaggaggaagagaaaatccgagaacaagaaaaacgacaggagcaagaggcaaagatgtggagacaggaggaaaaaattcgcgagcaagaggaaaaaattcgggaacaagaggagatgatgcaggaacaggaggaaaagatgggcgaacaagaggagaagatgtgggagcaggaagaagagatgcaagaacaagaagagaaaatgaggcgacaggaggaaaagatcagagagcaggaaaagaagattagagagcaggaggagaaaatacgagagcaggaggagatgatgcaggagcaagaggagaagatgggggagcaggagggcaaaatgtgcgagcaagaagctaagatgcaagagcaggaagagaaaatgagacggcaggaggagaaaattagagaacaggagaaaaagatcagagagcaggaggaaaaaataagggagcaggaagagatgatgcaagagcaggaagagaaaatgtgggagcaagaagaaaaaatgtgtgagcaggaagaaaaaatgcaagaacaggaagaaaagatgcggcggcaagaagagaagatgcgcgagcaagaggtgagactgcggcagcaagaagaaaagatgcaagaacattag

SEQ ID NO: 32590 - DNA, 399 bp, Artificial Sequence
  Description of Artificial Sequence: Synthetic coding sequence
tttacacagacataccgtcgaagccggcaacacgagcagctgcctggacagcgacacatggacctgctgactggttactccaaactgatccaatcccgcttaaagttgctgctgcacctgggttctcagccacccgttgggaagaccttcttcttttcttgttggtgccatccactgttccatggatccaaaaccacccctaacgtttggtataagttctccgagactgctctctcgattctaaatagttgtcaggcgtcccagttgggcgtgaggaaaatgcctggggatatgtcatctagtcccagggttagggaattctccgcacttgttgctatcaaggaaaagattcacatacttcccactaatgccaaagttggaagcaaattcggaagttag

SEQ ID NO: 32591 - DNA, 447 bp, Artificial Sequence
  Description of Artificial Sequence: Synthetic coding sequence
atgaatttcactttgatggtcagtatggagcacacaacaacaatggctagtgccacaccagccccatggccgcaccgatcccaaagatgcagacaagccgtcccagggcacccggcgagtggatgttgcggaaccggcacattccggacacagcgtcgacccggcgataagtcacggcgcgccggtagcagaggcagaggcgctgggcctggcaggcatgatagagattctgcacatgctggaagcatgcgaggagccagactagtgccagccctggtgcgcttacaactccggcctccagctttgcggggcgaaaggactcctatcagtatgcccccggcacgcccccctgccggcgtggctttcccgggcgcttccgccggaccgagcagaactcgccggggtgtggctaccgccggaggaaggcgggcgccagccgttatctag

SEQ ID NO: 32592 - DNA, 1599 bp, Artificial Sequence
  Description of Artificial Sequence: Synthetic coding sequence
atggatcagtttggggacatcctggagggtgaggtggatcacagtttttttgattcagattttgaagagggaaagaagtgcgaaacaaacagcgtgttcgacaagcagaacgacgaccccaaagagcgcattgataaggacacaaagaacgttaattcaaacacgggtatgcagacaacagagaattatctgaccgagaagggtaacgagagaaatgtcaaattcccacccgaacacccagtggagaatgacgtcacacaaactgtatcctcctttagtctgcccgcatccagcaggagcaaaaagctgtgcgatgttaccacaggtctaaaaatccacgtgagtatcccaaacagaattcctaagatcgtgaaagaaggggaggatgactactatactgacggagaggagagttcagatgacgggaagaaataccacgtgaaatcaaagtcagctaagccatccactaacgtaaaaaagtcaattcgtaagaaatattgtaaggtgtcctcatcctcctccagctccttgtcatcatccagcagcgggtctgggacagactgcctagacgctggatcagatagccatctgtctgatagctcaccatcaagcaaatcctctaaaaaacacgtctccggtatcactctgctgtcacctaagcacaaatacaaatcaggcatcaaaagcaccgagacacagcccagctcaactactcccaagtgtgggcattatcctgaagagagtgaagatacagtgacagacgtttcacctctgtcgacacccgatatttcaccgttgcagtctttcgagctcgggatagccaacgaccaaaaagtgaaaattaaaaagcaggagaatgtgtcccaggagatctatgaagacgttgaagatctgaagaataactccaagtatctcaaagccgcaaaaaaagggaaagagaaacacgaacccgatgtttcttccaagtcaagctccgtcctggatagctccttggatcacagacacaaacagaaggtcctgcatgataccatggatctgaatcacctgctgaaagcttttctacagctcgataaaaaagggccacaaaaacatcactttgaccagccatctgtagcccctggaaagaactattcgttcacacgagaggaagttaggcagatcgatagagaaaaccagcgtctgttaaaggagctgagccgccaagccgagaagccagggtccaagtccactatcccgaggagcgccgatcatccccctaagctgtatcacagcgccttgaaccgccaaaaggaacagcagcgcatcgagagggagaatctcgcattactgaagagattggaggcagtcaaaccgactgtcggaatgaaacgttctgagcagctgatggattatcacaggaatatgggctacttaaatagttcgccactttcccgtcgggcaaggagtacactgggtcaatatagtccgctgcgcgcctccaggacatcctcagcaacaagcggcctgtcttgcagaagcgagcggagcgcagttgaccctagctctggccaccctagacggaggcctaaaccaccaaatgtcaggactgcctggctatag

SEQ ID NO: 32593 - DNA, 2085 bp, Artificial Sequence
  Description of Artificial Sequence: Synthetic coding sequence
atggatctccataagcaatgggagaacactgaaaccaactggcacaaagagaagatggaacttctagaccaattcgacaacgagagaaaagagtgggagtcccagtggaaaataatgcagaagaagatagaggagctctgtcgcgaggtgaagctttggcgcaaaatcaatataaacgagtcggctaagattatcgacctgtatcatgagaagaccatacccgaaaaggtcatcgagtcttcacctaactaccctgacctgggacagagtgagttcatcagaaccaaccacaaggacggactgcgcaaagagaacaagcgcgaacaatctctggtttcgggcggtaatcaaatgtgtaaggagcagaaagccaccaagaaaagtaaagtcggttttctggaccctctagcaacggacaaccagaaagaatgcgaggcttggcctgatcttcgaaccagcgaggaagacagcaaaagctgctctggcgcactgtccacagctttagaggaacttgccaaggtctcggaagagttgtgttcctttcaggaggagattaggaagagatctaaccacagacgcatgaagtcagattccttcttgcaggaaatgcccaatgtgacaaacattccccatggcgaccctatgattaataatgatcaatgcatactccctatttccctggaaaaagagaagcagaagaaccggaagaacctcagttgtacaaacgtgctgcagagcaacagcacaaaaaaatgcgggatcgataccattgatctaaagcgtaacgaaactccacccgtgccccccccaagatccacttcccgcaatttccctagctccgacagcgagcaggcctatgaaagatggaaggaaaggctcgaccacaattcttgggtgcctcacgagggccggtcaaaacggaactacaacccgcattttcctctcagacaacaggagatgagcatgctgtatccaaatgaagggaagaccagcaaggatggtattatattcagctctctggtgcctgaagtcaagatcgatagcaagccaccctccaatgaggatgttgggctgtccatgtggagttgtgatatcggaattggtgccaagcgctcacctagtacatcctggttccagaagacctgctctacacccagcaaccctaaatacgaaatggtcattcccgaccatcccgcaaagagtcatcctgatcttcacgtctcaaatgattgctcaagttctgttgcagaaagcagctcccctctgagaaacttctcctgtggatttgaaagaacaacacggaatgagaaactggccgcgaaaaccgacgaattcaacagaacagttttccggacagacaggaactgccaagctatccaacaaaatcacagctgtagcaaatcctctgaagatctgaaaccatgtgataccagctccacacacacgggctcaatctcccagtcgaatgatgtgagtgggatttggaaaaccaacgctcacatgcccgtgcctatggaaaacgtgcctgataatccaaccaaaaaatccaccaccggacttgtgcgacaaatgcaaggccatctctcgccacgatcttatcgtaacatgctccacgaacacgactggcgtcctagtaatttgtccggtcgacctagaagcgccgatccacgatctaactacggagttgtcgagaaactgctgaagacttatgaaacggcaactgaaagcgcactgcaaaatagtaaatgcttccaagacaattggacaaagtgtaactctgacgtgtctggcggagctaccctgagtcagcatctggaaatgctgcagatggagcagcaattccaacagaaaaccgcggtctggggcggccaagaggtgaagcagggaattgatcctaaaaagataactgaagagtctatgagcgttaacgcttcccacggcaagggtttcagtagacccgcacgtcctgccaaccggcggttgccctcgagatgggcttccagaagtccgagtgcccctcctgccttacggcgaacaacccataactacaccatctccctgagatctgaagccctgatggtctag

SEQ ID NO: 32594 - DNA, 447 bp, Artificial Sequence
  Description of Artificial Sequence: Synthetic coding sequence
atgtcagtgcccaagctggtgaatcacggatgggagaccgaaccttgtaatcccgatccagccctgctgctgactggcgctgtccccggggagggcgagaccacactggagcgagctctccctagggtcgtcggagagcaggagctcgggagttggagggaacgggcgaattctacgcctgagcgaagactttcaccagccctaaagcacgtgagcgcacggcctactagcataccagagacccccggggagcgcggggcaagaacccgtagggatcgagccggtcgggctcgcaaaggggagggggctgctgcctcaacattgagttctctgcgcggcgccgctcctgaggccggcagaggggctgaggcccctgagtggtccgtgtctggaggggctgacgccgtgcccctggagggggctcctgccgtgaggagtaaatcgtag

SEQ ID NO: 32595 - DNA, 306 bp, Artificial Sequence
  Description of Artificial Sequence: Synthetic coding sequence
atgctcgtgggtaacagagcccgggagcgtgagctcaagcaggatcgcagggggctggagattgcctgggatctgatgaagcgccaggactgctttcgggaagctgcccacgggtccgcctctgagcaagtggcacttgagcctattctgtgctgtgacgaggtcgcctctcaggagcaccacgagggcggaaaagggtctcctcgccgggagtcaacagtccaggtccccgggggcgatcacggcaccctggaactgccctggtgtgtgtacttccagatcgtgtctggcatcaccctgcgttag

SEQ ID NO: 32596 - DNA, 213 bp, Artificial Sequence
  Description of Artificial Sequence: Synthetic coding sequence
atgtccctgcctatcggcatctaccggagggctgtatcctatgatgacacgcttgaggatccagcacccatgaccccccccccaagtgacatgggcagtgtaccctggaagccagtcatcccagagcgcaagtatcaacacctcgcaaaggtagaggagggggaggcttcgctccctagcccagcaatgacattatcttctgcgattgactag

SEQ ID NO: 32597 - DNA, 3702 bp, Artificial Sequence
  Description of Artificial Sequence: Synthetic coding sequence
atgggcacccgggcctttagccatgacagcattttcatccccgatggtggtgctgaatctgagcagacggttcaagccatgtctcaggacaacatacttggcaaggtcaagacacttcaacagcagttaggcaagaatataaaatttggacagcggtcacccaacgcgattcccatgaataaggctaactctggagaggcatcgttggaggaggatctgtttctgacatcacctatggagattgttacacaacaggacattgtactgtctgacgctgagaataaaagctccgatactccatcttctctgagccccctgaatctgcctggcgctggtagcgaaatggaggaaaaagttgcgccagtcaagcccagcagaccaaaacggcatttcagtagcgccgggacaattgagtctgttaatcttgacgcaatccctctggccatcgcccgacttgataattccgctgcaaagcataaactggccgttaaaccaaaaaaacagagggtgtccaagaaacatagaaggttagctcaggaccctcagcacgaacagggtgggcttgagtcccggccatgtctggaccagaacgggcacccgggagaagacaaacctacatggcatgaggaggagccgaaccctttagactctgaggaagaaagaagaaggcaggaggattactggcgagagctggaagccaaatgcaagagacagaaagcagaggctgccgaaaagcgacggctggaggagcagagattgcaggcactggagcggcgcttgtgggaggagaataggagacaggaattgttagaggaagaaggtgaggggcaggaaccccctttggaggcagaacgtgcacctagagaggagcagcagcgaagcctcgaagctccagggtgggaggatgcagagaggcgcgaacgagaggagcgggaacgactggaggctgaggaggaacgtaggaggctgcaggctcaggcacaggctgaagaaagacggcgtctggaggaggacgcccgcctcgaagaacggcgcaggcaagaagaggaggagggaagatgtgctgaggaattaaaacgacaggaagaggaggaggctgaaggctgggaggagcttgagcagcaggaggcagaggtccaggggccccctgaggctctggaagagactggcgagggaagaagaggggctgaggaagaggatctaggagaggaggaagaggagggtcaggcacatctggaggattggcgcgggcagctgtccgaactcctgaacgattttgaagaacgattagaggaccaagaacgcctgaagcctgaggggcagcgtgagcactccgaggagccagggatatgtgaggagcagaaccccgaagcggaaaggcggcgggaacaacagggcagatctggagacttccagggcgctgaccggccgggcccagaggaaaagcgcgaggagggggatacagaaccattgctgaagcaagaaggccccgtggaggctgcacaaccacccgtggaaagaaaggaggctgctgctctcgaacagggccggaaagtggaagagttgcgatggcaggaagtggatgaacggcaaaccatgcccaggccatatacgttccaagtctcaagtgggggaaagcagattctcttccccaaggtgaatctcagccccgtgacacccgccaaagacaccgggctgactgctgccccccaagagcccaaggcgccaaaggcatcaccagtacagcatgccttgccatcgtcgctgagtgtcccacacactgctatcctggtgacaggagcgcagctgtgcgggccagcggtgaacttgtctcagatcaaggataccgcctgtaaatcccttctgggtttggaagagaagaaacacgccgaggctcccgctggagagaatcctcctagaggacctggggacgcccgtgcggggtctgggaaagcgaagccacggcaagaatcaccctctagcgcaagtgctctagcagaatgggccagtataagatccaggatactcaagaacgcagagtcggatccaaggtctagcgagcgggaccaacttcgtcccggcgacgagagtactcccagggggagatgtgacagccgcggcaaccagaggaaaacaccccccgtcaatgctaaatttagcatcatgcccgcatggcaaaaattcagtgatggaggaaccgaaacctctaagcagagcaccgaggccgaaagcatacggaaacggcctatgctcgggcccagcgaggagaccgctccccagccacctcctgcgggagtgcgtgagctcggcaagggccccgaaaaatctgagatgcatagggagccggcagacaccaccgaggggtgcaaatttgctaaagacttgcccagcttcctcgtccccagtctgccgtatcctccccagaaggtagtcgctcacactgaattcacaacatcttcagactctgaaaccgcgaatggaatcgcgaaacctgaccccgttatgcccggcggcgaagagaaagccagccccttcggcatcaaattacgccggacgaactatagcctgcgctttaactgtgatcaacaagcggagcagaagaaaaaaaagcgccattcttccactggagatagcgccgacgccggtccaccagcggcagggtccgcacgaggtgagaaggagatggagggcgtcgccctcaaacacggaccctccctgccccaagagcgcaagcaggcgcccagcaccagaagggacagcgccgaaccatcttcatcccgctcagtgcccgtggctcatccaggaccccccccagccagtagccagactccagccccagagcacgacaaggccgcgaataaaatgccattggctcagaagcctgccctcgccccgaagccaacatcacagacccctccagcgagcccactgtcgaagctgtctcgaccctacctcgttgagctactgtctcggagggcaggtcggccggatcccgagccgagcgaaccatccaaagaggaccaagaatcctccgacaggcggccacccagcccacctggcccggaggagaggaagggacagaaacgtgatgaagaggaggaggctaccgagaggaagccggcaagtcccccattacctgccacacagcaagagaaaccatcccaaactccagaagccgggaggaaagaaaagccaatgctgcagtctcgtcattccctggatggaagcaaattgaccgagaaggttgagacagcacagcccctgtggatcaccttggccctgcagaagcaaaaaggcttccgagaacagcaggcaacccgcgaggaacggaagcaggccagagaggccaaacaggcagaaaaactaagcaaagaaaatgtgtccgtcagcgtgcagcccggcagctccagcgttagccgggccggaagtttacacaaatccacagctctgccggaggaaaaacggcccgagactgccgtgtctcgccttgagcggcgagaacaactgaagaaagccaacactctacccacatctgtgaccgtggagataagtgacagcgctccacctgcacctctggtgaaggaggtgaccaaaagattcagcacgccagatgccgctcccgtgtcgactgagccggcctggctagccctagctaagcgaaaagccaaagcgtggagtgattgtccacagatcattaaatag

SEQ ID NO: 32598 - DNA, 198 bp, Artificial Sequence
  Description of Artificial Sequence: Synthetic coding sequence
atgagcctgccgattggcatctaccgccgtgccgtcagttacgatgacaccctggaggaccctgcgcccatgaccccaccaccttcagacatgggtagtgtgccctggaaaccagtgatacccgagcgaaagtaccagcatttagcaaaggtggaggagggcgaggcttccctgcccagccccgcaatgacgctctag

SEQ ID NO: 32599 - DNA, 288 bp, Artificial Sequence
  Description of Artificial Sequence: Synthetic coding sequence
atgtctctccctattggcatctaccgccgcgccgtcagttatgacgacacactggaagaccccgcccccatgacacctcccccctcagacatggggtcagtgccttggaagcccgtgattccggagagaaagtaccagcatcttgctaaagtggaggagggcgaggcaagtctcccatctcccgccatgacgctaagtagcgctatagactccgtcgacaaagttccagtcgtcaaagcgaaggctactcacgtcattatgaattctctgatcactaaacaaacttag

SEQ ID NO: 32600 - DNA, 2130 bp, Artificial Sequence
  Description of Artificial Sequence: Synthetic coding sequence
atggaccagaagctaagcaaactggttgaggaactaaccactagtggcgaaccgcgcctgaatcccgagaagatgaaggagttgaaaaagatctgtaagagttccgaagaacagttatctcgggcttatcggttactcattgcccagctgacgcaggaacacgctgagattcgtctgagcgcgttccagatcgtggaagagttattcgtaaggagccatcagttcagaatgttggtggtaagcaatttccaggagtttttggagctcactctaggaacggatccagctcagccactcccccctcccagggaggccgcacagaggctcaggcaggcgactacacgagccgtggagggctggaatgagaagttcggcgaagcatataagaaactggctctcggctaccactttttacggcacaacaaaaaagtggattttcaggacactaacgcccgctctttagcagagaggaagcgcgaggaagagaagcagaaacacctggataagatctatcaagagagggcatcccaggccgaacgtgagatgcaagaaatgtccggagagattgagagctgtctcacagaagttgaatcatgttttagattgctggtcccttttgacttcgatcccaatcccgaaacagagtctttaggcatggcctcaggcatgtccgatgcattgcgctcatcttgcgctggtcaagttgggccttgccgtagcggtacaccagacccaagagacggggagcagccctgctgctcacgggacctccccgccagcgccggccatccaagagccggcggcggcgcccaacctagccagacggctactggggatccttccgatgaagatgaggattccgatctggaggaattcgtgcggagccatggcttgggtagtcataaatacacactggacgtggaattgtgctcagaggggttgaaagtccaggagaatgaggataacctggctttaatacacgcggctcgggacacactgaaactcattcggaacaagttcctgcctgccgtctgctcttggatccagaggtttacccgggtgggcacacatggggggtgcctcaaaagagccatcgatctaaaggctgaactggagctggtcctgagaaagtataaggagttggatattgagcccgagggcggagagaggcgacggactgaagccctgggagacgccgaggaggatgaagatgatgaggattttgttgaggtgccggagaaggaaggctatgaacctcatatccccgatcatctgaggcccgagtacgggctggaggctgcccccgagaaagacactgttgttagatgcctcagaaccagaaccagaatggacgaggaggtatccgatcccacctcagccgcggcccaacttcggcagctgagagatcacctcccacctcctagttccgcttctcctagccgtgcgctcccagagccccaggaagcccaaaaactggctgctgagcgggctagggcacccgtcgttccatatggagttgacctgcattattggggtcaggagcttcccacggctggcaagatagtcaagagcgatagccagcacaggttctggaaaccatcggaggtggaggaggaagtcgtgaatgcagacattagcgagatgctccgatcccggcacattacctttgccggaaagttcgaacccgttcaacattggtgtagagcacccaggcctgatggacggctctgcgaacggcaagacagactaaaatgccccttccacggaaaaatcgtgccccgtgacgatgagggaaggcccctggaccctgaggacagagcccgcgagcagcggcggcagcttcagaagcaggaaaggcctgagtggcaggacccagaactcatgcgcgacgttgaggccgccacaggacaagacctcggtagctccagatattctggcaaggggcgcgggaaaaaaaggagatacccgtccctcactaacttaaaagcccaggccgatactgcacgggcccgaattggtcgtaaagtgttcgccaaggcggctgtccgaagagtggtagcggctatgaacaggatggaccagaagaagcacgaaaaattctcaaatcaatttaactatgctctgaactag

SEQ ID NO: 32601 - DNA, 168 bp, Artificial Sequence
  Description of Artificial Sequence: Synthetic coding sequence
gaagtgtccaacccctttgacggactggaggagcttggtaagactctcgaagattatactcgagagttcattaaccgaatcacccagagtgaactgcccgccaaaatgtgggattggttttcagagacttttcgtaaggtgaaggagaagctgaagactgactcctag

SEQ ID NO: 32602 - DNA, 228 bp, Artificial Sequence
  Description of Artificial Sequence: Synthetic coding sequence
atgtaccctatctgcactgtcgtggttgacggacttccatctgagagttcgagttctagctaccccggccctgtgtccgtcagtgagatgtctcttttgcacgctctgggccctgtgcagacttggttgggccaggaactcgaaaagtgcggcattgatgcaatgatctacactcgatacgtgctttcacttttgctgcacgattcctacgattacgacctgcagtag

SEQ ID NO: 32603 - DNA, 918 bp, Artificial Sequence
  Description of Artificial Sequence: Synthetic coding sequence
atggcctcaagacaacctgaggtgccagcactggaagcctctgcccccttgggaaagatgtctctccctataggcatttatcggagggccgttagctatgacgatacattagaggatcccgcccccatgacacctcccccatctgatatggggtcagtcccatggaagccggttattcctgaacgaaagtatcaacaccttgctaaggtcgaggagggcgaagcaagtctgcctagtccggccatgaccctgtcatctgccatagatagtgttgataaagtaccggtggtcaaagcaaaagctacacacgtcattatgaacagtctcattacaaagcaaactcaggagtccatccaacacttcgagaggcaagctgggctcagagatgccggctatacccctcataagggactgaccacagaggagacgaagtacctgagagtagctgaggcactgcataagctcaagcttcaatcaggagaggtgacaaaggaagagaggcagccggccagtgctcagtccaccccttctacaacacctcattcaagcccaaagcagcgtccgagggggtggtttacgtccggttcttccaccgctctccccggccccaaccccagcaccatggactctgggagcggcgacaaggaccgaaacctgtctgataagtggtcgctctttggaccacggtccctgcagaagtatgatagtggctcattcgctactcaagcataccgcggcgctcaaaaacctagtccactagaactgattagggcccaggccaaccgtatggctgaggaccccgcagctttaaagccgcccaaaatggatataccagtcatggaagggaagaaacagcctccccgcgcccacaatttaaaacccagggacctgaacgtactgacccccactgggttctag

SEQ ID NO: 32604 - DNA, 2130 bp, Artificial Sequence
  Description of Artificial Sequence: Synthetic coding sequence
atggatcagaaattgagcaaattagtcgaggagctcacaacctcaggagagcctcgactgaacccagagaaaatgaaagagctgaaaaaaatctgcaaatcgagtgaagagcagctgtcccgggcatatcggctccttatcgcgcagctgacgcaggaacatgccgagatccggttatccgcctttcagattgtcgaagagctgttcgttcggtcacatcagtttcggatgttggtggtctctaattttcaggaattcctggaactaactttggggactgacccagctcagcccctgcccccccccagagaggctgcccagcgcttaagacaagccaccacacgggccgtggagggctggaacgagaagttcggagaggcttacaaaaagctcgccctgggctatcacttcctgagacataacaagaaagtggatttccaggatactaacgccaggagcctagccgagcggaaacgggaggaggaaaagcagaagcaccttgataaaatctatcaagagcgagcttcccaggccgagcgggagatgcaggagatgtcgggtgagattgagtcctgcctgaccgaagtggagagctgtttcagacttctcgtgcctttcgacttcgatccgaatcctgaaacagaaagcctcggtatggcaagcggaatgtctgacgctttgagatcaagttgcgctggtcaggttgggccctgccgctccggtactcctgatcccagagacggcgaacaaccttgttgctccagggatctgcccgctagcgcagggcaccccagggctggaggaggggcccagccatcacaaacggccaccggcgatccgtcagatgaagatgaggattcggacctggaggaatttgttcgaagtcacggcctgggttcccataagtatactctggacgtggagctctgtagcgaaggcttgaaggtccaggaaaacgaggataacctggcactcatccacgctgctcgagacacactgaaacttatcaggaataaattcctgcctgccgtctgttcgtggatacagcgttttactcgggtaggcacccatggagggtgtttgaagcgtgctatcgacctgaaggccgagctggaactcgtcctaaggaagtataaggaactagatatcgaaccagaggggggcgagcgccggagaacagaagccctgggcgacgcggaagaagatgaagatgacgaggattttgtggaggtgccagagaaggaaggctacgagccccacattcctgaccacctgcgcccggagtacggtttggaagccgcaccagaaaaggacacagtggtgcgctgccttagaacaaggactcgcatggatgaggaagtgagtgaccctacttcagccgccgcacagcttaggcagttacgggaccatctcccacctccgtccagtgcaagtcctagtcgtgcgttgccagaacctcaagaggcccaaaagcttgccgctgagcgggctcgggcaccagttgttccctatggggtggatctgcactactggggacaggagctccccaccgcaggcaagatcgtgaagagcgattcccaacacagattttggaagccgtcggaggtcgaagaagaagttgttaacgccgatatctccgagatgctgaggagcagacacatcacgttcgcggggaaatttgaaccggtgcagcactggtgtagggctccacggcctgacggcagattgtgcgagaggcaggaccgccttaaatgtcctttccatggaaaaattgtgcctcgggacgatgagggaagacctttagacccagaggatagggctagggagcagcgcagacagctgcaaaagcaggagcgaccagagtggcaggaccccgagctgatgagggacgtcgaagctgcaacagggcaggatttaggaagttcccggtactcgggtaagggacgcgggaagaagagacgataccccagtttgacaaatctgaaggcacaggctgatactgctagagcccggattggccgcaaggtatttgctaaggccgccgtgaggcgcgttgttgcagctatgaaccggatggaccagaaaaaacatgaaaagttctcaaatcaatttaattacgctctgaattag

SEQ ID NO: 32605 - DNA, 783 bp, Artificial Sequence
  Description of Artificial Sequence: Synthetic coding sequence
atggacgaggaagtttcagaccccacttcggccgcggctcagctaaggcaacttcgggaccacctgcccccacctagctctgcatcgcctagcagagccctgcccgaacctcaggaggcacagaaactggccgcagagagagcacgagcccccgttgttccttatggagtcgacttgcattattgggggcaggagctgcctactgcggggaagatcgttaaatctgatagccagcaccgcttttggaagccgtctgaggtggaggaagaagtggtcaacgccgacatcagtgagatgctgaggagcaggcacattacattcgccggcaaatttgagcctgtccagcactggtgcagagccccccggcccgacggtcgcttgtgcgagagacaagacagactgaagtgccccttccatggaaagattgtccctcgcgacgacgaagggagacccctcgatcccgaggaccgcgctagagaacagagaaggcaactccaaaaacaagaacggcctgagtggcaggaccccgagctcatgcgggatgtagaagccgctacaggacaagaccttggctcctcaagatactcaggcaaagggcggggtaagaaaaggcgctatccttcattaaccaatctgaaggcgcaggctgatacggcgagggctaggatcggtcgcaaagtcttcgccaaagcggcagtcagaagggtggtggctgccatgaaccgcatggatcagaaaaaacacgaaaaattcagcaaccagttcaactacgccctgaactag

SEQ ID NO: 32606 - DNA, 783 bp, Artificial Sequence
  Description of Artificial Sequence: Synthetic coding sequence
atggatgaggaggtgtcggatcccacctctgctgccgctcagcttcgccagctgagggatcacctgcctccaccctcctccgcatcgcccagtagggccttgcccgagcctcaggaggcacagaaactggccgccgagcgggccagagctcctgtggttccctacggcgtggacctccattactggggacaggaactacccaccgccgggaaaatcgtaaaaagcgacagccagcacagattttggaaaccctctgaggtagaagaagaggtggtgaacgcagatataagcgaaatgctgaggagcaggcacatcacattcgccggcaagttcgaaccagtccagcattggtgccgagctccccgccctgacggccgcctgtgcgaaagacaagatcggctgaaatgccccttccacggcaagatcgtcccccgtgatgatgagggacgccctctcgatcccgaggatagagctcgcgaacaaaggcgccagctccagaagcaggaacgaccagaatggcaagaccctgagttaatgcgggatgttgaagcggccacgggccaagacctcggctcgagtaggtatagcggcaagggccggggcaagaaacgtcgttacccatcgctgacaaaccttaaagctcaggcagacaccgcaagagcccggatcggccggaaagtgttcgcaaaagcagccgttcggcgtgttgtggcagctatgaatcggatggatcagaagaaacacgagaaatttagcaatcagtttaattatgccctgaattag

SEQ ID NO: 32607 - DNA, 3828 bp, Artificial Sequence
  Description of Artificial Sequence: Synthetic coding sequence
atggattgggatgatgagtatagccacaatagcttcgatctgcattgcctcctgaactctttccccggagaccttgaattcgaacagatcttctccgacattgacgagaaaatcgaacagaacgctgccagcataaaacactgtatcaaggaaatccagtctgagattaataagcagtgcccaggcgtgcagttgcagaccactactgactgcttcgaatggctgaccaactataactactccacgtcagagtcctcatttatcagtcacggtgacctgatcaagttttttaagacactacaagacctccttaagaacgagcagaatcaggaagagatgacacttgatctcctgtgggacttgtcgtgccattcatctgtgagcttcccctcaacgctgagtggaacaagtttccactttctgagtcgtacctccctccatagcgtcgaagacaactcctccatggatgtgaagtctatgtgggacgacatcagactccacctgcggcgttttctcgtgtcaaagctgcagtcccacaatgaaatcaacaattcccagcaaaagatcctgttgaagaagcagtgcctgcagcagctgctattcctgtaccctgaatctgaagtgattattaaatatcagaatatccagaacaaactgctggcaaacctgctgtggaactgtttcccaagctataacagggatagtaatctggacgtcattgcccatggttaccagagcaccatgctaaaactctacagcgtcattaaagaagactttaatacgttgtgcgagatcttggccccatcatcaatggtgaagttcatcaaggaaacatatctcgatactgtgaccgaggagatggccaaattcctggagaacttctgtgaattgcaatttcgggaaaatgctgtgagggttgtgaagacatcgaagagtagttccaaacataggggcgctgtgcacgctctggtgaccaccgaatgtcctcagaaggggcggaatttcagcctgcctctggacaaggtcgaattccttagccagctcatcaagtcgtttatgaaacttgagaaaggcgtccaggaacttttcgacgagattcttctgtctctgaaaatcaccagggacacctccggtatcctagagaaaagcgacagagaagtggtcatggagaaaccccgtgctaatgagactaatattccttccgaacagagcctgcccggcaaggaagctacattgctggactttggttggaggtcggcgttcaaggaggttagtctgccaatggcacattgtgtggtaacagctatagagggtttttcaacaaagatccttcaacaggagcagaacgagcgaagctccgccgtgtcttatgccatgaatctcgtgaacgtccagcaggtatggcaagatagccacatgtttcccgaagaagaacagcccaaaaaaatcggtaagttctgcagcgatatcatggaaaaactcgataccatgctgcccctggctttggcatgccgtgacgacagcttccaggagatccgggcaaatttagtagaggcatgctgcaaagtagcaactgcagtcctccagaggctgcaagagcgcgccaaggaggttccaagtaaagctccccttaagaaccttcatacgtacctctcaacagccgtatatgtgtttcagcatttcaaacgatacgataatctgatgaaggagatgactaagaagccaatcttcttagtgctggtgcagcggtatcaagaatttattaataccctccagtttcaggtgaccaattactgcgtcagggtgtgcgctaccagcattctgcaggatgccgagtcacaccattgggatgactacaaggctttctacgaaggtgaacgctgctccttcagcattcagatgtggcactacttttgctggagtctgcactacgatctgtggaccatccttcctcccaaactggcccaggaaatcctggtcgaggtgctagagaaatccttatcgttgctggcttcccggtacgcccgcgcacacccgagccgaaaaagaactcctcagctccggctggacgttaccaccattctgatttgtactgagaatatgctttggagtgtatgcaccagcgtgcagaagcttctcaatcctcaccagcacaccgacgataaaatttttaagattcacacacactgcaacaatctgtttaccaccttggtgatactgacttcacccctcacagagctatacaagacctttcagcacggactcgacgaaagcgccagcgactcactgaaatccttctttaagcaacctctctattgggtaagttgcatctctcacttctacccctctctcctacggactccatctgccggcggtctgaaggctgagggtcagctgaagctgctgctttctcaacctcgctgcaattggaacctcctgttagaaactcttctccatcacgacggattactgctcaggatcctcttaaagagctctaaacaagtttccgacaccgaaaataacctcaatcaggggccatcgcttatggaggccatttttaaaattctgtatcattgttctttctctccgcagacgttcgccaacgtgttcgtctcgtatatggaagaggaacaactatgggattttctgtacaacatcccggtgtcaacctgcgtcgaatatgagctggaggtcattaggtgcctacgactggctctcaccgatgccattaaggatacagtgcaacagatcgtcagtgtgatgtcatccaggcgtaactgtgaaaccaacctgaacaagcacatcgtccccgattgcctacttgaaagcatgcccaaagagtggaactattcaccaaaagaaacaaacaggaaagagagttgtaagtcgttcacacggctgacagctcaggcagtcagtattgtcatatccaagctacccacagtgatcgcctgtctgcccccgcctgttaaatatttttttttcttatctgaacgtaaaatgtccaagaagttcgttgagcttaagaaagcaggcctgctggtgtggaaccttatcgttatcatttgcaggattttcgaagacggcaacaccgtcgagctgttgactggcgcgagtcttgacagatggtcaaaggaaaaactcggcttgatctgtatgtgcctcaaatcaatcatgggagaccagacttctatccacaaccagatgatccagaaagtgattcagagcattgagcagcagaaaccaaactggatagagcgtcaactgctgaaggcgaggaaattatctaccgaatgcgcatttatgactatcgagaaatcgacagccctacaggagggtgacgtggccctcgagctcacggagcagaagatcaacacaatggtcctcgatctgtgccataaacctggggggagagaatacttgcggcagatctaccacatcatgcagttgaatgaggagtacctaaaggagcagctgttcagcatgaactcctcagaggagaagccactgcccatccgccccctgaagacaaccctccgaagcatcgaggaccagccttccgcatttaacccgttccacgtgtataaggccttttccgaaaatatgcttgatcagtctgccattaccaagtggaattggaactgggccaagcttttaccaaactacctacgcctggataaaatgacttttagtgtgcttctcaaaaaccggtgggagatgaaaaaggatgagaccctggaggaggaggagaaggctatcctggagcacctgaagcaaatctgcacacctcaaaactcttcagcatccgacaatattgaagagcagtag

SEQ ID NO: 32608 - DNA, 288 bp, Artificial Sequence
  Description of Artificial Sequence: Synthetic coding sequence
atggccagctcgcattggaatgaaaccacaacctccgtataccagtacctgggattccaggttcagaagatttatccattccacgacaattggaatacagcctgctttgttatcctactgttattcatttttacggtggtgtctctcgtggtcctggccttcctctacgaggtcttggactgttgttgttgcgtgaaaaataaaaccgtgaaagacttgaaaagcgagccgaatcctctgcggtcaatgatggataacatcagaaagagagagaccgaggttgtctag

SEQ ID NO: 32609 - DNA, 354 bp, Artificial Sequence
  Description of Artificial Sequence: Synthetic coding sequence
atggagactaagaaactgattggcaaaccgctacaacctgccagaccagtgcgccacttgacctccccgcctggtgcagtgttcccttttaatttccagaatgagtacccctgcaacacacagtgtattcagtcaggagttagcaggtgcaaaaccaacggcatgcaggccttttctcagggcctcaacgaacagcaacagcagcaatctcctgtcaagaaagaacggattaagtactctagagatttcttgctaaaactttcgtccgtgtcaatttgccgaaaaaaacctgactttctgccggatcaccctatcgttttgcaaaagcctgagaataatcagtcttttaagtag

SEQ ID NO: 32610 - DNA, 339 bp, Artificial Sequence
  Description of Artificial Sequence: Synthetic coding sequence
ctccaggacagaattgccacattttttttccccaaagggatgatgctgacaaccgcagctctgatgctattttttcttcaccttggtatattcatccgagatgtccataatttctgcatcacttatcactatgatcacatgagcttccactataccgtcgttctaatgtttagtcaagtgatcagtatttgttgggccgctatgggcagcttgtacgctgagatgacagagaataacgcacagcggtcacacgtgctgcagccccccgtgctgggtgtaagcggccaccgggtgcctggaggtgcccctctcaggcctggggagagcgaacagggatag

SEQ ID NO: 32611 - DNA, 6708 bp, Artificial Sequence
  Description of Artificial Sequence: Synthetic coding sequence
atgccactgttctttagcgctttactagtgctgctgctggtcgcactttctgctttgtttctgggtcgatggctcgtggtacgcctcgcgacaaagtggtgccagaggaagcttcaggctgagctgaaaattggttcgtttaggttcttttggatccagaacgtatccctcaaatttcagcagcatcaacagaccgttgaaatcgacaatctgtggatttcctcaaagctcctgtcccatgacctgcctcattacgtggcactgtgcttcggcgaggtgcgcatcagaacggacttacagaaggtgtccgatttgtccgcaccttttagccagagcgcaggtgtggatcagaaagaactgtcattcagcccatcgctgctgaagatcttctgccagcttttctctattcacgttgacgccatcaatattatggttcttaaggtcgataccagcgaatcattgtggcacatccagattagtcggtcccggtttctcctcgattctgatgggaaaagacttatctgtgaggtaagcctgtgcaagatcaacagcaaggttcttaaatcaggtcaactggaggacacctgtctcgtagaactgtcacttgccctggatttatgcctgaaggtcggcatctctagcagacacctgacagctataacggtggacgtgtggactctgcacgcagaattgcacgaggggctttttcagagccagctactgtgccaggggccttctctagcctcgaagcccgtcccctgcagcgaagtaaccgagaatttggtcgagcccaccctgccaggactctttcttctacagcagctccctgatcaggtgaaggtgaagatggagaacacctcagtggtgctgagcatgaactctcagaagagacatctcacgtggaccctgaagctgctgcagtttctgtaccacagagatgaagaccagctcccgcttcgctctttcaccgccaactcagatatggcccagatgtcaaccgaacttctgctggaggatggtttattgttgagccagtcaaggcagcgcatcgtgtgcttaaactccttaaaagccagcgtgcaggtgacaaccattgacttgagcgcgtcacttgtgctcaatacgtgtattattcactacaggcaccaggagttcagtcactggctgcatctgttggctctggaaacccagggatccagctcccccgtgcttaaacagaggaaaaagcgaacctttcctcagatcctggctcccatcattttttccactagcatatctaatgtgaacatttctatccaactgggagatacacccccttttgcactgggattcaacagcatctccctcgattaccagcacctgcgcccccagtcaatccaccagcgtggcgtactgaccgttgaccacttgtgctggagagtggggtccgatagccatatccagcgggccccccaccctcctaacatgcatgtctggggagaggcccttgtgctggacagctttactcttcagggaagctataatcagcccctggggctttcatccacacaatctgacacactgtttctggactgcacaataagagggcttcaagtcgaagcttccgatacctgcgctcaatgcctgtcaagaatcttatctctaatgggaccccaaagcggtaaaagtgctgtgtcaagacattcgagcttcggagagagtgttagtctgctgtggaaagtagacctgaaggtcgaagatatgaacctgtttactctgtcagccctcgtcggggcttccgaggttcggctggacacattaaccattttagggtccgctgaaacaagtaccgtgggcatccaaggattggtgttagcccttgtcaaatccgttaccgagaaaatgcagccctgttgtaaagcccccgacattcccacaccggttctatcactttcaatgctgagcattacgtatcactcatccatcagatctttagaggtccagtgcggggccggcttaactttactatggagtcctcctgatcacatgtatctctatcaacatgtgctggcaactctccagtgccgcgatctgcttcgggccactgtgttcccagaaaccgtgcctagtctggcactggaaacctcgggtactacttccgaactcgaaggcagagctcccgagccattgccccctaagcggctcctgaacctaacattagaagtttctacagctaagcttaccgcttttgtggctgaggacaagttcatcactctcgcggccgaaagcgtctccctatccagacatggcggctccctgcaggcttactgtcccgagctggctgccggttttgatggaaactccatttttaacttcaaggaagtggaagttcaactgctgcctgaactggaagagatgattctccataggaatccttttccggcactccagactctcaggaacagggtttggctattatccttcggctccgttagcgtcgaattcccatatcagtacgattttagtagaaccctcgacgaggcggttggcgttcaaaagtggctgaaaggactccaccaggggacgcgcgcctgggctagcccgtctccagtgccactcccccctgacttgctgctcaaagtcgagcacttttcctgggtattcctggatgacgtgttcgaggtgaaattacatgacaactatgagctcatgaaagatgaaagtaaagagagcgccaagcggctccagttattagatgccaaggttgcagcgttacgcaaacaacatggtgaattattgcccgcacgaaagatcgaggagctctatgccagcctcgagcgcaaaaatattgaaatttacattcagcgatcccggagactgtatggaaatacccctatgaggagagccctgctgacatggagcctcgccgggctggagcttgttgcactggcagatgcctccttccacggacccgaacatgtggtcgaacaggtgcaggaactggacccagggtccccgtttcccccagaaggcctggatttagtcattcagtggtgccgtatgttgaagtgcaatgttaaatcattcttagtcagaatcagagactacccaaggtacctctttgagattagggactggagactgatggggaggttggtcggcaccgaacagtctggtcagccttgttcaagacgaagacagatactccacttggggctgccctggggaaatgtggcagttgaacgcaacatgccccccctaaaattctatcatgacttccactctgagatattccagtatactgtcgtgtggggcccatgttgggaccctgcctggacactcataggacagtgtgtggatctgctgaccaagccaagcgctgatcctagtccacccttgccatggtgggacaaaagccggctgctgtttcacggcgactggcacatggacatcgagcaagcgaacctgcatcaactcgctactgaagacccctataacaccactgaaaatatgcactgggaatggagccacctctctttccattggaagccggggcagtttgttttcaagggagatctcgacatcaatgtgagaactgcttccaaatatgacgactgctgcttcctgcatcttccagacctgtgtatgactctggacctacagtggctctgtcacggaaacccccacgaccaccacagcgtgacactgagagctcctgaattcttgcccgaggtcccactcggtcagttgcatgacagctatcgtgcctttaggtctgaaaatttgaacctgagcatcaaaatggatctcacacggcattccggaacgatcagccagccaaggattttactatactcgtccacccttaggtggatgcagaatttttgggctacgtggacatctgtgactcgacctatctgccgcggtaaattattcaacaacctgaaaccatctaagaagaagctaggccagcactacaaacagctgtcttacaccgctctctttccacagttgcaggtgcactactgggcttcctttgcccaacagaggggaattcagatcgaatgttcacagggacacgtctttacccggggcacgcagcggctcatcccacaagccggtaccgttatgcgaagactcatctccgattggtcggtcactcagatggtgtctgacctgtcccaagtgaccgttcatctcatggcctctccaaccgaggaaaacgcagaccactgtctcgatccactcgtcacaaagacacacctattatctctatcctctcttacatatcagcgccacagcaataggaccgccgaggaggagctgtctgctagggacggagaccctaccttccacacccatcagctccacctggtggacctccggatcagctggacaacaaccaaccgagatatcgcgttcggactatacgacggttacaagaaagccgccgttctgaaaaggaacctcagcactgaggccctgaaaggtcttaagatcgatccccagatgcccgcaaagaaaccaaagcggggcgtgcctacttccgcgagtgctccacccagagtgaacacacctagcttctcaggccaaccagacaagggcagctcaggaggggcctatatgcttcagaaattaatcgaggagactgatcgcttcgtggtgttcacagaggaagaatccggtatgtccgaccagctgtgcgggatcgcggcctgtcagacggatgacatttataacaggaactgcctcatcgagctagtgaattgtcaaatggtcttgcgtggggcggaaacagagggttgtgtaattgttagcgccgccaaggcgcagctgttacagtgtcagcaccaccctgcttggtacggcgatactttgaagcagaagacctcatggacgtgccttctggatggcatgcaatactttgccaccacagagagcagtcccaccgaacaggacggcagacagctttggttggaggtcaagaacatcgaggagcacaggcagagatccctagattctgtgcaagaacttatggaaagcggccaggcagttggaggtatggtgaccactaccacagactggaatcaacccgccgaggctcagcaggctcagcaggtgcaacggatcatcagcagatgcaattgccggatgtattatattagttactcccacgacatagatcccgaactggccacccagatcaagcccccagaggtactggagaatcaggagaaggaggatctgctgaaaaagcaggaaggagctgtcgatacattcaccttgattcatcatgaactggagatctctaccaatcctgcccagtatgctatgatattggatattgtcaataaccttttacttcacgtagagcctaaacgcaaggagcatagtgagaaaaaacagagagtgaggttccagttggaaatcagtagcaatcctgaagagcaacgttcgtccatccttcatcttcaagaagcggtacgtcagcacgtggctcaaatccgacagctggagaagcagatgtattcaatcatgaagtcccttcaggatgactcgaaaaatgaaaatctcctggacctcaaccagaaactgcaactccagctaaaccaggagaaagcaaatctacagctggagtccgaagaattaaacattcttatcagatgcttcaaggactttcagctgcagcgggctaacaaaatggagctgagaaaacagcaggaagacgtgtcagtggtccgcagaactgagttctattttgcacaggcccgttggagactcaccgaagaagacggccagctgggtatcgcggaactggagctccagaggttcctgtattcgaaggtcaacaaatccgatgacacagcagaacatctgctggaactcggatggtttacaatgaataacttacttcctaatgcagtgtacaaagctattctcagaccccaatccagctgtcagtctgggaggcagctggctctccggctgttttctaaggttcggccaccggtcggcggaatctctgtgaaagagcactttgaagtgaacgtggtgcctctgactattcagttaacacatcagttcttccaccggatgatgggtttcttttttcctgggaggtctgtcgaagacgatgaggttggagatgaggaagataaaagtaagctcgtgaccacggggattcctgttgttaaaccccggcagctgattgccaccgatgatgctgtaccactaggaccagggaagggggtggcacaaggcttaacacggtccagcggagtgaggcgctccttccgaaagtcgcctgagcatcctgtagatgacatcgataaaatgaaagaacgcgcagcaatgaacaactcattcatatacatcaaaatcccccaggttcccctgtgtgtatcatataaaggcgagaaaaatagtgttgactggggagacctcaaccttgtgctgccttgcctcgagtatcacaataatacctggacatggctcgacttcgcaatggccgttaaacgcgactctcgtaaagctctggtggcacaggtgatcaaagaaaagctgcgactcaagtctgccaccggcagcgaggttcgcggcaaactggaaacgaagagcgacctgaacatgcaacagcaagaagaggaagagaaggcccgcctcttgatcggcctatctgtcggagacaagaaccctggaaaaaaatctattttcgggcggaggaaatag

SEQ ID NO: 32612 - DNA, 3876 bp, Artificial Sequence
  Description of Artificial Sequence: Synthetic coding sequence
atgccacccaattttcccgagttcgctgaacgaatcgaggcctccctttctgaggtttcggaggccggcgcttccaacccttccctgcaggaaaagaaagagtcctcaagcgccttgactgagtctagtggccatctcgatcaccgtgagccacaaagtgagagcgtgacactggagcacgtgtcaaaatcaattggaatcccagaagtccaggatttcaagaacttgagcggtgattgccaggactttcgatttcagcagcactccgcgaatccaccgcatgagttccaaccggtggaaagcgaagcggttgccactagcggtaacacagatgtaatgcaggaatcccgcttctccagtgcgacatggccccgggctaccaaatctttggccaagggcggcttttccgagaaacagcaccctctgggcgacacagcctgcaccgtggagatgcctcccctgtccccttgccttagcgaagagctgctcgatcctgagctgcatgttctgattactcccagcctgcgggaaaaaactgaaagcgagctgaagtttgaggaggacgagagatggattatgatggaggccgagggagagtgggaggaagagaagctgtctgaccgcgaaaagacttttctgatggctgatgaaaaaaactcattagccgatatcttcgaggaaagagagcaggccaataccgccgtggtggaagacggtagcgactgcctcgctgcagtgctgcgcacctttggccacttaagtctgggccagatttgctgcccagatgaccctcagcctgctaaagatcaactcgctacagtgccaaaggacatccccctggactgtgactgcgtgctcacaggcgaggacatcttgggagaggtggccaaccgcacggcccagggccttgaggggctcgtctctgactccgcgtgtacagtggggaccatagacgccgagcagctcagcgacaccgacagtgttcagatgtttctcgagttggagaaagagtgtctgtgcgaggagggcgttaccccgctcgtagaactccagaaccaaatctccagcgagggactcgccgcctctcaagacgctgagaacctgctcgtcatctcccatttctcaggtgctgctctggagaaagaacagcatctcggactgcttcatgtgcgcgccaaggactacgacactaggctggattgtggctattttaatactctcgactcttctcaggtgcctaatgctgtcgaactgattgcccacgtggacatcatgcgcgatacttctactgtgtcaaaagaggagtgcgaaaaagtgccattttccccaaggacggccgaattcaagtcaaggcagccagcggatctggatagcctggagaagctggaccccggaggcttgttgaattccgaccatcgcgtgagccatgaagaaaaactcagcgggttcatcgcatcggagctggcgaaggataacggatccctgtctcagggtgactgctcccagaccgagggcaatggagaggagtgcattgaaagagtcacattttctttcgccttcaaccatgaactgacagacgtgacatcagggcccgaggtggaggtcctttacgaatctaatctcctgactgacgaaattcacctcgagtccggaaatgtaacagtgaatcaggaaaacaatagcctcacttctatgggcaacgtggtcacctgcgaactgtccgtggagaaagtgtgtgacgaggatggggaagctaaggagctagactaccaggctactcttcttgaagaccaggcaccggcccacttccaccggaatttccccgagcaggtgttccaggacctgcaaaggaagtcacctgaatccgagatccttagcctccatcttcttgtagaagagctgagacttaatccagacggagtggagaccgtgaatgatactaaaccggagctcaacgttgccagttcagaggggggcgagatggaacgtcgggactcggactcttttctaaatattttcccagagaagcaggtgactaaagctggcaacaccgagcccgttctggaggagtggatccctgtcctgcaaagaccttcacgaaccgctgcagtgcccaccgttaaagacgcactggatgctgccttgcccagccctgaggagggaacatctatagccgcagtccccgctccggagggcacagctgtagtcgccgcgctggtgccctttcctcatgaggacatccttgtggcttccattgtaagcctggaggaagaggatgtgaccgccgcggccgtgtcagcgccagaaagagctaccgttccggctgtcacagtgtctgtgcccgagggaacagccgcagtggccgccgtctcctctccagaagaaaccgctccagcagttgcagccgccatcacacaggaagggatgtctgcagtagcaggctttagccctgaatgggctgccctagcgatcacagtgccaataacagaagaggacggcacccctgagggcccggtgacgccagcaacaaccgtgcatgcacccgaggagccagatactgccgccgtcagagtgagcacgccagaggagcccgcaagccctgccgccgccgtgcctaccccagaggaacccacgtctccagcagcagcggtgcctaccccggaggagccaactagcccggctgctgccgtgccaccgcccgaagagccgacttcaccggcggcagcagtgcctacccctgaagaaccaacatctccggccgccgccgttccaacgcccgaggagcctaccagtccagcggccgccgtccctactccggaggagcctacatctcctgctgcggccgtgccaaccccagaagagcccacctcccccgcagccgcagtacctacccctgaggagcccacaagccctgcagctgccgttcccactcccgaagagcccgcgtctccagccgctgccgtgccaactccagaagaaccagcctccccggccgcagcggttcccacacctgaagaacccgctttccccgcacccgctgtgccaactcccgaagaatctgcctcggcggccgtggctgtgcccacccctgaggaatccgcctctcctgctgccgcggtacccactcctgcagaatctgcatcattcgccgccgtggtggcgaccctcgaagaacctacatctcctgcggccagtgtcccaactccggcagcaatggtcgccacccttgaggagtttacaagtcctgccgcatccgtgcccacaagtgaggagccagcctccttagcagccgccgttagtaaccccgaagaaccgacgtctcccgcggctgcagtccctactctggaggaacccacatctagcgccgctgccgtcttaacgccggaagagctctcatcaccggccgcctccgtgccgaccccagaggagccggcctcacctgctgctgctgtgagtaatttagaggagccggcctctcctgccgccgcagtcccaactccagaagtggcagcgatacccgcagcatcggtgcccaccccggaggtccccgcgatacctgcagcagcagtgcctcctatggaagaagtgtcacctatcggagttccctttcttggtgttagtgcccacacagactctgtccccatctccgaggaggggactcccgtgttggaggaggcgtcttccacaggcatgtggataaaggaagatcttgactcactggttttcggcatcaaggaagtcacctccaccgtgctgcacggaaaagtgcccctggcggccactgccgggctgaactcggatgaagttattgtgcacttcgatagcggtaagggcctgaagtccaaagtaagattcgccggcctgacttggtggtag

SEQ ID NO: 32613 - DNA, 207 bp, Artificial Sequence
  Description of Artificial Sequence: Synthetic coding sequence
atgtgcctgtactgttgggacatagagccttcgcaggtcaacccagaggggcccaggcagcaccatccatccgaagtgaccgagcgccagctggctaacaagcggatacagaatatgcagcacctgaaaaaggagaaaaggcggctgaacaaacggttctctcggccatcccccatacccgaacccggactcctctggtcttcttag

SEQ ID NO: 32614 - DNA, 1584 bp, Artificial Sequence
  Description of Artificial Sequence: Synthetic coding sequence
atggtccgccccgggtacagccacagagtgtcactgcccacgagccctggaattttggctacgtccccctatcctgaaaccgacagcgcatttttcgaaccctctcacttgaccagtgcggcggatgaaggggccgtgcaggttagtcgacgaactatttcaagcaactctttctccccagaagtgttcgtgcttccagtggacgtggaaaaggagaatgcacacttttatgtcgccgatatgattatctctgctatggagaagatgaagtgcaacatcctctcccagcaacagacagaatcatggtctaaagaggtgagtgggctgttgggctctgatcagccggatagtgagatgacttttgatacgaatatcaagcaggagagcggatcttccactagctcctattccggttacgaaggatgtgcagtgctccaggtttcgccagtaacagagaccagaacttatcacgacgtcaaagaaatctgcaagtgcgacgttgacgaattcgtgatcctcgagctcggtgatttcaacgatataaccgaaacgtgcagttgtagctgttcttcaagtaagagcgtgacctatgaacctgattttaactctgcggagctgttggcgaaggaattataccgggtgtttcaaaaatgctggatcctgtctgtagtcaacagtcagctcgctggctccctttccgcagcggggagtatcgtcgtgaacgaggagtgtgtaagaaaggacttcgagagtagcatgaatgttgtgcaagagatcaaatttaaatcccgcatccgggggaccgaagactgggcacctcctcgctttcaaatcatcttcaacatccatccccccctcaaaagagacttggtcgtggctgcccagaattttttttgtgccggctgcggtacaccagtagagcccaagtttgtcaagaggctccgttattgcgagtatttaggcaaatatttttgtgactgttgccactcatatgccgaatcttgtattcccgccagaatcctcatgatgtgggactttaagaagtattatgtttcaaatttttccaaacagctcttggacagtatctggcatcagcctatctttaatctattgagtataggccagtccctgtacgccaaggctaaagaactcgatcgggtcaaggagattcaggaacagctcttccacataaaaaagttactgaaaacctgccgctttgcaaactcggctttgaaggagttcgagcaggtgccgggccaccttaccgacgaattgcatctgttctctctggaagacttagtgcggatcaagaaagggctgctggctccactgctgaaagatatcttgaaggcttccctggcacacgtggccggctgcgagctgtgtcaaggtaagggctttatctgtgaattttgccagaacaccacagtaatcttccccttccagactgcgacgtgcagaagatgctccgcctgcagagcttgctttcacaagcagtgcttccagtcttcagaatgcccccggtgcgcacgtatcactgccaggcgtaaacttttagaatcagtggcatcagccgctacctag

SEQ ID NO: 32615 - DNA, 462 bp, Artificial Sequence
  Description of Artificial Sequence: Synthetic coding sequence
gttcgtggagcttccgcaaggccacccctactggggagtgaggaacctctatctcccgcatctcatccagtgagagagggcggaggcggggtctcgcccccgcctggccaacccccatgtcctggaggtagatgggggggacagccgagcgctcgaccagccgccccaagcggccgggaagtaggtgtatcggcccccaggcccgcctcacggcccgtccgagaggttagaggggcttcagcgcgtcctcctctgcttggaagtgaggagcctctgtgcccggcatcacgcccagttagggagggcggcggcggcgtgagtcctccccccggacaacctcctagacctggaggtagaggtgctagtgcaagacccccactgttaggcagtgaagaacctttgtgcgcagctactaccccctcaggaagatgcgcccagcaactgatcgagaatggcccctag

SEQ ID NO: 32616 - DNA, 1290 bp, Artificial Sequence
  Description of Artificial Sequence: Synthetic coding sequence
atggggctaccgtcgtggactcggagatcaaggaaccatgatgtttcgggagctccactgcctctggaatgtaaccacgtgggggaggctcttccccctgagatggtgacacgactgtatgacggaatgcggcgcgtcgatctcactggaaaggccaagggaccttcagaaaatgtgtctcaggagcaatttaccgcctccatgtcccatttattgaaaggaaacagtgaggagaaatctttgatgataatgaaaatgattagcgctacagagggccctgtgaaagccagagaggtgcaaaagtttaccgaggacctcgtgggtagtgtggtccatgtccttagtcataggcaggaactgaggggctggacggggaaggaggctcctgggcccaaccctcgagtacaggtgctggctgcgcagctgctgtccgatatgaagctccaggacggaaagcggcttctcggcccccagtggctggactatgattgtgacagggccgttatcgaggactgggtatttagagtaccccatgtggcgatttttctatcagtggtgatctgcaaaggcttcctgattttgtgcagctcactggaccttaccacactggtccccgagaggcaagttgaccaggggagaggcttcgagtcaattctagacgttctgtcggttatgtatatcaatgcccaattgccaagggaacagcgccaccggtggtgcttgttgttctcttcagaactacacggccactcattctctcagctgtgcggccatattactcaccgcgggccatgcgtggccgtccttgaagatcacgataagcatgtgttcggcggctttgcgagttgtagctgggaggtcaaaccccagttccaaggtgacaacagatgcttcctcttttccatatgcccgagtatggctgtatacacacacaccggctacaacgaccactatatgtacctcaatcatgggcagcaaaccattccaaatggcctgggcatgggcgggcagcacaactacttcgggctgtgggtcgatgtggacttcggcaagggacatagcagagcgaaacccacatgcaccacctataattcccctcagctttcagcccaggaaaattttcagttcgacaagatggaggtttgggctgtgggagatccaagcgaggagcagctcgccaagggcaacaagagcatcctggacgcggatcccgaagctcaggcgctgctggaaatttctggccactctaggcactctgaaggccttcgagaggtacctgatgatgagtag

SEQ ID NO: 32617 - DNA, 2493 bp, Artificial Sequence
  Description of Artificial Sequence: Synthetic coding sequence
atggacgacgatgacgactcctgtctgctcgatcttattggcgatcctcaagccctgaactactttttgcacggacccagcaacaagtcaagtaatgatgacctgactaacgccggatacagcgccgctaactccaactctattttcgccaattccagtaacgccgaccccaagagtagtttgaagggagtctccaatcagttgggtgaaggaccttccgacggactcccacttagtagcagcctacaatttctggaagacgagctggaatcctccccgctgccagatttgacagaggatcagccttttgacatcctgcagaagtccctccaggaggccaatataacagagcagactctggccgaggaggcctatctcgatgctagtatcgggagctcccagcaatttgcccaggcccaacttcatccctctagcagcgcgagttttacccaagcatccaacgtgtctaattacagtgggcagaccctacaacctatcggggtgacacacgtgcccgtaggtgcctcattcgcctccaacacagtgggggtgcagcatgggttcatgcagcacgtcgggatcagcgtgccatcccagcacctaagcaacagtagtcaaataagcgggtccggacagatccaactcattggcagtttcgggaaccaccccagtatgatgaccatcaacaacctggatgggtctcagattatcctgaagggctccggtcagcaagctccgtccaatgtgagcggcggtcttttggtccaccgccaaacgcccaacgggaatagtctcttcggtaattcttcctcttcaccagtggctcagccggtgaccgtgccttttaacagcacaaacttccagacgtccttgcccgtgcacaatataataattcagcgtggtttggcaccaaacagcaataaagtccccatcaacatccagcccaaaccaatccagatggggcagcaaaatacatacaatgttaacaatcttggaatccagcagcatcacgtgcaacagggcattagcttcgcttcagcgtcttccccgcaagggtccgtggtgggtccacacatgagtgtgaacattgtcaaccagcagaacacaagaaagccagtcaccagccaggccgtgtccagcactggcggaagcattgtcattcattccccaatggggcaacctcacgcaccccagagccagttcctgatccccacttccctgtccgtgagtagcaacagcgtgcatcacgtccagacaatcaacggacaactgctgcagacccagcctagtcagctcatttctggccaggttgcaagtgagcatgtgatgttaaacagaaattccagtaacatgttgcgcacaaatcagccttatactggacccatgttgaataaccagaatactgcagtgcatctggtgtctgggcaaaccttcgctgcaagcgggagcccagtcatcgccaaccacgcctctcctcagctggtcgggggacaaatgcccctgcagcaggcttcccccacggtcctccacctgtcccccggacaatcttcagttagtcaaggccggccaggtttcgccacaatgccgagcgtgacctctatgagcgggccgagcaggttccccgctgtgagcagcgcgtccacggcacacccatccctggggtcggcggtccaatctgggtcctcaggttctaacttcacaggggaccaactcacacagcctaaccggacccctgtgcctgtttccgtttcccaccgtcttccagtcagctcttcaaagagtacaagcaccttttcaaataccccaggcactgggacacagcaacagtttttctgtcaggcccagaagaagtgcctgaaccagacttctccgatttcggctcccaaaacgaccgacggtctgcggcaggcccagatccccggcctgctgtctaccactctgcccggccaggattcaggatcaaaggttatcagcgcaagcttggggacagcccagccacagcaggaaaaggtggttggttcgagccctggacaccctgccgtgcaggtggaatcccatagtggtggccaaaaaagacctgccgccaagcagctgacaaagggtgctttcatattacaacagttgcaaagggaccaggctcataccgtgaccccagataagagtcatttcaggtccctgagcgacgccgtccagaggctgctatcataccacgtgtgccaaggtagcatgcctacagaggaagacctacgaaaagtggacaacgagttcgagaccgtggcaacccagctcctgaaaagaacccaggccatgctcaacaagtatcgctgcctgctcctcgaggatgccatgaggataaaccctagcgccgaaatggtaatgattgatcggatgtttaatcaggaggagagagcaagcctgtcgcgggataagcgccttgcgctcgtcgaccccgagggcttccaggcagacttctgctgctacctctactcctag

SEQ ID NO: 32618 - DNA, 1368 bp, Artificial Sequence
  Description of Artificial Sequence: Synthetic coding sequence
atggttgagcagggcgatgcagcccccttactccggtgggctgagggacctgctgtttccctgccacaagcccctcaacctcaggctgggggatggggtagagggggcgggggcggagcccgccctgctgccgaacccccccggcgcagggagccggaggagccagctgccccagaagtcctcctgcagcctggcaggctcgagttgggagatgtggaagaagaccaggtggttgccgtgttcgtagttactttcgatccaaggtccggcaacatggtggagtggtgcctacctcaggatatagacctggaaggggtggagtttaagtcaatggcctccgggtcgcacaaaatccagtccgactttatctacttcagaaaggggccattttttggactcgcatgtttcgcaaatatgcctgtagaaagtgaactggagagaggggccagaatgaagagtgtcgggattttatctccctcgtatactctgttgtatcgctatatgcacttcctggagaatcaggtgcgacaccaattggaaatgcccgggcactactcccacctagcggcattttacgaggacaagaaaggggtgctgcatgccgggccaggcagaggctcttccctgcctcccgtgtactggttgccttccattcacaggtatatgtatcctgagatgaaaatcacccacccagccgggtgcatgtcacaattcattaaattcttcggggagcagatcctgattttatggaaatttgccctcctcagaaagaggatcttaatttttagtccgcctccagtcggggtcgtgtgctaccgcgtgtactgctgttgctgtctagcgaatgtatcccttccgggaataggtgggacgatccctgagtccaagccattcttctatgtgaacgtggcggatatcgagtctctagaggtcgaagtttcatatgtggcctgcacaacggagaagatatttgaagaaaagcgggagttgtacgatgtgtatgtggacaatcagaatgttaagactcaccatgaccacttgcagccactccttaaaattaattccgccgacagggaaaaatacagacgcttgaatgagcagcgtcagatgctgctctacagtcaggaggtggaagaagactacaatccctgcgaggaggacttattcgtgttgttcttcttggagcagaataatagaattttccagaccctgctggaggtttctgcttcacaggataagactctcactgccgagcatgcacgagggatggggctcgatccacagggcgatagatccttcctgctcgatctccttgaggcttatggcatcgacgttatgctggtaattgataacccctgctgcccgtag

SEQ ID NO: 32619 - DNA, 2235 bp, Artificial Sequence
  Description of Artificial Sequence: Synthetic coding sequence
atggaggactgcttgcacacttcctcagaaaatctgtctaagctggtgagctgggcacattcccacgggacaatttgttccctcattccaaatcttaaacacctactgtccgaaggaagccacggaaacttaacagccatgtggggctgctctgcgggacacgcctaccattggccactgaccgcaacttgtcgagccggaagtcaggagcgagtttgcttccaggacaatcggagcttcaacagcgactctccatctataataggcgtcccgagcgagactcaaacctcccccgtcgagagataccccgggcgcccagtgaaagcaaagctggactgtaatcgcactagggatagctgcgatttcagctattgtagtgagcccagtgagctggatgagacagtggaggagtatgaagatgagaacactctcttcgacatggtctgcgagtcctcggtaaccgatgaggactccgactttgaaccccagactcaaaggcctcagtccatcgcacggaagagaccaggtgtcgtaccgtccagtcttcacagctcaagtcaaacccagatggtagacgagtgttccaatgacgtgatcatcaaaaaaattaagcaagagattccagaggactactacatcgtggccaacgctgaactgacaggcggcgtggacggaccagctttatcgttgacgcaaatggccaagcctaagccacagacacacgctggccctagctgtgtagggtccgcgaaactgattccccacgtgacctcagcaatcagcaccgagctggacccacacgggatgagcgcatctccctccgttatctcccgtcctatcgtgcagaaaactgccagagttagcctggccagcccaaaccgagggcctcccgggacccacggaactaaccagcaagttgctatgcagatgccagtgagtacatcccaccccaacaagcagataagtataccactgagcgcactacaactgccaggccaggacgaacaagtggcatctgaggagttcctttcacatctgcctagccaggtcagcagttgtgaagttgcactctccccctcagtgaataccgaaccagaagtcagcagcagccagcaacaaccaccagtcgccccagctatcaccacagaagcaaccgcccagtgcatcccagatcaagacgaacgagctgccgagttgtcccgggagcagaacgagaagacaatcaggtcaactcagacagccttaagaaattttccctattccacgaaactcaacaaatttccagtgttcaatatcaacgatgacttgaacgatctctgcacatccgctgtgagcccaaataccacaaaagccacaagatacgccttgaatgtgtggaggtattggtgcatgacaaatggcctgaaggaccacaccgatatcaccaaaattcccgccgtgaaattgaatgaacttttagaaaatttctacgtgactgtgaaaaagtctgacggctctgatttccttgccacttccctgcacgccattcgccggggtcttgacaggatcctgaaaaacgcaggcgtaggcttctctataacctcatcaacattctcctcatcaactaagaagctgaaagaaaagctgtgggttctcagtaaagccggcatgagtggagcacggtcgcgcaacatcgtttatttttctctttctgatgaagaggaaatgtggcaggcaggctgcctcggagatgacagccctattactctgcttagcaccgttgtgaaatataactcccaatatttgaacatgagaacattgcaagagcacgcagacttgatgtacggcgatattgagctcctcaaggacccacagaaccaaccttatttcgccaggaccgattctgtcaagcgggagtccagaagcgggagcacacgggtgtgccacggaaagatctatcatgaacactcccgcggccataaacagtgtccttattgcctgttgtataaatacatgtacatccatcggccccctactcagatggaggctaaaagcccattctacctgaccgcgagaaaggaagctactgacatgggtagcgtgtggtacgaagagcagcggatggggctcaggtcgctccgcggtatagtccctaatcttgctaaaaaagttaagctggaaaactgtgagaattttacttttgtaagttttacccaggtgagccgccggctaggctctcattcttgctgccaatag

SEQ ID NO: 32620 - DNA, 111 bp, Artificial Sequence
  Description of Artificial Sequence: Synthetic coding sequence
aaagaaaagaaggaagaaaggaaaaaagaacgcaaaaaggaggaaaggaaaaaggaacggaagaaggagcgcaagaaggagaaggaacgcaagaaggaaaaagagaggtag

SEQ ID NO: 32621 - DNA, 462 bp, Artificial Sequence
  Description of Artificial Sequence: Synthetic coding sequence
gtgcgcggcgccagtgctcgaccgccacttctgggctctgaagagccgttatgtccagcctcaaggcccgttagagaagggggaggcggagttagtcccccccccggacagcctccacgcccgggtggccgctggggggggcaacctccagctagaccggctgcaccatctgggcgcgaggttggaggagggcagcctccctgtccagcctcacgcccggtgagagaagtacgaggagcatctgcccgccctcccttactgggctctgaagagcctctgtgtcccgcgtcgcgccctgtgcgcgaaggtggtggaggggtgtcacctccccccggccaacctccccgtccgggacggggggcctcagcccgaccacctcttttgggatccgaggagcctctgtgccctgctacgaccccttcgggacgctgcgctcaacaactcattgagaacggcccatag

SEQ ID NO: 32622 - DNA, 267 bp, Artificial Sequence
  Description of Artificial Sequence: Synthetic coding sequence
atgcctggagttgtaagtgctgcaggcactcaagtccggcgactagacgaggttccagcaagcctgaggctgcagcaccacttacagctcagggagggactggccgtgccattgccgcccctcgtcattcagagcccagctgcgcatcatgtggcgggcgggtccttctctgactttacactggacatcgctctcggagcaaggcggatccgactggccctggtgcggcaagtgacccaagatggaccagtcgcgtttcttgcctag

SEQ ID NO: 32623 - DNA, 456 bp, Artificial Sequence
  Description of Artificial Sequence: Synthetic coding sequence
atgctacggtggtttgtgcagcagcccacctcatgcagccacgctcagccactgcctcctccccacggaacggctagcctgtcacctctggttccaagttgtggatccgcagcttggccaagcctccactacctcggttccccagctgattccggttgtagccgcggtcagcgggctttacctgctgtctggccgccaagctgttacagccagtgtccccaaggacgcccgccccacccagttcccaggtccccccggagaggcagtagggatctaggcaaggaaccgggcgaggaggccgcgccctggccaagtccttgtgattctcgtttacacagacacccaatgcccaggactccgctgagtgcaagtgccggctgcgacccttctctcatacaaccatccccccacccaacgccacctcagcaaggttgtgtgactcctttccacagatag

SEQ ID NO: 32624 - DNA, 2757 bp, Artificial Sequence
  Description of Artificial Sequence: Synthetic coding sequence
atgaacgaaaacatgcgcgccaccctcgccacgtcaaagaacgttttccagttgaaactggaggaaacccagaagcttctggaggaccagcacctgagtaacctgcagaaattcggcgatgaggtgaaccagattaccaactccgagacactgtcttctattgatagcctcgaggccacagaacacgaagagatctaccttacactcaacaaggaacacagcaccagtatccaaagaaatacaatctcactgaagcctgctaacatgcagtccacaaacctctcttgttttgatgaggacaagctcgcttttagtaagacacagcacattaacaactggctcacaaatctcgatgcctccaacacccaaaatgttaccgcctttagcgacattttgtcgaagagcaatgtgctcccatcctgggagtatttcaattccaaggagcagaatcccagtcctctgaatgggactgtcgagagggctacaaacaccgcgaacaacagcgtgccattcgtttccagcccgcccatgttcgtgctcgacaagaagtgcgaaaaaacctcagagaccagtaccatgagaaccactgatagcaccagcggcgcctttaaaagagaaaggccactggttacggaaagcccgaccttcaagttctcaaaatcacagtctacgtctgactctctaactcaggaagtggcgacgtttccagatcaggagaagtactcagagctgaaccaagagaacgggaccacaagcatacccacctcctgcgtgcctgtcgccacccccttagtgcttccatctaatattcagagtgctcgtccctccgccaaaaactcaatccacatcaaggaaattgacgcggttcaatgctccgacaaactagatgagctgaaagacggaaaagaagaggagatcaagtacttcaattgtaacaaggaggagctccccttgttctcagacagttttcaggacgcctacatcccgcataatcccgattctaaggatgagaaacaaaagcttgctgaaacctctagtctctccaacgtgacatctaactatgactttgtcggacaacacaaaaagatgaagtataatattcacgagcgcaacggagttaggtttctgaagagcattctcaagaaggaaagtaagtatgagcacggatatctcaaggctttgattattaatcagtcatttaaatttggtaatcagaaggctgccgccatcagagacagcattgagctgactaaggagaagggcgctgaaatccctaagacaattaagaaattgaggtggttcgacgagaccagcaacatcgagaataacgccgagaatagtcactccttgaaaaacaaaacagggacaacccagcaacatagccaacagtttcacatccagagtggggccggtagtaatataatatcagtctctacttgcgctgtgaattcggccgacactaaaaaaagcagagaagacagcattagcgagaatgtgactacgcttggcggatcaggcgctgaccacatgcccctgaattgcttcataccctctgggtacaattttgctaaacacgcatggcccgctagtaagaaagaagagagcaagatcccagtgcatgacgacagcaagacaaagcagggcaagccccaacggggtagagccaaaatcattagaaaaccaggatcagcaaaggtgcagagcggctttatttgcaccaataggaaaggagctgtaattcagcctcagagtgcctccaaagtgaatatcttcacccaggcccagggaaagctaatcatcccctgtccacctcctcaatcaacctccaatataagaagcggcaagaatatacaggtctctcagtgccagcctgtcactccagagaacccgcagaacatcatcacacataactcattcaacagcaagcatgtgctgcctaccgaacattccctcaatcagtggaaccaggaatcttcaagtcccttgagcaacgcttgctccgatctagtgacggtgataccctctctcccctcttattgttcctcagagtgtcagacattcgcaaagatcaaccactccaatggcactcaggcggtggctaggcaggatgcaacactgtactgtactcagcgctctcctgtgtgcgaggaaagctaccctagcgtgactctgcgcactgcagaggaagagtctgtgcctctgtggaaaaggggccctaatgtgctacaccagaataagcgagcaactggttcaactgtgatgagaaggaagcgcatcgccgagacgaagagacgcaatatcctggagcagaagcgccagaaccccgggagcgtggggcagaagtatagcgaacagataaataatttcggccaatccgttcttctgtcgtcttcggagcctaaacagacaacacgaggaacatcctacattgaagaagtgtccgattctacctctgagttcctgatggctgagaatctggtcaaggcaagcgtgcccgaggatgagattttgaccgtgctcaatagtaaacaaatccagaagtctaatctgcccctaaacaaaacacagcagtttaacatatgcactctgagtgccgaggagcaaaagatcctcgaatcattaaatgatctgtcagaacgtctacactatatacaggagagtatatgtaaaaatccaagtattaagaatacattgcaaatcatcccccttttggaaaaacgcgaggaccggacctcttcttgtcgcgacaagaggtag

SEQ ID NO: 32625 - DNA, 459 bp, Artificial Sequence
  Description of Artificial Sequence: Synthetic coding sequence
ctgccgctgttttgctcttctgggatcctccagaaagagttctggcggaatcgcatccagtataaccagtcacagaaagacattctgcagtcctggtttcagcacgatccttttcctgacaaggcagccagagagcagctcgcgaaagaaattggagtccctgagtccaacatccaggtctggtttaaaaattatcgcgtcaaacagagaaagctcgattacaagtgcttctccgagaaggatcagacacaggggcatgaccagagccagcatctcacacaggagtaccttcccaaggaagctcggcagaagcaaaccttcatcacttggacacagaagaatcgtttagtacaggccttcgaacgcaacccctttccagacatcgcaaccaggaagaaactcgccgaacaaactggcctgcaggaatcaaggatccaggtttcgtctatgtgtgtgtag

SEQ ID NO: 32626 - DNA, 3930 bp, Artificial Sequence
  Description of Artificial Sequence: Synthetic coding sequence
atgcttctaaacggtgattgcccggaatccttaaagaaagaagctgcagccgcggaacctccccgggagaatggtctggacgaagcaggtccaggagacgaaactaccgggcaggaagtcatcgttattcaggacaccggcttcagtgtgaagatcctggctccgggcattgaacccttctccctccaggtaagcccacaagagatggtgcaggaaattcatcaggtcctgatggacagggaggacacctgtcaccgtacttgctttagccttcaccttgatggaaatgtcttggaccacttcagcgaattgagaagcgtggagggccttcaagaaggaagcgttttaagagtggtcgaggaaccatacaccgtgcgggaggcccggatccacgtgcggcatgttcgcgacctcttgaagagtctggacccctcggatgcgttcaacggcgttgattgtaactctctgtctttcctgtccgtgttcacagacggtgatctaggcgacagcggtaaacgcaagaagggccttgaaatggatcccatagactgtactcctcccgaatatatccttccgggaagcagggagaggcctctgtgtccactgcagcctcaaaatcgagattggaagccactgcagtgtctgaaggtactcaccatgagcggatggaaccccccacctggcaatcgcaagatgcatggagaccttatgtacctgttcgttatcactgccgaagatcggcaagtgagcattactgccagcactaggggcttttatctgaatcagagtaccgcttaccactttaacccaaaacctgctagcccacgatttttgtcccacagcctcgtggaactcctcaaccagattagccccaccttcaaaaagaacttcgctgtgttgcagaaaaagcgtgtgcagagacacccttttgagcggatcgccacaccgttccaagtgtacagttggactgccccacaggccgagcatgccatggattgcgtgcgagccgaagacgcctatacttccagattgggatatgaagaacacatccctgggcagacgcgcgactggaatgaggagctgcagactacaagagagctgcctcgcaagaatctgccagagcgacttctgagggagagggcaatcttcaaagtgcatagtgactttacggccgcggcaactaggggagctatggcggtcattgatggaaatgtcatggcaattaatccatcagaagagacaaagatgcagatgtttatatggaataatatctttttcagcctaggattcgacgtaagggatcactacaaagacttcgggggcgatgtggccgcctacgttgctcccacaaacgacctaaatggtgtgcgcacttataatgctgtcgacgtggaagggctgtatacgttggggaccgtggtcgtggactaccgaggatatagggttactgcacagtctatcataccgggcatcctggaacgggaccaagaacagtccgtcatctacgggtcaattgactttggtaagactgtggtgtcccaccccaggtacctcgaactgttagaaagaactagccgccctttgaaaatcctccgacaccaagtgctgaacgacagagacgaagaggtggagttgtgctcttcagtggaatgcaagggcattattggtaatgatggcaggcactacattcttgacttactccgcaccttccctcctgacctcaactttctccctgtacctggcgaagagctccccgaggagtgcgctcgagcgggttttcccagagcccataggcacaaactatgttgtttaagacaggagttggtggacgcattcgtggagcatcgttatctcctgttcatgaaactggccgcactgcagctcatgcaacagaacgccagccagttggaaacacccagtagcctggaaaatggaggcccatcatccctggagtccaaatctgaggatcctccaggacaagaagccggctcggaagaggaaggatcctccgcttctggtcttgccaaggtgaaggaactggccgaaacaattgcagccgacgacggcaccgaccccagatctagggaagtgattaggaatgcctgtaaggcagtgggtagtatttcaagtaccgcctttgacataagatttaaccccgacatcttcagccccggggtgagattcccagagtcttgccaggacgaagttagggaccagaaacaactcctcaaggacgccgccgcctttcttctttcctgtcagatccccggactggtcaaagactgcatggaacacgccgtgcttcctgtcgacggggccacccttgctgaagtaatgcgccaacgcggcatcaatatgcggtacctaggtaaggtgctggaactagtcctccgaagcccggccagacaccaactggatcacgtattcaagataggaattggtgagcttatcacaaggtcagctaagcatatctttaaaacatatctccaaggcgtggaactctccgggctctcggccgcaatatcccacttcctgaactgctttctcagctcctatccaaaccccgtggctcatctgcctgccgacgagttggttagtaaaaaacgaaataagcgccgtaaaaacagacctcccggggctgcggataatactgcctgggccgtaatgacaccacaggagctctggaaaaatatctgccaagaggccaagaactacttcgatttcgacctggagtgcgaaacagtggatcaggccgtggagacctacggccttcagaagatcacactgttaagggaaatctcgcttaaaaccggcattcaggtgttactgaaagaatacagtttcgatagccgccacaagcctgctttcaccgaggaagatgttctgaatatatttccagtcgttaagcacgtgaacccaaaagcttccgacgcctttcatttcttccagtccggacaggccaaggtgcagcagggctttcttaaagaaggctgcgaactaattaatgaggctctcaatctgttcaataatgtatacggcgctatgcacgtcgagacgtgtgcgtgcctgcgactactcgcccgcctccattacataatgggcgattacgccgaggccctgagcaatcagcaaaaggctgtgctgatgagcgagcgtgtgatgggcactgaacacccaaacactatccaagaatatatgcacctggctctgtattgctttgcctctagtcagctgtccaccgctctgtctcttctgtatcgggcacggtatctcatgctcctggtttttggagaagaccacccagaaatggctctgcttgacaacaatataggactcgtgctgcacggggtgatggaatatgacctctccctccggtttcttgagaatgctcttgcagtgagtactaagtatcatggtccaaaggcactgaaagttgcgctttcccaccacctagtggctcgcgtttatgagtctaaagctgagtttagatcagcgttacagcacgaaaaagaaggctacactatctataaaacgcagctcggagaggatcacgaaaaaaccaaggagagcagcgagtatctcaaatgtctgacgcagcaggccgttgccctgcagagaaccatgaacgaaatttaccggaatgggagcagcgccaatattcctccattgaaatttactgccccttccatggccagtgtgttggagcaactgaacgtaatcaatggcattttgttcattcccctcagtcaaaaagatctagaaaacctcaaagccgaggtagcacgcagacaccagctccaggaggcaagtcgtaaccgtgatcgcgctgaggaacctatggctactgaacctgccccagcaggcgcacctggtgacttgggttcccagccccccgccgccaaagatccgagtcctagtgtccagggatag

SEQ ID NO: 32627 - DNA, 3681 bp, Artificial Sequence
  Description of Artificial Sequence: Synthetic coding sequence
atgggcgagcagaaagtgagccggcagtttaagcaatgccacagaactaccagttgggcaaagagcaaacttttcagtcgtctgtcatctatgtttcttcagcagttgggcaagaacataaaattcggtcagcgctcacctaacgccattccgatgaacaaagctaatagcggggaggcctctctcgaagaagacctgtttctcaccagccctatggagatagttacacagcaggacatcgtgctgtccgatgccgagaacaaatcaagtgatacacccagctccctcagtccactgaacttgccgggcgccggctctgagatggaggagaaggtcgcaccggttaaaccgagtcgtcctaagagacactttagtagcgctggaaccattgagagtgtgaacctggatgctattcctttagctatcgcaaggctcgacaacagtgccgccaagcataaactggcagtgaagcccaagaaacagagggtatcaaagaaacacagacgtctcgcccaggaccctcagcatgaacaagggggtttggaatccagaccatgtcttgaccagaatggccacccaggggaggataaacccacctggcacgaggaggaacctaaccccttggattccgaggaggaaaggcgcagacaggaggactattggagagaactggaggcaaagtgcaaaagacagaaggcagaagctgcggaaaagcgcagactcgaagaacagaggttgcaggcgctggaacgcaggctatgggaagaaaaccgcaggcaggaactgttggaggaggagggcgaagggcaagagccacctttagaagctgaaagggccccccgggaagaacagcagcgaagtttggaagcacctgggtgggaagacgcagagcgacgcgagcgggaagaacgggagcgcctggaggccgaggaagagagacggagacttcaggcacaagcccaagccgaggagcggagacgtctagaagaggacgcgcgactggaggaacgccggagacaggaagaggaagaggggaggtgcgcagaagagctcaagagacaggaggaggaggaagcagagggatgggaggagctggaacaacaggaggcggaggtgcagggtccacccgaagctctggaggaaactggcgaagggcggaggggcgctgaagaggaagatctgggggaggaagaagaggaaggacaggcccatttggaggactggcgcgggcaactgagtgaactgttgaacgacttcgaggaaagactagaagaccaggaaagactgaagccagagggacaacgggagcacagcgaggagccaggaatttgtgaagagcagaatcccgaagccgagcggcgcagggagcagcagggtcgctcaggagacttccaaggagctgacaggccaggacccgaagaaaagagggaggagggggacacagagcctctgttgaagcaggagggtcccgtcgaggccgcgcagcctcccgttgaacgcaaggaagctgccgcactggaacagggccgaaaggtggaagagttgcggtggcaggaagtggacgagaggcaaaccatgccccgcccttacacatttcaagtatccagcggcggcaagcaaattctgtttcccaaggttaacctctcccccgtcacaccagcaaaagatactggcctgacagcagcgccgcaggagccgaaggccccgaaggcaagtcccgtccagcatgccctgccatcctccctgtccgtgccccacactgccatacttgtgactggcgcgcaactgtgcggccctgccgtgaacctgagccagattaaagatactgcctgcaagtctcttcttgggctggaggaaaaaaagcacgccgaagcccctgctggtgagaacccaccacgaggccctggcgacgcccgcgcaggtagcggaaaagctaaacctcgacaagagtccccatcgtccgccagtgccctggcagagtgggcgtctattcgcagtcgcattttaaaaaacgccgagtccgacccccgctcctccgaaagagatcagctacggcccggcgacgagtccaccccaagaggtaggtgtgacagcaggggcaatcagcgcaaaaccccaccagtgaacgccaaattttctatcatgcccgcatggcaaaaattttccgacggagggacggaaacttctaagcagtccaccgaggcagaatctatacgaaagaggccaatgctggggccctctgaagagaccgctcctcaacctccacctgccggggtgcgcgagctggggaaggggccagaaaaatctgaaatgcatagagagcccgcggatacaaccgaaggctgtaaattcgccaaagacctccccagctttctggttccgtcactcccctatccaccccagaaggtcgtggcccacactgaatttactacatcgagcgacagcgagaccgccaatggaattgctaagccagaccccgtcatgcccggcggagaggaaaaagcctcccctttcgggatcaaacttcgtaggacaaattattctctgcgcttcaactgcgaccagcaagccgaacagaagaagaagaaaaggcactcatctacaggagatagcgcagatgctgggcccccggccgccgggagtgctcgaggggagaaggaaatggagggagtggcacttaagcacggtccatctctcccgcaggaaagaaaacaggcgccgtccacccgaagagattctgctgagccatcatcaagtcgatccgtgcccgtggcccatcccggaccaccacccgcaagtagtcagactcccgctcccgagcatgataaagctgccaacaagatgccgctagcccagaagcccgcgttggccccaaagcccacatcccagactccccctgcatcaccactaagtaagctgtctcgcccgtatcttgtggagctgctttctcgacgcgccggcagaccagatccagaaccgagcgagccaagtaaggaggaccaggagtcatctgataggcgccccccgtccccccctggaccggaggagagaaaaggccagaaacgcgatgaggaagaggaggcaactgagcgcaaacccgcttcaccccctctgcctgccacgcagcaggagaagccctcacaaacccccgaggccggacggaaagaaaagccaatgctacagtcccgtcactccctggatggaagcaaactaacggaaaaagtagaaactgcccagcctctttggatcactcttgcccttcagaaacagaagggtttcagggaacagcaagctacacgcgaggagaggaagcaggcccgggaggctaaacaagcagagaagctgagcaaggaaaacgtgagtgtgtcagtgcagcccgggtcttccagtgttagccgtgctggaagtctacataagtctactgcgctgccagaggaaaagaggcccgagacggctgtgtctagacttgagaggcgagagcagctgaaaaaagcgaacaccctacctacctccgtgactgtggaaatttctgactctgctccgcctgcacccctggtcaaggaggtgacaaagcgatttagtacccctgatgccgcaccggtctccacagagcctgcctggctggccctcgccaagaggaaagccaaagcgtggagcgactgtccacaaataattaagtag

SEQ ID NO: 32628 - DNA, 2538 bp, Artificial Sequence
  Description of Artificial Sequence: Synthetic coding sequence
atggcgcaggtctggaggcgggtgtcagagcacttctgggaatcagaaactacaacatccaaaagcacatctgggcttaccgatattacttggagcagttctgggtccgacctgtcagacgaggacaagactttgtctcagttgcagcgcgatgagctgcagttcatagactgggaaatcgactctgacagagctgaggcatctgattgtgacgaatttgaggatgatgagggtgccgtggaaatcagtgattgcgcctcttgcgccagcaatcagtccctaactagtgatgaaaaactgtctgaactccccaagccttcttccatcgaaatactcgaatacagcagcgattcagaaaaggaagacgacctggaaaatgtgctgctcatagacagcgaatctccgcacaaataccatgtccaattcgcttctgacgccagacagattatggaaaggcttattgacccccgcaccaaatctacggaaacaatcctgcacacgccacagaagcccacggcaaaattccctcgcacgcctgagaattcggctaagaaaaaactgctgaggggaggcctggctgagcgcctcaatggattacagaatcgcgagaggtccgcgattagtttgtggcggcatcagtgtatctcataccagaagacgctgtcaggcaggaaatctggcgtgctgacagttaaaattcttgagttgcacgaggagtgcgcaatgcaggtggcgatgtgtgagcagttacttgggagtcctgccaccagttcttcacaatcggtcgccccacgacctggagctggcctcaaggtcttatttaccaaagaaaccgccggttatttacgcgggaggcctcaggacaccgttaggatcttccccccatggcagaagcttattataccctctggatcttgccctgtgattcttaacacctacttttgtgaaaaagttgtggccaaggaggactcagagaagacctgtgaagtgtattgcccggacatacccctgccacgaaggtcaatctccctggcacaaatgttcgtgattaaaggattaaccaacaacagcccagagatacaagttgtgtgctcaggcgttgcaaccaccgggacagcttggacccatggccataaggaagcgaaacagagaatcccaactagcactcctctgcgggactctttgttggacgtggtcgaatcccagggcgctgcaagctggccaggcgctggagtaagagtagtggtccagagagtgtattctttgccttcccgggattctacaaggggccagcagggggcaagctccgggcatacagatcccgcggggacaagagcctgcttacttgtgcaggatgcttgcgggatgtttggcgaagtgcatttggagtttaccatgagcaaggcaaggcagctcgagggcaagtcctgctcactggtgggcatgaaggttctccagaaggtgactcgaggcagaacggccgggattttctccctgatcgacacgttgtggccaccagcaattccactgaaaactcccgggcgtgaccagccgtgcgaggagatcaagacacatctacccccacccgccctgtgctacatcttaactgctcatcccaacctgggacagattgatattatcgatgaggacccaatctataagctgtaccagcctcccgttacgaggtgcctgcgagatatactacagatgaacgacttgggaacccgttgttcattctatgccaccgttatttaccagaaaccgcagcttaaaagccttctgctgctggagcaacgtgaaatatggctgcttgtcaccgatgtgactctgcagacaaaggaggagagagatccccggttgcccaaaacccttctggtgtacgtggctcccctgtgcgttttgggcagtgaggtgttagaggctcttgcaggcgcggctccccattctttgttttttaaggacgctttgcgggaccagggccggatcgtctgcgctgaaagaactgtgctactgctccagaaacctctgctatctgtcgttagcggggcttcctcatgcgaacttcccggtcctgtgatgctcgatagcctcgattccgccactcctgttaactcaatttgctcggtacaggggaccgtggtaggtgtggacgagtcgacagccttttcatggcccgtgtgcgatatgtgcggaaatggccgtctggaacaacggccagaggaccgaggcgcgtttagctgcggcgactgttctcgtgtagtgactagccctgttttaaagagacatttgcaggttttccttgattgcaggtccagaccccagtgcagggtcaaggtgaaactcttgcaacgctcaatttcgtccttgctgcgctttgctgcaggggaggatggatcttacgaagtcaagtcagtgctgggcaaggaggtgggtctgcttaactgttttgtgcagtcggttacggcccaccctacctcctgtatcggtctcgaggaaattgaacttttgtccgctggtggcgcatctgcagagcattag

SEQ ID NO: 32629 - DNA, 324 bp, Artificial Sequence
  Description of Artificial Sequence: Synthetic coding sequence
atgctttcgaaggggcggtctccaagaagaaaacaggtacaaacacagcgaaaagccgccttggtgcttagcgtgacgccgatggtcccagtcggttctgtgtggttagccatgtcctcggtgctctctgcctttatgcgtgagctgcctggctggtttcttttttttggggtgttcctcccagttacactcctgttgctgctccttattgcgtattttagaattaagttaatcgaagtgaatgaggagctgagccagaattgtgatcggcaacataatcccaaagacggatcctccctctatcaaaggatgaagtggacatag

SEQ ID NO: 32630 - DNA, 876 bp, Artificial Sequence
  Description of Artificial Sequence: Synthetic coding sequence
atacggccttttagctccgtcaacagcctggtcctcaacgaggctagcacactggcgaagaggctttctacatttacgactttcatcagacctttctcttcaatgaagtcaccggtgttgaacgaggcaagggcactgagtaagcgctttgccacctttacggctctgattcggtcttgtgcctccatgaacagccccgtgctgaatgaagtgcggtttgcgggaaagggattctccacctttacggcctttattagatcgttctcctcagtgaactcactggttttgaatcaggacaagttcgcagcaaagggcttcttgactttcaccgccctcataaggcctatcacctccgtcaatgctgcagtaagcaacgaggtgcgcgaactttcaaaaggttttccaacattctccgccttcatacgatcttttagcacagtgaattccttagtcctgaacgaatttcgtttcgctgctaagagatttcctaccatcaccgccctcatcaggcattttagcagcgttaatagctctatgtccaacgaaatagaagatcttagtaagggtttccccacactgaccgctctaatccgaccgttttctagagtgaactctctagtgagcaagaaagctcgcgccctgtcgaaaggattccctgccttagcaacctttatcagaccatttagcagtgtgaatagcctagttttcaacgaggtcagattcgttgctaagggcttccccacctttaccacactcatgacccatagctcgagcgtgacgagtttggtggtcaatgagttcagattcatggataagggttttctcactatcaccgcattcatccggcctttctcctcggtaaactacctggtgtag

SEQ ID NO: 32631 - DNA, 672 bp, Artificial Sequence
  Description of Artificial Sequence: Synthetic coding sequence
aaaccctacgcctgcaatgaatgtgttaaaagcttctgtgtgaaaagctctttaatcattcaccaaagaacacacactggtgaaaaaccctacaagtgcaatgaatatgggaagacctttcaccacaaatccacactaacagttcaccagaggactcacggggaaaagccctataagtgtaatgagtgcaggaagagtttctacatgaagtccgccttgtcacaacatcagcgaattcacatatgggaggagcactgtgagtgtaaggagtgcggcaaaacttaccagcgctctcacctggcaaagcatcatcggaagtatactaaaaagccttatgaatgtaaacagtgcggtaagacctttcagaaaagtcacttgatcgaacaccagcgaacacaccctggggagatccctcacgaatgcaacaaatgtggaaaatcattctgttacaagagtccgttaaccattcaccagcgcactcacatcgaagagaaaccatacaaatgctctaagagtgtgacatatttttgcatgaagtcccatctcaccgttcaccaacgccctcatacccgtaaaaacccattcgagtgcaatgagtgtcgaaaaatgttctacgtgaaatcaaatctgatcaaccaccagcggacccatacaggagaaaaaccttactag

SEQ ID NO: 32632 - DNA, 621 bp, Artificial Sequence
  Description of Artificial Sequence: Synthetic coding sequence
atgaaagcaggatttcacctcaaccccaaagccattgaagcttcgcttcagggatgttgttccgaagcggaagctcagcagactggacgaagacaaacccctccacaacccatgcaatgcgagcttcctaccgtgccggtccaaatcggctctcacttcttaaaaggagttagtttcaacgaaagcgcagccgataacctaaaattaaagactcataccatgttgcagctgatgaaagaggccggctgttataacggaataacttctcgtgacgactttccagtgactgaagtgttgaaccaggtatgtcccagcacctggagaggggcgtgcaagactgcggttcagcttctgtttggccaagcgggactagtggtggtggataccgcccagatagagaacaaggaggcgtatgccccccagatttcgttagaagggagtcgtatcgtcgtccaggtcccatcaacctggtgcctgaaggaggaccccgccacaatgagtctcctgcagcggtctctcgatccagaaaagacacttggactggtagatgtcctgtatactgccgttctggacttgaataggtggagggccggcaggttagtgtacctgagctttttctag

SEQ ID NO: 32633 - DNA, 3945 bp, Artificial Sequence
  Description of Artificial Sequence: Synthetic coding sequence
atggaaaaacacaacgcgctgagatgtttgccaggcagaaatcggaaggagagtacctccgagcagatgcccagcttccctgagatggtgtactacatacaagagaaggcctctcacaggatgaaaacccctgttaagtacatgacaggaactactgtgttgccattcaaccctgccgcattcggcgaaattgttctctacctgcgcatgtgcctggctcacagtgctggtgtggttcctacttcccagtctctcgccgatatgcaggaccacgctcccgctattggaagatatatccgcactcttatgtccagtggccagatggctccttccagcagtaacaagtctggggaaactaacccggtgcagatatacattggacttctgcagcagctactcgcaggcgtgggaggcctgcctgtgatgtactgtctgctggaagccgtcagcgtgtaccccgaaaagctggccaccaaatttgtggataagacagagtggattaagtccctgatgaacaattctaaggaagagatgcgagaactcgctgccctgttttattcagttgtcgtctcaacggtaagtggaaatgaactcaaatcaatgattgagcagctgattaaaacaaccaaggacaaccacagccccgaaatccagcatggcagtttgttggccctggggttcacggttggccgttaccttgctaaaaagaaaatgcggatgagtgaacagcaggacctggagcggaatgctgacaccctgcccgaccaggaggaactaattcagtccgccaccgagacaatcggcagtttcctggattctacttcccccctgcttgctatcgccgcctgtacagcactcggagaaataggccgcaacggacccctgcctataccatcagagggatcaggcttcactaagctgcatctcgtggaaagccttctgagccggatcccttctagcaaggagaccaataaaatgaaagagagggctatccagacacttggctatttccctgtcggagacggcgacttcccacatcaaaaactcctgttacaaggactaatggatagtgttgaggccaagcagatcgagctgcagtttaccattggcgaggctatcacgagcgctgcaatcggcacgtcatccgtggccgctagagacgcctggcagatgaccgaagaggagtataccccccctgccggcgccaaagtgaatgacgtggtcccctgggtgctggatgtcatactcaacaagcacatcatctctcccaatccgcacgtgcgtcaggcagcttgtatctggctgctgtctctggtgcgaaagctttcaacccacaaggaagttaagagccatctgaaggagattcagtccgcctttgtgtctgtccttagtgagaacgacgaactctcacaggatgtggcgtccaaagggttgggactggtctacgagctggggaatgaacaagaccagcaggagctggtctctacactggttgagaccttgatgaccggcaaacgggtaaaacacgaggtcagcggagagacagtggttttccagggaggggcgctcgggaaaacacccgacggccaaggcctgtccacctacaaggagctgtgtagtttggcatccgacctctcacagccagatcttgtgtacaagttcatgaacctggccaaccaccacgcaatgtggaacagtagaaagggtgcagccttcggtttcaacgtgattgcaaccagggccggagaacaactcgcaccatttttgccacagttggttcctcgcttgtaccgctaccagttcgatcccaatctggggataagacaggcgatgacatccatctggaatgcgttggtgacagataagagcatggttgataagtatctcaaagaaattcttcaggacctggtcaaaaatctgactagtaacatgtggcgggtccgagagagcagttgccttgctttgaacgatctgctgcgagggagaccactagacgatattattgacaagctgccggagatttgggaaacccttttcagagtgcaggacgacatcaaggagtcagttagaaaagccgcagagctggcccttaagacactgagcaaggtgtgtgttaaaatgtgcgacccggctaaaggggcggcagggcagcgcaccatcgctgcactcctgccatgcctgttagacaaaggcatgatgtccactgtcacagaggtgagagcactgagtattaacaccctggtgaagatctcaaagtctgcaggcgcaatgctgaaacctcatgcaccaaagctgatccccgccctgctggagtcactctctgtgctcgagccgcaggtgctcaactatctctcactccgggctacggagcaggagaaggccgctatggattctgcccgattgtccgcagcaaagtcctcacccatgatggagaccattaatatgtgcctgcagtaccttgacgtgagtgtcttgggagagctcgtgccacggctttgcgagttgatccggtccggagtgggacttgggacaaaaggcggctgtgcatcggtaatcgtgtccttgacaacacagtgtccacaagaccttactccatattcgggtaagctaatgtccgccctcctctccggcttgaccgacaggaattccgtcatccagaagtcttgcgcttttgccatgggacacttggtcagaaccagtagagattccagcacggaaaagcttcttcagaagctaaacggatggtatatggaaaaggaagaaccaatatataagacaagttgtgcactgaccatccacgccattgggcgctacagccccgatgtgctgaaaaaccatgctaaagaagtgcttcctttagctttcctcgggatgcacgaaattgctgacgaagagaaatcggaaaaggaagaatgcaacctttggacagaggtgtggcaggagaatgtccccggcagtttcggaggaatacgtctctatctgcaggagctcattacaatcacacagaaagctctgcagagccagtcatggaagatgaaggcacagggcgcgattgccatggccagtatcgcaaagcaaaccagtagcctggtgccgccatatttgggtatgatccttaccgccctgctgcagggccttgcagggcgtacttgggcagggaaggaggaattgctaaaagccattgcctgtgtagtcactgcttgcagcgctgagctcgagaagtcagtgcctaaccagccctccaccaacgaaatcctgcaggcagtcctgaaggaatgtagcaaagagaacgttaaatataaaattgtcgctatctcatgcgccgcggacatcctgaaggctaccaaggaggataggtttcaagagttctctaatatcgtcattcctctgatcaagaagaacagcttagagtcgagcggtgtgagaaccacaaaaaatgaagaagagaacgagaaagagaaagaactgcagctggaatatctcctcggagcttttgaaagtttgggcaaagcctggccaaggaacgctgagacccagcgatgctaccgccaagaactctgcaaactcatgtgcgagagactcaagctttcgacctggaaggtccagctgggcgtattgcagtcgatgaatgcgttcttccagggattgatgttgcttgaagaggaacatgcggatcccgaggccttagccgaaattctactcgagacttgcaagagcattacctactctttggagaataaaacctattcatcggttcgaacagaggcactgtcggtgattgagcttctcttgaagaaacttgaagaatctaagcaatgggaatgtctgacttccgagtgtcgcgtactgttgattgaaagccttgccactatggagcccgatagtcggcctgaactgcaggaaaaggcggcactgttgaagaaaaccctagagaatctggaatag

SEQ ID NO: 32634 - DNA, 618 bp, Artificial Sequence
  Description of Artificial Sequence: Synthetic coding sequence
atggaggacggtggccagagggaggaagaaacacggcgaaacgccacttgcggagctgcagcaaagtctgagaataggggcaaacggcacgcctctgctggaaagaagggcgcgggaggtactagccccaccgcacctagcacgaagcggccacttcctggactttcagcacctctgggagccgggtccgcctcctcccctcccctgcgagcgccagtgccgagaagcgagtgccctggccgccggcgccccgtgctcgcggcccggagcgatgccctcgagagctcccctatttcactgcctgctaccccggtgagacgcccgctactctcctacagcgcgcctacacatctaggaacccctggcggtgcaagaggccacctgcagggtgaaggactgcgcggacaggggaaacctcctgtgtggagggtcagacgagcgctgccaccaggatggacccaacaggccgaagcgcaggagcaaggttcggctaccagggcaggactaggagctcgccgcggggtcggcactgccagctgggggtggacctgggctacttgtggccgtaagggcgctcgcaatcgcaagagatccgatgaaaggccacgtccgccgtag

SEQ ID NO: 32635 - DNA, 1353 bp, Artificial Sequence
  Description of Artificial Sequence: Synthetic coding sequence
atgaacagagtttccgaagagaaagaggttaccgaggagagactcaaggccgagcaagagtccttcgagaaaaaaattcggcagttggaagagcagaacgagctgatcatcaaagagcgcgaggccctccagttgcagtatagagagtgccaggaactactgagcctttatcaaaagtacttatcagaacagcaggaaaaactcactatgagtctctcagaactcggtgctgcccgaatgcaggaacaacaggtgagcagccggaagtcaactttgcagtgtagcagtgttgagttggacggctcctacctgtcaatcgcccggcctcagacgtattaccagaccaaacagcgacccaagtccgccgtacaggatagtgccagcgaatcactgatcgctttccgcaacaactcccttaagcccgttaccctccatcaccctaaggacgatcttgataaaatcccatccgagactacaacctgtaactgcgagtcccccggacgaaagccagccgtccctaccgaaaagatgccccaggaagaattgcacatgaaggagtgtccccacctcaaacccaccccgtcccaatgctgcggccacaggctcgcagccgatagagtgcacgattcgcaccccaccaatatgactcctcaacacccaaaaacccatcccgaatcatgcagttattgccggttatcatgggccagcctggttcacggtggcggcgcccttcagccaatcgagactctcaagaagcagatatcagaagatcgcaagcagcagctgatgctacagaagatggaattggaaatcgaaaaagaaaggctccagcacttactggcccagcaagagactaagctgctgcttaaacagcaacaacttcaccaatcacgactggactataactgccttcttaagtcgaactgcgatggttggctcctgggcacatcaagttccattaagaaacatcaggatcccccaaattccggtgaaaatcgaaaggagcggaaaactgtgggctttcactctcatatgaaggatgacgcgcagtggtcgtgccagaagaaggatacttgtaggccccagcgagggacagtcacaggcgttcggaaggacgcatctacttccccgatgccaaccggttcactcaaggacttcgtgacaacagccagcccgtctttgcagcacactacgtcaagatatgaaacgtctctccttgacctggtgcagagcctgagcccgaactctgcccctaaaccacagagatacccatcaagagaggccggagcctggaaccacgtcaatttgcaggaggtgagctctccctctcggcgcggaggtctccatctgtag

SEQ ID NO: 32636 - DNA, 1257 bp, Artificial Sequence
  Description of Artificial Sequence: Synthetic coding sequence
atgaaaaaaaggaaggagctcaacgcactcattgggctcgccggagatagcagaagaaaaaagcctaaaaagggaccctcttcacaccggttgctcagaacggaacctcccgactcggattcagagtccagttcggaggaagaggaggagttcggtgtcgttgggaaccgatctcgattcgcaaagggcgattacctgcgctgctgtaaaatctgttatcccctttgcggatttgtgatactggccgcctgtgtggtggcatgcgttggtctcgtgtggatgcaggtggccctgaaggaagatttagacgccctgaaggaaaaattcaggacaatggaaagcaaccagaagagctcctttcaggaaatccctaaactgaatgaggagcttctgtctaagcagaaacaactcgagaaaatcgagagcggcgagatggggctaaataaagtttggattaatataacggagatgaacaagcaaatctctctattgacttcagctgtcaatcacttgaaggcaaatgttaaatccgcagcagacctaatcagtctgccaaccaccgttgagggactgcagaaaagcgtcgcgagcattggaaacaccctcaatagcgtccacctcgccgttgaagctctccagaagactgtggacgagcacaaaaaaacaatggagttgcttcagtcagatatgaatcagcattttctgaaagagacgcccgggagtaatcagattattcctagtccctcggctacttccgagctggataacaaaacccacagcgagaacctcaagcagatgggcgatagaagtgcaactttgaaacggcagtctctggatcaggtgacgaatcggacggataccgttaaaatccagagcattaaaaaggaggacagttctaattcccaggttagcaaactgagagagaaactccagctgataagcgccctaacaaacaaaccagaatctaaccgaccaccagagacagctgacgaagaacaagtcgaatcctttacatccaagccttctgctctgccaaaattctctcaattcctgggagaccccgtcgaaaaggccgcccagctcagaccaatatcactccccggcgtgagctctacagagggtcagacacagctcctgctgtcccccgcctggagaaacgccgttaatttcgggagctcccaatggggaattccaggtaaagtgattctctctaacgtgtggaataggcgccagatgccctggggcaacagcctgtag

SEQ ID NO: 32637 - DNA, 1203 bp, Artificial Sequence
  Description of Artificial Sequence: Synthetic coding sequence
atgggcgttcttatgagcaaaagacagactgtggagcaagtgcaaaaagtttcccttgcagtgagtgcatttaaagatggtctgagagacagaccaagcatccggcgtaccggagaattgcctgggagccgcaggggtactgttgaggggtccgttcaagaagtccaggaagagaaggaagcggaggcaggtacttcagtggtacaagaagaatcatccgccggccgcgccgcctgggagagactccgagatggccgtggcgtcgaaccggaggagtttgatcgtactagcaggttcacccctccagcttttatcagaccaaccaggaagttagatgatgataagcctcccgaaatttgcctcgaaccgagagaacctgtggttaatgacgagatgtgtgatgtttgcgaagtatggaccgccgagagtctttttccctgtcgtgtgtgtacaagggtctttcacgacggatgtctgcggcggatggggtacatacagggtgattccgcagctgaggtgacggaaatggcacacaccgagaccgggtggagctgccattactgcgacaatattaacctgctgttaacagaggaggagatgtacagcttgacagaaacttttcagcgatgtaaagtcattcctgactgcagcctgacactcgaggactttctccgatatcggcaccaggccgctaagaggggcgacagggaccgggccctgagcgaagagcaggaggaacaggccgctaggcagtttgccgcactggacccagaacacaggggtcacatcgaatggcctgattttctgtcccacgagagcctgctgctcctccagcaacttagaccccagaactccttattgcggctcttaaccgtaaaggagagagaacgggccagagccgcgtttctggcaagggggtcaggatcaacagtgagcgaagctgagtgccgtcgtgcacagcatagttggttttgtaagcgatttccagaggcgccatcatgctctgtgtccataagccacgtcggccccattgcggacagctcgcccgcatcaagctcatccaagagccaggacaagacactcctgccaactgagcaggagtctcggtttgtggattggcccacctttctgcaggagaacgtactttatattcttgccgctcgccccaatagcgcagccatacatctcaagccgcccgggtag

SEQ ID NO: 32638 - DNA, 210 bp, Artificial Sequence
  Description of Artificial Sequence: Synthetic coding sequence
atgatggtcctcaccccgttttggcttggaagagattgtcctagccggggacagcccacactgagggagggaaaagggctctcggtgcccttcacatgtaagttgaataatccccaaagatacctgttatatctcacccacacccctagacgtcaatattcccccgcatggtatctacccggcaaattgggcataactcttactgtgtag

SEQ ID NO: 32639 - DNA, 1173 bp, Artificial Sequence
  Description of Artificial Sequence: Synthetic coding sequence
tgcgaaaagagcacattcttcaaacatcaaaagcggacgcatactgtggagaagacatttgagtgttcgcatggaaagaagtccttttgccaggaatctcattttacagaacaccacaggacatgcacaagagagaaaccctgtgagagcaacaagtatggtaagacattccaccagaagcggtcttttatccaccatcagcgaactcataccggagagaagccatacgagtgtaaagagtgtagaaagtcatttcacgtgaagccaaatctgaccaaacaccaaaagactcatatcggcgaaaagcccttcaaatgtactgcgtgcggccggacattttttcagcagagcacattgaacgtgcatcagggcaagcacactgaggaaaagccctacaaatatactgagtgcgagaaatccttctataaatccgtcctcatcatccacgagcggacccataccggagagaagccctgtgggtgtaatgagtgtgaaaagagctttgaggtgctgaccaccctggtgattcatcagagaacccatacaggtgaaaaaccatacaagtgcaacgagtgcgagaaatcgtacttgaacttgaaatctcacctgaatatccacttacggaaccataccggtaagaggccgcacgtgtgtaatgaatgcgggaaagcttttagcatgaagagtaattttacagaccaccagcgtactcattgcggagagaagccctacaagtgtaatgagtgtcgtaaatccttttatatgaagtccgccttgagtcagcatcagcggatacacatctacaagaagccttacgaatgtaaacaatgcggcaaaacctttcagaaaagccacttgatcgaacaccagaggacacatccaggcgagatccctcatgaatgcaacaaatgtggcaagagtttctgttataagagccccctgaccatacaccaacggacccacatcgaagagaaaccctacaagtgctccaaaagcgtcacttatttctgtatgaaaagtcaccttacagtacatcagcggccacacacgaggaagaatccttttgaatgcaatgagtgccgcaaaatgttttacgtaaagtccaaccttattaaccatcagcgaacccacaccggagaaaaaccctatgaaggcaatacatgtggcaaatag

SEQ ID NO: 32640 - DNA, 6279 bp, Artificial Sequence
  Description of Artificial Sequence: Synthetic coding sequence
atggttcttaaagtggatacaagtgagagcctgtggcatattcagatcagtcggagcagattcctgctcgactcagacgggaagaggctcatctgtgaggtgtccttgtgcaaaatcaacagcaaagtgctcaaaagcggccagttggaagacacatgcctggtggagctttctttggccttggacctgtgtttgaaagtcggcatctcctcgcgtcacctgaccgccatcactgttgatgtttggaccttacacgccgagctccatgaggggctcttccagtcgcagctgttgtgccaaggcccttccctcgcatccaagccagttccctgctccgaagtgaccgagaatctggttgaaccaaccttgcccggcctgtttcttttacagcagctgccagatcaggtcaaagttaagatggaaaacacaagcgtagtgctgtcgatgaattcacaaaagagacacctcacctggaccctgaagcttctgcagtttctgtatcacagagacgaggatcaactccccctgaggtcctttactgctaactcagatatggcccaaatgtcaaccgagctacttctggaagacggacttttactgagccagagtagacagcggattgtgtgtttgaattccctcaaggcctctgtccaggtgacaaccattgatctgtccgcatctctcgtcttaaatacctgcattatccactatagacaccaagaattttctcattggctgcatctactcgctcttgaaactcagggctctagctctcccgtactgaagcagcggaagaagcgtacttttcctcagatccttgcccctataattttcagcacttcaatctccaatgtaaatattagcatccagttaggtgacaccccaccatttgcgttgggctttaacagcatatccctggactaccagcatcttaggccccaaagtattcatcagcgcggcgtgctcaccgttgaccatttgtgctggcgggtcggtagtgactcccatatccaacgggcgccccaccccccaaacatgcatgtgtggggcgaggctctggtccttgattcttttaccctgcaggggtcctacaaccagccgctcggcttatctagcacccagtctgatacgctgttcctcgactgtaccatccggggacttcaagtggaggcttctgacacctgcgctcagtgcctctcacggattctctcccttatgggtccacagtccggtaagagcgcagtgtcccggcactcgtcttttggcgaatccgtgtccttactctggaaggttgacctgaaggtggaggatatgaacctctttacgttaagcgccctcgtgggtgcgagcgaggtgcgattggatacacttacaattctgggctccgccgaaaccagcaccgtcggtatacagggtttagtgctggcgcttgtgaaaagtgtaacagagaaaatgcaaccctgctgcaaagccccagacattcccacccctgtcttgagcctgtctatgctctctatcacgtaccattctagcattagaagtctggaggtgcaatgtggggccgggttgactctcctgtggtcaccccccgaccacatgtacctgtaccaacatgtcctggccacccttcagtgtcgtgatttacttagggcaaccgtgttccctgagactgtgccgagcctcgctttggaaacctctggtaccacatctgaattagagggccgagcccctgagcccctcccgcctaagagactcctgaaccttaccttggaagttagcaccgccaagctgaccgcatttgttgcggaggacaagttcattacactagctgccgaaagcgtctcccttagccgacacggcgggtcgctccaggcttactgccccgagctagcggcagggtttgatggcaactccatcttcaacttcaaggaggttgaagtgcagctgctgccagagcttgaggagatgattctgcatcgaaacccgtttcccgcactacagacacttaggaaccgcgtatggctcctgtccttcgggagcgtgagcgtggagtttccataccaatatgacttcagtcgcacgctagatgaagccgtcggagtacagaagtggctcaagggtctgcaccagggcacaagagcttgggcatccccttcccctgtgcccttgccccccgacctgctgctgaaggttgagcacttcagctgggttttccttgatgatgtgttcgaagtcaaacttcacgataattacgagctgatgaaggacgaatcaaaggagagtgcaaagcgccttcaattattggatgcgaaagttgcagcccttaggaagcagcacggggagctgctgcccgctagaaagatcgaggagctgtacgccagtctggagagaaagaacatcgagatctatatccagcggtcgcgaagactgtatgggaacactcccatgagacgcgcccttctgacttggagtcttgctgggctggaacttgtcgctttggcggatgcatccttccacggccccgagcacgtcgtggaacaggtacaagagctagatcccggttcccctttccccccagaggggctggatctggttatccagtggtgccggatgttgaaatgtaacgtgaagagcttcctggtcagaatacgcgactatccaaggtacctgttcgagattcgggactggcgattaatggggcggctagttggaacagagcagagcggtcagccgtgctccaggaggcggcaaattctgcacctaggactgccgtggggaaatgtagctgtggagcgcaacatgccaccactcaagttttaccacgatttccacagcgagatattccagtacaccgtggtgtggggcccatgttgggatccggcctggaccctgattggtcagtgcgtcgatttactgacaaagccttcggccgatccttctcccccccttccttggtgggacaaaagcaggttactgttccatggagactggcatatggatatcgagcaggccaacctccatcagttagcgacagaggacccttacaatacgacggagaacatgcattgggagtggtcccatttgtcttttcattggaaacccggacagttcgtatttaagggggatctcgatattaacgtccggactgcctccaaatacgacgactgctgttttctacatctgcccgatctgtgtatgacactagacctccagtggctgtgtcacgggaacccacatgatcatcattctgtcactctcagggcccccgaattcttgcccgaagtgcccctgggtcagttgcatgactcttatagggctttcagaagtgagaatttgaatctgtcgattaagatggatctgaccagacattctgggaccattagtcaacctaggattctgttgtattcatccacactgcgatggatgcagaacttttgggcgacgtggacgtccgttaccaggcctatctgccgaggcaagctgttcaacaacctgaagcccagtaaaaaaaagctggggcaacactacaagcagcttagttatactgccctgttcccccagctccaggtgcactattgggcttcattcgcccaacagcgagggatacagatagaatgtagccagggccatgtctttactcgggggactcagcgcctgataccccaggccggtactgtgatgagacgactaataagcgactggtccgtgacccagatggtctccgatttatcccaggttaccgtacacctcatggcctcacccacagaagagaacgccgatcactgtcttgaccccctggtgaccaagacacatctgctgtccttgtctagccttacttaccaacgacatagcaatcggacggcagaggaggagctgtccgccagagacggtgaccccaccttccacacgcaccagcttcatctggtcgatttgaggattagttggacaacaacaaacagggatatagccttcggcctttacgatgggtacaagaaggcagccgttctgaaaaggaacctgtccaccgaggcgctaaaaggactgaagatcgaccctcagatgcctgctaagaagccgaaaaggggtgtacctacatcagcttctgccccccctcgcgtgaacacgccaagtttctcagggcagcccgataaagggtctagcggcggagcttacatgctccagaagcttattgaagaaaccgatcggttcgtagtgtttactgaggaggagtcgggaatgtccgatcaactctgtggaattgcagcgtgccagacagatgacatttacaaccgcaactgcctcatcgaattggtcaattgtcagatggtcctgagaggcgcagagaccgagggatgtgttatcgtgagcgccgcgaaggcccagttactgcagtgccagcatcacccagcttggtatggagataccctcaaacaaaagactagctggacctgtctgttggacggcatgcaatattttgccacaacagaatccagcccgacagagcaggacggaagacagctctggctggaggttaagaatattgaggagcacagacagaggtctttagacagcgtgcaggaactcatggaaagcggccaggcggtcggggggatggtcacaactactacagattggaaccaaccagcagaggcccagcaggcccagcaggtacagaggattatctcgaggtgcaactgcaggatgtactatatctcttacagccatgacattgatcctgaactcgcaacccagatcaagccacccgaagtgctcgagaaccaggagaaggaggatttacttaagaaacaagagggagctgtggatacattcacacttattcaccatgagctggaaatttcgacaaatccggcccagtatgctatgatcctggacatcgtcaataacctcctgttgcatgttgaacccaaaaggaaggagcatagcgagaagaaacagcgcgttaggtttcaactcgagatttctagcaacccagaggaacagcgtagcagcatccttcacctccaagaggcggtccgccagcacgtggcacagattcggcagctcgagaagcagatgtactccattatgaagtcccttcaagatgactctaaaaatgagaacctactggatttgaaccagaaactacagttacagctgaatcaggagaaagctaatttacaacttgaatccgaggagttaaacatcttgatccggtgctttaaggactttcaactacaaagggcgaacaagatggagcttcgcaagcaacaggaggatgtctctgtcgttaggcgcacagagttctacttcgctcaggctcgatggcgcctgacggaggaagacggacagcttggcattgcggagctcgaactccagcggttcttgtattctaaagtgaacaagtccgatgacacagcagaacatctcctggagcttggatggtttactatgaataacctgctgcccaatgccgtttataaggtggtgctcaggccacagtccagctgccagagtgggcggcaactcgcactccggttgttttccaaggtgagaccacccgtggggggaatatcagtgaaagagcacttcgaagtgaatgtagtgcccctgactatccagctgacacatcagttctttcatcgcatgatgggattttttttcccaggcaggtcggtggaggatgacgaggtgggcgatgaggaagacaaatctaaattagttacaacaggaatcccagtggtaaaaccccggcagctgattgcaacggatgacgccgttccattgggacctggcaagggcgtggcacaagggctgacccgttccagtggcgttcggcgcagtttccgtaagagcccagagcatccagtggacgatatcgacaagatgaaggagcgcgccgcgatgaataatagctttatttatatcaaaatcccacaggtcccactgtgcgtgtcgtacaaaggcgaaaagaacagcgttgactggggggacctcaacctcgtacttccctgtctggagtaccacaacaatacctggacctggcttgactttgctatggcagtgaagcgagactcccgcaaggccctggtagcacaagtgatcaaggagaagctgagactgaagtccgccaccggatccgaggtgcgggggaagctcgaaactaaatctgatctgaacatgcaacagcaagaggaagaggaaaaagcaaggctcctcataggtctctccgtgggggacaaaaatccaggcaagaaatctatctttggcaggcggaaatag

SEQ ID NO: 32641 - DNA, 2571 bp, Artificial Sequence
  Description of Artificial Sequence: Synthetic coding sequence
atgtctggtgaactacaacgtaaaattggcctgaaagtccttgagatgcgcggaaatgcagtggtgggatatctccagtgttttgatctggagggggagtccgggctggtggttcgcgccatcggcaccgcatgcacactggataagctttcgtctcccgcggcctttctgccagcatgcaatagcccgagcaaagaaatgaaagagtctccgctagttcatcctcccagccacggctgccgctctacccacaattcacccattcacaccgcaacaggcagcaggctgacgcagaacttctctgtgtccgttccgacgttgatttacactggcatgggctcaggaagcgctggaaaggagggagggcccttcaaagccctgctcagacagcagactcagagcgccttggagcagagagagtttcccttcttcaccctgaccgctttccctcccgggttccttgtgcacgtcggcggggtagtgtccgctagatccgttaagctactggaccgcatccataaccccgccttcgtcgggatcatggggaacacgcgctcttataagcttctggactggaacagcttcaactcggatgagccagagacacgtgacgcttggtgggccgagattaggcaggagatcaagtcccacgctaaagcccttgggtgtcatgccgtggttggctatagcgaatccaccagtatttgtgaggaggtatgcattctgagcgcttctggcacagccgcagtcctgaacccccgcttccttcaagatgggaccgtggaaggctgcctcgaacaaagactcgaggaaaatcttccaactcggtgcggtttctgccacatcccgtatgacgaactgaatatgcctttcccagctcatctgacgtattgttataattgcagaaagcagaaagttcctgatgtactatttacaacaatagacctgcccacagacgcaacagtgattggtaaagggtgcctgatccaggctcgcctgtgtagactgaaaaaaaaggcccaggccgaggccaacgccaccgctatctcaaaccttctccctttcatggagtacgaggtccacactcagctgatgaacaagctgaaacttaaagggatgaatgcgttgtttgggttacgcattcagattaccgtgggggaaaatatgcttatgggcctggcgagcgccaccggcgtgtacctggctgctctgcctacccccgggggaatccagatagcaggcaagaccccaaatgacgggagctatgagcagcacatttcccacatgcagaaaaaaatcaacgacaccatagcaaagaataaggagctttacgagattaatccccctgaaatctccgaggagatcattggaagccccataccagaacctcgacaaaggtccagactgctccggtcacaatctgaatcttctgatgaagttacagagctggacctcagtcacggcaagaaagacgccttcgtcctggaaatcgacgatacggatgccatggaggatgtccatagcctcttaactgatgtcccgccaccatccggattttatagctgcaacactgaaatcatgcctggaatcaataactggacatcagagatccagatgtttactagcgtccgcgtaatccggctgagttctctgaacctgaccaatcaggcacttaacaaaaattttaatgacctgtgcgagaatctactcaagtctctgtattttaaactgagaagcatgataccatgttgcctgtgtcacgtaaatttcactgtctcattgccagaggatgaactgatccaggtgactgtcacagccgtagccatcacattcgacaagaaccaagcccttcagactacaaaaactccagttgaaaagtcactgcaacgggcatctactgacaatgaggaactccttcagtttcccctggaattgtgctcagatagcctgccttcacacccattcccccctgcgaaagaacatctggagagcgcgtcatccaactcaggcatcccggctgcccagcgggaccggtgcagctcctggatcgaactgattaagctaaaggcgcagacaatccgccgcgggagtatcaagactacaatgactgtggagaaggcgagtcccgtgggtgatgggaactttcggaatcgaagcgctcccccttgtgcaaactccacagtgggtgtggtgaagatgacacccctgagttttattccaggggcaaaaattacgaaatatctcggtatcattaatatgttcttcattagagaaacaacttcactgagggaagaaggcggcgtgtcaggttttttacacgccttcatagccgaggttttcgcaatggtcagagctcacgtcgccgcgcttggtggaaacgccgttgtcagctacatcatgaaacaatgcgtgtttatggagaaccctaataagaatcaggcacagtgtctgatcaacgtctccggcgacgctgtcgttttcgtgagggaatctgacctggaggtggtgtccagccagcagccgacaacgaattgccaaagctcatgtaccgaaggggaggtgaccacctag

SEQ ID NO: 32642 - DNA, 1545 bp, Artificial Sequence
  Description of Artificial Sequence: Synthetic coding sequence
atgatggaggacctgggccgaaaagagaaccaagacaagaagcaacaaaaagatcccagactgaccatggagatgcggcacaaacaggtaaaggaaaatcggttgagacgcgagaaagagctcgagtaccagcgaattgagaagaccctcaagaaatctgcattcctggaagcacaatgtttagtccaagaggagaagaaacgcaaggccctggaggccaaaaaggaggaagaggagattcaaagggagatggtgaaactccggagggagatcattgaacgccgtaggacagtgaaagctgcctggaagattgagaaaaagcgccaggaggagaattctcaaaattccagtgagaaggttatgttccagtctacccatattctccccgatgaggagaagatggtaaaggagcgaaagcgcaagctcaaagaggtgttgatacagacgttcaaggaaaaccagcagtgccagaaacgttacttcgcagcctggcacaagcttatcctagaccacaggatcaagctaggaaaggccggcaccctgtcagattggaagatccagttgaaggtgctccgggcatggcgagactacacccgcttccagaaactggaaagagaaacacaggccctcgaaaatgacctgcgggaagagaatcgtaaacagcagctggccacggagtataatcggaaacaggtcctgcgccattgcttcacggagtggcaacactggcacggcgctgaactcctgaagagggagcttgctctcacaaaggaggagaccagaaagaaaatggatgctctcctccaggctgctagcctgggcaagctgtctgctaatggactgtcgggtattagcctcccagaggaggcaacagctatggtcggtccccccgtgaagaacggccaggaaacagccgtgcctccattgtgggaaaagccaccgcttggatcctctggttgtatgctgagtcctcccctggggcgaacaacaaccgggaatctccaggggtccttgcagaacgtgtcactgtccgcccctggtaacaaacagcacaagacccttggggctgagccctcccaacaacccggatccaacgaaacactgcgtacaacttcccagaaagccgagccactatgcctggggcatttccacaataggcatgtgttccagcagcaactgatcgaaaagcaaaaaaagaaactgcaggaacagcaaaagactattctggaacttaagaaaaatctccaactggccgaggcccagtgggccgcggaacatgccctcgctgtgaccgaagctcagtcacatttactgtctaagcctagagaagaggaacctcgaacatgccaaatgctagttaatagtccggtagcctctcccgggaccgagggccggtcagacagtcgtaactcactgtccgggttgaggcgaaaaccaaaacagctgatgactcctcaccctattctcaaaggccgcgccgtctcagtcgtggccctggttgtggtcatttttagccccagggttgaatgtgtgcattgggattag

SEQ ID NO: 32643 - DNA, 2283 bp, Artificial Sequence
  Description of Artificial Sequence: Synthetic coding sequence
atgggtgatcctgggagtgagataatagaaagtgtacctcccgcagggcctgaggccagcgaaagcaccacagatgaaaatgaagatgacatacaattcgtgtcgattcttttcccaaagatgcccaagcgccagggcgacttcctgcacttcctgaacgtcaaaaaggtgaagactgataccgaaaataacgaggtgtcaaagaaccactgccgattgagtaaggctaaggaaccacattttgaatacattgaacagcccatcatcgaggaaaagccgagcctgtcctctaagaaagagatcgataacttggtcctgcctgactgttggaatgagaaacaagctttcatgtttactgagcagtataagtggctggagattaaggagggtaagcttggctgcaaggactgctccgctgtcaggcacctcgggtccaaggccgaaaaacatgtgcatgtctcgaaagagtggatagcctacctcgtgactcctaacggcagcaacaagacaacaagacaagcgagccttcgcaagaagatcagagagcatgacgtatcgaaagcccacggcaaaatccaggacctgctgaaagaaagtacaaatgactcaatttgcaatcttgtgcataaacaaaataataaaaatattgatgccactgtaaaggtcttcaacacggtgtacagcctggtgaagcacaaccggccactcagcgatattgaaggcgctcgtgagctccaggaaaagaacggggaggttaattgtctgaatactaggtacagtgctacacgcattgccgagcatatagctaaagaaatgaagatgaagatcttcaagaacattattgaagagaacgcgaaaatctgcataatcatagatgaggcatctactgttagcaaaaagaccaccctcgttatctacctccaatgcactatacaatcggcccctgcacccgtcatgctcttcgtcgcgctgaaagagttagtctcaacaattgccgagtgtatcgtcaacactcttttgaccaccctcaatgattgtggttttaccaatgagtacctcaaagccaacttaatcgcattttgttcagacggcgccaacaccatccttggacggaaatccggagtagcgacgaaactgcttgagaacttcccagagatcatcatttggaattgtctgaatcatcgcttgcagctatcattggacgactccattagtgagatcaagcagattaatcatttaaagatcttcatcgacaagatatactccatttaccaccaacctaacaaaaaccagacaaagctacttggaacggttgcgaaggaattggaaaccgagattatcaaaatcggccgcgtgatgggaccacgatgggccgcttgctctctccaggccgccacagccgtttggcatgcttacccaatcctatatatgcattttagtcacagttactcagggctcgcgaagagactggccaacatcaactttcttcaagacctcgctttaatgatcgacattctcgaagaattttctgtgctctcaactgcgctgcagtcacgcagcacaaacatcaagaaagcacaaaaattgattaagcggaccatccgagccttggagaatctcaagataggcactggaaaatatgagagtcagatcgaagacctaattaaaagtgacaagttcaaggatataccctttaataagaataataaattcaatgcactcccacgaagcatactcctggataatatcatccaacacatgaacttgcgcttgctcagcgataggaaccacgaggatatcttcaattacttcgacctgctcgagccgagcacctggccctatgaggagattactagtccgtggattgccggcgagaaaaccctatttcatttgtgtaagattcttaaatacgaagtcgatctgaatgactttagggagtttgtcaataacaacattaagtccaataacgtgtctattccaaccaccatttacaaggctaagaaaatcgtctccaccatcgctattaactctgccgaggccgaaagaggattcaatctaatgaacattatttgcacgagagtgcgaaatagcttgactatcgaccacgtgtcagacctcatgactataaatcttctaggtaaggagttggccgattgggatgctactcccttcgtgaaatcttggtcaaactgtaatcatagactggccacggataccagagttcggcagaaatcaaccaaggtgttccatgaaaatcagttggctatctggaaccttaaatag

SEQ ID NO: 32644 - DNA, 1230 bp, Artificial Sequence
  Description of Artificial Sequence: Synthetic coding sequence
atgaccctgagcaggggcaaggtcgatttcgccaccatccagtgtgggcagtgcttaatggagacaatccagctgtccaatcatctgcaggtcccctgcgaatggtttgtccaaagtcagaaaccagtggacaaactcgagaaacacatgcccaagtatctccgacaaaaactccgtgccgagttgaagcccaagactcggatatttgagattcagcctatatcaggcgtgttagaccctggtgaaaagagcaatgtacaggttaaatttatgcccaaagaagagaagttctactcccagaccctggtctttcagattgcccagagcgctcagaagttgactctgctggcccgagggcagggcttggagcctagattggaattctccccgtccgtgctggaccttggccccctgctcttgtgtgcccctggcgacgaggcagaggtgattgtgaagaacccctgtaatttccctatagagttctactccctcgaatttgaccagcagtacctgatcgaagagaagatcctccggaaactcaagggctacgacagttataacactttacttcttcctccacgtaatcccggagaaaaattgccaccagagctctacgagtacttcaaagaaatcaaaaaaagcaaagaggagcagatgcgagcgaagtacctggagaatctggcgcaagaaaatgaagaggaggatattacgtcatcggatcagggcacgagtaacagcactaagaggactagcctcagcagaggcattagcgtgacatccaatctcgaggagtggcacgcccttctcgtcgaaagtaaaacatatctcgaagaagaagaagatgaggagagccttgagaaaattatttttcagactgataagctacagagcatcgacagccacagtatggaggaggtaggcgaggtggaaaacaaccctgtgtccaaagccattgctagacatttgggtatagatatctcggccgaaggaaggctcgcaaagaatcgcaaaggtattgccatcatcatacacggcacacccttatcgggcaaaagcgctaatgccgtttctgtggctaagtattataatgccgcgtgtctctccattgattccattgtgctcgaagctgtcgcaaactccaacaatattcccggaatccgcgcctgtgagctgtgtatccgcgctgccatagagcagtccatgaaggagggtgaggaggcggcagagtag

SEQ ID NO: 32645 - DNA, 375 bp, Artificial Sequence
  Description of Artificial Sequence: Synthetic coding sequence
atggcagtctacacgcatactggctataatgatcactacatgtacctgaaccacgggcagcaaactattcctaacgggctaggtatggggggacagcataattactttgggctgtgggtggatgtggatttcggcaaaggccactcccgggccaagccaacatgcacaacatataactctccacagttatcagcccaggagaattttcaatttgacaagatggaggtgtgggcggtgggagacccatccgaggaacagctagccaaagggaacaagagcattctcgatgcagaccctgaggcacaggctctcctggagatatcggggcattcccgccatagtgaaggccttagagaagtgccagacgatgaatag

SEQ ID NO: 32646 - DNA, 2607 bp, Artificial Sequence
  Description of Artificial Sequence: Synthetic coding sequence
atgggcattactgaatcatcagacacccctagcagcctctctcctctgaacctcccaggggcgggttcagaaatggaagaaaaagtcgcccccgtcaagccgtcgagaccgaaacggcatttctccagtgctggaacaatagagtctgtgaaccttgacgctatcccactcgccattgcccgtctggacaactcagctgccaagcacaagttagcagtgaaacctaagaagcagcgtgtgtccaagaagcacagacgactcgcacaggatccccagcacgaacaaggtggtctcgagtcacgcccatgtttggatcagaacggccatcccggcgaagacaagcctacttggcatgaagaggaacctaacccattagattccgaggaagaaaggcgtcgtcaggaagactactggagggagctcgaagccaaatgtaaaagacagaaagccgaggctgccgagaaacgtcggctcgaggaacagcggctccaggccctcgaaagacgtctctgggaggaaaacaggaggcaggagctgcttgaggaggaaggagaggggcaggaacccccattggaagctgagcgcgcaccacgcgaggagcagcaacgctctcttgaggctccaggctgggaggacgcagaacgaagagaacgagaggaacgggaacgccttgaagccgaggaagagaggaggagactccaggctcaggcgcaggcagaggagcggcgcagactggaggaagatgcccgcctggaagaaaggaggcggcaggaagaggaggagggccggtgcgctgaggagctgaagcgtcaagaggaggaggaggccgagggctgggaggagttggaacagcaagaggctgaggtccagggtccgccggaggctttggaagagactggtgagggaagaagaggggcggaggaggaggacctgggtgaagaggaagaggagggacaagcccacttggaagactggagaggacaactgtccgagctcctgaacgattttgaggagcgcctggaagaccaggagcgcctgaaacctgagggacagcgtgagcatagtgaggaaccaggcatctgcgaagagcaaaaccctgaagctgagcgaagaagggagcagcagggacgcagcggagacttccaaggtgccgataggcctggcccagaagaaaagcgagaagagggcgacacagagcccctgttgaagcaggagggacccgttgaggctgctcaacctccagttgagcgcaaggaggccgcagctctggagcagggccggaaagtggaagagctgagatggcaggaggtggatgaaagacagaccatgccacgtccctacactttccaggtgtcctctggtgggaagcagatcctcttccccaaagtgaatctgtcccccgtcactccggcaaaagataccggactgaccgctgcacctcaggaaccaaaagctccaaaggccagccccgtccagcacgcactgccttctagtttatcagtcccccacactgccatactggttacaggcgcccagctatgtggacctgctgtgaatctgagccagattaaggacactgcatgcaaatctctgctggggctcgaagaaaaaaaacacgccgaagctcctgctggtgagaatccacccagaggccccggcgatgctagagcagggtccgggaaggcaaagccgcgccaagaatccccatctagtgcttctgccctggcagagtgggcctcaatccggtcccggatcctcaaaaatgccgaaagcgacccacggagttctgagcgcgatcagctccggccaggcgacgaaagtacgccccgcggacgatgcgactccagagggaatcaacgcaagactccacccgtcaatgctaagttcagtatcatgcctgcttggcagaagttttcagatggggggaccgagacctctaagcagagcacggaggctgagtccattcgcaagcgcccaatgttgggcccatcagaggagaccgcacctcagcctccacctgccggcgtgcgcgagttgggcaagggcccagagaagagtgagatgcatcgggaacctgcggacacgaccgaaggttgtaagttcgcaaaagatctaccatcctttttagtgcctagccttccctatccacctcaaaaggtcgtagcacataccgagtttacaacgtctagcgacagcgagaccgccaacgggatcgctaagcctgaccctgtgatgccgggaggagaagagaaagcaagcccatttggcatcaaattgagacgcacaaattattctctgcgcttcaactgtgaccaacaagcagagcagaaaaagaaaaagcggcactctagcactggcgactcagccgacgctggacccccggccgcaggatccgcacgcggcgaaaaggagatggaaggggttgctttgaaacatggcccgagcctgcctcaggaaagaaagcaggcaccctcgacgcgcagggactctgctgaaccgagtagctctcgctctgtacctgtggctcacccaggtccaccacccgcttcatcccagactcctgggccccctgtgcgccctcatcagcacccgcacttccccaactag

SEQ ID NO: 32647 - DNA, 309 bp, Artificial Sequence
  Description of Artificial Sequence: Synthetic coding sequence
gtgttgttgtgctgccccggatggagcgcggtggtgcggtcatggttaacggcaactagcgctagctggcagctcgcagggattaccggaatgtgtcaccacgcccagctgatttttgttttctttatcgagaccgagtttcatcacgtagggcaagctggccctgagctgcttaccagcggggacccctctgcttcagcctcccagtcggctggcatcactggcgccagtcatccacgccgggctaacttctgcatctttggcagggacggcgtttccccctgctggccaggctggtcatccacatag

SEQ ID NO: 32648 - DNA, 396 bp, Artificial Sequence
  Description of Artificial Sequence: Synthetic coding sequence
agtgcttgcatgtgtgtttgcgtatgcgtttgtatgtacatctatatctacatctacatattctttttttttttcttctttttctttctcaacattttcaagcaggcaccaccccgacagaaccaggtccgccgtccaggcgcagttgctcatacatgtaatccatccaccgtgggtggccacggaggccagataacccgcggccaggaatttgaaacctccttagccaacatgggagaaactccctcactcctcaaaattcaaacctggccaggagtcgtggctcacgcatgcaacccttcttactctggcgggaggctcaggcaggagaactgcctgaatctgggcggaggagggtgtggagaaattgcgttacagccaggacaacaggagtag

SEQ ID NO: 32649 - DNA, 309 bp, Artificial Sequence
  Description of Artificial Sequence: Synthetic coding sequence
gaggtgggccgctggctcgagcctggcaagcagaggctccagtgtgctgaaatggctcctctccacagctccctcggtgataaggcgcgtccttgcctgactaagaaaaaaaaaatgctggacatgaaccctacactggtgtgttaccggcaaggcctcgctcttctgccgagattggggtgctctggggctatcttggcccactgcaacctccggctgttgggcagcagcgattcccccgcgtctgccagcagggtagccggtattactggcgctagacatcacgcccaattgattttcgtgttctag

SEQ ID NO: 32650 - DNA, 288 bp, Artificial Sequence
  Description of Artificial Sequence: Synthetic coding sequence
ttcttctttttcctccgctggtcgctagccttgctgccacgggtggagtgctctggaatgatatccgcccactacaacttgcacctgccgggatctagcgactcacctgcctccgcttctcgcgtggccggcacaacgggagtacatcatcatgcgtggctgatcttctgtattttctcaagagacggtgtgctcctgtgttgccctggctggtcccctactcccgggctcaagcgatcgtcgtgtctgggattccgtaaatgctgggactacagacacgagccttag

SEQ ID NO: 32651 - DNA, 345 bp, Artificial Sequence
  Description of Artificial Sequence: Synthetic coding sequence
tggtgcaccccactgatcccagcgaccgaagtggaaactgggcgatgggtcgagcccagatcttccaggctgggtttctttttggtggaactcctctcatttgatcttggaaaccgagctcgcctgcatctaaagaagaagaaaaagaagaaaagtctgggaaagatttacttcttcctgcggtggtccctggcgttgctgccgcgtttggggtgtagcggcgctatcagcgctcactgtaaactccatctgttgggatcccaccacagccctgcatccgcatctagagtcgccgggatcaccggggcccgtcaccatactagacttattttttttttcctatag

SEQ ID NO: 32652 - DNA, 396 bp, Artificial Sequence
  Description of Artificial Sequence: Synthetic coding sequence
agtgcatgcatgtgcgtttgtgtctgcgtgtgcatatacatatacatttacatatacatcttcttcttcttcttttttgagttcctgacaaagctgatcaagcagctggtcatgatcaagaatcaggttcgccgtccgggcgcggtcgcacatacatgcaatgccagtaccgtcggtgggcacggggggcagataacaagaggccaggagttcgaaacatctctagctaatatgggcgaaaccccaagcctgcttaaaattcagacctggcccggcgtcgtggcccatgcctgcaacccgagttatagtggagggagactcaggcaggaaaactgcctaaatctcgggggaggcggctgcggggaaatcgcccttcaaccaggacagcaggaatag

SEQ ID NO: 32653 - DNA, 384 bp, Artificial Sequence
  Description of Artificial Sequence: Synthetic coding sequence
atcctggcccactgtaacctgcatcttcctaactcttcagactctcccgcgagcgccagccaggtggccgggatcactggcacatgttatcatactcaattgatctttgtgttccttgtggaaacggggtttcaccatgtcggacaggatgggctggaattactcacatctggagacctgcccgccagcgcctcgcagtcagccggcatcacgggagtgactcactgcgctcagccatcatccttgttgacaagcgagggccggaaagagacggtctctacattttttttttttttcctgcacgagaccgtatcccactcagttgcacaggccagggttcagtggcacaacctgtcttcgttgcagccccctccttcgcgctag

SEQ ID NO: 32654 - DNA, 288 bp, Artificial Sequence
  Description of Artificial Sequence: Synthetic coding sequence
tttttcttcttcttgaggtggagcctggcacttctaccaagagtagaatgcagcgggatgatttccgcccactataacctccacttgcccggctcgtccgatagtcccgcgtcagcttctagagtggccggaaccaccggggtacaccatcacgcatggcttatattctgcatattctcccgggacggcgtgctgctgtgttgtccaggctggtctcccactcccggactgaagaggagcagctgcctcgggtttagaaaatgttgggattatcgccacgagccgtag

SEQ ID NO: 32655 - DNA, 96 bp, Artificial Sequence
  Description of Artificial Sequence: Synthetic coding sequence
gccaaacctaggctacatcagcctggtcaatctggggagacccctagtctcctgaagattcagaagctcgccaggcgtgggggtgtacatctctag

SEQ ID NO: 32656 - DNA, 264 bp, Artificial Sequence
  Description of Artificial Sequence: Synthetic coding sequence
tcagtggcccaggccggggttcagtggcacaacctaggctccctgcaacctcccccgccgcgatttaatagattcagctgcctgagtattccgtcatcttgggattaccgccattcgcccccactcctcgccgacttttgcatttatctggtagagaccggcttccaccatgtgggtcaggctgggttagagctgctgactagctccgatttgccgacatcggccagtcagtcagccagaattactggggttagccaccgctag

SEQ ID NO: 32657 - DNA, 195 bp, Artificial Sequence
  Description of Artificial Sequence: Synthetic coding sequence
ccaaggcgctggagtctccaggtgtatcccaccgcccctaagaggcagcggccttccagaatgggtcacgacgataatggaagcttcgtcgagaagaaacgcggtaagtgcggagagaagaaagaacgctctgattgctattatgtgtgtgtggagcgcagccgacaccggaggttgcactttgtgctctattag

SEQ ID NO: 32658 - DNA, 456 bp, Artificial Sequence
  Description of Artificial Sequence: Synthetic coding sequence
agattctacatcggttgtgatctttgcaccaattgttattatggggagtgcgtcggcatcgctgagaaggaagccaaaaagatggacgtctacatctgcaacgattgcaagtgggcccaggaggggtcatcggaggagctttattgcatttgtcgaacccccgcgggcagctgcagattttttataggccatgatcgctgccagaactggtaccacgggtgctgcatcgggatccttcaatctgaggccgaactcatcgacgaatacgtgtgccctcaatgccagagcaccgaggatgccatggccgtgcttacacccctgacagagaaagacgatgaagagttgaagcgcgtcttgtgttccctgcagactcacaaaatggcccaaccctttctggagcccgttgacccgaacgacgcccctgactactacggagtcatcaaggagcccatgtag

SEQ ID NO: 32659 - DNA, 411 bp, Artificial Sequence
  Description of Artificial Sequence: Synthetic coding sequence
ggaacaataagcgcgcactgtaatctgtgtctgctggactcctctgatagtcctgcttcagcatcaagggtcgcaggaattattggtgcacaccaccatgctcaacttatttttgtgttcttggtagagatgggcttccaccacgtcgggcaggcgggacttaagctactgacttccgatccccctgctagtgccagtcaaagtgctggcatcactggtgtgtctcatcataactggctccacgggggacctgaccgggtgaaaagaccacctgtgttcttcttctggttttttttctttgagatggaatcctactctgtcgcacaggccggcgttcaatggcgcgacctcagcagtctgcagccacccccgcctcggcacacaattctgctgcctcagcctccagaatag

SEQ ID NO: 32660 - DNA, 279 bp, Artificial Sequence
  Description of Artificial Sequence: Synthetic coding sequence
ttaacccccgacggctttttctttcgagtccacatgttagtccttgactcatcatcatgtaacaaaccctgccctgagtttaagcccggcagccgctatatcgtgatgggccatatctatcataagagagggcagctgcccactgccctgttgcaggtgctgaggggacacctctgtccaggagacggactgctccggtcttcatcctcgtatgtcaaacgcttcaatcccaaaagggaaggccagattcaaggggcaatccacactcagtgcatctag

SEQ ID NO: 32661 - DNA, 378 bp, Artificial Sequence
  Description of Artificial Sequence: Synthetic coding sequence
tcatttttcttcttcttgcggcagagcctgagtttgtcggcccggctagagtgcagtgggaccatcagtgctcactgcaagctgaggctgctcggcagtcaccatagtccagcttctgtctcccgcataacgaggtcaggggtccaggaccaacgtgggcaacacagcgaaaccctgtcactgctcaaaatccaaaagctagctggccacggcgggcggcatctgcagtctcagttgcttggccgggtcagacaggagaaccgtctgaacccaggaggtaagggctgctcagagcccagaccatgccattgcaccagcgcgtggaccacatccagaaagatcaaaaagaagaagcggaaaaggaaaaaaaagaagtag

SEQ ID NO: 32662 - DNA, 399 bp, Artificial Sequence
  Description of Artificial Sequence: Synthetic coding sequence
tgcatgtgtgtttgcgtgtgtgtgtgcatttacatttatatctacatctacattagccagcccatttacatattcttgctcttacttctgcttctttttctcaggcagagcctgatgatcaagaatcaggttagacggcccggagccgtggctcacacatgtaatccttccacggtgggcggtcatggggggcagattacacggggacaggaatttgaaacatccctcgctaatatgggtgagacgccttccctgcttaaaatacagacctggcccggcgtggtcgcccacgcatgtaacccttcgtattccggcggtcggctgagacaggaaaactgtctcaacctcggaggcggtggctgcggcgagattgctcttcagcctgggcagcaagaatag

SEQ ID NO: 32663 - DNA, 111 bp, Artificial Sequence
  Description of Artificial Sequence: Synthetic coding sequence
ggtcgcgatgattggcaggccgcccctccggctgcccccgtacgcgaccctctgggggaggcctcctgggctcctgagtgcgggggcgatctagagaacctctatgtgtag

SEQ ID NO: 32664 - DNA, 321 bp, Artificial Sequence
  Description of Artificial Sequence: Synthetic coding sequence
ttttttcttagttttcttcacagtttttttctaagacaatccttcgcgctcgtggcccaggccggcgtccagtggcataaccttggaagcctacaaccacctcctcctggatttaaacagtttagctgtctgtcactcctgtcctcttgggactaccgacacgtgccaccctgcccagcaaattttgtgtttctagtggagatgggattcttgcacgtcgggcaggcaggactggagctgcgtacatccggagacccccccacactggcctctcaatctgccggtatcaccggggtctctcaccgcgcccagccttcatag

SEQ ID NO: 32665 - DNA, 276 bp, Artificial Sequence
  Description of Artificial Sequence: Synthetic coding sequence
tttttcctgcggtggtcactgacgctctcctcccggcttgagtgctcgggggccacctctgcacactgcaatgttcgccttcctggatcccgtcattcgccaacaagcgctagcagagtagctggtaccactggagcaagacacctctcacgcctaatattcatcttttctagggacggcgtgtcgccatggtcaagatctcccgatctggctatcaggccccccagacctccaaagaaactgggactccaggcccctgccactatgccaggctag

SEQ ID NO: 32666 - DNA, 381 bp, Artificial Sequence
  Description of Artificial Sequence: Synthetic coding sequence
cgtcatcaagcgcagctgatttttctatatgatctctttttatatgtttacttcttgaaggaccgggtgttactatgccacccaggatggagcgcaatgacccggtctaggttgacagctacttctgcgtcccaggtggcagggacaatcggtatgtgccatcacgcccgcctgatattcttctttttcttcgtgtttcttgtggagacaggctttcattgcgtttctcagcatggcctcgaactgctgacacttgacccaccggcaagtgcatcacagtctgcccgaattatcggcctgaaccactgcactcagcccacgttttgtatattttcccgtgatggtgactctccttgttggcctgactggagccggacatag

SEQ ID NO: 32667 - DNA, 327 bp, Artificial Sequence
  Description of Artificial Sequence: Synthetic coding sequence
cagatcaagtccaaatttttcttctttctcagacgaagcctggcactgtcccctaggctggagtgtagcggtggaatatccgcccactgtaaacttaggctccctggttctaggcacagtcccgctagtgcaagccaagttgcgggaacgaccggggcccgtcactacgcccgtcttatcttcctgtttctaatagagaccggattccactatgtggggcaggcagggctggagttgcttacaagtggtgatctgcccacatcagcttcacagagcgctggaattactggggtgtcacactgcacccaaccagaggacattttttag

SEQ ID NO: 32668 - DNA, 369 bp, Artificial Sequence
  Description of Artificial Sequence: Synthetic coding sequence
tgggactattcgttttttttttttctgaggcaatcacattctgtgcctcaagctggcgtccagtggtgtaacttgtcaagcctgcagccaccccccagcaggtttaaacggttcagctgtctctctctcctttcatcatgggattacaggcatacccccccttgtcccgcaaatttctgtatcttccgcaccttcttttttttcttacggtggagttttgcacttagcccaagattagagtgcagcggcgctattctcgtgcactgcaatctctgcctgcctggcagctccgactcctgcctcagcctgccaatcagttgggattaccgctgtgcaccaccgtgtctggcgaatttctgtattttttag

SEQ ID NO: 32669 - DNA, 372 bp, Artificial Sequence
  Description of Artificial Sequence: Synthetic coding sequence
tgggattacagtttcttcttctttctgagacagtcacactccgtgccccaggccggcgttcagtggtgtaacctctcatccttgcaaccgccaccttcccgcttcaaaagattctcatgcttgtcccttctttcttcctgggattatcggcacacccctccgtgccccgccaatttcctgtacacattcgaattattttttttttttctgagatggagcttcgccctgagtcccaggctcgaatgttccggtgccatcctggtacattgtaatctatgtctccccggttcctcggatagctgtctgtccctaccaatctcttgggattaccggtgcgcacctccttgcctggccaacttttgcatcttctag

SEQ ID NO: 32670 - DNA, 372 bp, Artificial Sequence
  Description of Artificial Sequence: Synthetic coding sequence
tgggactatagcttcttcttctttctccgacaaagccactctgtgccccaggctggcgtgcagtggtgcaatctaagttccctccagccgcccccttctcggtttaaacggttctcctgcctgagccttctgtcatcctgggactatcggcatacccctccttgcccagccaacttcctgtacacttttgaattgttcttctttttcttgcgttggagcttcgcactgtctccccggcttgagtgttccggcgcaatcttagtccattgcaatctgtgtttacctggctctagcgatagttgcctgagcttgcccatctcttgggattatcgctgcgctccgccatgcctggcaaacttctgcatattctag

SEQ ID NO: 32671 - DNA, 81 bp, Artificial Sequence
  Description of Artificial Sequence: Synthetic coding sequence
ttcttgatggataagtcaagtctcacgggggccctgtgttcaatcaccctagcaagtccttgcggtacgccaggaatctag

SEQ ID NO: 32672 - DNA, 318 bp, Artificial Sequence
  Description of Artificial Sequence: Synthetic coding sequence
gaaactggacgttgggtcgagcctagaagttcacgcttaggttttttcctcgtagagctgctgtcatttgatctgggaaacagggccaggctgcaccttaaaaaaaagaagaaaaaaaagatacctgggaagcactgtgtctgttttatgagatggagtcttgctctgcttccccgactcggttgtagtggagccatcagcgcacattgcaaactccatctactggggtcccatcacagccccgcgtcggctagcagagtagccggaatcactggggcacggcatcataccaggcttatcttcttctttttcgtttag

SEQ ID NO: 32673 - DNA, 228 bp, Artificial Sequence
  Description of Artificial Sequence: Synthetic coding sequence
tgcttctcccactcttttttctttttcttcttttttttgaggtggagcctcgctctgtcccccagattagaatgtagcggtgctattagcgctcactgcaaattgcggctcctgggctctagacatagtcccgcttctgcctcgcgcgtggctggtacaacaggcgcatgtcatcatgcccgcctttttttctgtattttcagcagggacggcgtgagcccctgttag

SEQ ID NO: 32674 - DNA, 324 bp, Artificial Sequence
  Description of Artificial Sequence: Synthetic coding sequence
gtgcttaatggtgcccaggctggggttcagtggagggacttgggctctctccagcctccacccccctcacatctgcctaggccgtccaaagtacctcgcgtccagcccctgcccggaaggcatccagtatgggaagttcgaggggtctcagcctggccgcctatcgtttgggacgtgcgtagcccctcagcctggttgcccagtctggaatcggaagaacgcctgtgcccagcagctatcccctctagaaagtggggcgcacctgtccctcgccggcccatctgggacgtcagatcagtgtctgcccagcccccacggctatag

SEQ ID NO: 32675 - DNA, 288 bp, Artificial Sequence
  Description of Artificial Sequence: Synthetic coding sequence
ttctttttctttctgcgatggtcactcgcactcttgccccgcgtcgagtgtagcggcatgatctctgcccactacaacctgcatctgcctggtagctcagacagccccgccagcgcgagtcgtgtggctgggaccactggcgttcaccaccacgcctggctgattttctgtatcttttcacgagatggggtgctgctgtgttgccctggctggtcccccacccctggtctcaagcgttccagctgtttggggttccggaagtgctgggactatcgacatgagccctag

SEQ ID NO: 32676 - DNA, 399 bp, Artificial Sequence
  Description of Artificial Sequence: Synthetic coding sequence
tgtatgtgcgtctgcgtgtgcgtctgtatgtatatctatatttacatctatatcagtcagccaatctacatcttccttctgttactgctcctgctgttcctgaggcagtctctcatgattaagaatcaggtaaggcggcccggggcagttgcccacacgtgtaatccttccacagttggaggccacgggggtcagatcacacgaggacaagagtttgagacaagtttggcgaatatgggtgagacgccttctctgttaaagatccagacatggccaggcgttgttgcacatgcctgcaatccgtcctactctggcggccggctccggcaggaaaattgcctcaatctgggtggcggtggctgtggcgaaatcgctctgcagcccggtcaacaggagtag

SEQ ID NO: 32677 - DNA, 282 bp, Artificial Sequence
  Description of Artificial Sequence: Synthetic coding sequence
tctgttgcacaagcaggagtccaatggcataacttgggtagcttgcaacctccgccacctagattcaatcgcttctcttgcttaagcatacctagttcatgggattaccgccatagtcccccaagacttgccgattttctatttctcgtggaaactgagttctgccacgtgggccaggccgcgctggagttgttgacttcaggcgatctccctacctcagccagtcagtctgcacgcatcacgggggttagtcatcggacgcgccctagcttattctattag

SEQ ID NO: 32678 - DNA, 423 bp, Artificial Sequence
  Description of Artificial Sequence: Synthetic coding sequence
ggcacaatttccgcacactgtaacttatgtttgttggattcctctgatagccccgcctccgccagccgcgtagcgggtatcattggggcacaccatcatgcccagttgatttttgtattcctggtggaaatggggtttcatcacgtggggcaggctggattgaaacttctgacatcagacccaccagtctctgcctctcaaagcgccggcatcacaggcgtctcacaccacagggaacctcagcacccgttcctgctgagcgtcgaatccagggaccgtcctttcttcttttttggctttttttttttcgagatggaatcctacagtgttgcccaagctggcgttcaatggcgggatctctcctcgctgcagccccccccgcctagggcccaggctatactgccacctcagcctcccaagtag

SEQ ID NO: 32679 - DNA, 396 bp, Artificial Sequence
  Description of Artificial Sequence: Synthetic coding sequence
tgcaatttatgtctgctcggctctagcgactcaccggccagtgccagccagattgctggtatcaccggcgcccaccatcatacctggctgttctccgtctttctggtggaatccggcttccaccacgtgggccaggccggtctggaattgctgacctctggtgatccagcgagcgcatcccactccgctggcatcacaggcgtaagtcactgtgcgtggccgcgtttagaggccacgtccgtacctaatttcttctttttcttctttttcttcttcttctttttaaggcggtccctcgcggtggcccaggctggggttcagtggaggaacctcggaagcttacaggcacctcctccaggcgtgcatgctattctgcttccacagccccctgagtag

SEQ ID NO: 32680 - DNA, 153 bp, Artificial Sequence
  Description of Artificial Sequence: Synthetic coding sequence
ccctctttcttactgttttttctgccatcatttctgcccttcagtctgtccagtttatcattcctaccttttctgttatccttcctgaccgggagccatctctttagtataacccatacgcacacccacacccacacccatacacacacatag

SEQ ID NO: 32681 - DNA, 423 bp, Artificial Sequence
  Description of Artificial Sequence: Synthetic coding sequence
ggcactattagcgcccattgcaatctgtgcctgcttgacagctcagactcccccgcctctgccagtcgggttgcaggcatcatcggcgcccatcatcacgcccagctcatattcgttttcctggtcgagatgggctttcatcatgtcgggcaagccgggctgaagctgctgacatccgatcccccagtctctgccagccaatccgccggtattactggggtgtcacatcatagggaacctcagcatccgttccttctctccgtcgaatcgagagatcgacctttcttcttctttgggttctttttcttcgagatggagagctatagcgtggcccaagcgggggtgcagtggcgcgatctgtcttcccttcagccccctcccccccgcgcccaggcgattctgccgcctcagcccccaaaatag

SEQ ID NO: 32682 - DNA, 396 bp, Artificial Sequence
  Description of Artificial Sequence: Synthetic coding sequence
tgtaacctctgcttgctggggtcatctgacagtcctgctagtgctagccagatcgccgggataaccggtgcacaccaccatacatggctttttagtgtgtttttggtggagagcgggttccaccatgttggtcaggccggcctggagctgctcaccagtggagaccccgcttctgccagccacagtgcagggatcacaggggttagccattgtgcctggccccgtttagaggctacgtcggttccgaactttttcttcttctttttcttctttttttttttccttcgaaggagtctggcagtggcccaggcaggcgtgcagtggcgcaatctcgggtcattgcaggctcctccccccggtgtgcatgccatcttactcccccagccccctgagtag

SEQ ID NO: 32683 - DNA, 279 bp, Artificial Sequence
  Description of Artificial Sequence: Synthetic coding sequence
ttttttttttttttctttgagactgattgtagatcagtgacacggctggagtgcagcggcattatctccgctcactgcaagctctgcctgccaggatcaagcgactctcccgcaagcgcttcccaggcagcccgaacaattggcacctgccaccacacacagcttatttttgtgttcttcgtagagacggggtttcaccatgtaggacaggatggattaaacctgtcattagtgatacaccccccacgcccgcctaaagttttgggactgcaggtgtag

SEQ ID NO: 32684 - DNA, 228 bp, Artificial Sequence
  Description of Artificial Sequence: Synthetic coding sequence
tgctttagtcactccttcttcttcttcttcttcttcttgcggtggtccttggccctttcacccaggcttgaatgctccggggccatctccgcacactgcaagctcagactgttagggtcccgtcacagtcctgcaagcgcatcccgtgttgctggcacaacgggagcttgtcaccatgctcgcctgttcttctgcatctttagcagggatggggtgtctccctgttag

SEQ ID NO: 32685 - DNA, 177 bp, Artificial Sequence
  Description of Artificial Sequence: Synthetic coding sequence
cccggcggagccgccgcagccgcaagcgtcatggcccccagaaggtctagatgtttctgcacctccatctgtgggggtcggggcgcccggcctcagctccccaggacgtgcggtgacggtacccagcattgcggtagagggaagccagcccttgctgccgcggaggaatggccatag

SEQ ID NO: 32686 - DNA, 372 bp, Artificial Sequence
  Description of Artificial Sequence: Synthetic coding sequence
gtgtgtgtttgcgtgtgtgtatgcgtgtgcgtgtgtcttttcatttactttagcgttttctggtcgttcttgtacctgtttgtctttctgctgaaaatctacgagaaacgcccatgcgccgttgcccatgcatgcaacccacctggcgtcgtcgcccacgcctgtaacccatcgactcttggcggtaggggaggccagattagctggagccaggagttcgaaacaagtttagccaatatgagcaagacaccaagccgtaagaagcgcaaggggtggtctggagtggttgctcacgcttgcaatcattcctatagcggcctaagacaagagaactgcctcaaccctgtgggaggtggctgcgtgcagccttag

SEQ ID NO: 32687 - DNA, 288 bp, Artificial Sequence
  Description of Artificial Sequence: Synthetic coding sequence
ttctttttttttttaagatggtcactagccttgctgcctcgcgtcgagtgctccggtatgatcagcgcccattataatctacacctgcccggctcaagtgacagtccagcttccgcctcacgtgttgcaggcacaaccggggtccatcatcacgcttggctgatcttttgcatcttctcacgggacggcgtgttgctgtgttgcccagggtggtcgcccacaccaggactaaagagatcgtcttgcctaggctttagaaaatgctgggattaccggcacgaaccatag

SEQ ID NO: 32688 - DNA, 261 bp, Artificial Sequence
  Description of Artificial Sequence: Synthetic coding sequence
ggcaccatcagcgctcattgcaacctatgcctcctgggatcttccgacagcccagcctctgcctctcaggtagcagcaggcatcaccggcgcatgccacctggctcagctcatcttcatattccttattgagaccggattccaccatgccgtgcaggcaggcctgaagctacttacactgtctgatctgccggcatctgcctctcaaagcgtggggatcacaggcgcgagtcatcgcgcagatccaaaggtattcctatag

SEQ ID NO: 32689 - DNA, 66 bp, Artificial Sequence
  Description of Artificial Sequence: Synthetic coding sequence
aatcgcaagaaggagggcaaaaagaatcagtcacctcctccaacagtgtccccactcgccacgtag

SEQ ID NO: 32690 - DNA, 303 bp, Artificial Sequence
  Description of Artificial Sequence: Synthetic coding sequence
ttccttagacggtctctcgccctgtccccacgacaatggcacgaccttggaagcctgcagcccccgccccccggcttcaagcccttttcatgtctgagcctgttgtcatcctgggattaccgctgtgccccaccgtgcccggccaacttttgcatcctggttgaaatgggcttccatcacgtgggccaagcgggcctcgaacttctcacctcagaccttcccactagtgcttcccaaagggcaggcattacgggagtgaatcatcatgcctggccaagggacgcgttcagcatctcatattag

SEQ ID NO: 32691 - DNA, 282 bp, Artificial Sequence
  Description of Artificial Sequence: Synthetic coding sequence
agtgttgcacaggcaggggtgcagtggcacaacctcggctcactccagcctcctccaccccgcttcaatagattctcatgtctcagtataccctcttcttgggactaccgccactctcctcccttactggccgactttctgtttctggtcgaaaccgagttctgccatgtgggccaggccgcccttgagctgttgacaagtggagatctgcccacttcagcatcgcaatctgcgcgcatcaccggggtctcacatagaacgagaccttccctgttttactag

SEQ ID NO: 32692 - DNA, 111 bp, Artificial Sequence
  Description of Artificial Sequence: Synthetic coding sequence
aagcggaagaaaaaggagagaaaaaaggagcggaaaaaaaaagagcgaaaaaaagagagaaagaaagagcgtaagaaggagaaagagcgtaaaaaggaaaaggaaaggtag

SEQ ID NO: 32693 - DNA, 234 bp, Artificial Sequence
  Description of Artificial Sequence: Synthetic coding sequence
atcaactgctattccttctattccctgtttctgttcgtctgcattaccgatggcgtatctctcagtcctagacccgagtgctctggtgccataagtgcccattgtaggctcaggccacgcggctcacgtcactcacctgccagtgcctctagagtagcaggaacaacaggtgcacggcacctcgcgcagcttattttttgcatattctcaagggatggagtgagtctgtgttag

SEQ ID NO: 32694 - DNA, 222 bp, Artificial Sequence
  Description of Artificial Sequence: Synthetic coding sequence
cggcgtgagagacctctgcccgaacctcactcacagttcttttttttctttttcttctattacactctgagctttcgcgtgcacgtgcatatcgtgcaggtgtcttacatttgcatacacgtgccgtgctggtgtgctgctcctacaaatgtcagtagttctatccgctacatttcacaatgctaccccagccccttgcctagacctcaccactctccctag

SEQ ID NO: 32695 - DNA, 123 bp, Artificial Sequence
  Description of Artificial Sequence: Synthetic coding sequence
agtccaccccctcctgggggaggagagaaacctctggcccctcctcctgggtgggtggagccacctaaatggctgggactgcaaggaccatctggtggtccgggtgcaggcccgggattgtag

SEQ ID NO: 32696 - DNA, 318 bp, Artificial Sequence
  Description of Artificial Sequence: Synthetic coding sequence
tacttctatttcctccgccaatctctgactctgtctccccggctggagtgctcagggactatttccgcccactgtaatctttgtctccctgggagttccaacagtcctgcttccgcttctcaggttgcaggaattaccggcgtttgccatcacacgcagctgatctttgtgttccttgtagaaatgggcttctgccacgtgggacaagcgggattggagctcttgacgagcgggaatccccccgccctagcctttcagtccgccggcatcacaggtatgagccaccatgcttggcctggccacatgttcttcaagtag

SEQ ID NO: 32697 - DNA, 216 bp, Artificial Sequence
  Description of Artificial Sequence: Synthetic coding sequence
ctgacttcttttcgggtggttcacactattccaatgattaaatctttcttcaactacctgtcccccaagcatctcaagttccaggtcgattgcaacaagggcgttacaggcactatatacgagtacggcgccctgaccctcaatggagaggagtatatccagtttaaacaatttgcgggaaagcacgtgctgtttgtgaatgtggcagcttattag

SEQ ID NO: 32698 - DNA, 168 bp, Artificial Sequence
  Description of Artificial Sequence: Synthetic coding sequence
gtaatcgggtgggtctggtggctcacaccagtgatcccggctctgtgggaagctgaagctggcggctcccctgaaattcgctcaagtaggccagcctggccaacgtggggaaacccatcacttcttaagatacaaaaactcgccagaaggggtggggcccacctatag

SEQ ID NO: 32699 - DNA, 366 bp, Artificial Sequence
  Description of Artificial Sequence: Synthetic coding sequence
ctgcctccagctgaccttttcatcttcattttcattgataaagtcagcctgttaagtccgcgattagaatgcaatggcacaatatcggcacactacaaactgcacttgccatttaaacgttttagttgcctcagtctgctgaaaacaggcttccatcacgtgggccagctgatcttcgtgtttctggttgaaatggccttccaccacgtgggacaggcaggtctagaacttctgaccagcggagacctgttcgaggtcgagtttcacagctgctgcttaggctggagtgcaatggcgagatcaaggctcacagcaaccagcgcctcacgcgttcaggccattctgctgccacagcctcccgaatag

SEQ ID NO: 32700 - DNA, 420 bp, Artificial Sequence
  Description of Artificial Sequence: Synthetic coding sequence
atctgccatcacacgcaattgatcttcgtattcctggggttctacctcttcatctatctcttcatcgatggagtgttgctctgctgtcctgggtggtcggctgtcgtgcaatcatggctgactgcaaccagtgccagtcaggtggccggtattacggggatgcaccaccacgcgcagctgatttttgtctttctggtagagatgggctttcatcatgttggccaggccggtctcgagctcctgacgtccggcgatccacccgcgtctgctagccagtccacggggatcactggggtttcacactgcacacgtcccaatttctgcattttctcgagggatggggtgtccccctgctggccaggctggtccaggaccccggacctggtgatatccgcgcacttagggttgcccaagtgttag

SEQ ID NO: 32701 - DNA, 228 bp, Artificial Sequence
  Description of Artificial Sequence: Synthetic coding sequence
tgcttcagccatagcttcttcttcttctttttcttccttaggtggtcactcgccttatctcctcgccttgaatgctctggggccatttccgcgcactgcaaactgcgtctgctaggatctagacacagtcctgccagcgctagtagggtagccgggaccacaggggcctgtcatcacgctcgtcttttcttttgcattttttcgagggacggcgtgagtccttgctag

SEQ ID NO: 32702 - DNA, 303 bp, Artificial Sequence
  Description of Artificial Sequence: Synthetic coding sequence
tttctgcggaggagcctggcactgtctccgcgccagtggcacgatctaggtagtttacagcctcctgcccccgggtttaaaccgttttcttgcctcagcttgctgtcctcatgggactatagatgcgcccctccttgccccgccaacttttgcattctggtcgagatgggatttcatcacgtgggtcaggccggactggagctgttgacctccgatctgcccgcaagtgcctcccaacgagccggaatcacaggagtgaatcaccacgcttggccgcgggacgctttttctattagttactag

SEQ ID NO: 32703 - DNA, 1251 bp, Artificial Sequence
  Description of Artificial Sequence: Synthetic coding sequence
atgaagatgcagaagggtaatgtgctgctgatgtttggtcttcttctacatttggaagctgccaccaattcgaacgagacaagtacctcagcaaacaccgggagctcggtaattagctctggcgccagtaccgccaccaactctggcagctcagtaacgtcctcaggggtcagtacggccacaatatcaggtagttccgtgacttccaacggggtcagtatcgtcacaaacagcgagtttcacacaacttcttccggtatctctaccgctaccaacagtgagttcagcactgttagctcggggatatctatagctacaaactctgagtcctccactacaagttccggcgcctcaacggcaacaaattctgagagctcaacaccaagtagtggcgcctccacagctaccaattctgattcctccaccaccagcagtggagcatctactgctacaaacagcgattcgtcaactacaagctcagaggctagcacagccactaactcagaatcgtcaaccacaagctctggcgcctctaccgcaacgaatagcgagtcctcaactacatccagcggtgcatctacggcaacgaacagcgaatctagtacgacctcttccggggcctccacagctacgaatagcggatccagcacaacgtccagcggcacttctaccgccaccaattctgaatcttccacagtatccagtggagcaagcactgctactacctctgagagctctaccacctcctctggggcttctacagcaaccaactccgagtccagcactgtttcttcgggggcatccaccgcaacaaatagtgaaagtagtacaacctcttctggcgccaacacagccacaaactcaggatcatccgtgacgtctgccggctctgggaccgctgcactgactggcatgcatacaaccagccatagcgcttcaactgccgtgtctgaggctaagccaggcggttcactggtaccctgggagattttcctcatcacactcgtgagcgttgtcgccgcagtcggactgttcgccggccttttcttttgcgtgaggaactcactgagtctccgcaacacatttaatacagctgtgtatcatccgcatggtctgaatcatggtttgggcccagggcctgggggtaatcacggagccccacatcggcctcgttggagcccgaattggttctggcgcagaccagtgagctctatcgcaatggaaatgagcggacggaacagcggaccttag

SEQ ID NO: 32704 - DNA, 372 bp, Artificial Sequence
  Description of Artificial Sequence: Synthetic coding sequence
tgggattacagcttctttttttttctccgccagagccactctgtgccccaggccggagtacagtggtgcaacctgtctagcctgcagcctcccccgtcgagatttaagaggttctcttgtctgtcgctgctgtcctcctgggattaccgccacactcctccctgccctgctaactttctctatacttttgagctcttcttttttttcctgcggtggagctttgctctatcccctcgcctggagtgcagcggtgctatcctcgtgcattgtaacctttgcctccccggatccagtgactcatgtctgagcctgcccatctcctgggactatcgctgtgctcccccgtgtctggccaatttctgtattttttag

SEQ ID NO: 32705 - DNA, 309 bp, Artificial Sequence
  Description of Artificial Sequence: Synthetic coding sequence
gtattgctctgttgccccgggtggtcagcagtggtgcgaagttggctcacagccacttctgcttcatggcagcttgcaggtattacaggtgtgtgccaccacgcccagcttatctttgtgttttttatcgaaactgagttccaccacgttgggcaggcagggccagagcttctgacatctggtgacccaagcgcttctgctagccagagcgccggaatcacaggcgcatcacacccacgtcgtgccaacttctgtattttcggccgagacggagtcagtccctgttggccagggtggtcttccacgtag

SEQ ID NO: 32706 - DNA, 381 bp, Artificial Sequence
  Description of Artificial Sequence: Synthetic coding sequence
cgacaccaggcacaactgattttcttgtacgatttattcctctatgtctactttctaaaggacagggtactcctttgccatcccggatggtctgctatgacccggagtaggctgactgccacgagcgccagtcaagtggccggcacaatcggcatgtgtcaccacgcccgcctgattttcttttttttctttgtcttccttgttgagatggggttccattgcgtgtcccagcacgggttagagctcctgactctggacccccccgccagcgcctcccagtcagccaggataatcggtctaaatcattgcacccaaccaaccttttgcattttctctagagatggcgatagcccttgctggccagactggtcccggacatag

SEQ ID NO: 32707 - DNA, 153 bp, Artificial Sequence
  Description of Artificial Sequence: Synthetic coding sequence
cccagctttttgctcttttttctcccttcctttttgccatttagcctgtcaagcctgtctttcctgccatttcttttgtcctttttaactggtagctttggccaagacaaagtgttctccatcacacacactcacacccacacccatacatag

SEQ ID NO: 32708 - DNA, 372 bp, Artificial Sequence
  Description of Artificial Sequence: Synthetic coding sequence
tgcgtttgcgtctgtgtgtgcgtgtgcgtctgcctgttcatatatttctctgtgttctggtctttcctgtacctgtttgtgttcctcctgaaaatatacgagaaacgcccctgtgcagtggcacatgcttgtaaccctcctggggttgtcgcacatgcttgtaacccctcaacactaggtgggcgaggggggcagatctcttggtcccaagagtttgagacgtcgctcgccaacatgagcaagactcccagccggaagaaaagaaaaggctggtctggagtggtcgcccacgcctgtaaccattcatactctggcttgcgccaggaaaactgtcttaaccctgtgggtggaggatgtgtgcagcctaggtag

SEQ ID NO: 32709 - DNA, 279 bp, Artificial Sequence
  Description of Artificial Sequence: Synthetic coding sequence
tttttcttcttttttttcgaaaccgattgccggtccgttaccagacttgagtgttcaggtattatttcagctcactgcaagctttgtctgccagggtcaagcgatagtcccgcctcagctagtcaggccgccagaactatcggcacttgccaccacacccaattgattttcgtcttctttgtggaaaccggctttcaccacgtcgggcaagatggtcttaacctcagccttgtgattcaccctcctcggccccctaaggttctggggctgcaggtttag

SEQ ID NO: 32710 - DNA, 384 bp, Artificial Sequence
  Description of Artificial Sequence: Synthetic coding sequence
attttcttcttccttcgacagggtctgctgctgtccccaagactgctcgagtgcaacggaacgatctctacccattgtaatctgcatattcctggctcctctgactctccagccagtgcttcgcaggtggccgggatttatcgttcccgggatcagcctgatcagcatggcgagacccccagtttattaaagattcagaaactggttggccggggaggatttcacttcttttcccagttgctgggccgtccacgtcaggagaacggcgtcaatccaggggggcgtgcttgttccgagctcaggctgcgccattgcacacccgcctgggcgacagaagctcgtctctgtctgaagaaaaagaagaaaaagaagaagaagaagtag

SEQ ID NO: 32711 - DNA, 312 bp, Artificial Sequence
  Description of Artificial Sequence: Synthetic coding sequence
ttcttctttttcttacgcaggtcactggcactttctccacggctggaatgtagcggtgggatttcagcacactgtaaactgcgactgctcggatctagacatagccctgccagtgcaagtcaggttgccggcacaaccggggcccgacactacgctagactgatctttctgtttctgattgaaactggtttccactacgtgggccaggccgggctggagctgctgacaagcggggaccttccaacatcagctagccagagcgccggcatcacgggcgtatctcactgtactcagccagaggatatcttctag

SEQ ID NO: 32712 - DNA, 243 bp, Artificial Sequence
  Description of Artificial Sequence: Synthetic coding sequence
gcgcaccacctccggtccggggccggcgatcagcccggacagcacggcgagacaccaagcttgctcaaaatcgaaaaactcgctgagcacggaggctcatgttttagctttcaggtgctcgggcgtctcagacaggaaaactgtttaaatcccggcggagggggatgctccgagcctaggttgtgccactgcacacccgcatgggctaccgagcaaggatccgtctccaggaagaaagagtag

SEQ ID NO: 32713 - DNA, 420 bp, Artificial Sequence
  Description of Artificial Sequence: Synthetic coding sequence
atttgccaccacactcagctaatttttgttttcctagggttctatctcttcatctacctgtttattgacggcgtgctgctgtgctgcccaggttggtccgcagtggtccaatcttggctgaccgcaacttctgccagtcaggtggctggaatcacaggtatgcaccaccacgcacaactgatcttcgtatttcttgtggaaatgggcttccatcacgtcggacaggccgggctggagctccttaccagcggagacccacccgccagtgcaagccagtccactgggatcactggtgtaagtcactgcacccggcctaacttctgtatcttttcccgcgatggcgtgagtccgtgttggccagggtggtcgaggacaccagacttggtgatatcagcccacttggggctaccaaagtgttag

SEQ ID NO: 32714 - DNA, 318 bp, Artificial Sequence
  Description of Artificial Sequence: Synthetic coding sequence
tatttctactttctgagacagagcttgacgttgtccccccggcttgagtgtagtggaatgatatctgctcattgtaacctgtgcctgcccggctccagtaacagcccagctagtgccagccaagttgcagggatcactggagtctgccatcatacccaactcatcttcgtgttcctggtggagatgggtttctgtcacgtaggccaggcttctctagaattattgacctccggtaatccacctgcactggctttccagtccgcgggtatcaccgggatgtcccaccatgcctggcccggccatatgtttttcaagtag

SEQ ID NO: 32715 - DNA, 462 bp, Artificial Sequence
  Description of Artificial Sequence: Synthetic coding sequence
gtccgaggtgcaagcgcccggccacctttgctgggaagtgaggaaccgctgtcacccgcgtcccgccctgtcagggaagggggaggaggagtgtcgcctccacctgggcaaccaccatgtcccgggggacggtggggcggacagcccagcgctagaccagccgctccttcaggccgggaggtcggggtgagcgcaccaagacctgcctccagacctgttagagaggtccgcggtgcctctgcgcgcccccctctcctcggttccgaagagcccttgtgtcccgcgtccagaccagttcgggagggtgggggcggcgtgtcccctcccccaggacagcctccccgacctggaggaagaggagcctccgcccgtcccccactgttgggtagtgaagaaccgttatgcgccgccacgacacccagcggcagatgcgctcagcagctgattgaaaacggtccctag

SEQ ID NO: 32716 - DNA, 348 bp, Artificial Sequence
  Description of Artificial Sequence: Synthetic coding sequence
atgaatgtgtgctgctctagtcatccagtcaatgaaaaagtctggaagccttctagtagaaaatggagtagcaaggtttggtcaatggatgagtttgatcttcagaccgcctgctactggttcatgacccgctgccaaaaggaggccgggaagtttggtactcaccggggcaagccaatgtgcttcgtccggtctctgctcagagtccagcttctgcctagaacatttccggccaactctttcgtgattagttttttcccttccctgatataccctttgcaggtttaccagctgcacttcgagagcagcgacaaacaacgagccatgcagttcgtgaccgagggatag

SEQ ID NO: 32717 - DNA, 318 bp, Artificial Sequence
  Description of Artificial Sequence: Synthetic coding sequence
tatttctacttccttcggcagtccctcaccttgtcaccaagattggagtgcagtggaaccattagcgctcactgcaacctgtgccttcccggaagcagcaacagtcctgcaagtgcttcccaggtggcagggatcactggtgtctgccaccatactcagttaatctttgttttcctggtggaaatggggttctgccacgtgggccaagcaggtctggagctgctcacttctggcaacccccccgctctggcctttcagagcgctgggatcactggtatgtctcaccatgcctggcctggccacatgtttttcaagtag

SEQ ID NO: 32718 - DNA, 111 bp, Artificial Sequence
  Description of Artificial Sequence: Synthetic coding sequence
aaacgtaagaaaaaagaacggaaaaaggagcgaaagaaaaaggaaagaaagaaggaaagaaagaaagaacggaaaaaggagaaagaacgcaaaaaggaaaaagaaaggtag

SEQ ID NO: 32719 - DNA, 420 bp, Artificial Sequence
  Description of Artificial Sequence: Synthetic coding sequence
atatgccaccacactcagctgatttttgtgtttcttggcttttacttgttcatttatctgtttatcgatggggtgctgttgtgctgccccgggtggtccgctgtggtccagtcatggttaaccgccactagcgcttcacaggtcgccggaataaccgggatgcatcatcacgcacaattgatcttcgtgttcctcgtcgagatgggattccatcacgttgggcaggcagggcttgagctgctgacatctggcgacccacccgcttccgcttctcagtccaccggcattaccggggtgtcacattgcaccagacctaatttttgcatattttctcgcgatggcgtatccccgtgctggccgggctggagccggactcccgacctggtcatcagtgctcatctaggcttaccaaagtgctag

SEQ ID NO: 32720 - DNA, 111 bp, Artificial Sequence
  Description of Artificial Sequence: Synthetic coding sequence
aagaggaagaaaaaggaaaggaagaaggagagaaaaaagaaagaacggaagaaggaaaggaagaaggagagaaaaaaggagaaggagagaaagaaggagaaggagagatag

SEQ ID NO: 32721 - DNA, 108 bp, Artificial Sequence
  Description of Artificial Sequence: Synthetic coding sequence
agccctaataagctcctgtttgaccctagggtaggtgggcgggtgagtcacgtgtttttcctcttccctccatttgtcctgctaccaggcccccctgggctgccatag

SEQ ID NO: 32722 - DNA, 303 bp, Artificial Sequence
  Description of Artificial Sequence: Synthetic coding sequence
tttctcagaaggtccctggccttatctccacgacagtggcacgatctcggctcactgcagccccccgctccaggatttaaaccattctcctgcttatctctgctgtctagttgggactaccgttgtgcacctccctgccccgccaatttttgcatacttgtggagatgggctttcaccacgtaggtcaagccggtctggagctcctgacatctgacctaccagccagcgcctcgcagagggctggcatcactggggttaaccaccacgcatggcccagggatgccttttctatatcatattag

SEQ ID NO: 32723 - DNA, 399 bp, Artificial Sequence
  Description of Artificial Sequence: Synthetic coding sequence
tgtatgtgcgtatgtgtatgtgtctgtatctacatttacatatatatctatatctcacaaccaatatacatctttctgctgttgctccttcttctgtttttgaggcaaagcctcatgatcaagaaccaggtgcggcgaccaggtgcagtagctcatacatgcaacccaagcactgtggggggtcatggcgggcagataactcggggccaggagtttgaaacttccttagccaacatgggggagaccccgagcctattaaagatccagacgtggcctggagtggtcgctcacgcatgtaacccgtcctactctggtggccgtctgaggcaggaaaactgcctgaatctaggtggaggggggtgcggggagatcgctttgcagcccggacaacaagaatag

SEQ ID NO: 32724 - DNA, 111 bp, Artificial Sequence
  Description of Artificial Sequence: Synthetic coding sequence
gggagggacgactggcaagccgcacctcctgccgctccagtgagagatcctctgggcgaagcctcctgggcacccgaatgcgggggtgacctagagaacctgtacgtgtag

SEQ ID NO: 32725 - DNA, 228 bp, Artificial Sequence
  Description of Artificial Sequence: Synthetic coding sequence
tgtttcagtcacagtttcttttttttttttttttttctgcggtggagtctggccctgagccccagactcgagtgcagtggcgctattagcgcccactgtaaattgagactgctggggagcagacactccccagcctccgctagcagggttgcggggaccacaggtgcgtgccaccacgcaaggcttttcttttgtatttttagtcgagatggcgtttccccctgttag

SEQ ID NO: 32726 - DNA, 336 bp, Artificial Sequence
  Description of Artificial Sequence: Synthetic coding sequence
ttcttcttcttcttttttttacgtcacacgttggctctcttgcccagactagagtgctccggagcaatcctggcgcactgcaatatccctttgtcatctagctctaacagcccagcctccgcctctcaggtagccggcataaccggcgtctgtcaccacgcccagttgatcttcgtgtttttcattgagacagaatttcatcatgttgggcaggccggaccggagcttctaacttccggggatccatctgctagcgcctctcagagtgccggaattaccggggccagccacagggcccagcccctctccatccttttcttctttttcgaagcctag

SEQ ID NO: 32727 - DNA, 462 bp, Artificial Sequence
  Description of Artificial Sequence: Synthetic coding sequence
gttaggggagcatccgccagaccaccactcttgggttcagaggagccactttctcccgcctcgcgcccagtgagagagggcgggggcggagtgtccccccctcccggccagcccccgtgcccaggcggacgctggggcgggcaaccttccgctaggcccgccgcgccatccgggcgggaagtgggggtgagcgcccctcgtccggctagtcgtccagtgcgggaggtcagaggcgcctctgcacgaccaccactactgggttccgaggaacctttatgccccgcaagtcgacctgtaagagaaggaggcgggggggtgagcccaccccctggacagcctccgagacctggcggaagaggggcctcagcacggccgccactgctcgggtctgaggaaccgctgtgcgccgccacaacccccagcggccgatgcgcccaacagctgattgagaacggcccatag

SEQ ID NO: 32728 - DNA, 273 bp, Artificial Sequence
  Description of Artificial Sequence: Synthetic coding sequence
cagtggtctgacctgggcagcctccagccgccacctccgggattcaaacggttctcctgtctcaacctccccacttcctgggattatcgccatgttcctcctcgccccgctaacttttgtttctttatcgagatggggttcctgcacgtgggtcagaccgggctggagttgcccacctctggagacccccccgcctccgcctctcagtctgccggaatcacaggcgtctctcatcatgcatggccccatttcattatcctcttgatgatttag

SEQ ID NO: 32729 - DNA, 387 bp, Artificial Sequence
  Description of Artificial Sequence: Synthetic coding sequence
tggagggcaccagttatccctgccacccgagaggcggaggccggagagtggtgtgaaccgagatccactcggatccaggagaaggacattgccttcctggctttttcattgggagatagggttcgcctgtatctgcagaagaagaaaaagaagaagaaaaagaatcaatcgagattgtttttgaggctgagcttggccctgagtccccgactagagtgtagcggggctatctctgctcactgcaacctgcatcatctggggtcctcggatagtccagcatccgccagcagagttgccgggatcacaggggctaggcaccacaccaggttcatcttcgtgtttctggttgagaccagctgctggaatctgcttgtatcaaacagctag

SEQ ID NO: 32730 - DNA, 357 bp, Artificial Sequence
  Description of Artificial Sequence: Synthetic coding sequence
tggtgcgccccagttgctcctgcaacgagagaagtggaggtagggggctcgctggagccaaaccgcagccgattgcagtctgcaaagatagctcccctacactattcgttgggaaatcggactaggctgtgtttgaagaaaaagaagaaaaaaagcctgttcaataaggtctgtttgttcctgaggcgttctctgacactttctccccgcttggagcattccggcatgatttccgcacattgcaacctaaggttacccgggtctagttactcccctgtctccgcttctcaggtcgccgggatcactggtgcctgtcaccatacccagttgatctttgtcttcttggttgagacctag

SEQ ID NO: 32731 - DNA, 318 bp, Artificial Sequence
  Description of Artificial Sequence: Synthetic coding sequence
tacttctatttcctgagacagtccctcacgctctcaccacgcctggagtgctcaggcaccatttcagctcattgcaatctgtgccttcctggctcgtcaaatagccctgcctcagcgagtcaggtggctggaataaccggggtgtgtcaccacacccagttgatcttcgtgttcctagtggaaatgggtttctgtcatgtaggtcaggcgggcctggaactactgacatccggaaacccccccgcgttggcctttcagtcagcaggcataacggggatgagccaccatgcctggcccgggcacatgttttttaaatag

SEQ ID NO: 32732 - DNA, 354 bp, Artificial Sequence
  Description of Artificial Sequence: Synthetic coding sequence
gaccgcgtcttattgtgtcatcctggatggagcgccatgactagaagccgactgactgcaaccagcgcttctcagctggcaggaatcactggtacgcatcaccacgtgtggctgagttttgtgttcctggtggagatgggaattcatcacgtagggcaaactggactagagctgccaacgtctggcgatctgccaactagcgccacgcagtcagccggaataaccggagtcgggcactgttctcgaccagaagaggtgctgttctttcgggacggggtgtccccttgctggagtggctggagccagacaccagggctgaaaccctcgagtcacctgggattaccaaagtgctag

SEQ ID NO: 32733 - DNA, 111 bp, Artificial Sequence
  Description of Artificial Sequence: Synthetic coding sequence
aaagaaaaaaaagaagagcggaagaaggagagaaagaagaaggagaggaagaaagagagaaagaaagaacggaagcgggaaaaagaacggaagaaggagaaagaaagatag

SEQ ID NO: 32734 - DNA, 306 bp, Artificial Sequence
  Description of Artificial Sequence: Synthetic coding sequence
ttccatctgttcctcttcatttgcttctttctgttcctgagacgaagcctggcactgtcacctagactcgaatatagcggaaccatttccgcccactgtaaactgcgtctgcctggctccagatattccgcttccgcttctagggttgctggaacaacgggcgcccgtcaccatgcccgactgattttctgcatcttttatcgcgatggcgtgtctccctgttggtctcggatccctgacctgatctgcctgccctggcccccaaaagtgcttggactccaagccccggccaccatccctggctag

SEQ ID NO: 32735 - DNA, 423 bp, Artificial Sequence
  Description of Artificial Sequence: Synthetic coding sequence
ggcaccatctctgctcactgcaatctgtgtctgttagattcttccgactcaccggcatccgcctcccgcgtcgccggcatcatcggcgcccatcatcatgctcagcttatatttgttttcctggttgagatgggcttccaccacgtcgggcaggccggacttaaacttctgacatccgatcctccggtcagtgcctctcagtctgccggcataacaggggttagccaccacagagaaccccagcacccctttctcctgagcgtggagtctagagaccggccattcttcttcttcggcttcttcttttttgagatggagtcttactcggtcgcacaggccggggtccaatggcgtgatttgtccagcttgcagcccccacctccgcgggcacaggccatattgcccccacagccccctaaatag

SEQ ID NO: 32736 - DNA, 387 bp, Artificial Sequence
  Description of Artificial Sequence: Synthetic coding sequence
tggcgagcccccgtcataccagccacacgcgaagccgaggccggggagtggtgtgagccaaggtcaactcgaattcaagagaaggatatcgcgttcctggctttctcgctaggagaccgggtccggttatatctgcagaaaaagaagaagaaatccaagaacaacaaaacctctctttttttgaggctgtcccttgccttatccccccggcttgagtgctcaggagcaatttctgcgcactgtaatctgcaccacttaggctcgagtgacagccccgcctcagcctcccgtgtggccggcattacaggcgctcgtcatcacactcgctttattttcgtcttcctggttgagaccagctgttggaacctcctggtgagcaattcatag

SEQ ID NO: 32737 - DNA, 306 bp, Artificial Sequence
  Description of Artificial Sequence: Synthetic coding sequence
tttcatctgtttctcttcatctgtttcttcctatttcttcgccgctcccttgcactgagtcccaggttggagtattccggaacgatcagcgcgcactgcaagttacgtctccccggttcaaggtactcagcttccgccagcagggtggcaggcacaaccggagctcggcaccatgcccgtctcatattctgcatattctatagagacggcgtctcgccatgctggagtaggatacctgacctcatctgccttccatggccgcccaaggtgctgggattacaggcccctgccaccattcccggttag

SEQ ID NO: 32738 - DNA, 111 bp, Artificial Sequence
  Description of Artificial Sequence: Synthetic coding sequence
aagaggaagaaaaaggagcggaaaaaggaacgtcggaagaaggaaaggaaaaaggagcgaaagaaagaacgcaagaaggaaaaagagcggaagaaggaaaaggagagatag

SEQ ID NO: 32739 - DNA, 279 bp, Artificial Sequence
  Description of Artificial Sequence: Synthetic coding sequence
tttttcttcttcttcttcgaaaccgattgtcgttccgtgaccagattggaatgttctgggatcatttcagcgcattgtaaactctgcttacctggctcttcagactctcctgccagcgcatcacaggcagcaagaactatcggtacatgccatcacacccagctgatttttgtcttcttcgtcgagaccggctttcatcacgtgggtcaggatggcctcaatctgagcctcgtaatccaccctccccgtcctcctaaagtccttgggttgcaagtctag

SEQ ID NO: 32740 - DNA, 111 bp, Artificial Sequence
  Description of Artificial Sequence: Synthetic coding sequence
aagagaaaaaagaaagagcgtaagaaggagaggaagaagaaggagcggaagaaggaacgcaaaaaggagcggaaaaaggagaaggagaggaagaaggagaaagaacgctag

SEQ ID NO: 32741 - DNA, 333 bp, Artificial Sequence
  Description of Artificial Sequence: Synthetic coding sequence
tgcaccagatacttctacttttatctgttctgttttattttcatttacttattcttctttctgcggtggtctctcgcgctgagccctcgcctggagtgttcaggcgcgatttcagcacattgtaagttacacctacctggctcgtgtcattatcccgcctcggcgtcgcgggtcgctgggacaacaggtgctagacatcacgcttggttgatcttctgtatgttcagcaaagatcgcgtttctaggtggagtcagagccccgatatcgcaatctgcctgccttggccacctaaagtactagggctgcaggctcctgcaacaacccctggatag

SEQ ID NO: 32742 - DNA, 357 bp, Artificial Sequence
  Description of Artificial Sequence: Synthetic coding sequence
tggtgtgcccctgttgctcctgccacccgagaagtggaagtgggcgggagcctcgagccaaacagatcccggctgcaaagccctaaaatcgcacccctccattactccctaggtaatagaacgcggctctgtctgaaaaagaaaaaaaaaaaaaaaaagatcaataaggtgtgcctgttcctgcggcgctccttgaccctgtccccccgtctggagcattctggaatgatcagcgcacattgtaacttacgattgccaggatcatcctactccccggtgtcagcttcacaagtggccgggatcacaggcgcatgccatcacacccagctgatcttcgtattcctggtcgaaacttag

SEQ ID NO: 32743 - DNA, 177 bp, Artificial Sequence
  Description of Artificial Sequence: Synthetic coding sequence
ccagggggggcagcggccgccgcatccgtgatggccccgaggcgaggccggtgtttctgcactagcatatgtggtggcagaggggcacggccccagctgccacggacctgcggggatggcacacaacactgcggccgggggaagcccgccttggctgctgccgaggagtggccatag

SEQ ID NO: 32744 - DNA, 129 bp, Artificial Sequence
  Description of Artificial Sequence: Synthetic coding sequence
aaagaggagaacgaggaggagaaggtcaaggaaaaggaaaagaacaaaaaaaggaagaagcggaagaagagccagagtagacgggtctaccatcaggagaaaacacatatactttgggtgtccacatag

SEQ ID NO: 32745 - DNA, 309 bp, Artificial Sequence
  Description of Artificial Sequence: Synthetic coding sequence
gtcttgctttgctgtcctggctggagcgcagttgttcggagctggctaaccgcaaccagcgccagctggcagctggcagggattacaggcgtatgccaccacgcacagcttattttcgtctttttcattgagactgagtttcaccacgtgggccaggctggtcctgagctgctcacctctggggatccaagtgcatcggctagccagtctgccggcatcacgggggcctctcatccgaggagagccaacttctgtatttttggtcgcgatggcgtgtcgccctgctggccgggctggtctagcacctag

SEQ ID NO: 32746 - DNA, 333 bp, Artificial Sequence
  Description of Artificial Sequence: Synthetic coding sequence
ttttttttcttcttcgggaacggagtatggctgtgtcacccggggtggtccgctgtggtccagtcccgcctgaccgctacttccgcttcttggcagctggctggcattaccggagtctgccaccatgcccagttaatcttcgtatttttcatcgagacggaatttcaccacgtcgggcaggccggcccggaactcttaacatccggagatccctctgctagcgcaagccagagcgccgggatcacaggggcctcccatcctcgccgagctaatttctgtatttttgggcgcgatggggtgagcccatgctggccgggatggtcgtctacatag

SEQ ID NO: 32747 - DNA, 75 bp, Artificial Sequence
  Description of Artificial Sequence: Synthetic coding sequence
agggagaccgaaagaacaataacagacgatggatggatggatgggtggatggatggttggatggacggctggtag

SEQ ID NO: 32748 - DNA, 372 bp, Artificial Sequence
  Description of Artificial Sequence: Synthetic coding sequence
ttcatcttcctgaggtggtccctctccctgtctcctcgtttagagtgctcggggactatctccgcccactgcaacctttgcctgcccgggtcttctcatagctccgcaagcgcgtcacaggtcgctagaattactgacgtcggatacgctccggggcagcacggcgaaacaccctccctcctgaagatccaaaagctggccggctatggggtggcaaatgtgtactcccagctccttggtcgactgaggcaagagaacggtgtcaacccagggggtgggacatgtagcgagccccgaagccgtcattgcacaccggcttgggccacggcacgcctaaggttgaagaaaaagaaaaagaaaaagaaaaagtag

SEQ ID NO: 32749 - DNA, 459 bp, Artificial Sequence
  Description of Artificial Sequence: Synthetic coding sequence
tctcgcttttacatcgggtgtgacctgtgcacaaactgttattatggggagtgcgtcgggatcgctgagaaggaggccaagaagatggatgtatatatctgcaatgattgtaaatgggcacaggaaggttcctcagaagagctctactgtatatgcagaacgccggcaggtagctgtaggttctttatcgggcacgatcgatgccagaattggtaccacggatgttgcatcggcattctgcaatcagaagcggaattaatcgatgagtatgtgtgcccccagtgtcagagcaccgaggatgttatgactgtccttacaccattaactgaaaaagacgacgaggagttgaaaagggttctaagatctctgcaagcgcacaagatggcccgcccgtttctcgaaccggtggatcctaacgacgcccccgattactatggcgtaataaaggagcccgtctag

SEQ ID NO: 32750 - DNA, 123 bp, Artificial Sequence
  Description of Artificial Sequence: Synthetic coding sequence
agccctccccccccgggaggaggcgaaaaaccacttgcaccccccccagggtgggtggaaccccccaagtggctggggctgcagggtccgagcggggggcctggcgccggtccaggactttag

SEQ ID NO: 32751 - DNA, 96 bp, Artificial Sequence
  Description of Artificial Sequence: Synthetic coding sequence
gcaaaaccaagactccatcagcccgggcaaagtggcgaaactccctccctcctgaagatacaaaaactggcaaggcggggcggggtgcacctgtag

SEQ ID NO: 32752 - DNA, 417 bp, Artificial Sequence
  Description of Artificial Sequence: Synthetic coding sequence
gggaccattagcgcccactgcaacctgtgcctcctggattcctccgactccccagccagcgcctcccgcgtggctggtattatcggggcccatcaccatgcacagctgattttcgtgttcctggttgaaatgggttttcatcatgtgggccaggctggcctcaaactcctgacaagtgacccccccgcctctgcatcccagtcagccggcatcacgggcgttagtcaccataactggctcttttttagcatcttcctcaagaatagccaagagaccgcgagattctttttttggttcttttttttcgagatggagtcctacagtgttgcccaggcaggagttcagtggagagacctcagctctcttcagccaccacccccccggcacaccatccttctacctcagccgccagagtag

SEQ ID NO: 32753 - DNA, 108 bp, Artificial Sequence
  Description of Artificial Sequence: Synthetic coding sequence
agcccaaacaaactgttgttcgatcctcgggtggggggaagagtttctcatgtgttcttcctttttcccccttttgttttgctgcctggcccccctggactgccctag

SEQ ID NO: 32754 - DNA, 369 bp, Artificial Sequence
  Description of Artificial Sequence: Synthetic coding sequence
tttatctttctgcgatggagtctgtcgttgtccccacgactcgagtgctctgggactataagcgctcactgcaacctctgtctgccaggctcttcacacagttctgcaagtgccagtcaggtcgctcgcattaccgacgtcggatatgcccctgggcagcatggcgagacgccttctctactcaagatccaaaagttggcaggctacggtgttgccaatgtatattctcaactactgggacgactaagacaggagaatggtgtgaatcccggcggagggacctgcagcgagcctcgctctcgccattgcacgccagcctgggccactgcgagattgagattaaagaagaaaaaaaagaagaagaagtag

SEQ ID NO: 32755 - DNA, 462 bp, Artificial Sequence
  Description of Artificial Sequence: Synthetic coding sequence
gtgcgaggagcttctgcgcggcctcctctcctagggtcagaggaaccactgagtcccgcatctcggcctgttcgcgaagggggggggggcgtcagcccccctcctggccagcccccttgcccaggtgggcggtggggcggccagccaagcgcgaggcctgccgctccaagcgggagggaggtcggggtgagcgctcctcggcctgcctcccgcccggtgagggaggtacggggcgccagcgccaggcctcctttacttggctctgaggaaccgctctgccccgccagcaggccggtgagggaggggggaggtggcgtgagccctcccccaggccagccccctcgccctggtggtcgaggagcatccgctcgtccaccccttctcggaagcgaagagcccctctgcgccgccactacccccagcggcagatgtgcacaacagcttattgaaaatggcccgtag

SEQ ID NO: 32756 - DNA, 213 bp, Artificial Sequence
  Description of Artificial Sequence: Synthetic coding sequence
atcagtgcccactgcaatctgtgccttctgggtagttctaattctctcgcctccgcatcccaagtcgctggcatcaccggggcacatcaccaggctcagctgattttcgtgttcttagtcgaaactgagttccatcacgtcggacaggctggtcttaaattgctaaccaacgagtggctgcccgtgtgcctgcccaaatgctgggactattag

SEQ ID NO: 32757 - DNA, 366 bp, Artificial Sequence
  Description of Artificial Sequence: Synthetic coding sequence
tgcgtatgcgtatgcgtgtgtgtgtgcgtgtgtgtcttcatctactttagcgtcttttggagtttcctctacctgttcgtcttcctgatctgggctaaggagcaggattcggtgtctaaaaagaaaaaaaagaagccaggggtcgtcgcccacgcttgcaacccgagtaccttgggaggccggggcggacaaatcaccaagcaggaattcgagacctctctgagcaatatggctaaacctcctaaagttctgggtctgcaaaattggccaggaatggttgcttctacctgcaacccaagttatgggaggcttaaacaggagaatcatctgattcgaggtgggcgcggctgcagtgaaccgagatag

SEQ ID NO: 32758 - DNA, 276 bp, Artificial Sequence
  Description of Artificial Sequence: Synthetic coding sequence
acgtttttcttcttttttttcgagaccgactgtaggtccgtgaccaggctggagtgcagtggtatcatttccgctcattgcaaactctgcctgccaggcagttccgacagccccgcatccgcctcccaggcagccagaacaatcggcgcatgtcaccacgctcagctgatctttgtcttcttcgagaccggatttcaccatgtaggccaggatgggctccttgatctggtgatacaccccccacggcctcctaaggtattggggctgcaggtctag

SEQ ID NO: 32759 - DNA, 372 bp, Artificial Sequence
  Description of Artificial Sequence: Synthetic coding sequence
tgggattattcttttttcttcttccttaggcaaagtcactccgtgcctcaggcaggcgttcagtggtgcaacctcagctctctccaacctccccctagcaggtttaagagattcagttgcctgtctctattgtcaagctgggattacagacacactcctccttgccccgccaattttctgtatactttcgagctgtttttcttttttctgcgatggtcattcgccctgtctcctcgcctggaatgttctggcgcgatcctggtgcattgtaatctatgcctgcccggctctagcgacagttgcctatctctgcctataagttgggattaccggtgcgcacctccttgcctggcaaacttttgcatattttag

SEQ ID NO: 32760 - DNA, 765 bp, Artificial Sequence
  Description of Artificial Sequence: Synthetic coding sequence
aaggtttctcatgtctatttcttcctgcataggcacggcaaccatcctatttcccaatcctttccccacttgtcacgactgtctatcccacagtcaaggcattgccacccgggcccattcagcatgtcgtgctgggcccacttgcccgacggcgctgtggccggtcagagggggagctccctgccttctcgtggtggcagagcggaggccccccttacctcccgcactggtcggctcgctggccaaggggcaccgcctacgtcgctgcctgattgggtggccgctggaaggcggcgttcgagtctcccacgatggggcgggtgtcgggccgagcggttactcacatcacagactggtcaattgccggggggaggggccccccacttcagcgatggggtggtcgcgcggcagagagtgtcgtcacttctccgacggggaggtagggcggagaccttgctgacatcacaaaccggatctagacccggtagaggggctcctcatattcccgatggggctgctggtcagaggcggagcccccacctccgacgatgggccgcaggccagcgcagatcttccttaccgcgatgggatggcggaagggccgagacattgctaactttccagactggacagccggggagaggagctccacatatcccagacgatggacgaccgggaagggacaccccccacttcccagatggcgtggcagcgggccagcgtctgcagtcccggcactttgggaggcctcgacaggctgcttag

SEQ ID NO: 32761 - DNA, 456 bp, Artificial Sequence
  Description of Artificial Sequence: Synthetic coding sequence
atggagagaaaaaacccatccagagaaagtcctcggagactgagcgccaaagttggcaaggggacagagatgaagaaggttgccagacaacttggaatggcagccgccgagagcgataaagattccggtttttccgacggctcgtccgaatgcctgtcctccgcagagcaaatggaatcagaagatatgttgtcggccctcggctggtcaagggaagaccgaccacgacagaattccaagaccgcaaagaacgcgttccctaccttgagcccgatggtggtgatgaagaatgtgctagtgaaacaggggtcctccagcagtcagctgcagtcatggacggtgcagcctagttttgaggtgatttcagctcaacctcagcttctcttcctgcacccacccgtcccctcccccgtttcaccttgccataccggggagaaaaaaagcgacagtcgctag

SEQ ID NO: 32762 - DNA, 408 bp, Artificial Sequence
  Description of Artificial Sequence: Synthetic coding sequence
atggagcggaaaaaccccagtcgcgagagtccccggagacttagtgctaaggtcggcaaagggacagagatgaaaaaggtagcccgacagctgggcatggctgccgcagagagtgacaaggatagcggttttagtgatgggagcagcgagtgcttgagttctgccgagcagatggaatctgaggatatgctgagtgcgctcggatggtccagggaggaccgtccgcgccagaacagcaagacagcgaaaaatgcgtttccgactttaagccccatggtcgtgatgaaaaatgtgctggtgaagcaaggctctagcagttcccaactccagagctggacagtgcagccctcctttgaagtcatcagcgcccagccacagctgctgtttctgcaccctccagtcccatag

SEQ ID NO: 32763 - DNA, 426 bp, Artificial Sequence
  Description of Artificial Sequence: Synthetic coding sequence
atggagagaaagaacccgtctagagaaagcccacgccgactgtctgcaaaagttggaaaaggcaccgagatgaagaaagtggctagacaactggggatggcagccgcagaatcggacaaagacagcgggttctcagatggttctagcgaatgcctaagcagcgcagagcagatggaaagtgaggatatgctgtctgcccttggatggagcagggaagacaggccaagacaaaacagcaagacagccaagaacgcttttcccacacttagccccatggtcgttatgaaaaatgtcctagtgaaacaaggatcctccagcagccaactccagtcatggacggtgcagccgagctttgaggtcatcagcgctcaaccacaattgctgttcctccacccacccgtgccctcccccgtgagcccctgctag

SEQ ID NO: 32764 - DNA, 474 bp, Artificial Sequence
  Description of Artificial Sequence: Synthetic coding sequence
atggagcgcaagaatccctctcgggagtccccaagaaggctgagtgccaaagtcggaaaggggacagaaatgaaaaaggtggcccggcaactgggaatggccgcagccgaatccgataaggatagtggctttagcgatggctctagtgagtgcttgagttccgcagagcagatggagtcagaggacatgctctccgccctcggctggtcccgggaggaccggccacggcagaactctaagaccgcaaaaaatgcgtttcccaccctgagccctatggtggtcatgaaaaacgtgctagttaaacaggggtccagttccagccagctgcaatcctggaccgtgcagcctagcttcgaggttatttccgcacagccccagctcttattcctccaccccccagtgccttcaccagtgagcccctgtcacaccggtgaaaagaaaagtgactccaggaactacttacctattctttag

SEQ ID NO: 32765 - DNA, 1752 bp, Artificial Sequence
  Description of Artificial Sequence: Synthetic coding sequence
atgaccttttacctgttcgggatccggtccttcccaaaactttggaagagcccatacctcggcctcggacccgggcatagctacgtatccctgttccttgccgaccggtgtggtatccgtaatcaacaacggctgttttcactgaaaacaatgagcccacagaatactaaagccacaaacctcatagccaaagctcgatatctgagaaaggacgagggaagcaataagcaggtctattcagtgccccatttttttcttgccggggcagccaaagagaggagtcaaatgaattctcaaaccgaggatcatgcgctggcaccagtgaggaacacaattcagcttcctactcagcccctcaacagcgaggagtgggacaagctcaaggaggacctgaaagagaacactggtaagaccagcttcgagtcttggattatttcccaaatggctgggtgtcatagctcaattgacgttgccaaatctttgttagcttgggtcgccgccaagaataacggaatcgtatcttacgatctattggtcaagtatctctatctgtgcgtattccatatgcagaccagcgaggtgattgacgtgtttgagattatgaaggctagatacaaaaccttggaaccaagggggtactctctgctgattagaggcctaattcactctgatagatggcgagaggccttgcttctcttagaagacatcaagaaggtgatcactcctagcaaaaagaactacaatgactgcattcagggcgcactcctgcaccaggacgtgaatacggcatggaacctgtatcaggagctgctgggccacgatatcgtcccaatgttagagaccttgaaagctttcttcgatttcgggaaagatattaaggacgataattatagcaacaagttgctcgatattctgagctacctgagaaataaccaactctacccaggggagtcattcgctcacagcatcaagacctggtttgagagtgtgccaggtaaacagtggaaggggcagttcactaccgtgaggaaatccggacagtgttcggggtgcggaaagacgattgaatctatccaactgagcccagaagagtatgaatgtctgaaaggtaagattatgcgagacgttattgacgggggagaccagtaccggaaaactacccctcaggagctgaagcgtttcgagaattttatcaaatcacgcccccctttcgatgtggttatcgacggtctcaatgtggctaaaatgttccccaaggtgcgggaatcgcagttgctcctgaacgtggtgtcacagctggctaaaagaaatctacgcctcctcgtgctggggcggaaacacatgttgaggcggtcctcacaatggtcacgggacgagatggaagaggttcagaagcaggcaagctgtttttttgcggatgacatttctgaggacgacccgttcctgctgtacgctactctgcatagcgggaaccactgccgattcataactagagacttaatgagggatcataaggcctgtctgcccgacgccaagacgcagcggctattttttaagtggcagcagggccatcagctggccatcgtcaaccggtttcctggctccaagcttacgttccagcgcattttgtcttacgataccgtcgtgcagactaccggtgattcttggcatatcccatatgacgaagaccttgtagagcgatgcagctgcgaggtgcccacaaagtggttgtgcctgcatcaaaagacatag

SEQ ID NO: 32766 - DNA, 309 bp, Artificial Sequence
  Description of Artificial Sequence: Synthetic coding sequence
gacatcgtgatgacgcagagtcccttgtccctgcccgtgacccctggcgaacctgccagcatctcttgcaggtcaagccagagtcttttgcactctaatggctacaattacctggactggtacctgcagaagcccggacagagcccccaattactcatatatttgggatcaaacagagcatcaggcgtgcctgacagattttctggttctggcagcgggaccgattttactttaaagatctccagggtggaggccgaggacgttggcgtgtactattgtatgcaggcactgcagacccctcccacatag

SEQ ID NO: 32767 - DNA, 348 bp, Artificial Sequence
  Description of Artificial Sequence: Synthetic coding sequence
aagatgtccccctcccaactgatagggttcctgctcctttgggtccccgcctcaagaggcgagatcgttctgacgcaaagtcctgattttcagtctgtcacgccgaaagagaaggttactataacttgcagggcttcccagagcattggatcttccctgcactggtaccaacagaagcccgatcaatcaccaaagctgctcattaagtatgcgagccaatcgatttcaggcgtgccttccaggttctctgggtccggaagcggaacggacttcaccctaaccattaatagcctcgaagcggaggatgccgccgcctattactgccatcagagctcttcactgccatag

SEQ ID NO: 32768 - DNA, 396 bp, Artificial Sequence
  Description of Artificial Sequence: Synthetic coding sequence
atgggcccagccgtgctgggtcagggccaagaaggacaacccgaggcccgcgcttgtagcgggcttctccagcctcctaagcggcccattgtcttcaaagaaaagctgacaatgaagactgacagtctcatggaagagaaacttgagtgctctctttggtgctgtttgtctgatcctagtatcccaggaaggtgctgtgtcttagagagaagaattgttccctggatgcagcaggagagctactcaagcagctctcccatctggtctgtggactccgacgagcctaacctcacttcagtcctcgaaaggctggaggacactaaggaaaactccagtgtgagaaaggaaaccaaattgttctccctctttcttatgaatatcatattccggaattag

SEQ ID NO: 32769 - DNA, 411 bp, Artificial Sequence
  Description of Artificial Sequence: Synthetic coding sequence
atgggcgattctcggagagatgtgctacacgaaccggccattgctctgctgtcttcaccccagacgcagtctcggctgcagattgacgccttcatcgcacggcggtgctgggggtcccagtgggatataaccgggtacatccaccaacaggatttccctactgcagtcttcattggctttagcaacgaattcaacatctgcatcccacacccatttacggaatggctgcagtgtgtccgaaagtactctcagtcatggggagtgcgcaagggtcagagacacattcggtacggcatgtgcagcgagcgaactcaccacctcagccggacttacagcagtttgcttgagcgagaagagaagttagccttttacggcgtgcttaccatgtgtcagatctggtgcgagacctag

SEQ ID NO: 32770 - DNA, 315 bp, Artificial Sequence
  Description of Artificial Sequence: Synthetic coding sequence
gaagacatcgtgatgactcagacacccctgagtctccctgtgacgccgggcgagcctgcctccatctcatgccgatcctcacagtctttgctggacagcgacgacggcaatacctacttggactggtacctccagaagcctgggcagagcccgcagctcctgatctataccttgagctaccgcgcatccggcgtccctgatagattctccggcagcgggagtggcacagactttacactgaaaatcagtagggtggaggcggaggatgtgggcgtgtactattgcatgcagcgcatagagttcccatcaacttag

SEQ ID NO: 32771 - DNA, 345 bp, Artificial Sequence
  Description of Artificial Sequence: Synthetic coding sequence
atgggcacaaggctcttatgctgggttgtgctcgggtttctggggactgaccacacgggcgccggagttagccaatctccacgttacaaggtcgcaaagcgggggcaagacgtggctctgaggtgtgaccctataagtgggcacgtctccctcttttggtaccagcaggccctaggtcagggccctgagtttctaacatacttccagaacgaggcacagctggataagtccgggctcccctcagacaggttcttcgccgagaggcctgagggctccgtgtccaccctgaagattcaaagaacccagcaggaagatagtgctgtgtacctgtgcgcttctagttag

SEQ ID NO: 32772 - DNA, 372 bp, Artificial Sequence
  Description of Artificial Sequence: Synthetic coding sequence
atgtgtggccaatgccaatcctcttcagggcatatggaagaagaggctcatcccgaattatgtcctcactggcccttacagttcagtccccagtcccattgcagacaggcctacggcagagatacccatgcgggggggcctggcgcacgcgtggattcaggacaccatctgggactgtttcccggattgttgagcacttgtcctgatgggttgtgcgtctttccagtcccttccccaacatttagcaccagtttgcacgtgctgatggagtgtaaagtgcatcagcctgggccactgccaggacgcggctcagctgacgccgggctgaggggccttccacaaggaaggacactctgtgtgctgactgcctag

SEQ ID NO: 32773 - DNA, 528 bp, Artificial Sequence
  Description of Artificial Sequence: Synthetic coding sequence
atgcatggtgagaagtcccacggaaggggacaggccgggcgtcaggtgcccttaaaacagcagtcagtgagtggagaaagccagcagggtgcccggcagggcgcaggccagtccacttgctatctgtcctcagcctttctctgcaacgggagtttccccgctgggtccatgtctctttgggacccacagcccaagcaggcatttcccagcgtactctggtgctcgtgggcaggggtccccggccgcaggaccgggcagagggatcctcgcgttcaggaaaggaggggggatttcgtctcaaaactgggagctgcagtcggaggagagccccttgccttgttcgggcctcactcttggcccgggatgggccaccgggtacccggactgggagccggctttttactcttcgcaggcttcgcgcttgagccttgggatagttaccatgtcgtgtttgagggctggaccattgatatgaggcggaacgaacctgagcggacaaggagcctgagtgcccctggacctctgtag

SEQ ID NO: 32774 - DNA, 1671 bp, Artificial Sequence
  Description of Artificial Sequence: Synthetic coding sequence
atgcaccctatggcccttcacatggtgctgccagcacatctgccttttctctccccggaagttctccggcttctggaggtacacgtgaaaaagtggatgcactttcagcggtggggattgccccgcagagtggaagagtctttacggcagttaatgccgaaccctcctctgtactaccagcccggcaacgaccagcctgtgtccttcaacctcaataatacgtctcaggtctccctgcaccgctccgaaacaatatcactccagacctggtgtagttgtgtcgctggccagcccatccagactttctgggtctctgagtggtccacaatgaatcctgaacagaggcatcattgccagcagactcctaatcccatggccctggcactgccaagtcccgcactgaaagccctctcaggaccacatccacaaagtgggggccaggataacgattctggttctgatctccagcaaaagtatagccaattattctgcggactcccaagcctacattccgagtccctggtagccacctttatgggttcccaggggctgcctaaaatcgagaacgttcctaaaccacccctaaaagatcctttcttattcaacgatctctcatttcctcagctgctgcccaaaacatcccctcaatccgctccaccgagctccccactgagcccgaactgggtcagcccttcagaccaccaacgggctcaaataaacgttccatttctgaccctggctgaatacgaggccctggaatggcacctgcttcagaggcagctgcagctgcagtggggctggccagcagcattgcagcggagccagcatacccagtgcttgatgcagcatgaaccttgcggcaaggcccagtctccggagacaacgacggcaagtcaaacaggcaagtctataagcgtcctgactcgcgaattactcttcttccccgagcatgctcgaaagttgctagaatttcacatccaaaagcaatcgatccggcatagatggggactgccccagaagatacagcagtcaatacagctgctactcacgtctaccgaccaacagaccgtttcctcctccagtaccgccctggccaacgtgtccataccacagcccgtggccttggaggcaaacggagcctgtgacgtactgagtcccatcgctgcgccggtgagtattccgcggccacaccttctgactcaggtcaaggccatcctccagtcccacatcgactctaaatgtgggcagatccaccaggggaagatacccgcctgcgtgcatagatcatgggattgccggatttcaggcgtgctggccgttgcaccgtttccttgtatacctgaatcccaatttctagtgcttcagacagcatccgaccctgacctgcatcataaagtgatgccatggatgcctacagcacttgatcagcagcagcaagctctgcctggtaccgttaccgagcatcccaaactgcttagagtcctgtcagtcgaggcgattgagaaactcgaaacaacacttcggcacaagcatctggcctttttgtctggcttacctgcactatattacgtggctctgccaagggcactcgctcccgctgtgacaagccagagcgtcatcaccgagatggaaccatctcctgttgaaatcccagccgagccactgatatag

SEQ ID NO: 32775 - DNA, 624 bp, Artificial Sequence
  Description of Artificial Sequence: Synthetic coding sequence
atgggaatgcggttacagctgcttcgagaccggaggatctccagcaggggacccggactgcaccgggctaaggccgacccacagcagcagaagcgccttactacgggcttgatgacccaggccgaaacgcagaaggaggcgcaacaacgacaagcggcaatgcggaaaacggccctgtggcatactggacacctacaacctaaaacccatacccacacagggatgcatacccaaacccatagggagcgcgagcggaacacacaacggcttcgagaccgtgagcgccgcgaaaacgggcgccatacacatcgccacacccatactctgacacatacccacacacatcgggatacgcacacggcaagttaccgccgagggattgaaacacacacaacgcgccagcccctgcggctacgaggatctgcccacgatgagaacgacccgcgtgttcgagagcaaccgcggggtacacaggcggacttgtctagccgcagccgtatggccgctaggctgcttgggcgccttacacccaccaacacggtgcgggcggggctgaggctaggatctagagccgcctcaccagatccagcctggggattcctaatcgttgtaggcccactgtag

SEQ ID NO: 32776 - DNA, 381 bp, Artificial Sequence
  Description of Artificial Sequence: Synthetic coding sequence
atgggcatgcggttgcaactccttcgggacaggcgtatttcatccagaggcccaggactgcatcgagcaaaagcagatccccaacagcagaagcgactcaccactggactgatgacgcaagcagagactcagaaggaagctcagcagaggcaggccgcgatgagaaaaacggctctatggcatacgggacatctgcaacctaagacgcatacccatactggcatgcacactcagacccacagggaacgggagcgcaatacccagcggctgagagacagggagaggagggaaaatgggagacacactcatactcacacagaaacgcacacccaacgccataccgaagaagccctgaaacacaccccaccaggcaatccctag

SEQ ID NO: 32777 - DNA, 693 bp, Artificial Sequence
  Description of Artificial Sequence: Synthetic coding sequence
atgaggttggcgggtcctttacggatcgtagttctggttgtcagcgtaggcgtgacctggatagtcgtctccattctcctgggaggaccaggttcagggttcccccgtatccaacagctatttaccagtcctgagagtagtgttaccgcggcccctagagcccgaaaatataaatgcggtttgccccaaccctgccctgaggagcatttagcgtttagggtcgtttccggcgcagctaatgtgattgggccaaagatctgcctggaggacaagatgctcatgagctctgtgaaagataacgtcggacggggcctgaacattgccctggtgaatggggtgagcggcgaattgatcgaggccagagcattcgacatgtgggcaggggacgttaacgacctgttaaagttcatcaggccgctgcatgagggcaccctcgtgtttgttgcttcctacgacgacccagctacaaagatgaatgaagaaactcgtaagctgttctcagagctgggctccagaaacgctaaggagctggcgtttcgggactcgtgggtattcgtgggggctaagggtgtccagaacaagtcaccctttgagcaacacgtcaaaaactctaaacatagtaataagtacgaaggttggcctgaggctcttgagatggaggggtgtattccccggaggagtacagcttcatag

SEQ ID NO: 32778 - DNA, 840 bp, Artificial Sequence
  Description of Artificial Sequence: Synthetic coding sequence
atggggaagggaaacgaggattccgaccttcactgttcatctatccagtgctctaccgaccagcctccattccagcagatttcatttaccgaaaaaggcagcgatgaaaaaaagccttttaaggaaaaggggaaaactgcatttagccattcttcagaaaagcatatacaaaggcaggcgggatcagaaccaaatcctaataaggaaaactcagaggagacaaagctcaaggcaggcaacagtacagctggatctgagccggagtcttcttcctatcgagagaactgccgcaagcggaaaatgtcgtccaaggacagctgccaggacaccgccggcaactgcccagaaaaggagtgctccttgtcattgaataaaaaatctagaagttctactgccgtgcacaattcagaaatccaagaaacatgcgacgctcatcatcgagggcacagcagagcgtgtactggccactctaaacgacatcgcagcagggcactgggggttcagacaccaagcatccggaaaagcctggtgacttccgtgcgggcaatgagcgaggccgtgtaccaggatctggctcaagtctgggctcagcaaattcacagccctctaacctgcgagcagctaaccctactcacgaggctgcgaggtcccctttgtgcccaggttcaaactctttatagtatggccactcaggcggcatatgtattccctgcggagtcatggttggttcctgccacattgcctggtcccggagagtccgcactcgacagagaggctcatccttttcccgggcaagaaatcaccgagacagtgtccggcagtgacgaagcaaaactatag

SEQ ID NO: 32779 - DNA, 849 bp, Artificial Sequence
  Description of Artificial Sequence: Synthetic coding sequence
atgggtaaaggcaatgaggaccccgaccttcactgttcatcaatccagtgttcaacagaccagccgccatttcaacagatttcatttacggagaagggaagcgatgagaaaaagccctttaaaggaaaggggaaaacggctttctcgcattcaagcgagaaacacactcagagacaagccggttcagatcccaatcctaataaagagaattctgaagagaccaagctaaaagcgggcaattctacagccggttctgagcccgagagttcaagctaccaggaaaattgtcggaaaaggaagatatctagcaaggacatttgccaagatagagcaggcaattgtccagaggaagaatgcaacttaactctgaacaaaaagtcacgctcgtctactgccgtgcacaacagcgaaatccaagagacgtgtgatgcacatcacaggggctcctcccgagcctgcaccggtcgatcgaagcgccaccgtagtagagctcttgaggttcagaccccttccctgcgcaaatcactggttacatctgtgcgggcaatgagtgaggcggtgtaccaggacttagcacaagtctgggcgcagcagatccattccccattgacctgcgaacagcttacccttttaactagacttcgagggcctctatgtgctcaggtccagacactatacagcatggcaacgcaggccgcttacgtcttcccggccgaatcatggctcgtcccggctaccctcccgggcccgggagattctgctttggatcgtgaggcgcatccattccccggacaggagattaccgaacccgtgtcgggcagcgatgaagcgaagctcggtgccccctag

SEQ ID NO: 32780 - DNA, 903 bp, Artificial Sequence
  Description of Artificial Sequence: Synthetic coding sequence
atggccgcaactgaagatgagcgtttggcaggttccggtgagggggagagactggactttttgagagatcgccacgtgaggttcttccagagatgtttacaggtactgccagaacgctactctagtcttgagacttcgcgccttacaattgcctttttcgccctgtctggcctggatatgctcgacagtcttgatgtcgttaacaaagacgacatcattgagtggatttatagccttcaagtgctgccaaccgaagacaggtctaatcttaacaggtgcggctttcggggctcctcttatcttgggatcccttttaaccccagcaaagctccaggcaccgctcacccctacgatagtggacatattgccatgacatataccggtctcagttgccttgtgattctaggcgacgatctgagtcgtgtcaacaaagaggcttgtcttgcaggactgcgagcgctccaattggaagacggatctttctgcgcggtgcctgaggggtctgagaatgatatgcggttcgtttactgtgcctcctgcatttgctatatgcttaataattggagcgggatggatatgaaaaaggctattacctacatcagaaggagcatgctgctgaagatctttcaatacactaatttcgaaaaaaaccggaactacatccttagcactcaggatcgcctggttggagggttcgctaaatggcctgatagccatcccgatgcgctgcatgcctactttgggatttgcggactgagtctcatggaggagagcgggatctgtaaagtccatcctgccctgaacgtcagcaccagaacctcagagaggctgttggacctgcatcagtcttggaaaacgaaagattcgaagcagtgcagtgagaacgtacacatcagcacttag

SEQ ID NO: 32781 - DNA, 1134 bp, Artificial Sequence
  Description of Artificial Sequence: Synthetic coding sequence
atggcggccactgaggatgagcgactggctggttccggtgaaggggagcggcttgattttctgagggacaggcatgtgaggtttttccagcgctgtctacaagtcctgcccgaaaggtactcttccttagaaactagccggctgactatcgcattctttgccctgtccggactggacatgttagacagcctcgacgtcgttaataaggacgatattatagagtggatctacagtctccaggttctccctacagaagacaggtctaatctgaaccggtgtggctttcggggctccagttacttagggatcccgttcaacccctccaaggcaccgggaaccgctcatccttatgactctggccatatagccatgacctacacaggtttaagctgcctggtgatcttgggagacgatctaagccgggtgaacaaagaagcctgcctggccggtttacgggctctgcagctggaagacgggtctttctgcgctgtccctgaaggctccgaaaacgatatgaggtttgtctattgcgcgtcttgcatctgctacatgctcaataactggtcaggtatggatatgaagaaggccatcacttacattaggcgcagcatgagttatgacaatgggcttgcacagggagcgggcctcgagtcccacggtgggagcaccttctgtgggatcgcctccctgtgccttatgggaaagttggaagaagtgttttcagaaaaagaacttaaccgcatcaaaagatggtgcattatgcgccaacagaacggttaccacggcaggcctaataaaccagttgacacatgctacagtttttgggttggagcaaccttgaaattgctgaaaatctttcaatacaccaattttgagaagaatcgtaactacatcctgtccacccaggatagactggttgggggctttgctaaatggcccgactctcatcctgacgctcttcatgcttattttggcatctgcgggctgtctttgatggaagagagcggcatctgcaaagttcatcccgctttaaacgtgtccacccggacgtctgaacgcctgcttgatttgcaccagagctggaaaaccaaggattcgaagcagtgtagtgagaacgtgcacatctctacatag

SEQ ID NO: 32782 - DNA, 1011 bp, Artificial Sequence
  Description of Artificial Sequence: Synthetic coding sequence
atgtgggtgaggacgacattgaccattgagcgctggaccaaggaaaaaaccgaaccaaaggcacggtcttgggatgagtctagatgtaggggagactgcaaggaacctgataagtgttgctggagacacaaacagtgcacgggccacattatttatccgtttgcaagtgactgcgtgagacactctctgcatttgcactcggttaatcactgtaactgcaactcacgcttaaaggacagcagtgaagattctagttcctccaggggagccgggcccacatgttcgcatgtcatcgaatccccctgcttcgagctcacacccgaggaggagcatgtggagagattccgctatggttggtgcaagtcgtaccggcccgtcagcgtggctgtgattcaccaccccctttatcatgagtgtggcgcagatgatctgaacgaggaggaggaagaggaggaggaggagtctaaacctcccattccaacccaggttggtccagccacagcgtccccagatttggggacctcaatggccacaggcaccccagattcgacggccccaatcacgatctggcgcagcgaatcacctaccggtaaaggacaaggatccaaagtgatcaaaaaagtgaagaagaagaaagagaaggaaaaggacaaagaggagatggacgagaaggctaagctgaagaaaaaagccaaaaaggggcagcttaccaagaagaagagccctgttaagctggaacccagccctccagatgtgtctaggtccctttctgcccgccagcttgccaggatgtccgagagctcccctgaatctagagaggagctggagagcgaggactcttataacggccgaggacagggagaactttccagtgaggatatagtagagagtagcagcccaagaaagagggaaaacacagttcaggcgaagaaaaccggtgccaagccaagccaggccagaaaagtgaacaagcgcaagagcccgcccggctcaaaccccaacctgagttag

SEQ ID NO: 32783 - DNA, 1095 bp, Artificial Sequence
  Description of Artificial Sequence: Synthetic coding sequence
atgtgggtgaggactacactgacaattgaacggtggacgaaggagaagactgaaccaaaggcccggtcgtgggatgaggctctctctgatgttaaccgtcttccatcttgggagagaggacatctgcttgcaggagtggcatccagcactgacgtatcaacattttccgaggccggcgattgtaaggaacccgataagtgctgttggcgccacaagcagtgtaccggacatattatatacccttttgcttctgattgtgtgaggcacagcctccacctacactcggtcaaccactgcaattgtaacagccgcctgaaagattctagtgaggattcctccagctctcgcggcgctggccccacttgtagtcacgtaattgagtccccctgttttgagctcacccctgaggaagaacacgtggagcggttcaggtatgggtggtgcaagagttatcgacccgtgtcagtcgctgtgatacaccaccctctctatcatgagtgtggcgcagacgatctcaacgaggaagaggaggaggaggaggaagagagtaagccacccatcccaacccaggtcggtcctgccactgcctctcctgacctcggtacctcaatggctacggggacaccggactccacagcgccaattactatctggaggtccgaaagccctactggcaaagggcaaggaagtaaggtcatcaagaaagtgaagaaaaagaaagagaaagagaaggacaaagaggagatggatgaaaaagcaaaattaaagaagaaagccaaaaagggacagttaactaaaaaaaaatcaccagtgaagctagagccatccccccccgacgtgtcgcgctccctgtctgctagacagttggcacgcatgtcagagtccagcccggagagccgggaggaactagaatctgaagatagttataatgggaggggtcagggtgaactgagcagtgaagacatcgtggagtcttcttctcccaggaagcgcgagaatactgtgcaggcgaaaaaaacaggcgccaaacccagccaggcccgcaaagttaataagcgtaagtccccccctggcagtaatcccaatcttagctag

SEQ ID NO: 32784 - DNA, 462 bp, Artificial Sequence
  Description of Artificial Sequence: Synthetic coding sequence
atgtctattacttacgtcaacaggctgccatcttgggagagaggccacctgttagcgggagtcgcttcctcgaccgacgtgtctacattttctgagggcgactgcaaagagcccgacaagtgttgttggagacataagcagtgtaccggtcacatcatatacccctttgccagtgattgcgtgaggcattccctccacttacattctgtcaatcattgtaattgcaactctaggttgaaggacagttccgaggacagttcaagctcacgaggcgccggccccacctgttcccacgtgatagaatccccatgttttgagctcactcccgaggaggaacacgttgagagattcaggtacgggtggtgcaagtcctacagacccgtctccgtcgccgttatccaccaccccttatatcacgaatgtggcgccgacgacttaaacgaggaggaggaggaggaatag

SEQ ID NO: 32785 - DNA, 1017 bp, Artificial Sequence
  Description of Artificial Sequence: Synthetic coding sequence
atgtctattacgtatgtgaatcggctgccatcatgggagcgcgggcacctcctcgccggagtagctagcagcactgacgtctccacattttctgagggagactgcaaagaacccgataaatgctgttggagacataaacagtgcactggacacatcatctatcccttcgccagcgattgcgtgagacactcactgcatttgcactctgtaaaccactgcaactgtaactcaaggctgaaagacagcagcgaggacagcagcagctctagaggtgcagggccaacttgtagccacgtgatagaatctccttgcttcgagctgacacctgaagaagaacatgttgaacggtttaggtatggttggtgcaaaagctatcgcccagtctctgtagccgtgatccaccaccctctttaccacgaatgtggagccgacgacctgaatgaagaggaggaagaggaggaagaagagtccaagccgccaatccccacacaggttgggcccgccaccgcttcccccgaccttgggaccagtatggctacagggaccccagactccacagcccccatcactatttggaggtccgagagccctactggcaagggccaaggctccaaggtgataaaaaaagtgaagaagaaaaaggaaaaggaaaaagacaaagaggagatggatgaaaaggcgaagcttaagaagaaagcaaaaaaagggcagctgaccaagaaaaagtccccagtgaagctagaacccagccctcccgatgtttcacggtcacttagtgcccggcagctcgccaggatgtcagagtcctccccagagagtagggaggagctggaatcagaagattcttacaatggcagagggcagggcgagttgtcttccgaggacatcgttgagagttccagtcctagaaagcgagagaatactgtgcaggccaaaaaaactggggccaagccatcccaggccagaaaggtgaataaacggaaaagtccgcccgggtccaacccaaatctctcatag

SEQ ID NO: 32786 - DNA, 303 bp, Artificial Sequence
  Description of Artificial Sequence: Synthetic coding sequence
atgggcatttctgaagaaggtaatctcttgtcaacagtttccccaactgtcaaggccctgttcgggaagacgcgggtgtcacccatcttcccattctcacccaggtctccctttcagccccttattccaagaacacccggcagtccttggggtcctgtgggaccagctagcccgcttggcccgggcttcccaatcgggccaatgggacccggcaaacctgtcggacccaaaggcccaatgctgcccttgggaccaagcggccccgttgggccaacctccccactctttccattctgcccctag

SEQ ID NO: 32787 - DNA, 315 bp, Artificial Sequence
  Description of Artificial Sequence: Synthetic coding sequence
atgatgtctaccgagcagatgcagccattagaactgtcagaggacaggctagacaagctggatcctaggtgctcacaccttggcgtgttctctgagcacctgatcaagcgatacgacgtgcaggagcgtcatcccaaggggaaaatgattccagtcctgcacaacacggacctggaacagaagaaaccccgcagaaaggataccccagccctccacatgagccctttcgcggctggcgtgacgctgttgagggatgaacgacccaaagcaattgtggaggacgacgagaaggacggcgataagatcgctatttag

SEQ ID NO: 32788 - DNA, 2400 bp, Artificial Sequence
  Description of Artificial Sequence: Synthetic coding sequence
atggcgcgcacggcacctgttgaacccccgcttcgccatagtgcccctccttctcccgccgccggggaaccccgcacgtcggttgaggctgctgtggccccgagaagggtgctcttcgctgatgaagccttgggtcttcctctagcccagcttcgcagatatagaccctggggggggcctggagccggcaaaatggccgccgccgccggacaagacggcgggggggggggaggcgccgacgaggacgatgacggcgaggatggcgatgaaggcgaggaggaagaagaggcgtgcccagagcccagtccactctgtcctgtgccagctggcggtggtttctaccttgtccctactttcagtcttccaccggctccaggcaggctggagcgactgggacgcgtgatggtagaacttgaagcactgctgccccccccaggggctgtgcccggcggagcaggcgtctgggtccccggagggaggccacccgtgctacgcggactcgtcagagtgttgaatcggtcattcgagaaagctgtgcatgtacgggctagccatgacggctgggcatcgttctgcgaccaccctgctcgctacgtgcctcgttcccccccctgggccggcgctgggggcaccggtgccggcgaccctatcttagatcctggactcgggcttggtcccggtcaggctagcgctagcagcccagacgatggcggcagaacagaccgcttcgcctttcagctgcccttcgccgagggggctggcgacggagcacggttggacttcgtggtcagatacgagacccccgagggaaccttttgggcaaacaatcatggccggaattatactgtcctattaaggattgccccagccccaactccaacagacgccgaaggcctcccacagcaacagcagctcccccagctagaaccgcaacccgagtgccagggacccgtggaagcagaggctcggcagctaaagtcttgtatgaaaccagtgagacggcggcccgcagaagaagagctaaagaccaagaacatggacgacaatacttttgctatggctgagcacccagatgtacaagaatctgttggtcctctggtggcacccacccctttaagaccttggcctcagatgaccctacaggtgagtgatgtgcccatgacagggaaccccgcggaagaaggagatgtgcctcgatcgagtcccccagtcgcattcaccgaggtacttcaggctccggcaattcggatcccaccatctagtcctctgtgcgggctaggggggtcacctagggatcaagcctcaggccctgacgcaagtgagggagcgacaggtcccttcttggagcccagccaacaacaggccgaagcgacatggggagtgtcttctgagaatgggggtgggctggaagccgtcagtgggtcagaagagttgttaggtgaagacaccatcgaccaagagctggagcaactatatctatcccacctctcgaggttgagagcagcagtcgccgccggaggggccgggggtggcggggagggcagtactgacggtggtatgagtcccagccatccactgggaattctaacagacagggacctgatcctgaagtggcccggacccgaaagggcactgaattcggccctggcagaggagattactctccattacgctaggttggggcgaggagtggaattgatcaaagacacagaggaccctgatgatgaaggtgagggtgaggaaggactgtccgtgactccttcctcgcctgaaggcgactccccgaaagagagtcctcctgaaattctttcaggcgcaagatccgtcgtggccaccatgggggacgtgtggttaccctgggcggagggtagcggctgtgatggccccgtggtgctgggaacagaaggccagttcattggggatcccgagaagggaatgggcaaggacacatcaagcctgcacatgaaccgtgtgatcgctggagtgaccgagtcactcggcgaagcggggaccgaagcccaaattgaggttacatcggaatgggcagggagcttggaccccatttctggaaaggagcctgcatcccctgttttactgcaaggccagaatcctacactattaagtcctcttggggccgaggtctgccttagcagtgtggctcggccccacgtcagttctcaggacgagaaagacgcaggaccctccctcgagcctcccaaaaaatctcctactttggctgtcccagccgagtgtgtttgcgcactgccacctcaactgagaggacctctgacccagacgctgggagtgcttgcagggctagttgttgtgcccgtggctctgaattccggggtgagtttactggtgctggccctgtgcctgtccctagcttggttctcctag

SEQ ID NO: 32789 - DNA, 468 bp, Artificial Sequence
  Description of Artificial Sequence: Synthetic coding sequence
atgatgagcaccgaacaaatgcagccccttgagcttagtgaggatagactggacaagttggatcctcgatgcagtcacctggatgatctgagtgaccagttcattaaggattgtgatctcaagaaaaaaccacgtaagggaaaaaatgtgcaagctacccttaacgtggagagcgaccagaaaaaaccccgaagaaaagacactcctgcactccacatccctccattcattcctggcgtgttctctgaacaccttataaaaaggtatgacgtacaggagcggcaccccaaaggcaagatgatccccgtgttgcataacaccgacctcgagcagaagaaaccacgcagaaaggacacccccgctctgcacatgagcccttttgcggctggcgttaccttgctccgggacgagaggcctaaagcaatagtcgaagacgacgagaaggacggggacaaaatagccatatag

SEQ ID NO: 32790 - DNA, 1842 bp, Artificial Sequence
  Description of Artificial Sequence: Synthetic coding sequence
atggcgaccatcccggactggaagctccaattgctagctcgcaggcgacaagaggaggcttctgtcagggggagggaaaaagctgaacgagagcgcctgagccagatgcccgcctggaagcgtggtctcctggagcgcagacgggccaagctgggattaagtcccggggagccgagccccgtactaggcactgtggaagcaggaccccctgacccggatgagtccgcagtcctcctggaggcaatcggccccgttcaccagaatagattcatcaggcaggaaagacagcagcagcagcagcagcaacagaggtctgaggaactgttagccgagagaaagcccggcccactcgaggcacgggagcggcgccccagcccaggagagatgcgcgaccagtctcccaaggggcgagaatccagagaagaaaggctgagccctcgcgagacgcgcgaacgtcgccttggaattgggggcgcccaggagctgagcctgagacctctggaggctcgggactggcgtcaatccccaggcgaagtcggggaccgaagttctagactgtccgaagcttggaagtggcggctctctccaggggagacccccgagcggagtttaagactcgccgaaagccgcgaacagtcaccgcggcgcaaggaggtggagagtggcctgtccccgggcgagtccgcataccagaaactagggttgaccgaggcacacaagtggagacctgatagtcgcgagtcccaagaacagagcctagtacaactagaggccaccgagtggcggttgaggagcggagaagaacgacaagactattcggaggaatgtgggcgtaaggaggagtggcctgtccctggggtcgccccgaaagaaacagcggagttatctgagactctaactagagaggcccaaggcaatagttctgcgggcgttgaggcagcggagcagcgacctgtggaagacggcgagaggggcatgaaacctaccgaggggtggaaatggacgctaaatagcggaaaggccagagagtggacccctagggacatcgaggcgcaaacccagaagcccgaaccccctgagagtgccgaaaagctgctagagtcccccggcgtcgaagctggcgaaggtgaggctgaaaaagaggaggctggcgcccagggacgccctcttcgtgccctgcaaaactgctgcagcgtgcctagccccctaccacctgaagacgctggtacaggcggtctacgccagcaagaggaggaagcagtcgaattgcagccccctcctccggcccccctgtcacccccgccccccgctcctaccgctccacaacccccaggagacccattgatgtcacgcctgttctatggtgtgaaggccggcccgggcgtcggcgctccaaggaggtctgggcatacattcactgtcaacccccggaggtccgtgccacctgccacacccgctactcctacaagccccgccaccgtcgatgcagccgtgcccggggcgggcaaaaaacgctatcccactgctgaggaaatactagtcctggggggctatctgaggctgagtaggtcatgcctggccaaagggagtccagagcgccaccacaagcagctgaagatttcctttagcgagacagcgctggagacaacgtaccagtaccctagtgagtcaagcgtgctggaagaacttggacccgagcctgaagtcccgtccgctccgaaccccccggccgctcagcccgatgacgaggaggatgaagaggagctcttactgcttcagcctgagctacagggcgggctgcgtactaaggcgttgattgtcgatgagagctgccgccggtag

SEQ ID NO: 32791 - DNA, 1842 bp, Artificial Sequence
  Description of Artificial Sequence: Synthetic coding sequence
atggcaaccatccctgactggaaactgcagcttctcgcgcgcagacgccaggaggaagcctctgtgagaggacgagagaaggctgagagagagcggctgtctcaaatgcctgcgtggaagaggggcctgcttgagcggagacgcgccaagcttgggttgtcccctggggaaccttccccggttttgggcacagtggaggccggacctccagatcctgacgagagcgctgttcttctggaagcaattggaccagtacatcagaacaggttcatcagacaggaaaggcagcagcagcaacagcaacagcagcggtcagaggaactgctagcggagcgaaagcccgggcctctagaggccagggaaaggaggcccagccctggagaaatgagagaccaatcaccaaaaggcagagagtcccgagaggaacgactgtctccccgcgaaacacgggagcgccgcctcgggatcgggggggcacaagaactctctctgagacctctggaagcacgcgactggagacagagccccggcgaggtcggagataggtctagtcgcttgtctgaggcgtggaagtggaggctttcccctggggaaacgcccgaacggtccttgcgcctggcagagagcagggagcaatcaccacgcagaaaagaagtggaaagtggactctccccaggagagtctgcataccagaagctgggcctgacggaagcccacaaatggcgtcccgattctcgtgaatctcaggaacagtccctcgtccagttagaggcaaccgaatggcggcttcgtagcggcgaggagcgtcaagattactccgaggagtgcgggcggaaggaggagtggccagttcctggcgtcgctcccaaagaaaccgccgagctgtcagagactctcactcgggaagcacaaggcaactcttccgctggtgtggaagctgctgagcagcggcccgtggaagacggtgagcggggcatgaaacctacagaggggtggaagtggactctcaactctggaaaagcgagggaatggacaccccgtgatatcgaagcccagacacaaaagcccgaaccccccgaatcagccgagaaactgctcgagagccccggagtcgaggcaggggaaggggaggcagagaaggaagaggccggcgcacagggaaggccattacgggccctgcagaactgctgttccgtgccttcccctctcccccccgaggacgcaggcactggtggattgagacagcaagaggaagaggctgttgagttacaacctcctccgcccgctcctctaagcccaccccctcccgcgcccactgcgccacagccccctggagacccgttgatgagccgcctgttctacggcgtcaaagccgggcctggcgttggagccccgcgtaggagcggccatactttcactgtcaatccacggaggtcggtcccgcccgccacaccagctactccaacatcgcctgctaccgtcgatgcagcggtgcctggcgcgggtaaaaagcggtatcctaccgcggaggaaatactcgtgttaggcggttacctgcggctctccaggagttgccttgccaaggggtccccagagaggcatcacaagcagctgaagatcagtttcagcgaaacagcgctcgagaccacataccagtacccaagcgagagctccgtgcttgaagagttgggtccggagcccgaagtgccctctgcaccaaacccccccgccgcacagcccgacgacgaggaggatgaagaagagttgctcctgctccagcccgaactgcagggcgggttgcggaccaaagccctcattgtggatgaaagttgtcggaggtag

SEQ ID NO: 32792 - DNA, 1842 bp, Artificial Sequence
  Description of Artificial Sequence: Synthetic coding sequence
atggctactatcccggattggaaactgcaactactggccagacgccggcaggaggaggcctccgtgagagggagagagaaggccgagcgcgagagattgagtcaaatgcctgcctggaagagaggactgttggagaggcgccgggctaaactggggctctccccaggcgaacccagtcctgttctgggaaccgttgaagcaggtcctccagatccggacgagtctgccgtcctcctggaggcgattgggcctgttcaccagaatcggttcattagacaggaacggcagcagcagcagcaacaacaacagagatccgaggagctgctagctgagcgcaaacctggccccttggaggcaagggaacgacgcccatcacccggagagatgcgggatcagtccccgaagggcagggagtcacgcgaggaaaggctgtctccccgagagactcgggaacgacgactcgggattgggggagcccaggaactaagcctgcggccactcgaagcacgagattggagacagtccccgggtgaggtaggtgacagatcaagtcgtctgtctgaagcatggaagtggcggctgtcccccggtgagacccccgagcggtccctcagattggcagagtcccgcgagcagagcccccgccggaaagaggtggaatcccgtctgtctcccggtgaatccgcttaccagaaactggggctgactgaggcccataagtggagacccgacagcagggaatcccaggagcaaagcctggtgcagttggaggctactgagtggcgattacggtcgggtgaggagcgacaggattatagtgaagagtgtggccggaaggaggaatggcctgtgccaggtgtggctcctaaagagacagcagaattgagcgaaaccctcacccgcgaggcacaaggaaattcttctgccggtgtggaagctgctgaacaaagaccggttgaagatggggagaggggaatgaagccgaccgaagggtggaaatggactctaaactccaggaaggctagggaatggactcctcgtgatattgaagctcagacgcaaaaacccgaacctccggagagtgctgagaagctgctggaaagcccgggggtggaggcgggcgaaggcgaggccgagaaggaggaggctggcgctcagggaaggcccctgcgagccttgcagaactgctgctccgtgcctagcccactgccccctgaggatgcggggactgggggcctccgacagcaagaggaggaagctgtcgaactgcaacctccaccgcctgcaccacttagtcctccccctcccgctccaacagccccacagccacctggcgatcctcttatgtctcgcctgttctatggagttaaggctggtcctggagtgggggccccacgcagatccggccatacctttacagtgaatccgaggagatcggtgcccccagcgaccccagcaacccctacaagccccgcgactgtggacgccgctgtgcctggagccggaaagaagcgttaccccaccgcagaggagatcctggtgctgggtggttatcttcggctcagcaggagctgtctggccaaagggtctccggagaggcatcacaaacagctgaaaataagctttagcgagactgcccttgagaccacttaccagtatccaagtgaaagtagtgtactggaagagctaggacctgagcccgaggtccctagtgcccccaatccgcccgccgcccaacccgatgacgaggaggacgaggaggagctactcctactgcagccagagctccagggtgggctgcgtactaaggccctgattgtggatgagtcttgccgccggtag

SEQ ID NO: 32793 - DNA, 231 bp, Artificial Sequence
  Description of Artificial Sequence: Synthetic coding sequence
ttgaagatttctttttccgagacagcactggagactacctaccagtacccctccgagtcttcagtgctggaggaattagggcccgagccagaggtccccagtgcccccaaccctccagccgcacagccagacgacgaggaagatgaggaagagctactgctgctgcaacctgagcttcagggcgggctgaggacaaaagcccttattgtggacgaatcctgtcgccgctag

SEQ ID NO: 32794 - DNA, 1842 bp, Artificial Sequence
  Description of Artificial Sequence: Synthetic coding sequence
atggctaccattcctgattggaagttacagctactggctagacgccgacaggaggaagcatcagtgagaggccgggagaaggccgaaagggaacgcctgagccagatgcctgcttggaagcgggggctcctcgaaaggcgcagagctaaactgggacttagtcccggagagccatctccagtcctggggaccgtcgaggccgggccacctgaccctgatgagtcagccgtgctgcttgaggctatcggtcctgtgcaccaaaatcgatttattcgacaagaaagacagcagcagcagcaacagcagcagaggtccgaggagctgttggcagagagaaaacctggtcccctggaggctcgggagcggcgaccctcaccgggcgaaatgagggatcaatcccccaaaggccgggaatctagagaggagcggctaagcccacgggagactagagagcggcgccttgggatcggcggcgctcaggaactttccctcagaccccttgaagccagagactggagacagtcacccggagaggtgggggacagatcaagcagactgtccgaagcctggaaatggcgcctatctccgggggaaacccctgaacgctcccttcgacttgcggagagtcgagagcagagtcccagacggaaggaggtagagtcccgacttagcccaggggaaagtgcctaccaaaaacttggcctcaccgaggcacacaagtggcgcccggacagccgggagagtcaggagcagagtcttgtccaactggaggcgacagaatggaggttacgatcaggagaggagaggcaagattactccgaagagtgtggcagaaaggaagaatggcctgtgcccggtgtggcacctaaagaaaccgcggagctctctgaaacccttacacgggaagctcaaggtaactcctctgctggcgttgaggccgctgagcagaggcccgtcgaggatggagagcgaggtatgaaacctaccgagggctggaagtggaccctcaactctcggaaagctcgagaatggacacccagggatatagaggctcaaacccagaaacccgagccccccgaatctgcggaaaagcttctggaaagtcctggagtggaagccggggaaggagaggccgaaaaggaagaggctggggctcagggtagaccgctgagagctctacagaactgttgcagtgtgccttcacccctgcctcctgaggatgcgggaaccggtggccttcgccaacaggaagaagaggcagtggaactgcaacctccgccacctgcccccttgtcacctccccccccagccccgacagctccccaacctcccggagatccactaatgagccgattattttacggcgtgaaggcgggccctggcgttggcgcaccccggagatccggccataccttcaccgtgaacccaagacggtctgtcccgcccgccacccccgctacccccacgtcacccgccactgtggacgccgccgttccaggagctggaaaaaaacgctacccaacagcagaggagatcctggtattaggtggttacctcagactgtcccggtcgtgtctggcaaaagggtcccccgaacgacaccacaaacagctcaagatcagtttttcagagactgctctcgagacaacatatcagtatcccagcgagtccagtgtcctggaggagctgggccccgagcctgaagtgccatctgcccccaaccctcccgccgcgcagccagatgatgaggaagacgaggaggaactcctccttttgcagcccgaactgcaggggggactacggaccaaggctctgattgttgacgagtcttgcaggcgctag

SEQ ID NO: 32795 - DNA, 231 bp, Artificial Sequence
  Description of Artificial Sequence: Synthetic coding sequence
ctcaagatctcgttctcagagacagcgcttgaaaccacctatcagtacccttccgagtcctctgtgctggaggagttagggccggagccagaggtgccttccgctccaaacccaccagctgcacaaccagatgatgaggaggatgaagaggagctgttgctgcttcagccagagctccagggcggcctacgaacaaaagcccttatcgtagatgagtcatgcagaagatag

SEQ ID NO: 32796 - DNA, 1134 bp, Artificial Sequence
  Description of Artificial Sequence: Synthetic coding sequence
atggctaccattccagactggaagcttcagctgctggcgcgcaggcgccaggaagaagctagcgtgcgcggccgtgagaaggccgaacgggaaagactcagccagatgcccgcatggaagaggggtctcctagaaagacgacgtgcaaagctcggcctgagccctggggagccaagtcctgtcctcggaactgtagaagctggcccaccagacccagatgagagtgccgtcctgctggaggccatcgggccagtacatcaaaatcgattcatacgtcaggagagacaacagcagcaacaacaacagcagcggtccgaagagcttctggccgagaggaagcctggtcccctggaagcacgggaacgtcgaccgagtcctggcgaaatgagagaccagtcacccaaaggacgcgagagccgcgaggaacggcttagccctcgcgaaacacgtgagcggcgattgggaattggaggggcccaagaactgtctcttagacccctggaggcacgagattggaggcagtcaccaggcgaagttggcgatcgctccagccgcttgagcgaagcctggaagtggcgcctgtcacccggcgagactcctgaaagatccctgcgactcgccgaatcccgcgagcagagcccaagaagaaaagaagtcgagagtagattgagccctggcgagtccgcctatcaaaagttgggcctgactgaggcgcacaaatggaggccagacagccgcgagtctcaggaacaatcccttgtgcaattggaggcgacggaatggaggctgaggagtggcgaagaacgccaggactactccgaagagtgtggaagaaaagaggaatggcccgtgccgggcgtcgccccaaaagagacggcagagcttagcgagaccctgacacgagaggctcagggaaactcatctgctggggtagaggccgccgaacagagacctgtcgaagacggtgagaggggcatgaaaccgaccgaaggatggaagtggacccttatcatgagtcttgcgggcaagggcaaccaacaccttgtgacgtgttttccccacccagtttccggcgggcgggctaattgccccattagtactctgatacaatccccatggtgcggttgggggtag

SEQ ID NO: 32797 - DNA, 1134 bp, Artificial Sequence
  Description of Artificial Sequence: Synthetic coding sequence
atggccacaatcccggactggaagctccagctgctggctagacgccgacaagaagaagcatccgtcaggggcagagaaaaggcagagcgcgaacggctctctcagatgccagcttggaaacgtggcctgttagaaaggcggagggcaaagctcggtttgagcccgggagaacctagccctgttttggggaccgtcgaggctgggcctccagatcctgacgaaagcgctgtcctcctggaggcaatcggccctgtgcaccagaacaggttcattaggcaggaaagacagcagcagcagcaacagcagcaaaggtcagaagagctgttggctgagcgtaagcccggcccccttgaggcgagagagagacgaccctcccctggcgaaatgagggaccaaagcccgaagggcagggagagcagagaggaaaggctgtccccacgcgagacccgtgaaaggcgactgggtattggtggcgcccaggagctctcattacgcccgctggaagctagggattggcgccagagtccaggcgaggtaggcgatcgcagctccagattatctgaggcctggaagtggcggctgtccccaggggaaacccccgagaggtctctgcggttagctgaaagcagagagcagagcccccgcaggaaagaggtcgagagcggtctctctccaggcgaaagtgcttatcaaaagctgggtctcactgaggcccacaagtggcgcccagacagcagagagtctcaagaacagtcattagtccagctagaagctacggaatggagactccgctccggggaggaacgccaggattatagcgaagagtgcggacgaaaggaggagtggccagtgccaggcgtggcccctaaagagacggctgaactaagcgaaaccttgaccagagaggcccagggaaattcctctgccggggtcgaggccgccgaacagcgccctgtggaagacggcgagagaggaatgaagccaacggaaggttggaagtggaccttaattatgtctctggccggaaaaggcaatcagcacctggtcacatgtttcccccacccagtgtccggcggcagggctaactgtcccattagcacactgattcagtcaccatggtgcgggtggggttag

SEQ ID NO: 32798 - DNA, 2310 bp, Artificial Sequence
  Description of Artificial Sequence: Synthetic coding sequence
atggcttcagctgaactgcagggcaagtatcagaagttggcacaggaatactctaagttgcgcgcccagaatcaggtgctcaaaaagggggtggttgacgagcaggcaaactcagcagccctaaaagagcaactgaaaatgaaagaccaaagcttacggaaattgcaacaggaaatggactctctcaccttccgcaatttacaactggccaagagagttgaattattgcaggacgaactcgctctgagtgagccgcgaggcaagaagaataagaaaagtggagagagctcatcccagctgtctcaagagcagaagagcgtgtttgacgaggatctgcagaagaagatcgaagaaaatgagcggttgcacatacagtttttcgaagcggacgaacagcacaagcacgtagaagccgaattgcgcagtaggctggcgaccctggagactgaggccgcccagcatcaggcagtggttgatggcctgactcgaaagtatatggagacaatcgaaaagctccagaacgacaaggctaaacttgaggtgaaaagccagacgttggagaaagaggccaaggagtgtaggctaagaaccgaggaatgtcaactccaactcaagactctgcacgaggacctgagcggcagactcgaggaatctctgtctattattaatgagaaggtgccttttaacgacaccaagtattcccagtacaatgcgctgaatgtaccactgcataatcggcggcaccagctaaaaatgcgggatatcgcaggacaggccttggcattcgtgcaagatttggttactgccctgctgaacttccacacatacaccgagcagcggatccagatattccccgtggactcagccatcgatactatttccccactgaaccagaagttctctcagtatctacacgagaacgccagctacgtcaggccgctggaggaaggcatgctgcatctctttgagtctatcacagaagatacggtgacagtcctggagacaaccgtgaagctgaaaaccttctcagaacacctcacaagctacatctgctttctgcgtaagatcttgccttaccagctgaagagtttggaggaagaatgcgaaagcagcctgtgcacttccgccctccgtgcccgcaatcttgaattaagtcaagacatgaagaagatgaccgcagtgtttgaaaagcttcagacctacattgccctgctcgctcttccaagcacagaacccgacggtttgctgaggaccaattactcctctgtcctcacaaatgtgggcgctgctttgcatggttttcacgatgttatgaaggatatctctaagcactactcacagaaggccgccatagagcatgagctgccaaccgctacacagaagttgatcaccactaacgactgcattctctcatccgtcgtcgccctaacaaatggcgccggcaagattgcaagttttttttcgaataatcttgactactttatcgcgtccctgtcttacggcccaaaggctgctagcgggtttatctcaccactcagtgccgagtgtatgctgcagtacaaaaagaaggccgccgcctatatgaagtccctgcgtaagccgttgttggaaagcgtgccttacgaggaagcgttggctaatcgccgtattctgttaagtagcactgagtcgcgcgaaggcctggcgcagcaggtccaacagtccctcgagaagattagtaagctggaacaggagaaagaacactggatgctagaggcacagttagccaaaattaagctggagaaggagaaccaaaggattgccgacaaacttaaaaatacagggtctgcccagctggtgggcctggctcaggaaaacgctgcggtgagcaacacagccggccaagatgaggcaaccgctaaggctgtgcttgaacccatccaaagcacctcacttgttcctgatgtcgagtcacgtgaggatttaattaagaatcactacatggctagaattgtagaacttacaagccaactgcagctggccgattccaaaagcgttcatttttacgccgagtgccgtgccttgtcgaagcggctggcactcgctgagaagtcgaaggaagcattgactgaggagatgaagttagcctcgcaaaacatttcacggctgcaggacgagctgactaccactaagcgctcttatgaggatcagctgtccatgatgtcagatcatctgtgcagcatgaatgagacgttgtctaagcaacgggaggaaatcgacacgttgaagatgagctctaaaggaaacagcaagaagaacaagtctcgttag

SEQ ID NO: 32799 - DNA, 2343 bp, Artificial Sequence
  Description of Artificial Sequence: Synthetic coding sequence
atggcaagcgccgagctgcagggaaaatatcagaagctcgcccaggagtactccaagctgagagcacagaaccaagtgttaaagaagggcgtagtggatgagcaggctaattccgccgctctgaaagagcagcttaagatgaaagaccagtctctccgaaaattgcagcaggaaatggacagcctaacctttcgtaacttacaactagccaaacgggtggagctgttacaggacgaactggcacttagcgaacctagaggtaagaagaataagaagagcggtgaatcttcatctcagttgtcgcaggagcagaaatctgtgtttgacgaggatctccagaaaaaaatcgaggaaaacgagcggctgcacatacagttttttgaagccgatgaacagcacaaacacgttgaggccgaattgagaagtcgattggctaccctcgagaccgaggcggcccagcaccaggcagtggtcgatgggttgaccagaaaatatatggagacaatagaaaagctgcagaacgacaaagcaaagctagaggttaaatcacagacacttgagaaagaagccaaagaatgccgacttcgaaccgaagaatgtcagctccaactgaagaccttgcacgaagacctgtctggacgactcgaagaaagcctttcaataattaacgagaaggtgcccttcaatgataccaagtacagtcagtataacgccctcaacgtgccgctgcacaataggagacatcagctgaagatgagagatatcgccgggcaggccctagctttcgtccaggatttggtcaccgcgctcctgaactttcatacctacaccgaacaacgcatccagattttcccagtagattcagcaattgacaccatctcaccactcaaccaaaagttctcccagtatctgcatgaaaatgcaagttacgtgcgtccgttggaggaaggcatgctgcatctgtttgaatccattactgaagatactgtgacagtgctggagacaactgtgaaactgaaaacgttctccgagcatctgacatcatacatatgtttcctccgcaagatcctgccttatcaactgaagtccttggaggaggaatgcgagtcaagcctttgtaccagtgcactgcgcgcccgcaacctggaactgtcccaggacatgaagaagatgactgcggttttcgaaaagctgcaaacctacatcgcactccttgcccttccatcaacggaaccagatggactccttagaactaattattcctccgtcttgactaatgtgggcgccgccctgcatggttttcacgacgttatgaaggatattagcaagcactattctcagaaagcggccattgaacatgagcttcctacagcgacccagaaactcataactaccaacgattgcatcctatcatcagtggtagccttgaccaacggagccggcaaaatcgcatcttttttttcaaataacctggactatttcattgcgagcctttcttacggtccaaaggctgcctcgggcttcatttcacctctcagtgccgaatgtatgctgcagtacaaaaagaaggctgccgcctacatgaagagccttaggaagcccctgctggaaagtgtaccatacgaggaagctctggctaacaggcgtattctgctgagttctactgagagtcgagaaggcctggcccagcaggttcagcaatccctcgagaagattagcaaattagagcaggagaaggagcactggatgctggaagcgcagctagccaaaattaagctggagaaagaaaatcagcgcattgcagataaattaaagaataccgggtctgcccagttggttggactggcacaggagaacgccgccgtgagtaacactgctgggcaggacgaggctactgctaaggccgtcctcgagcccattcagtccacctccctgatcggcacgctaacccggacctccgactcagaggtgcctgacgtcgaatctcgcgaggaccttattaaaaaccactacatggcacggatcgtagagttaactagccagctccaattggctgattcaaagtctgtccacttttacgccgaatgtagggccctttccaagaggctagctcttgctgagaagtctaaagaagcgctaacagaggagatgaagcttgcgtctcagaacattagtcggttgcaagatgagctcacgaccacaaagcggagttatgaggatcagttatcaatgatgagcgaccacctgtgttctatgaatgaaacactaagcaaacagagggaggagattgacacactcaaaatgtcctctaaggggaattccaagaaaaacaagagtagatag

SEQ ID NO: 32800 - DNA, 2217 bp, Artificial Sequence
  Description of Artificial Sequence: Synthetic coding sequence
atggcatcagccgagctgcaggggaaataccagaaactggcacaggagtacagcaagctgcgagctcagaatcaagtcttgaagaagggtgtggtagacgaacaagccaattcggccgccttaaaggagcagttgaaaatgaaggatcagtccctccgtaaattacagcaggagatggactccctgaccttcagaaacctacagctagcaaagagagtagagcttctccaggatgaactcgctctttccgagccccgtggcaagaagaacaagaagagcggagagtcatctagtcagctgagccaggaacagaaatccgtgtttgatgaggatttgcagaaaaagattgaagagaacgaaagactgcatattcagttcttcgaagcagacgagcagcataaacacgtagaagccgagctgaggtcgcgactggccacacttgagacggaagccgcacaacaccaggccgttgtggatggcctgacgcgcaaatatatggagaccatcgaaaaactccagaatgacaaagcaaaactggaagttaagtcccagactttagagaaagaagcaaaagagtgtcgtctgcgaaccgaagaatgccagcttcaattgaaaacactccacgaagatctctcgggccgtctagaggagagcctgtcaatcataaacgagaaagtcccatttaatgataccaagtacagccaatacaatgccctgaatgtcccgttgcacaacaggcgccatcaattgaaaatgagagatatagctggtcaggctctggccttcgtgcaggacctcgtaaccgctctgctgaacttccacacctatactgaacagagaatccaaatttttccggtcgatagcgccatcgatactatatcccccctgaaccagaaattctcccaatatctccacgagaacgcgtcttatgtgagacccctggaagagggaatgcttcacctgtttgagtctattaccgaagacaccgttactgtcctggagacaacagtgaagctgaaaaccttcagcgaacacttgacttcttacatttgttttctacgcaaaatcctaccttaccagctgaagtccctcgaggaagagtgtgaatccagcctgtgtaccagcgctctccgggcccgcaatctggagttgagccaggatatgaaaaagatgaccgcagtctttgaaaaactgcagacctacattgcgcttcttgcattgccatctacagaacccgacggtctgctcagaacaaactattcttcagtcctgactaacgtaggggctgcacttcacgggttccacgacgtgatgaaggatattagtaaacactattcacagaaagcagccattgagcatgagcttcccaccgccacccagaagctgatcacaaccaacgactgcatcctcagttccgtcgtggccctaactaacggtgcagggaaaattgcatcattcttcagcaacaacctcgattacttcatcgcctctctgagctacggacctaaggccgccagcggcttcatctctcccctgtcagctgagtgcatgttacagtataaaaaaaaggccgctgcctacatgaagtctcttcgtaaggtgcagcaatcgttagaaaagatttcaaagctcgagcaggaaaaggagcactggatgctcgaggctcaattggccaagataaagctagaaaaagagaaccagcggatcgccgataagttgaagaataccggatctgcacagctggtgggcctggcacaggagaacgccgctgtcagcaatactgcaggacaggacgaagcaacagccaaggccgtcctggagcctatccaatccacaagcctcgtgcctgacgtagaatcgcgggaggatttaattaagaaccactacatggctcgcatagtagagttaacatcccagctccagctggccgatagtaaatctgtacatttctatgctgaatgccgcgccttgtctaagcggcttgcgctggcagaaaaatccaaggaggcactgaccgaggagatgaaactggccagccaaaatattagtcggctgcaggacgaactcaccaccacaaagcgtagctacgaggatcagctgagcatgatgtccgaccatctgtgcagcatgaatgaaactcttagtaagcagagagaggagattgacacattgaaaatgtcctctaaaggcaacagtaaaaagaacaaaagtagatag

SEQ ID NO: 32801 - DNA, 465 bp, Artificial Sequence
  Description of Artificial Sequence: Synthetic coding sequence
atgcctagcaggacagcaaggtacgcaagatactctccacgccaacgtcgccgcaggatgttagcggacagatccgtccgtttcccaaatgatgttcttttcctagatcatatccgtcagggggacctggaacaggtcggacggttcattcgcacacgcaaggtgagtctagccacaattcatccgagcggcctggctgccctgcatgaagccgttttgtcaggcaatctcgaatgcgtaaagttgctggtgaagtatggtgcggacatccatcagcgcgacgaagctggatggacccctctgcatatagcctgctccgacgggtatcctgacattgcacggtatctcataagtctgggggctgatagggacgccacgaacgacgacggagatctgcctagcgatctgattgacccggattataaagagttggtcgaactatttaaggggacaacaatggactag

SEQ ID NO: 32802 - DNA, 1278 bp, Artificial Sequence
  Description of Artificial Sequence: Synthetic coding sequence
atgatgggaaagcttccacttggggtagtcagtccctacgttaagatgtccagcggtggatacaccgatcctctgaagttttacgcaacctcttactgcactgcatacggccgggaggacttcaagcctcgcgtcggctcacacgtggggacagggtataagtctaactttcagcccgtcgtatcttgccaggcatctcttgaagctttagacaatcccgccagaggagagcaagcccaggatcatttccagtccgtggcctctcagagctacaggcctctggaggttcccgatgggaaacaccccctgccttggtccatgcgacagacaagcagcggatacgggagggagaaacccagcgccgggccacccacgaaagaggtaagaaaagtgcatttcgacacacaagagcatggcccacaggccattaccggcctcgagccgcgggaagtccctcttctccatcagcaacaagggcaggaccctttagaaagagagaattttcggcacgggccacgctttatgactagtgaatacaactcgaaatacctcagagatcctctggatcagcccgattttctgcaaaagaaaagcatcggcgcgaaagaaggctctgggttcaccaagcaatcccaccagtcgcccatcgtcttccaaccaccatcgcaggcgttgcctggcgaccctgctctgctgcccggtcagtccgtgaccaagtcagatttcctgccgaagacgcacttgcacggggatgagtttttaccagtcttggctcgcgggtccaagagggagaccgctttctcccgcggtaatgagcggattctgaatcctcgtgtgccacccccctgcccagaaccctcctcggtatcccaccagcaatttcaacccctgcatagaatgcagcagaccaatgtggctctgctgggtcgtgagacagtgggtaagaaggaacccaccggatttagtctgaataatccaatgtacgtgcggtctccttgcgaccccgaccgggaccagcggtacctcacaacctataaccagggctactttgagaatatcccaaaaggtctagatcaggagggatggacacgcggcgggattcagccacaaatgcccggtggctacgctctttctcagcctgtttcatgcatggaggccacaccgaatccaatggagagcctcagacatcttcatccccacgtcggccgcactctgacttccgcggaccccttttatcagaatacgccccatagcagtaggtgcgtggcacactcctag

SEQ ID NO: 32803 - DNA, 1218 bp, Artificial Sequence
  Description of Artificial Sequence: Synthetic coding sequence
atgatgggcaagcttcctctgggggtggtaagcccatatgtgaaaatgtcctccggcggctacacagatccgttgaagttttacgccacctcatactgcaccgcttacggccgggaagatttcaaaccacgcgtagggtcgcatgtgggtacaggatataagtctaattttcaacctgtggtatcttgtcaggcatcccttgaggccctggacaacccggccagaggggaacaggcccaagatcacttccaaagcgtggcctcacaaagttacaggccattagaagtgcccgacggcaaacacccgctcccttggtccatgcgacagacaagctccggctacggacgcgagaaacccagcgccgggcctcctactaaagaggtaaggaaggtacactttgatacccaggagcatggacctcaggccattaccggcctggagccacgggaagtcccattgcttcaccagcagcaggggcaagaccctttggaacgcgagaactttcggcacgggcctcgcttcatgacctccgagtacaacagcaagtacctgcgggaccctctggatcagcctgatttcttgcagaaaaagtctattggcgctaaagagggctctgggtttacaaagcaaagccatcagtcccctatcgtcttccagccaccgtcccaggcattaccaggcgaccccggtgacgagtttctccctgtgttggcccgcggcagcaaacgagaaaccgcattttcacggggcaatgaacggatactgaatcctcgggtgcccccgccttgccccgagccatcctctgtgagccaccagcaattccaacccctccatagaatgcaacaaaccaatgtggcccttctaggccgggaaaccgtgggcaaaaaggagccaaccggttttagcttaaacaacccaatgtacgtgcgcagtccatgtgacccagatcgcgaccagcgttatctcacaacatacaaccagggttactttgaaaacatacccaaaggactcgaccaggagggatggacgcggggcggcatccagccccaaatgcctggtggctatgcgctgtctcagccagtttcctgcatggaggccacacctaatccgatggaatccttaaggcacttgcatcctcacgtcggtcgaacactaactagtgccgatccattttaccagaacactccgcacagctcaaggtgtgtggcccatagctag

SEQ ID NO: 32804 - DNA, 762 bp, Artificial Sequence
  Description of Artificial Sequence: Synthetic coding sequence
atgatgatgggatgtggcgaatctgaattgaaatcagcggacggggaggaagccgctgccgtgccgggtccaccccccgaaccccaggtgccccaactgagagctcctgttccagaaccaggtctggatctgtcactgagtccacgccccgatagtccccagccccgacacggtagtccagggcgtaggaaaggccgggccgagcggcgaggcgcggccagacagcgaagacaagtcaggttccgcttgacgccgccctcccctgtacgctccgagcctcagccagccgtccctcaggaactggagatgcccgttcttaagagctctttggcactcgggctggagctccgcgctgctgccggatcccacttcgacgctgcaaaggccgtggaggagcagctcagaaaatcctttcagataaggtgtgggctcgaagagagtgtaagtgagggacttaacgtgcccaggagcaagcgcctgttccgggacctcgtgtctctgcaggtgcccgaagaacaggttctgaacgctgcgctacgcgagaaactggccttgttgcctcctcaagcccgcgcccctcaccccaaagaaccccccggtcctggaccggacatgaccatcctgtgcgaccccgagactctgttctacgaaagcccccacttgacattggatggcctgcctcctttgaggctgcagctgagacctcgaccttctgaagatacttttctgatgcacaggacgctcagaagatgggaagcatag

SEQ ID NO: 32805 - DNA, 1269 bp, Artificial Sequence
  Description of Artificial Sequence: Synthetic coding sequence
atgtacagagttcctgagttctatgcccgccggaaacggttgggtggtcagacgccctacctgatggatcagctggggctcaggctgggcatgtggtactggaaggacgagacgcgcaccttggagttccggaggttcgccgcagaggacagtgttcaatggctgctcaagcatcacccccatttcactccggccgccgaagttaaggagaaaggcaagaaggggaaagcagtccactttgctgagaccgatggccctgctagcgaccgcctcactgataaacggctcgcagctaaagacgataagtcagccaaggccgtagagaagcgagggcaacagggcacaatcacgcttgacgatgtcaagtttgttaccttgctcctgctccaagataccgagatgcagcgaatatgcagctttacaacttttatgcggaataagaatcttgacaactttctgatggccttgctgtattatctaagccactacctggaaaaaaactcgcttgagaagaaacctaagtcttacatggtgggcttggtagaaaagaaagagatggagctggtcctgagtgaactggaggcagctcagcggtacctggcccaaaagtactgcatcctggtgctggggttggccgtccctgataaacaccacatgtgttgcgggaaggagaagatttcagatacacagaaagactggaagttctttgagtcattctacactttttgtacgtatgtggcttggatcgttttccgccggcagcacctgaccgagatcgaggaggaggtagggagattatttaggaccaacatgttcaacattccgcgcaggagaagggaggacgaggaaagcgggggcgaaaagaaaagaatgacgttcgtgcaattccgtaggatgatggccaaacggccagccattaagaaagcaatcaatatgcggtcccctgtgatgtccactctcttgccatccctgagggagaaggcacagaacgtcttcgaaaagaagtaccaccaggtggatgttcgatttcctgctgagatgcagaaacacgtggggacgctggatagcgtccctatgccagtggtagggatacttggcgagcccaggtgtctttttaacccccacactcttcatccacttgaccctgaagaaaacaccaaaagttttggccggtacccttctctgatggaaaataacaatatgcgaatacaagacacgttggatctcgtcatgaagaccctttcgtctcacaccagttgtcccaagtag

SEQ ID NO: 32806 - DNA, 624 bp, Artificial Sequence
  Description of Artificial Sequence: Synthetic coding sequence
atggccgcccttgttgaacccctgggtcttgaacgggacgtgagccgtgccgtggaacttctggagcgcctgcagaggtctggagagctcccacctcaaaaactccaggctctgcagagggtattacagtcaaggttctgtagtgcaatccgcgaagtgtacgagcagctgtatgatacgcttgacatcacaggctctgctgagatccgggcacacgctaccgctaaagccaccgtggctgcgttcaccgcatctgagggacatgcccatccacgcgtagttgagctacctaagactgacgagggtctcgggttcaatatcatgggaggcaaagaacagaacagtcctatatacataagcagggttatccctggtggcgtggctgatcggcacggcgggctgaaacggggagaccagctgctgtccgtgaacggagtgagcgtagagggcgaacagcacgagaaagcggtagaattactcaaggctgcccaggggagcgtgaaactcgtagtgcgctacacaccaagagttctggaagagatggaagcccgatttgagaagatgcggtcagcacgacggcgacagcagcatcaatcctatagcagcctagaatctcgcgggtag

SEQ ID NO: 32807 - DNA, 2064 bp, Artificial Sequence
  Description of Artificial Sequence: Synthetic coding sequence
atggaaatagccccccaagaggcgccccctgtccctggagctgacggcgatatcgaagaggcacccgctgaagctggatcccccagtcccgcctcgccacctgccgatggacgcctgaaggccgcggccaaaagggtaactttcccaagcgacgaagatatcgttagtggagccgtcgagccgaaagatccgtggcggcacgcacagaacgttaccgtggacgaggtaatcggcgcttataagcaggcctgtcagaaattaaattgtcgccagatcccaaagctgctacggcaactccaggagtttacggatttgggccacaggctagattgcctcgacctgaagggcgaaaaactcgactataagacttgcgaggccctggaggaggtgtttaaaaggctgcagtttaaagtggtagacctggagcagacgaatcttgacgaggatggcgcgagcgccctttttgatatgatagaatattacgagtccgctactcacctgaacatttccttcaataaacatatcgggactcgtggatggcaggctgccgcccacatgatgagaaaaacttcctgtctccaatatttggacgcccggaacacgccactgcttgatcattccgctccatttgtcgccagggcattgagaatcagatcctctctggctgtgctacacttggagaacgcatcattgagcgggaggccactcatgctgttggccaccgcccttaaaatgaatatgaacctgcgcgagctgtatctagctgacaacaagctgaatggattgcaggacagtgcccagctcggcaatctgctcaaattcaactgttctttgcagatacttgatctgaggaacaatcatgtgcttgattccgggctggcttatatatgcgaaggactgaaagagcagaggaagggactggtgactctcgtgctctggaataatcaactgacccacaccggtatggccttcttgggtatgaccctgagtctggaaacactgaatcttggtcataacccaattggcaacgagggggtaaggcacctgaagaacggcctgatatctaaccggtctgtattacgactcggattggcatccaccaagctaacttgtgaaggcgctgtcgcagtcgcggagttcatagccgaatctccccggttgctgagactcgacttaagagaaaacgagattaaaacgggtggactgatggcactgtcgctggccctgaaggtcaaccactcgctactgagactggacctcgatcgagaacctaagaaagaggcggtcaaaagcttcatagagactcagaaggctctgttggcagagatacagaatggctgcaagcgtaaccttgttctcgctagggagagagaagaaaaagaacagcccccacagctcagcgcatcaatgcctgaaactaccgctacagagccacagccagatgacgaaccagccgccggggtgcagaatggagccccttcacctgccccaagtccagactcagattctgacagcgacagcgatggtgaggaagaggaagaggaagaaggtgaacgcgatgagacaccttgtcctgcactggtacccccaaccgacagcctagggccaggcgatcgatcaccacccggatcaccttctacaccgacagaacagcgtattagcgtgtccagcccaggccgcggacacaaggtgttcgtggtgacccgagtagaatctccacctgagagagccgagcctcccgcttctcccacacctccctcccccccgcctcctcctagtcctcctgcgagtccaagcctgccaccagccggggcaattgatacacgggataccggaagctcggaaccccagcctccacctgaaccgcctcggtcaggaccacccttgcccaatggactgaagcccgagttcgctttggctcttccacccgaaccacccccggggcccgaggtaaaaggagggtcctgtgggctggagcatgaactgagctgctcaaaaaacgaaaaagagttggaggaacttctgctcgaagcctcacaggagtctgggcaggaaaccctttag

SEQ ID NO: 32808 - DNA, 858 bp, Artificial Sequence
  Description of Artificial Sequence: Synthetic coding sequence
atgatggcggtggatatcgagtaccgctacaactgtatggcccctagccttcgtcaagaacgcttcgcgtttaaaattagccctaaaccttccaaacctttacgtccctgtatacagctcagttccaagaatgaggctagtgggatggtcgctcccgctgtccaagaaaaaaaagtgaaaaaaagggtaagtttcgccgataaccagggactagcgctcaccatggtaaaagtgttcagcgagttcgatgacccgctggacatgcccttcaacataacggaactcctggacaatatagtatcactaacgactgcggagtccgagtcctttgttttagacttctcccagcctagtgcggactacctggacttcagaaatcgcctgcaagccgaccacgtctgtctggaaaattgtgtcctcaaggacaaggccattgctggcactgtgaaagttcagaacctagccttcgaaaaaacggtaaaaattcgcatgaccttcgacacctggaagagctatactgattttccgtgtcaatatgtgaaggacacctatgctggcagcgaccgggacacattttccttcgacatctcactgccagaaaaaatccagtcttatgaacgtatggagttcgccgtctattatgagtgcaacggccagacttactgggatagtaatcgtggcaagaattatagaataatcagggctgaactgaaatcgacccagggaatgactaaaccacatagcggccctgaccttggtatcagcttcgaccagttcgggtccccacgatgctcctacggcctctttcctgagtggccttcttatctggggtatgaaaaactgggaccctattactag

SEQ ID NO: 32809 - DNA, 858 bp, Artificial Sequence
  Description of Artificial Sequence: Synthetic coding sequence
atgatggcagtggatatcgaatacagatataactgcatggctccctctctgcggcaggaaagattcgcgtttaaaatttccccgaaaccctctaaaccactccgaccatgtattcagctgagcagcaagaacgaggcctcaggcatggtcgctcctgccgtccaggaaaagaaagtcaagaagcgagtgagttttgctgataatcaggggttggccctcaccatggtgaaagtgttcagtgaattcgatgatcccctcgacatgccttttaatatcaccgaactcctcgacaacatagtgtctctaaccacagccgagtctgagtctttcgtgctggatttctcacagccgtctgccgactatctggatttccgtaaccgcttgcaggctgatcacgtctgcttagagaattgcgtgttgaaggacaaagccatcgcaggtaccgtgaaggttcagaacctggcttttgagaagaccgtaaaaattcgtatgaccttcgacacctggaagagttatactgatttcccatgtcaatatgtcaaggacacatatgccggctctgacagagacacattcagttttgacattagcttgcccgaaaagatacagtcatatgaacgaatggaattcgccgtctactacgagtgcaatggacaaacctattgggactccaatcgcggcaaaaattacagaattatacgcgccgaactcaagagcacgcaggggatgactaagcctcacagcggaccagacctaggcatctcgttcgaccaattcggttctcccaggtgtagctatggactgtttccagagtggccatcctacctgggttacgagaagctgggcccttactattag

SEQ ID NO: 32810 - DNA, 687 bp, Artificial Sequence
  Description of Artificial Sequence: Synthetic coding sequence
atggtaagacttaccctggatcttatcgctcgcaactcgaatttaaaaccccgcaaggaggaaacaatttctcagtgtctgaagaaaatcacacacattaacttctccgacaagaatattgacgccatcgaggacctttccctgtgcaagaatctctccgtgttgtacctctacgacaattgtatttcccaaattacaaacctgaattatgcaacaaaccttacccacctctatctgcagaataattgtatttcttgcattgagaacctgcggagcttgaagaagctggagaaactttacctgggggggaactatatcgcagtgatcgaaggcctcgagggcctaggggagttgagggagttacacgtggaaaatcaacgactgcctctaggcgagaaactcttgttcgatccaagaactctgcattccctcgccaagagcttgtgtattttgaatattagcaacaataatattgatgacattactgaccttgaactgctggaaaatctgaaccagttaatcgcagtggataaccaactacttcacgtaaaggatctcgaatttctgctgaataagctgatgaagttatggaaaatcgacctcaacggcaatcccgtgtgcctcaagccaaaataccgtgatcgtctgattctggtttccaagagtcttgggacatacctgtattag

SEQ ID NO: 32811 - DNA, 1068 bp, Artificial Sequence
  Description of Artificial Sequence: Synthetic coding sequence
atggtacgcctcactctggatctaatagctaggaactctaacctcaagccaagaaaagaggagactatttcacagtgcctgaaaaaaatcacacatatcaatttctctgacaagaatatcgatgcaatagaggatctgagcctgtgcaagaacctgtcagttttatacctgtatgataactgcatcagtcaaatcacgaaccttaactacgctaccaatttgacacacctgtacttgcagaataactgcatatcatgcatcgagaacttgagatctctgaagaagctggagaaactttatcttggagggaattacatcgctgtcattgaaggcttagagggcctgggagagctgcgggaactgcatgtagagaatcagcggcttcccctgggcgagaagcttctgttcgacccccggaccctccacagtctggccaaatccttgtgcatactcaatatcagtaataacaatattgacgacatcaccgacttggagctcctcgagaacctcaatcaacttatagcagtagataatcaactgctccacgtcaaagatttggaatttctcttaaacaagctcatgaaactgtggaagattgatttaaacggaaatcccgtctgcttaaaacccaagtaccgcgatcgcctgattctcgtgtccaagagcctagagttcctggacgggaaggagatcaaaaatattgaacggcaatttcttatgaactggaaagcctctaaagacgccaagaaaatatccaagaaaagaagtagcaaaaacgaggatgcctcaaattctctgatctctaactttaaaactatgcaccatatagtgcccgtctactatcctcaagtgggcaagcccaaactggccttcttttccgagattcaacgatatccagtgaacgccaatgcctcgccagagagtagttgtcctttctggccaaatattgagcgaaagaatcttagccttaaacaatctgagtcactcttgacaaaaaacgacgttcatgaacctcatctattccacaaccctgaagaaaaagaaaatttgtttgtggaaaatgagtag

SEQ ID NO: 32812 - DNA, 930 bp, Artificial Sequence
  Description of Artificial Sequence: Synthetic coding sequence
atggttcgcttgaccctggatctcatagcacgaaactccaacctcaaacctcgcaaagaagagacaatatcccaatgtcttaagaaaatcacccacataaacttttctgacaagaacatcgatgcgatcgaagatctgagtctgtgcaagaacctgagcgtactatacttgtacgacaattgtatttcacagatcacaaacttgaactacgctactaaccttacacacctctatttgcagaataattgtatatcctgtatcgaaaacctcagaagtctaaaaaaactggagaaactgtatttgggcggcaactacattgctgtcatcgaaggcctggaagggcttggagaattacgcgagctccacgttgaaaaccagagattgccgttgggtgaaaaactgctcttcgaccctcggactctgcactccctggccaagtccctctgtatcttgaacatttccaacaacaatatcgatgatatcacagatttggaactgctggagaatctgaaccagcttattgcagttgataatcaactgctccacgtgaaagatctggagttcctactgaacaagcttatgaaactttggaaaattgacttgaatggaaatccagtgtgtctgaaacccaaatatagagacagactgatactggttagcaagagcttggagttcctggacggaaaggaaattaagaatattgagaggcagttcctcatgaattggaaagctagtaaagacgcaaaaaaaatttctaagaagagatcctccaaaaacgaagacgcttcaaatagcctgattagcaacttcaaaaccatgcatcacatagtcccagtgtactatcctcaggtagggaagcctaaacttgcattcttctctgaaatacaaagataccctgtcaatgctaacgcgagccccgaaagctcttag

SEQ ID NO: 32813 - DNA, 1245 bp, Artificial Sequence
  Description of Artificial Sequence: Synthetic coding sequence
atggacattgaggagcagaaggcggatatctatgaaatggggaaaatcgcaaaagtttgtggatgccccctttattggaaagccccgatgtttcgtgccgccggtggcgaaaaaaccggattcgtcacagcccagtcttttatagcaatgtggcgcaaactcctcaataaccaccatgatgacgcctctaagtttatctgcctgctcgctaaaccgaattgcagcagtctcgagcaagaagactttattcccctgttgcaagatgtggttgacactcatcctgggttgaccttcctgaaggacgcgccggaattccactcaagatatataactactgtaatccagcgaatattctataccgtcaaccgatcatggtccggaaagatcacctccacagaaattcgcaagtccaatttcctccagacgctcgctctgctcgaagaggaggaggatatcaaccagataacagattatttctcctacgaacatttttacgtcatctattgtaaattctgggagctcgacaccgatcacgatctgtatatctcgcaagcggatttgtcgcgctacaacgaccaggccagctcatctaggattattgaacgcatcttctcaggtgcagttacaaggggtaagacgatacagaaggaaggcagaatgtcctatgccgactttgtgtggtttcttatatccgaagaagataagcggaatcctacctcgattgagtattggttccggtgcatggatgtcgacggggacggagtgctgtctatgtacgaactggaatacttctacgaagaacagtgcgagaggatggaggccatgggaattgagcctctccccttccatgatttactgtgtcaaatgcttgacctcgttaagccagccgtggacgggaagataacgcttcgtgacctgaaaaggtgcagaatggcacacatcttctacgacactttctttaacttggaaaagtatctggatcatgagcagcgggatcccttcgcagtccaaaaagacgtagagaacgacggtcctgaaccatcagactgggatcgcttcgctgccgaagagtacgagacgctcgttgctgaggaaagcgctcaagcacagttccaagagggatttgaggactacgaaacagatgaacctgcttctccatctgaatttggtaacaagagtaataaaattttaagtgccagcctgcccgaaaaatgtggcaagctgcagagtgttgatgaagagtag

SEQ ID NO: 32814 - DNA, 3453 bp, Artificial Sequence
  Description of Artificial Sequence: Synthetic coding sequence
atggctgccacgtacagactggtggtctctacagtgaaccattattccagtgtagtgatcgaccgccggttcgagcaggctattcactattgcacaggaacgtgccatacctttactcatggcatcgactgcatagttgtccaccattccgtgtgtgccgacctgctgcatattcccgtgagtcaattcaaagacgccgatttaaactctatgttcctcccccatgagaatggactttccagcgcagagggggactaccctcagcaggcgttcacagggatcccacgcgtgaaacgtggcagtacatttcagaatacgtataacctcaaagatatagcgggggaagctatcagcttcgccagcgggaagataaaagaattctctttcgagaaactgaagaatagtaatcatgcggcctacaggaaagggcgtaaagtaaagtcggattccttcaataggcgatccgtggatctggacctgctatgtgggcactataataatgacgggaatgctcccagcttcggattactgcgcagcagttctgtcgaggaaaaaccgttgtcccaccgcaacagcctcgatacaaatcttacatccatgttcctccagaatttctcggaagaagatctcgtcacccagattctggagaagcataaaatcgacaattttagttccggcaccgacatcaagatgtgccttgatattctgctgaagtgttctgaggacctcaagaagtgcacggacatcatcaagcagtgtatcaagaaaaagtcagggagctcaattagcgagggctctggcaatgacactatttcttcctcggagactgtctacatgaatgtgatgacaaggttggcatcatatctcaagaagttgcccttcgagttcatgcagagtggtaataacgaggccctggacctgacggagcttatcagtaatatgccaagcttacaactgacacccttttcaccagtttttggcacagaacagccacccaaatatgaggatgttgtgcaattgtccgcaagcgactccggcagatttcagaccattgagctgcagaatgacaaaccaaattcccgaaaaatggacactgtgcagtctatacctaataacagtaccaactcgctttataatcttgaagtcaacgaccctagaacactgaaggctgttcaggtccaatctcagtccctgactatgaatcccttagaaaacgtgagcagcgatgacctcatggagacactctacatagaggaagagagtgacggtaaaaaggccctggataagggccaaaagacggagaacggcccatcacacgaactgcttaaggttaacgaacaccgggcagagtttccggaacatgcgacacatctgaagaaatgtccaacacctatgcagaatgaaatcggaaagatctttgaaaagtcttttgtgaacctccccaaagaagactgtaagtctaaggtttcaaagttcgaagaaggggaccagagagatttcacgaattccagcagccaggaagaaatagacaagctcctcatggatctcgagtctttttctcaaaagatggaaacctccctcagggaacctctagccaagggtaaaaactctaacttcctcaatagtcactctcaactcacagggcagactcttgtggacttggagcctaagagtaaagtgagctctcccattgagaaggtttcgccttcatgtcttacacggatcattgagaccaatggccacaagattgaggaagaggacagggctctcttgctgcggatactggagtccatcgaagattttgcccaggaactcgtggaatgcaagagctcccgcggctcactatcacaggagaaagagatgatgcagatccttcaagagacattgacaacgagttcgcaggctaacttatcggtttgccggagccctgtcggggataaggcaaaggatacaacatccgcagtgctgattcagcagacacccgaggtaatcaaaatacagaataagccagagaagaagcctggcactcctttgccaccaccagccacttctccaagcagccccagaccattgtccccagtgcctcacgtgaacaatgtcgtgaacgcccccctgagtatcaacattcctagattttacttcccggaaggtctgcccgacacctgttctaaccacgaacagacgttatcaagaattgaaaccgcattcatggatatcgaggagcagaaggccgacatctacgaaatgggaaagattgcaaaggtttgtggctgcccactgtactggaaggcaccaatgtttcgggcggcgggaggggagaaaacgggttttgttacagctcagagctttatcgccatgtggcgtaaactccttaataaccaccacgatgatgcctcaaagttcatctgcctcttggcgaagcctaactgcagctctcttgaacaagaggattttattccactgctgcaagacgttgtagatacccacccaggactgactttcttgaaggatgccccagaatttcattccagatacattacaaccgtgattcagcgtatattctacacggtaaatcggtcgtggagcggaaaaataacgagcaccgagattcggaaatcaaactttcttcagactctggccctattagaagaggaggaggatatcaatcagatcaccgactacttcagttacgagcacttctacgtcatttattgtaaattctgggagctggacaccgaccatgacctgtatatttctcaagctgacttgagtcggtataatgaccaggctagctcctctcggattatcgagcggatatttagtggggcggtgacccgaggcaagacaatacagaaggaaggcagaatgtcatatgccgactttgtgtggtttctcatctctgaggaagacaagcggaatccaacttcaattgaatactggttccggtgcatggatgtggacggcgatggagtcctgagcatgtatgagctagagtacttctatgaggagcagtgcgaacggatggaagctatgggaatcgagccgctcccattccatgatttattgtgccagatgttagacttagtgaaaccagcagttgacggcaaaatcactctgcgggaccttaaacgctgtcggatggcccacattttttacgataccttttttaatctggagaagtacctagatcacgaacagagagacccattcgcagtgcagaaggatgttgagaacgatgggcccgaaccgtccgattgggataggtttgctgcagaggagtacgaaaccttggtggccgaagaaagcgcccaggcacaatttcaggaaggtttcgaggattatgagaccgacgaacccgcctcaccctctgaatttgggaataaatctaacaagattttgtctgccagtttgccagaaaaatgcggcaaactgcagtccgtagacgaggaatag

SEQ ID NO: 32815 - DNA, 1590 bp, Artificial Sequence
  Description of Artificial Sequence: Synthetic coding sequence
atgatgatcaaagaaaccagtctcagaagagatccggacctgcggggcgagctggccttcctcgccagaggctgtgactttgtgctccctagtcggtttaaaaagaggttaaaaagctttcagcagacgcagatacagaataaaccggagaagaagcctggtacccctctgcccccccctgccacgtcacccagttcaccaagaccgctgagtcccgtcccacatgtgaataatgtcgtcaacgcccctctttctatcaatattccacggttctatttccccgaaggcctgcctgatacatgttctaatcatgagcaaactctatcgagaatcgaaaccgccttcatggatattgaagagcagaaggctgatatatacgagatgggcaagatcgccaaggtctgcgggtgtccactctattggaaggcgcctatgttccgggctgccggaggtgagaaaacaggcttcgttaccgcacaatcctttatcgccatgtggcgtaagctgctgaacaatcaccacgacgatgcatccaagttcatttgcctgctggccaagcctaactgcagttctttagagcaggaagattttatccccctgcttcaggacgtcgtggacacccacccaggacttacttttttaaaagacgcacctgaattccattcccgctacataactaccgtcatccagcgcatcttttacaccgtgaatcggtcttggtccggaaagattacctctaccgagattcgtaaatctaattttctacagaccctcgcacttctggaagaagaagaagacattaaccagataactgactatttctcctacgaacacttctatgtcatctattgcaagttctgggagctggatacggatcatgacctatatatctcacaggcagatttaagtcgttataatgatcaagcctcaagttctcgaataatcgaacggattttctccggagctgtcacacgtggcaaaaccatccagaaagaggggcgcatgtcgtatgcagattttgtttggttcttaatctcagaagaggataaaaggaatccaacatcgatcgaatactggttccggtgcatggacgtcgatggggacggcgtcctttctatgtacgaactcgaatatttctacgaagagcaatgtgagcgaatggaggctatgggtatagagcctctgcctttccatgatcttctgtgccagatgcttgatctggtaaagccagcagtagatgggaaaataacactcagagatctgaaacgatgcaggatggcccatatcttctatgacactttctttaatctggaaaaatatttagaccacgaacagcgggacccattcgctgtccagaaggatgtggaaaatgacggcccggaacctagtgattgggacaggtttgccgctgaggaatatgagactttggtcgctgaggagagtgctcaggctcagtttcaagagggcttcgaagattatgagaccgacgagccagcaagtccatcagaatttgggaacaaaagtaataaaatcctgtccgcaagcctacccgaaaagtgcggtaaactgcagagcgtcgatgaagaatag

SEQ ID NO: 32816 - DNA, 486 bp, Artificial Sequence
  Description of Artificial Sequence: Synthetic coding sequence
atggacatcgaggaacagaaggctgatatctatgaaatggggaagatagccaaggtctgcgggtgccccctctactggaaggctcccatgttcagagccgctggaggggaaaagacaggattcgtgacggctcagtctttcatcgcgatgtggcgcaaattgctgaacaatcatcacgacgatgcctctaagttcatctgtcttctggcaaagcccaattgttcttcactcgagcaggaggacttcattccacttctgcaagacgtcgttgacactcatcctggactcacatttctcaaagacgctccggagtttcactctagatacatcacgaccgtcatccagcggattttttacaccgttaacagaagctggtctgggaaaataaccagcacagagatcagaaagagcaacttcctacagtctaatgaggatctggcaaagctcgcagtgcatgacggctatacaaatatatttttgttctag

SEQ ID NO: 32817 - DNA, 1893 bp, Artificial Sequence
  Description of Artificial Sequence: Synthetic coding sequence
atgtctacaaataacgctctgcgcgtgttctggaaaagcagagagtggaatatgaagaccagcactttcgactctgacgaggacatcctattactgccaaaaaggaaacgatttcgtaaaaaaaagtctaggccagtccgccataccaaaaggcacgaggaggaacaggtctatgaacagggaaccacactgccatgctcgatttgcaagcacgagattgatttgacaggaatatttctgcacaaaaagcagcacgtcgctctggccaccctgggtttccagtggatgggccgaaagaagccccaacccagcgttatcgccgtgcaacgccagttcatgatttcaaagctgctgtcgagtttcatgttcaccgaaaagactttgcagtcgattaacaatgcgtttgagctgctgtggaaaaagcagattcccgcctactacaagattttcgacaacattgacaggagtgttatctactctcagaagatttgccatctgctgatcaagggggtgggaatatgcgaagatagaaactcgacttggaaggctgacatgaacgacaagtttaccgtggttagcaactttggcaacaagccaaacgtctgttttttcgggcttttcgatggccatcacggcgcatccgcagccgagctgacctcgatggaactgcccgtgctgttgctccaccagctcagtaaattcgacccgagttatcagatgactaccgacgagcagcagatcatcaactccttttatacggtattccgcgaggagtacgccgccattgaggatctattttccgcgatcaataagaccgaagctgtccgctgcgaatatgaagacactcacaaagcattcgccaaagcattttggcgtatggaccggctactggggttaggccgtaaagaggtgtcaagagtgcagtggagtggctgctcagccgtgacttgcatcttggaaggaaaacctaaaagtccttacgcgcacaagaactggaaaaggaaaaacacacatgatgggcttgccgaaagttctccatctcaggagatgccgaaaatcataagcggcatccttcatgtcgcaaatactggaaatgtccaggccgtcttgtgccgcaatggcaagggcttttgcctcaccaaggaacacacaaccagaaatacaaacgagaggaggcggattctgcagaatggggccgtcatctctagcaatgagccctatgggcttgtcgaaggccaggtcaagacaacacgcgggctggggtttcatgggaacctgaaactgaagaaaagtattatcccggcaccacagactatctctgtccccatcgacgacctgtgccaatttctgatcgtggccacaaatggcttgtgggaagtgcttgataaagaagaggtgacagcccttgcaatgaccacattccacatgtacaaagagacctactgccctattatacccaacaaatctccctccaagggccctctattgttctccacgagtgaaccaaatctgactaagtcccaaagcaacatccacgttcttttccagtataaaagtgtaagtgaagtcagggtctctactactaacagcaaggagaatctgagtgattctaattactcaaagtactgtatctataacccagagaatgtagaaacttttcccgcagagaccactcatagaaaaccatgttccgaaaaggtcaccgaccggccaacaagcgtaaatgacgtcgccacgaatgaaaaggagtccgatacaaagtccttctacgagggtgccgccgagtacgtatctcatgagttggtaaatgcggccctcctagctggcagccgagataacataactgtaatggttatcttccttaatggtagtgagtaccagctgcttacatag

SEQ ID NO: 32818 - DNA, 1248 bp, Artificial Sequence
  Description of Artificial Sequence: Synthetic coding sequence
atggcagagatacccttatatttcgttgatctccaggacgacttggacgactatggattcgaggattacggtacagattgcgacaacatgcgggtgaccgcgttcctggacatacccggccaggacaacctcccgccactgactcgtttagagaaatacgcgtttagtgagaatacatttaatagacagattattgccagaggtctgctggacatctttcgggactttggcaataatgaggaggatttcctgactgtgatggagatagtggtgaggctgagtgaggatgctgagcctaccgtcagaaccgagttgatggaacagataccccccatcgccatttttctgcaggaaaaccggtccaattttccagtcgtgttaagtgagtaccttattcctattgtcgtccgatatctcacagatccaaacaatcagataatctgtaagatggccagcatgctaagtaagagtactgtggagagactgctgttgccaagattctgtgagctttgcggcgatcggaagctgttccaggtgcgcaaggtctgcgctgctaacttcggtgacatctgtcacgccgtcggccaggaggccactgagaaattcttgattccgaagttttttgagctgtgttctgacgccgtatggggaatgagaaaggcctgtgcagagtgctttactgctgtcagccacagttcgagccccggcgtaaggagaactcagctattccctctatttatccgcttggtgagcgacccatgtagatgggtccaccaagctgccttccagagcctcggcccattcactagcacattcgctaatccttcccgcgcggggttgtatctacgcgaggacggtgccctgtctatttggcccctgacccaggacctagattccggctttgcctctggatcacccgccccgtccagtggcgggaacaccagtcccgctagtctaactagaagcgctaagccggtgaggagtgaacctgagttacccgtggagggaacttcggcaaaaacctcagattgcccccattcgtctagttcatctgacggccccgcggagtctcctgtggagtcttgtgtgagcgcaggcgcggagtggacgcgagtttctcctgaaacaagtgcctgctctaagctctcggacatgaacgacctgccgatttcaagctatcccggaagcgactcttgggcctgcccgggtaacaccgaagacgtttttagccactttctgtattggtag

SEQ ID NO: 32819 - DNA, 1365 bp, Artificial Sequence
  Description of Artificial Sequence: Synthetic coding sequence
atgtcctccggggctcctcagaaatcttcccccatggcctcgggcgctgaagagacacccggattcttagacacgctgctccaggacttccccgcactgctgaacccagaggaccccctcccttggaaggctcctggcacagtactgtcacaggaggaagtggagggcgaactggcggaacttgcgatgggcttcctcggctcccgtaaagctccccctccgttggccgccgcactagcccacgaagccgtgagtcagctcctacaaactgatctcagtgagttcaggaagcttcctagggaggaggaggaagaggaggaagacgacgatgaagaggaaaaggcacctgtgacactcctggacgctcagagcctggcacagtcttttttcaatcgactctgggaagttgccgggcagtggcagaaacaggtgccccttgcagcccgcgcctctcagcgccagtggcttgtttcaatccacgcaatcagaaacacccggcgcaaaatggaggaccggcacgtctccctgccctcttttaaccagcttttcgggctgtcggaccccgttaacagggcatactttgcagtcttcgacggacacggtggagtggacgctgctagatacgcagcagtccacgtgcacacaaacgctgcacgccagccagaactgcccacggatcctgagggggcattgagggaagctttccggcggaccgaccagatgttccttagaaaggctaaacgcgaacgacttcagtcggggacaaccggagtgtgcgctctgattgcaggcgccaccctccacgtggcctggctgggtgactcacaagttattttggtacagcaaggtcaggtcgtgaagctaatggagccccataggcccgagagacaggacgagaaggcacgcatcgaagccctcggcggctttgtctcccatatggactgctggcgagtcaacggtacactggccgtcagtcgcgccatcggagacgtgtttcaaaaaccgtacgtgtctggcgaggccgacgcagccagcagagcgcttaccggcagcgaagattatttacttctggcctgcgacggcttttttgacgtggttccccaccaggaggtcgtgggacttgtccagtcccatttgacaagacagcaagggagcggacttagggttgccgaggagctcgtcgctgctgcgcgcgagcggggcagtcacgacaatatcacagtgatggtagtgtttctgcgggatcctcaggagctgctggagggcgggaatcagggcgagggcgatccacaggccgaaggtagaaggcaggacctgccctcttcattgcctgagcctgaaacacaggcccccccaaggtcttag

SEQ ID NO: 32820 - DNA, 1086 bp, Artificial Sequence
  Description of Artificial Sequence: Synthetic coding sequence
atgtcgtctggtgcaccccaaaaatccagtccgatggcctccggggccgaagagacacccggatttctggatactttgctacaagacttccctgccttgctcaatcccgaagatcctctgccctggaaggcacccggcactgtactttcccaggaagaagttgagggggaattagccgaactcgccatgggcttccttggttcccgaaaagcccccccgccactggcagctgccttggcacatgaagcggtttctcaattgctccagaccgatctatcggaatttaggaaactacctcgagaggaagaggaggaggaggaggacgacgacgaggaggaaaaggccccagttaccctgcttgatgcccaaagcctggcacagagtttctttaatcggctatgggaggtggccggacagtggcagaagcaagtcccgctggctgcccgggcgtctcagcggcaatggctcgtcagcatccacgctataagaaacacacgtaggaaaatggaagatcgccacgtttcgctgccttcctttaatcaacttttcgggctctccgatccagttaaccgcgcttatttcgctgtcttcgacgggcatggaggggtcgacgcagcccgatacgcggccgttcacgtccacacgaatgcggcccgccaaccagaactgcccacggaccctgagggcgccttacgggaggctttccgcaggaccgatcagatgttcttacgtaaggccaaaagagagcggctgcagtccggtactacgggtgtgtgcgcgttaatcgccggtgccactttgcatgtggcctggttaggggacagccaggtgattctcgtgcagcagggccaggtagtcaagctgatggaaccacatagacccgaaagacaggacgagaaggccagaatcgaagccctggggggctttgtgtcacatatggactgctggcgcgtgaacgggaccctggccgtgtcaagggctatcggggagagccaacgcggtagacccaagtgggagaaagtctccagaaaacctagacccagggtctggcctgctgcacaccagggctttcgcgaagctgtctag

SEQ ID NO: 32821 - DNA, 861 bp, Artificial Sequence
  Description of Artificial Sequence: Synthetic coding sequence
atggaagaccgacacgtctcactcccatcgttcaaccaattgttcggactgtctgatccagttaacagggcctacttcgccgtcttcgacggacacggcggggtagacgctgcccgatacgctgcagtgcacgtgcacacaaacgctgctcggcagccagaattgcctacagaccccgagggtgccctccgggaggcctttaggaggaccgaccagatgttcctgaggaaggcaaagagagaaaggttacagagcggtactacaggggtatgtgctctcatagccggggctacccttcacgtcgcatggctgggagactcacaggttatcctggtgcagcagggccaagttgtgaaactcatggagcctcaccgtcctgaacgccaggacgagaaggctagaattgaggccctgggcggtttcgtatctcacatggattgttggagagtcaacgggaccctggccgtgtctcgagccattggggatgttttccagaagccatacgtgagcggcgaggcagacgcagctagcagagccctgactggctccgaagattaccttctgctcgcatgcgatgggttttttgatgtggttccgcaccaggaggtggtagggctggtgcaaagtcatctgactcggcaacagggatcaggcctcagggttgccgaagagctagtggcagcggcccgagaacggggaagtcatgataacatcactgtgatggttgtttttctgcgagacccccaggagctgcttgagggtggaaatcagggggagggggatccccaggccgaagggaggcggcaagaccttccgtcatctttgcccgaacctgagacgcaggctccgccgagaagttag

SEQ ID NO: 32822 - DNA, 861 bp, Artificial Sequence
  Description of Artificial Sequence: Synthetic coding sequence
atggaggaccgacatgtatcgctaccctcttttaatcagctgtttgggttgtccgatcccgtcaaccgtgcgtattttgcagtgttcgatggccatggaggggttgatgcagccaggtatgcggccgttcacgtgcacaccaacgcagctcggcagccggagctcccgactgatcctgaaggtgcactgcgcgaagcatttcgaaggacagaccagatgtttcttcggaaggctaaaagggagcggcttcagtccggaactaccggggtgtgcgccttaatcgcaggggctactctccacgtggcttggctgggagattcacaggttatcttggttcagcagggacaggtggtaaaattgatggagcctcacagacccgaacgacaggatgaaaaggctcgcatagaagcactcggcggctttgtaagccacatggattgttggcgtgttaatggtacgctggcagtgagcagagctattggtgacgtctttcagaagccctacgtgtcaggcgaggctgatgccgcttctagagcgctgactggatcagaggattatctcctgctggcctgcgatggattctttgatgtggtcccacaccaagaggtcgttgggctggtgcaaagtcacctgacccgacaacaggggtcggggctccgagtcgcagaggaactcgtggcagccgctcgcgagcggggcagccacgataacatcacagtcatggtcgtgttccttcgtgacccccaagagctgctggagggggggaatcagggggaaggcgaccctcaagctgagggtcgcagacaggacctgccctcctcacttcctgagcccgagacccaggcccctccccgaagttag

SEQ ID NO: 32823 - DNA, 1053 bp, Artificial Sequence
  Description of Artificial Sequence: Synthetic coding sequence
atgggtctttgtccctccacgcgggaaaccgccccaccagctgtgttggatgcccagtccttggcccagtcattctttaaccgactgtgggaggtggctggacagtggcagaagcaggtacccctggcagcccgggcttcccagcgacagtggctggtgtcaatccatgctatacggaataccagacgtaagatggaagaccgccacgtgtctctaccaagttttaaccagctctttgggctcagtgaccccgtgaaccgagcctacttcgccgtcttcgacggacacggcggagttgacgctgctaggtacgccgccgtgcatgttcatactaatgctgcccgccagcctgaactcccaacagatccggagggcgcactcagagaagctttccgacgaactgaccagatgttcctgaggaaggcaaagagagagcgcctacagtctggaaccaccggcgtttgcgcattgatcgcgggtgctacattacatgttgcatggctgggggactcccaggttattttagtgcagcagggtcaggtcgtgaagttaatggagcctcataggcccgagaggcaggacgagaaggccagaatagaagcccttggcggctttgtttcccacatggactgttggcgggtcaatggaaccctcgccgtttcccgcgctatcggtgacgtctttcaaaaaccctacgtctcaggggaagccgacgcggcctcccgagctttaacaggctccgaagattacctacttcttgcctgcgacgggttttttgatgtcgttcctcaccaagaggtggtgggtctggtgcagtctcaccttaccaggcagcagggatcggggttgagggtcgccgaggagttggtggctgcagctagagagcggggctcccatgacaatatcaccgtaatggtggtttttctgagagatccccaagagttactcgagggcggcaatcagggagaaggcgatccacaggccgaaggacgtcgccaagaccttcccagttccctaccagagcctgaaacccaggctccccctcggagctag

SEQ ID NO: 32824 - DNA, 3321 bp, Artificial Sequence
  Description of Artificial Sequence: Synthetic coding sequence
atgtttaactccatgacacctccccctatctccagctatggcgaaccctgctgtcttcggccattgccttcccagggagctcccagcgtgggcacagaagggctgagcggcccccccttttgccaccaggcaaatttaatgtctggcccccacagttacgggccggcccgggagacgaatagttgtaccgaaggacccttattctcatcacctaggtccgctgtgaaactcacaaaaaagcgggcattgagcatcagccccctctctgatgcaagcctggatttgcagaccgtaatccgcacatccccgtcctctctggtcgctttcatcaactcgagatgcacttctcctggtggaagctacggccatctttctattggtacaatgtccccgtccttggggtttccagcacagatgaaccatcagaagggaccttctccatcttttggcgtacagccatgcggaccccacgacagtgcacggggaggtatgatcccccatccgcagagcagaggcccttttcctacatgccaactgaagagtgaacttgacatgctcgtgggcaaatgcagagaggagcctctggagggtgacatgagctctcccaattctaccggcattcaggatcctcttctgggcatgctcgacggccgcgaagacctcgaacgcgaggagaagcgcgaaccagagagtgtttacgaaacagactgccgttgggacgggtgtagccaagagttcgacagccaagagcagttagtgcatcacatcaactctgagcatatccatggcgagagaaaggagttcgtgtgtcactggggaggctgctccagggaactgaggccttttaaggcccagtatatgctggttgtgcacatgaggcgccacacaggggagaagccgcacaaatgtaccttcgagggttgcaggaagagctactctagactcgaaaacctgaaaacacacttgagatcacatactggtgagaaaccctatatgtgcgagcacgaggggtgctctaaggcgttcagcaatgcgtcggaccgcgcaaaacaccaaaacaggacacatagcaatgagaaaccatacgtgtgcaagcttccaggctgcactaaacgctataccgatccttcgagtcttcgaaaacatgtgaagaccgtgcatgggcccgacgcacacgtcacaaagcgccataggggtgatgggcctctgccccgagctcccagcatttcaactgttgagcctaaaagggagagggaaggcggaccgatccgggaggagtcccgattgacagtcccagaaggggccatgaagcctcagcccagcccgggtgcgcagtcaagctgttcctctgaccactctcctgcgggatcagctgcgaacaccgattctggtgtcgagatgactggcaacgctggaggttctacggaagacctcagctcactggacgagggtccctgcatcgctggcactggcttgagcacacttcggaggctggagaatctgcgcttggaccagctgcatcagttaaggcccattgggacgagaggactgaaactcccttcattgtcccacacagggacaacggtgagccgtcgcgtcgggccccccgtcagtttggaacggcgtagcagtagctcaagttcaataagcagcgcatatactgtcagtaggcggagctcactggcttctccttttccacctggaagcccaccagaaaacggtgcgagctctctacccgggcttatgcctgcacagcactacctattgcgggcccgctacgccagtgctcgggggggcggcacaagccccacggctgctagctcgctggatcggattggagggctgcccatgcctccctggcgatcccgcgccgaatatcctggctacaatccaaatgccggtgttacaagaagggcctccgatccggctcaggctgcggaccgacctgcaccagccagagtacagagatttaaaagccttggatgcgttcacactcccccgaccgtagccgggggcgggcagaactttgacccctacctgcctacgtctgtctatagccctcaaccgccctcaatcacagagaacgccgccatggatgcgcgcggcctgcaagaagaacccgaggttggtacatcaatggtgggatctggcttgaacccatatatggatttcccgccaacagataccttaggctacggcggtccagagggcgctgccgcagaaccctacggagcccgcgggcccggatctctgcccctggggcctggcccacctaccaattacggcccgaatccttgtccgcagcaagctagctatcccgaccctacacaggaaacctggggggagtttccgtcccacagcgggttataccctgggccaaaggccctggggggtacttactctcagtgtccacgcctggagcattacgggcaggtacaagtcaagcccgaacagggctgccctgttggttctgatagcaccggactagccccctgtctcaacgcccacccctccgaggggccccctcatccacagcctcttttttcccattatcctcagccgagtccccctcagtatttgcagagtgggccctacacccagccaccgcctgattacctgccctcagagcccaggccatgcctggatttcgatagtcccacccactcaacaggccaactgaaagcccagctggtctgtaactatgttcagtcgcaacaggagttgctttgggagggcgggggccgcgaggacgcacccgcacaagaaccttcctaccagtctccaaagtttctgggaggtagtcaggtatccccctcaagggccaaagccccagtgaacacatacggccctggctttggccctaaccttcccaaccataagtctggttcatatcccacaccaagtccctgccacgagaacttcgtggttggcgcgaaccgagcgagccaccgggcagccgcgcccccccgtttattgccgcctctgcccacttgctacggaccattgaaagtcggagggaccaatccctcgtgcggccacccagaggtcggcagattgggcggggggcccgcgctgtatccacccccagaaggacaggtgtgcaatcccctcgattcccttgaccttgacaacacgcagctggattttgtggctattctggatgagcctcaagggctgagtccccccccatcccatgaccagcgtgggtcatccggacacactccccccccaagtggaccccccaatatggctgtgggaaatatgagtgtgcttctgaggagcctgcctggagaaaccgagtttctcaactcctccgcctag

SEQ ID NO: 32825 - DNA, 1023 bp, Artificial Sequence
  Description of Artificial Sequence: Synthetic coding sequence
atggaggatgcacactgcacatggctatccttgcccgggctgccccctgggtgggccttgtttgcagtgctcgatgggcacggtggcgccagagccgcccggttcggtgctaggcatttacctggacacgtgctgcaggagctaggcccagagcctagcgagccagaaggagtcagagaagcattgagacgggctttcctcagcgctgatgaaagactaaggtcgctgtggcctagagtggagactggtgggtgcacagccgttgtgcttttagtcagtcctcgctttctgtaccttgcccactgcggggactcccgcgctgtgctctcgcgggccggggcagtcgcgttctcaaccgaggatcacaggcccctgcgtccacgcgaacgagaacgaatccatgcggctggcggaactatccgccgccggcgcgtggagggttcgctggcggtctcacgggcactgggcgacttcacctacaaagaagcaccgggtcgcccccccgaactccagttagtgtcagctgaacccgaggtggccgctctggcacgacaggctgaggatgagtttatgcttttggcctccgacggcgtttgggatacagtgtctggcgccgctcttgctgggctcgtagcttccaggcttcgactcgggttagctcctgagcttctgtgtgcacagctgctagacacctgtctttgtaaggtgctaggagcttggaggggaacatttggggcctggtgcagccggggtcgagaacctaggggcttcggcgaggaaggctttgatcgagaggccagggtgaagttggccaaggaggggatcggcctgaaacggcgtgcttggcctgaagtgggaagagccaagatacaaggcagaagtctgagagacgcccttaggcacgggcgggtgagcgggagagacctaagggagcgggcctggtcctttggcaaagggcgattttgggtggtcggagctgggccagaagtgttgatttcagcaggccgttggaagtcaaggtag

SEQ ID NO: 32826 - DNA, 1293 bp, Artificial Sequence
  Description of Artificial Sequence: Synthetic coding sequence
atggctgtgctggcaaggcaactgcagcgtctgctctggacagcatgtaagaaaaaggagcgcgaaaaagaaggacgagaagaagaagaggaggaagaagctggccgtagggctccagaaggccccagatccctcctgacagcccctcggcgcgcgcagcgccctcatggcggcgctgaggcaagcggcggattgcgatttggcgcgtccgcagcccagggttggcgcgcccgcatggaggacgctcactgtacatggctgagcctgccaggcctgcctcccggttgggcactgttcgcagtccttgatggacatggtggtgccagggccgctaggttcggggcgcgacacctgcccggccatgtacttcaggagttgggtcctgaacctagtgagccggagggagtccgcgaggcgcttcgacgagcatttctgagcgcagatgaaagattgagatcactgtggccaagagtcgaaacagggggatgtaccgcagttgtgctgctggtatcccctcgctttctatatcttgctcattgcggagatagcagagcagtcctttctcgcgccggagccgtagcattctctaccgaggaccatagacccctgcgcccacgggagcgggagagaatccatgccgcgggggggacaatccgtcgtcggcgcgtggaaggctcactcgccgtgagccgcgccctcggcgacttcacatataaggaagcccccgggcggccacctgaactgcagctggtgagcgccgaaccagaggtggcagcacttgctcggcaggccgaagacgagtttatgttgctcgcgagcgacggagtttgggataccgtttctggggccgcgcttgctggcctcgtggccagccggctgagattgggcttggcccccgagctcctgtgcgctcagctgctggacacttgtctctgcaaaggaagcctcgacaatatgacctgtatcctggtctgttttcctggagctcctagaccatcagaagaggccatccggagggagttagcactggatgcggctcttgggtgtagaattgctgaattatgtgccagtgcgcagaagcccccgagtctcaatacggtcttccggacactggcctcagaggacatacctgaccttcctcccgggggagggcttgattgcaaggctaccgtgattgcagaagtgtactcacagatctgccaggtctctgaggagtgtggagagaaggggcaagacggcgccggaaaaagcaaccccacccacctgggctctgctctcgatatggaggcctag

SEQ ID NO: 32827 - DNA, 1209 bp, Artificial Sequence
  Description of Artificial Sequence: Synthetic coding sequence
atggccgagacttctgaggaggtggcagtgctggtgcaaagggtcgtcaaggacataaccaacgctttccgccggaacccacatatcgacgaaatcggcctgatcccctgtccagaggcccgatacaacagatccccaattgttttggttgagaacaaactcggagtcgagagttggtgtgtgaagtttcttctgccctatgtgcataataaactcttgctctacagaacccggaagcagtggctgaatagggatgaacttatcgacgttacttgcaccctgctgctgttgaaccccgactttacaacggcctggaacgttaggaaggaattaatcctcagcggaacactcaatccaattaaagacctgcacctcggaaaactggctttgacaaagttccctaagtctcctgaaacatggattcacagacgatgggtgctgcagcagctaatccaggagacatccctgccatcctttgtgacaaagggcaaccttgggacgatccctaccgagcgggcacagcgccttatacaggaggagatggaggtgtgtggtgaagccgccgggcggtatcctagtaattataacgcttggagtcaccgaatctgggtgctccagcatcttgccaagctcgacgtaaaaattctactcgatgaactgtcgtcaaccaaacattgggctagcatgcatgtgagtgaccacagcggttttcattaccgccagttcctcctgaagagtttgatttcccagacagtcatcgattccagcgtgatggagcagaatcctctcagatctgagcctgcacttgtgccccctaaagacgaggaggctgctgtgagtaccgaggagcctaggatcaatctgccgcacctgcttgaggaggaagtggagttcagcacagatctgatagatagttatccggggcacgaaaccctctggtgccaccggagacacatattttacctgcagcaccacttgaacgcaggatcccaactgtcacaggctatggaggtcgatggacttaacgacagctccaagcaggggtactcccaggagaccaagcgcttgaagcgtaccccggtgcctgacagtttgggactggaaatggagcatagattcatcgatcaggtgctgagtacctgtcgcaacgtggagcaggccagatttgcaagcgcgtacagaaagtggctagtaacactctcacagtag

SEQ ID NO: 32828 - DNA, 1158 bp, Artificial Sequence
  Description of Artificial Sequence: Synthetic coding sequence
atggggtgtggggccagccgcaaggttgttcctgggccccctgccctggcttgggccaaacacgaaggacagaatcaggccggcgttggcggggcggggcccggacctgaggccgcagcccaggctgcacagcgcattcaagtggcccggttcagggccaaattcgatccacgggtcctggctaggtatgatattaaggcactcattggcacggggtccttcagccgggtcgtgcgggtagaacagaaaaccactaaaaaacctttcgctataaaggtcatggaaacaagggaacgtgaaggaagagaagcctgcgtatccgaattgagcgttcttagaagagtttctcacaggtacatcgtgcagctcatggagattttcgaaacagaggatcaggtgtacatggtgatggaattggcaactggaggtgagctatttgaccgacttatcgcacagggctcttttaccgagagggacgctgtgcggatcttgcagatggtggccgatggaatccgctacctgcacgcgctgcagatcacccaccgtaacctgaagcctgaaaatctcctctactatcatcctggcgaagaaagtaagattctcattacggactttggtctggcctattcaggcaagaagtctggggattggacaatgaaaacattgtgcggtacaccagaatatatcgctcccgaggtcttgctgagaaaaccttacaccagtgcagtggacatgtgggccttaggagtaatcacctatgctctactgagcggctttctgccctttgacgatgagtcccagacccgcctttatagaaagatcctcaaaggaaagtacaattatacaggggagccttggccgagcatcagccatctggccaaagactttatagacaagttgctgatcctggaggccgggcatagaatgtcagctgggcaggcgctcgatcacccatgggttatcacaatggctgcagggtcctcaatgaaaaacttgcagagagccatctccaggaatttgatgcagagggcatccccacactcccaaagtccagggagcgctcaaagctccaaaagtcattattcacacaagtccaggcacatgtggtcaaaacgtaatctgcggattgttgagtctccattgagcgcactgctctag

SEQ ID NO: 32829 - DNA, 2265 bp, Artificial Sequence
  Description of Artificial Sequence: Synthetic coding sequence
atggctgccggagtcctccctcagaatgagcagccttacagtaccctggttaataattcagagtgtgtcgctaacatgaaggggaacttggagagaccaacaccaaaatacaccaaagtgggcgagcgcctccgccatgtgatccctgggcatatggcatgctccatggcttgcggagggcgggcttgtaaatatgagaaccctgcccgttggagtgaacaggagcaagctatcaagggggtgtactcttcttgggtcacggacaatatcctcgcaatggctagaccctcgtcagagctcctggagaagtatcatatcatcgaccagtttctttcacatgggatcaaaacgattattaacttacagaggccaggtgaacatgcaagttgcgggaaccccctggagcaggaatccggctttacctatttaccagaggcattcatggaagctggtatctatttctataacttcgggtggaaagactacggcgtagcgtcccttaccaccattctggatatggtgaaggtgatgacattcgctcttcaggaggggaaagtcgctatccattgccacgcgggattaggcagaacaggcgttctcatcgcttgctatctggtgttcgccacgcgcatgacggccgatcaagctatcatctttgtccgcgccaaacgccccaattcaattcagactcgcggacagctgctgtgtgtgcgggaattcacacagtttctgactcccctcaggaacatctttagctgttgtgacccgaaagcacatgcagtgacgttgccacagtacctgataaggcagcggcacctactgcatggctacgaggcgcgtctgctaaaacacgtgcctaaaattattcacctcgtgtgcaagctactgctcgacctcgcagaaaaccggccagtgatgatgaaggacgtaagcgaaggccccggactgtccgcagagatcgagaaaaccatgtcggagatggtgacgatgcaactggacaaggaactgctgaggcatgactctgatgtgtccaaccccccaaatcccacagcggtcgctgcagatttcgataatcgaggcatgatctttagcaacgagcagcagttcgaccctctctggaagcgccggaacgtcgaatgtctgcagccactgacccatctcaagcgacggttgagctactcagactcagacctgaagcgcgcggaaaatctgttggagcagggtgagactccacagacggtccctgcacagatcttggttgggcataaacccagacagcagaaactcatttcccattgctacattccccagtcgcctgagcccgacctgcacaaagaggccttggtccgcagcacgctgagcttctggtctcaaagtaaattcggaggtctcgaaggcctcaaagacaatggctctccaatttttcatggtcggattatccccaaggaggcacaacaatcaggggcgttcagcgctgacgtgagtggatctcactcacccggagaacccgtcagcccctccttcgccaatgttcataaggaccccaatcccgctcatcagcaagtgtctcattgccaatgcaaaacgcacggagtcgggtcccccggctcggtacgccagaatagtagaacaccccgttcacctctggattgcggaagctctccaaaggcccagtttctggttgagcatgagacacaggacagcaaggacctgagtgaagccgcctcacacagtgctctgcagtctgagttatctgcagaagccagacggattctcgccgctaaggccctggcaaatcttaatgaaagcgtcgagaaagaggaattgaagagaaaagttgagatgtggcagaaagagctcaattctcgcgacggtgcctgggagaggatttgcggggaacgtgatccatttatcttatgtagcctcatgtggtcttgggtcgagcagcttaaggagcctgtcatcaccaaggaagatgtcgatatgctggtggatagacgtgccgatgcagctgaagccctgttccttctggaaaaggggcaacaccaaaccatcctgtgcgtgttacactgtatagtcaacctgcaaacgattcccgtcgacgttgaggaggctttcctggcacatgccattaaagcttttaccaaggtgaactttgacagcgaaaatgggcccacggtctacaatacgcttaaaaaaatttttaagcatacactcgaagagaagcggaagatgactaaagacggtcctaagccgggtctctag

SEQ ID NO: 32830 - DNA, 2421 bp, Artificial Sequence
  Description of Artificial Sequence: Synthetic coding sequence
atgcaggtacaggatgcaacccgcagacctagtgctgtccgctttctgtcttccttcctgcaggggcgaaggcattctacctctgatccagtgctgcggctccagcaggctcgacgtggctccggattggggagcggatctgcgactaagttactgtcgtcatcctctctgcaggttatggttgctgtaagcagcgtcagtcacgccgagggaaaccccacttttccagaacgaaagagaaatcttgagaggccaaccccaaaatatactaaagtgggggaaagactgaggcatgtcattcctggccatatggcttgctctatggcatgcggaggcagagcatgcaagtacgagaatcccgccaggtggtccgagcaggagcaagcaatcaagggggtgtatagttcttgggtgaccgataatattctggcaatggcaaggcctagctccgaactcctggagaaataccatatcatagatcaattcctttcacacggtataaaaaccattattaacttacaacgtccaggagaacacgcctcatgcgggaacccactggagcaggaaagcggcttcacctatctgcctgaggctttcatggaggcagggatctacttttataactttggctggaaggattacggcgtggcctctctgacgactatcctagacatggtgaaagtgatgacatttgctctgcaggagggtaaagtggcaatacactgccacgctgggctgggcagaaccggtgtgctgatcgcctgttacctggtgttcgctaccagaatgaccgccgatcaggctattatcttcgtcagggcaaagaggcccaatagcattcagactcgcgggcagcttctgtgcgtgcgagagttcactcagttcctcacccccctgcgcaatatctttagttgctgcgaccccaaagcccatgcagtcacactcccacagtatcttattaggcagcgtcacctgctgcatggatacgaggcgagactgcttaagcacgttcctaaaattattcaccttgtctgcaaattgttgctggatctggctgagaatagacctgttatgatgaaggacgtgagcgaaggccctgggctgagtgctgagatcgaaaagaccatgtctgaaatggtgacaatgcagctggataaggagctgctgaggcacgatagcgacgtgagcaacccccccaaccctacagctgttgccgcggatttcgacaaccggggcatgatcttcagtaatgagcagcaatttgatccgttgtggaagcgtcggaatgtggagtgtttacaaccactgacccatctcaagagaagactctcttatagcgattcggatctgaagagggccgaaaacctgctcgagcaaggagagaccccccagaccgtcccggcccaaatcctggtgggccataagcccagacagcaaaaactgatctcacattgttacatcccccagtctcccgagcctgatctgcacaaagaggctctggttagatccaccctgagcttttggtctcagtccaagttcggcgggcttgaggggctaaaggacaatggatctccgatctttcatggcagaatcatcccaaaggaagcgcagcagtccggagcatttagcgcagacgtgtccggaagccactccccaggagaacccgtctctccgtccttcgcgaatgtccacaaggatcccaatcccgctcaccaacaggtgtcacactgtcaatgtaagactcacggtgtgggttcccctggcagtgtgcgccagaactctagaaccccacgaagccccctcgactgcggctcaagccctaaggctcagtttcttgtggaacatgaaacccaggattctaaggaccttagtgaggcagcatctcatagcgctctccagagcgagctgtctgcggaagcgcgccgtatcttggctgctaaggctctagccaatctgaatgagtctgtggagaaggaggagctcaagaggaaggtcgagatgtggcaaaaggagcttaactcacgtgacggcgcctgggagagaatctgcggcgaaagggaccccttcatcctctgctcactcatgtggagttgggtggagcagttgaaagaaccggtgattaccaaagaggatgtagatatgcttgtggatagaagggccgatgccgctgaagcgctcttcttgcttgagaagggtcagcatcaaacaatcctgtgcgtactgcactgtattgttaatctgcagacaattcctgtcgacgtcgaggaggcctttctcgcccacgctattaaagcattcacaaaggttaacttcgatagcgagaacggtccgacagtttacaataccctgaagaaaattttcaagcatacactcgaggaaaagcgcaaaatgaccaaggatggacccaaaccgggactctag

SEQ ID NO: 32831 - DNA, 438 bp, Artificial Sequence
  Description of Artificial Sequence: Synthetic coding sequence
atgtggacagccaggggaccgttcagacgggaccgctggagcagcgaagacgaagaggccgcgggccctagccaggcactgtcccctcttttgtctgatacacgtaagattgtgagcgagggagagctggaccaacttgcgcaaatcagacccctgatattcaatttccatgagcagaccgccattaaagactgtcttaagattttggaagagaagaccgcagcctacgatatcatgcaggagttcatggctctggagctaaagaacctgcccggcgagtttaactccgggaaccagccatccaacagggagaaaaatagatacagggatatccttccttttcagcaccatggctactctgggcccaacgaacgcaccaccttctggcatgggagcaacgagggagcagtctccctcctgctcaggtactgtgcgtag

SEQ ID NO: 32832 - DNA, 681 bp, Artificial Sequence
  Description of Artificial Sequence: Synthetic coding sequence
atgtcgtctccccgagacttccgtgctgagcctgtaaatgattacgaaggcaacgatagcgaagcagaagacctcaattttagagaaactctgccaagcagttcccaggaaaacacaccgcggtccaaggtgtttgaaaacaaagtaaattccgagaaggtaaaactgtcccttaggaattttccccataatgattatgaagacgttttcgaggagccttctgaaagtggctctgatccaagcatgtggacagcccgtggacctttccgaagggacagatggtcgtcggaggacgaggaggccgccgggccatcacaggcccttagccctcttctcagcgacactcgtaaaatagtaagcgaaggcgaactggaccagcttgcccagattcggcccttgattttcaacttccacgagcagaccgcaatcaaagactgtttgaaaattctagaggaaaaaacagcagcctacgacattatgcaggagtttatggctctcgaacttaagaatctgcctggcgagtttaatagcggaaaccagccttcgaaccgcgaaaaaaacaggtatcgggatatccttccgttccagcatcatggttactctgggcccaacgagcgaacgacattctggcacggcagcaatgaaggcgccgtgagcctgttgctaagatactgtgcctag

SEQ ID NO: 32833 - DNA, 1020 bp, Artificial Sequence
  Description of Artificial Sequence: Synthetic coding sequence
atgtggacggcacgagggcctttcagaagggatcgatggagttcagaggacgaagaagccgcaggacctagtcaggcacttagcccactcctgtccgatacacgaaagatcgtatccgagggggagctcgaccagttggcccaaattagacccttgatttttaactttcacgagcaaacggctattaaggattgcctgaagatcttggaggaaaaaactgctgcatatgacattatgcaggagtttatggctctggagctgaagaacctgccaggcgagttcaactctggtaaccagccgtccaaccgcgagaagaacaggtacagggacatactcccgtatgattcaacccgcgttcccttgggaaagtctaaggactacatcaacgcttcttatattcgcatcgtgaactgtggagaagaatacttctacatcgccactcagggacccctgctgtcaacaatcgacgacttctggcaaatggtgttggaaaacaactccaatgtgatcgctatgattactcgggaaatagaggggggaattattaagtgctaccactactggcctatcagtctgaaaaagccgctggagctcaagcacttcagagtgtttctggaaaattatcaaatcctgcagtacttcatcataagaatgtttcaggtggtggagaaatcaacaggcacaagtcattctgtgaagcagttacaattcactaagtggcccgaccatgggactcctgccagtgccgattcttttattaagtacattcgatacgccagaaagtcacacctcactggtccaatggtcgtccattgctccgctggaatcggtcgcacgggcgtgtttctgtgcgtcgacgtggtgttttgcgctatagtaaaaaactgctccttcaatatcatggacatcgtggcccagatgcgggaacaaaggtccgggatggtccagaccaaagaacagtaccatttctgttacgacatcgtcttagaagtgctccgcaagctgttaaccctggattag

SEQ ID NO: 32834 - DNA, 1137 bp, Artificial Sequence
  Description of Artificial Sequence: Synthetic coding sequence
agtttcagtcctcgcctgtgctctgtcaatgattacgagggaaacgactctgaggcggaggatctgaacttcagggaggctcttccgtcaagctcacaggagaatacaccacgctctaaagtgttcgaaaacaaagtgaacagcgaaaaggtaaagttatccctgcgcaattttccccacaatgattacgaggacgtgttcgaggagccctccgagtccggttccgatccaagcatgtggactgctcgcggcccattcggccgcgatagatggtcctccgaagacgaggaagctgccggaccgagtcaggctctcagtcccctcctatccgacacacgcaagatcgtatcagaaggagaactcgaccagcttgcacagatccgaccactgatattcaatttccacgagcagactgcaatcaaagattgccttaaaatacttgaagaaaagactgcagcgtacgatatcatgcaagaatttatggctctggagctgaaaaatctgcccggggagttcaactctggcaatcagccctctaatcgggaaaagaacagatatcgagacatattgccttacgattccacaagggtgccgctcggaaaaagtaaagattacattaacgcctcctacattcgcatcgtgaactgtggagaggagtacttctacatcgccacacaaggtccactgctgtctacgattgatgacttttggcagatggtgttggaaaataatagcaatgtgatcgctatgattacaagagagattgagggtggcataataaagtgctatcattattggccgatctctctgaagaagcccctggaactgaaacattttcgagtgtttctcgagaactaccagattctgcagtacttcatcatccgcatgttccaggtggtcgagaagtctaccgggacatcccactccgtcaaacaattacagttcactaaatggccagaccatggcacacctgctagtgccgactccttcattaaatatatccgttatgcccggaaaagccacctgaccgggccgatggtagtacactgttccgctggcatcggacgaacaggtgtcttcctctgcgtcgatgtcgtgttctgcgcaattgtgaaaaattgttctgtgtccgtgtag

SEQ ID NO: 32835 - DNA, 279 bp, Artificial Sequence
  Description of Artificial Sequence: Synthetic coding sequence
tgaggccctaattggcgaggctgttgggggtgctcggggaccgttggggcagccccgcaggctcaggttttcgaaaacaaggtcaacagtgagaaagttaaactaagcctgcgcaatttcccccataatgattatgaagatgtcttcgaggaaccctcagagtctggcagcgatccctcaatgtggacagcacgcgggccttttggccgagacaggtggagtagcgaagatgaagaggcggccggtccttcgcaggcactgtctcccctgctaagttag

SEQ ID NO: 32836 - DNA, 342 bp, Artificial Sequence
  Description of Artificial Sequence: Synthetic coding sequence
atgtccagccctcgagattttcgcgcggagtctgtgaacgactacgagggaaacgatagcgaagctgaggacctcaattttagggaagctctgccttcttctagccaggaaaacaccccccgatccaaggtgtttgagaacaaggtgaactctgagaaagtaaaattaagtctcaggaactttccccacaatgactacgaggatgtcttcgaggagcctagtgagtcgggtagcgatccatccatgtggacagcccggggcccatttggcagggacaggtggtctagtgaagacgaagaggcggctggtccttcacaagcgctctccccactcctgtcttag

SEQ ID NO: 32837 - DNA, 924 bp, Artificial Sequence
  Description of Artificial Sequence: Synthetic coding sequence
atggagaaccaagtccttactccgcatgtttattgggctcagaggcatagggaactgtacctgagggttgaattatcagacgtgcagaatccagcaataagcattactgaaaatgttctgcacttcaaggcccagggccatggcgccaaaggcgacaatgtgtatgaattccacctggaatttcttgaccttgtgaaaccagaggaggaggagagattgaataaactgagacttgaaagcgaaggctctccagaaactctcacaaatctacggaaggggtaccttttcatgtataatttggtccagttcctcggcttctcttggatctttgtgaacctgacagtcagattttgtatcctgggtaaagaaagcttttatgatactttccatactgttgcagacatgatgtacttttgtcagatgctcgcagttgtcgagaccattaacgccgctatcggcgtgactacttcacctgtgctgccctccctgatccagctcctgggcaggaactttattctgttcattatcttcgggacaatggaagaaatgcaaaacaaggccgtggtgtttttcgtcttctatctgtggtctgcaattgagatcttccgctattctttctatatgctgacttgtattgacatggactggaaggtcctcacatggcttagatacacattatggataccgctgtatcctcttggttgtctcgcagaggcggtgtctgtgattcaatccatccctatcttcaacgaaacagggaggttttcatttactctcccataccccgtgaaaatcaaggtgcgctttagctttttcctccagatctacctcatcatgatttttctaggcctctatattaacttcagacatctgtacaagcagaggcgacgtcgatatgggcagaaaaaaaagaagatacactag

SEQ ID NO: 32838 - DNA, 1932 bp, Artificial Sequence
  Description of Artificial Sequence: Synthetic coding sequence
atgcgtaccctgcgccgacttaagtttatgtctagcccaagcctcagcgacttgggcaaacgagaacctgctgctgctgccgacgaaagggggacacagcagagaagagcctgtgctaatgctacgtggaattcaatacacaatggggtgatagcagttttccagcgtaagggtcttcccgaccaagaacttttttcactaaacgagggggtgcggcagctccttaaaaccgaactcggctcattcttcaccgaatatctgcaaaatcagctgttgaccaaggggatggtgatattacgggataaaatccggttctacgaggggcagaaattgctggattcactggctgagacgtgggattttttctttagtgatgtacttcccatgcttcaggctattttttacccagtgcagggcaaggaaccctccgtccggcagctggccttactgcacttcagaaatgctatcaccctctccgtgaagctggaggatgccctggcccgcgcccacgcacgcgtgccgccagccattgtgcagatgttactggtgctgcagggggtccatgagtcccggggcgtgaccgaggactacctgcgtctggagaccctcgtgcaaaaagtggtcagcccctacctgggcacttacgggctccactccagcgagggacccttcacacactcctgcattctggagttgcaacgcgacaaggccgctgcagcagctgtgctcggagccgtgcgaaagcgcccatcggtagtgcctatggcaggccaggatccagcactctcaacctctcaccctttctatgatgtggccagacacggtattttgcaggttgcgggagatgaccgctttggcaggcgcgttgtcactttctcatgctgtagaatgccaccgtcccacgagctagaccaccagcgtctgctcgaatataaaaagaatctgaaggctctgtatgtagttcacccgaccagcttcattaaagtgctttggaacattctgaaaccgctcatctcacacaagttcggtaaaaaggtgatctactttaactatctttcagaattgcacgagcatctgaagtacgatcaacttgtgattccacctgaggtgctgcggtacgacgaaaagctccagtccctccacgaaggtcgcacaccccctccgaccaagacgcctcctccgcgacccccacttcctacccaacagtttggggtgtcactacagtacttgaaagacaagaaccagggtgaactaatcccacctgtgctgcggtttaccgtaacttatcttagagagaaaggcctgcgaacagaggggctgttccgcaggtccgcctctgtgcagactgtgcgggaaatccagcgcctttacaatcagggtaaacccgtcaacttcgacgactacggagacattcacatcccagccgtgatcttgaagaccttcttgagagaactgccacaacctttactcacttttcaggcttatgaacagatcttgggcattacttgtgtggaaagctctctgcgcgtgacaggctgcaggcagatcttgcggtctctgccagaacataactatgtggtgctgcgttatctgatggggttcctgcacgcagtgagccgcgaaagcattttcaataaaatgaactcctctaatctcgcctgtgtctttgggctcaacctcatctggcctagtcaaggggtgagctctctctctgccctggtgccactaaatatgttcacagagctactgatcgagtattacgagaaaatcttctcaactcccgaagcgcctggagagcacggcctggctccatgggagcaggggagcagagctgcccctctccaggaggcagtgcccaggactcaggccactgggctgacaaagcccaccctgccacccagcccactcatggcagcgaggaggcgtctctag

SEQ ID NO: 32839 - DNA, 1695 bp, Artificial Sequence
  Description of Artificial Sequence: Synthetic coding sequence
atgcgcactctcaggcggctgaaatttatgtctagcccgagcctgagtgaccttggcaagcgggaaccagctgctgctgctgacgaacgcggaactcagcagaggagagcctgtgcgaacgccacatggaatagcattcacaacggcgtgatcgccgtcttccagcgcaagggactgcccgaccaggagttattttccctaaacgaaggggtgagacaactattaaagaccgaactgggctcgttctttactgagtacctgcagaatcagctactcactaaaggaatggtaattctgcgtgacaaaattagattctacgaggaactccagcgcgataaggcagcggcagcagcggtcctgggagcagtacgaaaaaggccctctgtggtcccaatggcagggcaagatcccgccttatccacaagccatcccttttatgacgtggcacgacacgggatcctgcaggtcgctggggacgaccggttcggtaggcgagtcgttacttttagctgttgccgtatgcccccttcccacgagttagatcaccagcgcctcctcgaataccttaagtacactcttgatcagtatgttgagaatgactataccatcgtctatttccactacggcttgaattctcggaacaaacctagcctcggctggctccagagtgcctacaaggagttcgaccggaaatataagaagaacctgaaagctttatatgttgtgcatccgaccagctttatcaaagtactgtggaatattctcaagcctctgatctcacataagttcggaaagaaggtgatctattttaattatctaagcgaactgcacgagcacctgaagtatgatcagctggtgattccccctgaggtgctcagatacgacgagaagttgcagtcactgcatgaagggagaactcccccccccaccaaaactcccccacctcgcccacctttgccaacccagcagttcggagtgagtctccagtaccttaaggacaagaatcagggggagctgattcctcccgtgctcagattcacggtgacgtacctccgggagaaaggccttaggacagagggactgtttcgtcggtctgcaagcgtgcaaacggtccgggaaatccaacgcctgtataatcagggaaaaccagttaactttgatgattatggagatattcacatccccgcagttatcttaaaaaccttcctgcgggagctcccccagcctctgctgactttccaggcctacgaacagatcctcgggattacttgtgtcgaatcatctctgcgggtaactggctgtcggcaaattctgagatctctcccagagcataactatgttgtgctgcggtatctgatgggtttcctgcatgcagtctcacgcgagtcaatcttcaacaaaatgaattccagtaacttggcatgtgtgtttggccttaatttaatctggccatctcagggagtctcatcactttcagcgctcgtgcctttgaatatgtttaccgagctgctgattgaatattacgagaagatcttttctacccctgaggctcccggcgaacacgggttagccccctgggaacaaggcagcagggctgcacctctccaagaggctgtccctcgtactcaggcgaccggactgacaaagcccaccttgcccccttccccactgatggcagcgaggaggagattgtag

SEQ ID NO: 32840 - DNA, 1515 bp, Artificial Sequence
  Description of Artificial Sequence: Synthetic coding sequence
tgactggggagcttcttcacggagtatttgcaaaaccagcttttgaccaagggaatggtgatcctgcgcgacaagatccgcttctatgaggaactacagagagataaggctgctgcggccgcggttctgggggcggttcgaaagagaccatccgttgttcctatggccgggcaggacccagcactgtcgacctctcatcccttctatgatgtcgccagacacgggattctacaagtggccggagacgataggttcggaagacgagttgtgacattcagctgctgccggatgcctccaagtcatgagttagatcaccagaggctgctcgagtacctcaagtacacgctggatcaatatgtcgagaacgactataccatcgtttactttcattatggcctcaacagccgcaataagccttcactgggatggcttcaatcggcttataaagaatttgacagaaaatataagaagaacctgaaagcattgtatgtggtgcatcctacatcattcatcaaggtgctgtggaatatactgaaacccctgatcagccacaagttcgggaagaaagttatttacttcaactacttgtcagagctgcatgaacatctcaaatacgatcagctcgttatacctcccgaggtcctacgctatgacgagaagctgcagagtctccacgaaggccgcacgccaccgcctactaaaacccctcctcccaggcctcctctcccgacccagcaatttggcgtcagtcttcagtatttgaaggacaagaatcagggagaacttattccccctgtccttagatttacagtgacatatctgcgtgagaaaggtctcagaaccgaaggtctttttcggagatccgctagcgtgcaaactgtgcgtgaaatccagaggctttataaccagggcaagccagtgaactttgatgattacggcgatattcacatcccagccgtcatactcaaaacttttctacgggagttgcctcagccccttctgaccttccaggcgtatgaacagattctcggaatcacatcactgcctctcgcccccttggaactgtctcgggagccccacgccctcccaggagtcgaatcttctctgcgtgtcactgggtgcagacagattttaaggagcctccccgagcacaactatgtggtactccgctatttgatggggtttctgcacgcagtcagtagagagtccatttttaacaagatgaattctagcaatctggcgtgtgttttcggcctaaacctgatatggccctctcagggtgttagcagcctttccgcccttgttcccctcaatatgttcaccgagttgcttatcgagtattatgaaaagattttttctacccctgaagcccccggagagcacggactcgccccatgggaacaaggtagcagagctgcccctctgcaggaggcagtgccacgaactcaagccaccgggctgacaaagcccaccttgccgccttcacccctgatggctgctagacgtcggctttag

SEQ ID NO: 32841 - DNA, 1590 bp, Artificial Sequence
  Description of Artificial Sequence: Synthetic coding sequence
atgttcccgctgaccgaggagaataaacacgttgcccagcttttgctcaataccgggacatgtccccgctgcatttttcggttctgtggggtggacttccacgccccctataaacttccttacaaggagcttctgaatgaactccagaaattcctggagactgagaaggatgagttgattcttgaagtgatgaatcccccacctaagaagattagattgcaagagctggaggactctatcgacaatctctcgcagaacggggaggggaggataagcgtcagtcatgtgggatcgaccgccagcaaaaatagtaacctgaacgtgtgtaacgtttgcctcggaattctgcaggaattttgtgaaaaggatttcattaaaaaggtctgtcagaaggtagaggctagcggattcgagtttacttcgttggtattttccgtctcgtttcctccgcagctttctgtccgggaacacgccgcctggttgctggtgaaacaggaaatggggaagcaatctctgtccctaggtcgcgacgatattgttcagctgaaagaggcttacaagtggatcacccacccactcttctctgaagagctgggagtccctatagacgggaagtcgctgttcgaagtctctgtggtgttcgctcaccccgagaccgtggaagactgtcactttctcgcagccatttgtcccgactgctttaagcccgcaaagaacaaacaatcagtgttcacgaggatggccgtgatgaaggccctgaacaagataaaagaagaagactttctgaagcagtttccatgtcctccgaactctccaaaagcagtgtgcgcggtgctggaaattgaatgcgctcacggtgccgtgtttgtagccggcaggtataacaagtactcccgcaatctcccacagactccgtggatcatagatggtgagcgtaaactggagtcgtcagtggaagagttaattagcgaccatctgcttgcagtttttaaggctgagtcattcaatttcagctcaagcggtcgggaagatgtggacgtgcgcacattaggtaatggcagaccatttgccattgaactggttaatcctcaccgcgtgcattttacatcccaagagatcaaggaactgcagcagaagatcaacaactcttccaataaaatccaggtcagagatttacaactcgtcactcgggaggccatcgggcatatgaaggaaggcgaggaggagaagacaaagacctatagcgcgcttatctggactaataaggcaatccagaaaaaggatatcgaatttcttaacgacattaaggatctgaaaattgaccagaaaactccattacgagtgctgcataggcgccccctcgcagtacgtgccagagtaatccacttcatggagacccaatacgtggacgaacatcattttagactccatcttaagacacaggctggcacctacatcaaggaatttgttcacggcgactttgggcggacaaagcccaacattggaagcttaatgaacgtgactgcggacatccttgagctggacgtcgaaagcgttgatgttgattggccccccgccctggacgactag

SEQ ID NO: 32842 - DNA, 1590 bp, Artificial Sequence
  Description of Artificial Sequence: Synthetic coding sequence
atgtttcccctaactgaagagaacaagcacgtagcccaactgctcctgaacaccgggacgtgtccacgctgcatcttccggttttgtggcgttgattttcatgcaccctataagttgccatacaaagaactgctgaacgaattgcaaaagttcctggaaactgagaaggatgagctgattctggaggtaatgaacccaccccctaaaaagatcagactgcaggaactggaagactccatcgacaacctttcacagaatggtgaggggcggatttcagtgagtcacgttggtagcacagccagcaaaaactctaacctgaatgtgtgtaatgtgtgcctgggtatcctccaggagttttgcgagaaagactttatcaagaaagtgtgtcaaaaggtggaggcctccggatttgaatttacatccctggtgttttctgtttcgttccctccacagctctccgtgcgcgaacatgctgcatggctgctggttaaacaggagatgggcaaacagtctctatccctgggtcgagacgacatcgtgcaactgaaagaggcatacaaatggatcacccatccactcttcagcgaggagctgggggtgcctattgacggcaagagcctctttgaggtatcggtcgtttttgcccatccagagacagtcgaggattgccattttctggcagccatctgtcctgactgttttaaaccagctaaaaacaagcagtcagtttttacccgtatggccgttatgaaggccctgaacaagatcaaggaggaggacttcctgaagcagtttccgtgtcctcccaactcccccaaggccgtctgtgccgtcctggagatcgaatgtgcacatggcgccgtgttcgtcgctggtcggtacaacaaatattctagaaatttaccccagaccccctggattatcgacggcgagcgtaagttggaatcttctgtcgaggagttaatctccgaccacctgctagctgtcttcaaagcggaatcattcaatttctcctctagcggcagagaagatgtggacgttcgaacgctaggtaacgggcgccctttcgccattgagcttgtaaacccccacagggtgcatttcacatcgcaggagattaaggaactgcaacaaaaaatcaataattcgtccaacaagatacaggtaagagatcttcagctggtgacccgggaggcaatcggacacatgaaggagggagaggaagagaagactaagacatacagcgcactgatctggacgaataaagccatccagaagaaagatattgaatttttaaatgatattaaggacttaaaaattgatcagaagaccccactgagggttctccataggagacctctggctgtgcgcgcaagagtgatccattttatggagactcagtacgtggacgagcaccattttcggttgcacctgaagacacaggctgggacatatattaaggaattcgttcatggggactttggtagaactaaacccaatattgggtccttgatgaacgtcacagcagacatcctagagctggatgtggagagtgtggacgtcgactggcccccagcgctcgacgattag

SEQ ID NO: 32843 - DNA, 363 bp, Artificial Sequence
  Description of Artificial Sequence: Synthetic coding sequence
atgttccccctcaccgaggagaataagcatgtcgcccagcttctgcttaatacggggacctgcccacgttgcatcttccggttctgcggggtagactttcacgctccttacaagctgccttataaagagcttcttaacgaactgcagaagttcctggagacagaaaaggacgaactgatcctggaggttatgaaccctccccccaagaaaattaggttacaagaactggaggacagtatcgacaacctgagtcagaacggcgagggaaggatctccgtcagtcacgttggatcgaccgcctccaaaaattcaaacctgaacgtttgtaatgtatgtctggggatacttcaagaattctgttag

SEQ ID NO: 32844 - DNA, 1986 bp, Artificial Sequence
  Description of Artificial Sequence: Synthetic coding sequence
atggaaatgactgaaatgactggagtgtctctgaagcgcggcgccctggtggtagaagataatgattccggagtacctgttgaagagacgaagaagcaaaaactgagtgagtgctctttgaccaaaggccaggatggtcttcagaacgacttcctcagtatctccgaagacgtgccacgccctcccgacacagtgagcaccggaaaaggcggcaaaaattctgaggctcagttggaggacgaggaagaagaagaagaggatggcctatctgaggagtgtgaagaagaggagagtgagagtttcgcggacatgatgaagcatgggctgacggaggccgacgtgggcatcaccaagttcgttagtagtcaccaggggttctccggtattctgaaagagagatacagtgactttgttgtgcacgagatcgggaaggacggtcgcattagccatctgaacgacttgtccatcccggtcgatgaggaagatccttctgaggatatattcacggttctgacagccgaggagaaacagcgtttggaagagcttcaactgttcaagaataaggagacgtcagtggccatagaggttattgaagacacaaaagaaaagaggaccatcattcaccaagctattaagtccctgttccccggcctggagacgaagacagaagatagggaagggaagaagtacattgttgcttaccatgctgctggcaagaaagccctggccaatccacggaaacacagctggcctaagtccagagggagctattgccactttgttctctacaaggagaacaaggatactatggatgctatcaatgtactctctaagtacttgcgagtcaaaccaaatattttctcctacatgggtactaaggataagcgtgcaatcacggtgcaggagatagcggtgctgaagattaccgcccagagactggctcatctaaacaagtgcctcatgaacttcaagttaggcaacttctcttaccagaaaaatccacttaagctaggcgaactccaaggtaaccactttacggtggtacttcggaacatcactggcaccgatgatcaggtgcaacaggcaatgaattcactgaaagagatcggtttcattaactactatgggatgcagcggtttggcacaaccgctgtccccacataccaggtggggagagccattctacagaactcctggaccgaagtgatggacctgatacttaaacctaggagcggggccgagaaaggctacttggtgaaatgtcgagaagagtgggcaaaaacgaaggatcctacagctgcactccgcaagctgcctgtgaaacggtgcgtcgaaggacagttgctcaggggattgtcaaaatacgggatgaagaacatcgtgtccgcctttggcatcatccccaggaataatcgcttaatgtacattcactcttaccagtcatatgtttggaataatatggtgtctaaacgtatcgaagactacggcctcaagccagtgccaggagatttagtgttgaaaggtgctaccgccacatacatcgaagaagatgacgtgaacaactactccattcacgatgttgttatgccactgccggggttcgacgtgatataccccaagcacaagatacaggaagcgtatcgtgaaatgctcacagcagacaatctcgacatagacaacatgcggcacaagattagagattactcgctaagtggcgcttaccgaaagattatcatccgcccccagaacgtatcttgggaagtcgtcgcttacgacgatcctaagataccactcttcaataccgatgtcgacaacctcgaagggaagacaccacctgtgttcgccagcgaaggaaaatacagagccctgaaaatggattttagtttgcctccttctacatacgccacgatggccataagagaagtcttaaaaatggacaccagcatcaaaaatcagacgcaattaaatacgacatggctgcgctag

SEQ ID NO: 32845 - DNA, 1986 bp, Artificial Sequence
  Description of Artificial Sequence: Synthetic coding sequence
atggaaatgactgaaatgaccggtgtgagtcttaagagaggagccctggtggttgaggacaacgattcaggcgtgccagtcgaggaaacaaaaaagcagaaactcagcgagtgctccctcacaaaaggacaagacgggctccagaatgattttctctcaatttcggaggacgtaccgcggcccccagatactgtcagtaccgggaagggtggaaagaatagcgaagcgcaactggaagacgaggaagaggaagaggaggatgggctgtcagaagagtgcgaggaagaggagtctgagtcttttgctgatatgatgaagcacggattgaccgaggctgacgttggcataacaaagtttgtatcctctcaccagggtttttccggtatacttaaagagcgctatagcgattttgtcgtgcatgaaattggcaaagacggtagaatctctcacctcaatgacctcagtatacctgtcgatgaggaagatccatccgaagatatctttactgtcctgaccgccgaagaaaaacagaggttagaggagctacagctgtttaaaaacaaggagaccagtgtggctatagaggtcatcgaggacacaaaagaaaagagaactattattcatcaagctattaagagccttttccccggcctggaaacaaagaccgaggatcgggagggaaaaaagtatatagtagcttaccatgccgctggcaaaaaggctttagcaaaccccagaaaacattcatggcccaaaagtagaggatcatattgtcattttgtgttgtataaagaaaacaaggataccatggacgcaattaacgtgctctccaagtacctacgcgtcaagccaaacattttcagttacatgggcaccaaagacaaacgcgctattactgtgcaggagatagccgtgttgaagatcaccgctcagaggctcgcccatttgaacaagtgccttatgaattttaaactcggaaacttttcttaccagaagaatccgctgaaactgggcgagctgcagggtaaccatttcacagtggtcctgcggaatataacaggcacagacgaccaggtacaacaggctatgaattctctcaaggagattggttttatcaactactatggcatgcagaggtttgggacaacagcggtccccacatatcaggtgggccgggccatcctgcaaaactcctggaccgaagtaatggatctcatcctgaagccgagaagcggcgccgaaaaggggtacctcgtcaaatgcagggaggaatgggcaaagacaaaagacccaacagcagcgttacgcaaactacctgtgaagaggtgcgtggagggtcagctcttaagaggtctctctaagtacggtatgaagaatatcgtttcagcttttggcattatcccccgtaataaccggctcatgtacatccactcttatcagtcctacgtgtggaacaacatggtctctaaacgaatagaggattatggtctcaagcccgtgccaggagatcttgtgctgaagggcgctaccgcgacctacatcgaggaagacgatgtgaataattattctattcacgacgtggtaatgcctctgccgggtttcgatgtcatctatccgaagcacaagatacaggaggcctatcgggaaatgctgactgctgacaacctagatatcgacaatatgcgtcacaagatccgcgactattctcttagcggcgcttacaggaaaatcatcatcaggcctcagaacgtgagctgggaagtggtagcctacgacgaccctaagatccctttattcaataccgacgttgacaatctagagggaaagactcctcccgtgttcgcttctgaagggaaatacagggcactgaagatggatttcagcctgcctcctagcacatacgccaccatggcgataagggaagtattaaagatggacacgtccatcaagaaccaaacacagcttaacacaacatggttacggtag

SEQ ID NO: 32846 - DNA, 1986 bp, Artificial Sequence
  Description of Artificial Sequence: Synthetic coding sequence
atggaaatgaccgagatgactggagtgagcttgaaaagaggcgctcttgtggttgaagataatgattccggggtacccgtagaggaaaccaaaaaacaaaaacttagtgaatgcagcttgactaaggggcaggacggcctgcaaaatgatttcctctccatctctgaggacgttccaaggcctccggatacagtgtccacagggaaagggggcaagaacagtgaagctcagctcgaggatgaggaggaggaagaggaggatggcctgtccgaagaatgcgaagaggaggaatcggaaagcttcgccgacatgatgaaacatggtcttaccgaggctgacgtcggaatcaccaagttcgtctcttctcaccagggtttttccgggattctcaaagagagatacagcgactttgtggtgcacgagataggtaaagacgggagaatctctcaccttaacgacctgtccattcctgttgacgaggaagacccaagcgaagatatcttcaccgtcctgactgcagaagagaaacagcgccttgaggagttgcaactgttcaaaaataaagaaacctccgttgccatagaggtaatcgaagacactaaggagaagcggacaatcatacatcaggctatcaagtctttgttccccggcctagaaaccaaaacggaggacagagagggcaaaaaatatatcgtggcataccacgcagccgggaaaaaggcgcttgccaatccccgcaaacacagctggccaaagagccgcggatcttactgccactttgttctgtacaaggagaataaggacaccatggatgcaattaacgtgcttagcaagtacttgcgggttaaaccaaatatcttttcctatatgggcaccaaggataagagagcaatcaccgtgcaggaaattgccgttcttaagattactgcacaaaggctcgctcatttaaataagtgtctgatgaacttcaaactcggtaacttttcatatcagaaaaaccctttgaaactcggagagctccaaggaaaccactttactgtcgtgctgaggaatatcactggaactgacgaccaggtgcagcaggctatgaatagcctgaaggagataggatttattaactactacggcatgcagcgctttggaacaactgcggtgcccacctatcaggtgggtagggccatcctccaaaattcatggaccgaggtgatggacttaattctgaagccccggagcggcgcagaaaaaggctatctcgtgaaatgtagggaggagtgggctaagacgaaagatcccaccgctgccctgagaaagctcccagtgaaacggtgtgttgagggacagctcctgcgagggctgagcaaatacggtatgaaaaatatcgttagcgcttttggcattatccctaggaataatcgtttgatgtacatccactcgtaccagagctatgtctggaacaatatggtgagtaagagaatcgaagactatggtctgaaaccagttcccggcgacttagtgctgaaaggagctactgcaacctacattgaggaagacgacgtcaacaattattctatccacgacgtcgtgatgcctctccctggatttgacgtcatctatcccaaacacaaaattcaggaggcatatcgggaaatgctcactgcggacaatctagacatagataacatgaggcacaagattcgcgattatagtttatctggcgcgtacagaaaaattatcatacggccacagaatgtttcttgggaggttgttgcgtacgatgacccaaagatccccttgttcaatactgacgtggacaaccttgagggcaagacgccacccgtatttgcgtcggagggcaagtaccgagctctcaagatggacttctccttgcctccctccacatacgctaccatggccattcgtgaggtgctgaagatggacaccagcatcaagaaccaaacccagttgaacacaacgtggctcagatag

SEQ ID NO: 32847 - DNA, 2106 bp, Artificial Sequence
  Description of Artificial Sequence: Synthetic coding sequence
atggaagaggacactgactaccgtattaggttcagcagcctgtgtttctttaacgatcatgtgggatttcatggtacgatcaaaagctctccctcagatttcatagtgatagagatcgacgagcaggggcaattggtgaataagaccatcgacgagccgatctttaagatctcagaaattcagctagagcccaataacttccccaagaagcctaaactcgatttacaaaatctgtctttggaagatggacgcaatcaggaagtgcacactctgattaagtacacagacggggatcagaatcatcagagcgggtccgagaaggaggataccatcgttgatgggacctccaagtgcgaagaaaaggctgatgtgttaagtagtttcctcgacgagaaaacgcacgagttgctgaataacttcgcatgcgatgtcagagagaagtggttgagtaagaccgaactaattggccttccccctgagtttagcatcggcagaattctcgataagaaccaacgcgcaagcttgcacagtgcgatccgccagaagtttccttttctcgtaaccgtgggcaagaatagcgagatcgttgtcaaacctaacttggagtataaggagctgtgccacctggttagcgaggaggaggcctttgatttttttaaatacctcgatgcaaagaaggaaaattccaagttcacgttcaaacccgatacaaataaggatcataggaaggccgtgcaccattttgtcaataagaagtttggtaatttagtcgaaaccaagagcttctctaagatgaactgttcagccgggaacccgaacgtggtcgtgacggttaggttcagggagaaggcacacaagcgaggcaagagaccattgtctgaatgtcaagagggaaaggtgatttacactgcttttaccctaagaaaagagaatctggagatgtttgaggcaatcggctttctggctataaagttgggagtgattccatcggacttttcatatgctgggctgaaagacaaaaaagccataacctaccaagcgatggttgttcggaaggtaactccggagaggctgaagaacatcgagaaggaaatagaaaagaagcgtatgaatgtattcaacattagatcagtcgatgactctctccggcttgggcagttgaaagggaaccactttgacatagtcatcagaaatctaaagaaacagatcaatgattccgccaacttgagagaacggattatggaggctatcgagaatgtgaagaaaaaaggcttcgtcaactactacggtccacagaggttcggcaaggggcggaaagtgcacactgaccaaatcggtctagcactgctcaagaatgagatgatgaaggccatcaaactcttcctcactcccgaggacctggacgaccccgttaacagggccaaaaagtactttctgcagaccgaagatgccaaaggaactctgagcctgatgcccgaatttaaggtgcgcgagagggccctgctagaagcactgcatcggttcggaatgactgaagaggggtgtattcaggcttggttctctttgcctcattctatgagaatcttttatgtgcacgcttatacttccaagatatggaacgaagcggtgtcctaccgcctggagacctacggcgcgcgcgtggttcagggcgacttagtctgcctggacgaggatattgacgacgaaaattttccaaattccaaaatccacctcgttacagaagaagaggggagcgctaatatgtacgccatccaccaggttgttttacccgtgcttggctacaacatccagtatcccaagaacaaggtagggcagtggtaccatgacatactgtcacgagacggcctccagacctgtcgttttaaggtgccaactctcaagctgaatattcctggttgttacagacagattcttaaacatccttgtaaccttagctatcaattaatggaggaccacgacattgacgtgaagactaaggggtctcatatcgacgagacagctttaagcctgctgataagtttcgatctcgatgccagttgctacgcgactgtgtgcctgaaagaaattatgaaacatgatgtgtag

SEQ ID NO: 32848 - DNA, 2106 bp, Artificial Sequence
  Description of Artificial Sequence: Synthetic coding sequence
atggaggaggacactgactatagaatccggtttagctctctgtgcttcttcaatgaccacgtgggcttccacggcaccattaagtcctcacccagtgacttcattgtgatagaaatcgatgagcaaggccaactcgtcaataaaaccattgacgagccaatatttaagatttctgagatccagctcgaaccgaataattttccaaagaagccaaagctggatctccagaacctgagtttggaggatggaaggaatcaagaggtgcatacattgatcaagtatacagatggcgatcaaaatcaccagagcggctcagaaaaagaggatactatcgtcgatggcacgtctaagtgtgaagagaaagccgacgtgctttcctcatttttagatgaaaaaactcacgaactgctcaacaattttgcttgcgacgtgcgggaaaaatggctctcgaagaccgaacttatcgggctcccccctgagtttagcattgggcggatactggacaagaatcaacgcgcctccctgcactctgccatcaggcagaagtttcccttccttgttactgtcgggaagaactccgaaattgttgtgaagcctaacctggaatacaaagaattgtgtcacctggtctccgaggaggaggccttcgacttcttcaaatacctggatgccaagaaggaaaacagcaagtttacttttaagcccgatactaataaggatcacaggaaggccgtacatcactttgtcaacaagaagttcggcaacttggttgaaactaagtcattctccaagatgaactgttctgctggcaatcccaacgtggttgtgactgtgcgattccgcgagaaggcacacaagcgcggaaagcgtcccttgtctgagtgtcaggaaggcaaggtcatctacaccgcttttacactgcgtaaggaaaacttggagatgtttgaagcaatcggattcctcgctataaaacttggcgtcatcccaagcgatttctcatatgctggcctaaaggataagaaggctatcacctatcaggctatggtcgtgcgaaaggttaccccagagcgactgaaaaatatcgagaaagaaatagaaaagaagcgtatgaatgtctttaatatcagatccgtggacgattctctgcgcctgggacagcttaagggcaaccacttcgatattgtaatcaggaatctcaaaaagcagattaatgactctgctaatctgagagagcgcatcatggaggctattgagaacgtgaagaagaagggcttcgtcaattactacggtcctcaaagatttggaaagggccgcaaggttcatacagaccagattggtctggccctcctcaaaaatgagatgatgaaagccatcaagctgtttctaaccccagaagacctggatgatcctgtgaatcgtgcaaagaagtacttcttacagacagaggatgccaagggaacactctcactcatgcctgaatttaaagttcgggagagagctctcctggaggctctgcacaggttcggcatgaccgaggaaggctgcattcaggcatggttctctctgccacactcaatgagaattttttatgtacatgcatacacgagcaagatttggaatgaggctgtgagttatagacttgaaacatatggcgctcgcgttgtgcagggggatctggtgtgtctcgacgaggacatcgatgacgagaactttcctaattccaagatccacctcgtgaccgaagaggagggatctgctaacatgtatgcaatccatcaggtggtgctcccagtgttgggttataatattcagtatcctaagaataaagttggccagtggtaccacgacattcttagtagagacggactacagacgtgccgctttaaggtgcctacactcaagcttaacatccctggttgctaccgccaaatattgaaacatccctgcaatttgagctatcaattgatggaggaccacgatattgatgtgaagactaaaggtagccacattgacgaaaccgcactgagcctgctgatctcattcgacctggatgcatcttgttacgccacagtatgcctgaaagagatcatgaaacacgatgtctag

SEQ ID NO: 32849 - DNA, 381 bp, Artificial Sequence
  Description of Artificial Sequence: Synthetic coding sequence
atggaggaagatactgactacagaatccggttctcgtcgctatgtttcttcaatgaccacgtcggcttccatggcacgataaagagctccccctccgacttcatagtgatcgaaatcgatgaacaaggacaactcgtgaacaaaaccatcgacgaacccatcttcaagatttccgaaatacagttggagcccaataattttcctaagaagccaaagctagatctgcagaatttatcactggaggatgggcggaatcaggaggtccacactctcattaaatacaccgacggcgatcagaatcaccagtccggctccgagaaggaggacacaattgtcgatggaacatctaagtgcgaggaaaaggcagacgtgctgagctag

SEQ ID NO: 32850 - DNA, 2106 bp, Artificial Sequence
  Description of Artificial Sequence: Synthetic coding sequence
atggaggaggacaccgactaccggatcaggttcagctcactttgttttttcaatgaccatgttgggttccacggaacaatcaaaagctcccccagcgactttatcgttatagagattgacgagcagggacagctggtgaacaaaactattgatgaacctatcttcaaaatctctgaaattcagctagaacccaacaattttccaaaaaagcccaagctggacctgcagaacttgtctctggaggacgggcgaaaccaagaggttcacacactgatcaaatacacagacggagaccagaaccaccaatccgggtccgagaaagaagacacaatagtggatggcactagcaagtgcgaggaaaaagccgacgtgctttcttctttcctggatgaaaaaacacacgagctgctgaataactttgcctgtgatgtgagagaaaagtggctatctaaaaccgagctcattggcctgccccccgaattctctataggacgcattctggataaaaatcagcgcgccagcctgcacagtgcaattcgccagaagttcccatttctcgtgaccgtcgggaagaattccgagatcgtagtgaagcctaatcttgagtacaaggagctgtgccatcttgtctccgaggaggaggcatttgatttcttcaagtacctcgacgctaagaaagaaaactccaagttcacgttcaaacctgacacaaacaaggatcacaggaaagcggttcatcactttgtgaacaaaaaatttgggaatctggtggagaccaaaagtttcagcaagatgaactgtagcgcagggaaccccaacgttgtggttaccgtgaggtttagggaaaaggcccacaaaagaggcaagcgccccttatctgagtgtcaggagggcaaggtcatttacactgcttttaccctgcggaaagagaacctggaaatgtttgaggctatagggttcctcgccatcaaactgggagtgataccttcagactttagttatgctggcctaaaggacaagaaggcaattacataccaggccatggtggttagaaaagttacgccagaaagacttaagaatattgaaaaagagatagagaagaaaagaatgaacgtgttcaatattaggagtgtagatgacagcctcaggcttggccagttgaaggggaatcacttcgatattgtgattcgaaatctgaaaaagcagattaacgactccgcgaacctgcgagagcgaattatggaagctatcgaaaacgtcaaaaaaaagggttttgtgaattactacggtccacagagatttggcaaggggaggaaggtgcacacagatcagattgggctggccctgctgaaaaatgagatgatgaaggccataaaactgttccttaccccagaggacctggacgaccccgtgaacagggccaaaaaatactttttgcaaacagaagacgccaaaggaaccttgtctctgatgccagagttcaaagttcgtgagagggctctcctggaagcgctgcataggtttggaatgaccgaggaggggtgcattcaagcctggttctcccttccccacagtatgcgcatcttctacgtgcacgcatacaccagtaagatttggaatgaggccgtgtcttaccggttggagacgtacggtgcacgcgtggttcagggcgacctcgtctgcctggatgaggacatagacgacgagaactttcccaatagcaagatacacttggtaacggaggaggaaggatcagccaatatgtacgcgattcaccaggtggtgcttcccgtcttgggctacaacatccagtaccccaagaacaaagtcggccagtggtatcatgatattctctctcgcgacggactccagacatgcaggtttaaggttcccaccctgaaactgaatatccctggttgttaccgtcagatcctaaaacatccgtgtaacctgagctaccagttaatggaggatcacgacatagatgttaagaccaaaggttctcatatcgatgagaccgccctgtccctactcattagcttcgacctggacgccagctgttacgccaccgtgtgtctaaaggagatcatgaaacacgatgtgtag

SEQ ID NO: 32851 - DNA, 1098 bp, Artificial Sequence
  Description of Artificial Sequence: Synthetic coding sequence
atggaagaggataccgattatagaatcaggttttcttctttgtgcttctttaatgaccacgtgggttttcacggcactatcaagtcatcaccatccgacttcattgtgatagaaatcgacgaacaggggcagctcgtcaacaaaaccatagacgaaccaatttttaagataagcgagatccagctggaaccgaacaacttcccaaagaagcccaaactggacctccaaaacctgagcctggaggatggccggaatcaggaagttcacactttaattaaatataccgacggagaccagaatcaccagagcgggagcgaaaaggaagatacgatcgtcgacgggacgtctaagtgcgaggaaaaggctgatgtgcttagctcattcttagatgagaaaacacatgaattactgaataactttgcatgtgatgtgcgagagaagtggctcagtaagaccgaactgattggcctacccccagagttcagcataggacgtatcctggacaaaaaccagcgagcgtccctccatagcgcaatccggcagaagttccccttcttggtcaccgtcggtaagaacagcgaaatagtggttaaacccaatctggaatataaagaattatgccacttagtatcggaggaagaggcctttgatttctttaaatacctggacgccaaaaaagaaaactctaagtttacattcaaacctgacacgaacaaggatcaccgcaaggcagtacatcactttgtgaataagaagttcgggaacctggtggagacaaaatctttctctaaaatgaactgctcggcaggaaacccaaacgtggtagtgactgtgagattccgcgaaaaggcccacaagcgcggaaagaggcctctgagtgaatgccaggagggaaaggtaatctacactgcatttacattgaggaaggaaaaccttgagatgtttgaggctatcggctttcttgccatcaagctcggagtcatcccctctgattttagttatgccgggctgaaagataagaaagctatcacataccaggccatggtggtgaggaaagttacgcccgagagactgaagaacatagagaaagagatctag

SEQ ID NO: 32852 - DNA, 912 bp, Artificial Sequence
  Description of Artificial Sequence: Synthetic coding sequence
atgtcctctgcccccgccagtggttctgtgcgcgcacgatacttagtatatttccaatatgtgggaacagactttaacggtgtggcagccgtgaggggcacccagcgggcagtgggcgttcagaattacttagaagaggcagcggaacggctgaattctgtggagcctgttaggtttaccatctcctccagaacagatgccggagtgcacgccctttcaaacgccgcccatctggatgttcagaggcgttctggaagacctcctttcccccctgaagtcctcgctgaggcattgaacacccacctccgacaccccgctataagagttcttagagcctttcgggttccgagcgacttccatgcccgccacgcagccacatccaggacttatctgtaccgcctggctacaggctgtcacagacgtgatgaactgccggtgttcgaaagaaacttatgttggaccctacctgcggactgcctcgatatggtggctatgcaggaggcagcccaacacttgcttggaactcacgacttctctgccttccagagcgctggctcccccgtccccagtcccgtcaggacacttcgacgggtgtctgtgagcccaggacaggcaagccccctcgtgacacccgaagaatcccgcaagttgcgcttctggaatctcgagtttgaatcacaatcctttctgtacaggcaggtcagacggatgacggcagtgctagttgcggtggggttgggcgccctggcccctgcccaggtcaaaacaatcctggagtcgcaagatcctttggggaaacaccagacacgtgttgcacctgcgcatggccttttcctgaaatctgtactctacggaaacctgggagctgccagctgtaccctgcaggggcctcagttcggatcacatggctag

SEQ ID NO: 32853 - DNA, 216 bp, Artificial Sequence
  Description of Artificial Sequence: Synthetic coding sequence
atgggggccaccggccttggcttcttgctgtcttggcggcaggacaatctgaacggcacagattgccaaggctgcaatatcctgtacttcagcgagactacgggttccatgtgctccgaactgagcttaaatagagggttggaggctcgacgtaagaaagacctgaaggattctttcctctggcgcgacggggtcagcccctgtttaccctgttag

SEQ ID NO: 32854 - DNA, 444 bp, Artificial Sequence
  Description of Artificial Sequence: Synthetic coding sequence
atgggagccaccggcctgggctttttgctgtcttggagacaggacaacctgaacggcaccgattgccagggatgtaatatcctgtactttagcgaaaccactggctccatgtgctctgagctgtctctgaatagaggcctggaggcacgtcgcaaaaaggatctcaaggactcctttttgtggcgctatggaaaggtgggctgtatctccctccccctgcgggagatgacggcctggataaacccgccacaaatttccgaaattttccagggctatcatcaacgtgtgcatggcgccgacgcactgagtctccagaccaattcactcagaagccgactgagcagccagtgccttggtcaatcttttctcctgcgaacgctcgaacgggggaggggattccgggccttgggagacatttgtggtcacgtgcatgaagaagactag

SEQ ID NO: 32855 - DNA, 444 bp, Artificial Sequence
  Description of Artificial Sequence: Synthetic coding sequence
atgggggccacgggactaggcttcctgctgtcttggcgacaagataacctgaacggcacggactgtcaaggctgtaacattctgtatttctccgagaccaccggatctatgtgctccgagctctcccttaaccgcggtctggaggcccgaaggaaaaaagacctgaaagacagctttctgtggaggtatggcaaggtgggttgcatcagcctccctctgcgcgagatgacagcatggatcaacccgccccaaatcagcgaaatctttcaaggataccatcaacgagtgcatggtgccgacgctctcagcctgcagaccaattcattacgctctcgactttcaagccagtgcttaggccagtctttccttttacggactctggagcgcggaagagggttccgggctttgggagacatttgtgggcacgtccacgaagaagactag

SEQ ID NO: 32856 - DNA, 216 bp, Artificial Sequence
  Description of Artificial Sequence: Synthetic coding sequence
atgggagcaactggcctcggcttcctgttgtcctggcggcaggacaatctgaacgggactgattgccaaggatgtaatatactctatttttccgagactaccggatccatgtgctcggaactgtctctgaaccggggccttgaggcaagacggaaaaaggatctgaaagacagctttctgtggagggatggcgtttctccttgcttaccgtgttag

SEQ ID NO: 32857 - DNA, 2202 bp, Artificial Sequence
  Description of Artificial Sequence: Synthetic coding sequence
atgggcaaattgatcacccggatgtggaagcttctcaggcggcgaagtgcccccaaagaactgctgagtcgcacatcgcttgagacccagaaattggatcttatgactgaggtgtctgaactgaagctcaaactggtgggaatggagaaggagcaacgggagcaggaggagaagcagcgcaaggccgaagagctactgcaagagcttagacacctcaagataaaagtcgaagagctcgagaacgaaagaaaccaatacgagtggaagttgaaggcgaccaaagctgaagttgctcagttacaggagcaagtggcgctgaaagatgcggaaatcgagagactgcattctcagctcagtcgtaccgcggcattgcacagtgaaagtcacaccgaacgggaccaggagatccagagactcaaaatgggaatggagaccctactgctggccaacgaggacaaggaccggcgaatcgaggagctcacgggtctattaaaccaatatagaaaagtcaaagagatcgtcatggtgacacaggggccatccgaacgcaccctgtcaattaatgaagaggagccagagggcgggttttcaaaatggaacgccacaaacaaggatcctgaggagctgttcaaacaggagatgcctccgcgatgtagctcacctaccgtcggacctcccccgttaccacagaaatccctggagacccgcgcacagaagaaattaagttgttccctggaagaccttcggagcgagagcgtcgataagtgcatggacggcaaccagccgtttcccgttctcgagcctaaggactctcccttcctcgctgagcacaagtatcccaccttaccaggcaaactgtcaggtgccactcctaatggagaagcggccaagtccccacctacaatctgccagcctgatgctaccgggtcctcgctattacgactgcgggatacagaaagcggatgggacgacacagctgtggtgaatgacctgagctctacaagttctggtactgagagcggaccacaaagccccctaacgccagacgggaaacggaatcctaaaggcattaaaaaattctggggcaaaatcaggcgtacgcaaagcggaaacttttataccgacaccctcggaatggcagaattcagacggggaggcctgcgagcgacagccggccctcgcttgagtcgtacaagagatagcaaaggtcagaaaagcgatgctaacgccccgttcgctcagtggtcaaccgagagagtgtgcgcatggctggaagactttgggctggcacagtacgtgatattcgcccgtcagtgggtctctagcggtcacacactgctaaccgccacacctcaggacatggaaaaggaattgggtatcaagcaccctctgcaccggaaaaagcttgtgttggccgtaaaggccattaatacgaagcaggaagaaaaatcagccctgctcgaccacatatgggtgactcgctggttggatgatattggtctgccccaatataaggaccagttccatgagtcccgcgttgatcggaggatgcttcagtaccttacagtgaacgacctcctgtttctcaaggtaacatcacaattacatcacctgagtataaaatgcgccatccatgtcctacatgtaaacaagttcaatccccactgtctccacaggcgccctgcggacgagtcaaatctctctccttccgaagtcgttcagtggtctaaccacagagtcatggagtggctcaggagtgtggacttagctgagtatgcaccaaacctaagaggctcaggcgtacacgggggcctgattattttggaacccagattcacgggggatacactcgcaatgcttctcaacattcctcctcaaaagacccttctccgtcgccacctgaccacgaagttcaatgcactgattggccccgaggcagagcaagagaaacgggagaagatggctagtcccgcttatactcctctcacaacaacggcaaaggtgcgcccgcgtaagctcggtttctctcatttcggaaacatcagaaagaaaaagtttgacgagtctacagattatatatgccctatggagccctccgacggggtgtccgattctcacagagtgtatagtggataccggggtctgtcccccctcgacgcacctgagctggatggccttgaccaggttggtcaaatctcctag

SEQ ID NO: 32858 - DNA, 2157 bp, Artificial Sequence
  Description of Artificial Sequence: Synthetic coding sequence
atgctccaacaggaactgctgtcacggacgtcacttgagacacagaaattagatctcatgaccgaagtgtctgaattgaaactgaaactggtgggtatggaaaaggagcagagggagcaggaagagaaacagagaaaagcagaagagctcttacaggagttgagacatttgaaaatcaaggtcgaggaattggagaacgaaaggaaccagtatgagtggaagctgaaggccaccaaagctgaagtcgctcagttgcaggagcaggtcgccctcaaggacgctgaaattgagcggctgcactcacaattgagtagaacagcggccctgcattcggagagccatactgagagagatcaggaaatacagagactgaaaatgggaatggaaacgctcttgctagcaaacgaagacaaggacagacgtatcgaagagctcactggtttactgaatcaatatcggaaagtgaaggagattgtcatggtgacacaggggcccagcgagcgcactctatccataaacgaagaagaacccgagggaggctttagcaagtggaatgctaccaacaaggacccagaggaactctttaaacaagagatgcccccacggtgctctagcccgacagtcgggcccccacctctaccacaaaagagcctggagactagggcacaaaaaaagctgagttgcagtcttgaggatcttagatcagagtcggtcgataaatgcatggacggcaaccaaccattccccgtgctggagccaaaggatagcccctttctggccgagcacaagtaccccacattgcccgggaaactgtcaggagctacacccaacggcgaagccgcaaaatccccccccaccatttgccagcctgacgccaccgggagctctctgcttaggcttcgggacaccgaaagcggctgggatgatacagctgtggtcaatgatctgagttccacatcctccggcacagagtcaggcccccaaagtcccctaacccccgacgggaaaagaaatccaaaaggaattaagaaattttggggcaagatacggaggactcagtccggtaacttctataccgatactctgggtatggctgaattcagaagaggggggttaagggccacggcaggcccccgcctgtcaaggactcgcgattccaaaggccaaaagtccgatgcaaacgcaccgtttgcccagtggtccaccgaaagagtttgcgcatggctggaggattttggtcttgcacagtacgtgattttcgctcggcaatgggtcagctctggccataccctcctgaccgccacaccacaagacatggaaaaagagctggggatcaagcacccactgcacaggaagaaactggtccttgcggttaaagccattaatacgaaacaggaggaaaagagcgcccttctggatcatatatgggtaacacgctggttggacgatatcggactgccccagtataaggaccagtttcatgagtccagggtcgatcggcggatgctgcagtacttgactgtgaacgatctcctgttcctcaaggtaacatcccagctccaccacctgtccatcaaatgtgccatccacgttttacacgtcaataagttcaaccctcactgtctccaccggcgcccagcagacgagagtaacctgtccccaagcgaggtagtgcagtggagcaaccaccgcgttatggaatggctacgaagcgtcgacctagctgagtacgcgccgaatctgaggggcagtggtgtgcacggcggcctgataattctcgagccaaggttcaccggtgacaccctagccatgttgttaaatatcccaccgcagaaaactctgctcaggcgccacctgacaactaaatttaacgcattaatcgggcccgaagcggagcaagagaagagagaaaagatggcatcacccgcctatactcctcttactactacagcgaaagtgcgccccagaaagttgggtttcagccatttcggcaacatcagaaaaaaaaaatttgacgaaagcaccgattatatatgccccatggaaccatctgacggcgtatccgacagccaccgagtatactctggatatcgcggcttaagtcccttggacgcgcccgagctcgacgggctagaccaggttgggcaaatctcctag

SEQ ID NO: 32859 - DNA, 2631 bp, Artificial Sequence
  Description of Artificial Sequence: Synthetic coding sequence
atggcgtccgacgcgtcccatgcgctggaggcagcactggagcagatggacggtattatcgctggaactaagaccggcgcggacctcagcgacggcacatgcgaacctggactggcttctcccgcaagctacatgaatccttttcccgtgttgcatttgattgaagatttgagattggccctggagatgctagagctgccccaggagcgcgctgccttactgagccagattcctggcccaaccgccgcatatattaaggagtggtttgaggagagtttgtcccaggtgaatcaccattcagccgcctcgaatgagacctatcaggaaagactcgccaggctggaaggggataaggagagccttattttgcaggtatccgtgctgacagatcaggtcgaggcccagggagaaaaaattagggacctggaggtgtgcctagaaggccaccaagtgaagctgaatgccgctgaggagatgctccagcaagaactgctgtctaggactagtctggaaacgcagaagctggacctcatgacagaggtgagtgaactcaaattgaagctggttggaatggagaaggagcagcgcgaacaggaggaaaaacagagaaaagccgaagagttgctacaggaacttcggcacttgaagatcaaagtagaggagctggaaaatgagagaaatcagtatgaatggaagctcaaggctactaaagcagaagtggcccagctgcaggaacaagtggctttgaaggatgcagagatagaaaggctgcatagtcagctctcaagaacggccgctctgcactccgagtcacatacagagagagaccaggaaatccagagattgaaaatgggcatggaaacactcctgttagcaaatgaagacaaagaccgacgaatcgaagaacttaccggactcctgaatcagtataggaaagtgaaggaaatcgtcatggttacgcaaggtccgtccgaacggaccctaagtattaatgaggaagagccggaaggtgggttttccaagtggaacgcaaccaacaaagatccagaggaactttttaaacaagagatgcctcctcgatgtagctcccccaccgttggccctccacctctcccccagaagtccctggagactcgcgctcaaaagaagctttcctgttcccttgaggatcttcgctccgaatcagtcgacaaatgtatggacgggaaccagccatttcccgtgctggagccaaaagattcaccattcctggccgagcacaaatacccgacgctaccaggcaagctgtccggcgcgaccccgaacggagaagccgcgaagtcgccccccacgatctgtcagcccgacgccactggcagcagtctcttgcggttacgagacaccgagagcggatgggatgacacagctgtagtcaacgatttgagctctacgagctctggcaccgaatctggtcctcaaagccccctgactcctgacggtaaaagaaaccctaaaggaatcaaaaaattttggggaaagattcggcgtactcagagtggcaatttctacaccgacacgctgggaatggcggaattccggcgtggtggtctccgcgcaacagctgggccacgcttgagcagaacaagagattccaaagggcagaaaagcgacgccaacgctccattcgctcagtggagcactgagcgggtctgcgcttggctcgaagacttcggattggcccagtacgtcatctttgcccgacaatgggtgtctagcggccacaccctgctgacagcaacgccacaggatatggaaaaagaactgggcatcaagcaccctctccacaggaaaaaactggtcttggctgtgaaggccatcaatacaaaacaggaggagaagagtgcactactcgaccatatttgggtgactaggtggctggacgacattggcctgccccagtacaaggaccagtttcacgaatcaagagtggacagacgaatgctccagtacctgactgtgaacgatctcttgtttctgaaagtcacaagccaactgcatcatttgagcataaagtgcgccattcatgtgctgcatgtgaataaatttaatcctcattgcttgcatcgccgcccggccgacgagagtaacctttcacccagcgaagtggtccagtggtctaatcacagggtcatggagtggctgagatccgttgatctagctgagtatgctcccaacctcagaggcagtggcgtgcatggtggcctgatcatactggagcctcgttttacaggggataccctggctatgctgctgaatattcctccgcagaagacattacttagaagacatctgacgaccaagttcaatgcccttataggccctgaggcggagcaagaaaagagagaaaagatggcctcgcccgcctacacacctctaaccactacagccaaggtccgcccgcgcaaattaggtttctcacacttcggcaacattaggaaaaaaaagtttgacgaatcgaccgactacatttgtcccatggagccttcagatggcgtgtccgactcacatcgtgtctattcaggatatcgagggctctctcctctggacgcccccgagttagatggtctcgatcaggttggtcaaatatcgtag

SEQ ID NO: 32860 - DNA, 213 bp, Artificial Sequence
  Description of Artificial Sequence: Synthetic coding sequence
atggccagcgacgcaagtcacgcattggaggcagctttagagcagatggacggcatcattgccgggacaaagacaggggcagacctgtccgacggaacttgtgaacctggtttagcgtcacctgcttcctacatgaacccctttccggttttgcatctgatcgaagacctccgtctggcactggagatgctggagttgccacaggagcgctag

SEQ ID NO: 32861 - DNA, 270 bp, Artificial Sequence
  Description of Artificial Sequence: Synthetic coding sequence
atggcgtccgatgcctcccacgctctcgaagccgcccttgaacagatggatggcataatcgccggaactaaaacaggggcagatctctccgatggcacctgtgagcccggacttgcatccccggccagctacatgaacccctttcctgtgctgcacctcatcgaggatctgcgcttggctctggaaatgcttgaacttccacaggagagagccgcattgctctcacaaattccgggcccaaccgcggcctacataaaggaatggttctag

SEQ ID NO: 32862 - DNA, 513 bp, Artificial Sequence
  Description of Artificial Sequence: Synthetic coding sequence
atggcttctgatgcttcacacgccttagaagccgcactggagcagatggacgggattattgccggcaccaagacaggcgcagacctgtccgacgggacctgtgagcctggccttgcgtccccggcatcgtacatgaaccctttccctgtgctgcacctgattgaagacctccgactcgccctggagatgctagaactgcctcaggagagggccgcacttctttcccaaatacccggacctaccgctgcttacatcaaagagtggttcgaggaatctctgtcgcaggtgaatcatcattcggctgcaagtaatgaaacctaccaggaaaggcttgctaggttagaaggagataaggaatccttgattttgcaggttagtgtgctgacagaccaggtcgaggcacagggtgaaaagatcagagacctggaagtgtgtctggaaggtcaccaggtgaaactgaacgctgcagaagaaatgctgcagcaggagctccttagtcgcacgtccctctag

SEQ ID NO: 32863 - DNA, 270 bp, Artificial Sequence
  Description of Artificial Sequence: Synthetic coding sequence
atggcatcggatgcctcacacgccctcgaggctgccctcgagcagatggatggtatcattgccggaactaaaactggtgctgacctgtcagatggaacttgtgaaccaggccttgcttccccagccagttacatgaatccctttcccgtactgcacctgattgaggaccttaggctcgcattggaaatgctggagctgcctcaggaacgcgcagccctgttatctcagatacccggtccaacagccgcctacattaaagaatggttttag

SEQ ID NO: 32864 - DNA, 654 bp, Artificial Sequence
  Description of Artificial Sequence: Synthetic coding sequence
atgctgcaatatctgaccgttaacgacctgctgtttcttaaggtcaccagccaactccatcatctttcaattaagtgtgcgatccacgtgcttcatgttaataaattcaatccgcattgtctccacaggaggccagccgacgagtcaaacctgagtcctagcgaggtggtccagtggagtaatcaccgcgttatggaatggttacgttcagtcgacttggcggagtatgcacccaatctgcgcggctccggcgttcacggaggattaatcatcctggagcctagatttacaggagatactctagcaatgctcctcaatattccacctcagaaaacccttctgaggcggcatctaaccactaagttcaatgcgcttataggacctgaggccgagcaggaaaagagagagaagatggcctcccccgcgtacacacccctgactacaacggcaaaggtgcggccacggaaactgggcttctctcacttcggcaatatccgtaagaagaagtttgatgaatcaacagattatatttgtccgatggaacctagtgatggagtaagcgactctcacagggtgtactcagggtaccgggggctgtccccactggatgctcccgagctagatggactggatcaggttgggcagataagctag

SEQ ID NO: 32865 - DNA, 1203 bp, Artificial Sequence
  Description of Artificial Sequence: Synthetic coding sequence
atgttgcagcaggaactgcttagccgcacaagcttagaaactcagaagcttgatttgatgacagaggtttcagagctcaagcttaaactggttgggatggaaaaggagcagcgggagcaggaggaaaaacagcggaaggccgaagaactcttgcaagagctgcgccatttaaagatcaaggtagaagagttagagaacgaacgcaatcagtatgagtggaaactgaaagcaaccaaggctgaggttgcacaactgcaggagcaggtggctctaaaggatgcagagattgagcggctccactcgcagctgtccagaacagcagccctccatagtgagtcacacaccgagcgggatcaagagattcaacggttgaaaatggggatggaaaccctgctcttggccaatgaagataaggataggaggatcgaggagctcaccggactgctgaatcagtatcgaaaggtcaaggagatcgtgatggtcacgcaggggcccagtgaacgtacactctctattaacgaggaggaacccgaggggggcttcagcaagtggaacgctaccaataaggatcccgaagagctgtttaagcaggaaatgccaccccgatgtagctcccccactgtaggcccaccacctcttccacagaaaagcctggaaacgcgcgcacaaaagaagctgtcatgcagcctagaggatctgaggtcggagtctgtggacaagtgtatggacgggaaccagccatttccagtcctcgaacctaaagacagtccatttctggccgagcacaagtaccccacgctgcctggaaaactgagcggtgccacccccaacggagaggccgctaagagtccaccgacaatctgtcagcccgatgctacaggctcgagcctgttacggctgagagatacggaatccggctgggatgacactgccgtggtgaacgatctcagtagcacatcatcagggacagaatccggtccccagtccccgttgacccccgatggcaaaaggaatcctaaaggcataaagaaattttggggcaaaatccggcgcacacagtcaggaaatttctatacagatacactgggaatggccgagttcaggaggggaggtttgagagctaccgctggtccccgcctgagccggacacgagacagcaaaggtcagggactgcagtggctcccagggccacaacctccatag

SEQ ID NO: 32866 - DNA, 2277 bp, Artificial Sequence
  Description of Artificial Sequence: Synthetic coding sequence
atggacggggacatagacgtctacaagcacttttcttggttaaagcgttctcaggtcaaccatcacagcgcagcttccaacgagacctaccaggaacgtctggctagactcgaaggagataaggaatccttaatcctacaggtgagtgtcctcaccgaccaggtagaggctcagggtgaaaaaattagagacctggaagtgtgcctcgaagggcaccaggtgaagcttaacgccgctgaggaaatgctgcaacaggaactgctttcacgtacttccctggagactcagaaactggacctgatgacagaggtgtctgaactgaagctgaagctggtaggtatggagaaagaacagcgggaacaagaagagaagcaacgcaaagccgaggagctgttgcaggagcttagacacttgaagattaaggttgaggagctggaaaatgagaggaatcagtatgagtggaaactcaaggcaaccaaagccgaggtggcccagctacaggagcaggtcgctctgaaggacgctgagatcgagcgactccacagtcagctgagccgtaccgccgcattacattccgagtcacatactgaacgagatcaggagatccagaggctaaagatggggatggagaccttgcttctggcaaatgaggataaggaccgacggatagaggagttaactggactcctgaatcagtacaggaaggtgaaggagattgtgatggtgacccaagggcccagcgaacggaccctatctattaatgaggaggagcccgagggcggcttttcaaagtggaacgccacaaataaggatcctgaagaactgttcaagcaagaaatgccgccgcgctgctcctcgccaactgtaggtccaccaccactcccccagaagagtctggaaactagagctcagaagaagcttagctgtagcctggaagacttgcgttcagaaagcgtggataagtgcatggacgggaatcaacctttccccgtgcttgagcccaaagacagtccgtttttggctgaacataagtaccccacactgcctggaaagctcagcggcgccaccccgaacggagaagcggcaaagtcccctcctactatttgtcagcccgatgcaacaggaagctcccttctgcggcttcgcgataccgagtcaggctgggatgacaccgccgtggtgaatgacctgtctagcacatcaagcggtacagaatctgggccgcagagtccccttacgcctgatggcaagcgcaacccaaaggggatcaagaagttttggggaaaaatcaggagaacccagtccggaaatttctataccgacacactaggaatggcggaattccgacggggcggcttgagagcgacagcaggcccgcggctatcccggactagagactcaaaaggccagaagagcgacgctaacgctccctttgcgcagtggtcaactgaacgagtctgcgcttggctggaagattttggcttggcacaatacgtaatctttgctagacaatgggtctccagcgggcacaccctcctcaccgctacaccacaggatatggagaaggaactgggaattaaacatccactgcatagaaagaaactcgtgctggctgtgaaagcgatcaatacaaagcaggaggaaaagagcgccttgcttgatcatatctgggtgaccaggtggttggatgacataggcctcccccagtacaaagatcaatttcacgagtccagagtcgatcgcaggatgcttcagtatcttactgtgaatgaccttctgttcctcaaagtgacatcccagctgcaccacctctccattaaatgcgccatacatgtcctacatgtaaacaagtttaatccccactgcctgcaccggagaccggcagatgagagcaacctttctccatctgaagtagtccaatggagtaaccatcgggtaatggagtggctgcggagcgtggacttagccgagtacgctcccaacctccgtggtagcggcgtacatggcggcttaataattctggaaccaagatttacaggcgacacactcgccatgttgcttaatatccccccacaaaaaactctgcttcggagacacctgactacaaaattcaatgctctcataggccccgaggctgagcaggagaaaagagagaagatggcaagccccgcctataccccgcttaccaccaggtgggacaggttggcagacgccctggtgacatgtccgctttgcactctgagggcgcacagcaacaccgtctgtgttacaatatag

SEQ ID NO: 32867 - DNA, 411 bp, Artificial Sequence
  Description of Artificial Sequence: Synthetic coding sequence
atgatggaccaagaggagaagaccgaggaggggtctggcccatgtgctgaagccgggagtcccgaccaggagggtttttttaatttgctaagccacgtacaaggcgacagaatggagggccaaaggtgtagtctgcaggccggcccagggcaaaccacaaagagccaaagcgaccctacaccagagatggatagcttaatggatatgctggcatccactcaaggtcggaggatggatgaccagagggtgacggtgtccagtttgcccgggttccagcccgtggggagtaaagacggcgcgcagaaacgagccggaacactctccccccaaccactattgacccctcaagacccgacagcactgggattcaggagaaacagctctcctcagcctcctacccaggctccgtag

SEQ ID NO: 32868 - DNA, 207 bp, Artificial Sequence
  Description of Artificial Sequence: Synthetic coding sequence
atgtctgagctcaacactaaaaccagccccgcgaccaatcaagccgctggtcaggaggagaaaggaaaagcagggaatgtcaagaaagccgaggaggaagaggagatcgatatcgacctgactgctccagagaccgaaaaggccgccctggctattcagggcaaatttcgcagattccaaaagaggaagaaggacccaagtagttag

SEQ ID NO: 32869 - DNA, 1437 bp, Artificial Sequence
  Description of Artificial Sequence: Synthetic coding sequence
atgtggctggcggccgctgctcccagtctcgctcgaagactgctgttcctgggcccaccccccccaccccttctgttgttggtgttttcccgatctagtagaagacgcctccactccctgggactcgcagcaatgcctgagaaaagaccctttgaacgactgcccgccgacgtcagccccataaattgctccctgtgtcttaaaccggatcttttggattttacttttgaaggaaaacttgaggctgcagcccaagtgagacaggccactaatcagattgttatgaactgtgcagatattgacattatcaccgcttcctatgcccccgagggcgatgaagagattcacgccacaggtttcaattatcagaatgaagatgaaaaggtgaccctgtcatttccatcaacgctccagacaggaaccggcaccctcaagattgactttgtaggcgagctgaatgacaagatgaagggcttttaccgatcgaagtacactactccatctggtgaggtgcgttacgcagctgtaacacagttcgaagccactgacgctcgacgggcattcccatgttgggatgagccagcaattaaggcgacttttgatatcagtctggtagttcccaaagatcgggttgccctgagcaacatgaatgtaatagatcggaagccataccccgatgacgaaaacttagtggaggtaaaatttgctagaacacccgtgacgtcgacatatttggtggcctttgtcgtgggtgagtatgacttcgtggagactcgcagcaaggacggtgtttgcgtgtgtgtgtacacaccggtcggcaaggctgagcagggaaaatttgcaatcgaggtggcagcgaagaccctgcccttttataaagactatttcaacgtaccatatccactccctaagattgatctaattgccatagcagactttgccgctggagccatggagaactgggacctcgtcacataccgcgagaccgccttgttaattgacccaaaaaattcctgttcatccagccggcaatgggtggctctggtggtagggcatgagctcgcacatcagtggtttggcaacctcgtcaccatggaatggtggactcacctctggctgaacgaggggttcgcatcttggatagagtacctgtgtgtggatcactgctttccggaatatgatatctggactcagtttgtgagcgccgattacacccgcgcacaggaactcgatgctctcgacaacagccaccccatcgaggtttccgtcgggcacccttccgaggtggacgagatctttgacgcgattagttactctaaaggtgcctcggttatcagaatgttgcacgattacattggggacaaagactttaaaaagggtatgaacatgtaccttacgaagtttcagcagaagaacgccgcagcaggaaacttgtag

SEQ ID NO: 32870 - DNA, 975 bp, Artificial Sequence
  Description of Artificial Sequence: Synthetic coding sequence
atgaaggggttctaccggagcaagtacacaacgccctcaggggaggtccgctatgctgccgtgactcagttcgaagccacggacgcaagacgtgcatttccatgttgggatgaacccgctattaaagcgactttcgacatctctctcgtggtgccaaaagaccgagtggctctgtctaacatgaacgtcattgatagaaagccataccccgacgacgagaatttggtggaggtaaagtttgctagaacacctgtgaccagcacctatctggtcgcattcgtcgtcggcgagtatgacttcgttgagactagatctaaggacggagtatgcgtctgcgtgtacacccccgtgggcaaggcagaacagggaaagtttgccattgaggtagcagcaaagactctcccattttataaggattacttcaacgtaccatacccccttcccaagatcgatttgatcgctatcgccgattttgccgccggcgctatggaaaactgggacctcgtgacgtacagggagaccgcactgttgatagatccaaagaactcttgctcaagctcacgacaatgggtggccctcgtggtgggacatgagctcgctcaccagtggtttggaaacctggttacaatggagtggtggacccacttatggttgaacgagggctttgcttcatggatcgaatacctgtgcgttgaccattgttttccggagtatgatatctggactcagttcgtgtcagcggattatacccgggcccaggagctcgatgcactcgataattctcatcccatcgaggtctctgtgggccaccctagcgaggtggatgaaatttttgatgctatctcgtactctaagggcgcctctgtgattaggatgctgcatgattatataggggataaggattttaagaagggaatgaatatgtatctcacaaagttccagcagaaaaacgcagcagcagggtggacctggtag

SEQ ID NO: 32871 - DNA, 729 bp, Artificial Sequence
  Description of Artificial Sequence: Synthetic coding sequence
ctggtcaaaacagcaaaactcgggacaagttggaattatctatttgattttcacccacaccgcgttcttgtggtgggcgcgtttgctaacttctgtacggaacccacaggctgctcctgcctgttcccaaagctccccccccatcttcttatgctcccatgctggtttcatctgctcttctttcaggattatatcatgtctggagcttccgcactccccccaggattagtgtcctttgttaaggcccctctgccccagtggtggcctggtggatgtccaggcgtcggcgggccgctgcaagctctggaggcgaagcctggccaactgtctctaccgatacggaatcagaagcgcctcgtgaaatctgcgctggagttaggggaaaacgagctctttcaacaatttcccaacccacagagctcatgggttcagagaactcaggaggcactccgacctctgctatctgtagccctgcagctattcctcggtaggaggggcctcccactgccattccgtgcccccattcgtaccgtcgtgggttctgctattcctgtgcagcagtctcccccccccagtccagcccaggtcgacacccttcaggcccgctatgtaggtagactgacacagctgttcgaagaacatcaggctcgatacggggtgcccgcagacaggcatctggtgctgacggaggcacgcccaacagcttggccacgtctgagcgcaggttag

SEQ ID NO: 32872 - DNA, 1419 bp, Artificial Sequence
  Description of Artificial Sequence: Synthetic coding sequence
atggctggtggagaagctggcgtgacccttgggcaaccccatttaagcaggcaggatcttaccactctggacgtaaccaaactcaccccactatcccacgaggtgataagccgccaggctaccattaacattggcaccattggccatgtagcccatggaaagagtactgttgtaaaggccatctcaggagtgcacactgtacggttcaaaaacgaattggagagaaacatcaccattaaactcggctacgcaaacgccaaaatctaccaactggacgatccttcgtgtccgcggcctgaatgttaccgatcctgtggctcctccatgcccgatgagttccccacagatatccctggtacgaagggaaacttccggctggtcaggcatgtgtcctttgtggactgccccggacacgatattctgatggcaactatgctaaatggggcagcagtcatggatgcggcattgctgctaatcgcaggaaatgagtcctgtcctcagccccagaccagcgaacatctcgcagcgatcgagatcatgaaactgaagcatatactgatactgcaaaacaaaattgacctcgtgaaggagaggcaggccaaggaacaatacgagcagattctagcctttgtgcagggcacagtcgcagagggggcccctatcatccctatcagcgcccaactaaagtataacatcgaagtggtgtgcgagtatatcgtgaagaagattcccgtcccgccccgagacttcacgagtgagccaagacttattgtcattaggtccttcgatgtgaataagcctgggtgcgaagtggatgatctcaagggcggagtcgcaggagggtctatcctgaaaggcgttttgaaggtgggacaggaaacagaagtaagacctggtatcgtatcaaaagattcggagggcaaactaatgtgtaagtccatttttagcaagatcgtttctctttttgctgagcataatgacctccagtacgcggcacctggtgggctgatcggtgtcggaacaaaaattgacccaactctgtgtcgcgccgatcgcatggtgggccaaatactgggcgccgtgggcgcattaccagaaatcttcacggagctggaaatttcttacttcctgctccgccgcctgctgggcgtgcggacagaaggggataagaaagccgcaaaggtgcagaaactatctaaaaatgaggttctgatggtaaacataggttccctctctactgggggtcgcgtgagtgccgtaaaagctgacctggggaaaatagtgttgacaaacccagtatgcaccgaagtcggggagaaaattgcgctctcaaggcgtgtcgagaaacattggagactcatcgggtggggccaaatccgccggggcgtaacgattaagccgacagtggatgacgattag

SEQ ID NO: 32873 - DNA, 543 bp, Artificial Sequence
  Description of Artificial Sequence: Synthetic coding sequence
atggaagaggccggactttgcggactccgtgagaaagccgacatgctgtgcaatagcgagtcacacgatatcctgcagcatcaggattcaaattgtagcgccactagcaacaagcacctgttggaagacgaagagggtcgcgacttcattaccaaaaatcgatcttgggtgagcccagtacactgtactcaagaatctcggagagaactacccgagcaggaggtggctccacccagcgggcaacaggccctccagcaacaagagcagaggaagtccttacgcaaacggagcttcattattgatgcaagcccaaagcactttcgactgcagcgtcgtagctggcagctctctgtccgaaatatgctcatactggagattcacttgttctatcgtagggtgtgcttcgagctgtatgatcttaagcagaacagtttttttggggactatggcaacatactgaatcgcgagacactgttggactttgtaaaacagatcatggagaaaattcagaatttcctgaagaaccacgggaagtttctctag

SEQ ID NO: 32874 - DNA, 396 bp, Artificial Sequence
  Description of Artificial Sequence: Synthetic coding sequence
atggaggaagctgggctctgtgggctccgcgagaaggccgacatgctctgtaactcggagagtcacgacatcctccagcaccaagatagcaattgctctgccacctccaacaagcacctgctggaagacgaagaaggaagggacttcattactaagaacaggagctgggtctccccagtgcattgcacccaggagagccgacgcgagcttcctgagcaagaggtcgcaccaccaagtggccagcaggccctccagtgcaatagaaataaagagaaggttttaggaaaggaggtccttcttttaatgcaagcacttaatactctcagcacacctgaagagaagctggcggccctctgcaagaaatatgctgaccttggaaacagcccactgctctag

SEQ ID NO: 32875 - DNA, 423 bp, Artificial Sequence
  Description of Artificial Sequence: Synthetic coding sequence
atggaggaggcaggactttgcggcctgcgcgaaaaggccgacatgctgtgcaatagcgagtcacatgacatcctacagcatcaagactctaactgtagcgccactagcaataagcatctgctggaagatgaagaaggccgcgactttatcaccaagaacagatcctgggtttctccagtgcactgtactcaggagagccgtcgggaactgcccgaacaagaggtcgcccccccttctggacagcaggctttgcaatgcaacaggaataaggaaaaagttctgggcaacaatctctgcagcgtggtcgggtgctgccatattttagtgttcctgttttacatattttgttcgatgtcagattacgagctcggtctgtttggaggaaagtgctgccttgtaaacctttttcttcatcttgtgtag

SEQ ID NO: 32876 - DNA, 513 bp, Artificial Sequence
  Description of Artificial Sequence: Synthetic coding sequence
tgaacgagttggagacggggagaggtcacccccagacgaggctccggaggaggtgctaaaacaattggcgccaagcaaggtcgaacccaactgtccagtggcttcgtgaactctactatggaggaagccgggctgtgcggtctgcgcgagaaggctgatatgctgtgtaattctgaatctcacgacatcctgcagcatcaggattccaactgctccgcaaccagtaacaagcacttattagaagacgaggaggggcgggactttattaccaaaaacaggagctgggtttctcctgtacactgcacccaggaatccagacgtgaacttcctgaacaagaagtggcaccaccttcggggcagcaggccctgcaatgtaatcggaataaagaaaaggtgctgggaaaggaagtgctgctgttaatgcaagctctgaatacattatctacacccgaggagaagctggccgccctgtgcaaaaagtatgccgatctcggcaactcccccctgttgtag

SEQ ID NO: 32877 - DNA, 396 bp, Artificial Sequence
  Description of Artificial Sequence: Synthetic coding sequence
atggaggaggcaggtctttgtggactacgagaaaaagccgatatgctctgcaattccgagtcccacgacatcctacagcaccaggattccaattgctccgccaccagtaataagcatctgctcgaggatgaagagggccgggacttcatcaccaagaatagatcctgggtgtctcctgttcactgcacccaggaaagtcggcgggagctgcccgaacaagaggttgccccccctagtggccagcaggctctccagtgcaaccggaataaggaaaaagtcctggaaaggcaaggactcagtctgtcacctcgactggagcgtggaggcaccttcatgggacacggatccctgaagctgccagagctcgtgatcctgtccctgcagacactggagtag

SEQ ID NO: 32878 - DNA, 546 bp, Artificial Sequence
  Description of Artificial Sequence: Synthetic coding sequence
atgaagcaggaggaggcacagctgaaagaacaattgttcctctacatggataaattcgaggaattccagactactatggctaaaacaaacgagctattcacggcattcaagcaggagactgaaaaactcaccaagaaaattaagaagctggagaaggaaatggtgatatggtacaccaaatgggagaacaacaataccaccctgctgcagatggctgaggagaagaccattcgcgacaaaaattataaggtttttcaaattaagctggagaggctggaaaaactctataaagccctgcaaatcgagaggaacgagctgtccgagaagttaggaatcctcaaggggcaggtcagcgttaaagtggctgacgtggacctcgccgtgcctgtgacccactcatgcgccgatctagattcctctaacatgttaaatacttctagtaaacgagcgcccggggtgcatctggaagccgaccctaagggaatgaacgaggtgaaatgctattccaaagccctaagcactggcagccccctggggatcgattag

SEQ ID NO: 32879 - DNA, 546 bp, Artificial Sequence
  Description of Artificial Sequence: Synthetic coding sequence
atgaagcaagaagaagcccaattgaaagagcagctgttcctttacatggacaagttcgaagagtttcagacaactatggctaagaccaatgaactttttactgctttcaaacaagaaacagagaagctaacgaagaagatcaaaaagttagaaaaggagatggtgatctggtacaccaaatgggagaacaataacactacgctgctccaaatggccgaagagaaaaccattagagacaagaattataaggtcttccagattaagctggagagactagaaaagctgtacaaggcattgcagatcgaacgtaatgagctctcagagaaattgggaatccttaaaggccaagtgtcagtcaaggtggccgacgttgatttggctgtccctgtgactcatagctgcgcagatttggacagctccaatatgttaaacacctccagcaagagggcacccggcgttcacctcgaggcagatcctaaaggcatgaacgaggttaagtgctatagcaaagctttaagcactggctctcccctaggaattgactag

SEQ ID NO: 32880 - DNA, 792 bp, Artificial Sequence
  Description of Artificial Sequence: Synthetic coding sequence
atggacagggccaagcagcagcaggcacttctgctgttgcctgtgtgtctcgccctgacgttttcccttaccgcggtggtgtcttcacattggtgcgaaggaactaggcgggttgtgaagcccctgtgccaggatcagcccggggggcagcattgtattcactttaagagggataactcctccaatggaagaatggataacaattcacaggccgtgctgtacatctgggagctaggcgatgataagttcatccaaagaggattccacgtgggcctctggcaatcctgcgaggaatcactcaatggcgaggacgagaaatgccggtccttcaggagtgtagtgcccgccgaggagcagggagtcttgtggttatcaattggcggagaggtgctggacattgtcctcattctcacctctgctatattactcggttcacgtgtaagctgccgctcacccggattccattggcttcgtgtagacgccctcgtggcgatcttcatggttttggctggtctcttgggcatggtagcccatatgatgtacacgactatttttcaaatcacagtaaacttgggccccgaggactggaaacctcaaacctgggactatggctggagctactgtctggcttggggctccttcgccctgtgtcttgccgtctcagtgtccgctatgtcccggtttactgccgcccggctggagttcacggagaagcagcaagcccagaacggctcgcgacactctcagcactcatttctagagccagaggccagtgaatcaatctggaagtag

SEQ ID NO: 32881 - DNA, 888 bp, Artificial Sequence
  Description of Artificial Sequence: Synthetic coding sequence
atggcggaagagacccagcataataaattggcagccgcaaagaaaaagctgaaggaatactggcagaagaaccgaccccgagtgcccgccggggtgaatcggaaccgtaagaccaatggatcaattcccgaaaccgcaacttccggtggatgtcagccccctggtgactcagccactggcttccatcgggaggggccaacgagcagcgcaacactgaaggacctcgagagcccatgccaggaaagggcggtggtccttgattcaactagtgtcaagattagtcgcctgaaaaacacaatcaagtcgttaatctgtacacttaagaaggagaaacagcaggacatgagaagagtcgaggaactggaaagaagcctgagtaagctgaagaatcaaatggccgagcccctaccccccgaaccacctgctgtaccatctgaagttgaactccagcaccttcggaaagagcttgaaagggtagctggggagcttcagtctcaggtcaaaaacaaccagcacatctccctcctgaaccgaaggcaggaagaacggatcagggaacaagaagagcggctgaggaaacaagaagaacgcctgcaagaacaacacgagaaactccgacagctggcaaaaccccaaagcgtgttcgaggagctgaacaatgaaaataagtctacccttcagcttgagcagcaagttaaggagctgcaggagaagctgggtgaagtcaaagagactgagactagtactccctctaaaaagggatgggaggctggttcctccttactggggggcgaagttccaggacagcgtcagctcccagcttggggcctcgttacgactgcaccgcgccgtgcagtgttgagactcttcctggccagttgcctgtag

SEQ ID NO: 32882 - DNA, 888 bp, Artificial Sequence
  Description of Artificial Sequence: Synthetic coding sequence
atggctgaggaaacccaacacaacaagttggccgcagccaagaaaaagttgaaggaatactggcagaaaaacaggccccgcgtcccagctggcgttaacaggaaccggaagacaaacgggagtatcccagagaccgcgaccagcggaggctgccagcctccaggcgatagcgccacagggttccaccgggagggtccaacaagcagcgccaccctgaaagacctggagagcccatgccaggagcgcgctgtggttctggattccacatctgtcaagattagcagactcaaaaacaccatcaaatcgcttatctgcaccttgaagaaagagaagcagcaggacatgaggcgggtcgaggagctggaacggagtttgagtaagctgaaaaaccaaatggccgagccactccctccggagccaccagcggtcccttcagaggtcgagttgcagcacctacgtaaggagctcgaaagagtggcaggcgagctgcagtcccaggtaaaaaacaatcagcacatctccctgttaaatcggcgccaagaggaacggattagagagcaggaagagcgcttgcgaaaacaggaagaacgcctgcaggaacagcatgagaaactccgacagctggcgaagccacagtccgtgttcgaagaattaaacaacgaaaacaagagcaccttacagctggaacaacaggtgaaggagctgcaggaaaaactgggggaggtcaaggaaactgagacatcaaccccttcaaaaaaaggctgggaagcaggaagcagcctgctgggaggtgaggtccccggccagaggcaactgcccgcatgggggctggttaccacagcccccaggcgtgcagttctgcgtctgttcttggcttcttgcctatag

SEQ ID NO: 32883 - DNA, 720 bp, Artificial Sequence
  Description of Artificial Sequence: Synthetic coding sequence
agtgccactggttttcatagggagggaccaaccagttcggcaacgctgaaagatctggagtcaccatgtcaggaacgggccgtggtgctggatagcacaagtgtgaagatttccagactaaagaacacaatcaaatctctcatctgtactctaaagaaggaaaagcagcaggacatgcggagagtagaagagctggagcgatctcttagcaagttgaaaaatcaaatggccgaaccccttcccccagagcccccagctgtcccttccgaggttgaacttcagcacctgcgcaaagagctcgagagggtcgcaggtgaactgcaatctcaggtgaagaacaatcaacacatctcactgctgaataggaggcaggaggagcgaatccgggaacaggaggaacgcttgaggaagcaggaggagaggttacaggagcagcacgagaagctcagacagttggccaaacctcagtccgtatttgaggaattgaacaatgagaataagtctactctacagctggaacagcaagtgaaggagcttcaggagaagttgggggaggtcaaagaaaccgagacatccaccccgtcaaagaaaggctgggaagctggttcctcactgttggggggcgaggtccccggccagcggcagctcccggcatggggactggtgaccacggctccaaggagagcagtgttgcgactgttcctcgcgtcttgcctatag

SEQ ID NO: 32884 - DNA, 1899 bp, Artificial Sequence
  Description of Artificial Sequence: Synthetic coding sequence
atggcggaggaaacccagcataacaaactcgctgcagcaaaaaaaaagctgaaggaatattggcagaaaaatcgccccagagtgcctgcgggcgtcaaccggaacagaaagactaacggatctatccctgaaacggcgacgagtggcggatgccagccacctggtgactctgctactggctttcacagggagggacccacatcttcagcaactctcaaagatctcgaaagcccttgtcaagagagggcagtggtactcgacagtacttccgtgaagatatcgcgcctgaagaataccatcaagtccctgaagcagcaaaaaaaacaggtggagcaccagttagaggaggagaagaaggctaacaacgagcgccagaaagccgagcgggagctggaagtgcagattcaaaccctgatcatccagaaggaagaactgaacactgacctctaccatatggaacggtcgctccgttattttgaggaggagagcaaagatctggctgttcgcctgcaacacagcctccagtgtaagggcgaattggaaagcgcactatccgccgtgatcgctaccgaaaagaagaaggcaaatcagctcagctcctgctcaaaagcccacacagagtgggaactggaacagtcgctccaggatcaggccctcctcaaagctcaacttacccagctgaaggagtccttccagcagctgcaactagaaagagatgaatgcgcagagcacattgaaggtgagagggctaggtggcaccaacgcatgtccaaaatgagtcaagaaatttgcacgctgaagaaggaaaaacagcaggacatgcgaagggtcgaagagttggagaggtcattatctaagcttaaaaatcaaatggccgaaccgctcccccccgagccacctgccgtcccttcggaagtcgaactccaacacctgaggaaagaactggagagggtggctggtgagctccagtcacaagtcaagaacaaccaacacattagcttgctgaaccgacgccaggaggagaggatcagagaacaggaggagcgcttacgcaagcaggaagagaggctccaggaacagcatgagaagcttcgacaactggcaaagccgcaaagcgttttcgaagaacttaacaatgagaataagtctacactgcaactcgagcagcaagtgaaagagctgcaggaaaaactcggtgaggaacacctggaagccgcatcccaacaaaaccagcagcttaccgcgcaactcagtcttatggcgctgccaggggagggccacggtggggagcatcttgacagcgaaggggaggaggcaccccagcccatgccttctgtgcctgaggatcttgagtccagagaggctatgtccagcttcatggaccacctgaaggaaaaggcagacctgtcagagctcgtgaagaaacaggagctgcgcttcatccagtactggcaggagcggtgtcaccagaaaattcaccatttgctgtccgaacctggtggaagggcaaaagatgccgccctgggtggaggccatcatcaggcaggtgcacagggtggagacgaaggggaggctgctggggccgcggccgatggaatagccgcctatagcaactacaacaatggccacagaaaattcttagccgccgctcataactctgccgatgagcctggaccaggagccccggccccccaagagcttggcgcagctgataaacacggcgacctgcgggaggtaactcttacctcctccgcgcagggggaggcccgcgaggatccacttctggacaaacctactgctcagcctattgtgcaggatcaccaggagcatcccggcctggggtcgaactgttgtgtgcccttattttgttgggcatggctgccacggcgaaggcggtag

SEQ ID NO: 32885 - DNA, 1899 bp, Artificial Sequence
  Description of Artificial Sequence: Synthetic coding sequence
atggccgaggagactcagcacaacaagctggccgctgcaaaaaaaaaactgaaggaatattggcagaagaatagaccacgggtccccgccggggtaaatcggaatcgaaaaacaaacggttcaattcctgagacggcaacgagcggtggatgtcagccccccggagattccgccacgggctttcacagagagggaccaactagtagtgcgaccctgaaggacctggagagcccttgtcaggagcgcgcagtcgtgctagacagcacgtcggtaaagatatcccgactgaagaataccattaaaagtctaaagcaacagaagaaacaggttgagcaccagttggaggaggagaagaaggcaaataatgaaagacagaaagccgaacgggagctggaggtgcaaatccagactttgattatacaaaaagaagagctgaacacggacctatatcatatggagaggagcctgcgatactttgaggaagagagtaaggacttagcagttcgcctacagcatagcctgcagtgcaagggtgagctcgagtctgccttgagcgctgtcatcgccacggagaaaaagaaggccaaccaactgtcatcctgctctaaggctcacaccgagtgggagctcgagcaatcgctgcaggaccaagctctgttaaaggcccagctgacacagcttaaggagtcattccagcaactgcagcttgaaagagacgagtgcgcggagcatatagagggggagagggctcgctggcatcaacggatgtctaaaatgtcgcaagaaatctgcacactgaagaaagaaaagcagcaggacatgcggcgcgtagaagagctcgagcgaagcctgtccaagctgaagaatcagatggccgaaccactacccccagaacccccggctgtcccgtccgaagttgaactgcaacatctgcgcaaggaactggaacgcgttgccggggagctgcagtctcaggttaagaacaaccagcacatcagtctgcttaataggcgacaagaggagcggatacgagaacaggaggagcgcttgcgtaagcaggaggaaagactccaggagcagcatgagaagctgcggcagcttgccaagcctcagtcagtatttgaggagctgaacaatgagaataaatccacactccagcttgaacagcaagtgaaagaactacaagaaaaactgggcgaggagcatctggaagccgcctcgcaacaaaaccagcagctgactgcccagctttcactgatggctctgcctggagagggccacggcggggagcatttagactctgaaggcgaggaggcacctcgccctatgcccagcgtcccggaggatcccgaaagtcgtgaggcgatgtctagcttcatggaccacctgaaggagaaagccgacctctctgagctggtgaagaagcaggagctgagatttatccagtattggcaggaaaggtgtcatcagaagatccaccacctattgtctgagcccggaggacgggccaaagacgccgctctagggggtgggcatcaccaggcaggcgctcagggaggggacgagggggaagccgcgggagctgcagcggacggtattgctgcttactctaattacaacaacggtcacaggaagtttttagcggcagcacataactcggcagacgaacccggccccggcgctccagctccacaggagttgggcgcggcggataaacatggtgacctgcgggaggtgactctgacttccagtgcccagggagaagcacgagaagaccccctcctggacaagcctaccgcccagcctatcgttcaagatcaccaggagcaccctggcctcgggtccaactgctgcgtccctctgttctgctgggcttggctgccaagaagacgaaggtag

SEQ ID NO: 32886 - DNA, 690 bp, Artificial Sequence
  Description of Artificial Sequence: Synthetic coding sequence
atggatatgggcactagtgctctgtcgaaaaaaccctggtggacattacctcagaacttccacgcccctatggtatttcatatggaggaagatcaggaagagcttatttttgggcacggagatacctacctgagatgtattgaagtgcattcccacaccttaatacaacttgagtcctggttcaccgcaaccggtcaaacaagagttaccgtcgttgggccacaccgggcacgacagtggctcctgcatatgttctgctgcgtcggatcacaggattcttatcaccatgccagaggcggcagcacagcctggccatgggaaagagtgttgtccgccaggtcacgcggaggcccctgcccaaaaacctttattcttcagtggtgcagtacatggaaacggacgcgtaggtcctcctcaagcgatcttatgacgcgcacgttcgcagccctctcatgtaccgctactcctttattctcctggtgtttcacagctacaggacagacaagagtgaccgtggtcgggccacctatggctaaacaatggctgctgctcatgtttcattgtgtggggagccaggactccaagtgccatgccagggggctcaagatgctggagagggtgcgtagccaacccttgaccaacgacgacctggtgacctctgtttccctgcctccttatactggagactag

SEQ ID NO: 32887 - DNA, 492 bp, Artificial Sequence
  Description of Artificial Sequence: Synthetic coding sequence
atgagttcctgccctgtccatgattgcccttcttgggatcctgagcgattagagcctgttgagactggcagcaggggggctctcagactcaggggcggggcccccggcagtgccgcgggttttcgggcctccatctgggggccagctggttacccatctccagtcggactgggtcaccctgcctctctcccaagacccgcttactcaccccgttgtcctgagcccgacgccagacacgggtggggctcgggctcgaacgccggctacagggggcccgatcgggccggcacaccttgtcctgcccaggatagggaaggaagatctagctctccagtgccccctccccggctgaaagctatgaccagtcaggcccgtaagcagaacggtggagccctgattgacactgtagattggactcgggaggcccccgatagcgacccggtcatgagtatgcagaaaacccagaagcctcagacaacagtaggccaatag

SEQ ID NO: 32888 - DNA, 591 bp, Artificial Sequence
  Description of Artificial Sequence: Synthetic coding sequence
atggatcacgaggctgcccagctggagaaacagcacgttcataatgtttacgagtcaactgcaccctatttttccgatctccagtctaaggcctggccacgagtccggcagtttctccaggagcaaaagccgggatccctgattgcagatatcgggtgtggaaccggtaagtacctcaaggttaattcacaagtacacaccgtgggttgtgattattgtggtcccctggtggagattgcacgcaataggggttgtgaagcgatggggttagagcacccctggatctggtatccccgcgcctcctggaaccagccgccgaccgacattgagggtccgcagtatttttaccccccgtgccaccctatcccagatctccagaagcaaacgataatctgccacttcaaaggaccaactttgaatgagcaacagaaaagctcgccaactcaccatcgtctccatgcttgcttccagcattgccgcgaggaggaatcaagaccctggttgatggctctctctagctgggaccaggtagccatggaggggcatgtttctgcgtcgttgacaagctgcattgttaggctgctgctatag

SEQ ID NO: 32889 - DNA, 1365 bp, Artificial Sequence
  Description of Artificial Sequence: Synthetic coding sequence
atggaccacgaggcggctcagctagaaaaacagcatgttcacaacgtgtatgagtcaactgccccttacttcagcgacctacagtcaaaggcgtggcccagggtgcgccaattcttgcaggagcagaagcccggcagcttaattgccgatatcggctgcgggaccgggaaatatctcaaggtgaatagccaagtgcacacagtgggatgcgactactgtggccccctggtggagattgcccgcaataggggatgtgaggcaatggtctgtgataatttaaacctgccttttcgagacgaaggctttgatgcaatcatatcaatcggagtgatccatcacttcagcaccaagcaaagacggattcgcgccattaaagagatggctagggtgctggtgccagggggccagctcatgatttatgtctgggctatggagcagaagaatcgtcactttgaaaaacaggacgttctggtgccctggaaccgcgcactctgctcacagttgttctcggaaagcagccaaagcgggagaaaaaggcagtgcggctacccagagagggggcacccatatcaccctccctgttcagaatgttcctgtagcgtatgcttcaaggagcagtgtggcagcaaaaggtcacattcggtgggttacgagcctgccatggctaggacctgcttcgccaatatttctaaagaaggggaggaggagtacggattttacagtaccctcggtaagagttttcgatcttggttcttttcacggagcttagacgaatccacactgcggaagcaaatagaacgggtgaggccgcttaagaacactgaggtgtgggcatctagtaccgtgaccgtacagcctagcagacatagtagtcttgatttcgatcatcaggagcccttttccacaaaaggtcagtccctcgacgaggaggtttttgtggagtcctcgtccggtaaacacctggaatggctgcgagccccagggaccctcaaacaccttaacggcgatcaccagggagagatgagacgaaatggaggcggcaattttctggatagcacgaacactggagtcaactgtgtcgatgccggcaacatcgaagacgacaatcccagtgccagtaagattctgaggcgcattagtgctgtggatagtacggattttaatccagacgatactatgagcgttgaagaccctcagactgatgtattggattcgacagcctttatgaggtattatcacgtatttcgggagggagagttgtgctctctcctgaaggaaaacgtgtcggagctccgaatactgtcgtctggtaacgatcacgggaactggtgtatcattgccgaaaagaagcggggttgtgactag

SEQ ID NO: 32890 - DNA, 1104 bp, Artificial Sequence
  Description of Artificial Sequence: Synthetic coding sequence
atggtctgtgacaatctgaatttgccctttagggatgagggctttgacgcaatcatcagtattggagttattcaccacttttcaaccaaacagcgccgcatcagagccatcaaggaaatggccagggtgctggtcccaggtggccaactcatgatatacgtgtgggcaatggaacagaagaaccgccatttcgagaaacaggatgttctggtgccctggaatagggcattgtgttcgcagctgttttcagagtctagccagagcggtcgcaaacgacagtgcgggtaccctgaaagaggccatccgtaccatccaccatgctccgaatgctcttgcagcgtctgctttaaagaacagtgtggaagcaagagatcacattcagtgggctacgagcccgccatggctagaacctgctttgccaacatcagtaaggagggtgaagaagaatacgggttttacagtaccctggggaagagcttccggagctggtttttctcgcggagtctcgatgaatccacattgcggaagcaaattgagagggtgcgccctctgaagaacacggaagtgtgggcgtcatctacggtgacagtgcaaccgtccaggcattccagcctggatttcgaccaccaggagcccttttccacaaaaggccaaagcttagacgaggaagtcttcgtggagtctagctctggcaaacacctcgagtggctgagggcccccggaacattgaagcatctaaatggggaccaccaaggagaaatgagacgaaacggaggggggaacttcctggattcaacaaataccggagtgaattgcgttgatgctggtaatattgaggacgacaatcctagcgcctctaagattctccgtaggatcagcgccgttgattcgacagatttcaaccctgatgacaccatgtctgtcgaggatccacagaccgacgtgcttgattctacggcttttatgcggtattatcacgtgttcagagagggtgaactgtgctctctgttgaaagagaacgtgtctgagctcaggattctaagctcaggaaacgaccacggcaattggtgcattatcgcagagaagaaaagaggctgcgactag

SEQ ID NO: 32891 - DNA, 2547 bp, Artificial Sequence
  Description of Artificial Sequence: Synthetic coding sequence
atggtgaagttgagcatcgtgctgacaccacaatttctctcccacgatcagggacagcttaccaaagagttgcagcagcacgttaagtcagtcacctgcccgtgcgagtaccttcggaaagttattaacactctcgccgatcaccaccacagaggcacggacttcggcggttcaccctggttacatgtcataattgcatttcccacctcctataaagtcgtcattaccctgtggattgtttatctttgggtgtccctccttaaaactatattttggtcacggaacgggcacgatggaagcaccgacgtccagcagagagcttggagatctaaccgtcgacgccaggaaggattaaggagtatctgtatgcacacaaagaaacgcgtgtcttcatttagaggaaacaagatcgtactgaaggatgttatcaccctcaggcgacacgtcgagactaaggtgagggcgaagattcggaaaaggaaggtaaccacaaagattaatcatcatgacaagatcaacgggaaacggaaaacagccaggaagcaaaaaatgttccagagggcacaggaactgaggcggagagctgaagactatcataaatgtaagatcccgccatccgcgaggaaggccctctgtaattgggttagaatggccgccgccgagcatcgccacagttcggggcttccatattggccatacctaacagcagagaccctcaagaaccggatgggacaccaaccccccccccccacccaacagcattcgatcacagataattcactctcccttaaaaccccccccgaatgcctgttgacccctctgcccccgtcagctgatgataacctgaagactccaccagaatgcgttctcactccccttccaccttcggccgacgacaatctaaaaacaccacccgaatgtctcctgacgcctttaccaccgtccgccctcccatcggcgccgccaagtgcagacgacaacttgaagacaagggccgagtgtttgctacacccactaccacccagcgctgatgacaatctgaaaaccccaagtgagcggcagttgacacccctgccaccgtcagcaccgcccagcgccgatgacaatattaaaacacccgcattccaccctcaaaggatgatcatttctagacacctgccatcagtgtcctctctgccctttcacccccagctacacccccaacagatgataatctcgcgtcacctcccatcagtctgcggcggcaggtttcatccgcagcggatgattatatctagacatctaccatccgtgtcttctcttccattccaccctcagctgcaccctcagcagatgataatctctcgccacctcccttctgtatgcggaggaaggtttcatccccagcggatgattatatctagacatctaccttccgtgtctagtcttcccttccacccgcaactccatcctcagcagatgataatttcgcgccatttgccctccgtctgtggaggtcggtttcatccacaaaggatgattattagccgccatctcccatccgtctccagcctgccctttcacccccagctgcaccctcagcagatgatcatctcacgccacctgccctctgtgtgcggaggaaggtttcaccctcagagaatgattataagtcgacacctgccctcggtgtcctcacttcccttccacccccagctccacccccagcagatgattatctcaagacaccttccaagcgtgtgcggcggacggttccatcctcaacgtatgattattagtagacatctcccgtccgtctcatctctgccattccacacacagctgcatccacagcagatgataatctctcggcatctgccatcagtgtgcggagaacgcctgaggggacctctgcccccgtctgccgacgacaaccttaagactccttcagaacgtcagctgaccccactccctccatcagctccaccttctgcagatgataacatcaagacacccgcagagagactgcgcgggcccttgcccccctccgcagatgataatttgaaaactccttccgagcggcagcttactcccctgcccccatccgctccaccctcagccgacgacaatatcaagactcctgccgaaagactccggggacccttaccaccttctgccgacgacaacctaaagacgcctccactcgcaacacaggaggcggaagcggaaaagccaagaaagcctaagcgccagcgggcagccgagatggagccaccacccgagcccaagagacgtcgagttggcgacgttgagccctccagaaaaccaaaacgacggcgtgccgctgatgttgaacctagtagccctgaaccaaagcgcaggcgcgtcggcgacgtagagccaagcagaaaacccaaaagaagacgcgcagctgatgttgagccctcgagcccagagcctaagcggaggcgtgtaggtgacgtggagccgtcgcgtaagccaaagcgccgacgggccgctgatgtggagccatctttgccagagcccaagagacgcaggttgtcatag

SEQ ID NO: 32892 - DNA, 3417 bp, Artificial Sequence
  Description of Artificial Sequence: Synthetic coding sequence
atggttaagctgtctatcgtcttgacaccccagttccttagtcatgaccagggccaactgactaaagaattacagcagcatgtgaagagtgtaacgtgcccttgcgaatacttaagaaaggtaattaataccttggctgatcatcatcaccgcggcactgatttcggggggagtccctggctgcacgtcattattgctttcccaacaagctataaagtcgtgattacactatggatcgtttacctatgggtctccctcctgaaaacaattttctggagccggaatggccatgatggctctacagatgtgcaacagagagcgtggcgaagcaaccgcagacggcaggaaggactgcgaagcatctgcatgcataccaaaaagagggtctcatccttcaggggcaataaaattgtcctaaaggatgttatcaccctcagaaggcacgtggagacaaaagtgagggctaagataaggaagcgaaaagttacgactaaaattaaccaccacgataaaattaacggcaaacggaagactgccagaaagcagaaaatgttccagagagcccaggagctgcgcaggagggccgaggattaccacaaatgcaagatccctcccagtgcaagaaaggctctctgcaattgggtccgtatggccgccgcggagcacagacattccagcggtctcccctactggccttacctgaccgctgagacactaaaaaataggatggggcatcagcccccccctccgacacagcagcacagcatcacggataacagtttatcactaaagacacctcccgagtgtctcctgacgccactgcctccctccgcagacgacaatcttaagactccgcctgagtgcgtcttaaccccgttacccccatctgcggatgacaatctgaaaactcctccagagtgtgtgctgactcctctccccccctccgccgatgacaatctcaagaccccacccgagtgtctgctaactcccctccctccatcagccgacgataagctgaagaccccgccggagtgcctgttaacacctctccctcccagcgctttaccaagcgcccccccatctgccgacgacaacctgaaaaccagggctgaatgtctgcttcatcctctgcctccttctgcagacgacaatctgaagacgccctccgaacgccagctgacccccctgcctccatccgctccaccgtccgcagatgacaatatcaagactcccgccgaaaggcttaggggtccgctgcccccgagtgccgacgataacctgaagaccccttctgagcgccagttgacccccctcccccctagcgccccgccatccgccgacgacaacatcaagacacctgccgagcggttacgcgggcctttacctccttccgcagacgataatctgaaaacaccaagcgagcgacagctgacaccccttcccccatctgccccaccttcagcagatgataacatcaaaactcccgctgagaggctgagagggcccctgcccccttcggctgacgacaaccttaagacaccctccgaaagacaactaacgcccctcccccctagcgccccacccagcgccgacgacaacattaaaacacccgctgaacgactccgaggacccctgcccccttccgccgacgacaatctgaaaactcccagtgagcgacagctgacccctctgccgcccagcgccccccccagcgccgatgacaacattaaaacccctgccgaacgattgcgaggacctctgcctcccagcgccgatgacaacctgaaaaccccatctgaaagacagcttactcccctgcccccatccgccccgccatctgccgacgacaatattaaaacaccagcttttcacccccaaagaatgataatctccaggcacttgcccagcgttagcagcctgccctttcacccccaactacatccacagcagatgataatttctcggtatctgctgagcgtctgcggctttcggttccaccatcaacccatgatcatttcccgccacctcccctctgttagctctctcccatttcacccccaattgcatccccagcaaatgatcatctcccgccacttgccaagcgtgtgcgggggaagattccaccctcaacggatgatcatttctcgtcacctgccatccgtcagctctttgccattccacccccagctgcatcctcagcagatgataattagccgacaccttccaagcgtgtgtggagggcgttttcatcctcagcgaatgattatctctagacaccttccgtcagtgtcctctctgcctttccatccgcagctgcaccctcaacagatgatcatcagtaggcacctgccttcagtttgcggcggccggttccaccctcagagaatgataatcagtcgccacctgccaagcgtttcttcgctgccctttcatccccaactgcatccacaacagatgataatttctcggcatctcccgagtgtctgcggaggaagattccaccctcagcgcatgattatttcaaggcacctccctagtgtgagcagccttccatttcatcctcagctccaccctcagcagatgatcatttctcgccatctgccatcagtgtgtggtgaaaggctgagagggcccttgccacccagtgcagatgacaacctaaagacgccatcagaaaggcagttgacccctctccctccatccgctccaccgagcgctgacgataacattaaaacgccagcagagcggttacgagggccacttccccctagcgcggacgataacctgaagactcctagcgagcgccagctgacacctcttccgccatccgctccgccatccgccgacgacaatataaaaacccctgccgaacgcctgaggggaccccttccaccaagtgccgatgacaacctcaaaacccccagtgaacgtcaactgactccccttccaccaagtgcaccacctagtgcagacgataatataaagactcctgctgagcggcttcgggggccactacccccatcagccgatgacaatctcaagaccccccccctggcgactcaggaagccgaggcagagaagcctcggaagccaaaacgccagagggccgcagagatggagccccctccggaaccaaaacgcagacgggtgggtgacgtggaacccagcagaaaaccaaaacgccgccgggccgctgacgtggagcccagtagtcctgaaccaaagcgaagacgcgtgggcgacgtcgaaccttcccggaaacctaaaagacggagagctgctgatgttgagcccagtagcccagagccgaagcgccgtagagttggagatgttgagccctctcggaagcccaagcggcgcagagccgcggacgtcgagccttcactgcccgagccgaagaggaggaggttgagttag

SEQ ID NO: 32893 - DNA, 2979 bp, Artificial Sequence
  Description of Artificial Sequence: Synthetic coding sequence
atgttccagagagcccaggaattacggagacgagccgaggactaccacaagtgtaaaattccaccctccgctagaaaagccctgtgcaattgggtaagaatggctgctgcagaacaccgccactcaagtggcctaccatattggccctacctgaccgctgaaacactgaaaaaccgcatgggacatcagccccctccgccgacccagcaacattctataacagataatagtctttccctgaagacccctcccgaatgccttctcacaccactgccgccctctgccgatgacaacctcaagacccctcccgaatgcgttctcacccccctgccccccagcgccgacgataatctgaagactcctccagagtgtgttctgacacccttacctcccagtgctgacgataatttgaagacaccacccgagtgtctgctgacccctctgcctccctcagccgacgacaagctgaaaaccccccctgagtgcctgctgaccccactaccgccttcagcactgccttcagccccacccagtgccgatgataatctgaagactagagctgagtgtctcctgcacccccttcctccgagtgcagatgataacctgaagacaccctcagaaagacagctgacccctctgccgccttcagctccaccaagtgcagatgataatatcaaaacccccgcggaacggcttagggggcccctgcctccttctgccgacgacaacctgaaaacgccctctgaacggcagttaacaccactaccaccatcagcaccccccagcgcagatgacaatatcaaaacacctgcggagcgcctcagagggcctctgccgcccagcgctgacgataatctgaagacaccgtcggagagacagctcactccacttccaccaagcgctcctccctcagctgatgacaatatcaagacacctgccgagcggcttcggggacccctccccccttctgcggacgacaatctgaagactcccagcgaaaggcaactaactcccctgcctccaagtgctccccctagcgctgacgataacatcaaaaccccagccgagcgcctgcgcggacctctacccccgtcagctgatgacaacctgaagaccccgtcggagagacaattgacaccactgccaccttcagcccctccaagtgcagacgataacattaaaacaccagccgaaagattacgcggacctctacctccatctgctgatgacaatctaaaaactccatcagaaagacaactgactcccctgcctcccagcgcaccaccctccgctgacgataacatcaagatccccgccgagcgcctgagaatacccctccccccctctgccgacgataatctgaaaaccccttccgaacgtcagttgactcctctgcctccatcggctcctccttcggctgatgataacattaagactcctgcattccacccacaaagaatgattatatccagacacttaccttccgtgtcaagcctgccattccacccccagctgcacccgcaacagatgatcatctctcgccacctgccttcagtatgcggaggaagattccaccctcagagaatgataatctcccgacacctgccatccgttagcagtctccccttccatcctcagcttcatccgcaacaaatgattatttcgagacatcttcccagtgtgtgtgggggccgctttcacccgcagcgaatgattatcagtcggcacctgccaagtgtgagcagtctgccattccacacacaactgcatccacagcagatgattattagtcgacacctcccaagcgtatgtggtggacgattccacccacagcgcatgatcatctcccggcatctgccttccgtgtcttccttacccttccacccgcaactacatccacagcaaatgataataagccgacacctgccttctgtgtgtggcggcagattccatccccagagaatgattatttcgcggcaccttccttccgtgtcttcattgccgtttcatccgcagctacatccccagcagatgattatatctcgtcatctcccatctgtgtgtgggccactgcctccatcagctgacgataacctgaagaccccaagcgagcgtcagcttacacccctgcccccaagtgcaccccccagcgctgacgataacatcaaaaccccggcagagagactgcgcggacccctccccccatcagctgatgataacctgaagacacccagcgagagacagttaacccctcttccaccctctgccccgccaagcgctgatgacaatatcaaaacgcctgccgagcgccttcgtggccccctcccaccctccgctgacgacaatctgaaaactccaagcgaacgccaactcaccccactccctccgagcgctccaccatccgccgacgacaatataaaaacgcccgcagagcgcctgagaggtcctctccctccatctgccgacgataacctcaagactcccagtgagaggcagcttactcctctccctccatctgcacccccttccgccgatgataacatcaagacccctgctgagaggctcagagggcctctacctccaagtgccgacgacaatctcaagacgcctccactggccactcaggaggcagaagccgagaaaccgaggaagccaaagcgccagagagcagctgaaatggagcctcctccggaaccaaaacgaagacgggtgggcgatgttgaaccgtctcggaagcccaagcggagaagggccgccgacgttgagccatcctcccctgagcccaagcgccggagggttggggatgtggaaccttccagaaagccaaagaggagacgtgctgccgacgtggaacccagctctcccgaaccaaaaagaagacgggtgggagatgtggaaccctcccgaaaaccaaaacgtcggcgtgcagcagatgtggaaccaagcctgcctgagcctaaacgcaggagactttcatag

SEQ ID NO: 32894 - DNA, 1263 bp, Artificial Sequence
  Description of Artificial Sequence: Synthetic coding sequence
atggccgccgctgaacaccgacattcatccggcttgccttactggccatatctcacagccgagaccctgaagaatcggatgggacatcagcctccgccacccacacagcagcactccattaccgacaattccctgtccttgaaaacgcctccagagtgcttgctgaccccgctcccgccctcggcagacgataatctgaagactcccccagagtgtgttttaactccactgcccccctccgccgatgacaacctcaaaacccccccagaatgcgtgcttacccctcttcctccctctgccgatgataatcttaaaacgccccctgagtgtctcctgacgccacttcccccaagcgcggacgataagcttaagacccctcctgaatgcctgctcacacctcttccaccttcagctctaccaagcgcaccaccttcagccgatgacaacctcaagacaagagctgaatgtctcttgcaccctctgccgccgagtgcggatgataatcttaagacgccctccgaacgtcagctgacaccattaccaccctccgctccccctagtgccgacgacaatatcaagaccccggccgagcggttaagaggaccattgcccccctccgcggacgataaccttaagactccgagcgagcggcaactaacgcctcttcctccctcagcccctcccagcgctgacgacaacataaagacaccagccgagaggttgcgggggccactgccccctagcgctgacgataatctgaagactcctagtgagcgccaactgacgcccttaccaccatctgcacctccctccgccgacgacaatatcaaaacgccggcagaacggctgcggggcccattacctcccagcgccgacgataatctgaagacaccccctctggcaacacaggaagccgaggcggagaagcccaggaaaccaaagaggcagagggccgccgagatggagcctcctccagaaccaaaaagacggagggtgggcgacgtcgagccttcccgcaaacccaaaagacgccgcgctgcggacgtggagccctccagtcccgaaccaaagaggagaagggtgggcgacgtagaaccttctcgaaaacctaagaggcgccgtgcagccgatgtggagcccagcagccccgaacccaaacggagacgcgtgggggatgtggaaccatctaggaaacccaaaagaagaagagccgccgatgttgaaccttcactgccagagcctaagcgccggcgtctctcgtag

SEQ ID NO: 32895 - DNA, 1986 bp, Artificial Sequence
  Description of Artificial Sequence: Synthetic coding sequence
atgtttcagcgggctcaggagctgcgtcgccgcgccgaggattaccataagtgcaagattcctccatccgcccgcaaggcattgtgcaactgggtgcgcatggcagcagcagagcacaggcattccagcggtcttccatattggccatatttaaccgccgagaccttgaaaaacaggatgggacatcaaccaccaccgccaacccagcaacacagtatcacagacaactcactgtccttgaagaccccccccgagtgtgtgctgactccactcccacccagcgcagacgataatctaaagactccccctgaatgcgtgctgaccccccttcccccttcagccgacgataacttgaagacaccacctgaatgcctgctgacaccactccccccgtcagccgacgacaatctgaagacacctcccgaatgtttgctgacccctctgccaccgtctgcggatgacaatctgaaaaccccccccgaatgtttgttgacacctcttcccccatcagctcctccttccgctccaccatctgcggacgataatctgaaaacccgggcagagtgccttctgcatccactgcctccctcagcagacgacaacctgaagactccctccgagaggcagcttacccctctccccccatctgcgccgccttcagcagatgacaacattaaaactcccgcattccatccccaacgcatgattatctctcgccatttaccaagtgtgtccagcctgcctttccatccacaactccacagccagcagatgatcatcagtcgatatttgttatcagtgtgcgggtttcgcttccaccatcagccaatgattatatctagacatctgccatctgtgtcatctttgcctttccacccccagctgcaccctcagcagatgataatctctcgccacctgccgagcgtatgtggcggtagatttcacccacaacgtatgattattagtcgacatttaccgtcggtttcttctctgccctttcaccctcaactccacccccagcaaatgatcataagtagacacctccctagcgtgtgcggtggacggttccaccctcaacgaatgattatttctcgccatcttccctctgtgtcatccctgccgtttcacccacaactgcacccacagcaaatgatcataagtaggcatctgccatccgtttgtgggggccgctttcaccctcagcggatgattatctcccgccacctgccatctgtatccagtctacctttccacccccagctccaccctcagcaaatgatcatatccaggcatcttccctctgtatgcggcggccggttccatccacagaggatgatcatcagcaggcacctcccctccgtctcttccttaccttttcatcctcagcttcacccacaacagatgatcataagtcggcacctaccctctgtttgcggcgagagacttagagggcccctgccaccctcggccgatgataatctgaaaactccaagcgaaagacagcttaccccccttccgccttcagcgccacccagcgctgacgacaatatcaagactccagccgagaggctgcggggccccctccccccaagtgccgacgacaatctaaaaactccaccattggctacacaggaagcggaagcggaaaagccaaggaaacccaagcgtcaaagggctgccgagatggagcccccaccagaaccgaaacggcggcgcgtcggggacgtcgaaccgtctagaaagccaaagagaagaagagccgcagacgtggagccgtcgtctcccaagcccaagaggcggagggtaggagacgtggagccttcaaggaaacctaagcgtaggcgcgccgcggacgttgaaccgagctccccagagccaaaacggaggcgggtgggcgacgtggaaccaagtcgcaaacctaaacgcaggagagcagccgatgtggagcccagctcacccgaacccaaacggaggcggctctcttag

SEQ ID NO: 32896 - DNA, 1263 bp, Artificial Sequence
  Description of Artificial Sequence: Synthetic coding sequence
atggctgccgccgagcatcgacactctagtggtctgccatactggccttacctcacagccgagacattgaagaatcgcatgggccaccagccaccgcctcctacacagcagcatagcatcacggacaactcactctcccttaagacccctcctgagtgtgtgctcacacccctacccccttccgcggatgataatctgaagacaccaccagaatgtgtgctaacccccctgcccccttcagccgatgacaacctgaaaacccccccagagtgcctgctaactccgctgcctccatccgccgatgacaatcttaaaacaccccccgaatgtctcctcactcccctaccaccttcggcggacgacaatctgaagacaccccccgaatgcctgctaacccccctgccaccctctgcacctccgagtgcacctcccagtgccgacgacaatctcaagactagagcagaatgccttctgcatccattaccaccaagtgccgacgacaatctaaagactccttccgaacggcagcttacgcccctgccgcccagtgcgcctccatccgcagatgataatattaaaaccccagccgagcgcctgcggggccccttgcctcccagtgccgacgataatttgaagactcctagcgagaggcagctcactccactaccgccttcagctcccccaagcgcggacgacaatatcaagactcctgccgaaagattgcgcgggcccttaccacccagcgccgacgacaacctgaagacaccgtcagaaaggcagctcacccctctgccaccctccgctccgccctctgcagacgataacatcaaaacacctgcggagcggctgcggggacctcttcccccatccgctgacgataacttaaaaactcccccgctcgctacacaagaggcggaggccgaaaagccgcggaagcccaagagacagcgggccgcggagatggaacctcccccagaacccaagagaagaagggtcggagatgtcgaaccctcccgaaaaccaaagagaaggagggctgcggatgttgagccttctagccccaagccaaagaggcgcagggtcggggacgtggaaccatcaaggaagccaaaaaggcggcgggctgcagatgtcgaacccagtagcccagagcctaagagaagaagagttggagacgtggagccatcccggaagccgaaaagacggagagcagcagatgtcgagccatccagtccggagccaaagagaagaagactgagttag

SEQ ID NO: 32897 - DNA, 2505 bp, Artificial Sequence
  Description of Artificial Sequence: Synthetic coding sequence
atgaaggtcatcgtgattcacagaaaaatgttccagagagcccaggagctccgtcgtcgggctgaggattaccataaatgtaaaattccgccttccgccagaaaggccttgtgcaactgggtacggatggctgccgccgagcacagacactcgtctggactcccctattggccttatctgacagctgaaacactgaaaaatcgcatgggtcatcagcctccgcccccgacccaacaacacagcatcaccgacaatagtctctccctgaagacccctcccgaatgtgtgttgacgcctcttcccccgagcgccgacgataacctaaagaccccgcccgagtgtgttttaaccccacttccaccaagcgccgatgataatctgaagacaccaccagaatgcttgctgactcccctgcccccaagcgcagacgacaatctgaagaccccaccggagtgcctccttacccctctccctccgtcagctgatgacaatctgaaaacccccccagaatgcctgctcaccccactcccgccaagcgccccaccatctgcccctccttcggctgatgacaaccttaagactcgcgctgagtgtctcctgcacccacttcctcctagtgccgatgacaaccttaaaaccccctctgagcgccagctaacacccctgccgccgtccgcgcctccatcagccgacgataacataaaaaccccagccgaaaggttacgcgggcctttgccaccctctgcggatgacaacttgaagaccccctccgagaggcagcttacgccattgcccccttctgcaccaccttcagcggacgataatattaagactccagctgagcgcctccgtggcccactaccaccttccgctgacgacaacttgaagactcctagcgaacggcagctcaccccccttcccccatcagctcccccctcagcagatgacaatatcaaaactccagccgaacggttgcgcggacccctccctcctagcgcggatgacaacctgaagactccttcagagcgccagctaacgcccctccctccaagcgccgacgataatatcaagacaccagccttccacccacagcgcatgatcatcagccggcatctgccttccgtgtccagcctaccttttcatcctcagttgcactcacagcagatgattatctctcgctacctgctcagtgtatgcggatttcggttccatcaccagccaatgattatctcacgtcatctgcccagtgtctcaagcctgcctttccacccacagctgcacccgcaacagatgattatctctcgccacctcccctcggtttgtggtggtcgattccatcctcagcgaatgatcatatcacgtcacctcccttccgtgagctctctccccttccatcctcagttacatccacaacaaatgatcatttctcgccatttgccaagcgtgtgcggtggacggtttcacccccaacggatgatcatcagcaggcatctaccatccgtttcttcccttccctttcacccgcaactccatccgcaacagatgatcatatccagacatctccctagcgtctgcgggggccgattccacccccaaagaatgattattagccgtcacttgccctccgtgtcttccttgccttttcatcctcaacttcacccacagcagatgattatctctcgtcatctgcctagcgtctgcggagagcggctccgtggcccattgccccccagcgcggacgacaacttaaagactcccagtgaaagacagctgactccgctccccccttctgcacccccctccgcagatgacaacattaagactccagcggaacgactgcgtgggcctctgccgcccagcgccgacgacaatctcaaaacacccagtgaaagacagctgacccctcttccaccatctgcgccaccatcggctgacgataacataaagacccctgcagagaggctgaggggtcccttaccaccttctgcagatgacaacctgaagacgcccagcgagagacagctcaccccactgcccccctctgccccgccttctgcagatgataacatcaagacacccgctgagcggctacggggacctctgcctccaagcgccgacgacaatctgaagacccctcccctagcaacccaggaggcggaagctgaaaagcccagaaagcctaagcgccagagagctgccgagatggaaccacctcccgaacctaaacgtcgaagagtcggtgacgtggagccttcacggaaacctaaaagacgccgcgctgctgacgtggaaccctcttcaccaaagcccaagcggagacgggtgggcgatgttgaacccagcaggaagccaaaacgtcggcgggccgcggatgtggagccctcctcaccagagccgaaacggcgccgcgtcggagatgtggagccaagtcgcaaacctaaacgccggagggccgctgacgtcgagccttcctcacctgagcctaaacggaggcggctctcatag

SEQ ID NO: 32898 - DNA, 591 bp, Artificial Sequence
  Description of Artificial Sequence: Synthetic coding sequence
atgatcagatgtggactcgcctgcgaacgatgccggtggatattgacattgctcctcctcagcgccatcgcattcgatatcattgcactcgcaggccgcgggtggctgcaatcgagcgacagggtccagacttcatcactatggtggagatgctttctgccccaagggcggagacgaaggcagagagttttacgtggcaggctgccccagcctcacggcgtgcgcgttgggtccagtagcgctgctatgctgttctggggagtttccatcctggtaatttgtttcatcctgtcgtttttcgtactctgtgtcccacaaattctggtattcctccgggtgattgggggcctgcttgccctggccgcagtctttcagataatcagcctagtaatctatcccgtcaaatacacccagccctcaacatttatgcctagcccggctgtgacctcaatctataactgggcttgcgggtttggctgggcagctatgatcattctgatcggctgtgctttcttttgttgctgcctgcccagctgcgaggacgatctcctaggaaataccaagccaaggtacttctatactagtgcatag

SEQ ID NO: 32899 - DNA, 1389 bp, Artificial Sequence
  Description of Artificial Sequence: Synthetic coding sequence
atggatagcttgtggggccccggagcggggagtcacccctttggcgtccataacacacgtcttagtccggatttgtgcccgggcaagattgtgttaagggcgctgaaagagagcggagccgggatgccagagcaagacaaagatccccgcgttcaagagaatcccggagaccagcggcgggtaccggaggtgaccggcgatgccccttcggcttttcggccgctcagagataaccgcgggctctcacctttcgtcccaggccctggtcctctgcagactgacctccatgcccaacggtctgaaatccgatacaaccagacgtcccagacatcctggacatcaagctgcaccaatagaaatgccatctcatcttcttattcaagcactggcgggctccccggtttgaaacggagaaggggtcccgcttcatcccattgtcagttgacgctttcatcgagcaagaccgtgtctgaggatcggcctcaggctgttagtagcggccacacacagtgtgagaaggcagccgacattgcccccggccagacattagcactgagaaatgacagctcaacttctgaagctagtcgaccgtccacgcacaagtttccactgcttccccgacgtaggggcgaacctcttatgttaccccctccattagagctaggatatcgtgtgacagtggaagacctggatcgggaaaaggaggcagcgttccagaggataaactctgcactgcaagtagaggataaggctatctctgattgccgtcccagtcgaccgtctcacaccctgtcatccttggccaccggtacatctggtttgcctgcaattagtaaagcgccaagtatggatgttcagcaggaaacccataaaagccaagattgtctgggcctgcttgcccccttggccagcgcagcaggtgtcccatcaactgcacccatgagcggcaaaaaacataagcctccaggtcctctcttctccagttcagaccccctccccgccacctcttctcacagccaggacagcgcccaggtgacaagtttgattcccgccccatttcccgcagcctccatggacgttgggatgcgccgtactcggtgcgggaccagtgcaccggcagctgcagctgccgccccccctccgtccactctgaatcctaccctaggcagccttctcgagtggatggaggcccttcatatatcaggcccccagccccaattacagcaggtcccacgaggacaaaatcagagaagccagacttcacgcacttccagctgtcccaagcggaatgccatctcttccccctatcgcagtactgggggactgcctgagcgcaagcgacggcgcggtccagccagctcccattgtcagctgaacctcagtagctag

SEQ ID NO: 32900 - DNA, 381 bp, Artificial Sequence
  Description of Artificial Sequence: Synthetic coding sequence
atgggacgcatctttcaactgctgcgagataggcggatctcatcacgaggccccggcctccacaccccaaaggcagaacctcggcgtagaaagggtctgactacaggcctgatgacacaggcagaacgacagaagcaggcgcaccagaggcaggccgctatgcgggaaacagcgctgtggtgtaccggccatattcggccaaggacacatacgcacacaggcactcacacgcagaccgacagggagagagagaggaatacacaaaggctgcgtgatagggaacgcagggagaacggccgccatacccacattcacacacagacacacacccaatcgctgatcgccaaagcgcttaaagacacacaccccggcaacccctag

SEQ ID NO: 32901 - DNA, 1395 bp, Artificial Sequence
  Description of Artificial Sequence: Synthetic coding sequence
atgatggcttgcagggatccaaagcctggtgccaagcggctcgtgagagcccagaccctgcagaaacaacggcgtgctccggtgggccctcgggcacctccccctgacgaggaggatcctagacttaagtgtaagaactgcggggcgtttggccatatggctcgcagcacgagatgtcccatgaagtgttggaaagcggccctcgtcccacccaccttagggaagaaagaggggaaggagaatcttaagccttggaagcctcaggttgaggcaaacccaggacccttaaataaggataagggcgagaaggaggaacgaccccggcagcaagacccccagcggaaggctctgctgcatatcttctccggcaaaccgcccgaaaaacctttacctaatcggaaaggaagcactgaatcgagcgtatacttaagggtcgcctctggacctatgcctgtacatactacctcaaaacgtcctcgtgttgatcctgtgcttgcagatcgatctgctaccgagatgagtgaccggggaagcgctctggcttctctgagccccttgagaaaagcctctctttcctcctcttccagccttggcccaaaagagcgacagacaggcgcagctgccgacattccacaaccagccgtacggcaccaggggccagaacccctgctagtagtcaagcccacccactccagccccgaggggggatgccgcgaagtgcctcaggcagcctcgaagacacatggtcttttacaggcgatcagcccacaggctcaagacaagaggcccgccgttactagtcagccatgccctccagccgccacccacagcctgggactggggagcaatttgtcattcgggccaggggccaagcggccagctcaggctccgattcaggcctgcttgaatttccctaagaagccacggttgggacctttccaaatccctgaatctgccatccagggtggagagttgggcgctcctgagtaccttcaacctcctcctgcgaccaccgaattaggcccgagcacctccccgcagatgggccgcagaaccccagcccaggtgagcagtgtggacaggcagcccccccactcccggccttgtctcccaacagcccaggcgtgtacgatgagtcaccaccccgctaccagtcacgacggggctcagcctctcagagtactgttccggagattggaaaacggacgctggtcgtcctcactcttagccgcgcccagctttcactcaccagagaaaccaggggccttcctggctcagtctccacacgtgtcagagaaatctgaggtcccacgggttagagtccctcccaacgtcctgtatgaagacttacaggtgtcttcatcatcagaggactccgattctgatctcgagtag

SEQ ID NO: 32902 - DNA, 1383 bp, Artificial Sequence
  Description of Artificial Sequence: Synthetic coding sequence
cagatggcccgtcattccgtgcatcaccaagctcagcggcctcctagggccaagaatcctcaggagcaacagagacggccgatgggacagactactctgccagccgagcaggaggagtctagggtgaaatgtaagaattgcggcgcatttgggcactccgcccgcagcaagacttgcccaattaaacggtggtctggagccctgcctcttcaggctctcggatctcataaggagaaggagaacctcaagcctgccaaggcccagcttcccttcaccacgcccggcccctttacaacaaatgacagggagaaagaacggtccccctccccacagcagcagcagtctgaagcgccaacccagacttttccacgcaccccccaggagaagatgcaagaggcctggaaagagcccgcagaggattgcctgtttctccgacaccctacaatgccgctccctgtgcatacaaccaagaagagaagtgtgttaggtccagtgtcgacaggtccaccacccgtgaataagcctgagatgcgactgctgtgcccgagcggtcataacgatagcccacaactgagcacatgtggacccaccaagggacatggccgggatgtgaccgccagcctgctccctgttctgaaaagttcccaccaaacgcccacactgagtgctaggttgccagcaaatagaccagatatgtcctcgcacggcgcactgcagcccgccatgcaagccttagctctgggccctggcctgaaatcccaagccgaaatcaagcaccctgacgccgatgccaagcccagaccccagcaggttaggaaacagtgtgggcaggactcgcggacacaagctcccgacaaggaacctgctcccgtgcctacccaaacttttcaaaaccccgccaaaaaagcacgcttctcttctttccagactccagcccttcgcactcaactccccgatgtgggcgccgtccagaccctgcagcctcccagaaccgctactggcctgggtagcaaagaagccccaaaggctactgccgagacagccgctaccaagaccgctaccctgcagcctagggtgaacctccagcctgccccaagttctccatttctgggtcctgcccagggatgccctgttctccagccaggacccccgattcatgtgcctggtcgtcctggctccgtcaccttcatgcgtggggataaggggcagaagagccctaggttccggatgccgcccacatcccgccctcccgagaatagtgcctctgcacagtcccctcggttctctagacagccagagggtcagggcccccaggtctcaacttctgtgctatacgaggatctgctggtgacctcctcttccgaggactccgactccgattag

SEQ ID NO: 32903 - DNA, 894 bp, Artificial Sequence
  Description of Artificial Sequence: Synthetic coding sequence
ttcgtcctgggtgcagttagccctgctgtcgtcgtgctgtatactatggtcctgcaggagaatggctatggcgtggaggaggacatccctaccctgctgatggctgctagtagcatggacgacctgttggcgatcacaggcttcaacacttgcctgtctattgtcttttactcgggcggcatgatcaataacgctattgcttctctgaggaatgtgtgcatttcactccttgccggaatagtgctaggcttcttcgtccgctattttcccagcgaagaccaaaaaaaaatcacactgaaacgtgggttcctggtcctgatcactttcgtgagtgcagtcttaggttcacagcctatcgggctccacggctctggaggcctgtgcacgctggtgctgcatttcatcgaatggaccaagtggagccaagaaaagatgaaagtgcagaagatcattaccaacgtgtgggacatcttccagcctttgcttttcggcctcgtgggggccgaggtgtctgtctcccttctcgaatctaacatagtgggcatcagcgtgtctacgcttagtttggccctttgtgtgaggattcttaacatctatctgctaatgtgtttcgccgggttctcattcaaagaaaaaatcttcatagctttagcttggatgcctaaggctaccgtccaggctgttctgggcccactggctctcgagactgcccgggtgagcacccctcacctggaaacctatgccaaggatgtgatgaccgtagctttcctggctataatgattacagcccccaatggggcgctgttaatgggcatactgggacccaagatgctcacacggcattacgacccaagtaagatcaaactacagttgagtactctggaacaccactag

SEQ ID NO: 32904 - DNA, 2325 bp, Artificial Sequence
  Description of Artificial Sequence: Synthetic coding sequence
atggaacctgaacgcgaaggcacagaacgacatccacgcaaggttcgtgagagcaggcaggcccccaacaagctggttggcgcagcagaagccatgaaggctggctgggacctagaggagtctcagcccgaggcaaaaaaggcaagattgtccaccatactgtttacagacaattgcgaggttactcacgatcagctgtgcgaattgctgaagtacgccgttctaggaaaatcaaacgtcccaaagcccagttggtgccagttgtttcaccagaaccacttaaacaacgtcgtcgtgtttgttcttcaagggatgtcgcaactgcatttttatcggttctacctggagttcgggtgtttacgcaaggcttttaggcacaagttccggcttccaccacctagcagcgactttctggctgacgtggttgggctgcaaactgagcagcgagccggtgacctccccaagaccatggagggtcccctgccctccaacgctaaggcagccatcaacttgcaggacgaccctatcattcagaaatatgggtccaagaaggtgggtttgacccgttgcttgttaactaaggaggagatgcgcacatttcactttcctcttcagggctttccagattgcgagaatttcctactgacaaagtgtaatggttcaatcgctgacaactcccccctgtttggcctcgactgtgagatgtgcttaaccagtaagggccgggagcttactcggatctcactggtcgctgaaggggggtgttgcgtcatggacgaactcgtaaagccagagaacaaaatactcgattacctaacatctttttcagggatcactaagaagatactgaaccccgtcacgactaagctcaaggacgtgcagcgccaactgaaggcacttctgccacctgatgctgtgctcgtcggacatagtctcgacctggacctaagagctctcaaaatgattcacccttatgttatcgacacttccttactttacgtgagggagcagggacgccgcttcaagctcaaattccttgctaaggtgatcctcggcaaggatattcagtgtccagaccgtctaggacatgacgccacagaggatgcacgaaccatccttgaacttgccagatattttctcaaacacggacctaaaaagatcgccgagctgaatctggaggctttggccaaccatcaagaaatccaggcagcaggccaggagccgaagaacaccgccgaggtgctgcagcatcccaacacatccgtactcgaatgcctggactctgtcggccagaagttgctgttcctgacaagggaaaccgacgcaggcgagttaccgagttctcgcaattgccagaccatcaagtgtctttccaataaagaggttctggaacaggctcgagtggaaatccctcttttccctttctccattgtccagttctcatttaaagctttcagcccggtgctaacagaagagatgaataagcgcatgagaattaagtggaccgagatcagtaccgtctacgccggtccattttcaaaaaactgcaatcttcgtgcattgaaacggctgttcaagtcttttggacccgtacagagtatgacctttgtcctggagacgagacaaccccacctatgtattcagtacgaggtgctcgaggccgcacagctcgctatcgagtctcttgacggcattctggtcgatggaatatgcattaaggtgcagaggcctgtgacagaactcacgcttgactgcgacacattagtgaacgagctggagggtgacagtgaaaaccaaggatcaatctacttgtcgggggtcagcgaaaccttcaaggagcagctgctccaggagccgaggcttttccttgggctggaggccgtaatcctgcctaaggacctgaagtctggcaagcagaagaaatactgttttctgaagtttaaaagctttggaagtgcccaacaggccctaaatatcctcacagggaaagattggaagctcaagggcaggcatgccttgaccccccggcacctgcacgcctggctgagaggtctgcctccagagagtacacggttgcctggcctcagagtggtgccccccccctttgagcaggaagcccttcagactctgaaattagatcatcccaaaatcgccgcgtggcggtggtccaggaagatcggaaaactgtataatagtttatgtccgggaacactatgcctgattcttttacctggaacaaagtccacccatggttcactgtctggtctgggacttatggggatcaaggaggaggaagagtctgctgggccaggcttgtgcagttag

SEQ ID NO: 32905 - DNA, 2232 bp, Artificial Sequence
  Description of Artificial Sequence: Synthetic coding sequence
atggaacccgaacgcgaagggactgagaggcatccacgaaaagtccgcgaatcacgccaggcgcccaacaagttggttggtgcggcagaggccatgaaggccggctgggacttggaggagtcacagcctgaggctaagaaggcgagactgagtacgatcctattcactgataattgtgaagtcacacacgaccagctatgcgagctcctcaaatatgcagttcttggtaagagcaatgtgccaaaaccctcctggtgccagctgttccatcaaaatcatctcaacaatgtggttgtgtttgtgctccagggcatgtctcagctgcatttttatcggttctaccttgagttcggatgtttacgcaaggcatttcgtcataagtttcgactcccccctccaagctcggattttctggccgatgtggtcggactacagaccgagcaaagagcgggtgacctgccaaagaccatggaaggccctttaccaagtaacgctaaggcggctattaatttacaggacgatcccattattcaaaaatacggatctaagaaggtcggacttacccgttgcctcctgacaaaggaagagatgagaactttccattttccgctgcaaggctttcccgattgcgaaaattttctgttaacaaaatgcaacggctcaattgccgacaatagccccctttttggtcttgactgtgaaatgtgtctgaccagcaaagggcgcgaactgacacgtatctctttggtggcggaggggggctgttgcgtcatggacgagttggtgaaaccagaaaataagattctggactaccttacttctttctccggaattaccaaaaagatcctcaatccagtgactactaagctgaaagacgtacagcggcaactgaaagccctactcccacccgatgcagtgcttgtggggcatagcctggatctcgatttgagagctctgaaaatgatccacccatatgtgattgacacgtccctgttatatgtgcgtgaacagggtcgtcggttcaagctcaaatttttggctaaggtcatcctgggcaaggacattcagtgtccggatcggctgggacacgacgccactgaagatgcaagaacgattctggaactagcaaggtactttttaaaacatgggcccaaaaaaattgccgagctgaatctcgaggccctggccaatcaccaggaaatacaagccgctggccaggagccaaagaataccgctgaggtattgcaacatcctaatacaagcgtcctcgaatgcctagattcagtcggccaaaaactgctctttcttacacgcgaaacagacgcaggcgagctgccatcgtctagaaattgccagaccattaagtgtctcagtaataaggaagtcctggagcaggcgagggtggaaattcctctgtttcctttttctatcgtgcagttctcctttaaagccttctctccggtgttgaccgaggaaatgaataagaggatgcgtatcaaatggacagaaatttctaccgtgtacgccggccctttctcgaaaaactgcaacctaagagccctgaagcggctgtttaaaagtttcgggccggtgcagtcgatgaccttcgtgctggagactaggcaggtccagcgcccagtgaccgaactcacactggattgtgacaccctcgtgaatgagctcgagggcgattcggagaaccagggaagcatctacctatccggcgtgtctgaaacattcaaggagcagcttttacaggaaccgagactcttcctggggctggaggccgtaatactgcctaaagacttgaagtccggtaagcagaagaaatactgcttcctgaaatttaaatcctttggtagtgcccagcaggccttgaatatacttaccgggaaggactggaaactcaaaggcaggcacgccctgacgccaaggcacctgcacgcatggcttagggggctacctcccgagagtaccagacttccaggcctgagggttgttccaccacccttcgagcaggaagcccttcaaaccctcaagctggaccacccaaaaattgcagcctggcgctggtcgcgaaagatcggtaaactgtacaactctctctgtcctggcacactgtgcttaatcctccttcccgggacaaaatccactcatggctctcttagtggcttagggctgatggggatcaaggaggaagaggagtcagctggtccgggcctttgcagctag

SEQ ID NO: 32906 - DNA, 2082 bp, Artificial Sequence
  Description of Artificial Sequence: Synthetic coding sequence
tcactcccccagtccgaagcccaggggcaggccgtcgacctgaggacccccgtctcatgcctgagaggtaggctcccaccagggcacaccgaggcgaggctggtgggcggcgagcacccttgcgcagggagacttgaggtcacctggggaacggtgtgcgacgccgctcttgacctggcaaccgcccacgtcgtctgtcgagaactgcaatgcggcgccgtggtgtctacaccagagggcgccaggttcggtcgtggctctggccctgtgtggactgaggctttccgctgtgccggtaatgagagtctgctctttcattgcccacggggccgtggcagtcaatgcggtcacggccatgatgcaggactgcggtgttccgagttcaggatggtcaacggaagcagctcatgcgagggccgcgtggaattccaggtccagggctcctgggccccgctgtgtgcaacccactgggacatcgccgatgcgacggtcctatgccatcagctcaattgtggtaatgccgtggctgcacctggaggtgggcactttggggatggcgatgctgcaatctggccagacgctttccattgcgagggcactgagagctacctctggaattgcccagtgagtaccctcggcgcacccgcctgcgcgcccggaaataccgcctccgccgtctgttccggattggcccacgctcttcgactccgagaaggacagtctcgttgtgacggccgtgttgaggtgtccctcgacggagtttgggggagagtactggatgacgcctgggatctccgcggtgccggagtggtgtgccgtcaactaggatgtagaggagcccaacaggcctatgatgctcccgctcctagtcgcggctccgtccaggtggctctatcacgcgtgagatgtctgggaacagagaccaggctgacacagtgcaacgtgtcagccactcttcaggagcctgcaggtacgagcagagatgccggagtggtgtgttcaggcgaagttgggaccgctagcccgatggcacggagacacggaattcccggcgctctcactctgtcactgcacagagaaccccaaggagctgctggcaggggcgctggtgccctgcatggaggcgcttggggcacagtgtgcgatgatgcctgggatctccgggacgcccatgtcgtatgccgccaattgggctgcggaagggcgctgtcccctggcggaaggaccctccgctcacgtggaagggcgcacctcgccggtcgagctgggctgcccgggcctagagtttgtgcggtggccgtgccagtcggcggactgggcgccgcccgtctggaggcccagggcgggagacgcagactcctccttcgcgtgggcgggagtgaagccgcccgttgggatcttctgctgtgttgggtcgcgggaagggtcctccaatgggatttaggcaggcacgttcagcagtgtcccgagggcccattgcttgttcaccatctgcaggctgcgggggtctggggggtggggctagccggtgagcaggcactccccctctgcggccatcgggaccgcctgggcgggcaacaccgggttcctcaggccgcacaattgcacagcgtcgctatgccattcccccccatggctcccgctcttctaagaccctctcgagcgggccttgattatctgtgcaggatagttcgcggccaggctactggctgttggggggctcctcagctgctcctattggccaggctgccccgcggggggagaactgcacgggcccgaggcaggggacctctcttgcgggcaaggggagccctcgcccgtggactgttggggcaccgcgtgcgacggtggctcggacccggcggccggggaggccgtgttccaccagccgggctgtggtctgggaggcggcgtcccggcggtcgtagactgtggccgtggctcagagctagggtggccgggcgcgggggtgtacccggtcagcgcggcgtgcccgtgggactgcctaggagtggcggagatgcagagaccgccaggacccgcaggacccgcgcttgtgctgcaggcaagaccaattcttag

SEQ ID NO: 32907 - DNA, 1359 bp, Artificial Sequence
  Description of Artificial Sequence: Synthetic coding sequence
atgaattcaggaattctacaagtgtttcagagagaacttatttgtcccatatgcatgaactatttcatcgatcctgtcaccatcgactgtggccactcattttgccgaccttgtttttatctgaactggaaagattctccctttcttgtccagtgcagcgaatgcacaaaaagcacaggccagattaatttgaagaccaatattcactttaagaaaatggccagtctagccagaaaggtcagtctgtggctgtttttgtctagtgaggagcagatgtgcggtacccaccgggaaactaaaaagatgttctgtgaggtggatcgtagcctgttgtgcctcctgtgcagcagttcacaagaacatcgcgaccatcggcattgccctatcgagagtgctgcagaggagcaccaggagaagcttctccagaagatgcagtctctgtgggagaaggcgtgtgaaaatcacaggaacttgaacgtagagacaactcggactagatgttggaaggattacgtgaatctccggttggaggccatccgcgccgagtatcagaagatgccggccttccaccatgaagaggaaaaacataatttggaaatgttaaaaaagaagggtaaggacattttccataggctgcacttgtcgaaggccaaaatggcccatagaagagaaatcctgcggggaatgtacgaagaactcaatgagatgtgccacaagccggatgtggagttactgcaggcttttggcgatattctacatcgttcagagagtgtgctcctccatatgcctcaaccgttgaaccccgagctgtctgcagggcccattaccggtctgcgcgataggctcaatcagttccgtgtgcacatcacgctgcaccatgaggaagcgaatagcgacatttttttgtgcgagattctccgatcaatgtgcattggatgtgaccatcaggacgtgccttatttcactgccaccccccggagcttcctggcctggggggcacagaccttcacatccgggaaatattactgggaagttcatgttggtgattcatggaactgggccttcggagtgtgcaacatgtactggaaagaaaaaaaccagaatgagaagatcgacggcgaggatggcctgttcttactcggatgtgtcaagaacgacatacagcgtagcctgttcaccacttctcctctactactacaatacattccacgacctactagtagagtggggctgtttctggattgcgaagctaagacagtttcctttgtcgatgttaaccagtccagcttgatatacacaatcccaaactgtagtttttcaccccctttaagacctatcttttgttgcattcatttttag

SEQ ID NO: 32908 - DNA, 339 bp, Artificial Sequence
  Description of Artificial Sequence: Synthetic coding sequence
caagtagcgtacgtcagagcccgcgagctgcacactctcgaggtgaccgggctggagactgtggcccagtctaaagctcacgtggcctcgctggagggcttgattcctgaggacaaggtggtgctactagcagggtcccccttacagaacgaagcaactctgggacagtgtggcgtcgaagcccttaccacacttgaagtagtaggacgtcgcctgggaggcaacaattgtttgtccttgcaggttaaccccgtacagccagctcgatacctgtggacaacactccacagctcaaaacagggagagcctaacagttccgcaaaccaccgctgttcatag

SEQ ID NO: 32909 - DNA, 1026 bp, Artificial Sequence
  Description of Artificial Sequence: Synthetic coding sequence
atgagattgtgtcttatccctaggaacaccggcacaccgcaaagagtgctgcgacctgtggtctggtctcctcctagtcgaaagaaacctgttctctcaccacacaacagcattatgttcggccacctgagtcctgttcggattccctgtctgcgaggcaagtttaacttgcagctaccctctcttgacgaccaggtgatccctgcccggctgccaaagactgaagtgtccgctgaggaacctaaggaggcaactgaagtgaaagaccaggttgagactcaaggccaggaggataacaaacgtgggccatgttctaatggagaggctgcgtcaactagcaggcccctcgaaacacaaggcaacctcaccagtagctggtacaacccgagacctctggaaggcaacgtacacctgaaatctttgaccgagaagaaccagaccgacaaagcacaagtccatgcagtcagcttctatagcaagggacacggtgtagcgtcgagtcacagccccgctggcgggatactgccatttggcaaacctgatccactccctaccgtgctgccggctcccgtccctggctgcagcctttggcccgagaaggctgccctgaaagtccttggcgaggaccacctgccttcttcccccggattactcatggtcggcgaggacatgcaacctaaagaccccgccgctcttgggtctagccggagttctccccctcgcgccgccgggcaccggtcgcacaaacggaagttgagcggaccaccattgcagctgcagcccacacccccactgcaacttaggtgcgacagagacgaacgccctccccccgctaagttgccgtgtctgtcacctgaagctttactggtgggacaggcttcccagcgtgaaggcagattgcagcacggaaatatgagaaaaaatatgagggtgctgagtcgcatatccaaatttcgcaggctcagacagctgctccgacgtcgaaaaaaaaccagacagggtagacgaggaggctcttgtctatag

SEQ ID NO: 32910 - DNA, 285 bp, Artificial Sequence
  Description of Artificial Sequence: Synthetic coding sequence
atgcggaagctgagactcagagcttccaacccaggccccagcggagctcctggcacccggcagcacttctccacttccaggggtggccatcactgtgcccgtcgctggctccggagagtaaggaggtcacggtcgcaaaccccctcctatcagaatctggaccccaatcctccaatcgttaggttccctctgcccttggaaaggatctctgaggtgccaaggcgggcttgcttacatgggagagatgcgtctagtgtttggccgccacccgaacgtagcgattag

SEQ ID NO: 32911 - DNA, 2268 bp, Artificial Sequence
  Description of Artificial Sequence: Synthetic coding sequence
atggctgcggttgccgctgaggccgccgccaccgccgcatcacccggcgagggcggcgccggcgaggcggagccagaaatggagcctattcccggcagcgaggcaggaacagaccccctccccgtaacagcgaccgaggcctccgttcctgacggagagacagacggacagcagagtgcacctcaagccgacgaacctcctctgcctcctcccccccctcccccaggtgaactggcgagaagcccggaggccgtggggcctgagttggaggccgaggagaagctgagtgtgagagttgctgaatcagccgccgccgccccacaaggtggaccagaactgccaccatcccctgcttctccccctgagcagcctcccgcccctgaggaaagggaagaaccccccttgccgcaaccagtggcgcccgcactggttccgcccgctggcggcgacagtacagtctcccaacttatccctgggtctgaggtgagagtgacactggaccacatcattgaagacgccctggtggtgtccttcagatttggcgaaaagctcttttctggagttctgatggacctgagcaagagatttggcccacatggtattcccgtgaccgtgttcccgaaacgcgaatacaaagataagcctgaagcaatgccactacagagtaacactttccaggagggcaccgaggtgaaatgcgaggcgaatggtgctgtaccagacgatccatcgcccgtgcctcacccagaactgtcattggcagaaagcttgtggacttcaaagcctcccccgctgttccatgaaggagccccgtatcccccgcccttattcatccgagatacttacaatcagtctattccccaaccgccaccacggaagataaaaaggcctaagcgcaaaatgtaccgggaagagcctacctcgatcatgaacgccatcaagttaagacctcggcaggtcctttgtgataaatgtaaaaattccgtcgtagcagaaaaaaaagagatccgtaaaggatcatcagcgactgatagttccaagtacgaagataagaagagacgtaatgagtccgtcactacagtcaacaaaaaactaaagaccgatcacaaagtcgacggaaagaatcagaacgaatcgcagaagaggaatgctgttgtgaaggtgtctaacatcgcccatagcagaggcagggttgtgaaagtctccgcccaggccaacacctcaaaagcacaactgtccacaaaaaaagtcctgcaaagcaaaaacatggatcacgcgaaggctagagaagtcttgaagattgctaaagaaaaagcccagaaaaagcagaacgaaactagcacctctaagaacgcgcatagcaaggttcactttactagacggtaccagaacccctcctcaggatctctgccacctcgagtgcggctaaagccgcaacggtacaggaacgaggagaatgacagctccctcaagaccggactcgaaaagatgcgttccggcaaaatggcgcctaagccccaatctcggtgtacgtcaaccagaagcgctggcgaggctccaagtgagaatcagagtccaagcaagggacccgaggaagcatcctcggaagtacaagatacgaatgaagtgcacgtgcctggagatcaggatgaacctcaaaccttaggaaagaaggggtccaagaataacatctctgtttacatgacactcaatcaaaagaagagcgattccagttctgcatctgtctgctccattgactccacagacgatcttaagagcagtaacagtgagtgttcttcatctgaatccttcgacttcccccctggctccatgcacgctccctcaacctcaagcacctcatcaagttctaaagaagagaagaagctttcaaattccctgaagatgaaagtcttctctaagaatgtctcaaaatgtgtgacacctgacgggaggaccatttgtgtcggcgatatcgtatgggcaaagatatacggcttcccgtggtggcctgccaggatcctgaccatcaccgtgtcacgaaaggataatggcctgctggtcagacaagaggctagaatttcttggtttggctcacctacgacttctttccttgctctcagtcaactctctccgttcctcgaaaatttccagtccaggttcaataaaaagagaaagggcctttatcgaaaagcaatcaccgaagccgcgaaggccgcaaagcaactgacgcctgaagtacgagccctcctcacccagttcgagacctag

SEQ ID NO: 32912 - DNA, 1683 bp, Artificial Sequence
  Description of Artificial Sequence: Synthetic coding sequence
atggccgcggtggctgccgaggcagccgctactgccgcttcgccgggagagggaggggcgggcgaagccgagccggagatggagcccatacccggcagtgaggcaggaacggatcccttgcccgtgacagccactgaagcctcagtcccggacggtgagactgatggccagcagagcgcccctcaggccgatgaacccccactgcccccaccccctccgcctcctggcgagcttgctaggagtcctgaggcggtgggcccagagctggaggcagaggagaaactatcagtcagagtagcagaatcagccgcagccgccccacaaggagggccagagctgcccccatctcctgccagccctccagaacagccacctgcccccgaagaacgggaagagccccctttgccacagccggtggcaccagcacttgtgcccccggccggtggggattctactgtctctcaattgattcctgggagtgaggtgagagtgactctggaccatattatagaagacgccctggtcgtgtcattcagatttggcgaaaagttgttcagcggtgtgcttatggacctgtcaaagagattcggcccacatggcatccccgtgactgtgtttcccaagagggagtataaggataagcccgaggccatgcccctgcaaagtaatacctttcaggagggtactgaggtaaagtgtgaggcgaatggcgccgttcctgatgatccatcccccgtcccgcacccagagctgtcacttgccgagagcctctggacatccaagcctcctccattattccatgagggtgcgccgtacccgcctcctctattcattagagacacctataatcagagtattccacagccaccaccacggaagataaagagacctaagcgcaaaatgtaccgtgaggagcccaccagcattatgaacgcgatcaagctcaggcccagacaggtgctgtgcgataagtgtaaaaactcagtcgtggcagaaaaaaaagagatccgcaaggggtcatctgcgacggatagttctaagtacgaagacaaaaagcgaagaaatgagtccgtcacaacagtgaacaagaagttaaagactgatcacaaagtcgacggaaagaatcagaacgagtctcagaagaggaacgcagtggtgaaagtgagcaacattgctcattcccggggccgggtggtcaaagtgagcgcacaggcaaacacgtctaaggcccagctgtcgaccaagaaagtgctgcagtcaaaaaatatggatcacgctaaagcacgagaggtgctcaagatcgccaaagaaaaagcccagaagaaacagaacgagacatctacgagcaagaatgctcactccaaggtccattttacccgccgttaccagaaccccagctcaggctctctacctccccgggtgagactgaagccacagaggtacagaaacgaggaaaatgattcatcacttaagactggtcttgagaaaatgaggtctggcaaaatggcccctaaaccccagtcccgctgtacctccactaggtcagccggtttgaataaatggcagctgcttcaccagaccgtgacctcaccagccgccccactgcaatgtctcactgaccattgcggctttaggctgggggccttgaagctgaccgtgaaacgagcagcacagcgacattag

SEQ ID NO: 32913 - DNA, 1563 bp, Artificial Sequence
  Description of Artificial Sequence: Synthetic coding sequence
atggcagctgtcgccgccgaagcagccgccacagctgccagcccaggagaaggaggggctggcgaagcagaaccagagatggagccaataccggggagtgaagcgggtactgatcccctgcctgtaacggctaccgaggcttcagtcccagacggcgagacggatggacagcaatctgcaccgcaagcagatgaaccccccctgcctcctcccccccccccacccggggaactcgcacgatcgccagaagctgttggccctgagctagaagccgaagagaaactctccgtgagggtggcagaaagcgccgcggcagcaccccaaggtggcccagaattgcctcccagcccagcttccccacccgaacagcctccagcgcccgaggagagagaagagccccccctgccccaaccggtcgctcctgcccttgttccgccagccgggggagacagcaccgtatcccagttgatccctggttccgaagtgcgcgttacgctggaccatataattgaggacgctctcgtggtttcttttagatttggtgaaaagctcttctcgggagtgcttatggacctgtcaaaacgattcggtcctcatgggatccccgttacagtatttcctaagcgcgaatacaaggacaagccagaagctatgcccttacaaagcaacacctttcaggaaggcactgaagtgaagtgtgaggcgaacggagccgttcccgatgatccatcacctgtcccccatcccgagctctcgctcgctgagtctctgtggacatccaaacctccacccctctttcacgaaggagctccctatccacctcctctcttcatccgcgacacgtacaaccagtcaatccctcagccacccccgagaaagattaaaaggcccaagcggaaaatgtacagagaagaacctacatcaatcatgaatgcgatcaaactcagaccccggcaggttctctgcgacaaatgcaaaaattccgttgtggcagagaagaaagagattagaaaaggaagttcagccaccgattcgtctaagtatgaagataaaaagagaagaaatgaatcagtcactacagtgaataagaagctgaagacagaccataaagtagatggcaagaaccagaatgagtcacagaaacgaaacgcagtggtgaaggtgtcaaacatcgctcacagtcgcggccgcgtggtgaaggtgtccgcgcaggcgaacactagtaaagctcagctgagcaccaagaaagtgttacagtccaaaaacatggatcatgctaaggctcgggaggtcctcaaaatcgcaaaggaaaaagcacagaagaaacagaacgaaacctcaaccagtaagaacgcacatagcaaagtgcatttcacccgccggtaccagaatccctcatccggctctttaccaccccgggtgcgcttgaagccccagcgctaccggaatgaggagaacgactcctccttgaagacaggcctggaaaagatgaggtccggtaaaatggctccgaaaccacagtctcgttgtactagtacccgcagcgcagctcagaggcactag

SEQ ID NO: 32914 - DNA, 1773 bp, Artificial Sequence
  Description of Artificial Sequence: Synthetic coding sequence
atggagccacgtgcaggatgtaggttacccgttcgagtcgagcaggtagtcaatggcgctctggtggtgacagtgtcctgcggcgaacgttcttttgccggcattttgctggactgcacaaaaaaatccgggctgttcggtttgccaccactggccccactgccccaggtagatgaaagtcctgtgaatgattcacacgggcgcgcccctgaggaaggagatgcagaggtaatgcaattggggtcctcgagccctccccccgctcgtggtgtccagcctccagaaacaacacggcctgaaccaccaccaccactggttcctcccctgccagcgggatccctccccccatatcctccttatttcgagggagcccctttccctcaccccctctggcttagggacacttacaaactctgggttcctcaaccccccccccgtacaattaaaaggacccgtcgaaggttgtctagaaaccgtgatcctggcaggctgattctctccaccattaggctgcggcctcgccaggtgttgtgcgagaagtgtaagtcaacgctgtcacctcccgaagctagcccagggcccccagccgcgccccgagctcgcagaagactggggagcgggcccgacagagagcttaggaagccggaagagcccgagaacggggagcctaccgcagctgcaaccgcgaggcgaagtaaaagggaaagacgcgaggaggaccgggcgccggccgagcaggtgccgcgctcccctgtaattaagatctcatattcaacacctcaaggaaaaggagaagtggtcaaaattccttccagagtgcacggctctctcgaaccattcaggcctcagcaggccccccaagatgatggctcacaggatcctgaagtccttgaccgcgagagcagagacagaccaagctgtgcccccagcgccagtatccctaaattaaaactaacaaggcctgtcccagcgggagccgacctgccaccaccgaaaattcggttgaagcctcaccgactgggggactcggaacacgaaccagtgtaccgagccgagctggtcggcgaactgaatgggtacttgcgcgattcgtcgcccgccccctgcgccgatggaccagccggggggttagccgacctaagcagtggttctagtggcgaagacgacgactttaaaagttgtccacaggggccccaggggcgcgagggcctggcctttctggtgagctgccccgagggaagggctgactgcgctagtgaaagcgcatgctcctcagactcattggatgaggcccgctctagcggcagcgagggaacaccggcagataccggggatctgagtcccggacacggcgcatccgccccttccgtgagtagggaggcacgccagactgtgcctccccttacagtccggctgcacacccagagcgtcagcgaatgcataacggaggatgggcggacagtagctgtcggggacattgtttgggggaaaattcacgggtttccgtggtggcctgcaagagtcttagatattagtttagggcaaaaagaggatggggagccatcttggcgagaagcaaaggtttcatggtttgggtctcctacaacatcatttctgagtatttcaaaactgtcccctttctcagaattctttaagctgcggtttaatcgcaagaaaaagggcatgtaccggaaagccataaccgaggctgcaaacgccgcgaggcacgtagcaccagagattcgggaactgttgactcagtttgaaacctag

SEQ ID NO: 32915 - DNA, 1500 bp, Artificial Sequence
  Description of Artificial Sequence: Synthetic coding sequence
atggagccccgagccggctgccggttgccagtccgggtggaacaggttgtcaacggagcattagtggttacagtaagctgcggggagagaagcttcgctggcattctcttggattgcactaaaaaatccggcctgttcggtttacctccacttgctccgttgccacaggtggatgaatcccccgtgaacgattcacacgggcgcgcccctgaggagggcgatgccgaagtgatgcaattaggtagcagcagtcctcctcctgcccgcggggtacagcctcctgagacgactaggccagaacccccccctcccctggttccacctctgccagctgggtctttacccccgtaccctccatatttcgaaggagctcccttcccccacccactctggctgcgtgacacttataagttatgggtgccacagcccccaccaagaactatcaagcgaactaggaggagactgtcacgtaaccgagatcccggccgcttgatcctgtccaccatcagactgagaccccggcaggtgctctgcgagaagtgcaagtccactctgagcccccccgaagccagccccggacctcctgcagccccccgcgctcggaggcggctaggaagtggcccagatagagaattgaggaagccggaggaacccgagaatggcgagcccacggccgcagccactgctcggaggtcaaagagagagaggagagaggaggacagagcgcccgccgaacaggttcctagatcgcctgtgatcaagatctcttacagcacacctcagggcaaaggtgaggtggtgaagattccctctcgtgttcacggctcactggagccttttcgcccacaacaggccccccaggacgatgggtcacaggatcccgaagtcctggatagggaaagccgcgacaggcctagttgcgcaccatctgctagtatcccaaaactcaagctaaccaggcccgttccggccggagccgatctcccaccccctaagattcgtctgaaaccccatcggctaggagactccgagcatgagcccgtttaccgggctgagctggtgggggagcttaacggatacctgagggactccagtcccgcaccctgtgcagatggcccggcaggaggcctggcggatctttcttctggatcttcaggtgaagatgatgactttaaaagctgtccgcaggggccccaaggaagagagggcctcgccttcttggtaagttgtcctgaaggacgcgctgattgtgcgtccgaatctgcctgtagctccgactcactggacgaggcccggagctctggctccgagggcacacccgcagacacaggggacctgtcgccgggtcatggcgcaagtgcaccgagtgtctcccgcgaagctcggcaaacagtgcccccactaacagttcgcctccatacccaaagcgtctccgagtgcataacagaggatgggcgtacggtggctgtcggagatatcgtttggggccaccgaaggtag

SEQ ID NO: 32916 - DNA, 540 bp, Artificial Sequence
  Description of Artificial Sequence: Synthetic coding sequence
tgacagtcgcgtaggattgaacccgttatggggaggctccttttgtgcgcttctcacggcgagattgaaaaacatccgtctttgcacgctagcagctacggactcgtcgcaatcaaggaggctcatgatatcgaaacaaggctaaatgaggttgagaagctgcttaaaactataatctcgatgccttgcaagtacagccggagcgaggtagtccttacattctttgagcgttctcccctcgatcaggtgcttaagaatgataatgtgcataagatccagccatcattccagagccctgtgaaaatttccgagatcatgagatctaacggattctgcctggccaacacagaaacgatagtgatcgaccatagcattcctaatggccgggatcagcagctaggcgtggaccccacagagcatctcttcgaaaacggtagcgaattcccgtccgaactggaggatggagatgatccggccgcatatgtcacaaatttgtcctattaccaccttgtcccgttcgagaccgatatctgggactag

SEQ ID NO: 32917 - DNA, 696 bp, Artificial Sequence
  Description of Artificial Sequence: Synthetic coding sequence
atggcctccgctgtgttcgaaggaacatctttggtaaacatgtttgtgaggggctgttgggttaatggtattcgaagacttatcgtgtcaaggaggggggacgaggaggagttctttgagatcagaactgagtggtcagaccgcagcgtgctgtatctgcatagatccctggctgaccttggccgactgtggcagcgactccgcgacgccttcccggaggaccggagtgaactcgctcagggccctctccggcagggactggtcgcgattaaagaggcgcacgacatcgagacccgattaaatgaagtggagaagctactgaaaaccatcatcagcatgccctgtaagtattcccgatctgaggtcgtgctaaccttcttcgagcgctctcctctggatcaggtgcttaagaatgataatgttcacaagattcagccaagcttccagtcacccgtgaagataagcgaaatcatgcggagtaatggattttgtctggcaaatactgagacaatcgtgattgatcattcgattccaaacgggcgcgaccaacagctcggggtggacccgacggaacatctgtttgagaatgggtccgaattcccgtcagagttggaagatggcgatgacccagcagcatatgtcacaaacctgagctactaccatctggtcccgttcgagaccgacatttgggactag

SEQ ID NO: 32918 - DNA, 1503 bp, Artificial Sequence
  Description of Artificial Sequence: Synthetic coding sequence
atggaagctgcgcggccaccgccaactgctggtaaattcgtggtggtggggggaggcattgctggcgtgacctgtgccgagcagctggccacccattttccttccgaagacatcctgctagtgacggcatcccccgtgatcaaggcagtcactaacttcaaacaaatttctaaaatcttggaggagtttgacgtggaggagcaatctagcactatgctgggtaagaggttccccaacatcaaggtgatcgagtctggagtcaaacagctcaagtcagaggaacactgtatagtgaccgaggacggaaatcagcacgtctacaagaagctatgcctctgcgccggcgccaagcccaagttgatctgcgaaggcaacccatatgtcctgggtatccgggacactgacagtgcccaagagttccagaaacagctgaccaaggcgaagaggataatgattataggcaatggaggcatagctcttgaactcgtgtatgagatcgaaggatgtgaggttatttgggcgattaaggataaagctatcggcaatacttttttcgacgccggggcggccgaatttctgacgagtaagttgatcgccgagaaatctgaagccaagattgcacataagcgaacaaggtacactacagaaggcaggaaaaaagaggctcggtccaagagtaaggccgataacgtaggcagtgccctcggccctgactggcacgaagggctgaacctaaaaggtaccaaggaattcagccacaagatacacctcgaaacaatgtgcgaggtgaagaagatttatttgcaggacgagttcaggattctgaagaagaaaagcttcaccttccctcgagaccacaagtctgtgacggcggacacagagatgtggcccgtttacgttgaactgactaacgaaaagatttatggttgcgacttcatcgtgagcgccacaggagtcactcccaatgtagagcctttcctccatgggaatagcttcgatcttggcgaagatggagggctgaaggtggatgaccacatgcatactagcctgcctgacatttacgccgcaggagacatctgtactacaagctggcagttgtcccctgtttggcaacagatgcgactgtggacacaggctcgtcagatgggttggtatgccgcaaaatgcatggccgcagcctcttctggagatagcatagatatggacttttcctttgaattgtttgcccacgtaacgaaattttttaattataaggtggtgctgctcgggaaatacaacgctcaggggctgggatctgaccacgaattgatgctgcggtgtacaaagggcagggagtacatcaaggtagtcatgcagaacggaagaatgatgggcgccgtgttaataggtgaaactgatctggaggagacattcgagaacctgatcctgaatcagatgaacctttccagttacggcgaggacctgctggatccaaacatcgacatcgaggattactttgattag

SEQ ID NO: 32919 - DNA, 420 bp, Artificial Sequence
  Description of Artificial Sequence: Synthetic coding sequence
atggaagccgccaggccgccacctaccgccggaaagtttgtagtggtgggagggggtatcgctggcgttacgtgcgcggagcaactggccacccacttccctagcgaggacattcttctcgttaccgcctcaccagtgattaaggccgtcaccaacttcaagcaaatctccaaaatattagaggagttcgatgtggaggagcagtcaagtacaatgctgggaaaacggttccccaatataaaggtgatcgagagtggagtaaaacaactgaaaagtgaggagcattgcatcgtcactgaggatggcaatcagcacgtctacaagaagctctgcctgtgcgctggggcaaaacctaagctcatctgcgaaggcaacccgtatgtccttggaatccgcgataccgactcagcccaggtgtag

SEQ ID NO: 32920 - DNA, 1746 bp, Artificial Sequence
  Description of Artificial Sequence: Synthetic coding sequence
atggctgccagcggccggggactgtgtaaagccgttgccgcttcccctttccccgcttggagaagggacaataccgaggcccgaggtgggctgaaacccgaatacgatgcagtcgtgattggcgccggtcataacgggctggtggctgcagcatatcttcagagacttggtgtcaataccgcggtctttgagaggcgtcacgttattggaggcgcagcagtaacagaggagatcatccctggattcaagttcagtagggcaagttacctgctgagcctattgcgcccgcaaatttacactgatctggagctgaagaagcatggcttaagactgcacctccggaatccgtattccttcactcctatgctagaagagggcgccggctctaaagtacctcgctgtctgctccttggaactgacatggctgagaaccagaaacagattgctcaattcagccaaaaggatgctcaggtgttcccaaagtacgaggaatttatgcatcggctggctttagccatcgatcccctcctggacgcagccccggtggatatggcagcgttccagcacggttccctgttgcagagaatgcgctccctcagcacattgaagccacttttgaaggctggacggatcctgggggcacagctgccccggtactacgaggtactgaccgccccgatcactaaggtgcttgatcaatggttcgaaagtgagcccctgaaagcaaccctggcaaccgacgcggtgatcggggccatgacatccccacacactccaggcagcggttacgtcctcctccaccacgtgatgggaggactggagggcatgcagggagcctggggctacgtccagggcggaatgggcgctctgtctgatgccattgcatcaagcgccacaactcatggcgcatccatcttcaccgagaagacagtggctaaggtacaggtcaatagtgaaggatgcgtgcaaggcgtggtccttgaggatgggacagaagttcgcagcaagatggtcctaagtaatacgagccctcagataacatttcttaaactgacaccacaggaatggctccctgaggagtttttggagcggataagccagttggacacgaggagccccgttacaaaaatcaatgtggcagtggatcggctcccctcttttctcgccgcgcctaatgccccccgcggacagccactgcctcaccatcagtgttcaatacacctcaattgcgaagacaccctgcttctccaccaggctttcgaggacgctatggatgggcttccttctcacaggcccgtcattgaactctgtatcccatctagtttggaccccaccctcgctccccctggctgtcacgtagtgtccctgttcacacaatacatgccctacactttggcagggggtaaagcctgggacgaacaggagcgcgacgcatatgccgatagggtgtttgactgtattgaggtctacgctccaggattcaaggacagtgtggtgggaagagatatccttactcctcccgatctggagagaatattcggcctgccgggtggtaacatatttcactgtgctatgtcactggaccagctctactttgcacgtccagtcccgctccattccggctatagatgccctcttcagggcctttatctatgtgggtctggcgctcaccccggagggggcgtcatgggcgccgcagggaggaacgccgcccacgtcgccttcagggacctgaaatctatgtag

SEQ ID NO: 32921 - DNA, 591 bp, Artificial Sequence
  Description of Artificial Sequence: Synthetic coding sequence
atgaaaccccgtacgcttgttgagctgagcaaattgggcctcggcaacgaaaccgtagtgcaattgcggaccctcgaactgcccgtggactatcgggaggctaaaagacgcgtgaccggtatctgggaggatcaccagccacagctggtggttcacgtcggaatggatactgctgctaaggcaattatcctggagcagagcggaaagaaccaggggtaccgagatgcggatatcagatccttctggcctgagggaggggtgtgccttcccggttcaccagatgtgctggaaagtggagtgtgtatgaaagccgtttgcaagagagtggcggtggaaggtgtggatgtcatcttttcacgagatgcgggtcggtatgtgtgcgactacacgtattatctgtctttacatcacggtaaagggtgcgctgccctgatacatgtgccccctctcagtagaggtctcccggccagtctgctggggagagcgctgcgagttatcattcaagagatgctggaagaggtggggaaaccaaaacacagggcacagtttgaagagaacagcaccatggtgctgccagcaaaaggcaattag

SEQ ID NO: 32922 - DNA, 429 bp, Artificial Sequence
  Description of Artificial Sequence: Synthetic coding sequence
atggacactgccgccaaggccataattctcgaacagtccggcaaaaaccagggctatcgcgatgccgatattcgctccttttggcccgaaggaggcgtttgtctgccaggctcccccgacgtgctggaatctggagtgtgcatgaaggcagtgtgtaaaagagtggccgtcgagggagtagatgtgatttttagtagagacgctggcagatacgtgtgcgattatacttattatctttccctgcatcatggaaaaggctgcgccgccctgattcatgtgccccccctctcgagaggccttcccgccagcttactgggccgggcactgcgggtaattatacaagagatgttggaggaggtcggtaaacctaagcatcgcgctcagtttgaggaaaacagcactatggtgcttccagcaaagggcaactag

SEQ ID NO: 32923 - DNA, 429 bp, Artificial Sequence
  Description of Artificial Sequence: Synthetic coding sequence
atggatacagcggctaaggctatcatcctggagcagtctggaaaaaaccagggatacagagacgctgatatcagaagcttctggcccgaggggggcgtgtgtttgccaggatcacccgatgtgttggagtccggggtgtgtatgaaggcagtctgtaagagagtggccgtcgagggagtcgacgtcatattctctcgcgatgcagggagatatgtgtgcgactacacatattacctaagcttgcaccatggaaaaggttgtgccgcccttatccatgtaccgcctctctcacgagggctaccagcaagtctgctgggcagggccctgagagtaatcatccaggagatgttggaggaggtgggtaagcctaagcatagagcccaattcgaagagaattcaaccatggtgctgccagcaaagggaaattag

SEQ ID NO: 32924 - DNA, 8397 bp, Artificial Sequence
  Description of Artificial Sequence: Synthetic coding sequence
atgacctctattcacttcgtggtccacccactgcccggaacagaggaccaactgaatgaccgccttcgcgaagtctcagagaaactcaacaaatacaacctcaacagccatccccccctgaacgtgctcgagcaggctacgataaaacagtgcgttgtagggcctaaccatgctgccttcctgctcgaagacggccgtgtgtgcaggataggtttcagtgtccagccagaccggctagaacttggaaagcctgacaacaacgatgggtccaaacttaatagcaattcaggggcagggcgaacaagccgcccaggcaggacctccgactccccttggttcctaagcggctccgagaccttgggtaggctggccggcaacaccctcggatctaggtggtcgtccggggttggaggcagcggtggcgggtccagcgggagaagctcagccggggcccgggactcacgacggcagacacgcgtgattcggaccggcagagacagggggtctgggctgttggggtcccaaccccagcccgtgatcccagcctcagtcatccccgaagagttgattagccaggcccaggtggtgttacaaggtaagagtcgctcggtcatcatccgggaactccagaggacaaacctggatgtgaatctcgccgtcaacaatctgttgtcaagggacgacgaggatggtgacgacggggatgacactgccagtgagtcctaccttccaggagaagatcttatgtcgctgctagacgccgacatccatagtgcccacccctcagtcattatagatgccgatgcaatgttctcagaggatataagttactttggatatccgtcgttccgccggagtagcctttcgaggctaggaagttctcgggttctgcttttacccctagaaagagatagcgagttactgagagagcgggaaagcgtcttgagactgcgggagcgaagatggctcgacggcgctagttttgacaacgaaagaggttctacaagtaaagaaggggagcccaaccttgataagaagaacacacctgtgcagtccccggtatctctcggcgaggacttgcagtggtggccagataaggatgggactaaatttatctgcataggggcattgtactccgaattgttggccgtgtcctctaaaggtgagttataccaatggaaatggagtgagtccgagccatacagaaacgcccaaaatccttccttgcaccacccacgcgcaaccttccttggattgaccaatgaaaagatcgtcttgctctcagccaattctatccgcgctaccgtcgcaacagagaataacaaggtggccacctgggtggacgagaccctcagcagcgtggcgtccaagctggagcataccgcgcagacatacagcgagcttcaaggtgaacgcattgttagcctacattgttgcgctttatacacgtgcgctcagctggaaaactcgctgtattggtggggcgtcgtacctttctcgcaaaggaagaagatgctcgaaaaggcacgcgctaaaaacaagaaacccaagtccagtgctgggatctctagtatgcccaacatcacagtggggacacaagtatgcctgcggaataatcctctgtaccacgccggcgcagtggcattcagcatttcagctggcataccaaaggttggagtgctgatggagagtgtatggaatatgaatgattcttgcaggtttcagctgagatccccagagtctctgaagaatatggaaaaggcgagcaagacaacagaggcaaaacctgaatctaagcaggagcctgtgaagaccgagatgggacctcccccatcaccagcatcaacttgttctgacgcatcctccatcgccagctcggccagtatgccatataagaggagaagatccacgccagcccccaaggaagaggagaaggttaatgaggagcagtggtctctccgcgaagtggtgttcgtcgaggatgtgaagaacgtgccggtgggtaaagtactgaaggtcgacggtgcctatgttgccgttaagtttcctgggacatctagtaataccaattgtcagaatagctcaggacctgatgcagatccatctagcctgctgcaggactgtcgtctcttacgaatcgatgagctgcaggtggttaaaacaggcggcaccccaaaggtccctgactgtttccagcgaacccccaagaagttgtgtatccctgagaagaccgaaattttggcggtgaatgttgattccaagggcgtgcacgccgttctgaaaaccgggaactgggtgcggtattgtatttttgacctagccacaggaaaggccgaacaggaaaacaatttccccacatcttctattgccttcttaggccaaaacgagcggaacgttgccattttcacagcaggccaggaatcacccatcatattgcgcgatggcaatggcacaatctatcccatggccaaggattgtatgggcgggatccgtgatccagattggctcgatctgccacctatcagtagcctgggcatgggggtccattcccttattaatctgcccgcgaactctaccatcaagaagaaggctgccgttataattatggctgttgaaaagcagaccctgatgcagcatattctgaggtgtgactatgaggcctgtcggcagtatttgatgaacttagagcaagcagtagttctcgaacagaacctccagatgctgcagaccttcatatcccaccgttgcgatggcaatcgaaatattctgcatgcctgcgtgagcgtgtgttttccaacctcaaacaaggaaaccaaagaagaggaggaggccgagaggtccgagcgaaacacgttcgcagagagattgtcggccgtcgaagccatagctaatgcaatcagcgttgtctccagtaatggccctgggaatcgcgccgggtccagcagcagcagaagtttgcgacttagagaaatgatgaggcgttcattacgggctgccggtcttggacgccacgaggcgggcgcatcgagcagtgaccaccaggaccctgtttcgcctccgatagcgccaccatcgtgggtacctgaccctcccgccatggaccccgacggtgatatcgacttcatacttgctcctgctgtcggctccctgaccaccgccgcgacaggtactggccagggccctagcactagcaccattcctgggccttctactgaacctagcgtcgttgagtctaaagatcgcaaggccaacgctcatttcatattgaagcttctttgcgacagcgtcgtgttgcagccatatctaagagaacttctctcagccaaagatgctaggggtatgaccccatttatgagcgccgtttccggacgggcttatcctgctgcgattaccatactagaaactgcgcagaaaatcgcaaaggcagaaatctcttcctcagaaaaggaagaggacgtgttcatgggaatggtttgtcccagtggcaccaacccagatgactcccctctttacgtcctttgctgcaatgatacctgttcattcacctggacaggcgccgagcacattaatcaggacatcttcgaatgccggacctgcggcttgctggagtcactttgttgttgcactgagtgtgcccgcgtgtgccacaagggtcacgactgtaaactcaaacggacatcccccacagcctactgcgattgctgggaaaagtgtaaatgtaagactctgatagccggacagaagtcggcccgcctcgacctgctttatcgacttctcaccgctaccaacctggtgactctccccaactctagaggtgaacacctgctgctgttcctggttcaaaccgtggctcgtcaaaccgtcgaacactgccagtacaggccacctaggatcagagaagaccgtaataggaaaacggcctccccggaagactctgatatgcctgaccacgatttagagccgccaaggttcgctcagctcgcattagagcgggtcctacaggattggaacgccctgaaaagcatgatcatgtttggcagccaggagaacaaggatcccctttccgcatccagtcgtatcggccacctgctgcccgaggagcaggtgtatctaaatcaacagtccggaactatcagactggactgcttcactcactgcttaattgtcaagtgtaccgctgatattttgttactggatactctcctaggcaccctcgtcaaagaattgcagaataagtacacacctggcagacgggaggaggcgattgctgtcacaatgagattcttacgctccgtcgcccgggtcttcgtcatactgagtgtggagatggcctcctccaaaaaaaaaaataactttatccctcaacccattggtaagtgcaaacgagtgtttcaagccttgttgccctatgccgtggaggagctttgtaatgtcgcagagagtttgattgtgcccgtccgcatgggtatcgccagacctaccgccccctttacccttgcctctacaagcattgatgcaatgcaggggagtgaggaactattcagcgtggagcccctccccccccgcccatcatcagatcagtcttcctcttcctcccaatcccagtcttcttatatcatccgtaacccgcagcagcgacggatctcccaaagccagcccgtacgcggcagggacgaggagcaagatgacattgtctcggccgacgtggaagaagtcgaagttgtcgagggagttgctggggaagaggatcaccacgacgagcaagaagaacacggcgaggagaacgccgaggcagaaggacagcacgatgagcacgacgaggacggctcggacatggaactcgacttgctggctgctgccgagacagagtctgatagcgagagcaaccactccaaccaggacaatgcctctgggagacggtccgtagtgactgccgcaaccgctggaagcgaggccggcgcatcgtctgtccccgctttcttctcagaggacgactcacagtccaatgatagtagcgactcagattccagctccagccagtctgacgacattgagcaggagaccttcatgttagatgagcccttggaacgaaccactaacagttctcacgccaacggcgccgcacaggcccccagatctatgcagtgggccgtgcggaacacacagcatcaaagggcagcttcgaccgcgccttcgtctactagtaccccagcggctagtagcgccggcctgatttatatcgatcccagcaatctgaggagatccggcaccattagcacaagcgccgccgccgcggctgccgctctggaggccagcaatgcgtcctcttatttaacgtctgcatctagcctcgccagagcatacagtatcgtcattcgacaaattagtgatttgatgggactgattcccaaatataaccatcttgtctacagtcagattccagctgctgtgaagcttacttaccaggacgccgtgaatctgcaaaactatgtggaagagaaattaatccccacttggaactggatggtctcaataatggacagcaccgaagcgcaactgcggtatggcagtgccctggcctccgctggggatcccggccacccaaaccacccactccatgcaagtcaaaatagtgcccgaagggaacgaatgactgcaagagaagaggcttctctgaggactctggaaggacgcaggagagccacccttcttagtgccaggcaagggatgatgagcgcacggggtgatttcttaaattacgcactttcgctgatgcgaagccacaatgacgaacactctgatgtattgcctgtcctggacgtctgcagtcttaagcatgtggcttatgtgttccaggccctaatatactggataaaggccatgaatcagcaaactacgctggacacaccacagcttgaaagaaagagaactcgcgaactcctcgaactgggaattgacaacgaggatagtgaacatgagaatgatgacgacacaaatcaatctgccactctgaatgataaggacgacgactccctccctgctgaaaccggccaaaaccatccgttctttcgacggtccgattccatgaccttcctcggctgcatcccccctaacccattcgaggtgcctctcgctgaggctattccactggcggaccagccacacctgctacagcccaatgcacgtaaggaagatctctttgggaggccaagccagggtttatactctagcagtgcatcatccggcaagtgcttgatggaggtcaccgtggatcgcaattgcctggaggtactgccaacaaaaatgtcttatgctgctaacctgaagaatgtaatgaacatgcagaacaggcagaaaaaagagggcgaggaacagcctgtgctccccgaagaaacagaatcctcaaagcctggtcccagcgcacacgacctggcagctcagctcaagtcttctcttcttgcagagattgggctgaccgaatccgaaggaccacccctgaccagcttccggcctcagtgtagctttatgggcatggtcattagtcatgatatgctcctggggaggtggagactgagtctggagctgtttgggcgtgtgtttatggaggatgtaggagctgagcctggctcaatcctgacggagctgggtgggttcgaggtgaaggagtcaaagtttcggagggagatggagaagctaagaaaccagcaaagtcgggatctttcccttgaggtagacagagatagagatctcctgattcagcaaactatgaggcagttgaacaaccattttggccgcagatgtgccacaaccccaatggctgtgcatagagtaaaggtcacgtttaaggacgaacctggtgagggttctggcgtggcaaggagtttctacaccgccatcgctcaggccttccttagcaatgagaagctgccaaatctagagtgtattcagaacgctaataagggtacacacaccagtttgatgcagagactgcggaatcgcggcgagcgagaccgggagcgcgagcgggagagagagatgcgcagatccagcggcctgcgggctggctcccgccgcgatcgggacagggactttcggaggcagctctcaatcgacacacggccattcagacccgctagtgaaggcaacccctccgacgatccagagcccctcccagcacaccggcaggccttgggggagcgcctttatcccagagtgcaggctatgcagcccgcttttgcatccaagatcaccggtatgctgctggaactgagtcccgcacagctgctgctcctgctcgcttctgaggactccctgcgcgcccgggtggacgaggccatggaattaatcatcgcccatggcagggagaatggggctgactctatcctggatttgggcctggtcgactcctccgagaaagtgcaggagaaccgaaaacggcacggctcatcgcgcagcgtggtcgacatggacctggacgacacagatgatggggacgacaatgcaccattgttttaccaacccggtaagcgtggcttctacacgccaaggccggggaaaaacactgaggcaaggttgaattgttttaggaacatcggcagaatcctggggctgtgtctcctgcaaaatgagttgtgtccgatcaccctcaacagacatgttattaaggtgctgctgggaagaaaggtcaactggcatgactttgcgttctttgaccccgttatgtatgagtcgttgcggcagctaatcctggcttctcagagcagcgacgctgacgctgtcttctctgccatggatctggcgttcgcgatcgacctgtgtaaggaggaaggtggtggacaagtggagctcattccgaatggggttaatatccctgtcacaccacagaatgtctacgagtacgtgagaaaatacgctgaacatagaatgctcgtcgtcgctgagcagcctcttcacgctatgcgaaagggcctgttagatgttctccccaaaaattcactcgaggatctgactgctgaggactttagacttctagtcaacggctgtggcgaggtgaatgtgcagatgctgattagctttacatctttcaatgacgagagtggagagaatgccgaaaagctcctgcagttcaaaagatggttctggagcatagtggagaaaatgtccatgacggaaaggcaggatttggtctatttttggacctcctccccgagtctgccagcctctgaggagggcttccaaccaatgcctagcatcactatcaggccacctgacgatcagcatctgcctacagcgaatacttgcattagccgcctgtatgtgcctctgtactctagcaaacaaatattgaagcagaagctgctccttgccatcaagaccaaaaattttggcttcgtttag

SEQ ID NO: 32925 - DNA, 414 bp, Artificial Sequence
  Description of Artificial Sequence: Synthetic coding sequence
atggcacggggacgtcacgtgggaagcagtgagacaaaactgctgcagcatctgctggaagcttgcggtcgctgtgaggaggtgcctgaggcttacgtcgatattcatactggacttagcgggtccggcgtggcttttgtgtgcgcgtttagtgaggccctggccgagggagcagtgaagatgggcatgccatctagcctggcccatagaattgctgcccaaaccctactggggacagctaaaatgctgctacatgaagggcagcatccagctcagttgcgatctgacgtttgtacgcctggtggtaccacaatttacggactccatgctctggagcaaggcggattgcgggcagcaacaatgtctgccgtggaagcggcgacttgtcgcgctaaagagctgagtaggaagtag

SEQ ID NO: 32926 - DNA, 762 bp, Artificial Sequence
  Description of Artificial Sequence: Synthetic coding sequence
atgacgcaaggaacggaggatttgaaggggcccgggcaacgttgcgagaacgagcccctcctggatcccgtaggacctgagcctctagggccagagagtcagagtggaaaaggtgacatggtagagatggcaaccaggtttggctccacactgcagttggacctcgagaaaggtaaagagagtctgcttgagaagcgcttggtggccgaagaagaggaagacgaagaggaagtggaggaagacggaccatcatcttgcagtgaggatgattattcggagttgttacaggagattacggataacctaacaaaaaaggaaattcagatagagaaaatacacttggatactagctccttcgttgaggagttgccgggcgaaaaagaccttgcccatgtagtcgagatttacgacttcgagcccgctctgaagacagaagatctcctggccactttctcagagtttcaagagaaaggctttcggatccagtgggtcgacgacacacatgctctgggcatttttccttgtcttgcatcagccgccgaggctttaacaagggaatttagtgtgttgaaaatcaggcctctaactcaaggtactaagcagtcgaaactaaaagcgctgcaaagacccaagctgcttcgtttagtgaaagagcgccctcagacaaatgccaccgtggctaggagactggtagctagagcactgggtctgcagcataagaaaaaagaaaggcccgcggtgaggggccccctcccaccttag

SEQ ID NO: 32927 - DNA, 1443 bp, Artificial Sequence
  Description of Artificial Sequence: Synthetic coding sequence
atgaacatgaaggcaagtagagtaactttgggcgaggcgggtgcaagagcccgctggcccttaggcactcccagagctgcagctaccagacgcgaggcagcggccctgcctcctgtgactctggcccttctttgcttagatggagtattcctgtcctccgcagaaaacgatttcgtgcaccgaattcaggaggagttagaccggtttctgcttcagaaacagttaagcaaagtgctgctgttccccccactctcgtccagactgcgctatctgatccataggactgcagagaactttgatctgctgtcgagtttttctgtcggagaaggctggaaaaggcgtactgtgatctgccaccaggacatcagagtcccttctagcgatggattgagcgggccctgtcgcgccccagcttcctgcccgagccgctaccatggtccccgcccaatcagtaaccagggtgccgcagcggtgccgcgaggcgcacgagcaggtcgatggtacagaggacgaaaacccgaccagccactttatgttccaagagtcctacgtcgccaggaagaatggggcctcacatccacctccgttttaaaacgagaagcccccgctggtagagatccagaggaacccggagacgtaggggccggggacccgaacagcgatcagggccttcctgtgctgatgacccaagggaccgaagacttgaagggaccagggcagaggtgtgagaacgagccactcctcgaccccgtgggacccgaacctcttgggcccgaatctcagagcggaaagggcgacatggtagaaatggccactagattcgggtcaaccctgcaactcgacttggagaagggcaaggagagtctgcttgaaaagcgcttagtagcggaagaagaggaggacgaagaggaggtagaagaggacggaccgagcagctgtagcgaagatgactactccgaactcctgcaagaaattacagacaacctcacaaagaaagagattcaaattgagaagattcatttggatacctcctcttttgtggaggaactgcccggcgagaaggatctagcccacgtcgtcgagatctacgatttcgaaccggctctcaaaacagaagatttgttggcaacattctcagagttccaagaaaaggggtttcggatacaatgggtggatgacacacatgcgctgggcatttttccatgcctggcctcagctgcggaggctttgactcgggaatttagcgttttaaaaatccgtccgctcacgcagggtaccaagcagagtaagttgaaagccttgcagaggccaaaactgttgagactagtaaaagagcgaccacagaccaatgccaccgtggctaggagactggtcgcccgagcactgggactgcaacacaagaagaaagagcggcctgcagtgcggggtcctctccctccatag

SEQ ID NO: 32928 - DNA, 762 bp, Artificial Sequence
  Description of Artificial Sequence: Synthetic coding sequence
atgacacaaggcacagaagacctgaagggacccggccagcgctgcgagaatgagcccttactcgaccctgtaggccctgagcccttaggtccagagtcacaatctggaaagggcgatatggtcgaaatggccactcgcttcggtagcactttacaactggacttggaaaaggggaaagagagcctgctcgaaaaacggctggttgccgaggaagaggaagatgaggaagaggttgaggaggatgggccatcttcctgtagcgaagatgactactcagagctccttcaggagatcaccgataatctcaccaagaaagagatacagattgagaaaatccacttggacacatcgtccttcgtggaagaattgcctggtgaaaaagatcttgcacacgtggtggagatctacgacttcgaacccgccctgaagactgaggatcttctggccacatttagcgagtttcaggagaagggatttagaatccagtgggttgacgatacccacgccctgggcatttttccctgcttggccagtgcagccgaggctctcacacgggagttttcagtgctgaaaatcagacctttgacacagggtaccaaacagtctaaattaaaagcactccagagacccaagctgttacgcctggtaaaggaacgtcctcagacaaacgcgacggtcgcaaggaggctcgtggcccgtgctctgggcctgcagcataaaaagaaagaaaggcccgccgtgagaggccctctccctccgtag

SEQ ID NO: 32929 - DNA, 111 bp, Artificial Sequence
  Description of Artificial Sequence: Synthetic coding sequence
atgacacagggtacggaggatctaaagggccctggccagcgatgcgaaaacgagcccctcctggaccccgttggcccagaacccctaggccctgaaagtcagtcaggctag

SEQ ID NO: 32930 - DNA, 402 bp, Artificial Sequence
  Description of Artificial Sequence: Synthetic coding sequence
atgactcagggtaccgaggatctgaagggccctggccagcggtgcgaaaacgaaccactcctcgatcccgtcgggcccgagccccttggccccgagagccagagcgggaagggagacatggtggagatggctacccggttcggtagcaccctgcagctggacctcgagaagggtaaggagagtctcttggagaaaaggctcgtagctgaggaggaagaggacgaagaggaggtggaggaagatgggccctcaagctgctctgaagatgattactcggaactgctgcaggagatcacagataatttgaccaaaaaggagattcagatcgaaaaaatccatcttgacacctcttccttcgtcgaggaactgcccggcgagaaagacctcgcccatgttgtgtag

SEQ ID NO: 32931 - DNA, 291 bp, Artificial Sequence
  Description of Artificial Sequence: Synthetic coding sequence
atgacacagggcacagaagacctgaagggtccgggtcaacggtgtgagaacgagcctctgttggatcctgtcggacccgagcctctcggccctgagagtcagtccggaaaaggtgacatggtcgagatggccactaggttcggtagcaccttgcagcttgatctcgaaaaagggaaggaaagtttgttagaaaagaggctggttgcagaggaggaagaggacgaggaggaggtcgaagaggacgggccttcaagctgctctgaggatgattactccgagttgcttcagtag

SEQ ID NO: 32932 - DNA, 3300 bp, Artificial Sequence
  Description of Artificial Sequence: Synthetic coding sequence
atgcgcatgagcgacaccgtgacagtgaaagacgaaaccgctaccatgaaggacctggaggcagaggtgaaagacaccacacgggtggagaacttaataaagtccgaaaactacggcaagattctcgtggagaagaacgaacactgtattgaaaataacatcgatcttcagcgccctctgcagagctttggacagaccggcaagagatccaaatcttcgagcaagctgaagctggtgcgcagcctggccgtttgtgaggagagtcccccacccccggctcccgaaatcagccaggaaaaccaggagaaaatccagattcagctgacccagtcctttgagaaggaggagaagccctctaaggatgaagcagagaaagagaaggcttcggataagctgccacgcaagatgctgtccagggactcctctcaagaatataccgactccacaggcatagacctgcacgagttcctggtgaataccctcaagaataatcctcgggacagaatgatgctgctgaagctagagcaggagatacttgatttcattggcaataatgagtctccaagaaaaaagttcccacccatgacttcctaccatcgaatgctactgcaccgcgtggctgcttacttcggcctggaccacaatgtcgatcagtccggcaagagcgttattgtgaacaaaacaagtaatacccggatcccggaccagaagttcaacgagcatattaaggatgacaaaggggaagattttcagaaaagatatatacttaaacgggataatagttccttcgataaggatgataaccaaatgagaatccgtcttaaggacgatcgccggtccaaatccattgaagaacgtgaggaagagtaccagagagcgcgggataggatttttagtcaagactctttgtgcagtcaggagaactacattatcgataaaaggctacaggacgaggacgctagctccacccagcagagacgtcaaatctttagagtcaacaaggacgcatccggcaggagcaccaattcccaccagagctctaccgagaatgaactcaaatatagcgagccacgaccgtggtctagcactgactccgactcctctttgaggaatcttaagccagctgttacgaaggccagttctttctcaggcattagtgtcttaactagaggcgactcctcaggctccagcaaaagcattggacgattgagcaagaccggatctgagtcttccggatcggtgggaagttccactgggagtctgtctcacatccagcaaccacttccgggaactgcgctcagccagtcttctcacggggcaccggtggtttaccccacggtgagcactcattcctctcttagcttcgatggagggctcaatggccaggtggcttctccttccacatccttctttctgttgccactggaggccgccggtattcccccaggcagtattttaattaatcctcagacgggccagcccttcataaacccggatgggagtcccgtggtatacaatcctccaatgacccagcaacccgtgcgaagccaagtgcctgggcctccccagccacccctgcccgcacctcctcagcaaccagcggctaaccatatttttagccaggacaatctgggttctcaatttagccatatgtcactcgctagacagccgtcggcggatgggtctgatccacatgcagccatgtttcaaagcactgtggtgctgcaatccccacagcagtcagggtatattatgacggccgcccctccaccgcacccgccaccaccaccaccacctcccccgcctcccccccccctcccacccggacagcccgttcccacagccgggtatcccgccagcggccacccagtttctcagcccgtgctccaacaacagggctatatccagcagccctccccccaaatgcccgcctgttactgcgcccccgggcactaccacagctcacagcctcagtataggcccgtgcctagcgttcactataatagccacctcaaccagcccctgccacaacccgctcagcagaccggttatcaggtcatccccaatcagcagcagaattatcaaggcatagtaggagtacagcagcctcagtcccagagtctagttagcgggcaacctaactcaattggcaatcagatccagggagtcgtcatcccttataccagcgttccaacctaccaggtttctctcccccaggggtcccaaggcatccctcaccagacgtaccagcagcctgtcatgtttcccaatcagagcaatcagggcagcatgccgactacgggcatgcctgtttattacagtgtcatcccacccggacagcagaacaatctctcaagttctgttggctatctgcagcacccagggtctgaacaagtccaatttccccgcactaccagcccttgttcttcccagcagctgcagggccaccaatgtaccgcgggaccacctccccctcccggcggggggatggtgatgatgcagctgagcgtgcccaacaacccacagagttgcgctcactcccccccacagtggaagcagaacaaatactattgcgatcaccagcgcggacagaagtgcgtcgaattttcttctgtcgataacatcgtccagcacagcccccagctcagtagcccaattatcagtcctgcccagtcccctgccccagctcaactgtccacattaaagactgtgcggccaagtgggccccccctgagcattatgcctcagttcagccggcccttcgttcccggtcagggggacagtcggtaccctctccttggccagccccttcagtacaatccaccagccgtcctccacgggcacatccctaatcagcagggccaacccggaagtagacacggtaacaggggacgcagacaagctaaaaaggccgcttcgacggacttaggggccggagagacagtggtgggaaaagttctcgaaattactgagctcccagatggcattactcgcatggaggccgagaagctattcggtgagctgtttaagattggcgcaaagatcaggtggcttagggatccgcagagccagcccagaagacaccctctctgctgtgggtccggagacaatactgcaaaccctgaacgctccaaaccctctgacttggcgagcacctacaccgtcctggcgacctttcctagtattagcgctgcccaaaacgccctgaagaaacagatcaacagcgtgaataaatttaagctgaggacatctaagaaacactatgactttcatatcctggaacgtgctagctctcaatag

SEQ ID NO: 32933 - DNA, 2913 bp, Artificial Sequence
  Description of Artificial Sequence: Synthetic coding sequence
atgaggatgtctgacacggtgaccgtcaaggatgaaaccgctacaatgaaggacctggaggccgaggtgaaggacaccactcgggttgagaacctcatcaaatctgagaactatggcaaaatcctcgtggagaagaatgagcactgcattgaaaataacatcgacctgcaggaaaaaatacagatccagctaacgcagtccttcgagaaagaggaaaagccttccaaggacgaggccgagaaggagaaggctagcgacaagctccctcgcaagatgctttccagagattcatcccaggaatacacggatagcacaggcattgaccttcatgaatttctggtcaacacattaaagaataaccctagagacagaatgatgctattaaaactggagcaggagatactcgacttcattggaaataatgaatcacccagaaagaagttccctcccatgacatcgtaccataggatgctgttgcaccgggtcgctgcctacttcggactcgatcataacgtagatcagtcagggaagtctgtgatcgtgaataagacatcaaacacccgtattcccgaccagaaatttaacgagcacattaaggatgacaaaggagaagactttcagaaaaggtatattcttaaacgggataatagctcgtttgataaagacgataatcagatgagaataagactgaaagacgaccgcaggtccaaatccatcgaagagagggaagaagaatatcagcgggcccgggatcgtattttttcccaggattcactttgtagtcaggagaactatatcattgataaaagattgcaggatgaagatgcttctagcacccagcagcggcgtcaaatctttcgagtgaataaagatgcgagtggcagatccacaaattcccatcagtcctccaccgagaatgagctgaagtactctgaacccaggccttggtcaagcaccgactccgattcgtcactccggaacctgaaacccgctgtgaccaaggccagtagtttctcaggcataagcgtgttgaccaggggtgattcaagcggaagctccaaatctattgggcgactgtcaaaaaccgggcagccttttatcaaccccgatggaagccctgtcgtttacaacccgccaatgacccagcagccggtaagatcccaggttcccgggcccccgcagccaccgttaccagcccctccacagcagccagctgccaatcacatctttagccaagacaatctggggtctcagttcagccacatgtccctcgctaggcagccatctgctgacggcagtgacccacacgccgcgatgttccaatcgacagttgtactgcaaagcccacagcaaagcggttacatcatgaccgccgctccccctcctcacccgccccctccgcctcccccaccgcccccccccccccccctacccccaggtcaaccagtccccactgctggctaccccgcatccggacatcccgtctcccagcctgtcctacaacagcagggctatattcagcagccatcaccacagatgcccgcttgctactgtgccccaggacattaccactcctctcagccccagtaccgaccagtgcctagtgtgcactacaacagccacttgaaccagcctctcccacagccagcacagcagaccggataccaggtgatccctaatcaacaacaaaactatcagggtattgtgggcgtgcagcagccacaatcccagtctttggtgtctggccaacctaactctattggaaaccagattcaaggagtggtgatcccctatacgagtgtgccaacctaccaggtcagcctcccccaagggtcccagggtattccgcaccagacataccagcagcctgtgatgttccctaatcagtccaaccaggggtcgatgccaacgactgggatgccagtgtattacagcgtaatccccccgggtcaacaaaacaatctctcttcatccgtgggctacctgcagcaccctggctccgagcaagtgcaattcccacgaaccacaagcccctgttcctcgcagcagctacaaggacaccagtgtacggccggtccaccaccccctccaggaggggggatggtgatgatgcaacttagcgtccccaacaacccgcagtcttgcgcccattctcctcctcagtggaaacagaataagtattattgtgatcaccagcggggccagaagtgcgtagaattttcaagcgtagataatattgtacagcatagtccccagctgagtagcccaatcatatctcccgcccaaagtccagcaccagcacagcttagtaccttgaagaccgtccggccgagcggcccgcctctaagcattatgcctcaattcagtagacctttcgtgccggggcagggtgattcaagatatcccctgctcgggcaaccgcttcagtataatcctccagcggtcttacatggacacattccaaatcagcaaggccagcctggctctcggcatggtaacagaggtcgacgacaggcaaagaaagcggccagcacggatctgggtgccggagaaaccgtggtaggtaaagtcctggaaatcaccgagttacctgacggcatcacccgcatggaggctgaaaagctgtttggtgaactgttcaaaatcggggccaagattcggtggcttcgcgaccctcagtcccagccacgacggcaccccctgtgttgtggatcaggggataacaccgccaaccctgagagaagcaaaccaagcgacttggctagcacctatacagtgttggccactttcccctcaatcagtgcagctcagaacgctttgaaaaaacaaatcaacagcgttaacaagttcaagttgcgcacctcgaagaagcactacgacttccacattctggagagggcctcttcacagtag

SEQ ID NO: 32934 - DNA, 807 bp, Artificial Sequence
  Description of Artificial Sequence: Synthetic coding sequence
atggtcgcattagagaatcctgagtgcggaccggaggccgccgaggggaccccaggagggcgacggttgctgcctttaccaagctgtctgcccgcacttgcatctagtcaggttaagcggctgtcggcctcccggagaaaacagcactttattaaccaggcggtcaggaactccgatttggtgccaaaggctaagggacgcaaaagcctgcagaggctggaaaatactcagtaccttctgactcttctcgagacagacggcggccttcccggcctggaagacggagacttggccccccctgcctccccgggcatcttcgccgaggcatgtaacaacgccacatatgttgaagtgtggaacgactttatgaaccgatccggggaggagcaggaacgcgtgctgcggtacttggaagacgaaggacgctcaaaggctcgccgcagaggccccggacggggagaggacagacgccgcgaggaccccgcttatacgccgcgggagtgtttccagaggatcagcagaagacttcgggcagtactgaagcgcagcagaattcccatggagacgctggagacctgggaagaacgcttactgagatttttttcggtctctccccaagccgtgtacaccgctatgctcgataactcttttgaacgactgctgctacacgccgtttgccaatacatggacctgatttcggctagtgcggatctggagggcaagagacaaatgaaggtgagcaaccgacatctggactttctgcctcccggactgctgctgtccgcttacctggaacaacatagctag

SEQ ID NO: 32935 - DNA, 690 bp, Artificial Sequence
  Description of Artificial Sequence: Synthetic coding sequence
atggctgaggacaaaactaaaccatcagaactcgatcagggaaagtatgacgcagacgacaacgtaaagatcatctgcttgggtgatagtgctgtgggcaaatccaaactgatggagagatttcttatggacggattccaaccacagcaactgagcacttacgctttgacgttgtacaaacacacggctacagtagacggcagaactattctggtggacttctgggacactgcaggccaagaaaggttccagagcatgcatgccagctattaccacaaagcccacgcatgtatcatggtttttgacgtgcagagaaaagtcacttatcgtaatctgtccacgtggtacactgaactgagggagtttagacccgagataccatgcatcgtcgtggcaaataagatagacgccgacatcaatgttacacagaaatccttcaactttgctaagaaattcagtctgcctctgtacttcgtctctgctgccgatggaaccaatgtggtcaagctgtttaacgatgcaatccggctggccgtgtcctacaagcagaattctcaggactttatggatgagatatttcaggaacttgagaacttctctcttgaacaagaggaagaagatgtgcccgatcaggaacagtcttccagcatcgaaacaccaagtgaagaagccgccagccctcactcttag

SEQ ID NO: 32936 - DNA, 687 bp, Artificial Sequence
  Description of Artificial Sequence: Synthetic coding sequence
atggcagaggacaagactaaaccttctgagttggaccagggtaagtatgacgccgatgataacgttaaaattatttgtctgggagattcggcggtgggcaaatccaaactcatggagagattcttaatggatggatttcaaccccagcagctgagtacatatgcccttaccctctacaagcatactgctactgtcgatggtaggactatcctggtggacttctgggatacagcaggccaagagagatttcagtccatgcacgccagctattatcacaaggcacatgcttgcatcatggttttcgatgttcagcgaaaggtgacctacagaaacctctccacatggtatacagaattacgagaattccgtccagagattccttgcatcgttgttgctaacaaaatcgacgacattaacgtcacgcaaaagtcttttaactttgctaaaaagtttagccttcccctgtattttgtgtccgctgctgacggcaccaacgtcgtaaagttatttaatgatgctattagactggccgtctcatacaagcaaaactcacaggattttatggatgagatctttcaagaattagagaacttttctttagaacaggaagaagaagacgtccctgatcaggagcagtccagcagcatcgagacaccttctgaggaagccgcctctcctcattcctag

SEQ ID NO: 32937 - DNA, 690 bp, Artificial Sequence
  Description of Artificial Sequence: Synthetic coding sequence
atggccgaagacaaaaccaaaccttcagagctggatcagggtaagtacgacgccgatgacaatgtcaaaattatttgtcttggcgacagtgccgttgggaaaagtaagctcatggaacggtttctcatggacgggttccaacctcaacagctatcaacttatgcgctgactctgtataagcacactgccacagtcgatggacgtacgatcctcgtcgatttttgggacacggccggacaggagcgtttccagtccatgcatgcatcttactaccacaaagcgcacgcgtgcattatggtcttcgacgtgcaaagaaaagtgacatacaggaacttgtccacctggtacacagaacttcgggaatttcgccctgagatcccttgtattgtcgtggcgaataagatcgatgccgatatcaacgtgacacagaagagttttaacttcgctaaaaagttctcgctacccctttactttgtcagtgcagccgacggaaccaacgtcgtcaagctttttaacgacgccatcagattggcagtctcttacaaacagaatagccaggattttatggatgagatctttcaggaattggagaacttctcgctggagcaggaggaggaggacgtgcccgatcaggaacagagctctagtatagagacaccatctgaggaggccgccagcccccattcatag

SEQ ID NO: 32938 - DNA, 558 bp, Artificial Sequence
  Description of Artificial Sequence: Synthetic coding sequence
atgctcaaggctaagatcctgttcgtgggcccatgcgaatccggaaagacagttcttgcaaattttctcaccgaatcgagcgacatcacagagtactcccccactcagggcgtgcgaatactcgaattcgagaacccacacgttaccagtaataacaaagggacaggctgtgaatttgaactgtgggattgtggcggcgatgccaagttcgagagctgctggcccgctctgatgaaggacgcacacggcgttgtgattgtgttcaacgccgatataccctcccatcggaaagaaatggaaatgtggtactcatgctttgtgcagcaacccagtctgcaggatacccagtgcatgctgatcgcacaccataagcctggtagcggggatgataaaggaagcctgtccctcagtccccccttgaacaagcttaagctcgtccacagcaatttggaagacgatcccgaagagattagaatggaattcataaagtatctgaagtctatcatcaactccatgtctgaatcaagggacagagaggagatgtccattatgacatag

SEQ ID NO: 32939 - DNA, 558 bp, Artificial Sequence
  Description of Artificial Sequence: Synthetic coding sequence
atgttgaaggctaaaatcctctttgtcgggccttgcgaatctggcaaaacagtattggcaaacttccttacggagtcaagcgacatcacagagtattctcccacacagggcgtgcggatacttgaattcgagaacccccacgtgaccagcaacaacaaaggcacgggatgtgagttcgagctctgggattgcggaggcgacgctaaatttgagtcgtgctggcccgcgctcatgaaagacgcgcacggcgtcgtcatcgtcttcaatgccgatatcccgagtcatcggaaagaaatggaaatgtggtactcctgttttgttcagcagccctcgttgcaagatacgcagtgcatgctaatagcccaccataaaccgggctcaggggacgataagggctcactcagtctttcaccccccctcaacaagcttaagcttgtacacagtaatctggaggatgatcctgaagagattcgaatggagtttataaaatatctcaagagcatcattaacagtatgagcgaatctcgcgatcgcgaagagatgagtatcatgacctag

SEQ ID NO: 32940 - DNA, 468 bp, Artificial Sequence
  Description of Artificial Sequence: Synthetic coding sequence
atgcttaaagcaaaaatcttgttcgtcgggccgtgcgagtcaggcaaaaccgtgcttgcaaactttttaactgagtcatctgacattacagagtactcccccactcagggcgttaggtttgagagttgctggcctgccctgatgaaagatgcacacggagtcgttatcgtgttcaatgccgacatccccagccacaggaaggagatggagatgtggtatagttgcttcgtgcagcagccatccctgcaggacacccagtgcatgctgatcgcacatcacaagcctggttccggggacgataagggcagtttgtctctgtcccctcccctgaacaagttgaaattggtgcactctaatttggaggatgatcctgaagaaatcaggatggagttcatcaaataccttaagtctattattaatagtatgagtgagtctagagatcgcgaagagatgagtataatgacatag

SEQ ID NO: 32941 - DNA, 327 bp, Artificial Sequence
  Description of Artificial Sequence: Synthetic coding sequence
atgaaggacgctcatggggtcgtgatcgtctttaacgccgatatcccctctcacagaaaagagatggagatgtggtactcatgcttcgtacaacagccgagcttacaggacactcagtgtatgctgatagcccatcacaaaccgggctcaggggacgacaaaggctccctctcactgagcccccctttgaataaactgaaactagtgcattccaacttggaggatgaccccgaggaaattcgaatggagttcatcaaatatcttaagtccataataaactcaatgagcgaaagccgagacagggaggaaatgtctattatgacctag

SEQ ID NO: 32942 - DNA, 327 bp, Artificial Sequence
  Description of Artificial Sequence: Synthetic coding sequence
atgaaagatgcacacggggttgtgatagtgttcaacgccgatataccttctcaccgcaaggagatggagatgtggtacagttgtttcgtgcagcagccatcccttcaggacacccagtgcatgttgatcgcacatcataagcccggatccggcgacgataagggttccctgagtttgtctcccccactgaataagctgaagcttgttcatagtaacctcgaagacgatccagaggaaattaggatggagttcatcaagtatctcaagagcatcattaatagtatgtccgagtcgcgggatagagaagagatgagcattatgacctag

SEQ ID NO: 32943 - DNA, 1071 bp, Artificial Sequence
  Description of Artificial Sequence: Synthetic coding sequence
atggacagttctgaggaacacgccggatgtcccgccaggggaacttgcccggtctttctcgcgatgagtgccggaaccgtccggtatgcccctagtggtctgtgtcccgtgctagaggggaatctgagagaggagccatggggaactgatagccctcctcaacccgaccagggcctgcctcctccgctggctgcagtgcctgtgccgtggaagagcacagatccctgtcaaggacaccgggaaagcccaggcgctcttgtggaaacctccgcaggtgaagaagcccagggacaagaggggccagcggccgcccagctagacgtcttgagactgcgctccagtagcatggagatccgagagaagggcagcgagtttttgaaagaggagttacatagagctcagaaggagcttaaactcaaggatgaggagtgtgaacgactgtctaaagtcagggaacagctagagcaggagctcgaagagcttactgcgtccttatttgaagaggctcacaaaatggttagagaagccaatatgaagcaagccgcctcggaaaaacagctgaaggaagcaaggggcaaggtggacaccatcctattcgcagaatttcaggcgtggagagagtcccccacgctggacaaaacatgcccctttctggagagagtgtacagagaggatgtggggccctgcctggattttacaatgcaggaactgtccgttttggtaagagccgccgtggaagataacaccttgactatagagccggtcgcttctcagactctacctacagtgaaagtcgcagaggtcgactgtagttcaactaatacctgtgctttaagcggcttaacacgcacctgccgccacaggatcaggctgggggatagcaaatctcactactacatctccccatcatctcgggccagaattaccgcagtgtgtaacttttttacttatatcaggtacatccagcagggtctcgtgcgccaggatgccgagcccatgttctgggagatcatgaggctccgcaaagaaatgtccctcgctaagctcgggttctttccccaggaagcgtag

SEQ ID NO: 32944 - DNA, 1149 bp, Artificial Sequence
  Description of Artificial Sequence: Synthetic coding sequence
atgtggagtggccctccacaaccagatcagggactccctccacccctcgccgcggttcccgtgccctggaagtctactgatccctgccagggtcatagggaaagcccaggggccttggtggagaccagcgctggagaagaagctcaaggtcaggaggggcctgccgcagctcagttggacgtgctgcgtctccggtcttctagcatggaaatacgagagaagggctcagaatttcttaaggaggagctgcaccgggctcaaaaggagcttaaactcaaggacgaagaatgcgagcggctctccaaagtgcgggagcagttggagcaggagcttgaggagctaacagcgtccctctttgaggaggctcacaagatggtgcgagaggcaaacatgaagcaggccgcttccgagaagcagctcaaagaagcgagaggcaaaatcgacatgctgcaggccgaagtgacagcccttaaaaccttggtgatcacctcaactcccgcctcacccaaccgagagctacatccccagctgctttctcccaccaaagctggcccccgcaaaggccatagtaggcacaaatccacttctagcaccctgtgtccggccgtatgccccgccgcaggtcataccctgactccagaccgcgagggtaaagaggtggataccattcttttcgctgagtttcaggcctggcgggagtctcccacactggacaagacttgtccctttctggagagggtttatcgggaggatgtggggccatgcctggacttcactatgcaggagctctccgtgctggtcagggctgctgttgaggataacacgctgacaatcgaacctgtggccagccagacgctaccaactgtcaaggtggctgaggtggattgttcaagtactaatacttgtgccctctcaggactaacaaggacctgcaggcatagaattaggctgggggatagcaagagtcattactacataagcccaagttccagggcccgcattactgctgtctgcaatttctttacgtacattcggtacatccagcaggggttggtccggcaggatgccgagcccatgttttgggaaattatgaggttgcggaaggagatgtccctcgctaaactggggttcttccctcaggaagcatag

SEQ ID NO: 32945 - DNA, 318 bp, Artificial Sequence
  Description of Artificial Sequence: Synthetic coding sequence
atggctacacagggtcccgacaaggtaatcttcctgcttgtcggacataagtcggatcttcagtctacgaggtgtgtgagcgcacaggaggccgaggagctggccgcttctttgggtatggcattcgtcgagacctcagttaaaaacaattgcaacgttgatcttgcatttgacaccctcgccgacgcaatccagcaagccttgcagcagggggacatcaagctagaagagggctggggaggcgtccgcctgatacacaaaacccaaatccctagaagcccgtctcggaaacagcatagcggcccatgtcagtgctag

SEQ ID NO: 32946 - DNA, 1398 bp, Artificial Sequence
  Description of Artificial Sequence: Synthetic coding sequence
atggctatgaccggctctacaccttgctcaagtatgtctaaccacacaaaagagagagttaccatgacaaaggtcactctggagaatttttatagcaatttgatagcacagcatgaggagcgagaaatgcggcagaagaagcttgaaaaggtcatggaagaggagggcctgaaggatgaagagaaaaggctcaggagaagtgctcatgcccgcaaagagaccgaatttctgaggctcaaacgtaccagacttggcttagaagactttgagtcactgaaggtgatcggccgcggtgcatttggggaggtacggctggtgcagaagaaagataccggtcatgtctacgccatgaagatccttaggaaggcggatatgctggaaaaggagcaggtaggacatatcagagcggagagagacattttagtggaggctgatagtctgtgggtcgtgaagatgttctacagcttccaagataagctcaacctttaccttattatggaattcctccctggtggcgatatgatgacattgttaatgaagaaagacacactgacagaggaggaaacgcagttttatatcgccgaaacggtgttggcaattgatagtatccaccagcttggcttcattcatcgcgacatcaagccagacaacctgctgctggatagcaaaggccacgtgaaattgtccgactttggcttgtgcaccgggctgaagaaggcgcaccggaccgaattctaccgcaacttaaaccatagtttaccgtctgacttcacttttcagaatatgaattccaaacggaaagctgagacttggaagcgcaacagaagacaactggcattctcaactgtcggaactccagattatatcgctcctgaggtttttatgcagactggctacaacaagctgtgtgactggtggagcttaggcgttattatgtatgagatgctaatcggatatcccccattttgctccgaaactccgcaggagacctacaaaaaggtaatgaactggaaggaaacgctgaccttccctcccgaggtgcctatctcagagaaagcaaaggacctgattcttcgcttctgctgtgagtgggagcatcgcatcggcgctcccggggttgaagaaatcaagagcaactctttctttgaaggagtcgactgggagcacattagagagcggcctgccgccatctctattgagattaagagcattgatgatacctcgaacttcgatgaatttcccgagtccgatattctgaaacccaccgtggcaaccagtaatcatcctgaaacagactacaaaaacaaggattgggtcttcattaattatacatataaacgcttcgaaggcctcacagcccggggcgctatcccctcgtatatgaaggcagccaaatag

SEQ ID NO: 32947 - DNA, 651 bp, Artificial Sequence
  Description of Artificial Sequence: Synthetic coding sequence
atggccggcaggggaggagctgcccgccccaatggcccagctgctggaaacaagatctgccagttcaaactggtactcttaggggagtccgcagtgggcaagagtagcctggtcctgcgcttcgtgaaaggtcaattccacgagtatcaggagtccacgatcggcgccgccttcctaacccagactgtctgcttggacgacacgaccgtgaaatttgagatttgggatactgccggacaagaacggtatcactctctggccccaatgtattaccgaggagcccaagcagccatcgtggtctacgacattacaaacacagacacttttgctcgcgccaagaattgggtcaaagagctgcaaagacaggctagccccaatatcgtgatcgcactggcggggaataaagccgatttggcatcaaagcgagcagtggaatttcaagaggcccaagcttacgccgatgacaacagcttgctgttcatggaaacatcagccaagaccgcaatgaacgtaaatgagatatttatggctatcgcaaaaaagctgccaaagaatgaaccccaaaacgcgacaggtgcaccagggcgaaatcgcggcgttgatctccaggagaataaccccgcctcacgtagccagtgttgcagcaactag

SEQ ID NO: 32948 - DNA, 861 bp, Artificial Sequence
  Description of Artificial Sequence: Synthetic coding sequence
atggcagatacgatatttggctccgggaacgatcaatgggtctgtcccaacgaccgtcagctggccttgcgggccaagctgcagacaggctggtcggtccacacctatcagactgaaaagcagcgccgaaagcaacacctgtcacctgccgaggttgaggctattctgcaggttatacagagggccgaacgactggacgttctggagcaacagaggatcgggaggctcgtggaacgactggagacaatgaggaggaacgtgatgggaaacgggctctcccaatgcctgctgtgcggagaggtgctgggcttcttgggtagttcatccgttttttgtaaagattgtaggaaggtgtggaaaaggtcaggtgcttggttctacaaaggactccctaaatacatcctgcctctaaagacccccggacgagctgacgatccacatttcagaccgctgccaaccgagcctgccgagagggagccaagatctagcgagaccagcagaatatacacttgggcccgcggaagagtcgtgagcagcgattccgatagtgattctgacttatcatctagtagcctggaggaccgcctgccaagtacaggggtgcgagatcgcaaaggtgacaagccctggaaagaatcaggcggctccgtggaggcacctcgaatgggatttacccatcctccaggacacttgagtggttgccagagctcattagcatctggcgagactggaacaggcagcgcagaccccccaggggggccacgacctggtttaacccgccgagctccggtgaaggatacgcctggcagggcacccgcggccgatgccgcaccagccggtccaagctcgtgtctggggtag

SEQ ID NO: 32949 - DNA, 2013 bp, Artificial Sequence
  Description of Artificial Sequence: Synthetic coding sequence
atgaaccaggtgactgactgggtggatccctcttttgacgactttcttgagtgtagtggtgtgtcaactattaccgctactagtctcggcgttaacaatagctcacaccggcgtaaaaacggaccctctaccttggagtcatccaggttccccgctcgtaagagagggaacctgtctagcctggagcaaatttacgggctggagaattctaaagagtatctgtcggaaaacgaaccatgggttgataagtacaagcccgagacacagcatgaactggctgttcataagaagaagatcgaagaggtggaaacatggcttaaggcccaggtgctcgagaggcagcccaagcagggggggagcattctgctaattacgggccctccggggtgcggcaagacgacaactctgaaaattctgtccaaagagcacggcatacaggtgcaggaatggatcaaccccgttctgccagatttccagaaagacgactttaaaggaatgttcaacaccgaaagtagcttccacatgtttccatatcagagtcagatcgccgtcttcaaggaatttctactgcgagcaacgaaatacaataaactgcagatgttaggggatgatctccggactgacaaaaagattatactggtcgaggatttaccaaatcagttctacagggattcccacaccctgcatgaagtgctgcgtaagtacgttagaatcgggcgctgccccctcatattcattatttcagacagtctttcaggagacaacaaccagcggctgctgtttcccaaggagatccaggaggagtgtagcatatctaatatctcatttaatcccgtggcccccacaattatgatgaagtttctgaaccgcattgtaacaatcgaagccaataaaaacggggggaaaataactgtgcctgacaaaaccagtctggagttgctatgtcagggctgttccggagatataagaagcgccattaattcacttcagttctcctcatctaagggtgaaaataacctgaggccaagaaaaaaagggatgagcctcaagtctgatgccgtgctgagcaagtcgaagcggcgcaagaaaccagaccgcgtttttgaaaaccaggaagtacaggccatcggcggaaaagacgtgagcctattcctgttccgggcactggggaaaatcctgtactgtaaaagggcaagcctcacagaactggattccccgcgcctgccttcccatctgtcggaatatgaacgggacactctgctggttgaacccgaggaagttgtcgagatgtcacatatgccaggcgatctgttcaacttgtatctgcatcagaattatatagatttttttatggagatagacgatattgtgagggcctcagaattcctgagctttgctgacatcctgagcggcgattggaacacccgcagcttactgagggaatactccacatccatcgccacgagaggggtgatgcattctaataaggcaagaggctacgcccactgccagggcggaggttcttccttccggccactgcataaaccacaatggttcctgataaacaagaaatatcgcgagaattgtctggcagctaaggcccttttccccgacttctgtctccccgccctatgtaggcagactcagctcctaccatacttagcactgctcaccatacccatgcggaaccaggcccagatcagctttatacaggatattggtcgtctgcctttaaaaaggcatttcgggcgtctgaagatggaggcccttacagaccgcgaacacggcatgatcgatcccgacagtggtgacgaggcgcaactcaacggcgggcatagcgcagaggagtccttaggggagcccacccaggccacagtccccgagacttggtccctccccctgtcccagaactccgcctccgaattaccagcctcccagccacagccatttagtgcccagggtgatatggaggaaaacattatcatcgaagattacgaatccgacggaacctag

SEQ ID NO: 32950 - DNA, 2013 bp, Artificial Sequence
  Description of Artificial Sequence: Synthetic coding sequence
atgaaccaggtcaccgattgggtggatcctagcttcgatgacttcctggagtgtagtggcgtcagtacgattacagcaaccagtctcggcgtgaacaacagctcccacaggcgcaagaatggcccttcaacactggaaagctcacggttccccgccagaaaaaggggcaatctgagctccctcgagcagatttatggactggagaatagcaaggagtacctgtctgagaacgagccctgggttgataagtataaacctgagactcagcatgagctggccgtccacaagaagaaaattgaggaagttgagacctggcttaaggcccaagtcttagaacggcaaccaaaacaggggggctccatactcttgatcaccgggccgccaggctgtggaaagacaactactttaaagattctcagcaaggagcacggcatccaggtacaagagtggattaacccagtccttccggacttccagaaagatgatttcaaaggcatgtttaatacagagagcagctttcatatgttcccctatcaatctcagattgctgttttcaaagagttcctcttgagagctaccaaatataataaactccagatgctgggggacgacctgcgtactgataagaagataatccttgtggaggatctcccaaatcagttttaccgggatagccacacactacatgaggtgcttaggaagtatgtccgtatcggacgatgccccctgatattcatcatctctgactcattaagcggagacaataaccagagattactgtttcctaaagaaatccaggaggagtgtagtatttcgaatatctcctttaacccagtcgcccccactatcatgatgaagttccttaaccggatagtgacgatcgaggccaacaaaaacggcggaaagatcacagtgccagataagacctccttagagttgctttgtcagggatgttcaggggacatccggtctgctattaattcactccagttctcgtcttctaagggtgagaataatctgcgccctaggaaaaaagggatgagcctaaagagtgacgcagtgctttccaagagcaagaggagaaaaaaacccgatagggtcttcgagaaccaagaggtccaggcaatcggaggcaaagatgtgtcccttttcctgttccgagccctggggaagattctttattgtaagagagcgagccttaccgagcttgattccccccgacttccctcccacctctcggagtacgaacgggacactctgcttgtggaacccgaggaagtcgtcgaaatgtcgcatatgccaggtgatctcttcaatctgtacctgcatcagaattatattgatttctttatggaaattgatgacatcgtacgggcctctgagttcctctcttttgccgatatccttagcggcgactggaatacgcggtccctgctgcgggagtattctacaagcattgccacccgaggcgtgatgcatagtaataaggcgaggggatatgcgcattgtcagggaggaggtagttcatttagacctctgcacaaaccgcagtggtttctcatcaacaagaagtatcgagagaactgccttgccgctaaggccctatttccagatttttgtcttccagcactttgtcgccagacccagctgcttccatacctcgcgctcttaaccatccctatgagaaaccaggcgcagattagctttattcaggacatcgggaggttgcctctgaaacggcactttggcaggttgaagatggaggctttgaccgacagagagcatgggatgattgatccagatagtggagacgaagcgcaattgaacggcggccattccgccgaggaatcactcggcgagcccactcaggctactgtacctgaaacgtggtccttaccactgtctcagaattccgcgtccgagttacctgcaagtcagccccagccgttctcagcccagggagacatggaggagaatatcataattgaggactatgagagcgatggcacctag

SEQ ID NO: 32951 - DNA, 2013 bp, Artificial Sequence
  Description of Artificial Sequence: Synthetic coding sequence
atgaatcaggttacggactgggtggatccctctttcgacgattttttggaatgcagcggagtttcaacaatcaccgcaacctcgctgggtgttaataacagttcacaccgccgtaaaaatggtcctagtacgctcgaaagttcccggtttccagcacgtaagcggggcaatctttcaagtttagagcagatctacgggctagaaaactcgaaagaatacttatctgaaaatgagccttgggtcgataagtacaaaccagagacacaacatgagctagccgtccacaaaaaaaaaattgaggaagtggaaacctggctgaaagcgcaggtattagaaaggcagccaaaacagggcgggagcattttactgatcaccggcccaccagggtgtggtaagaccactactctgaagatcctgagtaaggaacacggaatccaggtgcaggaatggatcaaccctgtgcttcccgatttccaaaaggatgacttcaagggcatgttcaatactgaaagctcatttcacatgttcccctaccagtctcagattgccgtgtttaaagaattcctgctgcgcgcaaccaaatacaataagctccagatgctgggtgacgatctacggaccgataagaagatcatcttggtggaagacctgcccaatcaattctacagagattcccacaccctgcatgaagtgctgaggaaatatgtccgcattggccgttgcccgctaattttcatcatttccgattccctgtcaggtgacaataatcaacgcctcctcttccctaaagaaatccaggaggaatgtagtatttccaacatcagttttaaccctgttgctcctactatcatgatgaaattcctcaaccgtattgtgaccattgaggcaaacaagaatgggggtaagattactgttccagacaagacttctctcgagcttctttgccagggatgctccggagatatccggtccgccatcaattccctccagtttagctcgagtaaaggagagaataacttaaggcccagaaaaaaagggatgtccctgaaatctgatgccgtgctgtcaaaatccaagaggagaaaaaagccagacagggtgttcgaaaatcaagaggtgcaagctattggtggaaaagatgtgtcgcttttccttttcagggcactgggcaagattctgtactgtaaaagggcgtctctaacggaactcgactcacctcgcctgccatctcacctgtccgagtatgaaagggatacgctactggtcgaacccgaggaagtggttgaaatgagccatatgccaggggatcttttcaacctctatctgcatcagaactacatcgacttttttatggaaattgatgatattgtcagagccagtgaattcctctcatttgcagacatcttgtcaggggactggaacacacggagcctactgagagagtactccacatctatcgcaacccgcggcgtcatgcattcaaataaagctcggggctacgcccactgtcaaggtggtgggtcatcattccgccccctgcacaagccccagtggtttcttattaacaagaaatacagagaaaattgcttagctgctaaggccctattccctgatttctgcctgccagccctctgtcgccaaacccagctcctgccgtacctggctctgctgacaattcctatgcgaaatcaggctcaaatctcatttatacaggatattggccgactgcctctcaagcgccacttcggtcgtctgaaaatggaagcactgactgatagggagcacggcatgatagaccccgacagcggcgatgaggcgcagcttaacggaggacacagtgccgaggagtcacttggagaaccgacgcaggctacagtgcctgagacctggagcctacctctgtcccaaaattccgcctccgagttgccggcctctcagccacagcccttctccgctcagggtgatatggaagagaatattattatcgaagattatgagagtgatgggacctag

SEQ ID NO: 32952 - DNA, 3480 bp, Artificial Sequence
  Description of Artificial Sequence: Synthetic coding sequence
atgtctctcccgcaacctactcctcgcatggccgagcttcggaagcccacttcatctttaactcctccagaagatcctgattcacagcccccctctagcaaacggctttgtctcgaagaacctggtggggttttcaaggccggatggcggcttccgctggtgccacggttgtcagaagctgaaaaggtgtgggagctctcacccaggcccttcaagggacttttggtcagtacaaatgccatattcgataactccacagactcttgtgtggaaaaatcggtgtccgggaagcagatatgtaaccttaagtgctcaaatctgaagttccagatgagcagttgcctgcagtctcccccctctcagagtcccgacagcgacttgagagccagtggccgctcagaagccggccttcatgatcgcgaagcctttagtgtgcatcgaagtaatagcagcaaagccggggtgagtcaactgctgccctccacgagtattcatgatatacacgggattcgcaacgaaaatagaaagcagcaattcgtacaagggcgcgataatgtgcataaagagaaccccttcctggatgtgaccttttacaaggagactaagagtccgttccatgagatcaagaatcgctgtaaggcaaattccgttgtgcctagtaacaagagggagaataatatctcctcatccgttctgaagatcagcaaatcccaaaaccagccaagtttggaaattgctaaaccttcttacttcagagatagtggtaccatttcagtaccccagttccctatggatctgaactctaaaatgtctagtgtatatctgaaagagatagccaagaagaagaacgacaagaaggaggcatacgtccgcgattttaccaatatctattggagtcagaaccggcccgacgtcaagaaacaaaagttgcagaacgacaaaaagaccgtggaggcagagaacatcttttccaaatgctacgaaaatgattatccaagtctgagctctcagaacacatgcaagcggaaggacctcatcagctctaattactgcaactgtagcagcattcagtgcaatgtgcgggactcccggaaaaatttcgcgatccttgagaatgcaaactgggaagaggccgaatgcttagattcgtatgtgctgaccaggctagagaagtcacagaattgggactgtaatgtgagacatattctccgaagaaaccgtggcaactgctggataattaacaattgtaaaaccaaatgcgagaacatgaaaaaaaccgaggagaaatggaattggctgctcctgctcgagattgatttattgtctaaagaggattaccattgtgccaaggtgattaatgcttatgaggagcaatctaagttgctggtgagagaaatcctcggatcccaaaccgccctcataactacggtctggttgaacggtaagggcgaaaatgacaacacccttcaactgcggtacaataccacccagaaagttttccatgttaacaaccccttcgagtccttcataattgagatcttctacttccataaatctatctccggcaataagaaggataatagcatcctgacttgctgtaacatcttgaagtgcaagaaacagataggaattatcgggattcaaaaccttatcacccgcaacatgaacacaaacattaaaaacggaatactaagtatctatttacaggacagtgtgagtgagcctctggatatattgctgaagaccaatatcgccttcctactcaacaattttgatagccttacccgcatcgagaacgatttcgagctggaggaggaatgtattttcaaatgcatgctgtacctcaagtatcccaaaaacattgtggagaaccacactgcatacctggtgaaaattctgaccagctcacgtctgctggaggacaatatgaaacccatgctaaaaaagaggaagctgttcagaacagagcaagtttttgagaaaagtaagaaaaaactgatcaatagcttcagcatgacaacccaaaatactggttttcctatttttgaaacatacgagaagattcccttgctgatggattttgacgatatggacgagatatcattgatccgtgagatcacttgtcagaacatgtcatgcccgcagcaagtcgtgaacgtagaaaattgggcccactacaactcatctactgtaaaggcccacggtaattcctgtcctcagtttattcagaacaaccgcgggtatatcaacgaaaacttttatgaagtgaatatgcacagccaggacctgaatatggaaagaaagcaggggcataacaagatctcaaatttcgattgtgaacacatctttgaggatctttgcaacgtgagacagcaagccatacccgcaagtcataatattatacacaacgaagagacccataccacatcaattacccaggtcctcaacttttggaatctcttaagcgagatcgaggagaagaagtatgatctgatcctaaaggaagaggtgaaggttaccgccgagtcactgacaaattcttgtcaagtgcacaaagacaccaaaatcgagaaagaagaaaaggattcattctttccaatggatgacatgttctccgtgcagtctgtgtctctcatctcaaaggaagtgaacgtcgaggaaaacaagtacgtgaaccagaactatgtcacgaatactaatgaatatgagagcatcctgcctgagcgagagatcgccaattccaaggacttccaccggaagaatgacagtgccctgtatattaaccaccagttcgagaccgggctgagcgagggcaacgacgagtgtttccaggaccttgcagcaaagtatttaagcacagaagccctgaccatcgtgaaagacttcgaaatgaagaggaagttcgacttagttctggaagagttaagaatgttccatgagatttctagagagaatgaactgctgtcaaccgtggaaaccaataatggccaggaaaactactttggcgagaatgacgctgagaaggtgaagatggagatcgagaaagacttgaagatggtggtggtgaacaaaatccgcgccagctctagctttcacgacacgatagcaggccccaatatgggaaagagccaccagtcgttgttcaagtggaagactgtgcctaacaatggcgagcaagaggtacccaacgagagttgttatcctagccgtagtgaggaagaactgctatatagcactagcgaaaaagattgcgagactcccttgcctaagcgccccgccttcctgcctgacgaatgtaaggaggaatttaattatctcctgcgagggggctcacactttccccatggcatctcgcgtgttcgacctttaaagacatgctctcgtcctattcggattggcctgtcaagaaaagccaggattaaacagcttcacccttatttgaagcagatgtgctacgggaatctgaaagagaacttctag

SEQ ID NO: 32953 - DNA, 1683 bp, Artificial Sequence
  Description of Artificial Sequence: Synthetic coding sequence
atgaccgtcaagcctgcaaaggctgcttccctggccagaaatctggccaaacgaagacggacctatttggggggtgccgccggacgctcacaggagccagaggtcccctgtgccgccgtgcttcctggcaagcccggggataggaactgtcctgaattcccaccccccgataggactctgggttgctgggcaactgacgccgcgcccgcagccggcctctgcggagctggcagcgagccctcaattgcacctacctcttgtgcgggcaatctaccctcccggccaccaccactcctctctcccttactggccagtcgcaacccttgcccctggcattacttacatctgagcgggagtcataacacgcttgccccaacctgttttaaggccaagctgcacaggaaaaggggcagccaacctcctgacatggcatcagccctgaccgaccggacttctcgggcaccctcgacatatacttatacttccagacctagggctctgccttgccagcgaagtcgctaccgggacagtctgacgcagcccgacgaggaaccaatgcactacggaaatatcatgtatgatagaagagtgatccgggggaatacatacgctctgcagactggacctcttctgggtaggccagacagtctggaactccagaggcagcgggaggcaagaaagagagccctggcgcggaaacaggcccaagaacagttgcgcccccaaactcccgagcctgtcgaaggtcggaagcacgtagatgtgcagaccgaactgtacttagaggaaatcgctgatagaataatcgaggttgacatggagtgccagaccgatgcttttctggacaggccacccacgccactctttattccagcgaagaccggtaaggacgtagccactcaaatcctagagggagagcttttcgactttgacctcgaggtcaaacctgttttagaggtgttggtgggtaagacgattgagcagtctcttctcgaggttatggaggaagaagaattggccaatctgcgcgccagccagcgcgaatacgaagagttacggaacagtgagcgtgccgaggttcagcgtctcgaagagcaggagcgacgtcatcgagaagaaaaggagcgaagaaaaaaacaacagtgggagattatgcataagcacaatgaaacttcgcagaagatcgctgcccgggctttcgcccagcggtacctggcggaccttctccctagcgtctttggctccctacgagacagtggttacttttacgacccaatcgagagagatattgagataggctttctgccttggctgatgaacgaagtcgagaaaactatggaatatagcatggttgggcgcaccgtgttagatatgcttataagagaagtcgtcgagaagcggctctgtatgtacgagcatggggaagacacacaccaatcaccagagccggaggatgagcccggcggcccgggcgctatgacggaaagcctggaagccagcgagtttctcgaacaaagtatgtcacagacaagagagctcctcctcgatggcgggtatcttcagagaactacttacgacagaagatcgtcccaagaacgcaagttcatggaggaaagagaactgctgggtcaggacgaggaaaccgccatgcggaaatctctcggggaggaggagctgtcttag

SEQ ID NO: 32954 - DNA, 1395 bp, Artificial Sequence
  Description of Artificial Sequence: Synthetic coding sequence
atgacagtcaaacccgctaaggccgcctctctcgctcgcaatctggcaaagcgcaggagaacctacctgggaggggccgccgggcggagtcaggaacccgaggtgccatgcgcagctgtgctcccagggaagcctggtgatcggaattgtcctgaattccccccacctgaccggaccttagggtgctgggccacagatgctgctcccgctgctgggctctgtggagcgggcagtgagccttcaattgcgccaacaagctgtgccgggaacctcccaagtcgccctcctccattgctttcccccttactggcctctcggaacccttgcccttggcactatctgcacctgtctggaagccacaacaccctcgcacccacatgctttaaggcgaaattgcataggaagcgaggaagccagcctccggacatggcgagcgcattaacagataggactagtagggctccatccacctacacgtatacatctaggccacgcgcgctcccctgtcagcgtagccggtatagagactctctgactcagccagatgaggaacctatgcattacggcaatatcatgtacgatcgccgcgtgattaggggtaatacgtacgccctgcagaccggcccattactgtttgattttgaccttgaggtcaagcctgtgctggaggtcctcgtgggcaagaccatagaacagagcctgctggaggttatggaggaagaagaactggcaaatctcagggccagtcaacgagaatatgaggaactgcgcaactcagagagggccgaagtccaaaggcttgaggagcaggaaagacggcaccgcgaggaaaaggaacgccgcaaaaagcagcagtgggaaatcatgcacaaacataatgaaacgagtcagaagattgccgctagggcgtttgctcaacgctacctcgccgatttgctgccatctgtgtttggcagtttacgtgactctggatacttttacgacccaatcgagcgtgatatcgaaatcggcttccttccatggctcatgaacgaggtggagaaaaccatggaatacagtatggtcgggcgaacagtactggatatgctgataagagaggtggtcgaaaagcggctgtgcatgtacgagcacggagaagatactcaccagtcccccgagcctgaagatgaacctggggggcccggcgccatgacagaaagtttagaagcaagtgaatttctggaacagagtatgagccagacacgagagctacttctagatggcggctacctgcaaaggaccacctacgacagacgatcttcccaggagaggaaattcatggaggagagagaactgttaggccaggacgaggaaaccgccatgcggaaatccttgggcgaggaagaattatcttag

SEQ ID NO: 32955 - DNA, 1257 bp, Artificial Sequence
  Description of Artificial Sequence: Synthetic coding sequence
atggcctctgccctgacggacaggacttcaagggccccctcaacctatacttatacttcacggccccgggcccttccctgtcaaagatcaaggtacagggactcactaacccagcctgatgaagagccaatgcactacggcaacattatgtacgataggagagtcattaggggtaacacctatgccctgcagactggcccactcttggggcgaccagactcactagaacttcagcgacagcgagaagccagaaagcgtgccctggctcgaaagcaggcacaggaacagcttcggcctcaaactcccgagccagtagagggacgaaagcacgttgatgtgcagactgaactgtatctagaggagatcgctgatagaatcatcgaggtggacatggaatgtcagaccgatgcctttttggatcgccccccaacacctctcttcatcccagcaaagactgggaaagacgttgcaacccagatcctggagggcgagttgttcgacttcgacctcgaagtaaaaccagtgctcgaggttctcgtgggcaagactattgaacagagcctgctggaggtcatggaagaggaggaactggctaacttgcgggcttcacagcgggagtacgaggaacttaggaattccgagagagccgaagtccagcggctagaggaacaagaacggcgacatcgagaggagaaagagcgacgaaagaaacagcaatgggagattatgcacaagcataacgagacaagtcagaagatcgccgctagagcttttgctcaacgctatctcgccgacctacttcccagcgtgttcggatcactacgggactctggctacttttacgaccctatcgagcgggacatagaaatcgggttccttccatggcttatgaacgaagtggagaaaaccatggaatactcaatggtgggcaggacagtgcttgatatgctgatccgagaagtggtcgaaaaacgtctttgtatgtatgagcacggggaggatacgcaccaatcgcccgaaccagaggatgaacctggtgggcccggagccatgaccgagtcactggaagcatccgaatttcttgagcagagcatgtcacaaacacgagagttgcttcttgatggtgggtacctccagcgcacgacctatgatcggagaagttcccaggaacgaaagttcatggaggagagggagttattggggcaggatgaagaaacagctatgcggaaatcactgggagaggaagaactttcctag

SEQ ID NO: 32956 - DNA, 969 bp, Artificial Sequence
  Description of Artificial Sequence: Synthetic coding sequence
atggcgtctgcactgacggaccgaacgagcagagccccgtctacatacacctataccagccggcccagagcactgccatgccagcggtcaagataccgtgattctctcacgcagcctgatgaggagcctatgcattatggcaacattatgtatgatagacgtgtgataagggggaacacatatgctttgcagactggccccttactgttcgattttgacctcgaagtgaaaccggttctggaggtgctagtcggaaagaccatcgaacagtccctgctggaagtgatggaggaggaagagctggccaacctgagagcatcccagcgggagtacgaagaattgcgtaattctgaacgcgccgaggtgcagagactggaggaacaggaaagacggcaccgagaagaaaaggaaagacggaaaaagcagcagtgggagatcatgcacaaacataatgagacgagtcagaagatcgctgctagggcctttgcccagagatacttagccgacctcctaccttcagtgttcggttctctacgagattcaggctatttctatgatcctattgagcgggacattgagattggattccttccctggctgatgaatgaagtggagaagacaatggagtactctatggtgggtcggactgtcctcgacatgctcatacgagaggttgtggaaaagagactttgtatgtatgaacatggcgaagacacacatcagagcccggaacccgaggacgagcccggaggccccggtgccatgactgagtctttagaggcgtccgaatttctggaacagtccatgagccagactagagagctgctcctcgacgggggctatctccaacgtacaacctacgacagacgttcttctcaggaacggaagtttatggaggaacgggagctgctcggtcaagacgaagagacagcgatgcgaaagtcactgggcgaggaggaactgagttag

SEQ ID NO: 32957 - DNA, 2613 bp, Artificial Sequence
  Description of Artificial Sequence: Synthetic coding sequence
atggtgaaagaaaagaaaaaggcagataaaaaaggtgagaagagtgcccgctctccctccagcctatccgacaatttggatttcagcaagcaggacggaaacacaaccagacaggagatgagccctgctggcgtcccccttctggggatgcagctgaatgaggtgaaaccaaaaaaagataggcagaacgtgcagcagaacgaggatgccacccaatatgaagagtcaattttaactaagcttatcgtggagtcctatgaaggcgagaaagtgcgcggcttgtatgaaggtgagggtttcgcagccttccagggcggttgcacctataggggaatgttttccgaaggtctgatgcatgggcagggcacttatatttgggctgacggactcaagtacgaaggcgatttcgtcaaaaacgttccaatgaaccacggcgtgtatacttggccagacggatccatgtacgaaggagaggtggtgaatggcatgaggaatgggtttggcatgttcaagtgttcaacacaacccgtcagctacatcggccattggtgcaacggaaaaagacatggtaaagggtccatctattataatcaggaagggacttgctggtatgaaggtgattgggtgcagaatatcaagaaaggctggggaatcaggtgctacaaatctggcaatatatatgaaggccagtgggaagacaacatgcgacatggtgaggggaggatgcggtggctgactacaaacgaggagtacacgggcaggtgggaacgcggaatccagaatgggtttggtacacacacgtggtttttgaagcgtattaggtcttcccagtaccccttgcggaacgagtatattggagagtttgtcaatggctaccggcacggtaggggaaaattctattatgcttctggtgctatgtacgatggagagtgggtgtccaataagaagcatggaatggggcggctaactttcaaaaacgggagggtatatgagggagcattttcaaacgaccacatcgcgggattccctgacctcgaggtagagtttatatcatgcctagatctgtctagcggcgttgctccgcggctgtcccggtccgctgaactgattagaaagctggatggaagcgaaagccactcagtgctgggctcatcaatcgagctcgacttgaatttgctcttggacatgtaccctgaaacagtgcagcccgaggaaaaaaagcaggttgaatacgctgtcttaagaaatatcacggagctcagaaggatctactccttttacagctcccttggctgcggccactcccttgataatacattcctgatgacaaagctacatttctggcgtttcttgaaggattgtaaatttcaccaccacaaactgaccctggctgacatggaccgcatcctaagcgcaaataatgacatacccgtagaggagatccactcccctttcaccaccatcctgctccgcacattcttaaattacctcctgcatctggcctaccatatctaccatgaggaattccagaagcgttcgccaagtctgttcctgtgctttactaagctaatgacagagaatatccggcccaacgcctttcaaattaaaggaaacctgttcagagaacagcagcggaccctttactctatgtcgtacatgaacaagtgttgggaaatctaccttgcctactgtcgcccgtctgccgctccaccccacgagcctacaatgaagatgagacattttctgtggatgctgaaagacttcaagatgattaacaaggagttgacagcagccacctttatggaggttatcgccgaggataatcggttcatctatgacggaatcgacagcaattttgaacctgagcttgtattcctcgagttttttgaggccctgctgagctttgctttcatttgcgtgactgaccagatgacaaagtcctacaccaatgtgcctgccgacgatgttagcggtaataaacacgagaccatatatacaatacttaatcaggacgcacagaacaagtctcccagcgccgtcatgagccatgaaagtgatgctgcccattctgattccgccaggagcagctctagcaaattagaactctctccagatgtaaacaaaatcaggaagtccgagcccaagatcaaaaaatcagttagtcacgagcgggtcagtaagatgaactttaaactcactggtaagggcatcacttttttttcaagcgagagcaaaaagtatgaacgccctaaggacgacagagaagaggagtttaacacgtgggtcaacaacatgtacgtcttcttcgtgaacaccctcttccacgcgtataagagggaagaggcgataaaagaaaagatacgggctgacaggctgcgatctaccgcccaagcgcaacagagaaagatggaagacgacgagctggaagccaggctgaatatttttatactgagggaggaggaagccaagcgccatgactacgaagtggatatcacagtccttaaagaacctgcagatgtctctagcagtcatctgattctcgatccacccaaggaggacgtgactgtgagtccttcctccaaaactattacttccaagaaaaagaagaagtag

SEQ ID NO: 32958 - DNA, 1857 bp, Artificial Sequence
  Description of Artificial Sequence: Synthetic coding sequence
atgaatcatggggtgtacacttggccggacggttcaatgtacgagggcgaggtggtcaatggcatgagaaatggcttcggcatgtttaagtgttccacccaacccgtgagttacattggccattggtgtaatgggaaaagacatgggaagggatcgatttactacaaccaggaaggtacctgttggtacgagggagattgggtgcagaacatcaagaaaggatggggaatccggtgttataagtctgggaatatatacgaaggtcagtgggaagataatatgagacatggcgagggtcgcatgcgttggctgaccacaaacgaggagtacacaggcagatgggagcgcgggatccagaatggatttggaacccatacatggtttctaaagaggatccgttcttctcagtaccctctgcgcaacgaatatatcggagagttcgtgaatggttatcgccatggaagaggcaaattttactacgcatccggggctatgtacgatggggagtgggtctctaataaaaagcacgggatgggacgcctgacgtttaaaaacgggagagtgtacgagggggcctttagcaatgatcacattgcaggcttccctgacctagaggtggaattcataagctgtctcgacttgagctccggtgtggctccaagattatccaggagtgctgagcttattaggaagcttgatggtagtgaaagccactctgtgttgggtagcagtattgagctggatctcaatctgttgctggatatgtatcctgagaccgtgcagcctgaagaaaagaagcaggtcgagtacgcagtgctacggaacatcacagagctgcgacggatctactcattctacagtagcctgggttgcgggcactcacttgacaatacctttctgatgaccaaactgcacttctggcggttcctgaaagactgtaagttccatcatcacaagctgaccctggcagatatggaccgcatattgtcagctaataatgacattcccgtggaagaaattcacagtcccttcacaacaatcctgctgaggacctttctgaattatctgttgcatttggcatatcacatctatcatgaggaatttcagaagcgcagtccctctctgtttttatgtttcactaagctgatgactgaaaacattcgcccaaatgctttccagattaaaggtaacctgttccgagagcagcagcgcactttatatagtatgtcctatatgaacaagtgttgggagatctacttggcttactgtcgcccaagcgctgcacctccacacgagcctactatgaagatgagacatttcctgtggatgctgaaagacttcaaaatgataaacaaagaactgaccgcggctaccttcatggaagtgatcgccgaagataatagatttatttacgacggcatcgatagcaatttcgaaccagagctggtttttttagaattcttcgaagcacttctgagcttcgccttcatctgtgtgacggatcagatgacgaaaagttacacaaatgtgccagcggacgacgtgtctggtaacaaacacgagacgatctatacaatactgaaccaggatgcccagaacaagtcaccttccgctgtgatgtctcatgagagcgacgccgcccacagcgactccgctagaagctcctcttcaaagttggagctgtctccggacgtgaataaaatacgcaaaagtgaaccgaaaattaagaaatccgtctctcacgagcgggtgtctaagatgaatttcaaattaacaggtaagggtatcactttcttttcatcagaatctaagaaatacgagcggccaaaagacgatcgggaggaagatggacgctag

SEQ ID NO: 32959 - DNA, 2613 bp, Artificial Sequence
  Description of Artificial Sequence: Synthetic coding sequence
atggtcaaggaaaaaaaaaaagccgacaagaagggagaaaaatcagctcgcagtccttctagcctgtcagacaacctggactttagcaagcaagacggaaatacaactcgccaagagatgagcccagcaggcgtgccattgctgggcatgcagctgaacgaggtcaagcctaagaaggaccggcagaacgtgcagcagaatgaagacgcgactcagtacgaggaatcgatcttaaccaagcttatagtcgaatcctatgagggcgagaaagtgcgcggactgtatgagggagagggcttcgccgcatttcagggaggctgtacctacaggggcatgttctccgagggactcatgcacggccagggcacgtatatatgggccgacggactgaaatatgagggcgactttgtcaagaacgtgcccatgaaccacggggtgtatacatggcccgacggcagtatgtacgagggggaagtggtaaatggcatgagaaacgggtttggaatgttcaaatgtagcacacagcccgtgagctatattggacactggtgcaacgggaagcgacacggcaaaggctcaatttattacaaccaggagggaacatgctggtacgagggcgattgggtccagaacatcaaaaagggttggggaatacgctgctataaaagcggcaacatttatgaggggcaatgggaggataacatgcggcacggagagggacgtatgaggtggctcacgacgaacgaagagtataccgggcggtgggaacggggcatccaaaacgggttcggcacacacacctggttccttaaacgtatccgttcatcacagtatccccttagaaacgaatacattggggagtttgtgaacggatacagacatgggaggggaaaattttattatgcttcgggcgccatgtacgacggggaatgggtgtccaacaaaaagcacggaatgggccgccttacattcaaaaatgggcgcgtgtacgaaggagctttcagtaatgatcatatcgcaggctttccagacctggaggtggagtttatcagttgcctcgatctctcctcgggcgtggctcctaggctcagtcgctccgctgaattaataaggaaacttgacggctcggagtcacactcggtgctcggtagctcaatagagcttgacctaaatttgctgctggacatgtaccccgaaacggtgcagccggaggaaaagaaacaagttgaatacgccgtcctgcgaaacattacagagctaaggcggatttattccttctactcatcgctgggatgcggacattctttggacaacactttcctgatgacaaaactacacttttggcggttcctgaaggactgtaaatttcatcaccacaaactgacactggctgatatggatcgtatcctctcagccaataacgacatccccgtcgaggagattcacagtccgttcactaccattcttctacgcacgtttctaaattacctgttgcacctagcgtaccacatctaccacgaggagttccagaagcgatcgcctagcctcttcctctgttttacgaagctcatgaccgaaaacatccggccaaatgcctttcagatcaagggcaacctttttagagagcagcagcgaaccctctattccatgtcttacatgaataagtgttgggagatctatctggcgtattgtcgcccttctgcagctccgccgcacgagcccactatgaagatgaggcactttctttggatgctcaaagattttaaaatgataaataaggagcttacggcagccacatttatggaggtgattgccgaggacaaccgttttatctatgatggcatcgacagtaattttgagccagaactcgtgtttctggaattcttcgaagccttactctcgtttgctttcatatgtgttacagatcaaatgacgaagtcctacacaaatgtgcccgctgatgacgtaagtggaaacaaacacgagactatttatactattttaaaccaagacgctcaaaacaagtctcccagtgcagtgatgagccatgaaagcgacgccgctcactctgactcagccaggtcctctagctctaagctggagcttagcccggacgtcaacaaaatcagaaaatccgagcccaagatcaagaaatcagtctcccacgaacgcgtttccaaaatgaatttcaagctaacgggtaaagggatcacattcttctccagcgaatctaaaaagtatgaaaggccaaaagacgatagagaggaagaatttaacacgtgggtcaacaacatgtacgtgttctttgtgaatacgctatttcacgcatataaacgcgaggaagctattaaggaaaaaatacgcgccgacaggctgcgcagtaccgcccaggcgcaacagcgaaaaatggaggacgacgagctcgaagcccgcttgaacatctttatcctgagagaggaggaagccaagcgacacgactacgaggttgacatcactgtccttaaggaacctgcggatgtgtcttctagtcacctcattctcgacccacccaaagaagacgtgaccgtcagcccatcaagcaagacaatcactagtaagaaaaaaaagaagtag

SEQ ID NO: 32960 - DNA, 2613 bp, Artificial Sequence
  Description of Artificial Sequence: Synthetic coding sequence
atggtgaaagagaagaaaaaggccgacaaaaagggagaaaaatcagctaggagtccttcatcgctgagtgacaatttggatttctctaagcaggacggaaataccactagacaggaaatgagccctgcaggtgttccattactgggcatgcagcttaatgaagttaagcccaagaaggataggcagaacgttcagcagaatgaagacgccacccaatacgaagaatctatcctcaccaagctcatagtcgagagttatgagggggagaaagtcagaggattgtatgagggggaggggttcgcagcttttcagggtggatgtacctaccgagggatgttctctgaaggtctaatgcatgggcagggaacttacatctgggcagatggtctgaaatacgaaggagacttcgtaaagaacgtgcccatgaaccacggggtgtatacatggccggacggttctatgtacgagggcgaagtggtgaatggaatgcgcaacggatttggcatgtttaaatgtagtacacagcctgtgagctatataggacactggtgcaacgggaaaaggcatggcaaaggctcaatctattacaatcaagaggggacctgctggtacgagggtgattgggtgcagaatattaagaagggttgggggatcagatgttataagagcggtaatatttacgaaggccagtgggaggacaacatgagacatggagagggcaggatgcgctggctgactacaaacgaggaatacactggccggtgggagcgcggaatccagaatggatttgggacgcatacctggttcctgaaacgcattcggtccagtcaatacccgctcagaaatgaatatataggcgaatttgtgaatggttacaggcacgggcgcggcaagttttactatgctagcggcgcaatgtacgatggggagtgggtgagcaataagaaacacggcatgggccgtttgacatttaagaacgggagggtctacgaaggcgctttttctaacgatcatatagctggctttccagacctcgaagttgaatttattagctgcctggacctcagctccggggtcgccccccgtctaagtaggagcgccgaactgattaggaaactcgatgggagtgaaagccattcagtactggggtctagcatagagctagacctgaatctcttgttggatatgtatcccgaaactgtgcaaccggaggagaagaagcaggtggaatacgctgtgcttcggaatattacagagctgcgtaggatctactctttttactccagccttggttgtggccactccctggacaacactttcctaatgaccaagctccacttttggcggttcctgaaagattgtaagttccaccaccataaactgacgctggcagacatggacagaatcctctcagccaacaacgacatccccgtggaagagatccatagccctttcactaccatcttgctgcggacctttctaaactacctcctgcatcttgcatatcacatttatcacgaggagttccagaagcgatcgccatccctttttttgtgcttcacgaagctgatgacagagaacatacggccgaatgcatttcagattaaggggaatctcttccgcgagcagcagagaacactctattccatgtcatacatgaacaaatgctgggaaatttacctggcctactgccggcccagcgctgcccccccccatgagcctaccatgaagatgaggcattttctgtggatgttgaaggacttcaagatgatcaacaaggagctcacggccgctacttttatggaagtcatcgcagaagataaccggtttatttacgatggcattgattcaaattttgaaccagagctcgtgttcctggagttctttgaggctctactgagttttgcttttatatgtgtgacggatcagatgactaagtcttacacaaacgttcccgccgatgacgtgtctggcaacaaacatgaaactatttatacgattcttaaccaggatgcacagaataagagtccctcagcggtgatgagtcatgaatcagatgcagcccactctgacagtgctagatcatcatcaagcaaactcgagctcagtccagacgttaataagattcggaagtccgagccaaaaattaagaaatcggtgtctcatgagagagtctccaaaatgaatttcaagctcaccggcaagggaatcaccttcttcagtagtgaatctaagaagtacgagaggcctaaggatgacagggaggaggaattcaatacttgggttaataacatgtacgtgttctttgtgaataccctctttcatgcctacaaacgcgaggaagccataaaagaaaaaattcgcgcagatcgcctgcggtcaaccgcccaggcccagcagcgcaaaatggaagatgacgagctcgaagctcgattaaatatttttattctgagagaagaagaagccaagaggcacgattatgaggttgatatcacagtgctgaaggaacctgccgatgtaagttcttcacatctgattctggacccacctaaggaggacgtaaccgtgtctcctagctccaaaacaattacaagcaaaaagaagaaaaagtag

SEQ ID NO: 32961 - DNA, 2613 bp, Artificial Sequence
  Description of Artificial Sequence: Synthetic coding sequence
atggtcaaagaaaaaaaaaaagccgataaaaagggagaaaaatccgctcggtcaccctcttcgctctccgataatctcgacttttctaaacaggacggaaacactactcggcaggaaatgtcccctgccggggtcccactactcggaatgcaattgaacgaggtgaagcccaaaaaggataggcagaatgtccagcagaatgaggacgcaactcagtatgaagagtccatcctcacgaagctcatcgtggagtcctacgagggagaaaaggttaggggcctctatgaaggtgaggggtttgccgcctttcaaggaggctgcacatataggggaatgttcagcgaggggttgatgcacggccaagggacttacatctgggccgatgggttgaaatatgagggtgattttgtcaagaacgtacccatgaatcatggggtctatacatggcccgatggatcaatgtatgagggagaggtcgttaacggaatgagaaatggattcggcatgttcaaatgttctacccagcccgtcagctacattggacactggtgtaacggaaagaggcatggcaaagggtccatttactataaccaggaagggacatgttggtacgagggcgattgggtgcagaatatcaaaaagggatgggggatacgctgctacaagagtggtaatatctacgaggggcagtgggaagataacatgagacacggggaggggaggatgcgctggttaacaacaaatgaggagtataccgggagatgggagagagggatccagaatggttttggcactcatacttggttcctcaagagaatccggagcagccagtatcctttgcgcaatgaatacatcggggaatttgtgaatggataccggcatggtagaggcaagttttactacgcctctggggctatgtacgatggggagtgggtgtccaataaaaagcacggtatgggccgactgacattcaaaaacggccgcgtttatgaaggggcattcagtaatgatcatattgccggcttccccgacctggaggtggagtttatcagctgcctggatctttcctcaggggtagcaccgcgactctctaggagcgccgaactgatccgtaaactagacggctctgaatcccacagcgtactaggatcttcaattgaattagacctgaacctgctgctggacatgtatcctgagacagtccagcctgaagaaaaaaagcaggtggagtacgcagtgctgcggaatatcaccgagcttaggcgtatctatagtttctattcttccctgggatgcggacacagcctggataacacattcctcatgacgaagcttcacttctggaggtttctgaaagactgcaagttccaccaccataagctcacgctggccgacatggaccgcattctttcagcgaataatgacattccagtggaagagattcactccccctttaccaccattcttctgcggaccttcctgaactatcttctccacctcgcttaccatatataccacgaggagttccagaaacgctctccctctttattcctatgctttaccaaactgatgaccgaaaatattcgccccaatgcctttcagatcaagggaaacttgttcagggagcagcagcgaacactgtattcaatgtcttatatgaataagtgttgggaaatttatctggcgtactgtcggccctcagccgcgcctccacatgaacccacaatgaaaatgcgccacttcttatggatgttaaaagattttaagatgattaataaggagctcacggcagccaccttcatggaagtcatcgcagaagacaacagatttatttacgacggcattgatagtaacttcgagcctgaactggtattcctagaattcttcgaggcgctgttgtctttcgcctttatctgtgtgacagatcagatgacaaaaagctacactaatgtgcctgccgatgacgtttctggaaataagcacgagacaatctataccatcctgaaccaggatgcacagaataaatcacccagtgcagtgatgtctcacgagtccgacgccgcgcatagtgattcagccagaagctcttcgagcaagttggagctgagcccagacgtgaataagatccggaagagtgagccaaaaataaaaaagagtgtatcccacgaacgcgtatcaaagatgaatttcaagctgaccggcaagggaatcaccttcttttcatctgagagtaaaaagtacgagcggcctaaggacgaccgagaggaagaattcaacacctgggtaaataatatgtatgtcttctttgtaaacacgctgtttcatgcctataaacgagaggaagccattaaagaaaaaatccgggcagatcgcctgaggtcaacagcacaggctcagcagcgaaaaatggaggatgacgaacttgaggcgcgactgaatatctttattctgagggaggaggaggctaaacggcacgactacgaagtggatatcacagttttaaaggagcctgctgacgtgagttcttctcatctcatcctggacccgccgaaagaggacgtcaccgtgagcccttcaagtaagaccatcacgtcgaagaagaagaagaaatag

SEQ ID NO: 32962 - DNA, 15 bp, Artificial Sequence
  Description of Artificial Sequence: Synthetic coding sequence
atggtcaaagagtag

SEQ ID NO: 32963 - DNA, 843 bp, Artificial Sequence
  Description of Artificial Sequence: Synthetic coding sequence
atgcgccacggcgaaggccgcatgcgatggctaacaaccaacgaagagtataccggccgctgggaacggggcattcaaaacgggtttgggacccacacctggttccttaaaagaatcaggagtagccagtacccattgcgcaatgagtatatcggcgagttcgtgaacggctacaggcacggccggggaaagttctactatgcatctggcgccatgtatgatggggaatgggtgagtaataagaaacatggcatggggcgcctcacctttaagaatggtcgggtgtatgagggggccttttcaaatgaccacattgcagggtttcctgatctggaagtggagttcatcagctgcttggacctctcaagtggagtcgcccctaggctcagtcgttctgccgagctaattcggaaactggatggctcagaatcccactcagtcctgggatcctctatcgagctcgacctcaacctcctcttggatatgtaccccgagacggtgcagcccgaggagaagaagcaagtggagtacgccgtcttaaggaatatcaccgagttgagacggatttactcattttactcttcactcggctgcggccactcactcgataatacattcctcatgacgaaactgcatttctggcgctttctgaaagattgcaaattccatcaccataaattgactcttgcggatatggacagaatccttagcgcaaataacgacatacctgttgaagagatccacagcccattcaccactatcctccttaggacctttctgaattatttgctgcacctagcctaccacatctatcatgaggaattccaacaatttatcccctag

SEQ ID NO: 32964 - DNA, 42 bp, Artificial Sequence
  Description of Artificial Sequence: Synthetic coding sequence
atggttaaagaaaaaaagaaagccgataaaaagggagagtag

SEQ ID NO: 32965 - DNA, 2613 bp, Artificial Sequence
  Description of Artificial Sequence: Synthetic coding sequence
atggttaaggagaagaaaaaggccgataagaaaggcgagaagtccgcccgcagcccctcaagccttagtgataatcttgactttagtaaacaggatggaaataccacacgtcaggaaatgagcccagcaggtgtgccactgctcggaatgcagctcaacgaggtaaaaccaaaaaaggatagacagaacgttcaacagaatgaagacgcctctcagtacgaggaatctatcctgactaagctcatcgtcgagtcttatgaaggagagaaggtccgtggtctgtacgagggagagggcttcgctgcattccagggcggttgtacctaccgaggcatgttctcagaagggctcatgcacgggcagggaacatacatctgggccgacggtctgaaatacgagggggacttcgtcaaaaatgtgccgatgaatcatggcgtttacacttggccagatggatcaatgtacgagggggaggttgtgaatgggatgcgcaacggctttggaatgttcaagtgctccacccagcctgtgtcgtatattggacactggtgcaatggcaaaagacacggtaagggttctatatattacaatcaagaggggacttgttggtatgaaggtgattgggtgcagaatatcaaaaagggttggggaattcgttgttacaagagcggaaatatttacgagggccagtgggaagacaacatgagacatggcgaagggcggatgcggtggctcacgaccaacgaagaatataccggcagatgggaacggggcatacagaacggttttggcacacatacatggtttttgaagcggatcaggtcctcacaatatccattacgcaatgaatacatcggagagtttgtaaatggatatcggcatgggagagggaagttttactatgcaagcggggccatgtacgatggggaatgggtgtccaataaaaaacacggcatgggtaggctcacttttaaaaacggccgggtttatgaaggagccttttccaacgatcacattgctggcttccctgatctcgaagtcgaattcatcagttgtctagatctttcaagcggcgtagcccccagactatcaagatccgcagaactgatcagaaaactggacggcagcgagagtcatagcgtgctggggtcctctatcgagctcgatctgaacttgctacttgatatgtatcccgaaaccgtgcagccagaagagaaaaaacaggtggagtacgcagtccttcggaatattactgagctcagaaggatttactccttctattcctctctgggatgtgggcattctttggataatacttttctgatgactaaacttcacttttggagattcctgaaagactgcaaatttcaccaccacaagctcacacttgcagatatggacagaattctatctgccaacaacgacattcccgtggaagagatccatagcccattcactacaattctgctaaggaccttcctcaattacttgcttcatctagcataccacatctatcatgaggagttccagaaacggagccctagtctgttcttgtgtttcacaaaactgatgaccgagaatattcgtcccaatgcctgccagataaaggggaatctgtttagagaacaacagagaaccctgtactccatgtcttacatgaataagtgttgggagatttatctggcatattgccggccatccgctgccccccctcacgagcctaccatgaagatgaggcactttctgtggatgctgaaagacttcaagatgattaacaaggaactcactgccgcaacttttatggaagttattgcagaagacaataggttcatctatgatggcatcgacagcaattttgaacccgagttagtctttcttgaattcttcgaggcacttttgtccttcgctttcatttgtgttacagatcagatgaccaagagttataccaacgttccggccgacgacgtgagcggaaacaagcatgagacaatctatactatcctgaatcaggacgcccaaaataagtcaccttcggcggtcatgtctcatgagtccgacgccgcccactccgacagcgcccgatcctcgagcagcaaactggagttgagcccagacgtaaacaagatccgtaagagcgagcccaaaatcaagaagtcagtgtcccacgagcgggtgagcaaaatgaatttcaagctgaccgggaaagggatcaccttcttttcttctgagagcaagaagtacgaacgccccaaggacgaccgggaagaagagttcaatacctgggtgaacaacacctatgtattcttcgtaaacacactttttcacgcgtacaagcgtgaggaagctataaaggaaaaaataagggccgataggctcaggagcaccgcgcaggcacagcagcggaagatggaagacgatgagttggaagccaggttaaatattttcatactgcgggaggaagaagcgaagcgtcatgactacgaagtggatatcaccgttttgaaggagcccgctgatgttagctccagccatcttatactcgaccctcctaaggaagatgtcacagtgagtccctcatcaaagaccattacatctaagaaaaaaaagaagtag

SEQ ID NO: 32966 - DNA, 843 bp, Artificial Sequence
  Description of Artificial Sequence: Synthetic coding sequence
atgagacacggcgaaggaagaatgagatggctaaccacaaatgaggaatatactggccggtgggaacggggcattcagaacggtttcggaacacatacctggttccttaagagaatcaggtcctctcagtaccccttgaggaacgaatatattggcgagtttgtgaatggttacaggcatgggagaggaaagttttattacgcaagtggcgccatgtacgatggcgagtgggtgtccaataaaaagcacggcatggggcgtctcactttcaaaaatgggagggtgtacgaaggggcgttttccaacgaccatatcgccggcttccccgacctggaggtggagtttatttcttgcctggatctttcttcaggggttgcccccaggctgtccaggagtgcagagctgatccgtaagttggacggctcagaatctcactccgtcctgggctcctcgattgaactagacctgaatctgttgcttgatatgtatcccgagacagtgcaaccggaggagaagaagcaggtggagtacgcggtattgcgaaacattacagagctgaggcgcatttatagcttttattcatccctgggatgcggacattctcttgataacacctttcttatgacgaaacttcacttctggaggtttctgaaagattgcaaattccatcatcacaagctgactcttgctgacatggataggatcctttctgccaataatgacattcccgtggaagagatccattctcccttcactactatccttctgcgaactttcctgaattacctgctacacctagcataccatatctatcatgaagaatttcaacaattcatcccttag

SEQ ID NO: 32967 - DNA, 2613 bp, Artificial Sequence
  Description of Artificial Sequence: Synthetic coding sequence
atggtcaaggagaagaagaaggcggacaagaagggagaaaagagcgcccgcagtccaagttccttgagtgataacctggatttctccaaacaagatggtaacaccacgaggcaggaaatgagtccagcgggagtccccctgttgggtatgcagctgaatgaagtgaagccaaagaaagaccggcaaaatgtccaacagaacgaggatgcctcccagtatgaggaatctattctcaccaagttaatcgtggaaagctatgaaggggagaaggtgcgcggactgtatgagggagaggggttcgccgcatttcaaggcggttgtacttaccgaggaatgttctccgaggggctcatgcatgggcaaggcacatatatctgggctgacgggctcaaatacgagggtgactttgtgaaaaatgtgcctatgaatcatggtgtctacacttggcctgatggctccatgtatgagggagaagttgtgaatggaatgaggaatggctttggcatgtttaagtgttctacccagcctgttagctacatcggacattggtgtaacgggaaaaggcacggtaaaggcagcatttactacaaccaggaaggaacctgctggtacgaaggtgattgggtacaaaacatcaagaaaggatgggggatacggtgctataagtcagggaatatttatgaaggacagtgggaagataacatgcgtcacggcgagggccgcatgaggtggcttactacaaacgaagagtataccggccgctgggaaagaggcattcaaaacggatttggcacccacacctggtttctgaagcggattaggtcctcacaataccccctccgaaacgaatacattggagagttcgtgaacggctatagacacgggcgaggaaagttttactatgctagcggcgcaatgtacgacggggaatgggtgtccaacaagaagcacggaatggggagactcacattcaagaacggcagagtgtacgagggtgcattttcgaacgatcacatcgccggattccctgatctagaggtagaatttatatcttgcttggacctatccagcggagtagccccaagattgagccggagcgccgagttgattcggaaactcgacggatcagaaagccatagtgtcttggggtctagcatcgaattagacctcaatttactcctggatatgtatcctgaaaccgttcagccagaggaaaaaaagcaggtggaatacgccgtgctgcgcaacattacagagcttcgacgtatttactcattttactcttctctgggttgcggacattcacttgacaatacctttcttatgacaaaattgcacttctggaggttcttgaaggattgcaagttccaccatcacaaactgactctggctgatatggatcgaattctgtccgcgaacaacgatatccccgtcgaggaaatccatagccccttcaccacaatcctgctgcggacctttttgaactacttgcttcacttagcctaccacatttaccatgaggaatttcagaaacgttcgccttcactgtttctgtgcttcaccaaactcatgacagagaatatcaggccaaatgcgtgccagatcaaggggaatctttttcgtgagcaacagaggaccctgtatagcatgagctatatgaataagtgttgggaaatctacctggcttactgccggccatctgcggcccctccccatgagcctacaatgaagatgcgtcacttcttgtggatgcttaaagactttaaaatgataaataaggaactaacagcagccacctttatggaagttatagccgaagataatcgcttcatctacgatggcatcgacagtaactttgaaccggagctagtgttcctcgagttcttcgaggccctgctctcttttgccttcatctgcgtcacggaccagatgaccaagtcttacactaacgttcccgcagatgatgtaagcgggaataagcacgagactatatataccatcttgaatcaagatgcccagaacaagtctcctagcgctgttatgtcacacgagtctgatgcggcccatagtgactctgcccgatcttcttcaagcaaacttgagctgagccctgatgttaacaaaatccggaagtccgagcccaaaattaagaaaagcgtttcccacgaaagggtcagcaaaatgaattttaagctgacggggaagggaatcactttcttcagctctgaatcaaaaaaatatgaacggccgaaggatgaccgtgaggaagaatttaatacatgggtcaataacacatatgtgttttttgtcaacaccctgttccatgcctacaagcgggaagaagctatcaaagagaaaattcgcgcagaccgtctgcgctccacagcacaggcacagcagcggaagatggaagatgacgagttggaggcaaggctgaatatctttatactccgggaggaggaggcaaagagacacgactatgaggtggacattacagttctaaaggaacccgccgatgtgtcatctagtcatctgattctggatcctcccaaggaggacgtgacagtgagcccatccagcaagacgatcaccagcaaaaagaaaaaaaaatag

SEQ ID NO: 32968 - DNA, 2613 bp, Artificial Sequence
  Description of Artificial Sequence: Synthetic coding sequence
atggtgaaagagaagaaaaaggcagataagaagggagaaaaatctgcacgcagcccctcttctctgtcagataatctcgattttagtaaacaggacggcaacactaccaggcaggagatgagcccggctggtgtccccctgctcgggatgcagttgaatgaggtgaaaccgaaaaaagatcgacaaaatgtgcagcagaatgaagatgcttctcagtatgaggagtccatcctgaccaagttgattgtagagtcctatgagggcgagaaagtgaggggcctgtatgagggcgaaggcttcgccgcatttcagggtggctgtacgtatagggggatgtttagcgagggtttaatgcacgggcaggggacctacatctgggccgacggactgaaatatgaaggtgatttcgtgaaaaacgtgccaatgaatcacggggtatatacttggcctgatggaagcatgtacgagggcgaagttgtgaatggaatgagaaatggcttcggtatgtttaaatgtagtacccagcccgtgtcctatataggccactggtgcaatggtaagcgacacggtaagggttcaatatattacaaccaggaaggcacatgttggtacgagggtgactgggtccagaacattaaaaagggctggggcatccgctgttacaaatctgggaatatttacgagggccagtgggaggacaacatgcgccacggggaaggcaggatgcggtggctgacaaccaacgaggagtataccggccgatgggagagaggcatccaaaacggattcggcactcacacatggttcctgaaacgaattaggtctagccagtatcctctgcgcaatgaatatatcggtgaatttgtgaatgggtatcggcacggtaggggcaagttctactatgcttcaggggctatgtatgacggcgagtgggtaagcaacaaaaaacacgggatgggaagactgacgttcaagaacggcagggtgtatgagggggccttctccaatgatcatatagctggttttcccgacttagaagtggagtttataagttgccttgatctctcgagcggtgttgctccacgactgtcccgcagtgcagaattaatccggaaattggacggttccgagagccacagtgtcctcggttcaagcattgagcttgatcttaacctgctgctcgacatgtatccagaaacagttcagccagaggaaaagaaacaggtggaatatgcagttctgagaaacatcaccgaactgcggcgaatttacagtttctactcctcactgggctgtgggcattctctggacaacactttcctcatgaccaaactccacttctggcgattcctgaaggactgtaagtttcaccaccataaactcacactggcggatatggatcgcatcctgtctgccaataatgacatcccagtggaggaaattcactccccctttaccacgattctcttacgaacgttcctcaattatttgctccacctggcctaccatatttatcacgaagagtttcaaaaacggagcccaagcttatttctgtgtttcacaaaattaatgacggagaacatccgacccaatgcttgtcagattaaagggaatctttttcgtgagcagcagcggaccctgtactcaatgtcctacatgaataaatgttgggaaatatatctggcctactgcaggcctagtgcggcccctcctcacgagcctacaatgaagatgagacactttctgtggatgctaaaagatttcaaaatgatcaataaagagttgaccgcggcgacctttatggaggttattgctgaggataatcgcttcatctacgacggcatagattcaaactttgaacctgaactcgtgttcctggaattttttgaggctctcctttcattcgcgtttatttgtgtaacagaccagatgaccaagtcatacaccaacgttcctgctgatgacgtaagcggcaataagcacgagacgatatatactatcctaaatcaggacgcccagaataaaagtccctccgctgtgatgtctcacgaatcagatgctgcacacagtgattccgccagatcgagctcttccaagctcgaactctctcctgacgtaaataaaatccgaaagtcagaaccaaagatcaagaaatcagtgtctcatgaaagagtgtctaaaatgaacttcaagctaacgggaaaaggcattactttcttcagctccgaatccaaaaagtatgagcgtcctaaggacgaccgcgaggaggagttcaacacttgggttaacaacacttacgtattctttgtgaataccctcttccacgcgtataaacgggaagaagccataaaggaaaagatccgggcggacagactgagaagtactgcgcaagctcagcaaagaaagatggaggatgacgaactggaagccaggcttaatatttttattcttcgggaggaggaggccaagcgccatgactatgaggtggatataactgtcctgaaagagcccgccgacgtcagctcctctcatctaatcctggacccccccaaagaggacgtgacagtgtctccaagctccaaaacaatcacctctaagaaaaaaaagaagtag

SEQ ID NO: 32969 - DNA, 180 bp, Artificial Sequence
  Description of Artificial Sequence: Synthetic coding sequence
atggttaaggagaaaaaaaaagccgacaaaaaaggagagaaatcggcccgctcccctagcagcttaagcgacaatctggacttcagcaagcaggatgggaataccacccgtcaggaaatgagtcccgctggcgtgccgctgctcggtatgcagctcaacgaagttaagccaaagaagtag

SEQ ID NO: 32970 - DNA, 2613 bp, Artificial Sequence
  Description of Artificial Sequence: Synthetic coding sequence
atggtgaaggagaaaaaaaaggcggacaaaaagggagagaagtccgctaggtcccccagttctttgtcagacaatcttgacttctccaagcaggacggaaacaccacccgccaagagatgtcgcctgccggggtgccccttctggggatgcagctgaacgaagtcaagccgaaaaaggacaggcagaacgtgcaacaaaatgaggatgcaagccagtatgaagagagcattctgaccaagctaatcgtggagtcatacgagggggagaaggttcgaggactctacgagggggaaggtttcgccgcatttcagggtggttgcacatacaggggtatgttctcagagggcctaatgcacggtcagggtacctatatctgggctgatgggctaaagtacgagggagacttcgtgaagaacgtgcccatgaatcacggggtctacacttggccagacggaagtatgtatgaaggggaggtggtcaatggaatgcgaaacggtttcgggatgttcaaatgctcaacccagcctgtgagctatattggccactggtgcaacggcaaaagacacggcaagggcagcatctactataatcaagaaggcacctgttggtatgagggcgactgggtgcagaatattaaaaaaggttggggtatccgatgttacaaatcgggcaatatctacgaaggtcagtgggaagacaatatgagacatggtgagggaagaatgaggtggctgactaccaacgaagaatacaccggcaggtgggaacgcgggattcagaatggatttggtacccacacctggtttttaaagcgaatccgcagctcgcagtaccccctgcgaaacgagtacattggagaatttgtaaatggctataggcatggtcgtggcaaattttattatgcctcaggcgcaatgtacgatggcgagtgggtcagcaacaagaagcatggcatgggtaggctgactttcaagaacggacgggtctacgagggcgccttctctaacgaccacatcgctggttttcctgatttagaggtcgaatttatctcctgtctcgacctaagcagcggcgttgcacccagactcagtagaagcgcagagctcatcaggaaactggacggctcagaaagtcactcagtcctgggctctagcatagaactagaccttaatctgctcctggatatgtatcccgaaaccgtccagccagaggagaaaaagcaggtggagtacgctgtgttacggaatatcacggagctgaggaggatttatagtttctatagttctctgggctgcggccactcactagacaatacctttctgatgaccaaattgcacttctggcgctttctgaaggattgcaagtttcatcaccataaactcacactggcagacatggaccgaatactatctgcaaataatgacatccccgttgaggaaattcattctcctttcaccaccatcctcctgcggactttccttaactatttgcttcacctggcttatcatatttaccacgaagaatttcaaaagaggtccccctccctctttctgtgctttacaaagctcatgaccgagaatatccggcctaatgcgtgtcagattaaaggcaatttgtttagggagcagcagcgcacattgtactctatgtcatatatgaataagtgttgggagatatacctggcctattgccgccccagtgctgcccccccacacgaacccactatgaagatgagacacttcctgtggatgctgaaggactttaaaatgattaataaggaactgactgccgcaacattcatggaggtgattgcagaagataaccgcttcatctatgatggcatcgactcaaactttgagcctgaactcgtgttcctagagttttttgaagccctcctgagttttgcattcatctgcgttacggaccaaatgactaaaagctacacaaatgtgccggccgatgatgtcagcggcaacaagcacgagaccatctatactattctgaaccaggatgcccagaacaaatcaccttcagccgttatgtctcatgaaagcgatgccgcgcactccgacagcgcgaggagcagcagttctaaactggagttaagtcctgatgtgaataaaatccgcaaatccgagcccaagatcaagaaatcggtcagccatgaaagagtcagcaagatgaacttcaagctaaccgggaagggcataaccttctttagctccgagtcaaagaagtacgagaggcctaaggacgatagagaggaagaattcaatacctgggtgaataatacttacgtattcttcgttaacactctgttccacgcttataagcgtgaggaagccataaaagagaaaatacgggcagaccggctacgttctaccgctcaggctcaacagcggaaaatggaggatgatgaactggaggctcggctcaatatcttcatactgcgtgaagaggaggcaaaaagacacgactacgaggtggatattactgttctcaaggagccagccgacgtctcatcgtcccacctgattttagacccccccaaggaagacgttaccgtaagcccctcaagcaagaccatcacctctaagaagaagaagaaatag

SEQ ID NO: 32971 - DNA, 30 bp, Artificial Sequence
  Description of Artificial Sequence: Synthetic coding sequence
atggtaaaggagaagaaaaaggccgattag

SEQ ID NO: 32972 - DNA, 1857 bp, Artificial Sequence
  Description of Artificial Sequence: Synthetic coding sequence
atgaatcatggagtctatacatggcccgatggaagcatgtacgaaggggaagtcgtaaatgggatgaggaatggattcggaatgtttaaatgcagcacacagccggtgtcgtacattggtcactggtgcaacggcaagaggcacggaaaaggcagtatttattataatcaggagggcacatgctggtatgagggcgattgggtgcagaatatcaaaaaggggtggggtatacgctgctataagtccgggaacatatacgagggacagtgggaagacaatatgaggcatggcgaggggcgaatgcggtggctaacaaccaacgaagagtacactggcaggtgggaacggggaattcagaacgggttcggaacccacacctggtttttgaaacgcattaggtccagccagtatcccctcagaaacgagtatataggcgagtttgtcaacggatataggcacgggagaggaaaattttattatgcctccggcgctatgtatgacggtgagtgggtgtccaacaaaaaacacggcatgggacgtctgactttcaaaaacggacgggtatatgagggagctttctcgaatgatcacatcgctggtttccccgacctggaagtggagtttattagctgtctcgacctttcttcgggcgtggccccacggctgtctaggtcagctgagctgatccgaaaactcgatgggagcgagtctcattctgtcctcggctcatcaatcgagttggacttgaacctactgctggacatgtatcctgagactgtgcaacctgaggagaaaaagcaggtggaatatgcagtcctccggaatattactgagctgaggcgcatctactccttttatagttcgctgggttgtggtcactcccttgacaacacatttctgatgactaagctgcatttctggcggtttctcaaggattgtaagtttcatcatcataaactaactctggccgacatggaccgtatcctctcagccaataacgatatccccgtggaagagatccactcgcctttcactaccattcttctgcgcacattcctgaactaccttttacatttggcctaccatatataccacgaggagttccagaagcgatctccttctcttttcctgtgcttcactaaactgatgacggagaacattcgacccaacgcctgccagattaaggggaaccttttcagagagcagcagcgcactctatatagcatgagctacatgaataagtgctgggagatataccttgcatactgccgtcctagtgccgccccaccacacgagcctacaatgaagatgcgacacttcctgtggatgctcaaagacttcaaaatgatcaataaagaactgacggcggctacatttatggaagtcattgctgaggataataggttcatctatgacgggatagattctaatttcgagcccgaactggtatttctggagttttttgaggcactgctctcctttgcgtttatctgtgtgaccgatcagatgacaaaatcctatactaacgtccccgctgatgacgtttctggaaataaacacgaaaccatatataccatcctgaaccaggatgcccagaacaaaagtccgtccgcagttatgagccatgagtccgatgccgcgcattccgactctgctagaagctcttcctccaaacttgaactttctccggacgttaataaaatccgaaagtccgaaccaaagattaaaaagagcgtttcccacgaacgcgtatcaaagatgaatttcaagcttacagggaaaggaattactttctttagcagcgaaagcaaaaagtacgagcggcccaaagacgaccgcgaggaggacgggcgatag

SEQ ID NO: 32973 - DNA, 327 bp, Artificial Sequence
  Description of Artificial Sequence: Synthetic coding sequence
atgaaggctctatgtctcctcctgctgcctgtccttggcttattagtctctagtaagacgctgtgtagtatggaagaagctataaatgaacgcatccaggaggtagcaggaagcctgatatttcgagccatcagctccatagggctggaatgtcaatccgtcacctcgcggggcgaccttgccacctgtcctagagggtttgcggtgacgggctgcacatgcggatctgcctgtggcagctgggacgtgcgtgcggagactacatgtcactgccagtgcgccgggatggattggaccggagcccgatgctgccgtgtccagccctag

SEQ ID NO: 32974 - DNA, 4485 bp, Artificial Sequence
  Description of Artificial Sequence: Synthetic coding sequence
atgtatagtgaatggagatcactccacttggtgattcagaacgaccagggccatacgtccgtgttgcactcataccccgagtccgtgggtcgtgaagttgctaatgcggtagtacgaccacttggacaggtcctgggtaccccgagcgttgctggcagcgagaatttgttgaaaacagacaaggaggttaagtggaccatggaggtgatctgctacggcctgacacttccactggacggagaaaccgtgaagtattgcgtcgatgtgtataccgactggattatggcactggtattgcctaaggattctattccattgcccgtgatcaaggagcctaaccagtatgtgcagactatcctgaagcaccttcaaaatctgtttgtccctcgtcaggagcaaggatcttcccagatccgactctgcctacaggtgcttcgtgctatacaaaagttggcgcgagaatcaagtctgatggcccgggagacctgggaggtactactgctgttcctgctgcagattaatgacatcttgctcgccccccccaccgtgcaaggtggtatcgcggaaaacctcgcggaaaagttgataggagtgctgtttgaggtgtggctgcttgcctgtacaaggtgcttcccaacgcccccctactggaaaaccgccaaggaaatggttgccaactggagacaccacccagcagttgtggagcagtggtccaaggtcatctgcgctctgacatccagacttctgagattcacctatggaccctcctttccggccttcaaggtgcccgatgaagacgcttctttaatcccacctgagatggataacgaatgcgtcgcacagacttggtttcgtttcctgcacatgctgagtaatccagttgatctgtcaaacccggccattatctcttcgacaccgaagtttcaggagcagtttttaaacgtgtccggaatgcctcaggaattaaaccagtatccatgcctgaaacacctacctcagattttctttagggccatgcgagggatcagctgtctagttgatgccttcttgggaatctccaggcctagaagcgactccgccccaccaacaccggtcaacagactgagcatgcctcagagtgcagccgtgagcactacccccccacataacagaaggcacagagcagtgaccgtgaataaagctactatgaaaacaagcacagtctcaactgctcacgcgagcaaagtacaacaccagacatctagcacatcaccgttgagtagtccaaaccaaaccagcagcgagcctaggcctctgccggctcccaggagacccaaggttaatagtatcctaaacctcttcggatcctggctcttcgatgcggcgttcgtccattgcaaactgcacaacgggatcaacagagatagtagcatgaccgcaatcaccacccaggccagtatggaattcaggagaaaggggtcccagatgagcacagatactatggtgagcaatccaatgttcgacgcctctgagtttccagataattacgaagctgggcgggccgaagcatgtggcaccttatgtcgcatcttctgtagcaagaagacaggtgaagaaatcctgccagcttacctaagccgcttttatatgctcttaattcaggggctacagatcaatgactacgtctgtcacccagtgcttgcctctgtgattctaaatagccctccccttttctgctgtgacctgaagggcatcgacgttgttgtgccttacttcattagtgccctggaaaccattctgccggaccgggagctcagtaagtttaaatcatatgtgaacccgaccgaacttagacgtagctccatcaatattcttctgtccctcctgccactgccccaccacttcggaacggttaagagtgaggtggtgctggaaggtaaattctcaaacgacgactcatcttcatatgacaagccaattacatttctctctctaaaactgcgcctagtaaatatcctgataggcgctttgcaaacagagacagaccccaataatactcagatgatcctcggggctatgctgaacatcgttcaggattccgcactgcttgaagctatcggctgtcagatggaaatgggaggcggcgagaataacttgaagtcccatagccgtaccaactctgggatttcctccgcatcaggaggctctactgaacccaccactccagacagtgaaaggcccgctcaagccttacttagggattatgctctcaataccgattctgccgcaggccttttaattcgatcaatccacctagttacacagaggctcaacagtcagtggcgtcaagacatgagcatctcactggcagcgttggagctgctgtcaggtctggcaaaagttaaagtgatggtggactcaggggaccgtaaacgcgctatctcaagcgtgtgcacatacattgtgtaccaatgtagccgccccgccccactccacagtcgcgatctgcacagcatgatagtggccgccttccagtgcttatgcgtctggctcaccgaacatcctgacatgttggacgagaaggattgtcttaaggaagtgttggagattgtggagctggggattagcggctcaaaaagcaaaaacaacgagcaggaggttaaatacaagggggacaaggagcctaacccagcatccatgcgcgtgaaagacgccgcagaggctacactgacgtgcataatgcagctgttgggagcttttccctcgcctagtggccccgccagcccttgctcactagtgaatgagacaaccttgattaaatactccagattgccaacaatcaataagcacagttttcgatatttcgttctggataactctgtgatcctcgcgatgctggaacagcccctggggaatgaacagaatgatttcttccctagcgtaactgtgttagtcagagggatgtccgggcgactcgcctgggctcagcagctctgtctgctgccccgcggtgccaaggcaaaccagaaattgtttgtgcctgaacccagaccagttccaaaaaacgatgtcggtttcaagtactctgttaagcatagaccttttcccgaagaggttgacaagatcccatttgtgaaggccgatctaagcatcccagatctgcacgaaatagtcactgaagagctggaggagcgtcacgagaagctgcgctccggcatggctcaacagattgcctacgaaatccacttagaacaacagagcgaagaagagttacaaaaaagatctttccccgatcctgtgacagactgtaagccccccccccctgctcaggagttccagactgcaagacttttcttaagtcactttggcttcctgagtcttgaagctctgaaggaaccagccaattcccggctgcccccccaccttattgcccttgattctacgattccagggttctttgacgatatcggttacctggatctactgccctgccgcccatttgataccgttttcatattttacatgaaaccaggtcagaagacaaaccaagagatcctgaaaaatgtggaatccagtcgtaccgtgcagccacatttcctggaattcctgctgtcccttggctggtccgtagacgtaggccggcatccaggatggacaggacatgtttccacatcgtggtcaatcaattgttgcgatgacggagaaggatctcaacaggaggtgatttctagcgaggacatcggtgccagcatctttaatggacagaagaaggtgctgtattacgccgatgctcttactgaaatagcattcgtggtgcccagccctgtggagtcactgacagatagtttggagagtaatatcagtgaccaagactccgactcaaatatggaccttatgccgggcattctcaagcaaccatcactgacactggagctcttccccaaccataccgacaatctgaacagcagtcaaagactcagcccctctagtagaatgcgcaaactgccacagggcaggccggtgccaccactcgggcccgagacaagggtgtcagttgtgtgggtggagcgatacgacgatatagaaaattttcctctgtccgaactgatgaccgaaatcagcaccggggtggagaccaccgccaatagttctacttctctccgaagcaccaccctcgaaaaagaagtacctgtgatcttcattcacccactgaacacagggctgtttcgtattaaaatccagggagccacagggaagttcaacatggtgatacctctcgtcgacggtatgatcgtctcaagaagggcactaggttttctcgtacgccagactgtcattaacatctgcagacggaaacgccttgaaagtgacagctactcgccaccccacgtgcggagaaagcagaaaatcacggacattgtaaacaagtatagaaacaagcaactggaaccagagttctacacatccctcttccaggaggtgggtctcaagaattgtagctcttag

SEQ ID NO: 32975 - DNA, 2892 bp, Artificial Sequence
  Description of Artificial Sequence: Synthetic coding sequence
atgtacagtgaatggcggtcattacacctggtgatacaaaacgaccagggacatacttctgtgttgcactcataccccgaaagtgtcggacgtgaagtggctaacgccgtggttcggcccttgggccaggtgctgggcaccccctccgtggccgggtccgaaaacctgctcaagacagataaagaggtcaagtggaccatggaggtaatctgctacggcctgacactgcccctcgacggagaaactgtgaagtactgtgtcgatgtgtacaccgattggatcatggcactagtgctccccaaagatagcatcccactccctgttatcaaggagcccaatcaatacgtgcagaccatcctgaagcatctccaaaatctgtttgtgcctcgccaggaacagggcagttctcagataagattgtgtctccaggtgttgagagccatccagaagctcgcccgtgaatctagcctgatggcccgggaaacatgggaagtgctactactgtttctcctgcagattaatgatatccttctcgcccctccgactgtccaaggtggaattgcagaaaatttggccgaaaaactcattggcgtcctctttgaagtttggctactggcttgcacaaggtgtttccctacaccgccatattggaagacagctaaggaaatggttgcgaattggaggcatcatcccgccgtggtggaacagtggtcgaaggtgatttgcgccctcacatcccgtcttctgcggttcacatacggtccctcgttccccgcctttaaagtgccagacgaagacgctagcctcattcctcccgaaatggacaatgaatgtgttgcccagacttggttccgcttcttgcacatgctgagcaatccagtggacctctctaacccagcaattatctcttccactcctaagttccaggaacagttccttaacgttagtggcatgcctcaggagttaaatcaatacccatgcctcaaacacctaccccagatcttcttcagagcaatgaggggtatcagttgtctagtggacgcctttctggggatctcgaggcctcgctcagattctgcacccccaacccctgtcaatcggctctccatgccccagagtgccgccgtctccacaaccccaccccacaaccgacgccacagagccgtgaccgtcaataaagcaacgatgaagacatcaacagtgtcaacggcacacgcatctaaagtgcagcatcagacttcctccacttcacccctgtctagtcccaaccaaacaagtagcgagcccagacctttgccggcccctcggagaccaaaggttaactccatcttgaatctttttgggtcctggctcttcgatgccgctttcgtgcattgcaaattgcacaacgggatcaacagggattcttccatgacagctatcaccacgcaggctagcatggaattccgtcgtaaggggtcgcagatgagcaccgacacaatggtctcaaaccctatgttcgatgcaagcgaatttcctgataattatgaggcaggcagagccgaggcatgcggcactttatgcaggatcttctgtagcaaaaagacgggcgaggaaatcttacccgcctatctaagcagattttacatgttgctgattcagggcctccagatcaatgattacgtgtgtcatccagtgttggccagtgtaatcctgaattctcctccccttttctgttgtgatctgaagggtatcgacgtggtggtcccctactttatctctgctctcgaaaccattttaccagaccgagagctatcaaagtttaagtcttacgttaacccaaccgaactcaggaggtccagcattaatattcttctgtctcttttgcctcttcctcatcacttcggaaccgtgaagtcagaagtggttttggaaggaaaattttccaatgatgatagctcttcgtacgataagccaatcacattcctgtccctgaagttaagactggtgaatattctgatcggggcgctgcaaacagagaccgatcccaacaacacacagatgattctgggagctatgctgaacatcgtgcaagattcagctctgttggaggctattggctgtcagatggaaatgggaggcggcgagaataatctgaaaagccattcaaggacgaattctggaatctcttccgccagtggggggtctaccgagcccacaactcctgacagcgagaggccagctcaagcccttctcagagattacgccctcaacacggactcggccgctggcttattgataaggagcatccatctggtgacccagaggctgaactctcagtggagacaagacatgtccatctctctcgcagccctggagctgttgtccggcctcgccaaggtgaaagttatggtggactctggcgatagaaaacgcgctatatcctctgtgtgtacatacatagtctatcagtgctccagaccagcaccgttacatagccgcgacctccactcaatgatcgttgccgctttccaatgtctgtgtgtttggctgactgagcacccagacatgctggacgagaaagactgcctgaaagaggtcctcgaaatcgtggagctgggtatcagcgggtctaagtctaaaaacaacgagcaggaagtgaaatacaagggagacaaggagcctaaccccgcatccatgcgcgtaaaagacgcggccgaggccactcttacctgtattatgcaactgttaggcgctttcccttctccgagcgggcctgcctcaccatgttccctggtgaacgaaaccacgctgatcaagtatagtcgcctgcctaccatcaacaagcaactggagccagagttctacacctcattgttccaagaggtggggctaaagaattgttctagttag

SEQ ID NO: 32976 - DNA, 3822 bp, Artificial Sequence
  Description of Artificial Sequence: Synthetic coding sequence
atggtggccaactggagacatcaccccgctgtcgtagagcagtggtctaaagtgatttgcgccttgacatcgcggctgctgcgctttacctatggcccctctttccccgcctttaaagttcccgacgaagacgcgtcactcatcccacctgagatggacaacgagtgtgtggcccagacctggttcaggttcctgcatatgctcagcaaccccgtcgatctcagcaatcccgccattatctcaagcacacctaaatttcaggagcagttcttgaacgtgagcggtatgcctcaagagctcaatcagtacccatgccttaagcatctccctcaaatattctttcgggcgatgagaggcatttcctgcttggtcgacgcattcctggggatcagccggccacgctccgactctgctccccccaccccagtgaaccgtctgagtatgccccagagcgcggccgtgagtactactccacctcataatagacgtcaccgtgcagttactgttaacaaagcaacaatgaagacctccaccgtctcaactgcacatgcctccaaagttcagcaccagacctcatcgacctccccgctgtcatcacctaatcagactagctccgaaccacggccccttcctgctccgcgtagaccgaaagtgaacagcatccttaatctcttcggcagctggctattcgacgccgcgttcgtgcactgtaaactccataacggaatcaaccgggacagctctatgactgccattaccacccaggcgagtatggaatttcggcgaaaggggagtcaaatgtctacagacactatggtctctaacccgatgtttgatgcttctgaatttccggataactacgaggcagggcgtgccgaggcttgcggcacattatgccgtatattctgcagtaagaagacaggcgaggaaattctaccagcttacctttcccgtttttacatgctgctgattcagggtttgcagatcaacgattatgtctgccatccagtgctggccagcgttatcctgaatagcccccccctcttctgttgcgatctaaaggggatcgatgtggtggtgccttatttcattagtgcactcgagactatattaccagatcgggagctgagcaagtttaagtcatacgtcaacccaactgagctgagaaggtcatcaattaacattctgctgagtctgctacccctgccacatcacttcggcactgtcaaatcagaagtggtgctggagggtaagttctccaatgatgattcctcctcctatgataaacccattacattcctgagtctgaaacttcgccttgtgaacattctgattggcgccctccaaacagagaccgatcccaacaacacacaaatgattctcggagcaatgcttaacattgttcaggacagcgcgctactcgaggcaattggatgtcagatggagatgggcggcggagaaaacaacctcaagtcacacagcaggaccaatagcgggattagctccgcctccggcgggtctactgaaccgactacccctgactctgagagacctgctcaggcgctgctgcgggactatgcattaaatacagacagcgccgccggtcttttgatccgaagcattcatcttgtcacccagaggctcaactcccagtggcgacaagacatgtcaataagcctagccgccctggagctcctgtcagggctcgctaaagttaaggtcatggttgatagtggagacaggaaaagagctatttcatctgtttgcacatacattgtgtatcaatgtagtagaccagcccccctgcactctcgggaccttcatagtatgatcgtcgcagccttccagtgcttatgcgtgtggctgacagagcatccggacatgctggacgaaaaagactgtcttaaggaagtgttggaaatcgttgagctcggaatatctggatcaaagagcaaaaacaacgagcaggaggtcaaatacaaaggtgataaagaacccaatcccgcaagtatgcgcgtaaaggacgctgctgaagcaaccctgacctgcatcatgcaactgctcggagcattccctagcccctccgggccagcctccccctgctctctggtgaatgagactacactcattaagtactcccgactacctaccatcaataaacatagttttcgctacttcgtgctcgacaatagcgttatactagccatgctcgagcagcctctagggaatgagcagaatgactttttccctagcgtgactgttctcgtacgcggtatgtctggccgacttgcttgggcccagcagctctgcctgttaccgaggggcgctaaagctaaccagaagctgttcgtaccagagccgcgtccggtgcccaaaaatgatgtcggcttcaaatattctgtgaaacacagaccatttcctgaggaggtggacaaaattccatttgttaaggccgacctgtctattccagacctgcatgagattgttaccgaagagctggaggaacggcacgagaagctgagaagtggaatggctcagcagatagcttacgagatacacttggagcagcagtcagaagaggagttacaaaaacgctcctttccagatcctgtgaccgactgtaaaccaccccctccagctcaagagttccagacagcaagactctttctgtctcattttggattcctctctctggaggctctgaaggaacccgctaactcgcgtctgccgcctcacttgattgccctagactcaacaattccaggctttttcgatgacatcggatatctggatcttttgccatgtaggcctttcgacacggtgttcatcttctacatgaaacccggacaaaagacaaatcaggagatcctgaaaaacgtcgaaagctctcgcactgtccagcctcactttttggaatttcttctgtctctcggttggagcgtggacgtcggaagacacccagggtggacaggacatgtgtccacaagctggtccattaactgctgcgacgatggcgagggatctcagcaggaggaagtcatatcatctgaagacattggcgcatcaatcttcaacggacagaagaaagtcctttactatgcagacgccctgaccgaaatcgccttcgtggtgccatcacccgtggagtccctaactgattctttggagagtaacatcagtgaccaggactcagacagcaatatggatttgatgccaggtatcctgaaacaaccttctctcacgctggagctgtttcccaaccacactgacaatctgaactccagtcagcgcctgtcaccttcgtcaagaatgcgtaaactgccacagggtcggcccgtcccaccactcggaccagaaacgagagtgtctgtcgtgtgggtagagagatacgacgacatcgagaactttcctttaagtgagttgatgacagaaatctctacaggagttgaaacaactgccaactcttccacatcactgcgaagtaccacactggaaaaagaagtacccgtgatctttattcaccctctgaacacaggacttttccgtattaaaatccagggagcaacgggtaagttcaatatggtcattccactggtggacgggatgatcgttagccggagggcactcggattcctcgtgcggcagacggtgattaatatttgtcgtcgcaaaaggctggaaagtgacagctatagccccccccacgtgcgccggaaacagaagatcacagatatcgtcaataagtatagaaataagcaactcgaaccggaattttatactagcctgttccaggaagtgggcctgaaaaattgttcatcctag

SEQ ID NO: 32977 - DNA, 4485 bp, Artificial Sequence
  Description of Artificial Sequence: Synthetic coding sequence
atgtatagcgaatggcgtagcctacacctcgtgattcagaatgaccagggccacacttccgtgttacacagctacccagagagcgtgggccgggaggtcgctaatgcagttgtcaggcctcttggtcaggtattaggcactccttctgtggcaggatctgaaaaccttctgaagactgacaaggaggtcaagtggacaatggaagtaatctgttatggcctgacactgcccctcgatggggagactgtaaagtactgcgtggatgtctataccgattggatcatggctcttgtgcttccaaaagatagcatacctctgcccgtgattaaggaaccaaaccagtacgtacagaccatcctcaagcatctccagaacttattcgtgccgcgccaagagcaaggcagctcgcaaatccggctgtgtctgcaagtgctcagagctatacagaaactggctagggaaagctctctgatggcccgcgagacctgggaggtgctgctactgtttcttcttcagatcaacgatatactcctggctcccccaactgtgcagggaggcatcgcagaaaacttagctgaaaaacttatcggagtcctatttgaagtctggcttctggcgtgtacacgctgcttccctactccaccttattggaaaacggctaaagagatggtggccaattggcgacaccaccccgcagtcgtggaacagtggtcaaaggtcatctgcgctctaacctcccgtttgcttaggttcacatatggcccgagtttccctgcgtttaaggttcctgacgaggacgcatccttaattccccctgagatggataacgagtgtgttgcccaaacctggttccgcttcctgcacatgctctctaacccggtggacctcagtaatcccgctatcatctcttccactcccaaattccaggagcagttcttaaacgtttccggcatgccccaggagctcaatcagtacccttgtttgaaacatctgccccagattttcttcagagccatgaggggaatctcttgcctggtggacgctttcctgggaatctcaaggccacgaagcgattcggctccgcccacccccgtgaaccgactgagtatgccccagtctgcagcggtctccactacacctccacataacagacgccacagggctgtaacagtgaataaagccacaatgaaaacttccactgtttccacagcacacgcttctaaggttcaacatcagacttcttctactagccctctgtctagtcctaaccagaccagctcagaacctagacctctcccagcgccgcggagaccaaaggtgaactcaatcctcaacctgtttggcagttggctttttgacgcagcctttgtgcactgcaaactgcataacggtatcaaccgggacagcagtatgaccgcaattacgacacaagcatcaatggaattcagaagaaagggctcgcagatgagcaccgacaccatggtgagcaatcccatgttcgacgcatccgagtttcctgataattatgaagccggccgcgccgaggcgtgtggcaccctatgccgtattttttgctccaagaaaaccggagaggagattttgcccgcctacctgtctcggttttacatgctattgattcaagggttgcagatcaatgattacgtttgccatccagtactggcttccgtgatcctgaatagcccgccactgttctgttgcgatctgaagggcattgacgtcgtggtgccgtatttcatttccgcactggagactatccttcccgatcgggaactgtccaaattcaagtcttatgtaaatcctactgagctgcggagatcgtcaataaacatcttactcagcctgctgccgcttccccaccatttcggaactgttaaatccgaagttgtgttggagggcaaattttctaatgacgatagctcgtcctatgataaaccaattactttcctgagcctgaaactccggctagtgaacatcttgatcggagctctccaaacagagacggatcctaataacacccagatgatcctgggcgccatgttgaacatcgtccaagattctgctctgctcgaggcaattgggtgccagatggaaatgggtggtggggagaataacctaaagagtcacagccgaacaaactctggtatttccagcgcgagcggaggcagcactgaacctactactccggattcagagaggccagcccaggccctgctgcgcgattatgcactgaataccgacagtgcagcaggcctcctgattcgatcaatacacttggtgacccagaggttaaacagtcagtggagacaagacatgagcataagtttggccgccctggagctgctctccggcttggccaaagtcaaagttatggttgacagcggcgatcggaagagggccatcagcagtgtgtgtacctacatcgtctatcagtgtagtaggcccgcgcctctccactcgagagacctgcattctatgatcgtcgctgctttccagtgcctgtgcgtctggttgacagaacaccccgatatgctggatgaaaaagactgtttgaaggaagttctggaaatagtggaactgggcatcagcggatccaaatcaaagaacaacgaacaggaagttaagtacaagggggataaagaaccgaatcctgcatcaatgagagtgaaagacgccgccgaggctactcttacatgtattatgcaactgttgggtgcattcccttctccaagcggacctgcctcaccatgttctctagtcaatgagaccacgctgattaagtatagtagattgcctacgatcaacaaacatagcttcaggtatttcgtcttggataacagcgtgattttggccatgctggagcagcccctaggtaatgagcagaatgattttttccctagcgtgactgtgctagtgaggggaatgtcaggccgactggcctgggcacagcagctgtgtcttctgcctcggggtgcgaaagccaaccaaaagttgttcgttcccgaaccccggcctgtccctaagaatgatgtggggtttaagtatagcgtcaaacatcggccctttcccgaagaagtagacaaaatcccattcgtgaaggccgatttgtcgatccccgatctgcacgagattgttaccgaagagcttgaggagcgacacgaaaagctgcgttccgggatggcccagcagattgcatacgaaattcacctcgaacagcagagtgaagaagaactgcaaaagaggtcatttcctgatcccgtaacagactgcaagcctccacctcccgcacaggagttccaaacagcccggctgttcctttctcatttcggttttctcagtctggaggccctgaaagagcccgctaattcccggttaccaccgcacctgatcgctctggattccaccattccaggtttttttgatgatataggctatcttgatctcctgccatgtaggccgtttgatacagtgtttattttttacatgaaacctggccaaaagactaaccaagagatacttaaaaacgtggaatccagcagaaccgtgcagccacatttcctggaattcctgctgagcctgggctggtccgtggacgtgggtagacatcctggctggactgggcatgtctctacttcctggtccattaattgttgcgatgacggagagggttctcagcaggaagtgattagcagtgaggatatcggcgcatcaatttttaatggacagaaaaaagtgttgtactacgctgacgctctgactgagatagcgtttgtcgttcctagtccggtggagagcctgaccgattctctggaaagcaacatatccgaccaggattccgatagcaacatggatctaatgcccggcatccttaaacaaccaagtctgacgctggagctttttcccaatcacaccgacaatctgaatagcagtcagcgtctgtcaccaagttcgagaatgagaaaattgccacaaggccggcccgtgcccccacttggtcccgaaacgagagtcagcgtggtatgggtcgagcggtatgacgatattgagaatttcccactatctgagcttatgaccgaaatctccacgggagttgagacgactgccaactctagcacatccctaagatccacaaccctggagaaagaagtgccggtcatatttattcacccgttaaatacaggcctgttcaggatcaagattcaaggggctactggaaaatttaacatggtgattccactcgtggacggaatgatcgtgtcccggagggctctgggctttctggtgagacagactgttatcaacatctgtcggcgcaaacggctggagagcgactcctactctccgcctcacgttaggcggaagcagaagatcactgacatcgttaataagtacaggaacaagcaattggaacctgagttctacacgtcgctcttccaggaggttggcttgaaaaattgctctagctag

SEQ ID NO: 32978 - DNA, 4476 bp, Artificial Sequence
  Description of Artificial Sequence: Synthetic coding sequence
atgtacagtgagtggcgaagcctccatttggttattcagaacgatcagggacacacaagcgtgctgcactcctaccccgaatcagttggtcgcgaagtggctaacgctgtggtccgccccctcggacaggtcttgggcacccctagcgtggccggaagtgagaacctgctgaagactgacaaggaggtaaaatggacaatggaggttatctgttatggcctcactcttccattagacggcgagactgtgaagtattgcgtcgacgtgtacaccgattggatcatggcccttgttctgcccaaggattctattcctttgcccgtcattaaagagcctaatcaatacgttcaaaccattctgaaacacctgcaaaacttatttgtgccacggcaggaacagggatctagccagattagactctgtctgcaggtacttagagccatccagaaactggcccgcgagagctccctcatggcaagggagacatgggaggtactcctgctgttcctgctccaaatcaacgatatactgctcgcacctccaacggttcagggaggcatcgctgaaaacttagccgaaaagctgattggggtccttttcgaggtctggctgctagcctgtacacgctgctttccaactccgccctactggaaaacagccaaggagatggtagcaaattggaggcaccacccagcagtagtggaacagtggtctaaagtgatttgtgccctgactagccgactccttcgttttacctatggcccaagctttcccgccttcaaagttcccgacgaggacgcatctctgatccctcccgaaatggataatgaatgcgttgcacagacatggtttaggtttcttcacatgctgtcaaatcctgtggatctgagcaacccagccataatttcaagcacccccaagtttcaagaacagtttcttaacgtgtctgggatgccacaggaactgaatcagtatccctgcttaaagcacctgccacaaatctttttcagggctatgcgggggattagctgccttgtcgatgcattcctgggcatcagccgaccacgtagcgatagtgcccctcccactcctgtgaatcgactcagtatgccccaatccgctgcggtctccacgacacctccacacaaccggagacatcgggccgtcaccgtgaataaggcgacaatgaaaactagtacggtatcaacagcgcatgcaagcaaggtgcagcaccaaacctctagcacgagcccattgagcagtccaaaccagacctcttctgagcctagaccattgcccgccccccgaagaccgaaagtcaattctatcctgaatctgttcggttcctggctctttgatgccgcctttgtccactgtaagctgcacaacgggataaatagagactcttcaatgactgcaattactacacaggcaagtatggaattcagaaggaagggatcgcagatgtctactgacacaatggtgagcaatcccatgtttgatgctagtgagtttcctgataattatgaagccggtcgtgccgaagcgtgcggtaccctgtgcaggatattttgcagcaagaagaccggcgaggaaattctccccgcgtacctgtcacgcttttacatgctgttaattcaagggctacaaatcaacgattacgtgtgccaccccgtgctggcatctgtgatcctcaactcccctcctttattctgttgcgatctgaagggaattgacgtggtggttccatacttcatcagtgcactggagactatcttgcccgatcgcgaacttagcaagtttaaatcatacgtcaaccctactgagctcagaagaagctccattaacatattgctcagtctcttgcctctgcctcatcactttggcacggtgaagtcagaagtcgttctcgaggggaagttcagcaatgacgactcctcctcttatgacaaacctatcacattcctctccttaaaactaagactggtaaatatcctgattggtgccctgcagaccgaaactgatcctaataacacgcagatgatcctgggggccatgttaaatatcgtacaggacagcgcactactggaagcgatcggctgtcagatggaaatgggaggtggagaaaataacctcaaaagccatagtagaaccaattcgggcattagcagtgcctctggtggaagcacagagccgacaacacccgattccgaaaggcctgcacaggccctgctgcgagattatgactccgccgccggcttattgataagaagtattcacctggtcacacaacgccttaactcccagtggagacaggatatgtccatcagccttgcggctctggagctgctcagcggtctagctaaggtcaaggtgatggtcgattcaggcgaccgaaagagagcaatttcttctgtctgtacctacattgtttatcagtgctccagacctgctccattgcacagccgagatctccactccatgattgtggctgccttccaatgtctatgcgtgtggctgaccgaacatccggacatgctagatgagaaagactgcttaaaggaagtgctggagatcgtggagctgggtatctcgggatcaaagtctaagaacaatgaacaggaggtcaagtacaagggcgacaaggagcctaatcctgctagtatgcgcgtcaaagacgcagccgaggcaacgcttacgtgcatcatgcaactgctcggggcatttccgtctccgagtgggcctgcctctccatgctcattggtgaatgagaccactctgattaaatattctcgtcttcctaccatcaacaagcactcattccgatatttcgtccttgataactcagtgatccttgcaatgctcgaacaacctctggggaacgaacagaacgactttttccctagcgttacagtattggttaggggaatgagcggcaggctggcctgggcacagcagttgtgcctgctccctaggggcgcaaaggcgaaccagaagctttttgttccggaaccccgaccagtgcctaaaaacgacgtggggttcaagtactctgttaaacaccgtccttttcccgaggaggtcgacaagataccttttgtcaaagccgacttgagcataccagatttacatgagatcgttacagaggagctggaggagaggcacgaaaagctgcgctctgggatggcccagcagatagcctatgagatacacctcgaacagcaatcagaggaggagctgcagaaacgctctttccccgacccagttaccgactgcaagccaccccctccagctcaggagttccagacagcacgcctgttcttgtctcacttcggctttctgtcccttgaggcacttaaggagccagccaatagtcggttgcccccacatctgatagccttggactctaccatccccggattcttcgacgatatcggctacctggacctgctgccatgccggcctttcgataccgtttttattttttacatgaagccaggccaaaagactaatcaggagatcttaaagaacgtggagtcaagtcgaaccgtgcagcctcacttcctcgagtttctcctctctcttggctggagtgtggatgttggacggcatccaggatggaccggccacgtctcgacttcatggtcaattaattgctgcgatgacggagaagggtcacaacaggaagaggttatttcttccgaggacatcggtgcctctatctttaacggacagaagaaagtcctgtactacgcagacgctcttaccgagattgcattcgtggtgcctagcccagttgaaagtcttaccgattccctcgagagcaacataagtgaccaggatagcgactccaatatggatttgatgcctgggatcctcaaacagccatctctgacattggaactcttccctaatcacactgacaatctcaattcctcccagagactctccccttccagtcgcatgcggaaattgccccagggcaggcctgtaccccccctcggccccgagactcgcgtgtctgtggtatgggtggaacggtatgatgacatagagaactttccactgagcgaattgatgacagagatatccaccggtgtcgagaccacagccaacagttccacttcattaaggagcaccactctagagaaggaagtcccggtgatctttattcacccactcaataccggactcttccgcataaagatccaaggtgcgaccggcaaattcaacatggtgatccctctggtcgatggcatgatcgtgtcccgccgcgccctaggcttccttgttagacagaccgtgatcaacatctgccggcgtaaacgcttggaaagtgacagctactcacccccccatgtacgaaggaaacagaaaataacagatatcgttaacaagtatagaaacaaacagctggaacctgagttttacacctcccttttccaggaggtggggctaaagaactgcagttcttag

SEQ ID NO: 32979 - DNA, 3972 bp, Artificial Sequence
  Description of Artificial Sequence: Synthetic coding sequence
attaatgacattctattggccccgccaacagtacagggggggatcgccgagaatttagccgagaagctgattggggttttgtttgaagtgtggttactggcttgtacccgctgttttcctaccccaccgtactggaagacggcaaaggagatggtcgcaaattggcgtcaccaccccgccgtcgtcgagcaatggtctaaggtaatctgcgcccttacatcacggctcctgcggttcacctatgggccctctttcccagctttcaaagtccccgatgaagacgccagtctgatcccacccgagatggataacgagtgcgtcgctcagacatggttccggtttttgcacatgttgagcaacccagtagatctgtccaacccagccatcatttcttcaacacccaagttccaggaacagttcttgaatgtctctggcatgccacaagaactgaaccagtatccttgtcttaagcacctccctcaaatcttcttcagagccatgagaggaatcagctgtctggttgatgcatttctggggatatcccggccacgatccgattccgcacctcctacgccagtgaatcgattatccatgcctcagagtgccgccgtgtctactaccccacctcacaaccgaaggcaccgcgcagtgactgtcaacaaggccactatgaagacatctaccgtcagcactgcccacgccagtaaagtgcagcatcaaacttcgagcacaagcccattatcctctcctaaccagacgtcgagtgagccgagacccttgccagccccccgaaggcctaaagtaaacagcatccttaacttgttcggctcttggctgttcgacgccgcatttgtgcactgtaaattacataatggcatcaacagggactccagcatgactgcaataaccacccaggctagcatggaattccgaagaaagggttcacaaatgtcaacggacaccatggtgtccaaccccatgtttgatgcctcagaattccccgataattatgaagcaggtagggcagaagcttgtggaacgctgtgtaggatcttctgttctaagaagactggcgaggaaattttgcccgcgtatctgagcagattctacatgctcctgatccagggcttgcaaataaacgattatgtctgccaccccgtcttggcgagtgtcattctcaactcaccaccactgttctgctgtgatttaaagggaatagatgttgtggtgccatacttcatcagcgcgttggaaacaattctgccggaccgcgagctttctaaatttaagtcatatgtcaaccccaccgagttgaggcgctcctctataaatattctgctgtcgctcctgcccctgccacaccactttgggaccgtgaaatccgaagtggtgttggagggcaaattttcaaacgacgactcttcttcctatgacaaaccaataacttttttgtcactaaagttgaggttggtcaacattctcatcggcgccctgcaaactgaaaccgatcctaacaatacacaaatgatactcggtgctatgctaaacatcgtgcaagactcagcactgctggaggccattggatgccaaatggaaatggggggaggcgaaaataatctgaagtcccattccagaaccaatagcggaattagcagcgcctccggcggttccacagagccgactaccccagactcagaaaggcctgctcaggctcttctcagggactacgcactgaacaccgatagtgcagccggcttgttgatacgcagtattcatctagtgacccagcgcttgaactctcagtggagacaggatatgtctataagtctggcggcactggagctgctgtctggtctggcaaaggtgaaagtcatggttgactccggggacaggaagagagcgatctcatcagtttgcacctacatcgtttaccagtgtagcagaccagccccattgcacagcagggatctccattccatgatcgtggcagcgtttcagtgtctttgtgtgtggctgaccgagcaccctgatatgctagatgagaaggattgtctgaaggaagtgctggagattgtcgagctagggatctctgggtccaaaagtaagaacaatgaacaggaagtgaagtacaaaggagacaaggaaccaaacccggcctccatgagggtgaaggatgccgctgaagctacacttacatgtatcatgcaactcctcggagcattcccttcccccagcggccctgcctctccttgctccctggtgaacgaaactacacttatcaagtactcgagactacccacgattaacaagcattcttttcgttactttgtgttagacaacagcgttattctggcaatgctcgagcagccactcgggaatgagcagaatgatttctttccctcagtgaccgttctggtgaggggcatgtctggcaggttggcatgggcccagcagctgtgtttgcttccaagaggagcaaaggctaatcaaaagctgttcgtccctgagcctcgccctgtgccaaagaatgatgtcggtttcaagtactcagttaagcacagacccttccctgaagaagtagataagatccctttcgtgaaggccgatctctctataccagatttgcacgagatagtcacagaggagctggaggagagacatgaaaagctacggtccgggatggcgcagcagattgcttacgagattcacttggagcaacaatcggaggaggagcttcaaaaaaggagttttcccgatcccgtcactgactgtaagccccctccccccgcacaggagttccagacagctcggctgtttctgtcccatttcgggttccttagtctcgaagccttgaaagagccagccaattcgaggctgcctcctcatctgattgccctggattcaactatccccggattcttcgatgacatagggtacctcgacctgttaccttgccgaccctttgatacggttttcattttctacatgaaacctgggcagaaaactaatcaggaaattctgaagaacgtggagtcctcgcggacggtccagcctcactttcttgagtttctgctcagcctgggctggagcgtagatgttggtagacatcccggatggaccgggcatgtatcgacctcctggtccattaactgctgcgacgacggagagggttcccaacaggaggaggtgataagtagtgaggacatcggagcaagcatcttcaacggccaaaaaaaagtgctgtattatgccgacgccctcactgagatcgcatttgttgtcccttcgcctgttgagagtctcactgactctttagaatccaatattagtgaccaggactcagattctaacatggacctgatgcccggcatactgaagcaaccctcgctcaccctggaactgtttcctaaccacacggataacttaaattcatctcagagattgtcaccttctagccgtatgaggaagcttccacaggggagacccgtacccccactggggcctgaaacgagagtgtctgtcgtctgggtggagcgttacgacgatattgagaattttcctttaagcgagcttatgaccgagatatccacaggggttgagacgaccgccaatagttcaacttcattacgctccactactctagagaaggaagttcctgtgatatttatccatcctctcaataccggcctgtttcggatcaaaatccagggagctacagggaagttcaatatggtgattcccctagtagatggaatgatagttagccgacgggccttggggttcctcgtaagacagaccgtcattaacatctgtcggcgcaagcggctcgagtcagattcatattctccgccccacgtgagaaggaagcagaaaattactgacatcgtgaataagtataggaataaacagctggaacccgaattctatacaagcttgtttcaggaggtgggcctgaaaaattgtagttcctag

SEQ ID NO: 32980 - DNA, 1434 bp, Artificial Sequence
  Description of Artificial Sequence: Synthetic coding sequence
atgtacagtgagtggcgaagtctccatctggttattcagaatgaccagggtcacacgtccgtgcttcatagttatcccgagtcggtgggcagagaagttgccaatgccgttgtaaggcctcttggacaggtgctgggaaccccctcagtagctggtagtgagaacctcctaaagacagataaggaagtgaaatggaccatggaagtgatatgctacggtcttacattgcctttagatggcgagactgtgaagtattgcgtagatgtgtatactgattggataatggccttagtccttcctaaggatagcatccccctgccggtcattaaggagccgaatcagtacgttcagaccatcctgaaacacctccaaaacctatttgtgcccagacaggagcagggatcatcccaaattcgactgtgccttcaggttcttagggctattcagaagttggcaagagaaagcagccttatggcaagggagacctgggaagtactgctccttttcctcctgcaaatcaacgatatattattggcgccccctaccgtgcagggcggcatcgccgaaaatctggccgagaagttgatcggagtcctttttgaggtctggttattagcttgtactcgctgtttccccaccccaccctattggaaaaccgctaaggagatggtagccaactggaggcatcacccagctgtcgtagagcagtggtcaaaagtgatttgtgctctgacatcaaggctcttgaggtttacatacggaccatcgttcccagcgtttaaagttccagatgaagacgcatcattaatcccgcccgagatggataatgagtgcgtggctcagacatggttcagatttttgcacatgctctccaatcccgtcgacctttcaaatcctgctattataagcagcactcccaaatttcaggagcagttcctcaacgtgagcggtatgccccaagaactcaatcaatacccatgccttaagcacctaccacaaatattcttccgcgcaatgcgtgggatttcttgccttgtcgacgccttcctaggcatctctcgaccccgaagcgacagcgctccccccactcctgtaaaccggctctcaatgcctcagtctgctgccgtgagtaccacacctcctcataaccgacggcatcgggctgtgacagtcaataaagcaacaatgaaaacgtccaccgtgagcacggcccacgcctcaaaggtacaacaccaaacatcgagcactagcccgctcagcagtccaaatcagacctcttccgagccccgccccctaccagcgcctagaaggccaaaagtcaactccatattgaacttgtttggctcatggctgtttgatgccgctttcgtgcattgcaagctgcacaatgggattaacagggacagttccatgaccgatttcacctgcttctag

SEQ ID NO: 32981 - DNA, 2334 bp, Artificial Sequence
  Description of Artificial Sequence: Synthetic coding sequence
atgcttcccagacctctgcgcctactgcttgacacatcccctcccgggggcgtcgtcctgtctagtttcaggagcagagaccccgaggaaggcggaggccccggcggtttggttgtcggcggcgggcaggaggaagaagaggaagaggaggaggaggcccccgtgagcgtgtgggacgaagaggaagatggagccgtgttcaccgtgacttcacgccaatataggccgctggacccgttggtacccatgcctccaccgcgatcctcaaggcgcctccgagccggcacccttgaagctttagtacgtcatctactcgacacccgcacgagcggcactgacgtgagtttcatgtccgctttcctcgctacccaccgcgctttcacctccacgcctgcccttctgggcctgatggccgataggctggaggccctggagtcacatccaactgacgagctcgagcgcaccactgaggttgctatcagtgtcttgtcaacatggctcgcatcacacccagaggacttcggctctgaggccaaaggacagctcgatcggctcgagtcgttcttactccagaccggatatgccgccggtaaaggtgtcggaggggggtctgcggatttaattcgcaacctgcggtcccgtgtggacccgcaggcgcccgatctgcccaagcccctggcattacccggtgacccaccagcagaccccaccgacgtgttggtgttcctggctgatcatctggctgaacaactaactttgttggacgcagagttatttctaaatttgatcccaagccagtgcctgggaggactgtggggccacagggatagacctgggcactctcacttgtgcccttccgtccgcgctactgtgactcagttcaacaaagtggccggcgccgtggtgagtagcgttttgggcgccaccagtaccggtgaagggccaggcgaggttacaatacgcccactgaggcctccccagagggccaggctgctggagaaatggatccgggtcgcagaggagtgtcggttgctgagaaacttctcatctgtttacgcggttgtgtcagcgcttcagagcagtcctatccataggctgcgagccgcgtggggggaggccacgagagactctctgcgcgtgtttagcagcctgtgtcagatatttagcgaagaggacaattacagccagtctcgcgaattgctcgtgcaggaggttaagctccagtcaccactggaacctcactctaaaaaagcccctcgctccggctccagaggtggcggagtggtgccttatctgggtaccttcctgaaagatttggtaatgctggatgccgcctctaaagatgagctggagaatggatacatcaacttcgataagcgcaggaaagaatttgccgtgctatccgaactcagaaggctgcagaacgagtgtcgaggttacaatttgcagccagatcacgacatccagcggtggttacagggcttacgacccctcacagaggcccagtctcacagagtgtcctgcgaggtcgaacctccgggctcgtcagacccccctgcaccacgggtgctcagacctacactggttatcagtcagtggaccgaagttctgggatctgtgggggtacctactccactggtctcatgcgataggcccagtacggggggcgacgaagctccaaccacgcctgcaccactactgacacgactggcccagcatatgaagtggccctcagtgtccagcctggacagcgcactcgagtccagtccgtccctgcatagccctgcagaccccagccacctgagcccaccagcatcttctccgagaccgtcccggggccaccgccggtccgcttcatgcggatctcccctctccggcggcgccgaagaagcatctggtggcactggatatggcggggagggtagcgggcccggagcaagtgactgcagaatcattcgagtgcaaatggaactcggagaagatgggtccgtgtacaagtcaattctggtcacaagtcaggataaggctccaagcgtgatttctagggtactcaaaaagaataatcgcgattccgccgtggcgagtgaatacgagctcgttcagcttctacctggggagcgtgagctgacaattcctgcatccgcaaacgtgttttatgccatggatggagcaagccacgacttcttgctccgacaaagaaggcgtagctcaacagcaacgccaggtgtgaccagcggcccatccgctagcggcactcccccaagtgagggcggcggggggtcatttcctcggatcaaagccactgggcgtaagattgcccgcgcccttttttag

SEQ ID NO: 32982 - DNA, 441 bp, Artificial Sequence
  Description of Artificial Sequence: Synthetic coding sequence
atgctgcccaggcctcttcgtctgctcctggacacaagcccaccaggtggggtagtgctgtcctcctttcgctctagagatcctgaagaaggcggtggtcctggtggcctagttgtcggtgggggccaggaagaggaagaagaggaggaggaggaggccccagtgagcgtgtgggatgaggaggaggacggggcagtgttcacagtgaccagcagacagtatagaccactcgatcctctggtcccaatgccacctcccagatcctccagaagattgcgggctggaaccctcgaggcactggtgaggcaccttctggatacgcgcacatcaggaaccgacgtgagctttatgagtgccttcttagcaacacatcgtgcatttacaagcactcctgctctgctgggactcatggccgatcgtctggaggccttggagtcttag

SEQ ID NO: 32983 - DNA, 2334 bp, Artificial Sequence
  Description of Artificial Sequence: Synthetic coding sequence
atgctgccccgaccattgcggctgttactcgacaccagtccacccggaggcgtggtgctgagtagttttcggtctcgtgacccagaggaaggtggcggaccaggaggtttggtagtaggagggggccaggaagaagaagaagaagaggaggaggaggcccccgtcagcgtttgggatgaagaagaagatggcgcagtcttcaccgtaacctcaagacaatatcgaccactcgaccctctggttccgatgcctccgcccaggtcctcccggagattgcgggcaggcacactcgaagcactggtgagacatttactggatacgcggaccagtggcacagatgtatcgtttatgtccgcatttcttgccactcaccgtgctttcaccagtaccccagcattgttggggctaatggccgatcggttggaagctctggagtctcatccgactgacgaacttgagcggacaactgaggtggcaatctctgtgctatctacatggttggcaagtcatccagaagatttcggaagcgaggccaagggccaacttgatcggcttgagtcattcctattgcagaccggctacgctgcaggcaaaggcgtgggaggaggcagcgctgacctcattagaaacctgagaagcagggttgatccacaggcacctgacctgccaaaacctctggcccttccgggagaccctcccgccgatcccacagacgtcctcgtctttctggctgatcacctagcagaacagttaactttgcttgatgccgaacttttcctaaacctaataccctcccagtgtctgggcggcctttgggggcacagggatcggcctggccactcccatctctgtccgtcagtacgtgcgacagtgacgcagtttaataaagtcgccggggcagttgtaagttctgtgctcggagcaacgtcaactggcgaaggccccggcgaagttaccattaggcctctcaggcctcctcagcgggccaggttgttagagaagtggattagggtggccgaagaatgtcgcctgcttagaaacttcagttcagtgtatgcagttgtcagtgcgctgcagtcgtcacctatacacaggctccgcgcggcctggggtgaagccacgagggacagcttaagggtgttcagtagcctttgtcaaatcttctccgaagaggataactattcccagtcacgtgaactgctcgtccaggaagtgaagctgcaatcccccctggagccgcactcgaagaaggcacccaggtccggttctaggggcggcggtgttgtgccttacttggggacatttctgaaagacttggtgatgctggacgctgcaagcaaggacgagctggaaaacggatacataaatttcgacaaacgtcgtaaagaatttgcggtgttatctgagctgcgcagactccaaaatgagtgccgcgggtataacctgcagcccgaccacgatatccagcgctggctacaaggactgcgccctctgaccgaagctcagtcacatcgcgttagttgcgaggtcgaaccgcctggaagctccgacccacccgcgccaagggtgcttaggcctacacttgtaatctcacagtggacagaggtgctcggctctgtgggagtgcccacgccgctcgtgtcatgtgaccgcccaagcacaggtggagacgaggctcctactacacctgcaccactactcaccagactcgcccagcacatgaagtggcccagtgtgtcctccctggattcagcgctcgagtctagtcccagtttacacagccccgctgacccctctcacctgagtccaccggccagctcccctagaccaagccggggccaccgccggagcgctagttgcggctcacctctgagcggaggagcagaagaggcttccgggggaaccggttacggcggtgaggggagcggaccgggagccagcgattgtagaataatacgcgtacagatggaacttggagaggatgggtccgtgtataagtccatcctagtcacatcgcaggataaggctccttcggtcatatctcgcgtactcaaaaaaaacaacagggactcagcagttgcatccgagtatgagctcgtgcagttacttccgggagagcgagagctgacaatcccggcaagtgcgaacgtgttttacgccatggatggggccagccatgatttcctgctccgccagagaagacgaagttccacggcaacacctggagtcacatcaggcccgtctgcctccgggacgccaccttctgaaggcgggggcgggtctttcccacgaattaaggccaccggccgcaagattgcacgcgcgttattttag

SEQ ID NO: 32984 - DNA, 2334 bp, Artificial Sequence
  Description of Artificial Sequence: Synthetic coding sequence
atgctgcctcgacctttacgactgctactcgacacctctccccccggcggggtcgtgctcagcagttttcgatcccgggacccagaagagggaggaggcccgggaggcttggtggttggcggcgggcaggaggaggaagaagaagaggaagaagaagccccagtctcagtgtgggatgaggaggaggacggagctgtgttcaccgttaccagccgccagtacagaccgctggatcctctggtgcccatgccccccccccggtcctctcgcagactcagggctgggacactcgaggctcttgttagacatcttctggatacaaggacctccggtaccgacgtgagctttatgagcgcatttctagctactcaccgggcctttacgagtacccctgcgcttttgggcctcatggcggacagactcgaagcactcgagtctcatcctactgacgaactcgagagaacaacggaggtggccatttcggtgctatccacctggctggccagtcaccctgaagactttggatcggaggctaagggccagctcgaccgtctggagtcattcttgttgcagacaggttacgccgccggcaaaggcgtcggcggcggaagcgctgatctgatccgtaacctccgcagtcgggtcgaccctcaggcacccgacctcccgaaacccctggccctgccaggcgaccctcctgcagatccaaccgatgtgctggtgttcctggccgaccacctcgctgagcagttaaccctgctagatgccgaactgtttcttaacttgattccatcgcagtgtttgggtggactttggggacaccgggacagaccaggccacagccacctttgtccgagtgtgcgcgcgaccgtgacgcagttcaataaggtagctggcgccgtggtcagttcagttctcggggccacatctacgggtgagggacccggggaagtcaccattaggcccctgcggcccccccagcgcgcccgactgcttgagaagtggatcagggtagccgaggagtgcaggctgctccgaaactttagctcagtatatgcggtcgtaagcgccctacagtcaagcccgatccaccggctcagggctgcttggggagaagctacgagagattcactgcgagtcttcagctccctatgtcagatttttagcgaagaggataactatagccaatcacgggaactcttggtccaggaagtaaaactacaatccccattggagcctcatagcaaaaaggccccacgctcaggaagtcgcggaggtggtgtcgtgccttaccttggaacatttttgaaagacctcgtcatgcttgacgctgccagtaaagatgaactggagaacggctacatcaactttgataagcgtcggaaggaatttgcagtcctgtccgagctccgtaggctgcaaaacgagtgcagaggctataatttgcaacctgatcacgatattcagagatggcttcaaggcctcagacctctcactgaagcccaatcccaccgggtctcctgcgaggtagaacctccaggttctagcgatccgcccgccccacgcgttttgcgccccacactggttatcagccagtggacagaagtactgggatcagttggcgtgccaaccccactggtgtcatgcgacagaccctccacagggggcgatgaagctcctacaacacccgctccccttctaacccggctcgcccagcacatgaaatggccctccgtgtcatccttggactctgcccttgagtccagccctagtctccactcccccgctgaccccagtcacctgagcccgccggctagctccccaagaccttctagagggcacagacgaagcgcctcatgcggttcgcctctgtcggggggcgctgaggaggcctccggtggcacggggtatggaggtgagggctcgggaccaggggcctcggactgtcgcattattagggtacaaatggagctgggtgaggatgggtcggtgtataagtcgatcctggtgactagtcaggacaaagcgccatccgtgatctcccgcgtgctgaagaaaaacaacagggattcagctgtggcctcggaatacgagctagtgcagctgctgcctggcgagcgggagctgaccatcccggcctctgccaacgtgttctacgcaatggatggcgccagtcatgatttccttttacgccagcggagacgtagcagcacagcaaccccgggagtgacaagcggaccttcagcaagcggtactccccctagcgaaggcggaggcggctctttccctcgcatcaaagcaacaggccggaaaattgcaagagcgttattctag

SEQ ID NO: 32985 - DNA, 1977 bp, Artificial Sequence
  Description of Artificial Sequence: Synthetic coding sequence
atggccgatcgccttgaggcactcgaatctcatccaactgatgaacttgagcgtactaccgaggtcgcaatttcagtgttgagcacctggctggcctctcacccagaagattttgggtctgaggcgaaaggtcagctggacaggttggaaagttttttgttacagactggatatgcggcaggaaaaggcgtggggggaggctcagcagatcttatacgtaatttgcgctccagagtggacccacaggctcctgacctgcctaaaccgctagcactgccaggagacccaccagctgatcctactgacgtgctggtctttctcgccgaccacctggccgaacagctgaccctcctggacgcagagcttttcctcaatctaatcccttcgcagtgtctggggggtctgtggggccaccgcgacaggcctggtcattctcatttgtgtcctagcgtgagagctacagtgacccagttcaacaaggtcgccggcgccgtggtaagctccgttctgggtgcaacaagcactggggaagggcccggcgaggtgaccatcaggcctttgcggcctccccaacgtgcccgtttactggagaagtggattcgcgtggctgaagagtgcaggttactgcggaatttcagtagcgtctatgctgttgtctcagccctgcagagcagtcccatacacaggttgcgcgccgcctggggagaggccacccgggactctctccgggttttttcatctctgtgccaaatctttagcgaagaggacaactatagccaatctagggaactcctagtgcaggaggtgaagctgcagagtccactcgagcctcactctaaaaaggcacctcgatcaggctccagagggggaggagtcgtaccttacctgggcacctttcttaaggacttagtaatgctggatgccgcatccaaagacgagctggaaaatgggtatatcaacttcgacaagcgccggaaagaatttgccgtcttgtccgagctacggaggcttcagaacgagtgccgcggatacaatttgcagccagaccatgatatccagagatggctgcagggactccggcctcttacagaggcacagtcgcaccgggtgtcttgcgaagtggagcctccaggctctagtgacccaccagccccccgggttcttcggccgaccttagtgatatcacagtggacagaagtattaggatccgtcggcgttccaacaccactggtgtcttgcgataggcccagtactggaggtgacgaagcccccactacacctgctcctttgcttaccaggctcgcgcagcatatgaagtggccctctgtgagctctctggactctgccctcgagtcgagcccatcactgcactcacccgccgatccctcccatttatccccccccgcttccagtcccagacccagtcggggccaccgacgcagcgcatcctgcggttcaccactgagtgggggagccgaagaagcctcaggcggaactggatatggaggcgaaggatccggacctggtgcctccgattgtcgtatcatccgcgtccagatggagctgggcgaggatggcagtgtctataagtcaatcctggttacatcacaagataaagccccaagcgtgatctcaagggtccttaagaagaataatagagactccgccgtcgcctccgagtatgagttagtgcagctcctgcctggtgaacgggagctgaccatccctgccagcgccaacgtgttctatgccatggatggagctagtcacgacttccttctcaggggtgaggggcctttgctgctgcacctggcctcgcctgtggcacgactgccgcaggagctgctgcgggtgcgggaggagggagccccttttcccggctctcggccccagggcggacgattgcacggccactgcagcgaggaggaggccccgctcgcttaccgctctcatggggttcatacaagatgcggttag

SEQ ID NO: 32986 - DNA, 441 bp, Artificial Sequence
  Description of Artificial Sequence: Synthetic coding sequence
atgctgccccgacccctgcggttattgttggacacatcaccgccgggaggcgtggtgctgtcgtcttttcggagtcgtgatccagaggaaggggggggtccaggaggcctggtagtgggaggaggccaagaggaggaggaagaggaagaggaagaggcaccagtttctgtatgggacgaagaggaagacggtgccgtctttacagtcacatctcgccagtacaggccactggacccattggttccaatgcctccccctagaagttctcggcgcttgcgagctgggaccctcgaggccctcgtacgtcacctcctggatactcggacctcgggcaccgatgtttcatttatgagcgcttttctcgcaactcatagggcttttacatccacgccagccctgctggggctcatggcggaccgcctggaagccctagagtcttag

SEQ ID NO: 32987 - DNA, 441 bp, Artificial Sequence
  Description of Artificial Sequence: Synthetic coding sequence
atgcttcctcgaccactgcgcctcctgctggacacgtcccccccaggcggcgtcgttctgtcttcgtttaggtctcgtgatcccgaagaaggcggtgggcccggaggcctcgtagttggaggaggacaggaggaggaggaggaagaagaggaggaagctcctgtcagcgtatgggacgaagaagaggatggtgctgtgtttacagtgacttccaggcagtatcggccccttgatcctctggtgcctatgccacccccgcggtcttcacgcaggcttcgggccggcacattggaggctctagtgaggcacctgctggacacgaggacttccggaaccgatgtgtcattcatgtctgcattcctggcaacacacagagccttcactagtacccctgctctgttaggcctcatggctgaccgattagaagctctggagagctag

SEQ ID NO: 32988 - DNA, 1383 bp, Artificial Sequence
  Description of Artificial Sequence: Synthetic coding sequence
atgccacctcctaggagttctagacggttaagggctggaaccctcgaggctttggtgcggcacctacttgatacacggaccagcggcactgacgtgagtttcatgtctgccttcttggccacacaccgggccttcacgtccacaccggccctattggggttgatggccgaccgtttggaggccctcgagagccatcccaccgacgaactggagagaaccacagaggtcgctatttcagtgctcagcacttggctggccagtcacccagaagatttcgggtctgaggctaagggacagctcgatcgcctggagagcttcttattgcagactgggtacgcagctggcaaaggcgtcgggggcggatcagccgatttaattcgcaacctgagatcacgcgtggaccctcaggctccggacctccctaagcctctcgcactccccggggacccacccgcagacccaaccgacgtgctggtcttccttgctgaccacctggccgaacagctgactttactggatgcggagctctttctcaacctcatcccatctcagtgccttggcggcctgtggggccatcgggaccggccgggacactctcatctctgcccgtcagtgagagctacagttactcagtttaacaaggtagccggcgccgtggtgtcttcagtgctgggggcgacgagcactggggaagggcctggagaggtcaccatccggccactgcgtcctccacaacgagctcgcctcctcgaaaagtggatcagggttgctgaggagtgtagactactgcgcaacttctcttcggtgtacgcagtggtgagtgctctccagagcagtcctatccatcgccttcgtgccgcctggggggaagccactagggatagtctacgcgttttcagctcactgtgtcagattttcagtgaagaagacaactattctcagagtcgcgagctgctcgtgcaggaggtgaagttacagtctcccctagaaccacacagtaagaaggctcccaggagcggtagtcgggggggcggagtggtcccctatcttgggactttcctgaaggacctggtgatgttggatgccgctagcaaagacgagcttgagaacgggtatatcaactttgacaaaagacgcaaggtgtccggtgttagtggcctcgatgctggtctcccatatccttgttctaggaaggggcgcggaaaatcccaaggatccctgagttttggctcttgctccctgagggctccttcccaagagtttgccgtgctctcggaactgcgacggttgcagaatgagtgccgaggatacaatctccagcctgatcatgacatccaacgctggttgcagggcctaagacctttaacagaggcccagcgatag

SEQ ID NO: 32989 - DNA, 441 bp, Artificial Sequence
  Description of Artificial Sequence: Synthetic coding sequence
atgctgccgcgtcccctgaggttattgctggacacgagtccccccgggggagtggttctttcgagcttcaggagtcgcgaccctgaggaagggggcggacccgggggactggtggtgggcggtgggcaagaagaggaggaggaggaagaagaagaggccccagttagtgtctgggatgaagaggaagatggcgccgtgttcaccgtaacgtccaggcagtaccgaccacttgatccgctcgtgccaatgcctccccctcggtcctcccggagactgcgggcgggaacattggaagctcttgtgcggcatttgctcgacacaaggacatctggcactgacgtgtctttcatgtccgcttttctggcaactcatagggcttttactagtacccccgctctactaggtctcatggctgacagacttgaggctctggagtcctag

SEQ ID NO: 32990 - DNA, 2334 bp, Artificial Sequence
  Description of Artificial Sequence: Synthetic coding sequence
atgctcccaaggccgctgagactgctcctcgacacatcccctccaggtggcgtagttctctcaagtttccggtcaagggatcccgaagaaggaggaggaccgggaggcctcgtcgtgggcggagggcaggaagaggaagaggaggaggaggaggaggccccagttagcgtgtgggacgaagaagaagatggagctgtgttcaccgtgacatctagacagtacaggcccttggatcccttggtgccaatgccgccccctagaagctctaggcggcttcgggcggggaccttggaggccctcgtgcgtcacctgctcgatacgcgcactagcggtaccgacgtctcattcatgagcgcatttctcgctacccacagagcattcacctcaaccccagccctgctcggactcatggcagacaggctcgaggccctcgagagccatccgacggacgagctcgagagaacaactgaagtggccatttccgtgttgtcaacatggttggcctctcacccagaagacttcgggtccgaggctaaagggcagctagatcggctcgagtcttttctgttacagactggttacgctgcgggaaagggcgttggtggaggcagcgccgatctgattaggaacttgcggtccagagtggatccacaagcccccgacttaccgaaacctctcgccttgcccggagaccctcctgctgaccctacagatgtgttggtgtttcttgccgatcacctcgccgagcagctgactctgctggatgcggaactctttctcaacctcatccccagtcagtgccttggcgggctttggggccatcgcgatcgccccgggcactctcatctgtgcccctcggtgcgtgcgaccgtaactcagtttaataaagtcgccggcgctgtcgtctcatccgtcctcggcgcaacaagtacaggtgaaggacccggagaggtgaccatcaggcctctccggcctccccagcgcgctaggttgctggagaaatggatcagggtcgcagaggaatgtagactactcagaaacttctccagcgtgtacgctgttgtgtcagccctgcagtcctcgcccatccatcggctcagggcagcctggggagaggccacacgcgactcactgcgtgttttctcctctttgtgccagatctttagcgaggaagacaattacagccagtctcgggaactactcgttcaggaggtgaagctgcaaagtcctcttgagcctcattctaagaaggcacctcggtccggaagccggggcgggggagtggttccttatcttggtacattcctgaaggaccttgtcatgctggacgccgcatcaaaggatgaactggagaacggatacattaactttgataaacgccgtaaggagtttgccgtgctgtccgagctaaggcggctccaaaacgagtgtcgcggctataacctccagcccgaccacgacatccaaaggtggttgcagggcctaaggccactcaccgaggctcagtcacaccgcgtgagctgtgaggtggagcccccaggatcttctgacccaccagctccacgagtccttcgacctaccctggtgatatcccagtggacagaggtactgggatcggtgggggtcccgacccctctcgtttcttgtgacagaccgtctacgggtggggacgaagcacctacgacaccggcccctctgctgacccggctggcccagcacatgaagtggccgtccgtgtcttcgctagactccgcactggagtccagcccttctctgcattcacccgccgatcctagccacttgtcgcccccagcgtcgagtcccaggccatccagaggacacagaaggagcgcaagttgtgggtctccactctccggaggagccgaagaagcctccggtgggactgggtacggtggagaggggtctggccctggggcaagcgattgtcgaattattcgggtgcagatggagcttggcgaagatggttccgtgtacaagtccattttggtgacatctcaggataaggcgccatcagttatatcccgggtcttgaagaaaaataaccgggactccgctgtggcgagcgaatatgagctagtccagctgctccctggtgagcgtgaattgaccatcccagccagtgccaacgtgttctacgctatggacggcgcgtcacatgattttctcctcagacaaagaaggcgatcttccaccgccactccgggggtcactagtggtccttcagcttctggcacaccgccatctgaaggaggcgggggatctttcccgcggataaaagccaccggtcgtaagatcgcaagagcactcttctag

SEQ ID NO: 32991 - DNA, 441 bp, Artificial Sequence
  Description of Artificial Sequence: Synthetic coding sequence
atgctgcccaggccactccgcctgttgctcgacacctctccccctgggggagtggtgctcagttcgttccggtctcgcgacccagaggagggcggcggccctggaggcctcgtggtcggtggcggacaggaagaggaggaagaggaggaagaggaggccccggtcagcgtctgggatgaggaagaagatggcgcagttttcaccgtcacctctaggcagtatcgtcccttagatccgctcgtgccgatgcctccaccccgctcctcaaggcgcctgcgtgccggaacgcttgaggctttggtacgtcaccttctcgatacaaggacttccgggacggatgtttccttcatgtccgcctttttagctacacacagggctttcacgagtacccccgcactcttggggctgatggcagaccgtttggaggctctggagtcatag

SEQ ID NO: 32992 - DNA, 2334 bp, Artificial Sequence
  Description of Artificial Sequence: Synthetic coding sequence
atgttgccaagaccactccggctcctcctcgatacctctccccctggtggagtggtgctcagctcttttcggtcaagggaccctgaggaaggcggtgggcccggcggcctggtggtcgggggaggacaagaggaggaagaggaagaagaggaggaggcacctgttagcgtctgggatgaagaagaggacggcgccgtctttaccgtcacaagccgacagtataggccccttgaccctctagtccctatgccacccccacgcagctctagaagactcagggccggcacactcgaagcccttgtccgccatcttctggacacaaggacctccggtaccgacgtcagtttcatgagcgcatttcttgcaacacatagggccttcacaagcacacctgctttactgggcctgatggctgatcggctggaagcgctggaaagccatccaactgacgagcttgaacggacgaccgaagtggcaatttccgtgctgtcaacatggctggctagccaccccgaggattttggaagtgaagcaaaggggcagctggaccgactggagtctttcctcctgcagacaggttatgccgcaggcaagggcgtcggcggcggctctgctgatcttatcagaaatctccgcagtcgcgtggatcctcaggcgcctgatttgccaaaacccctagcactgcccggagaccctcctgcagatccaacagacgtcttggtgttcctggcagaccacctagccgaacagctgaccttactggatgccgaattgtttctgaacctgatacctagccagtgcctcgggggtctgtggggtcaccgagaccgtccaggtcactcccatctttgtccatcagttagggcaaccgtgacccaattcaataaagtggcgggggccgtggtatccagcgtcctcggagccacctccactggggagggaccaggtgaagtcacaatacgacccctacggccaccgcaaagggctagattactggaaaagtggattagggtggctgaggaatgccggcttctgaggaatttctcctccgtgtacgcggttgtctctgctctccagagttccccgatccaccggttgcgcgctgcctggggagaggccacccgcgatagcttacgggttttttcctccctgtgtcaaatattttcggaggaggataactacagccaaagtagagaactgcttgtccaggaagtgaagctgcagtcgcctctggaaccacacagcaaaaaagcccctcgatccggatctagggggggtggcgtggtgccttatttaggtacctttcttaaagacctagtaatgctggacgctgctagcaaggatgaactggagaacgggtacattaatttcgataaacgccggaaggagttcgctgttctgtctgaactccggcgcttgcagaatgaatgcaggggatataacctgcaaccagatcacgacatccaaaggtggctgcagggtctccggcctttgacagaagcacaatcgcacagggtgtcttgtgaggttgagcctcccggaagctctgatcctcctgcacccagggttctgaggcctaccctggttatctcacaatggaccgaagtgttgggctcagtcggagtgccgacccccttggtgtcttgtgaccgcccatctactgggggcgacgaagcaccaactaccccagcccccctccttacacgcctggctcagcacatgaagtggccatctgtgagttccttagattctgctcttgagagcagcccttcccttcatagcccggccgaccccagccacctcagtcccccagcctcttcaccccggccatcacgggggcaccggagatccgcaagctgcggatccccactatctgggggggcagaggaggcgagtggagggaccggctacggcggagaggggtcgggtcccggagcttctgactgtaggataatacgggtgcaaatggaattgggtgaagacggctctgtgtacaagtccatactagtgacttcacaggataaagctccgtctgtcatttcccgagtcctgaaaaagaataatcgggattccgccgtggcctctgaatacgaattagtccaactcctgccaggcgagcgggaattgacaatccctgcaagcgcgaatgtcttctatgctatggatggagctagtcatgatttcttactgcgtcagcgcaggagatctagcacagctaccccgggcgtgacctccggaccctcagcgtcaggcacgccacctagcgaaggggggggtggctcattccctaggatcaaggctacgggacggaaaattgcgagggccctgttttag

SEQ ID NO: 32993 - DNA, 1383 bp, Artificial Sequence
  Description of Artificial Sequence: Synthetic coding sequence
atgccgccgcctaggtcatccaggcggctccgagctgggacgctggaagccctggtaaggcacctgctcgacacacgcacaagcgggaccgatgtgtcttttatgagcgcattcctcgccacacacagagcattcacatctacacccgcgcttctgggcctgatggcggaccgcttagaggccctggagagccacccgacagacgaactggagcgcacgacagaagttgctatcagcgttctgtctacctggctagcttcacaccccgaagattttggctccgaagccaaggggcagctcgatcggctcgaaagttttctcctgcagacaggctacgcagcaggcaagggggtaggagggggttcggctgatttgattcgaaaccttcgctctcgggttgacccgcaagcccctgatctgccaaagcccctcgctttgcccggggatccacctgctgaccccaccgacgtgctggttttcttggccgaccatttggcggagcagctgacattattggacgcagagttatttctgaacttaatcccatcacagtgcctaggcggactgtggggccatcgggatcggcccggacatagccatttatgtccaagtgtacgtgcaactgtgactcagtttaataaggttgccggcgccgtggtgtctagtgtgctcggagccacatctactggagaaggtcctggggaagtgacaattcggcctcttaggcccccacagcgcgcccggctgttggagaagtggattagagtggcggaggagtgccggctattgagaaattttagcagcgtatatgctgtggtatctgcacttcagtcctctcccatccacaggctcagggctgcatggggcgaagccaccagggattcactaagagtgttttcaagtctatgccagattttttcagaggaagataactatagccagtcgcgagaactgctggtgcaggaggttaaattgcagagcccactcgagccacatagcaagaaagcaccaaggagtgggtctaggggagggggggtggtcccctacttggggaccttccttaaggatctagtaatgctggatgctgcatcaaaggatgaactggaaaacggttacattaatttcgacaagcgaaggaaagtgagcggagtgtccggactcgatgccggcctgccctatccttgctcccggaaggggcggggaaaatcccaggggagcttgagtttcggcagctgctcattaagagccccctcccaggaatttgcagtcctgtctgagctacgccgtttacagaatgagtgtcgcggatataacctgcagcccgatcatgacatccagcgatggctgcaagggctgcgccctcttaccgaggctcagcggtag

SEQ ID NO: 32994 - DNA, 1977 bp, Artificial Sequence
  Description of Artificial Sequence: Synthetic coding sequence
atggccgaccggcttgaggcactggagtcacacccgacagacgagctggaacggacaaccgaggtagcaatcagcgtgctgagcacttggctcgcttcccacccagaagactttggatctgaggctaaaggacagttggaccgtttggagagctttctgcttcaaaccggttatgctgctggcaaaggtgtgggcggaggatcagctgacctgatccgcaacttgcggagcagagtcgacccacaagcccctgacttacccaagccgctggccctcccaggagatcccccggccgatcctactgacgttctggtgtttctggccgaccatctcgccgagcaactgacactgcttgacgctgaactctttttaaatctgatcccatcccagtgcctgggggggctgtggggtcatcgcgatcggcccggccattcacacctgtgcccgagcgtaagagccactgtcactcagttcaataaagtagcaggcgcggtggtgtcatccgtcttaggcgctaccagcaccggcgagggaccaggcgaagtgacaataaggccactgcgccctcctcagcgtgcacggctactggagaagtggatccgggtggcggaggagtgcaggctcttgagaaatttttcctcagtatacgcagtggtcagcgcgctccagagtagtccaatacacaggttgcgcgcagcctggggcgaggccactagagattcgctccgggtattcagctccctctgccagatttttagcgaggaggacaattacagccagagccgggaactgctggtccaagaagtaaagcttcagagcccactggaaccacattccaagaaggctcctagatctggaagtcgtgggggcggagtcgtgccgtatctagggaccttcctgaaagacctggtaatgcttgacgccgcaagcaaggacgaattggaaaacggttatattaacttcgacaaaagaaggaaagaattcgcagtgcttagcgaactgcgccgcctccagaacgagtgtcgtgggtacaacttgcagcccgaccacgacattcagcgctggttgcagggccttcgccctctcacagaagcgcagtcacacagggtctcctgtgaagtcgagcctcctggatcaagcgacccgcctgccccgcgagtgctccgtccaacactggtaatctctcagtggaccgaggtccttggctctgttggtgtgccaaccccccttgtgagctgcgaccggccatccactggcggcgatgaggccccaactaccccggccccgctgttgacaaggctggctcagcatatgaaatggccttctgtctcctcgttggatagtgcactcgaatctagcccgagcttgcactcccccgccgacccctctcacctgtctccccccgcgagctcaccacgaccctcgcgcgggcataggcgtagcgcaagttgcggcagccccctctccggtggcgccgaagaggcctctgggggcaccggctacggtggcgaggggagcggcccaggcgcctccgattgccggataataagagtgcagatggagctgggggaagatgggagtgtctataagtctatcctggtgactagtcaggacaaagctccctccgttatatcaagggttctaaagaaaaataatcgagactccgcagttgcttccgagtacgaactggttcagttgctgcctggggaaagggagctcacaattcccgcctcggccaatgtgttttacgccatggacggcgcgtcccacgatttccttctccgcggagaagggcctctcctcctccacctggcctcgccagtcgctaggcttcctcaggaactgctcagggtccgggaagagggggctccttttcccggatctcgccctcagggcggccgcttgcacggacattgctcggaggaagaagcccctcttgcttacagaagccacggtgttcatacccgctgcggctag

SEQ ID NO: 32995 - DNA, 1977 bp, Artificial Sequence
  Description of Artificial Sequence: Synthetic coding sequence
atggccgaccggttggaggccctcgaaagccaccctactgacgagcttgagcgcactaccgaggtggccatttccgtgctctctacatggctggccagccacccagaggacttcggctctgaggctaaggggcagctcgataggctagagagcttcctgctgcagaccggatatgccgccggcaaaggcgttggtggcggatccgcagatctcatccgcaacctcagatcacgggtggaccctcaagctcctgatctcccgaaacctttggcgttgcctggcgatccccccgcagacccaacggacgtcctggtgttccttgctgaccacttagccgaacagctgacactgcttgacgctgaactttttcttaatcttattccttcacaatgcttgggcggcttgtggggtcatagggaccggccagggcactcgcacttatgtcccagtgtgcgggccactgtaacccagtttaataaggtggcaggcgcagtggtttcaagcgtgctcggagcaacttccacaggtgaagggccaggggaggtaacaattcgccccctccgcccgccacagagggccagactgctagagaagtggatccgcgtggcagaggaatgtcgactgctgcgaaacttttcctccgtgtacgctgtggtttctgctctgcagtccagccccatccataggctccgcgctgcctggggagaagccacaagggattcactaagagtcttttcctctctctgccagattttttcggaggaagataactattcacaatctagagaactgctcgttcaggaggtcaaactgcagtcccccttagaacctcactctaaaaaggccccacggtctggctcccgaggcggcggcgttgttccatatctgggcacattcctcaaagatctggtcatgcttgatgctgcaagcaaggacgagctggagaatggctatatcaacttcgacaaacgcaggaaggagttcgcggtgctgagtgagttgaggcggctccagaacgagtgccggggctataatctacagcctgaccatgatatccagagatggctacagggcctccgccctctaaccgaggcccaaagccatcgagtgtcttgtgaggtcgaaccacccggctcttctgatcctcctgctccgcgtgttcttaggccaacactcgtcatttcccaatggactgaggtactgggcagtgtgggggtgcccactccgctcgtctcctgcgataggccatctactggtggggacgaggcccccaccaccccagcacccttactaacaaggttagcacaacatatgaagtggccctcagtttcctcgctggatagtgccctcgagagcagtccctccctacactcccccgccgatccatctcatctttcccccccggcctcgtcccctcgcccatccaggggccaccgacgttccgctagttgtggaagtcctctgtcaggcggtgcagaggaggcaagcggcgggacaggttacggtggtgagggaagcgggccaggcgcatccgactgtcgcataatacgagtgcaaatggaactgggggaggacgggagtgtctataagagtattctggtaacatcacaggacaaagcacccagtgttatttctagggtgctaaaaaagaacaacagggactccgccgttgcttctgagtacgagcttgtgcagctgcttcctggtgaaagagagctgacaattcctgctagcgccaatgtcttttatgcgatggacggcgcctctcacgatttcctcttacgcggagaagggccgctcctgttacatctggcctctcccgttgcccgtctgccccaggaacttctgcgcgtgcgggaagagggcgcacccttccccgggtctaggccacaagggggcagactccatggacactgtagcgaggaggaggcccctcttgcttaccgttcccacggggttcatactcgttgcgggtag

SEQ ID NO: 32996 - DNA, 1977 bp, Artificial Sequence
  Description of Artificial Sequence: Synthetic coding sequence
atggccgaccgcttagaggcattagagtcccatcctactgacgaactggagagaactacagaggtggccatatctgtgctgtctacgtggttggcctcacacccagaagacttcggctccgaagccaaggggcaactagataggctggagtcgttccttctccagacaggctatgcggccggaaaaggcgtcggggggggcagcgcagacctaattcgtaatctgaggtctcgggtggaccctcaagctcctgacctgcccaaacccttagccctacctggtgacccccctgccgatccaaccgacgtgctggtgtttcttgctgatcatctggccgaacagctcactcttcttgacgcagaattgtttctgaaccttatcccgagccagtgtctggggggtttgtgggggcacagggatagacctggccattctcacctttgccccagtgtgagggcaacggtgacgcagtttaacaaggtggccggtgcagtggtctcctcagtgctgggggccacttccacaggggaggggccgggcgaggtaacaataaggccgctccgccctccccagcgcgcgagacttttagaaaagtggatacgagtggctgaggagtgccgactgctgaggaactttagcagcgtctacgcggttgtaagtgccttgcagtcatctcctattcacaggttgcgagcagcatggggggaggcaactcgtgactcactgcgcgtctttagtagtctgtgccagatctttagcgaagaagacaattactcccagagccgcgaacttctggtgcaagaagttaaactccagagcccactggaaccacatagcaagaaggcccctaggagcggaagcaggggcggcggagtcgtcccttacctggggacatttctgaaggatctcgtgatgctggacgccgcctccaaagatgagctagagaatggctacatcaactttgacaagagaagaaaggaattcgctgtcctatcagagcttcgccgcttgcagaacgagtgtagaggatacaacttgcaaccagatcacgacattcagaggtggttacagggtttgagacctctgaccgaggcccagtctcatcgggtgagttgcgaggttgagccccctgggtcttcagaccctcctgccccgcgtgtgcttaggcccactctcgtcatttcccagtggaccgaagtgctcggtagtgtcggtgtgcctacacctcttgttagctgcgatcgcccttctacggggggggacgaggcaccgaccacgccagccccattgctgacaaggttggcccaacatatgaaatggcctagcgtttcctcattggactcagccttggagagtagcccctccttgcacagcccggccgacccaagccacctttccccccctgcgagtagccccaggccgagcagagggcatagaaggtctgccagttgcggttcccccctgtctggaggcgccgaggaggcctcggggggcaccggttacggcggggagggaagtgggccaggcgcctcggactgccgtattattcgggtccagatggagctcggagaagacgggagcgtctacaaatcaattttggttacctcccaggataaggctccctctgtgatcagtcgtgtgttgaaaaaaaacaacagagatagcgccgtcgctagtgagtatgagctggtccagctactgcctggggagagagagttaaccattcccgcgtctgccaacgtgttctacgctatggacggcgcttcccatgactttctgttgcgtggcgaagggccactgctgctccacctggccagtcccgtggcgagacttccacaggagctactgcgtgtccgagaggaaggggccccattccccggctcccgtcctcagggtggacggctccatggtcactgttctgaggaggaggctccactagcgtataggtcacacggagtgcacactagatgcgggtag

SEQ ID NO: 32997 - DNA, 1977 bp, Artificial Sequence
  Description of Artificial Sequence: Synthetic coding sequence
atggcagacagacttgaggcgctggaatctcatccaacggatgagctggagcggactaccgaagtggctatcagcgtcctttcaacttggctggccagtcatcctgaggactttggatccgaagctaaggggcagttggatagactggagagcttcctcctccaaactggatatgcggcggggaagggggtaggcggcggctccgcagacctgatccggaacctccgctctagagttgaccctcaggccccggacctgcccaaacctctggctctgccaggcgacccgcctgccgacccaaccgacgtgctggtgtttttggccgatcatctcgccgagcagttgacgctgcttgacgcagaactctttctgaacttgatcccaagtcagtgcctgggaggattgtggggccatcgagaccggcccggccattcccatctgtgtccttcggtgagggctacagtgacacaatttaataaagttgccggtgccgtcgtgtcatccgtgcttggggcaacatccacaggggagggcccaggggaagtgaccattcggcctttgcgtccaccccagagggccaggttactcgagaaatggataagggtggccgaggagtgccggttactgcgcaacttcagtagtgtctacgcggttgtatcagccttgcagtcttcccctatccaccgccttcgagccgcctggggggaagccacccgggacagcttgagggtgttttccagcctgtgtcagatttttagcgaagaggacaactactctcaaagccgggagttattggtgcaggaggtcaagctccagagtcctcttgagccccactccaagaaagccccgagaagcggctcaagggggggcggagtcgtaccatacctggggactttcttgaaggacctcgttatgttggacgctgcttcaaaggatgagcttgaaaacggatatattaactttgataagaggagaaaagagttcgccgtgctcagcgagctgcggcgattgcagaatgaatgtcgcggatacaatctccagcccgaccatgacattcagcggtggcttcaaggcctaagacccctcacagaggcccagtcccaccgggtttcttgcgaagtggaaccccctgggagttcagacccgcccgctcctagagtgttgcgtcccaccttggtcattagccaatggactgaggtgctggggtctgtcggagtgcccacccctctagtttcatgtgaccggcccagtactgggggtgacgaagctcctacaacacctgcccctctgctcacgcgcctggcacaacatatgaaatggccttctgtatcttccctggatagcgctctggaatcctctccatctctgcacagcccggcggatccgtcacacctgtctccacctgcctcatctccacggccctccagaggccatagaaggtcagcctcctgtggcagcccactgagcgggggagccgaggaggctagtggtggcacaggttatggtggtgaagggagtggccccggagcttctgattgccggatcatacgtgtccagatggaattaggagaagatggctctgtctacaaaagtattctggtcacaagtcaagacaaggccccttcggttattagtagggtactgaaaaagaataatcgtgacagtgcggttgccagcgaatatgagctggtccagcttttaccaggggaaagagagctgaccattccagcttcagcgaacgtcttttacgcaatggacggagcaagtcacgactttttactgcggggagaggggcctttactgctccaccttgcctctcctgtggctcgcctcccccaggaactgctaagagtgcgtgaagagggagcaccattccctggcagccggcctcagggaggacgcctgcacggtcattgcagcgaggaggaagcgccactggcataccggtcccatggcgtgcacacccggtgtggttag

SEQ ID NO: 32998 - DNA, 1383 bp, Artificial Sequence
  Description of Artificial Sequence: Synthetic coding sequence
atgccaccgcctaggagctctcgccgtctgcgggcaggtacgctggaagccctcgtaaggcatctattggatacaaggacttccggcaccgatgtatctttcatgtccgcctttcttgccactcaccgggcctttaccagcacccccgcactacttgggctcatggcggacaggctggaggccctggagtcccaccctacggatgaactggagagaactaccgaagtggcaattagtgtgctgtcaacctggttagcgtcccaccccgaggatttcgggagcgaagcgaaagggcagcttgatcgattagagagtttcctgctgcaaacaggctacgccgctggaaagggagtggggggaggcagcgcggaccttatccggaatctgaggagccgtgtagacccacaagccccagacctcccaaaaccgttagcactacctggtgatcccccggccgatcctaccgacgtgcttgtttttctcgctgaccacctggccgagcagctgaccctcctggacgcagaactctttctgaatctgatcccctcccagtgcctcggcggcctgtggggacaccgggaccggcctggtcattcccatttgtgccccagtgtgagggccacagtaacccagttcaataaagttgcaggtgcagtagtgtcatccgtactgggggccacctctactggtgagggccctggagaagtgactatccggccactgcggcccccccaaagggctaggctactcgagaaatggatacgggtagccgaagagtgtcgcctgttacgcaattttagctcagtctacgccgtagtgagcgccttacagagctcccccatacacagacttcgtgctgcctggggtgaagcaacacgggactccctgcgcgtgtttagttctctgtgtcagatttttagcgaggaagacaattactcccagagtcgggagctactggttcaggaggttaaactgcagtccccacttgagccgcacagtaagaaagccccacgttctggctcgcgtgggggtggagttgttccctaccttggcacgtttctcaaagatttggttatgttggatgcagcgagcaaagatgagcttgagaacggctacattaacttcgataagagacgcaaggtgtcaggagtgagcggtttggacgcggggttgccttacccgtgttcaagaaaggggcgggggaaatcccagggaagtctgtcattcggttcgtgttcactgagggccccatcacaagagttcgccgtgctctctgaactgcgcaggctgcagaatgagtgcagaggatataaccttcagcccgaccacgatatacagaggtggctgcagggtctgcggcctctcactgaggcccaacggtag

SEQ ID NO: 32999 - DNA, 1383 bp, Artificial Sequence
  Description of Artificial Sequence: Synthetic coding sequence
atgcctccgccccgcagcagcaggagactcagggccggcactctggaagctcttgttcggcatctgctggatacccgcacctccgggactgatgtgagcttcatgtccgcttttctagctactcaccgggcgtttaccagcactcccgctctgttaggactgatggccgacaggctggaggccttggagtcccatcctaccgatgagcttgaaaggacaactgaggtggcaataagcgtgctatcaacctggctggccagccacccagaagactttggctccgaggcaaagggccagttggaccgattggaatcctttctactccagacagggtacgctgcaggcaaaggggtgggaggtggttccgcagaccttattcggaaccttaggtcacgtgtcgacccccaggcccccgacctaccaaaaccactggctctaccgggcgatcctcctgccgatcccaccgatgtgttggtgtttctagccgatcatctggccgagcagctcacgctgcttgacgcagagttgttcttgaatctgattcctagccagtgtctcggcgggctttgggggcaccgcgatagacctggacacagccacctgtgccccagcgtacgcgctacagtgacacagtttaataaggttgcgggtgcggtggtatcgagtgtgctcggggccacttctaccggggaaggcccgggggaagttactattcgccccctgagaccgccccaacgggcacggctgctggagaagtggattagggtggccgaagagtgtcgccttttaaggaacttttcaagcgtctatgctgtggtatctgccttgcagtcttctcccatccatcgcctgcgggcagcatggggggaggccaccagagactctttgcgtgtgtttagttcgctgtgccagattttctccgaggaagacaattatagccagagcagagaattgctggtgcaggaagtcaagctgcagagcccactggaaccacactctaagaaggcgccccgctctgggagcaggggcggaggtgtcgtcccttacctcgggacctttcttaaggatctggtgatgttggacgccgcaagcaaagacgagctcgagaacggctacatcaattttgataaacggaggaaggtcagcggggtatcaggtctcgatgctgggttgccatatccttgctccaggaagggccgcggcaagtcccaagggtcattatcgttcggaagttgctcactcagggccccctcccaggaattcgctgtcctgagtgagctgagacggctccagaatgagtgtagaggatataatctgcaacctgaccacgacattcaaagatggctgcaaggcttacgccctctgactgaagcacagcgttag

SEQ ID NO: 33000 - DNA, 1383 bp, Artificial Sequence
  Description of Artificial Sequence: Synthetic coding sequence
atgcccccacctaggagcagtcgccgactgcgcgccggcacactggaggcattggtccgacatctcttagacacccggaccagcggaacagacgttagttttatgtccgcctttctggcgactcatcgcgccttcaccagcacccctgcactcctcgggctgatggccgacaggcttgaagcacttgagagtcatccaacagacgagctggaacgaacaacagaggtcgccatctccgtcctgagcacttggctggccagtcatcctgaggactttgggagcgaggctaagggccaactcgacagactggagtcgtttctgctacaaactgggtatgctgccggaaagggggttggtggtggttcagccgatctgattcgaaatctgaggtcaagagttgatccacaagcccctgatctgcccaagcccctcgcgttgcccggggatccccccgctgatcctaccgatgtgctggttttccttgccgaccaccttgctgagcagctgactctcctcgatgcggaactgtttctcaatcttatccctagccagtgcctgggtggactgtggggccatagggaccgacccggacactcgcacctctgtcccagtgtgagagccacagtgactcagttcaataaagtggccggtgcggttgtgagtagcgtactgggggccacatcgaccggggaggggccaggtgaagtcacgatcaggccactcaggccaccccagcgcgcgcgtttgctggaaaaatggattcgggtggcggaagaatgtaggctcctgcggaatttttcctccgtgtacgccgttgtgagtgcactacagtccagcccaatccacagactccgggccgcctggggtgaggccacaagggattctttgagagtgttctcgagcctgtgtcagattttcagtgaggaagataactactcccagtcacgggaactgttagtgcaggaggtgaaactgcagtccccactggaaccccactctaagaaagctcctcgttcaggctcgcgcgggggaggagtagtgccctatctgggcacgtttttgaaagacttggtcatgctcgatgccgctagcaaagacgagttggagaatggctatattaattttgataaacgacggaaagtctcgggagtgtcgggattagacgctgggttaccctacccatgctcacgaaaggggcgcggtaaaagccaggggtccctgagcttcggctcctgttcgctcagagccccaagccaggaatttgcagttctctccgaactgcgccggctgcaaaatgaatgtcgcggttacaatctgcagccagaccacgacattcagcgctggcttcaaggccttaggccccttaccgaagcacagcgctag

SEQ ID NO: 33001 - DNA, 1494 bp, Artificial Sequence
  Description of Artificial Sequence: Synthetic coding sequence
gcacgcgctggaaggggggctgcctctggcccaccacgtgtggctcagacatccgacccagatagttccgaagcctgtgccgaggaagaggaaggactgatgccacaaggcccccagcttctggatttctctgttgatgaggtcgccgagcagctgacgctgatcgatcttgagttgttcagcaaggtgcgattatacgaatgcttgggcagtgtgtggagtcaaagagataggcccggcgccgcgggggctagccccacagtgcgggcaaccgtagcgcagttcaacacagtgaccggttgtgtgctgggatcagtcctgggggcacctggcctggcagcccctcagagggcccagaggttagaaaagtggattaggatcgctcagcggtgtagggaattacgcaacttctcctcactgagagcaattcttagcgctctgcagtctaacccgatatatcgactgaaacgatcgtggggcgccgtctccagagaacccctaagtacgtttcgaaagctctctcagattttcagcgatgaaaacaaccatctctctagtcgagagattctttttcaggaagaggcgaccgaaggatcgcaagaagaggacaacacccccgggtccctcccaagtaagcctcctcccggtccagtcccatatctgggtacctttctgacagacctcgttatgctggatacagctcttcctgacatgttagaaggcgacctgatcaacttcgagaagcgccgcaaagaatgggagatcctcgcccgcatacaacaactgcagcgacggtgtcaatcttataccttatccccacaccctcctatcttagcggctctccacgcccagaaccaactgactgaggaacaatcataccgcctcagcagggttatagaaccccctgccgcctcgtgcccctcttcccccaggattcggaggaggatttctctaaccaaacgtctgtctgcaaaattggctagagaaaaatcttcatcaccttcaggaagcccaggtgacccatcttcaccaaccagtagtgtaagtcccggctcgcccccctcgagtccgcggtctagagacgcccctgctggatcccctccagcctctccgggtccacagggaccgtcaacaaaactccccttgtcacttgatctcccttccccacggccattcgcccttcccctgggtagccccaggattccccttccagcacaacagtccagcgaagcccgggtgattcgtgtctctattgacaatgaccacgggaacctgtataggagcatactattaacgtcccaggataaagctccttcagtggtgcgaagagcgttgcagaaacataacgtcccgcaaccctgggcttgcgattatcagctgtttcaagtgctaccaggggatagagggtgggaagaaatgcttatcagcgccattaagtcagtgggcactttctttggaatgtttgccatgtgccaggccagattctaccggtag

SEQ ID NO: 33002 - DNA, 2133 bp, Artificial Sequence
  Description of Artificial Sequence: Synthetic coding sequence
atggagaggacggctggaaaggagttggccctagcccctctccaggactggggagaggaaaccgaggatggggctgtctacagtgtctccttacgccgtcagagatcgcagcgccgcagtccagctgaaggtccgggtgggtctcaggctccaagccctatcgctaacacgtttctccactatcgtacttctaaagtccgggtcctcagagcagcgcgcctcgagaggttggtgggagaactcgtgtttggggatcgtgagcaggacccctcttttatgccagcttttctggctacatatcggacctttgtgcctaccgcttgccttttagggtttcttttacctcccatgccccctcctccgcccccaggcgttgaaatcaaaaagaccgctgttcaagacctgtccttcaataagaacctacgtgcagtggtgtccgtactgggtagctggctgcaggatcaccctcaggatttccgcgaccctccagcacacagcgacctgggttccgttaggacattcctgggctgggctgcgcccggctctgcagaggcccagaaagctgagaaattactggaggacttcctcgaggaggccgaacgggagcaggaagaggaacccccacaagtgtggactgggcccccccgagtggcacagaccagcgaccctgatagctccgaggcatgcgccgaggaggaggagggcttgatgccacaggggcctcagttactggatttctccgtggatgaggtggccgagcagttaacactcatcgacctggagctgtttagcaaagtgcgcctgtatgagtgtctgggtagtgtctggagtcagcgcgacaggccaggagccgcaggcgcaagtcccactgtaagagccacagtcgcccaattcaatactgtgacaggctgcgtgttaggctctgtccttggcgcccctggccttgccgcaccgcaaagagcccagaggttagagaagtggatccggattgctcagcgctgccgagagctgcgtaacttttcaagcctgagagccatattgagcgccctccaaagtaatcctatttataggctgaagcggtcctggggggctgtgagccgagaacccctttccaccttcaggaaacttagccaaatttttagtgacgagaataaccacctcagcagcagggagattctatttcaagaggaggcaaccgagggtagccaagaagaagacaacacccctggcagccttccctcaaagccccctcccgggcctgtcccctatctgggaacatttctaacagacctggtgatgctggacacagcgctacccgacatgctagaaggggatctgatcaatttcgaaaaacggcggaaagagtgggaaatcttagccagaatccagcaacttcaacgccgttgccaaagctacaccctgtccccccacccgcccatcctcgccgcactgcatgcccagaaccagctgaccgaagagcagtcatatcgcttatcgagggtgatcgaacctccagctgcctcttgccccagttcacctcgaattagacgaaggatctcactgaccaaacgtctatccgccaaactggctcgtgaaaagtcatctagtccctcaggatctccgggggatcctagcagtcctactagctcagtctctcctggctcgcctccttcctcccctagaagcagagacgctccggctggtagcccaccggccagcccaggacctcaagggccctccactaaactgcccctgtctcttgatctgccatcaccgcggcctttcgcgctacccctgggatctccccggattcccctccctgcccagcagtcctctgaggccagggttattagagtttccattgacaacgaccatggtaatttgtatcggtccattctgctcacatctcaggataaagccccctcagtagtgcgtcgtgctctgcagaagcacaacgtacctcagccatgggcctgcgactaccaactgtttcaggtgctccccggagatagagtactgttgattcccgataacgccaatgtcttttatgccatgagccctgtggcacccagagactttatgctgaggcgcaaggaaggaacaagaaataccctgtctgtcagcccttcttag

SEQ ID NO: 33003 - DNA, 2151 bp, Artificial Sequence
  Description of Artificial Sequence: Synthetic coding sequence
atggagaggacagcgggcaaagaattggctctcgcaccactccaggattggggcgaggaaaccgaggacggggcggtgtactcggtctctttaagaaggcagcggagccagcgccgatcaccagccgaaggaccagggggatctcaggcaccatcccctattgccaacacctttcttcattatcgaacatccaaggtgcgcgtgttgcgggcagcacggctggagcggctggtgggcgagctcgtgttcggcgaccgagagcaggaccccagttttatgccggcgtttctggccacctaccgaacatttgtgcccacagcctgtcttctggggttcctactcccccccatgccaccccctcctccgcctggagtggaaatcaagaagactgctgtgcaagatctatccttcaataaaaacctccgcgctgttgtatccgtactggggagttggcttcaggatcaccctcaagacttccgcgaccccccagcgcactcagatttaggtagcgtgcggacctttctgggctgggccgcccccggcagcgccgaggctcaaaaagccgagaagctgcttgaggatttccttgaggaagcggagagagaacaagaagaagaacccccgcaagtctggacaggcccaccgagggtggcccagactagtgatcccgatagcagcgaggcatgtgctgaagaagaggaagggctaatgcctcaaggaccccaactacttgacttcagcgttgacgaggtagcagagcagctgacccttattgacctcgagttgttctcaaaagtgcgcctctacgaatgtctcggctccgtctggagccagagagataggccgggtgccgctggggcttcacccaccgttcgggcaacagtcgctcagttcaacacagtcactggctgcgttttaggctccgtgcttggtgccccaggtctcgccgcaccgcagagagcccaacggcttgaaaagtggatcaggattgcccagaggtgcagagaacttcgtaatttctcctctttacgggctatcctgtccgcgttgcagtcaaatcctatttatagacttaagcgctcctggggagcggtgtcacgggagcccctcagcactttcagaaagctgagtcagatttttagtgatgaaaacaaccacttgagttccagggagattctctttcaggaggaggcgactgagggttctcaggaggaggataatactcctggctccctccctagcaagcctccgcctggaccagtgccctatctggggactttcttaaccgatctcgtcatgctggacaccgcgctgcctgacatgctggaaggcgatctgattaattttgagaagcggcgaaaggagtgggaaatcctggctagaatacagcagttgcagaggagatgtcagagttatactctgtctccacaccccccgattctcgcagcactccacgcccagaatcagctgacggaagagcagtcctatcggttatcacgggtcattgagccacccgccgccagctgtccttcttcgccccggattcgtagaagaatctcactaaccaagagacttagcgctaagcttgcccgagagaagtccagttccccttctggtagcccgggagatccatcttcaccaacgtcttctttgtgtattagtccttcagtgtcaccgggatccccaccgtctagtcccagatccagagatgctccggcaggaagtcctccagcatcccccggtccccaaggtccgagcactaaattacctctgtctctcgacctccccagtccccggcccttcgccctgcccttgggaagcccccgcatccccttgcccgcccaacagagtagcgaggcaagagtgatccgggtttccatcgacaatgaccacggcaacttatatcgaagtattctgttgaccagtcaggacaaggctccaagtgttgtccgccgggctctccagaaacataatgtaccccaaccctgggcatgcgactatcagttgttccaggtcctcccaggcgacagagtgctccttatccctgacaatgcgaatgttttttacgccatgtcccccgtggcgccccgggattttatgcttagacggaaggagggtaccagaaataccctgtcggtttccccaagctag

SEQ ID NO: 33004 - DNA, 813 bp, Artificial Sequence
  Description of Artificial Sequence: Synthetic coding sequence
atggagagaacagcagggaaggagctggcactcgcaccgctacaggattggggagaggagaccgaggatggtgccgtgtactcggtaagtcttcggcggcagcgctctcagagaaggtcccctgccgagggacccggcggctctcaagcgccatctccaatcgcaaacacatttttacactatagaaccagtaaggtccgagttctccgggctgctcgattggaacgtttggtcggggagctggttttcggggacagagaacaagacccatcttttatgcccgcctttcttgcaacttatcggacatttgtgcccacagcctgccttttgggcttcttgctgccacctatgcccccgcccccaccacctggggtcgaaatcaagaaaaccgcggtacaggatctctccttcaataagaacctgaggctgttcagaggcctgcggggtggtcgggggcgggcccatgctagtaggtccccagcgcctggcctgcagagagggagaggaggccgagccgctgatccacacagactgggagctctacttcagggagaggctctgcgcgtgcttgggctgagggtggtcgccgaaggtccagctggcggctgtcggaggctgccacattgtgctcgacaccgggggcccgttcagcaccgcgaccgcttgtgtgcaggatttagagctaggtccaccggcttgggacggccggccgaaggagccgctgctggtgaggtcgacccccatcggcctgcactccctcggacagctgagctgctcttgttggccagacaccctgtgcgtcctgccatttag

SEQ ID NO: 33005 - DNA, 258 bp, Artificial Sequence
  Description of Artificial Sequence: Synthetic coding sequence
atgaccgggaaaactcagactagcaacgtaactaataagaacgatccgaaatcgattaacagccgggtcttcattggaaatttgaacaccgcaatcgtgaagaaggtggatatagaagctatcttttcaaagtatggtaagattgttggatgctctgtgcataagggctatgcattcgtgcaatatatgagcgagcggcacgctcgggccgcagtcgccggtgagaatgctcgggtcatcgccggccagcccctgtag

SEQ ID NO: 33006 - DNA, 876 bp, Artificial Sequence
  Description of Artificial Sequence: Synthetic coding sequence
atgacgggcaaaacgcagacatccaacgttacaaacaagaacgatcctaaaagtattaatagtagagttttcatcggaaatctcaacacggccattgtaaaaaaagtggatatagaagcaatcttctcaaaatacggcaagatcgtcggatgctccgtccataagggttacgcattcgtgcaatatatgagcgagcggcacgctagggccgcagtggcaggggagaacgctagggtcattgcaggacagccattggatatcaacatggctggagagcccaagccctataggcccaagcctgggaacaagcgaccgctgtctgccctgtaccgcttggaaagcaaagagcccttcctgtccgtgggcggctatgtgttcgattatgactactatcgtgacgacttctataatcgtctgtttgactatcacggaagggtgccacccccccctagggccgtaattccactgaagcggccccgagttgccgtgactactaccagacggggaaaaggagtgttttctatgaaaggcgggtctcgaagtaccgcttctgggagcactggctccaaattgaagagtgatgaactccagaccattaaaaaggagctcacacagattaagaccaagattgattctcttcttgggcgcctggagaagattgagaagcaacagaaagccgaggccgaggcgcaaaagaaacaactggaggagtccttggtgctaatccaggaggaatgtgtcagtgagatcgctgaccactcgactgaagagcctgctgaaggagggcccgacgctgacggggaggaaatgacagatggaatagaggaagactttgatgaggatggaggccacgaactgttcctgcagataaaatag

SEQ ID NO: 33007 - DNA, 876 bp, Artificial Sequence
  Description of Artificial Sequence: Synthetic coding sequence
atgactggaaagactcagacatccaacgttaccaacaaaaatgatcccaaatcaataaacagccgcgtcttcattggtaaccttaatactgccattgtgaagaaggttgacatcgaggcaattttttccaaatacggtaaaattgtgggatgcagtgtgcataaaggctatgcgttcgtgcaatacatgtctgagaggcacgcccgggctgccgttgcaggcgagaacgctcgagtgattgcagggcagccactggacataaatatggctggtgaacccaagccttacagacctaaacccggtaataaaagacccctctccgcgctgtacagactggagagtaaagaaccgttccttagcgttggaggctatgtctttgactatgactattaccgagatgatttctacaatcgactgttcgattaccacggcagggtcccacctccgcctagagcagtgattccgttgaaacgccccagagtggccgtcaccacgacccggagaggcaagggcgtcttctctatgaagggcggctcccgtagcaccgcgagcggcagcacgggcagtaaattgaagagcgatgaacttcagacaattaagaaagaactgacacaaatcaagaccaagattgactccctgctagggagattggaaaagatcgagaagcagcagaaagcagaggcggaagcccaaaagaagcaactcgaagagagtctagtcctcattcaagaggagtgtgtctctgaaatcgcggaccactccactgaagaacccgctgaaggtgggcctgacgccgacggcgaggagatgaccgatggtattgaggaggattttgatgaagacggtggacatgaactgttcctgcagatcaagtag

SEQ ID NO: 33008 - DNA, 876 bp, Artificial Sequence
  Description of Artificial Sequence: Synthetic coding sequence
atgacaggcaagactcagacctccaacgtgacaaataagaatgacccaaaatcaatcaacagccgtgtcttcattggcaacctgaacacagcaatcgttaagaaggtggacatcgaggctattttttccaaatatggaaaaatagtggggtgttctgttcacaaggggtacgccttcgtacagtatatgtcagagcgacacgctcgcgcagccgtggctggcgaaaatgctagagtgattgctggtcaacctctcgacatcaacatggctggtgagccaaagccatacaggccaaagccaggaaacaaaaggcctctgtccgcattatacaggttggagtctaaagaaccctttctatcggtcggcggctacgtatttgattacgattactatagagatgacttttataatcggctgttcgactaccacggaagggtacccccccccccgcgagccgtgatccctctgaagcgaccgcgcgttgcagtgacaaccaccagaaggggcaagggcgtgttctccatgaaggggggttcgaggagtacagcatccggatctaccggtagcaagcttaaatccgatgaactgcaaacaattaaaaaggagctcacacagattaaaacaaaaatagattcactcctcggcaggctggagaaaatcgagaagcagcaaaaagccgaagcagaggctcagaagaagcagctggaagagagcttagtgctcattcaggaggagtgcgtcagcgagatagccgaccattccactgaggagcccgctgagggcggaccagatgccgacggcgaggagatgacagatgggattgaggaggactttgatgaggacggaggtcatgaacttttcctgcaaattaaatag

SEQ ID NO: 33009 - DNA, 258 bp, Artificial Sequence
  Description of Artificial Sequence: Synthetic coding sequence
atgaccggaaagacccagacctctaacgtcaccaataaaaatgatccaaaaagtattaattcccgcgtcttcattggcaatctgaacacagcaattgtgaaaaaggtggacatcgaagccatcttttcaaagtacggaaagattgtggggtgcagcgtccataagggatacgcgttcgtgcaatacatgagcgagcggcacgcacgggctgctgtggccggcgagaatgcccgggtcatcgctggacaacctttatag

SEQ ID NO: 33010 - DNA, 657 bp, Artificial Sequence
  Description of Artificial Sequence: Synthetic coding sequence
atgacaatgtacaaatcaaaaaggcgccaccaacggtacatcaatatggctggggaacctaagccataccgccctaagcccggaaacaaacggccactctccgccctgtatcgcctagagagtaaggagccttttcttagcgtgggtggatacgtgttcgattacgactactatcgggacgatttctataatagactctttgattatcacggcagggttcctcccccgccacgcgcggtgatccccctgaaacgtccgcgggtggcagttaccacaacacggcgcggtaaaggcgtcttttcaatgaaaggcggctcgaggtcaacagcctccggatccacggggtccaaacttaagagtgacgagttgcaaacaatcaaaaaggaattgacacagatcaaaacaaaaatcgactccctcctcggtaggctcgagaaaatagaaaagcagcaaaaagcagaggctgaagcacagaaaaagcagctggaagaaagcctggtccttatccaggaggagtgcgtgtccgaaatcgctgaccacagcacagaggaacccgctgaaggtgggcccgacgctgatggagaggaaatgaccgatgggatcgaagaggattttgacgaagatggtggacacgagctgttccttcaaattaaatag

SEQ ID NO: 33011 - DNA, 1986 bp, Artificial Sequence
  Description of Artificial Sequence: Synthetic coding sequence
atgaaaccactggagaaattcttgaagaaacaaactagtcagcttgcaggtcggacagtggccggaggcccaggcggcgggctggggagttgtggtggacctggcggaggtggcggtccaggtggcggcggcggccctgctggcggtcagagaagcctgcagcgcaggcagtccgtgtcaagactgctcttgcctgcttttctgcgggagcctccagctgaacccggacttgagccacctcctgaggaggggggggaacccgccggagttgccgaggaacctggtagcggcggcccatgttggctgcagctggaggaagtgccaggtcctggccctctgggtggtggcggcccacttcgctcaccctcaagctattcaagtgacgagctttctccaggggagcctctcacctccccgccatgggccccactgggcgcccccgaaagacctgagcatctgctgaaccgcgtgctggaacggctagccggaggtgccacccgcgattccgctgcctcggacatcctgcttgatgacatcgtcctcacccatagtctgtttttacccactgaaaagttcctgcaagagttgcaccaatacttcgtccgtgctggaggtatggagggcccagaagggttgggcaggaaacaggcatgcctcgccatgctgctacactttctggacacataccagggactactgcaggaagaagaaggcgccgggcacatcattaaggacctctatctcctgattatgaaagatgaatcgttatatcaaggcctccgggaggacacactccggcttcaccagttggttgagactgtcgaactcaagatacctgaagaaaaccagccaccaagtaagcaggtgaagccactgttccggcacttccgaagaattgacagctgtcttcaaaccagggtcgccttccgcggcagtgacgaaattttctgtcgcgtctacatgcctgaccacagctatgtgacgattcggagtcgactgtcagcttccgttcaggacatattaggctcagtaaccgagaaactgcaatattctgaagaacccgccggacgggaggatagtctcatcctggtggctgtatcgtcgtccggtgagaaagtgctgttgcagcctaccgaagattgtgttttcaccgccttaggaattaatagccacttgtttgcctgcacccgtgattcatacgaagccctggtcccgctgcccgaggaaatccaggtcagcccgggtgatacggagatacaccgagtggaaccagaagatgtggccaaccatctgacagcctttcattgggagctctttaggtgtgtgcatgagctagagtttgttgattacgtgtttcacggtgagcgtggaaggagggagacggctaatctcgagctgctcctacagcgctgcagcgaggttacccactgggtggcgacggaagttctcctatgcgaggcacccggtaagagggctcaactgttgaagaaattcattaagatcgccgccttatgtaagcagaaccaagatctgctgagcttttacgccgtcgtcatggggttagacaatgccgccgtttctcgactccgcctgacatgggagaagctgccaggaaagtttaagaacctgttccgcaagttcgaaaacctaactgacccttgtcggaaccataaatcgtatcgggaggtgatctcaaaaatgaagccgcccgtgattccttttgtaccactcatcctcaaagacctaaccttcctgcacgaggggtctaagacactggttgacggactagtaaatattgaaaaactgcattccgtagctgagaaggttaggacgatccgcaagtatcggtccaggccactctgtctggatatggaggccagtcccaaccacctgcaaactaaagcgtacgtccgccagttccaggtgatcgacaatcagaatctcctcttcgaactgagctataagctcgaggccaatagccagtag

SEQ ID NO: 33012 - DNA, 1371 bp, Artificial Sequence
  Description of Artificial Sequence: Synthetic coding sequence
atggagggccctgaaggcctgggacgaaaacaggcttgcctcgccatgctccttcattttcttgacacataccagggcctgttacaggaagaagagggggcgggacacatcattaaagatttgtacttgcttattatgaaagatgagtccttataccagggcctccgcgaggataccctgagacttcatcagctggtggagactgtggagctgaagattccagaggagaatcagcctccgtccaagcaagtgaagccattattcagacattttcgccggattgatagctgcctgcaaaccagagtggcatttagaggcagcgatgagatattttgccgggtctatatgccggatcactcttacgtgactatcaggtcccggctgagtgcgagtgtccaggatattctcggatccgtgaccgagaagctgcagtacagcgaggagcctgcaggcagagaagacagcctgatcttggttgccgtgagcagctccggggagaaggtcctgttgcagcccaccgaggactgcgtcttcactgcgctcggcatcaactcacatctgttcgcctgcaccagagattcctacgaggctttggtacctctgcctgaagagatacaagtatcacccggagacactgagatccacagagtggagcccgaagacgtggcaaaccatttaacagcctttcattgggagctctttcggtgcgtgcacgaacttgaatttgtggattatgtcttccacggcgaacggggtcggcgcgaaacagcgaacctggagcttctccttcagcggtgctctgaggtgactcactgggtggctacggaggtactgctgtgcgaggcgcctggaaaacgggctcaactactgaaaaagtttattaagattgctgctctctgcaagcagaatcaggaccttctgagtttctatgcagttgtcatgggtctcgataatgccgcagtgagccgcctgagactgacctgggagaagctgcccggcaaatttaagaatttgttcaggaagttcgagaacctcacggatccttgcagaaatcacaagagttacagggaagtcataagtaagatgaaaccccccgtgattccttttgtgccattgatcctgaaagatttgacattcctgcatgaaggaagcaaaacactggtggacgggctggttaacattgagaaacttcacagcgtagctgaaaaggtccgcacaattagaaagtataggagcagaccattgtgcttggacatggaagccagtcccaaccacctgcaaacaaaggcatacgtgcgtcaattccaggttattgataatcagaatctcctgtttgagctttcatataagttggaggccaactcacagtag

SEQ ID NO: 33013 - DNA, 1371 bp, Artificial Sequence
  Description of Artificial Sequence: Synthetic coding sequence
atggaaggacctgagggtcttggccggaagcaggcttgtctagccatgctcctccactttcttgacacttaccaggggctgctacaggaggaggaaggagccggtcatatcattaaagatttgtatctcctaatcatgaaagacgagagtctctaccagggactacgagaggatactctgcgtctgcaccaacttgttgagacggtggaactcaaaataccggaagaaaaccagcctccatccaaacaagtcaagcccctttttaggcacttcaggcgaatcgattcttgcttacagacgcgtgtcgctttccgcggctcagatgagatcttctgccgcgtttatatgcccgaccacagctacgtgaccatcagatcaaggctgtccgcttcagtgcaggatatccttgggtctgtaacagaaaaactacaatattccgaagaacctgctgggagggaggatagtctgattctggttgcagtgtcatcctccggtgaaaaagtgcttctccagcctaccgaggactgcgtctttactgccctgggcattaacagtcacctgtttgcttgcacccgcgatagctacgaggctctggtgccgttacctgaagagatccaggtctcccccggcgacactgagatccaccgcgttgaacccgaagatgtcgccaaccacctgacagctttccattgggaactgttccgctgtgttcatgaactggagttcgtcgactacgtatttcatggggagcgcgggcgtagggaaactgccaacctggaactgctgctgcaaagatgttctgaggtcactcattgggttgccaccgaggtgctcttgtgtgaagccccagggaagagagcacagctattgaagaaattcataaaaatcgccgctttgtgtaaacagaaccaggacctgctgtctttctacgccgttgtaatgggcctggataacgccgccgtcagtaggctgaggctgacttgggagaagctgccaggaaagttcaagaacctttttcggaaattcgagaatctgacggacccctgccggaatcacaaatcttatagagaggtgattagcaagatgaaaccccccgttatcccatttgtcccactcatcctgaaagatctcacattcctccacgagggtagtaagacactcgttgatggtttggtcaatattgagaaactgcactctgtggccgaaaaggttaggacaataaggaagtatcgttccaggcccctgtgtctggatatggaagccagtccaaaccacctacagacaaaagcatatgttcgccaattccaggtgattgacaatcagaatttactgtttgaactgagctacaaactggaggccaacagccagtag

SEQ ID NO: 33014 - DNA, 63 bp, Artificial Sequence
  Description of Artificial Sequence: Synthetic coding sequence
atggaagggccagagggcctggggaggaaacaggcgtgtcttgcgatgctgctgcatttctag

SEQ ID NO: 33015 - DNA, 306 bp, Artificial Sequence
  Description of Artificial Sequence: Synthetic coding sequence
atggaaggtccagagggcctgggtaggaagcaggcttgcttggctatgctgttgcattttcttgacacgtaccaaggattgcttcaagaggaggagggagcgggacatattattaaggatctctacctgttaatcatgaaggatgaaagcctgtaccagggcctccgcgaggacacactgcgtcttcatcagctagtcgagaccgttgagttgaaaatcccagaggagaatcagcctccctctaaacaggttaaaccattgttcaggcacttccgcagaatcgactcctgcctgcagacaagatag

SEQ ID NO: 33016 - DNA, 450 bp, Artificial Sequence
  Description of Artificial Sequence: Synthetic coding sequence
atggaaggtcctgagggactagggcgaaagcaggcctgcctggcaatgcttctgcacttcctggacacttaccagggtctcttgcaggaggaggagggagctgggcacattattaaagacttgtacctcctgatcatgaaggacgaatctctgtaccagggcttgagggaagataccctgcgattgcatcagctcgtagagactgtcgagttaaagatcccggaagaaaaccagccgccaagcaagcaggtaaagccgttgttccggcactttaggcgaatagacagttgccttcagactcgtgttgccttccgggggtccgacgagatcttctgcagagtgtacatgccagatcatagttatgttacaatccgttcacgcctgagcgcgtctgtgcaggatatattgggcagcgtaactgagaagctgcagtattccgaagaaccctag

SEQ ID NO: 33017 - DNA, 1359 bp, Artificial Sequence
  Description of Artificial Sequence: Synthetic coding sequence
atgcccgatctgccgcacttgctggctttcctatcggcatctagagacgtactgcctcggactctccttttaccccctccaacattaggaccgagagatgaacatacagaccctgtacagataggccgagtccagcaggacactcctggcaaagttctttcaattgtaaaccaactgtacctggaaactcacaggggctgggggcgggagcagacaccccaggagacggagcctgaagctgcacaacgccatgacccagcgccacgaaaccctgcccctcacggagtcagctgggtcaagggcccactgagtcctgaggtggaccatcctggtccagcccttgctagcttgctagaagaagaagaagaggatctcgaaggaaaggaagagggacgtgaagatgacccagaggaggaagggcccgaggacgtcctcaccatccatgtccagtctttagttcgggcccggtcaagctatgttgctcgacagtatcgatcacttcgagtaaggatcgcctcagatagcggaggccctcacggaagtggagatccagctacagaattgctgcaagacgtccgtcacctcttgaccgatctgcaggaccacctggcaaaggactcgtacataagagccgtcttcggcagtagaggaccaggccttccaaagaaagacgaggatcccgggccggccctggaaactgcagtctgtcaggccgtcttggccccactgaagcccgcactgtggacaagactgcggaccttacgggccccagagcttagaagactaaggagaaggcagacagcactgcgcgctggtgcaggccctcccggagcacaaggccccgggcctgaggggcagtcccccgcccccgcactccgctcccggatccatgaacggctagctcatctccatgccgcctgcgctccacggcggaaggtggctcttctgttggaggtgtgcagggatgtctacgccggcctcgccagaggcgagaaccaggaccccctgggtgcagatgccttcctccccgccctcacggaagagttgatctggtctcctgatattggagatacacagctggatgtcgaatttttaatggagttattggatccagatgagttaagaggagaggcaggctactacttgaccacatggttcggagcattacatcatatagcacactaccagcccgaaaccgatcgagctccacggggactgtcaagcgaggccagggcgagtctccaccagtggcacagaaggcgcactctgcacagaaaggaccaccctcgggcccaagctaatttgccctttaaagaaccgtgggctgaagagactgtcacaggtaccagcgacaactag

SEQ ID NO: 33018 - DNA, 1359 bp, Artificial Sequence
  Description of Artificial Sequence: Synthetic coding sequence
atgccggaccttccccacctattggcattcctgtctgcctctagggacgttctcccccgtaccctccttctgcctccccccacgcttgggcctcgcgatgagcatactgatccggtccagatcgggcgtgtgcagcaggacacacctggcaaggtgctctccatagtgaaccagctttacctagaaacacatagagggtggggccgggagcaaactccccaggaaacagagccggaggccgcccagcggcacgatccggccccgcggaatcccgctccacacggcgtttcctgggtaaaagggccactatccccagaggtcgaccatcccggacctgctctcgcatccctgttggaggaggaggaggaagacctagagggtaaggaagagggcagggaagatgacccagaggaggaaggtccagaggacgtactgaccatccacgttcagagtctcgttcgagctcgctcttcctacgtcgcacgccagtacagaagcttgagagtgaggattgcctccgacagtgggggccctcacgggtctggagatcccgctactgagttgctccaggacgtccggcacctcctaaccgatttgcaggatcatctggccaaggacagttatattcgcgccgtgtttggatctcgcggacccggtctgcctaaaaaagatgaagatccgggccctgctctggagactgcggtctgccaagctgtcctggcacctctcaagcccgccctgtggacccggctccggacattacgagccccggaacttaggcgtcttcgccgtagacaaactgcccttagagccggtgcgggaccacctggagcccagggccctgggcctgagggtcagagccccgccccagcactccgctcccgcattcatgagagacttgcacacttgcatgccgcttgcgcccccagaaggaaggtggcactcctgctggaggtgtgccgagatgtctacgctgggctggctagaggggaaaaccaggatcccctgggcgccgacgctttcctccccgctctcacggaagaactgatttggagtccagacattggtgacactcagctggatgtggaatttcttatggaacttctggatccagacgagcttaggggcgaggcgggctactacttaactacctggttcggagctctgcatcacatcgcccattatcagcccgaaacagatagagcgcctcggggcctttcctccgaggccagggcatcactccaccaatggcatcgccgtaggacactgcacagaaaagaccaccctcgggcccaggcaaacctgccgttcaaggagccctgggccgaagagaccgtgacaggaacctcagataattag

SEQ ID NO: 33019 - DNA, 1260 bp, Artificial Sequence
  Description of Artificial Sequence: Synthetic coding sequence
atggagctaaaggtttgggtcgatggcgtgcagagaattgtttgcggcgtcactgaggtcacgacgtgccaggaagttgtcatcgccttagctcaggctattggtcggaccggacgctacactctgatcgagaaatggagagacaccgagcgacacctagccccccacgaaaaccccatcattagcctgaataaatgggggcagtatgcaagcgatgtccagttaatcctccggcgaaccggacctagcctgagtgagcggcccaccagcgattctgttgctagaatccccgaacggacactgtatcgacagtctctgccccctctggctaagcttagaccccaaattgacaagtcgatcaagcgcagggaaccaaaacggaaatccttgaccttcacaggcggcgccaaaggacttatggatatattcgggaagggaaaagaaaccgagttcaaacaaaaggtactcaacaactgtaaaaccacagcagacgaactgaagaaactgattcgtcttcagaccgagaaactgcagagcatcgaaaaacagctcgaaagcaatgagattgagatcaggttttgggagcagaagtacaatagcaacctggaagaggaaatagttagattggaacaaaagatcaaacggaacgacgtggaaattgaggaagaagagttctgggaaaatgagttgcaaattgagcaagaaaacgagaagcagttgaaggatcagcttcaagaaattcggcagaaaataaccgaatgtgaaaacaaactgaaagactatctggcgcagatcagaacgatggaatccggactcgaagccgagaagctccagcgcgaggtacaggaggcgcaggtgaatgaagaggaagttaagggcaaaattggcaaggttaagggggagattgatattcagggccagcaatccttgagacttgagaacggcatcaaagccgttgaacgctccttaggacaggcaacaaagaggctccaagataaggagcaggaactcgagcagctgaccaaagagctccgtcaagtcaacttgcagcagttcattcagcagacaggcaccaaggtgaccgtgctgcccgcagagccaattgagatcgaagcatcacacgcagacattgagcgcgaggcaccattccaaagcggcagtctcaaacgccctggtagtagtcgccagctcccgagcaaccttcggatcttacagaatccaattagcagcggcttcaaccctgaggggatatacgtctag

SEQ ID NO: 33020 - DNA, 1179 bp, Artificial Sequence
  Description of Artificial Sequence: Synthetic coding sequence
atggagctcaaagtttgggtggacggtgtgcagcgaatcgtgtgtggtgtaaccgaagttaccacatgtcaggaagtggtaatagccttggcccaagctatcggccgaactgggcgctacactctgattgagaaatggagggacacagagcgccacctcgcgccccatgaaaatcctatcatcagccttaataagtggggacagtacgccagcgatgtccagttgattctgcggcggactggcccaagcttgtctgagcgccccaccagcgattctgtggcacggattccagagaggactctgtatcggcagagcctgccgccactggccaaacttaggccacaaatcgataagtccattaagaggagagaacccaagcggaagtcactgacattcacaggaggcgctaaaggccttatggatatctttgggaaaggcaaggagacagaatttaagcaaaaggtgctcaataactgtaaaaccaccgccgacgagctcaaaaaactcattcggttgcagaccgagaagctccaatcgatcgaaaagcagttggagtctaacgaaatagagattcggttctgggaacagaagtataacagcaatctggaagaagagatagtgcggctggaacagaagatcaaacgtaacgacgtcgaaatcgaagaggaggaattttgggagaacgagttacagatagagcaggagaatgagaaacagctcaaagatcaactccaagagatccgccagaaaataacagagtgtgagaataaacttaaagactacctcgcccagatcaggactatggagtccggcctcgaggcagaaaagctgcagagggaggtgcaagaagcccaagtgaacgaggaggaggtgaagggtaagataggtaaggtcaagggggagatagatatccagggacagcagagcttacgtctcgagaatggcatcaaggctgtcgagcgaagcctggggcaagcaaccaagaggctgcaggacaaggaacaggagcttgagcagctgacaaaagaactcagacaggtcaatctgcagcaatttatccagcaaacaggcaccaaggtaactgtgctgccggcagagcccatcgaaatcgaggcctctcatgcagatattgagagaggcatcattattctttcagacaagcaggagtgcaaggattag

SEQ ID NO: 33021 - DNA, 1260 bp, Artificial Sequence
  Description of Artificial Sequence: Synthetic coding sequence
atggaactgaaggtgtgggtggacggggtccagagaattgtgtgcggtgttacagaagtcactacatgccaggaggtcgtcatcgccctggcccaggcgatcggccgaaccggccggtacacccttatcgagaagtggcgcgacaccgagcgccaccttgcacctcacgagaacccaataatttccctcaataagtggggacagtatgccagcgacgtgcaactgatcctgagacgaactggtcccagtctctctgaacgcccaacaagcgactccgtggcaagaattccagagaggactctctaccgacagtccctcccccctctggccaaactgaggcctcaaattgacaaaagtataaaaagacgagaaccaaagcgcaagtcattgacatttactggaggtgcaaaggggctcatggatatctttggcaaagggaaagaaacggagttcaaacagaaagtgttaaacaactgtaagacaaccgcagacgagctgaaaaaattgatccgtctgcagacagagaagttgcagtctatcgagaaacagctcgagtccaatgagatagagatccggttctgggaacagaaatataacagcaacctcgaggaggaaatcgtacggctcgaacagaaaatcaaacggaacgacgtggagatcgaggaggaggagttctgggagaatgaactgcagatcgagcaggaaaatgaaaagcagctcaaggaccagctacaggagatcagacaaaaaattaccgagtgtgaaaacaaactcaaggactatctagcccaaatacggaccatggagagtggtctggaggcagagaaactgcagcgggaagtacaggaagctcaggtcaatgaggaggaagtgaaaggcaaaatcgggaaggttaaaggcgagattgatatccaggggcaacaatcattgcggctggaaaatggcatcaaggctgtggaacggtctctgggccaggccaccaaaaggctacaggataaagagcaggagctggaacaactaaccaaggaacttcgccaggtaaacctccaacagttcatccagcagaccggcacaaaggttacggtgctaccagccgagccgatcgagatcgaagcatcacatgccgatatcgagcgcgaagctccttttcagtccgggtctcttaaaagaccagggtcgtccagacaactccccagcaatctgcgaatactgcagaatccaattagtagtggcttcaatccagaagggatctatgtatag

SEQ ID NO: 33022 - DNA, 276 bp, Artificial Sequence
  Description of Artificial Sequence: Synthetic coding sequence
atggaactcaaagtgtgggtcgatggagtgcagcggatagtttgcggcgttacagaagtgacaacgtgtcaagaggtggtgatcgccttggcacaagcaataggcagaacagggcggtatactcttatcgagaagtggcgcgataccgaacgtcatttagcaccacacgaaaatcccatcatatccctcaacaagtgggggcaatatgctagtgacgttcaattgattttgagaagaaccgggcccagcctctctgaaaggccaacgagtgactag

SEQ ID NO: 33023 - DNA, 90 bp, Artificial Sequence
  Description of Artificial Sequence: Synthetic coding sequence
atggagctgaaggtatgggtggacggggttcagaggatcgtgtgtggggtgacagaggtaacaacttgccaggaagtcgttattgcttag

SEQ ID NO: 33024 - DNA, 627 bp, Artificial Sequence
  Description of Artificial Sequence: Synthetic coding sequence
atggaattgaaggtatgggtcgacggagttcagcgaatagtgtgtggcgtgaccgaagtcacaacttgccaggaggtagtgatcgccctggcccaagctattggccggacaggaaggtacacattaatagagaagtggcgcgatactgaacgccatctcgctccccacgagaacccaatcatttctcttaacaagtggggccaatacgccagtgatgtccagctgatattacgacgtactgggcctagtctctctgagagacctacaagcgatagtgtggccaggataccagagaggactctttatcggcagagtcttccccctctggcaaagctgaggccccagatcgacaagtcaataaagcgcagggagccaaagcggaaatccctgacattcactggcggcgccaagggcctgatggatatttttggaaagggcaaagaaacggagttcaagcagaaagtcctgaacaattgcaaaacgaccgccgatgaactcaaaaaactgattcggctccagacagaaaagctccaatcgatcgaaaagcagctggagtccaacgaaattgaaatcaggttctgggaacaaaagtacaacagcaacctggaggaggagattgtccggtag

SEQ ID NO: 33025 - DNA, 1260 bp, Artificial Sequence
  Description of Artificial Sequence: Synthetic coding sequence
atggagcttaaagtctgggtggatggcgtccagcgcatcgtttgcggtgtcacagaagtcacaacttgtcaggaggtagtgatagcccttgcacaggctatcggcagaaccggcaggtacacactcattgagaagtggagagacactgagagacatcttgcgcctcacgagaaccctattatcagtttaaacaaatgggggcagtatgcctccgacgtccaattgatcctgcgaaggaccggaccttccctgtccgaacggcccacctccgactccgtggcaaggattccagagcggacattgtaccgccagagcctcccaccccttgcgaagttgcgtccacagattgataagtcaatcaagcgccgcgaacctaaacggaagtctctgactttcacagggggcgcaaaaggcctcatggatatctttgggaaggggaaagagactgagtttaagcagaaagttctgaacaattgtaaaaccaccgctgacgaactcaaaaaactaatacgcctccaaaccgagaagctccaaagcatagagaagcagctggagtccaatgaaatcgaaattcgattctgggaacaaaagtacaacagtaacctggaagaggaaatagtcagacttgaacagaagattaaacgtaacgacgtggaaattgaagaagaggaattttgggagaacgaacttcagatcgaacaggaaaacgagaagcagctgaaagaccagctgcaggagataaggcagaagatcaccgagtgcgagaataagctgaaggattacctggcacagatacgaacgatggaatccggcttggaggcagagaagctccaacgtgaagtacaggaagcgcaggtgaatgaagaagaggtaaaggggaaaatcggtaaggttaagggggagatcgacatccagggacaacagagccttcgcctggaaaatggtatcaaggctgtggagaggagtttgggccaggcaacaaagaggttgcaggataaggagcaagagctcgaacagctgacaaaggagctacgccaagtgaacctgcagcagtttatccagcagactggaactaaggtcaccgtgctgccggctgagccaatcgaaattgaagctagtcacgccgacatagaacgcgaggccccgttccagtccggaagcctcaaaaggccaggcagctctcgacaactgccatcaaacctgcgaatccttcagaatccaatctcttcagggtttaatcccgagggaatatatgtctag

SEQ ID NO: 33026 - DNA, 330 bp, Artificial Sequence
  Description of Artificial Sequence: Synthetic coding sequence
atggagctcaaggtctgggtcgacggcgttcagagaatcgtttgcggagtaactgaggtgaccacatgccaggaggtcgtaattgccctcgcacaggccataggccgcaccgggcgatatactctgattgaaaagtggagagacacagagagacatctggcaccgcatgagaatccaattatcagccttaacaaatggggacagtatgcctcagacgttcagctgattcttcgccgcaccggcccaagccttagcgagaggccaacgagcgattccgtagcccgcatcccggaacgcaccttataccggcagtctctacctctgagttag

SEQ ID NO: 33027 - DNA, 660 bp, Artificial Sequence
  Description of Artificial Sequence: Synthetic coding sequence
atggagctcaaggtgtgggtggacggggttcagcggatcgtatgcggcgttacagaagtgaccacatgccaggaggtggtcatagccttggcccaggccatcggcagaacaggccgatacaccctgatagaaaaatggcgcgacactgagcggcatttggcaccgcatgagaaccccatcatttcacttaataaatggggccaatacgcgtccgatgtgcagctcattttgagacggacgggcccatccctctccgaacgacctacttcagactctgtggctagaatccctgaaagaactctgtaccgacagtctctgcctcctcttgctaaactgaggccgcagatcgacaagtcaatcaagaggcgcgagcccaaacgcaagagcttgacttttaccggcggagctaaggggctgatggatatttttgggaaaggcaaagaaacggaatttaaacagaaggtgctcaataactgtaaaacgactgccgatgaactgaagaagctgatccgtttacagacagagaaattgcagtcaattgagaagcagttggaaagcaatgaaatagagatcaggttttgggagcagaaatataactctaacttggaggaagagattgtacggctcgagcagaaaatcaagagaaatgatgtggagtag

SEQ ID NO: 33028 - DNA, 369 bp, Artificial Sequence
  Description of Artificial Sequence: Synthetic coding sequence
atggagctcaaggtctgggtcgacggcgtccagaggattgtatgtggagtgacggaggtaaccacctgtcaggaagttgttatcgctttggcacaggctattggaaggactggtagatacaccttaattgagaagtggcgggataccgaaagacatttagcaccgcatgagaaccccatcatatctctgaataaatggggacagtacgcctcagatgtgcagctgattctccgccgtactggcccttccctctcggagcgcccaacctccgattccgtggcccgcattcccgagagaacactgtacaggcagagcctccccccactggccaaactgaggccacagattgataagagcattaaacgatag

SEQ ID NO: 33029 - DNA, 1260 bp, Artificial Sequence
  Description of Artificial Sequence: Synthetic coding sequence
atggagctcaaggtctgggttgatggggtacagaggatagtctgtggcgtcactgaggtcactacctgtcaggaggttgttatcgccctggcccaagccattggtaggacaggccgatacactctcatagagaagtggagagacaccgaacgacacctggccccccacgagaaccctataatcagcttgaataaatggggacaatacgccagcgatgttcagctgatcttgagaagaacaggcccctcccttagcgagcgtcctacaagtgattccgtggcacggataccagaacgcacgctctataggcagtccctgccccctttggcgaaacttaggccccagattgacaaatctatcaaacggagggaacctaaacgtaagagcttaacgtttactggcggggcgaaggggctgatggatatattcggaaagggtaaagagacagaatttaagcagaaagtcttgaacaactgcaaaaccacagccgatgagctgaagaaactgatcagactgcaaaccgaaaaattgcagtcaatcgagaaacagctcgagagtaacgaaattgagattaggttttgggagcagaagtataacagcaatctggaggaagaaattgtcaggctggagcagaagattaaaagaaacgacgtggagattgaagaggaagaattttgggaaaacgagctgcagatcgagcaggaaaatgaaaagcagctgaaagatcagctgcaggagatccggcaaaagataaccgagtgtgagaataaactgaaagattatctcgcacaaatcaggactatggaatcaggactcgaagctgagaagcttcagagggaagttcaggaagctcaggtgaatgaggaagaggtgaaagggaagattggaaaggtgaagggggagatcgatatacaggggcagcagtccctgcggttagagaatggaattaaagccgtggagagatctttgggacaggcgaccaaaaggctgcaggacaaggaacaggaactggagcagttgactaaagagctacgccaggtgaacttacaacagttcatacagcagactggaactaaggtgactgtacttccagccgaaccgatcgaaatcgaagcctctcacgcggacatcgagagggaggctcccttccagtccggttctttgaagaggcctggatcgagcagacaactgccctcaaatctacggattttgcagaacccaattagttctggctttaatcctgagggcatttatgtatag

SEQ ID NO: 33030 - DNA, 480 bp, Artificial Sequence
  Description of Artificial Sequence: Synthetic coding sequence
atggagctgaaagtttgggtcgatggtgttcaacggattgtgtgcggggtaactgaggtgacaacttgccaggaagtagtgatcgcattggctcaggctattggtcgtacaggccgttatacccttatcgagaaatggcgggacacagaaagacacctcgcccctcacgaaaatccaataattagcctcaataaatggggccaatatgcatccgacgtgcagctgatactccggagaaccgggcctagtctgtccgaacgcccaaccagcgattctgtggccaggatccctgaaagaacattgtaccgccagagtctgccaccactggccaagctgaggcctcagatcgacaaatccatcaaacggcgggagccgaagaggaaatccttgaccttcacgggcggagccaaaggattaatggacattttcggtaagggcaaggaaacggaatttaaacagaaggtgctgaataattgttag

SEQ ID NO: 33031 - DNA, 2412 bp, Artificial Sequence
  Description of Artificial Sequence: Synthetic coding sequence
atggcaaaacgaagttccctgtatatcagaattgtagaggggaagaatttacctgcgaaggacataacaggcagcagcgatccttattgtatagtaaaagtggacaatgaaccaattatcagaaccgccacggtatggaagactttatgccccttttggggagaggagtaccaagtccatttaccgccaacttttcatgcagtagcattctatgtgatggatgaggatgccttgtcacgggacgacgtgatcgggaaggtgtgtttgacgagggacaccatcgcctctcatcctaaaggatttagtgggtgggcacatctgaccgaggtcgaccccgatgaggaggtgcagggagagattcatcttcgacttgaagtttggcctggcgcaagggcgtgccgtctacgatgctcggttctcgaggcacgtgatctagcccctaaagacaggaacggtaccagcgatcctttcgtcagggtgagatataagggacgaacgagggagactagtatcgtgaaaaagtcctgctatcccaggtggaacgagacgttcgagttcgagcttcaggaaggagccatggaggcattatgcgttgaggcttgggactgggaccttgtgagcaggaatgactttcttggaaaggtggtgatagatgtgcagagactgagagtggtgcagcaggaagagggatggttccggctgcaacccgatcagtctaaatctcggcgtcacgacgagggcaatctggggtccctccagctggaggtgaggctgcgagacgaaacagttctgccctcaagctactaccagcccctggtgcacctgctttgccatgaagtgaaattaggcatgcaagggcccggccagctgatccctcttatcgaggaaacaacctccaccgagtgtaggcaggacgtagcaaccaatcttcttaaattgttcctaggccagggcctggccaaagacttcctggacctcctgtttcaactcgagttgtcgcgcacttccgagacaaacacactcttcagatccaattccctcgccagcaaatccgtagaaagcttcctgaaggtcgcggggatgcagtacctgcatggcgtgctcgggcccattataaacaaagtttttgaggagaagaagtacgtggagctggacccaagtaaagtcgaggttaaggacgtgggatgctctggtctacatcggccccaaaccgaagctgaggttctagaacagagcgctcagaccctgagagcccatctgggggctcttctgtctgcattgagtcggtccgtgagggcctgtcctgccgttgtcagggccacttttaggcagttgttcagacgcgtcagggaacgattccccggggctcaacacgagaatgtgcccttcatagccgtgaccagtttcctctgtttgaggtttttcagcccagcaatcatgtctcctaaactgtttcatctcagggaacgtcacgctgatgcaagaacgagtcgcacacttttattactcgcaaaagccgtccagaacgtggggaacatggacacccccgcatcaagggccaaggaagcctggatggagccacttcagccaacggtacaccaaggcgttgcccaactgaaagatttcatcacgaagctcgtcgatattgaggagaaggacgaacttgacctgcaacggaccctgtccctgcaggcgcctccggtcaaagagggacccctattcatccaccgcaccaagggcaagggcccactgatgtcaagctcatttaaaaagctgtacttttctttgactactgaggcactgtccttcgccaaaactccgagttctaagaagtctgccctgatcaaacttgcaaacatacgggccgcggagaaggtggaagaaaaatccttcggcgggagtcacgttatgcaggtgatatacaccgatgatgcggggcggcctcagaccgcctacctccagtgcaaatgcgtgaatgagctgaatcagtggctatcagctttgcgtaaggtatccattaacaacactgggcttctcgggtcctaccatcctggcgtgtttaggggcgacaaatggagctgctgccaccagaaggagaagactggccaaggttgcgacaagacgcggagtagagtgactctccaagaatggaatgatcccctggatcatgatttagaagctcagctgatctacagacacttattaggagttgaggccatgctctgggagcggcatcgggagttaagcggcggggcggaagccggaaccgtgcctacatctcccggcaaggtgcccgaggactcccttgcgaggctgcttcgggtgctccaggatttaagggaagctcactcatcctcgccggcgggctcaccgcctagcgagccaaactgtctgttagaacttcaaacctag

SEQ ID NO: 33032 - DNA, 2274 bp, Artificial Sequence
  Description of Artificial Sequence: Synthetic coding sequence
atggccaaacgtagcagcctctatataagaatagtcgaggggaagaaccttcctgcaaaagacatcacagggagttcagatccatactgtattgtgaaagtggacaacgagcccatcatccggaccgctacagtttggaagaccctgtgccccttttggggcgaagagtaccaggtgcacctgccgcccacttttcacgccgttgcgttttacgtgatggatgaggacgccctttctcgcgacgatgtcataggcaaagtttgcttgaccagggatactattgccagccacccaaaggggttctccgggtgggcacatctgaccgaagtggaccctgacgaggaagtgcagggcgagatccacctcagattagaagtttggccgggcgccagagcttgcagactgcggtgcagcgtcctagaggccagggacctcgcaccaaaagatagaaacgggacgagtgacccgtttgtgcgcgttaggtacaagggacgcaccagggagacttccatcgtcaagaaaagttgctaccctagatggaacgagacttttgagttcgagctacaggagggtgctatggaagccctctgtgtggaggcctgggactgggatctggtaagtcgcaacgatttcttaggtaaagtagttattgacgtacagcgtctccgtgtggtacagcaggaagagggttggttccggctccagccagatcaatccaagagtagaagacacgatgaggggaatctggggagccttcaactggaggtccgccttagggacgagaccgtcctgccgagcagctactaccaaccacttgtgcatttattgtgtcacgaagtgaaactgggtatgcagggacccgggcagttgattccacttatcgaagaaactacatctacagaatgcaggcaggatgtcgctactaatttgcttaagttgttcctaggccaagggctggcaaaggacttcctggacctgcttttccagctggagctgtcaagaactagcgagacaaacactttgtttaggagcaactcactggcatccaaaagcgtggagtcttttttgaaagtagctggcatgcagtatctccatggcgttctgggcccaattattaacaaggtgttcgaagagaagaagtatgttgagctcgacccatctaaagtcgaggtcaaagacgtggggtgttcaggcctgcataggccccagactgaggctgaggttctggagcagagtgcgcagacgctgcgcgcacatcttggagctctgttgtccgctctgagtcgatctgtcagggcatgtccagctgtcgtgcgtgcaactttcagacaactttttagaagggtgcgggagagattcccgggagcccagcacgaaaatgtcccttttatcgcagttacgtcttttctatgtctccgctttttcagccctgccatcatgtctccaaagctctttcacttaagggaacgccacgccgacgcaaggacttcccgcacgctcctgttactggccaaagctgtccaaaacgttgggaacatggatacccccgcgagcagggctaaggaagcatggatggagccactccagcctacagtccaccagggtgtggctcagttaaaggactttatcactaaactggtggatatcgaggagaaggatgaactggacctgcagagaactcttagtctgcaggccccacctgtaaaagaaggccctctgtttatccacaggaccaaggggaaaggcccattaatgagctcctcatttaagaagctgtattttagtttaacaaccgaagcgttatctttcgccaagacgccaagctccaagtgcgttaacgagctcaatcagtggttaagtgctctgaggaaggtgtccatcaataacacaggactgttgggaagttaccatcctggtgtgttccgaggtgataagtggtcctgttgtcaccagaaagagaaaactgggcaaggctgtgataaaacaaggagcagagtgactctgcaggagtggaatgaccctctcgatcatgacctcgaagcccagctcatctacaggcacttactgggtgtagaggccatgttgtgggaacgacacagagagctgtctggcggcgcagaggccggaaccgtgcccactagcccgggtaaggtgccggaagattcccttgcccgacttctaagggtgttgcaggacctgcgggaggcccactccagttcccccgcaggatctcccccaagcgagcctaattgcctcctggagctgcaaacatag

SEQ ID NO: 33033 - DNA, 3774 bp, Artificial Sequence
  Description of Artificial Sequence: Synthetic coding sequence
atgcagaagggtattcgcctgaacgatggccatgtcgccagtctaggtcttctcgccagaaaagatggaactaggaagggatacctatccaaacgtagcagtgacaacacgaaatggcagacgaagtggttcgctttattgcagaacctgttgttctattttgagagtgattccagttcaagaccgagcggcttgtacctgctggaggggtgcgtgtgtgatagggcaccctcccctaagcccgccctgagcgcaaaagaacccctggagaagcagcattattttaccgtgaatttttcgcatgaaaatcaaaaggcgctggaactccggacagaagacgcgaaggattgcgacgaatgggtggcggctatagcccatgcctcctatcggacattggctacagaacacgaggctctcatgcagaaatatcttcatctactccagattgtcgaaaccgaaaaaaccgttgcaaagcagttgcgccagcagattgaagatggagagattgaaatcgagaggttaaaagcggagatcaccagtctgctgaaagacaatgaacgcattcagtcaactcagacagtagcgcccaacgacgaagactccgatattaaaaagataaagaaggtacaaagcttccttcgcggatggctctgtagacggaagtggaaaacgatcattcaggattacatcaggtccccacacgctgacagcatgcgcaagagaaaccaggtagtattttctatgctcgaggccgaggctgagtatgtccagcagctacatattctcgtgaacaatttcctgagaccccttaggatggcggcctccagtaaaaagcccccgataacacacgatgatgtgagttcaattttcctaaactccgaaaccatcatgtttctccatcagatattttatcaggggctgaaggctcgcatttcttcttggccaaccttagtactcgcggaccttttcgatatactgctgcctatgctcaacatatatcaggaattcgtgcgcaaccaccagtattcattgcagattctggctcactgtaaacagaaccgtgactttgacaaactcttgaagcactatgaagctaaaccagattgtgaggagaggaccctggagacctttctcacataccccatgttccagattccgaggtacatcttgacattacacgagctgctggcccataccccgcacgagcatgtagagcgtaactcactggactacgcaaagtccaagctagaagagcttagtaggatcatgcatgacgaagtgagcgaaactgaaaacattcgcaagaatttagcaattgaaagaatgataatcgagggttgtgagatcctcctcgacacttcccagacttttgtacgccaggggtctttgatccaggtccccatgagtgagaaagggaaaattacacggggcagattaggatccctgtccctaaagaaagagggtgagagacagtgctttctgttctcaaaacacctcattatttgcactcgtggatctggcggcaaactccatctcacaaaaaacggcgttatttctctgatcgattgtacattacttgaagagcctgaatcaactgaggaagaagccaagggctcgggccaggacatcgaccacctagacttcaagataggcgttgagccaaaggactccccgccatttaccgttatcctcgtggcatcctcacgacaggaaaaggccgcctggacctctgacatctctcagtgtgtagacaacatcaggtgtaacggcctcatgatgaatgccttcgaagaaaacagcaaggtgactgtgcctcagatgatcaagagtgatgcaagtctgtactgtgatgatgtggacattcgcttctctaaaactatgaatagctgtaaggtgctccagatcagatacgccagtgttgaaaggttactggagagactcacagatctgagattcctgtcaattgattttctcaataccttccttcattcctatagagtttttaccaccgccattgtagtcttggacaaattgatcaccatctataaaaagccgatcagcgctatacccgctcgctctttagagctcctttttgcatcgggccaaaacaacaagctgctctacggtgagccccccaaatctccgagggcaacccgcaaattttccagtcccccacctttgtctatcactaagactagtagcccgtcaaggcggcgcaagctttccctcaatatccccatcatcaccggcggaaaagcccttgatctcgctgctcttagctgcaactctaatgggtacactagcatgtacagcgctatgagcccgtttagcaaggcaactctcgacactagcaagctgtatgtgtcctcgtcctttacaaacaagattcccgatgaaggagacactacgcctgagaagccagaggaccctagtgccctgtctaaacagtctagcgaagttagcatgagggaggaatccgatatcgaccaaaaccagtccgacgacggggataccgagaccagcccaactaagagcccaacaacacctaagtcggtcaagaacaagaacagctccgaattccccttattttcttataataacggggtagtgatgacatcttgcagagaactcgataacaatcgctctgcactgtccgcggcatctgcgttcgctatagccacagccggtgctaatgaaggtacccccaataaagaaaagtacaggagaatgagtcttgcctcagccggttttccaccggatcaacgtaacggagacaaggagttcgtaataagaagggcagccacaaatcgagtcctgaacgtactgaggcactgggtgtctaaacatagtcaggacttcgaaactaacgatgaactgaagtgtaaggtgattggctttttggaggaggttatgcacgatccagagctgttgacccaagagcgtaaggccgccgcgaatatcattcggaccctgactcaggaggatccgggcgataaccagattactctcgaagaaataacccagatggcagagggggtgaaggctgaaccatttgaaaatcatagtgcccttgaaatagcagaacaactgacacttttagatcatctcgtctttaaaaaaattccctatgaggagttttttggtcaaggctggatgaagctcgaaaagaacgaaagaactccctatattatgaagacaacaaagcacttcaacgatatttcgaacctcatcgcttccgagatcatcagaaacgaggatataaacgcacgcgtatccgccattgagaagtgggtcgccgtcgctgacatttgtagatgcctgcacaactataatgctgtgctggagatcacctcaagtatgaatcgaagcgccatatttaggcttaaaaagacctggctgaaggtgagcaagcaaactaaggccctgatcgataaattacagaagttagtcagttctgaggggaggtttaagaatttgcgggaggcactcaagaactgtgacccaccctgcgtgccatacctcggaatgtatctgacggatctcgctttcatagaggaaggaacacccaactacaccgaagacgggttagtgaacttcagcaagatgcggatgatcagtcatatcatcagagagattcgccagtttcagcaaactgcttacaaaatcgagcatcaggccaaagtgacacagtatctgctggaccaaagctttgtcatggacgaggagtccctgtatgaatcctccctgcgaattgagccaaagctgcctacttag

SEQ ID NO: 33034 - DNA, 1470 bp, Artificial Sequence
  Description of Artificial Sequence: Synthetic coding sequence
atgtattcagccatgtctcctttttctaaggccaccttagacacctccaagctatatgtgtcttcctctttcactaataagatccccgatgagggggacacaacacccgaaaaacccgaggatccttcagccctttctaagcagagcagcgaggtgtcgatgagggaagagtctgatatcgatcagaatcagagcgatgacggggacacggaaacctccccaacaaagtctcccaccacgcctaaatccgtgaagaataagaattctagcgaatttccgctgttcagttataataatggggtcgtcatgacctcatgccgtgaactggataacaacagatccgccctttcagccgcgtcagctttcgccattgctactgctggagctaacgaaggcacaccaaataaagagaagtatagacgaatgtctttagcttccgccggattccccccagatcagaggaacggtgataaggaatttgtgatacgcagggcagccacaaatcgtgtcctgaacgttctccggcactgggttagtaagcactcccaggacttcgagaccaacgacgaactcaaatgcaaagtgatagggttcttggaagaagtgatgcatgaccctgagctcctgacccaagagaggaaagcggccgccaatattatcagaaccctgacccaagaggaccccggcgacaatcagattactttagaagagatcacacaaatggccgagggggtcaaggcagaaccatttgaaaatcacagcgcattagaaattgcagaacagctcacactcctggatcatcttgtattcaaaaagattccctatgaagagttttttgggcagggttggatgaaactggagaagaacgagcgcactccctatatcatgaagaccaccaaacacttcaatgacattagtaacttgattgcctccgagatcataagaaacgaagacattaatgctcgggttagcgcgattgagaagtgggtggccgtggcagatatttgcaggtgcctgcacaactacaacgccgtgctggagatcacctcctccatgaacagatcggctatcttcagattgaagaagacttggctgaaggtgtctaagcagacaaaggcattaatcgacaagttgcagaagcttgtgtcttcagagggcagattcaaaaaccttcgcgaggccctaaaaaactgtgatccaccttgcgtgccttaccttggaatgtatctgacggaccttgccttcatcgaagagggaacacccaactacaccgaagacgggcttgtgaacttttccaagatgcgtatgattagccacatcatcagggagatccggcagttccagcagactgcttacaagattgagcatcaagccaaagttacccagtatcttcttgaccaatcatttgtgatggatgaagagtccctttatgagagcagcctgcgcatcgagccgaagctgccaacctag

SEQ ID NO: 33035 - DNA, 3822 bp, Artificial Sequence
  Description of Artificial Sequence: Synthetic coding sequence
atgcagaaaggcatcagactgaacgatggtcatgtggcttctttaggcctgctcgcccgcaaagacggaacccgtaaaggatatctcagcaagcggtcctctgataacacaaaatggcagacaaaatggtttgccttgctccaaaatctgctgttttatttcgagagcgatagttcctctaggccaagcggactatatctgcttgagggctgcgtgtgcgatcgggccccctctccgaaaccagctctcagcgccaaggaacccctcgagaaacagcactacttcacagtgaactttagccacgagaaccaaaaagcactggagctgcgaacggaagacgcgaaggactgtgatgaatgggtagcggcaatagcccacgcttcctacagaacgcttgcaaccgaacatgaggccctgatgcagaagtatctgcatttgctgcagattgttgaaactgaaaagactgtagctaagcagctgcggcagcaaatcgaggacggggagatagagatcgaacgcctgaaagccgaaattacatctctgcttaaagataatgaacgcatccagagcacccagactgtggctcctaatgacgaggattcagatataaagaagattaaaaaagtgcagtcttttctccggggatggctctgtaggaggaagtggaaaaccatcatccaggattacattcgttccccccatgccgacagcatgcgaaaacgaaatcaggtcgtcttctcaatgctggaagccgaagccgagtatgtccaacagctgcacattcttgtgaataattttctacgcccactccggatggcagcgagcagcaagaaaccacccataacccacgacgatgtatcgtccatctttcttaattccgagacaattatgtttctccaccagatattttaccaaggcctgaaggctagaatctcctcctggcctacactggttttggctgatctgtttgatatcttgttgcctatgctgaatatctaccaggagtttgtgagaaatcatcaatacagcctccagatcctggctcactgcaaacagaacagagattttgacaaactgctaaagcattacgaggccaagcccgactgcgaagagcggacgctcgaaactttcctgacatacccaatgtttcagatccctagatatatcctgaccctacacgagctcctggctcataccccccatgaacatgtcgagcgaaattcattggactacgccaagtctaagctcgaagagctatccaggattatgcacgacgaggtgtctgagaccgaaaacatccggaaaaacttggcaattgaaaggatgatcatcgaggggtgtgagatattgctcgacacctcccagaccttcgtgcgtcagggatctctcatccaggtaccaatgtctgaaaaaggcaagataacgagggggaggctggggtcactgtcgctgaagaaggagggggagaggcagtgctttctgtttagcaaacatttaatcatctgcaccagaggcagtggaggcaagcttcatttaactaagaacggagtcatctccctgattgactgtacactgctggaagaacccgaatccaccgaggaggaagcgaaggggtcaggtcaggacatcgaccacctcgacttcaagataggagtggagccaaaagacagccccccatttacagtgatcttagtcgcctcttcccgccaggagaaagccgcgtggacttctgatatttcccagtgcgtggataatatccgctgcaatggccttatgatgaacgctttcgaggaaaactcaaaggtgaccgttcctcagatgattaagcggacccgagagggcaccagagaagcggagatgtccaggagtgacgcctcactgtactgcgacgatgttgacatcagattttcaaagacgatgaattcatgcaaagttctccagataagatacgcgagcgtcgagcgccttcttgagaggctgactgatctcagattcctttcaattgacttcctcaacaccttcctgcacagttacagagtttttactacagcaatagtggtacttgacaaactcatcaccatctataaaaagcccatctctgctatccctgctcgttggctgaggagtcttgaactgctgtttgcttcagggcagaacaataaactgttgtatggtgagccacctaaatctcccagggctactcgaaagttctcaagtccccctccactatccatcacaaagacctcttcaccatccaggcgcaggaagcttagcctaaatataccaataataactggcggtaaggccttggaccttgctgcgctcagttgcaattccaacggctatacctcgatgtactcagcgatgagcccttttagcaaggctaccctggacacttcaaaattatatgtctccagcagcttcaccaacaagatccccgacgagggggatacaacccctgagaaaccagaagatcccagcgcactgtcaaagcagtcaagcgaagtctccatgcgcgaggagtctgatatcgatcaaaatcaatctgacgacggcgatactgagacttcacctactaagtccccaaccacccccaagtccgtgaagaataagaattcctcagaattccccctgttctcatacaataacggggtagtcatgacatcatgtcgtgagctagacaacaaccgaagcgcattaagtgccgctagtgcgttcgctatagcaactgctggcgcaaacgaggggactccaaataaggagaagtaccgtcgaatgtcactggcgtcggctggctttccacctgatcagcgaaacggggataaggaatttgtcatcaggagagccgccactaatcgcgtcctgaacgttctacggcattgggtgagtaagcacagtcaagactttgaaactaacgacgagttgaagtgtaaagtcatcgggttcttagaggaggtgatgcacgatcccgagttgctcacacaagagcgaaaggccgcagctaacattattagaactctcacccaggaggaccctggagacaatcagatcactttagaagagatcacgcagatggcggagggagtcaaggccgagccttttgagaatcattccgccctggaaatcgctgaacagcttacattgctggaccacttggtgttcaagaaaatcccatatgaggagttctttgggcagggctggatgaaacttgagaaaaatgagaggacgccctatatcatgaagactacgaagcatttcaacgatatctctaatctgatcgccagtgagattatcagaaacgaagatattaatgcgcgggtgtctgcaatcgagaaatgggtggcagtcgccgatatttgtcgatgccttcataattacaatgcagtgcttgagattacaagtagtatgaaccgatctgcaatctttaggctcaagaaaacttggttgaaagtatcgaaacaaaccaaggcactgattgataagctgcagaaactcgtctcctctgaaggtcgatttaaaaatctgagggaagccctcaagaattgcgacccgccttgcgtgccatacctgggtatgtacctgacagacctggccttcattgaggaggggaccccaaactacaccgaagacggccttgtgaacttctccaagatgcgtatgataagtcatatcattcgggagattagacaattccagcagactgcctacaaaattgagcaccaagctaaagtgacacaatacctgcttgaccaatcgtttgttatggacgaggagtccctatatgagagctccttgaggattgaacccaagctgcctacttag

SEQ ID NO: 33036 - DNA, 3783 bp, Artificial Sequence
  Description of Artificial Sequence: Synthetic coding sequence
atgcagaagggcattcgtcttaacgacgggcacgtcgccagtctggggcttctggcccgtaaagatgggacaaggaaaggctatctgtctaaaagatcatcggataatacaaaatggcaaacaaaatggtttgcactgctacagaacttactattttattttgaatccgacagctctagcagaccgtctgggctgtacctgctagagggctgcgtttgcgacagagcaccttcaccgaaacccgctcttagcgcgaaggaaccgcttgaaaaacagcactatttcactgtcaatttctcgcatgagaatcagaaagccttagaattacgcacagaagatgccaaagactgcgatgagtgggtggcggcaatcgcccacgcatcttatcggactctcgcaactgaacacgaggcccttatgcagaagtacctgcaccttctgcaaatcgtggagacggagaagaccgtagcaaaacagctccggcagcaaatcgaagacggggaaatcgagattgagcgactgaaggccgagatcacaagccttctgaaagataatgaaagaattcagtctacccagacggtggcccctaatgacgaggactccgacattaagaaaattaaaaaagttcagtcttttcttcgtggatggttgtgcagacgcaagtggaaaaccattattcaggattacataaggagtcctcacgcagactccatgcggaagagaaaccaagtggtcttctcgatgttagaggcagaagccgagtacgtgcagcagctgcatattttagtgaacaactttctcagaccgctgcggatggccgcttcaagcaaaaaacccccaatcacccacgacgatgtatcgagcattttcctgaactccgaaacaattatgttcctgcatcagattttctatcagggacttaaggctagaataagcagttggcccacgctggtgttggccgacctcttcgacatcctgctgcctatgcttaacatttatcaggaattcgtccgcaaccaccagtactccttgcagattctcgctcactgtaaacagaatagggatttcgataagctcctgaaacattatgaagccaagccagactgcgaggaacggacgcttgagaccttcttgacttatcctatgttccagataccgaggtacatcttgaccctgcatgagctcctcgctcacacgcctcacgaacacgttgagcggaattctctcgactatgctaaaagtaagttggaggagctctctcgcattatgcacgacgaagtctctgagacggagaacattagaaagaacctggccatcgagcgcatgattatagagggatgcgaaattctccttgacaccagtcagacctttgtccgccaggggagcctgatccaggtccccatgagcgaaaaagggaagataacccgaggccggctaggctctctaagtctcaagaaggagggggaaaggcagtgttttctgttttctaaacaccttattatctgtacaagaggctccggaggtaaactccatcttacaaagaacggagtgatctctttgatagattgtacgctgcttgaggagcctgaaagcaccgaagaggaagcaaagggaagcggccaggatatcgaccacctggatttcaagatcggagtggagcccaaggacagtccaccattcacagtcatcctcgtggcttccagccgacaggaaaaagcggcatggacttccgacatcagccagtgtgtggacaatattagatgtaatggccttatgatgaacgccttcgaagaaaatagcaaagtaactgtaccacaaatgattaagtctgatgcgagtttatactgcgatgatgtcgatattaggttttccaagacaatgaatagttgtaaggtgctacagatccggtacgcatccgtggaacggctgcttgagagattgactgacctgcggttcctgagcatcgacttcttgaacacttttttacattcctacagagtgttcaccactgccattgtagtgctggacaaactaatcactatttacaagaaacccatttctgcgattcctgccagatggcttcggagtctggaactcctgtttgcctccgggcagaacaataagctactctacggcgagcccccaaaaagtcctagagccacccgtaaattctcctctccgcccccgctttctatcactaagacctcaagcccgtcgcggaggcgtaaactctcactcaatattcccatcatcaccgggggcaaagcactcgacctggccgccctatcatgcaacagcaatggctatacctctatgtattccgccatgagcccgttctccaaagcaaccttggatacatccaaactgtacgtgtcttcctctttcactaacaagattccagatgagggggacaccacaccagagaagcccgaagatccatccgcattgtctaagcagagctccgaggtcagtatgagggaggagagcgacattgaccagaaccagtcggatgatggtgatactgaaactagcccaaccaagagccctaccactcctaaatctgtaaaaaacaagaactcatcagagtttcccctgttttcctacaataatggggtagtgatgacctcttgcagagaattggacaataaccgttccgctctgagcgccgctagtgcatttgctatcgccaccgctggagctaacgagggaactcctaataaggagaagtaccgaaggatgtcacttgcttccgctgggttccctccagatcagaggaatggcgacaaggaatttgtgatacgcagggccgcaacaaaccgcgttctgaacgttttgcgacattgggtgtcaaagcacagtcaggactttgaaaccaacgacgagctcaagtgcaaggtaattggatttcttgaagaggtgatgcacgaccccgagcttctgacacaagagcgcaaggctgccgctaatatcattcgaaccttaacccaggaggatcccggcgataaccagattaccctggaggagattactcagatggccgagggcgtcaaagccgagccatttgagaatcattctgctcttgaaattgccgagcagctgaccctgctggatcacctggtcttcaagaagatcccttacgaagaatttttcggtcagggttggatgaaactagaaaagaatgagcgcacaccttatattatgaaaacaacaaaacacttcaatgatatttccaatttaattgcatccgagatcattcggaacgaagacattaatgcgagggtgtcggcgattgaaaagtgggtggccgtggcggatatctgcagatgtctgcacaattacaacgctgtgcttgagattacctcgtccatgaacaggtccgctattttccggttgaaaaaaacctggctgaaagtgtccaagcagacgaaagccttgattgataagctgcagaaattggtgtcctccgaaggtcgctttaagaacctgcgcgaagccctgaagaactgcgatcctccttgtgtcccttatctaggcatgtatttgaccgacctggccttcatcgaggaagggacaccaaattacacggaggacggactcgtcaacttctctaaaatgcggatgatctcccatataatcagagagattcgccaatttcagcaaacagcttataagatcgagcatcaagccaaggtcacacagtacctacttgaccagtcttttgtgatggatgaggaatcgctatatgagagttctttgagaatagaacctaagctccccacttag

SEQ ID NO: 33037 - DNA, 1470 bp, Artificial Sequence
  Description of Artificial Sequence: Synthetic coding sequence
atgtttctggagcctcaggagacaatgccacagaccagcgttgtgttctcctcaatactgggaccgagttgctctggtcaggtccaacccggcatgggggaaaggggcggaggcgctggcgggggatccggagatttgatttttcaagatggtcatctcatctctggcagtcttgaggcattaatggagcatcttgtgccgacagtggattattatcccgataggacttacatttttactttcctcctgtcctccagggtgtttatgccccctcacgacctcctggcgcgtgtgggtcagatctgcgtagagcaaaagcagcaactggaagcgggaccagaaaaggctaagttgaaaagttttagtgccaaaatagtgcagctgttgaaagaatggaccgaagccttcccctacgatttccaggatgagaaagcaatggctgagctgaaggccatcactcacagggttactcaatgtgacgaggagaatggcaccgtgaagaaggctattgcccagatgactcagagtctgctcttgtcactcgccgctcggtctcaattgcaagaactgcgggaaaaattgaggccacctgcagtggataaagggcccatcctgaaaacgaaacctcctgctgcgcagaaggacatcctgggggtgtgttgcgaccccttggttctggctcagcaactcactcacattgaacttgatcgcgtctccagtatatatcctgaagacctgatgcagattgtgagccatatggatagcctagataatcatagatgtaggggcgacctgaccaagacttactcgcttgaggcctacgacaactggttcaattgtttgtccatgttggtggccactgaagtctgccgcgtggtaaagaagaaacaccggacccgaatgcttgagttctttatcgatgtagcccgagagtgtttcaatattgggaatttcaattctatgatggctatcatatctggcatgaacctgtcccctgtggctcgcctgaagaagacatggtcaaaggtcaagacggctaaatttgacgtcttagagcaccacatggacccatcttcaaatttttgcaattaccggacagcgctgcagggagctacacagcggagccagatggctaacagtagcagagaaaaaatagtgatccccgtgttcaacctgtttgtgaaagatatttactttctccacaagattcacaccaaccatctgcccaatggacacatcaatttcaagaagttctgggagatttccaggcaaattcacgagtttatgacctggacccaggtggaatgccccttcgagaaagacaaaaaaatccagtcgtatctcctgaccgctccaatctacagcgaggaggccctgttcgtggcctcctttgaatccgaagggccggagaaccacatggaaaaagactcttggaagacccttcggaccacacttctgaatagagcctag

SEQ ID NO: 33038 - DNA, 1446 bp, Artificial Sequence
  Description of Artificial Sequence: Synthetic coding sequence
atgcctcagacttccgtagtcttctcttctattcttgggccatcttgtagtggacaggttcagcccggtatgggcgagcgagggggcggcgccgggggcgggagcggagacctcatctttcaagatggacacctcatctcaggatctcttgaggccctgatggaacatctagttccaaccgtggattactaccccgatagaacttatatcttcacatttctcctgagtagccgtgtattcatgccaccccatgacctgcttgcaagagtggggcaaatctgcgttgagcagaaacagcagctggaggcagggccagagaaagccaagctgaaatcattctccgccaagattgtgcagctgcttaaagagtggacggaggccttcccatatgactttcaggacgagaaggcaatggctgaactgaaagctattactcatcgagtcactcagtgcgatgaggagaacggcactgttaagaaggctatcgcccaaatgacacagtctctgctgctgtccctcgctgcgagaagccagctgcaggagctccgggagaagttgagaccacccgccgtggacaaggggcctatcttaaagaccaagcccccagccgcacagaaagacatcctaggagtgtgctgcgacccactggtccttgcgcagcagctgactcacatagagctcgatcgggtgagctcaatctatcctgaagacttgatgcagatcgtgagtcatatggacagcttggataatcacagatgccggggcgatttaacgaaaacctacagtctcgaggcctatgacaattggttcaattgcctgtcgatgctagttgcaacggaagtgtgcagggtggtcaagaagaagcataggacacgaatgctggagtttttcattgatgttgcccgggagtgttttaatattggaaattttaactccatgatggcaatcattagcggaatgaacctgtctcccgtggcacgtctgaagaaaacatggagtaaggtgaagaccgccaaatttgatgtgctggagcaccacatggatccaagcagtaatttttgtaactatcggaccgcactgcaaggagcaactcagcgatcccagatggccaactcttcgcgggaaaagatcgtgatccctgtattcaatctctttgtgaaggatatctactttctccacaaaatccacacaaatcatctgccaaatggccatatcaattttaaaaagttctgggagattagccggcagattcacgagttcatgacctggacacaggtcgagtgccctttcgaaaaagacaagaagatccagagctacctcctaaccgcacctatctacagtgaggaggccctgtttgtggctagttttgagagcgaaggccccgagaaccatatggagaaggactcttggaaaaccctcaggacgaccctgctgaaccgcgcctag

SEQ ID NO: 33039 - DNA, 1446 bp, Artificial Sequence
  Description of Artificial Sequence: Synthetic coding sequence
atgcctcagacttcagttgtgttcagctccattcttggtccttcctgctctggccaggtccaacccgggatgggcgagcgcggagggggagctggtgggggctctggggatctcatctttcaggatgggcatttaatcagcggctctctagaagccctgatggagcacttggtccccacagtcgattactaccccgataggacgtatatttttacattccttttgtccagcagagtctttatgccaccccacgatttactggcaagggtcggacaaatttgcgtggaacagaaacagcaattggaagcaggtccagaaaaagccaaactgaagtccttttctgccaagatcgttcaacttcttaaggaatggacagaagcctttccttacgacttccaggatgaaaaggccatggcagagttgaaggctatcacacaccgtgttactcagtgcgatgaagaaaacgggacagtgaagaaggccattgcccagatgactcaatctctcttgctgagtcttgccgcacggtctcagctgcaagaactgagggaaaaactccggcccccagccgtagacaagggccctatcttgaagacaaagccacccgcggctcaaaaggacatcctgggggtctgctgtgacccactggtgcttgctcagcaactaacacatatcgaactcgaccgtgtatcctctatttaccctgaagacttaatgcaaatcgtgagtcatatggactccctggacaatcaccggtgtaggggggacctgacaaagacctattccctcgaggcgtacgacaactggttcaattgtctgagcatgcttgtcgccacagaggtatgcagggtcgtcaagaaaaaacatcgcacacggatgctcgaattttttatcgacgtcgccagagagtgcttcaatattggtaacttcaattctatgatggccattatcagtggaatgaacctctcaccagtggctcggctgaaaaagacgtggtcaaaggtcaaaacggctaaatttgatgtgttggaacatcacatggacccatccagtaacttttgcaactaccgtacagctctgcaaggggccacccaaagaagtcaaatggcaaacagctctcgagagaaaatcgtgataccagtcttcaatttgtttgtgaaggatatatatttcttacacaaaatacacacgaatcatttgccgaacggccatataaactttaagaagttctgggagatcagtaggcagattcatgagttcatgacatggacccaggttgaatgtccatttgagaaggacaagaaaatccagtcttatctcctgaccgcaccgatctacagcgaggaagcactttttgtggcctcattcgagagcgagggaccagaaaatcacatggagaaggattcctggaagactctaagaactaccttactgaaccgagcttag

SEQ ID NO: 33040 - DNA, 1422 bp, Artificial Sequence
  Description of Artificial Sequence: Synthetic coding sequence
atgccccagacaccaccattttctgctatgttcgatagtagcggttataacaggaacctttaccagagcgcggaggactcgtgtgggggcctgtactaccacgacaataatttgttatcagggtcgctcgaagctcttatccagcatcttgttcctaatgtggattattatcccgatcggacctatatttttacctttctgctgtcatcccgtctgttcatgcacccttacgagctgatggccaaggtttgtcacctgtgtgtagagcaccaaaggctgagtgacccagatagcgacaaaaaccagatgaggaaaattgcccctaagatcctgcagttgctgaccgaatggaccgaaaccttcccgtatgattttcgagacgagcggatgatgcgaaacttgaaggacttggcccatcgtattgctagcggagaagaacagacataccgcaagaacgtgcagcagatgatgcagtgtttaatcaggaagctggcagctttgtcccaatatgaagaagttttggccaagatttcttccacttccacagacaggctaacagtgcttaaaactaaacctcagagcattcagcgagatatcatcacggtgtgcaacgacccttacaccttggctcagcaacttactcacatcgagctggagaggctgaactatatcggtcctgaggaattcgtacaggcgtttgtgcagaaggacccgttggacaatgacaagtcgtgctatagtgagaggaagaaaacgaggaacctggaagcctacgtagaatggttcaatagattatcctacctggttgccaccgaaatctgcatgccagtgaagaaaaagcatcgcgctagaatgatcgagtatttcattgatgtggcacgtgagtgcttcaacattggcaactttaatagtttgatggccattatttctgggatgaatatgtcacctgtatctagactcaaaaagacatgggcaaaggtcaagacagctaagttcgacatccttgaacatcagatggatccttcaagcaacttttacaactacagaaccgcgcttaggggggcggcacaacggagccttacagctcatagtagcagagaaaagattgtgattcccttcttctcactcctaatcaaggacatctattttctcaatgaaggctgcgctaaccgtttgcccaacggccacgtcaactttgaaaagttctgggaacttgcgaagcaggtgtcagagtttatgacgtggaaacaagtcgagtgccccttcgaacgtgatagaaagatactccagtacctccttacagtacctgtgttcagtgaggacgccctatacttagcttcatatgagagcgaaggccccgaaaaccatatcgagaaggaccggtggaagtctctgagatcctcactgttagggcgcgtgtag

SEQ ID NO: 33041 - DNA, 1296 bp, Artificial Sequence
  Description of Artificial Sequence: Synthetic coding sequence
atgccgcagaccccaccatttagcgccatgtttgattcctccggctacaacaggaacctgtaccagtccgctgaagatagctgcgggggcctgtactatcatgataacaatctactgtccggctccctcgaagcactcatccaacatctggttcccaatgtcgactactaccctgataatcaaatgcgaaaaatcgcgccgaaaatcttacaactgctgactgaatggacagaaacatttccttatgatttccgggatgaacggatgatgcggaacctaaaggatctcgcacataggatagcttcgggtgaggagacctatcgaaaaaatgtgcagcaaatgatgcagtgcctgattagaaagctggctgctctatcacagtacgaagaagtactggcaaagatctcctcaacatcaaccgatcggctaacagttcttaaaacgaaaccgcagtcaattcagagagacataataacggtgtgcaacgacccatatacactggcacaacagctcacccatatcgagctggagagactgaactacatcggccccgaggaatttgtgcaagcatttgtgcagaaggatccgcttgataatgataaatcatgttatagcgagcgcaagaagacccgtaacttggaagcctacgtcgagtggtttaacagattgtcatatctcgtcgctaccgagatttgtatgccagtcaagaagaaacaccgggcccggatgattgaatactttatcgatgtggctcgcgagtgttttaatattggcaactttaacagcctgatggccattatctccgggatgaacatgtcacctgtgagccgactgaagaaaacgtgggccaaggttaagacggccaaatttgacatcctggagcaccagatggatccttctagcaatttttataattatcgaacagcacttagaggagctgcgcaaaggtctcttacagcacactcatcacgtgagaaaatagtcatcccattcttctctctgctcataaaagacatttacttccttaacgagggatgcgcaaacagacttcctaacgggcacgtgaacttcgaaaagttctgggagctagcaaaacaagtgtcagaattcatgacgtggaaacaagttgagtgtccctttgagagagaccgaaaaatattacagtacctgctgaccgtccctgttttctcagaggatgccctctacctggcatcttacgaatcagaaggtcccgaaaaccatatcgagaaagatagatggaaaagtcttcggtcgtccctcctgggccgagtttag

SEQ ID NO: 33042 - DNA, 633 bp, Artificial Sequence
  Description of Artificial Sequence: Synthetic coding sequence
atgccccaaacaccaccgttttcagctatgttcgattctagtggatacaataggaacctttaccagagcgccgaggactcctgtggaggcctgtactaccatgataataacctcctttcggggagcctagaagccctgattcagcacctggtgccaaacgtggattattatccggaccgcacatacatctttaccttcctgctgtctagccgattgttcatgcacccttacgagcttatggctaaggtgtgtcatctttgtgtggaacatcagaggctcagtgaccccgattcagataagaatcagatgcgcaagatcgctccaaagatcttacaactgttgacagaatggacagaaacgttcccttatgatttccgtgatgaacggatgatgcgaaaccttaaggatctcgcccaccgcatcgccagcggggaggaggtggggaacctgaacctcgcaaggctactggaattccctggaagagcatgggttggtaatggagcggaactctgcatcttgatttcgaccgcttcctccctgttctgcctgtgggcctctccccctcatcacatcctcgtgtacctagtgtgtcaggtgcgtatgattattcccagccattttaaggggatttag

SEQ ID NO: 33043 - DNA, 633 bp, Artificial Sequence
  Description of Artificial Sequence: Synthetic coding sequence
atgccccagacaccaccgttttccgcaatgttcgactcttccggctacaataggaatttataccaatctgccgaggattcatgcggaggcttatattaccatgacaataacctactatctgggtctctggaggctctgattcagcacttagtcccaaacgtagattattaccccgatcgcacctatattttcacgttcctgctgagttcccggctgtttatgcatccatatgagttaatggccaaggtgtgccacctctgtgtggagcaccaaaggctcagtgaccccgactccgacaagaaccaaatgcgaaaaattgcaccaaaaattttgcagttactgaccgagtggacagaaacctttccctacgatttcagggatgaacgcatgatgcgaaacctaaaagatctggcacacagaatcgcaagtggtgaggaagtgggaaacctgaatctggcccgccttctagagtttccaggacgagcttgggtcggaaatggagctgagttgtgtatcttaattagtaccgcttcgtctctcttctgtctgtgggcttcaccccctcatcacattttggtctacctcgtatgccaggtacggatgattattccatcgcattttaagggtatttag

SEQ ID NO: 33044 - DNA, 1419 bp, Artificial Sequence
  Description of Artificial Sequence: Synthetic coding sequence
atgccacaaacacccccattcagcgccatgtttgatagctcaggatacaaccggaatctctatcaaagcgccgaagactcctgcggtggtctctactatcacgacaacaaccttttgtctggtagcttagaagcactaatccagcacctggtaccaaacgtggattattatccagatagaacctatatctttacattccttcttagttcaagactgttcatgcacccctacgagctaatggccaaggtctgccacttatgtgttgagcatcaacgcctgagcgatcccgacagtgataaaaaccaaatgcgcaagattgccccaaaaatactgcagctcctgacagaatggactgaaacattcccttatgatttcagagacgagcgcatgatgcgtaacctcaaggatctcgcccatagaatagcttctggagaagagacctacagaaaaaacgtgcagcagatgatgcagtgcctaatacgtaaactggcagcgctgagccagtatgaggaggtgttggccaagatttccagcacatcaacagataggctcaccgtcctgaagaccaagccgcagagtattcagcgggatatcatcaccgtgtgcaacgacccatacacccttgcccagcagctcacacacattgaactggaacgcttaaactatataggcccagaggagttcgtgcaagccttcgtgcagaaggaccctctggataatgacaagtcctgttactcagaacggaagaaaactcgaaacctggaagcttatgtagagtggttcaatagattgtcttacctggtcgccacagaaatctgtatgcctgtgaagaagaaacatagggcaaggatgatagaatacttcattgatgtggcccgggagtgttttaacatcggtaacttcaatagcctcatggccattatcagtgggatgaacatgagccccgtgagccggctgaaaaaaacctgggcaaaggtgaagacagcaaaattcgatatcctggaacatcagatggacccaagtagcaatttttacaactatcgaaccgccctgcgaggggcggcccaacggtctcttactgcccacagcagcagggagaaaatcgtcatcccattttttagtctgctgataaaagacatctacttcctaaatgagggttgtgcgaatcgactccccaacgggcatgtgaattttgaaaagttttgggagctggccaagcaggtgtcggaatttatgacttggaaacaggtggaatgtccctttgaacgggaccggaagatcctccagtatctcctgactgtgccagtgttctcggaagacgcactgtatctggcgtcttatgagagtgaggggccagaaaaccatatcgagaaggatcgctggaaatcgctccggtcttctctgctggggcgagtgtag

SEQ ID NO: 33045 - DNA, 1401 bp, Artificial Sequence
  Description of Artificial Sequence: Synthetic coding sequence
atgccacaaaccctgagtgcaagtgacatggttactcctgggagcttgtctcctccaccgacagagcccacggatggagaacaggccggccaacctcttttggatggagcccccagttctgcatccctggaaactctaatccaacacctcgtgccgaccgccgattactaccccgagaaggcttacatattcacctttctgctgtcttctcggttatttattgagcccagagaattgctggccagggtgtgtcatctatgtatagagcagcagcaattggataagccggtgctggataaagccagggtgagaaaatttggaccaaaattattgcagctgctggcggaatggactgaaaccttcccaagagactttcaggaggagagcaccatcggacatcttaaagatgtcgtgggccggattgccccatgtgatgaagcctatagaaaaaggatgcaccagcttctgcaagcactgcaccagaaactggccgccctcagacagggaccagagggcctggtcggcgcagataaacccattagctatcggaccaagccacctgcatctatccatcgtgagctgctgggcgtctgttccgatccctataccctggctcagcagctgacccacgtcgagttagagaggttgcggcatatcgggccagaggagtttgtgcaggcctttgtgaataaggaccctcttgccagcactaaaccctgttttagcgacaagacatctaaccttgaagcttatgttaagtggttcaatcgactgtgctacttagtcgcaacggagatctgcatgcctgccaaaaagaagcaacgtgctcaggtgatcgaattttttatcgatgtcgcacgcgaatgttttaacatcgggaattttaattccctgatggcgattattagcggcatgaatatgagtcccgtttctaggctcaaaaagacgtgggcaaaggtaaggacagccaagttttttatcctggagcatcagatggacccaactggaaacttctgtaactataggactgcgctgcggggggccgctcatcgctccctgactgcccattccagtagggaaaagatcgtgataccatttttttctttgctgatcaaggacatctatttcctgaatgagggatgtgccaaccgcctgcccaatggacatgtcaactttgaaaaattcctggagctcgccaaacaagtgggggaattcattacctggaagcaggttgaatgtccgttcgaacaggatgcgtctatcacccactatttgtatacagccccaatattctctgaagatggcttgtacctggcgtcatacgaatccgagagtccagaaaatcaaaccgagaaagagaggtggaaagccttacggagctctatcctcggcaaaacgtag

SEQ ID NO: 33046 - DNA, 1401 bp, Artificial Sequence
  Description of Artificial Sequence: Synthetic coding sequence
atgcctcagacactatctgcttccgatatggtcactccagggtcactctcaccgcctccaacagagcccaccgatggcgagcaggcaggccagccgctgttggacggcgcaccctcatctgcgtccctcgagacactgattcagcacttggtcccaacagctgattattatcctgagaaagcttacatcttcacatttctcctatcaagcaggctattcatcgagccgagggaacttctggccagggtctgccatctctgcatcgagcaacaacaactcgacaaacccgtcctcgacaaggcaagagtgcggaagtttggtcccaaacttcttcagctcctcgctgaatggacagaaacgttccctagggactttcaggaagagagcaccatcggtcacttgaaggacgttgtggggcgtatcgctccttgtgatgaggcctaccgaaaacggatgcaccaactgttgcaggccctgcaccagaagctcgccgctttgaggcaggggcctgaaggtctggtaggcgccgataaacccatctcatacagaactaagccgcccgcaagtattcaccgcgaactgctaggggtctgttctgatccctacacacttgctcaacagctgacacatgtggagctggaaaggctgaggcacattgggccagaggagtttgtgcaggccttcgttaacaaggacccacttgcatccaccaaaccctgcttctcggacaaaactagcaacctggaagcatacgtgaagtggttcaatcgcctgtgctacttggtggcgacagaaatttgtatgccggcaaaaaagaagcaacgggcccaggtaatcgaattcttcattgacgttgcgcgcgaatgtttcaatattggcaatttcaactcactgatggcaattatctcaggaatgaacatgtccccagtttcccgcctgaaaaagacatgggccaaggtgagaaccgccaaattctttatcttggagcatcaaatggatcctactggaaatttttgcaactatagaacagccttgcgtggagccgctcaccggagcctgactgcacactcatcccgcgagaaaatagtcatccccttcttctcgttactcattaaagacatttacttcttgaatgaaggttgtgccaatcggctgccgaatgggcacgtgaactttgagaagtttctggaacttgctaaacaggtgggcgagtttataacatggaaacaagtcgagtgtccctttgaacaagatgccagcataacgcattatttgtacacagcaccgattttttcagaggatggactctacctcgctagttatgaatccgaatctcccgaaaatcagacagaaaaggaacgctggaaagccctacggagctctatcctgggaaagacttag

SEQ ID NO: 33047 - DNA, 1170 bp, Artificial Sequence
  Description of Artificial Sequence: Synthetic coding sequence
atgagagtcctagttagacggtgttggggtccccctctggcccacggcgcccggcgcgggaggccttccccccagtggagggcgctggcaagattaggttgggaggattgtagggactctcgcgttagagaaaaacccccttggagagttcttttttttggtaccgaccagtttgcgcgtgaggccttgcgggcccttcatgcggcaagagaaaacaaggaagaggagctgattgacaagctggaggtcgtgacaatgcccagtcctagccctaagggcctgccagttaagcagtacgccgtccagtcgcagctgcctgtttacgaatggccggacgttggcagtggcgaatatgacgtgggcgtggtggccagtttcggcagactcctaaacgaagccttgatactgaaattcccatacgggatattgaatgtgcacccttcgtgcctgccacggtggcgcggccccgcacccgttattcatactgtgctccatggggatactgtaaccggagtgacgattatgcagatccggcctaagcggtttgatgttggacccatcctcaagcaagagactgtgccagtgccaccgaaaagcactgccaaagagctggaagcagtgttaagccgacttggcgcgaacatgctgatcagcgtgctgaaaaacctgccagaaagtctctctaacggtcgacagcagccaatggaaggagctacatatgcacctaagatttccgccggaacctcatgcataaagtgggaggaacagacaagcgagcaaatctttcggctatatcgggctatagggaacatcattccactccagacactgtggatggccaatactattaaactgctcgacctggtggaggtcaacagctcagtgctggctgacccaaagctgaccgggcaggcccttatccccggctccgtcatataccataaacaatcccagatacttctggtgtattgcaaagatggttggattggcgttcggtctgtaatgttgaaaaagagcctgaccgcaacggatttctacaatggctacctgcacccgtggtatcagaaaaactcccaagcacagccatcacagtgtaggtttcaaactcttcgccttcccaccaagaaaaagcagaagaaaacagtggctatgcaacagtgcatagagtag

SEQ ID NO: 33048 - DNA, 744 bp, Artificial Sequence
  Description of Artificial Sequence: Synthetic coding sequence
atgtcttccgtcttcggaaagccccgggctggatcagggccccagtcagctcctttggaggtcaatttagcgattttaggacgccgaggcgcaggcaagagtgaagatacgtactcttcagaggaaacagtggaccatcagcccgtacatctgagggtgatggataccgcggaccttgatacgccacgcaactgcgagcggtacctgaattgggcccacgcctttttagttgtgtattctgtggattcgcggcagtcatttgactcatctagttcatacttagagcttctggcactgcacgcgaaagagacgcagcggtcaatccctgctctgctgctcggcaataaactagacatggcgcaatacaggcaagtcaccaaggcagagggagtggcgctcgccggccgcttcgggtgccttttcttcgaagtgtctgcatgtctggattttgagcacgtgcagcacgtctttcatgaagcggtgcgagaggcccggcgggaactggagaaatccccccttacaagaccgttgtttatcagtgaggagcgcgctctgcctcatcaggccccacttacggcaagacatggtctagcctcctgtactttcaatacactgtctaccattaacttgaaggaaatgcctaccgtcgcccaagccaagttggtcactgttaagtccagccgcgcacagtcaaagcgaaaagctccaacactcaccctcttgaagggcttcaaaatattctag

SEQ ID NO: 33049 - DNA, 768 bp, Artificial Sequence
  Description of Artificial Sequence: Synthetic coding sequence
atggtaattatgggacccgaactggtgggaagttggtctgatttcaagaacgaagccgccgatcctcgcgccttaactgtaaaatttctcacaaagcgcttcatttccgaatatgacccaaacttagaagacacttattcctcggaagagactgtagatcaccagcctgtgcatctgcgcgtcatggacacagccgacttagacactcccaggaattgcgagaggtatctgaactgggctcacgctttcctcgttgtttactctgttgactctaggcaatctttcgactcctctagcagctacctggaactcctcgccctacacgcgaaagagacacagagatccatccccgccttacttctggggaataagctggacatggctcagtacaggcaggttacaaaggcggaaggtgttgccctcgcaggcagatttggatgtctcttctttgaggtaagtgcttgcctcgactttgagcacgtccagcacgtgttccatgaggcggttcgggaggcaagacgtgagctggagaaatctcctttgacaagacctctgtttattagcgaagaacgcgccctgccccatcaggctcccctgactgccaggcacggactggcttcatgcacctttaataccctgtcaactattaacctgaaagagatgccaacggtcgcacaagccaaactcgtgaccgtgaaaagtagccgggcccaatctaagagaaaggctccgaccttaacactcttgaaaggctttaaaattttttag

SEQ ID NO: 33050 - DNA, 1131 bp, Artificial Sequence
  Description of Artificial Sequence: Synthetic coding sequence
atggccgaggagcggccaggagcctggtttggctttggcttctgtggatttggccaggaacttgggtctggtaggggacgccaggttcatagcccttctcctctgcgggccggcgtggacatctgccgcgtgtcagcaagctggtcgtacaccgcttttgtgacccgggggggaaggcttgagctgtcaggctcggccagcggcgcagccggccggtgcaaagacgcctgggcttcagaggggctgctcgcggttctgagggcaggcccaggccctgaggctcttctgcaggtctgggcagcggaaagtgctctcagaggagagccgctttgggcacagaacgtggtgccagaagccgagggcgaggacgacccagctggcgaggcccaggccggaagactgcccctgctgccatgtgctcgtgcttacgtaagcccgcgcgccccattttacaggcccctggcccctgaacttagggcgaggcagctcgagcttggggccgaacacgctctccttctggatgccgcaggtcaggtcttttcttgggggggaggccgtcacgggcagttggggcatgggaccctcgaggcagagctggaaccacgactgttggaggccctgcagggcctggtgatggccgaggttgctgcaggaggctggcacagcgtttgcgtctccgaaactggtgatatatatatctggggctggaacgaaagcgggcagctggctcttcccacacggaatctagcagaggatggagagacagtagcacgagaggcaacagaactgaacgaagacggctcccaagtcaagaggaccggcggagccgaggatggggccccagccccattcatcgctgtgcaacctttccccgccctcctcgacctccctatggggtccgacgccgtaaaggcctcttgcgggtcgcgacacaccgcagttgttacaaggacaggagaactgtacacatggggctgggggaagtacgggcagcttggccacgaggacaccactagtttggatagaccccgcagggtcgaatactttgtggacaagcaattacaggtcaaagccgttacctgcgggccatggaatacatacgtttatgctgtcgagaagggcaagtcttag

SEQ ID NO: 33051 - DNA, 1131 bp, Artificial Sequence
  Description of Artificial Sequence: Synthetic coding sequence
atggcagaggagagacctggggcttggttcggcttcggcttctgcggctttggccaggagctgggatcaggcagagggcggcaggttcactccccttcaccgctgagggccggagtggacatctgccgggtgtcagctagctggtcatacactgcttttgtgacacggggtgggaggctggaactaagcggatcagcctccggggccgcaggtcggtgtaaagatgcctgggcttctgagggcttactagccgtcttgcgcgctggacctggccctgaggcacttctgcaggtgtgggccgccgaatccgcactgagaggcgagcctctatgggcacagaatgtcgtcccggaagccgaaggtgaggatgaccccgcgggtgaagcacaagcaggcagacttccactgttgccctgcgcccgcgcctacgtcagcccaagggcacccttctaccgccccttggcccccgagctgcgggccagacagctggagctcggagctgagcacgctttgctgctcgacgcagcaggacaagtgttctcctggggaggcggcagacacgggcagctcgggcacggaactctggaagccgaactcgaacctaggctgttagaagccttgcagggccttgtcatggccgaagtcgctgccggcggatggcatagtgtttgcgtgagcgagacgggtgacatttatatttgggggtggaacgagtccggccagctcgccttgcccacgagaaacttggctgaagacggggagacagtcgcacgggaagccacagaattaaatgaggatgggtctcaggtgaagaggaccggtggggcagaagatggcgcacccgcaccgtttattgctgtccaaccatttccggccctcctggacctgcccatgggctctgacgccgtgaaagcaagctgcggctcccgtcacacggccgtggttacacgtaccggggagctgtatacatggggctggggaaagtatgggcaattaggtcacgaggatacaacctcccttgaccgcccacgcagggtagagtacttcgttgataagcagctgcaggtcaaggccgtgacatgcggcccatggaatacatatgtatatgccgtggaaaagggtaaatcttag

SEQ ID NO: 33052 - DNA, 594 bp, Artificial Sequence
  Description of Artificial Sequence: Synthetic coding sequence
atggaggagcgaccagccgagaccaatgcaaatgtcgacaattcagcaagcccaagcgtggcccaactggccggacgatttagggagcaggccgctgcggcaaaggaaacaccagcatcgaaacctacacgcaggaaacctccatgctctctccctctgtttccacctaaggtcgaccttggccaaaacggggaggaagcaaacctgaccttcgacccagccgccctgctacctggggcttcacccaagtctcccggtctaaaagcaatggtgagtccctttcattcacctccctccacgccctctagccccggcgtcaggagcagaccttccgaagccgaagaggtgcctgtgtccttcgaccaacccccagaagggtcccacctcccctgttataataaagtaagaacccggggatcaatcaagcgccggccgcctagccggcggttccggaggtctcagagcgactgtggggaattgggggacttccgtgccgtcgaatcatcccagcagaatggggcgaaggaagaggacggcgatgaggtgcttccaagcaaatcaaaagccccaggtagtccattgtctagcgagtag

SEQ ID NO: 33053 - DNA, 1251 bp, Artificial Sequence
  Description of Artificial Sequence: Synthetic coding sequence
atggaggagaggccagctgagacaaacgccaacgtcgataactcggcatccccatcagttgcccagctagccggcagattccgggagcaggcggcagcagcaaaagagactccggcatccaaacccacaagaaggaaacccccctgcagtttgccactcttccccccaaaggtcgacctcggtcagaacggagaggagaagagtcctccaaatgcgagccatccccctaagtttaaggtgaaatcatcgcctcttatcgaaaaactccaagctaatctgacttttgatcccgccgccctgctgcccggggcgtcaccgaagagcccaggactgaaagctatggtctccccgttccatagccctccaagcactccctccagcccaggggtgagatccaggcccagtgaggccgaagaagtccccgtgtcttttgatcagccgccggaaggcagtcatctgccctgttacaacaaagtacgcactcgtggcagtattaagagacgcccgccatcccggaggttccggcgcagccaatctgactgcggggaattaggggattttcgcgctgttgaatccagtcaacagaatggagcgaaggaggaagatggtgatgaggtgctgcctagtaaaagtaaggcaccgggatcccccctgtcgtctgaaggcgctgctggggagggtgtgcgtactctgggtcctgctgaaaagccaccgttgaggaggtctcctagtcggactgagaaacaggaagaagatcgagcaacagaagaggctaaaaacggggagaaggcaaggaggtccagcgaggaagtggacggtcagcatccagcccaggaagaagtgccagagtcgccccaaactagcggtcctgaggctgagaacaggtgcggaagccctcgcgaggagaaaccggcaggcgaagaggccgaaatggagaaggccaccgaggtgaagggcgaacgggtgcagaacgaagaagtaggcccggaacatgacagtcaagaaacgaagaaactggaagagggggcagccgtcaaggagacgccccatagcccgcccggaggggtgaaagggggagatgtccctaagcaggaaaaggggaaagaaaagcagcaggagggcgctgtattggagcccggctgctcccctcagaccggccctgcccagttagagacgtctagtgaggtgcaatccgagcccgcagtgcctaagcccgaggacgatacaccagtgcaggacaccaagatgtag

SEQ ID NO: 33054 - DNA, 1161 bp, Artificial Sequence
  Description of Artificial Sequence: Synthetic coding sequence
atggaagaacgtcctgcggaaacaaacgccaacgtcgacaatagcgcgtccccatctgtagcccagcttgctggccggttccgcgagcaggcagccgccgctaaagagaagtcgccccccaatgccagccaccccccaaaattcaaggtgaaaagcagcccattaatagaaaaactgcaggcaaacttaacgttcgaccctgctgcactcctgcctggagcctctcccaagagccctggcctaaaagctatggtatctccgttccatagccccccatcaaccccttcctctcctggcgtcagatctagaccaagtgaagccgaagaagtccccgtgtcatttgatcagccacccgaggggagccatctgccctgctacaataaagtacggacacgcggcagtatcaaacgccggcccccttcccggcggttccggcggagtcagagtgactgtggagagcttggggacttccgtgcagtggagagcagccagcagaacggcgccaaagaggaagacggagacgaagtgcttccatccaagtcaaaggccccgggatctccgctgtcctccgagggagcagccggagaaggggtgaggaccctggggcctgcagagaagcccccattacggcggtccccgtctcgtaccgaaaagcaggaggaggatcgggctacagaggaagcgaaaaatggtgagaaggcccggaggagcagtgaggaggtggatggccagcacccggcccaggaagaggttcccgagtcaccccagaccagcggcccggaggccgaaaacaggtgtggaagtcctcgggaagaaaaacccgccggggaagaggctgagatggaaaaagctaccgaagtcaagggagagcgcgtgcagaacgaggaggtgggtccggagcatgactcccaggagacaaaaaaactggaagagggggcggccgttaaagaaacaccccatagcccccccggtggcgtgaaaggcggcgatgtgccaaaacaagaaaagggaaaagagaaacagcaagaaggagctgtgctggaacctggctgtagcccacagaccggacccgcgcagctcgagacatctagcgaagtgcaatctgaaccagccgtgcccaaacctgaagatgatacccctgtccaggataccaagatgtag

SEQ ID NO: 33055 - DNA, 561 bp, Artificial Sequence
  Description of Artificial Sequence: Synthetic coding sequence
atggagcccacccgggattgtccgctcttcggtggtgcctttagcgccattcttccgatgggagctattgatgtatctgatttgcgaccggtgcctgataatcaggaggtcttctgtcatcccgtcactgatcaatctttgattgtggagctcctcgaacttcaggcacacgtacgaggcgaagctgctgccaggtaccactttgaggatgtgggcggagtacagggcgcacgggccgttcacgtggaatccgtccagccgctgagtctggaaaacctggctctgcgcgggcgctgccaggaggcttgggttctttcaggcaaacaacagattgccaaagagaatcagcaggtcgccaaggacgtgacactgcaccaggccctgttacgtctcccacaataccagacagatttactgctaacatttaaccagccacctccggacaatcggagctccctgggcccggagaacctgtcccctgccccatggagtctcggtgatttcgagcaattggtgacatcactgactctacacgaccctaacatcttcggcccccagtag

SEQ ID NO: 33056 - DNA, 870 bp, Artificial Sequence
  Description of Artificial Sequence: Synthetic coding sequence
atgagtgccttcagcgaggccgctttagagaaaaaactgagcgaactaagcaatagtcagcaaagcgtacaaacgttgtcactttggctaatccaccaccgaaaacactcgcggcctatcgtgacagtatgggagcgagaactacgtaaagccaaacccaatagaaagctcacttttctttatcttgctaacgacgtcattcagaattcaaaaagaaagggacccgagttcaccaaggactttgcaccagtgattgtggaagcgttcaaacacgtttcttccgagacagatgagagttgcaaaaagcacctcggaagagttctgagcatctgggaagagagaagtgtttacgagaatgatgttcttgagcagcttaagcaagcactctacggcgataagaaacctcgcaagcgcacttacgagcagattaaggtcgacgaaaatgaaaattgcagctcactcggctccccgtctgagcccccacagaccctcgatttggtgagagccctccaagacctggaaaatgcggcaagtggcgatgcagcggtgcaccagcgcattgcatccttgcctgtagaggtccaggaagtctccctactcgacaaaatcacagacaaggagtcaggtgaaaggctcagtaaaatggtggaggacgcgtgtatgctgctcgcagattacaatggacggcttgctgccgagatcgacgataggaagcaactaacaaggatgctagccgatttcttacgctgccaaaaggaggccctcgctgaaaaggagcacaagctggagatcctggacatgggcgtgtcttctaatgatgttgtcactatctccatatttttcctgctgaaaattaatataaagccgtag

SEQ ID NO: 33057 - DNA, 831 bp, Artificial Sequence
  Description of Artificial Sequence: Synthetic coding sequence
atgcggaactctaattggcggttttgtcagaccggtatctatagcaagcctaatcgcaagttgaccttcctgtacctggctaacgatgtgatccagaacagcaagagaaagggacccgagttcacaaaagacttcgcgcccgtcatcgttgaggcctttaaacacgtaagctctgagaccgatgaatcttgcaagaagcaccttgggcgtgtcctgtccatttgggaggagagatcagtctacgagaatgatgtcttagaacagttgaagcaagcactctacggcgacaagaaaccgcgtaaacggacctacgagcagatcaaggtagatgagaatgaaaactgtagcagtctcggatccccctccgagcccccccagacactggacttagtccgtgctctccaggacctggaaaacgccgcttccggggatgcagccgtgcatcagcgaattgcgagtctaccagtggaagtgcaggaggtatccctgctagataaaatcacagacaaggagagtggagagaggctgagcaagatggtggaagatgcttgtatgcttctagccgactataacggccgcttagccgctgaaatagacgaccgtaagcaactgactcgaatgctggccgacttcttgagatgtcagaaggaggccctcgcagaaaaagagcataaactggaggaatacaagaggaaacttgcacgcgtgtctttagttcggaaagagctgcgttcgcgaatccagtcccttcctgacttgtctagattgcccaacgttactggctctcacatgcacttgcctttcgccggggacatctattcagaggattag

SEQ ID NO: 33058 - DNA, 939 bp, Artificial Sequence
  Description of Artificial Sequence: Synthetic coding sequence
atgagcgcgttcagcgaagccgcattggaaaaaaaattgtctgagctttccaattctcaacagagcgtgcagaccctcagcctctggctgatccaccatcggaaacattcccggcctatcgtgacagtatgggaacgtgagctgcgaaaagccaaacctaacagaaaactcacttttctgtatctggcgaatgatgtgatccagaacagcaagcgaaagggaccagaattcaccaaagactttgctcccgtgattgtggaggccttcaaacacgtatcctccgaaaccgatgaatcttgtaagaagcacttggggcgagtactgagcatctgggaagaacggagcgtatatgagaatgatgtgcttgaacaactgaaacaggccctctacggcgataagaagcccagaaagcggacgtacgagcaaataaaggtcgacgagaacgagaactgttcctcccttggaagccctagtgagccgccccagaccctggacttggtgagagccctccaggacctggaaaacgccgcttccggtgatgctgcagtgcatcaacggattgccagtttaccagtggaggtccaagaggtcagccttcttgacaagatcacagacaaggagtccggcgagcgactgagcaaaatggtcgaagatgcctgcatgctgctggcagattataatggacgattggccgctgaaatagacgaccgcaaacaactaacacgcatgctggccgacttcctgcgatgtcagaaagaggccctggctgagaaagagcataagcttgaagagtacaaaagaaaacttgccagagtgtcgctggtccgtaaagaattacgaagccgcatccagtcgttgcccgacctctccagattacccaacgtgacaggttcccatatgcacctgccattcgctggtgatatctacagcgaagactag

SEQ ID NO: 33059 - DNA, 939 bp, Artificial Sequence
  Description of Artificial Sequence: Synthetic coding sequence
atgtcagccttttcagaagccgcacttgaaaaaaaactgtcggaactcagtaactcccagcaaagcgtgcagaccctgtccctgtggctgatccaccacagaaaacatagccgccccatcgtaactgtttgggagagagagctgcgcaaggccaaaccaaataggaagctgactttcttatacctggccaatgacgtaattcagaatagcaagaggaaggggccggagttcacgaaggacttcgccccagtcattgtggaggccttcaagcatgtgagtagtgagaccgatgaatcgtgcaagaagcatctgggacgagtgctcagcatctgggaagagcgcagtgtgtatgagaatgatgtcctcgagcaactaaagcaagcgctgtatggcgacaagaagcctagaaagcgcacgtacgagcaaattaaggtggatgagaacgagaactgttcatctctggggagtcccagcgaaccgccacaaactcttgacctggtaagggccctacaggacctggaaaatgcggccagcggagacgccgctgtccaccagcgcatcgccagccttccggtggaagtacaggaggtgagtttactagacaagattaccgataaggaatccggagagaggctctccaaaatggtggaggacgcgtgcatgctgctggcagattacaacggccgcctggctgccgaaattgatgaccggaaacagcttactcgaatgctggctgacttcctcagatgccagaaagaagctctcgctgaaaaggagcataagctggaggaatataagcggaagcttgccagggtgagtttggtgaggaaagagctcaggtctcgcattcaatccttgcctgacctgagtaggttgcctaacgtgaccgggtctcacatgcacctcccttttgccggggacatctactccgaggactag

SEQ ID NO: 33060 - DNA, 981 bp, Artificial Sequence
  Description of Artificial Sequence: Synthetic coding sequence
atgagttccttctccgagagtgctcttgagaagaagctgagtgaactgtcgaactcacagcagtctgttcagactctgagtctttggctgatccatcatcggaagcacgctggccctatcgtgtcagtatggcatagagaacttcgaaaggccaaaagcaataggaaactcaccttcctgtacctcgcaaacgacgtcatccagaactctaagaggaagggacctgagtttactagagagttcgagtccgtactggttgatgccttttctcatgtcgctagagaggctgatgagggctgcaaaaaaccccttgagaggctgcttaatatatggcaagaacgctccgtttatgggggagagttcatccagcagctgaagctctcaatggaggattccaagtcaccgccccccaaagctactgaggagaagaagagtctgaagcgcacattccagcagatacaggaggaagaggacgacgattaccctggatcctactctcctcaggacccatctgctgggcctctgctgacagaagaactcattaaagcccttcaggatctcgaaaacgctgcaagcggcgacgctactgtgcgtcaaaaaatcgcctcactgccgcaagaggttcaagacgtgtccctgctggagaagatcaccgacaaggaggcagccgagaggctcagtaaaaccgtagacgaggcttgcctgttgttggctgaatacaacggtcggttagccgccgaactggaggatcgccgccagctggcgcggatgctggtggagtacacccagaatcagaaagatgtgctgtcagagaaagaaaaaaaattagaagagtataaacagaaactggcccgcgtgacccaggttcgaaaggaactgaaatctcatattcagtccttacccgatttaagtctgctgcccaatgtaacggggggtttggctcccttaccatccgccggcgatctgttctctacggattag

SEQ ID NO: 33061 - DNA, 459 bp, Artificial Sequence
  Description of Artificial Sequence: Synthetic coding sequence
atggccgcaggaggtggaggaggtagcagcaaggcttcttcgagtagcgcttcaagcgccggagctttggagtcaagtctggaccggaagtttcagtccgtcaccaatactatggaatctatccaggggttaagcagctggtgcatcgagaacaaaaagcaccatagcaccatcgtgtaccactggatgaagtggttacggcgtagcgcttacccacatcggctcaacctcttttatctggctaacgacgtaatacagaattgcaagaggaagaatgctatcatctttcgcgagagtttcgctgacgtgctaccggaagcagcagcactggtcaaggacccttccgtgagcaagtccgtggaacgaatttttaagatttgggaagatcgtaacgtttatccagaagaaatgatcgtggcgctgagggaagccctgtcaaaatgtctctttctcagctag

SEQ ID NO: 33062 - DNA, 4386 bp, Artificial Sequence
  Description of Artificial Sequence: Synthetic coding sequence
atggccgcagggggggggggtgggtcatccaaagcctcatcatcctccgccagttctgccggcgctttagagtcaagtttggatcgtaaattccaatccgtaaccaataccatggaaagcattcaggggctctcctcttggtgcatcgagaacaaaaagcaccactcaacaattgtgtaccactggatgaagtggctcaggaggtcggcctatccacaccgtctcaacttgttctatctggctaacgatgtgatacagaactgcaagcgaaagaacgcgatcatctttagggagagcttcgctgatgtactgccagaggccgccgcgcttgtgaaagacccgtccgtgtccaagtctgttgagcgcatttttaagatctgggaggacaggaacgtgtaccccgaagagatgatcgtcgccttaagagaggccctcagcacgacctttaagacccagaagcaactgaaggaaaatctgaacaagcagcccaacaaacagtggaagaagtcacaaacatccactaatcctaaagctgccctgaagagcaaaattgtggctgaatttcggagccaggccctgatcgaggagctgctgctatataaacgatccgaagaccagatcgagctaaaggagaaacagctttccaccatgagggtcgacgtttgttcaacagagacgctgaaatgtttaaaggacaagacaggcggaaagaaattctccaaagagttcgaagaggcgtcctccaaactcgaagaatttgtgaatgggttagataaacaggttaagaacggccccagtctgacagaggcccttgagaatgctggaattttttacgaggcacagtacaaggaagtcaaggtggtggcaaatgcatacaagacatttgccaaccgggtgaataatttaaagaaaaagcttgatcagttgaagtcgaccctgcctgacccggaggaatctcccgtgccctcacccagcatggatgcccctagtcctaccggttctgagagccctttccaaggcatggggggcgaggagagccagagccctaccatggaaagcgagaagagtgctacaccagagccagtcaccgacaatagggacgtcgaggatatggagctgtcagacgtcgaagacgacggatcaaagatcatcgtagaagaccgaaaagagaaaccggccgagaaatccgcagtgagtacgtccgtccccaccaagcccacagagaatatctcaaaagcctcttcctgtacacccgtgcccgtgactatgaccgccaccccccctctcccaaagcctgtcaacacctccttgagcccttctcctgcattagcccttcccaaccttgctaatgttgatctggcgaaaatatccagcatactgagttccctgacatcagtaatgaaaaacaccggcgtgagccccgcctcgcggcctagccctggcactccaacctccccgagcaacctgacttcaggcctgaaaacaccagcccctgcaacgacaacttctcataatcctcttgccaatatcctgagtaaggtggagatcaccccagagtcaatcctgtctgctttgagcaagacacaaacgcaatcagccccagccctgcagggcctgtcaagcctgttgcagtccgtaactgggaatccggtcccagcctctgaggctgcctcccaaagtacgagtgcttctcctgctaacactacagtttctactattaagggtcggaatctgccctcttcagcccagcccttcataccgaaaagcttcaattacagccccaactcctccacttcggaggtatcctccacctccgcgtcaaaagcaagcatcggacaaagccctggcctccctagcactacttttaagctgcccagcaattctctgggatttacagctactcacaatacctccccagccgcccctccaacggaggtcactatttgtcagtcttcagaagtgtccaagccgaaactggagagtgagtcaacctcccctagtcttgaaatgaaaatacataactttctgaagggtaatcccggattcagcggtctgaacctcaacatccctattcttagttcattgggctcgagtgctccctcagagtcccatccctcagactttcagcgcggtcctacttccaccagtatcgataacatcgacggcactcccgtccgggatgagcgcagcggaactcctacacaggacgaaatgatggataagccgacctcatcttctgtcgacaccatgagccttctgtctaagatcattagtccaggaagttcaactccgtcatctacgaggagcccaccgccgggacgggatgagtcctatccaagggaactgtccaattccgtgtctacatacagaccatttggtcttggctcagaaagtccatacaaacagccctcggatggcatggagagaccctccagcctgatggacagttcccaggaaaagttctatcccgatacatcctttcaggaagatgaggactaccgcgacttcgaatactcaggtcccccaccaagcgctatgatgaaccttgagaagaaacccgcaaaatccattctaaagtcatctaaacttagcgataccacggagtatcagccgatcctgtcctcctacagccaccgggcccaggagtttggagtgaagtctgcctttcccccttcagtccgtgcgctgctggatagctccgagaactgtgaccgcctctcttccagtccaggtctgtttggtgccttctctgtccgtgggaatgaacccggctccgaccggtctccctcccctagcaaaaacgactcctttttcaccccagatagtaatcacaacagcttgagccaaagtacaaccggccacttgtcactgccgcagaagcagtatcccgactccccgcatcctgtgccacatcgctccctcttcagtccccagaacaccctggcagctccgactgggcatcccccaaccagcggagtggagaaggtgctggcctccacaattagcacaaccagcaccatagagttcaagaacatgctcaaaaacgcgagccggaaacccagtgacgacaaacatttcggtcaggctccgtccaagggcacaccttcagacggtgtgtccctctctaatttaacacagccatctctcactgccacagaccagcagcaacaggaagaacactatcgtatcgagacccgtgtgagtagcagctgtctcgatctgccagatagtacagaggagaaaggtgcaccaattgaaactttagggtaccactctgcttccaatcgtcgcatgagcggagagcccatacagacagtcgagagcatcagagtgcccggtaaaggcaacagaggacacggcagagaagcttcacgtgttggatggtttgaccttagtacgtctggatcctcctttgacaacggaccctcgtctgctagtgaactcgcctctctgggcggcggtgggagcggggggttaactggcttcaagacagctccttataaggagcgggcgccacaattccaggaatctgtcggttccttcaggtccaatagcttcaacagcaccttcgaacaccacctccccccctcccccctggagcacggaaccccattccagcgggaaccagtggggcctagtagcgcgccccctgtcccacctaaagatcatgggggcattttctctcgcgacgccccaactcatctcccctcagttgacctatccaatccattcactaaagaagcagcgctggcacatgccgccccaccaccaccacctggagagcatagcggaatcccgttcccgacccctccgccacccccccccccgggcgagcattcctctagtggaggaagtggagtcccgttttccacaccgccaccaccgccaccaccggtggatcactccggcgtggttccatttcccgcgcctccgctagcagagcatggagttgctggagctgttgcagtgttccccaaggaccatagtagtctcctgcagggcactcttgctgaacacttcggagtcctgccaggtcccagggaccatggcggaccaacgcaacgggatctgaacggtccagggctgtctcgagtgcgagagagccttaccctgccatcccacagcctggagcacttaggtcctccgcacggaggcggtggggggggcggctccaacagtagttcaggacctcccctgggaccatcgcacagggacactatcagtcgctccggtatcatactgcgctctcctcgcccggacttcaggcccagggaaccattcctgtctagagatccttttcatagtctcaagcgacctagacctccttttgccagaggaccacccttcttcgctccaaagcgtccatttttccctcccagatactag

SEQ ID NO: 33063 - DNA, 4308 bp, Artificial Sequence
  Description of Artificial Sequence: Synthetic coding sequence
atggcggcaggggggggaggtggaagctctaaggcttcttcttcaagcgcctcaagcgctggtgcattagagtcatctttggaccgaaaattccagagtgtaaccaatactatggaaagcatccagggcctgtccagctggtgcattgaaaacaaaaaacaccattccacaattgtttaccactggatgaaatggctaagacgctcggcctaccctcaccggctgaacctgttctacctcgccaatgacgtgatccagaattgtaagaggaaaaacgccattattttccgagagagtttcgctgatgtgctgcccgaagcagctgcgttggtgaaggaccccagcgtgagtaaatccgtggagcggatcttcaagatttgggaagaccggaatgtataccccgaagagatgattgtcgcactgagggaggctctgacaagtactaaccctaaggcagctctgaaaagcaagattgtggcagagtttagaagccaggccctcattgaggagctgctgctatataagcgctcagaagatcagatagagctgaaggagaagcagctctccaccatgcgagttgatgtgtgctccacagagaccttgaagtgtctgaaagacaagaccggtgggaagaagtttagtaaagagtttgaagaggcctcctccaagctggaggagttcgtgaatggtctggacaagcaggtcaagaatggcccttcactgactgaggctctcgaaaacgctggtattttctacgaggcccaatacaaagaggtgaaggtcgtggctaacgcatacaagacctttgctaaccgggtgaacaatctgaagaagaagctggaccagcttaagtccactctccctgatcccgaagaaagccccgtgccctcgccctccatggacgccccctctccgacaggttctgaatctcctttccaggggatgggtggtgaagagagccagtccccgacaatggagtccgagaaaagtgccacacctgagcctgtcacggacaacagggatgtcgaggacatggaactgtccgatgttgaagatgatgggagtaaaattatcgtcgaagaccgcaaggagaagcccgccgagaagagtgctgtgtcgaccagtgtccccacaaagccaacagaaaatattagtaaagcttcaagttgtactcccgtgcccgtcactatgactgccactccacctcttcctaaacccgtgaatacctcgttatctccaagcccagcactggcattacccaacctcgctaacgtggacctggccaaaatatccagcattctatcgtcactgactagcgtgatgaaaaacaccggtgtgagtccagcatccaggccatcaccaggaacacccacgtcacccagcaacctgacatctggcctgaaaacacccgccccagcgaccacaacatcgcacaatcccctggccaatatcctgtccaaggtggaaatcacacccgaatcaatcctgagtgctttgtctaaaacacaaactcaatccgcaccagcactccagggactcagcagcctactgcagtccgtgaccggcaaccccgtgccagctagcgaagctgcatcacagagtacaagcgcaagtccagcaaacaccacagtgagtacgattaagggccgaaacctacccagctcagcccaaccatttattccaaagagcttcaactactctcctaactcatctactagcgaagtctcatcaaccagtgcctctaaagcctctatagggcaatctcctggtctccctagcacgactttcaagctgcctagtaactctcttgggttcacagcaacacataatactagccccgccgcacctcccaccgaagtgaccatctgccagtcatccgaggtttctaagcccaaactggaatctgagagcacaagtccatccctcgagatgaagatacataattttctgaagggaaaccctgggttcagcggcctgaatctcaatattcctattttgagtagccttggctcatccgccccgagtgagtcccatccctcagattttcagcgaggacctaccagtacgtctatagataacattgatggaacccccgtgcgggatgaaagaagtggtacacccactcaggacgagatgatggacaagccaaccagcagcagtgtggataccatgtccttactgtctaagatcattagccccggctcctccacaccttcaagcacaagatcccctccacctggtagagacgagtcgtatccacgggaactgtcaaatagtgtatcaacctacaggcctttcggattggggtcagaaagcccctataagcaacctagcgatggcatggaaagaccttcatcattgatggactcctctcaagagaagttttatccagacacttcttttcaggaggacgaagattatagagacttcgagtactctggtccgcctcctagtgcaatgatgaatctggaaaagaagcccgcaaagtccatcttgaagagctccaagctctcagacactaccgagtaccagcccatactgagtagctattctcaccgcgcccaggagttcggggtgaagtcagctttcccacctagcgtgagggccctactagattcttcagagaattgtgacaggttgtctagctccccgggactgttcggcgcgttcagtgtccgggggaatgagcccggttcagacagatccccctctccttctaagaatgactccttctttaccccggactctaatcacaacagtctgtcacaatccaccacgggccacctgagtttgccacaaaaacaatatcctgattcaccacaccccgtgccccacagaagcctgttcagcccacagaacaccctcgctgcccccactggtcatcccccaacgtcgggagtagaaaaggtgctggccagcaccatctccacaactagcactattgaattcaagaacatgctcaagaatgccagtagaaagcccagcgacgacaaacactttggccaagctccttcaaaggggactccttcggacggagttagtctatcaaacttgacccaaccgtccttaaccgcaactgatcagcagcagcaggaggagcattatcgcatcgaaactcgagtaagctccagttgcctggacttgccggactccactgaggaaaaaggcgcccccatcgagaccctgggatatcactcagccagcaatcgtcggatgtcaggtgagcccattcagactgtggaatccattcgtgttcccggtaagggcaatcggggccacggtcgcgaggccagccgggtgggatggttcgacctcagcactagtggatctagcttcgacaatggaccttcctctgcctcagagctagcaagcctcggcggaggaggaagtggaggcctgactggtttcaaaacggctccatataaggagcgcgctccccagtttcaggagtccgttggcagttttaggagcaattcgtttaattcaacattcgaacaccacctcccccctagtccactcgaacacggaacaccatttcaacgtgaaccagttgggccctcttccgcacctcctgtccctcccaaggaccacggcggcatattttctcgcgatgccccaacacacctcccctctgtagacctgagtaacccatttacgaaagaagctgcgctggctcacgctgccccacctcctccccccggagaacacagcgggattccctttccaactccacctccacctccacccccaggcgaacatagcagttcagggggatcaggtgtgccgttttcaacaccccccccaccgcctccgcctgtggaccatagcggcgtggttcccttcccagcacctcctctggccgaacatggcgtggctggcgctgtcgctgtgtttccgaaggaccactcaagtctattgcagggaacactggcagagcacttcggggtactccccggccctcgggaccacgggggaccaacccagcgggaccttaacggaccaggcctttcccgtgttagggagagtctgaccctcccctcgcactctttggagcatcttgggcccccacatggcggaggtggcggtggtggctctaattcctcctctggacctccccttggcccaagccatagggacaccataagtagatctggtattatcttacgtagtccacggccagattttcggcccagagagccattcctgtcccgagacccattccacagcctgaaaaggcccaggccacctttcgcgcgaggtcctccgttctttgcccctaaaaggccttttttcccaccacgatattag

SEQ ID NO: 33064 - DNA, 2805 bp, Artificial Sequence
  Description of Artificial Sequence: Synthetic coding sequence
atggccgctggcgggggtggcggttcctccaaagcctctagcagtagcgcctcctccgccggtgctctggagtctagtttggacaggaaattccagtccgtgaccaacaccatggagtctattcagggcctgtctagttggtgtatcgagaacaaaaagcaccatagcaccatagtgtatcactggatgaagtggcttcggcggtccgcttaccctcacagactgaacctcttttacctcgctaatgacgtgatccagaattgtaaaaggaagaatgccatcattttccgggagtcttttgccgatgttctacccgaggctgccgctctggtgaaggacccgtccgtgagtaagtcagtggaaaggattttcaaaatctgggaagaccggaatgtataccctgaggagatgattgttgccctcagagaggcactgactagtacaaatccaaaggctgcactgaagtccaaaattgttgctgaattcaggtctcaagctctcattgaggagttgctcctttataagaggtcagaggaccagatcgagctaaaagagaaacagctctccacaatgcgcgtggatgtctgttccacggagacactcaagtgcctgaaagataagaccggaggaaaaaagttctcaaaggaattcgaggaagcttctagcaaactggaagagtttgtgaacggtctggataagcaggtgaagaatggccctagtttgacggaagctcttgagaatgccgggatattttacgaggcccagtataaggaagtcaaggtggtggctaacgcatacaagactttcgcaaatagagtgaacaatctgaaaaagaagctagaccagctgaaatcgacgttacccgaccccgaggaaagtcctgtgccttcaccctctatggatgccccgagccctaccggatcggaatccccgtttcagggtatgggaggggaggaaagtcagagtcccactatggaatcagaaaaaagcgctactccagaaccggttacagataacagggacgtcgaagacatggagcttagcgatgtggaggacgatgggagcaagattattgttgaggacagaaaggagaagccagccgagaagtctgcggtgtcaacatccgtccccaccaagcctactgagaatatttctaaggcgagctcttgcaccccagtgccagtcaccatgaccgccaccccacctttgccaaagcccgtcaacactagcctcagcccctcaccagcattggccctgccaaatctggccaatgtggacttagccaagatttccagtatactctcctcactgacatcggttatgaagaacacaggggttagtcctgcaagtcgcccctcccctggcacccccacgagtccctctaatctgactagcggcctcaagactcccgcccctgcgacgactacatcacataaccccttagctaacatcctcagtaaagtagagattacacctgagagtatactctctgccctatccaaaactcagactcagagcgccccagcccttcaaggactctcaagccttctgcagagtgtgaccggcaacccagtgccagcctctgaagccgctagccagtctaccagcgccagccccgcaaacaccacagtatcgacaattaaaggccgcaatctccctagcagcgctcaaccattcattcctaagagcttcaactattcgccgaattcaagcaccagcgaagtctcttctacctccgcctctaaggcttctattggacaatctccagggctgccctccaccacctttaaactgccatccaactctctgggtttcaccgcgactcataataccagccctgcagcgcccccaacggaggtgactatatgtcagagctccgaagttagtaagccgaagctggagtccgaatctacgagtccgagcttggaaatgaaaatccacaactttctgaagggaaatcccggattcagcgggcttaatctaaacattcccattctgtcctcactggggagctccgcgccttcagaatcacacccctctgattttcagagaggaccaactagcactagtatcgacaatattgatggcacacctgtcagagatgagcgttcggggacgcctacccaggacgagatgatggataagcctacttcttctagcgtcgacacaatgtcactgctgagtaagattataagcccgggtagtagtacaccaagttctaccagaagtcccccgcccgggcgcgacgaatcctatcctcgggaattgtcaaactccgtttccacctatcgtcctttcggccttgggtcggaatcaccatataaacagccatcagacggtatggagaggccatcaagcttgatggattcatcacaggagaagttctacccagacacaagcttccaggaggatgaggattatcgggatttcgaatactccggacctccacccagcgctatgatgaacctggagaagaagcctgccaagagtatcttgaagtctagtaagctctccgatacaactgagtatcaaccgattctcagcagctactcccatcgagcccaagagttcggcgtcaagagcgctttccccccatcagtacgggcgctgctcgactctagtgaaaactgcgaccgcctcagctcatcgccaggcctttttggcgccttctcagtccgtggcaacgagccaggctctgatcggagcccctctcccaagcacccatgtaggtcccatggtagtccaacacacgtcagacgtggagaatcccccggcctgcatcactttcatcacgtggacgactag

SEQ ID NO: 33065 - DNA, 3231 bp, Artificial Sequence
  Description of Artificial Sequence: Synthetic coding sequence
atgtcttccgctgagatcatcgggagcactaacctgatcattctgttggaagatgaggtcttcgccgattttttcaacaccttcttgtctctcccagtctttgggcaaaccccgttttatacagtggagaactcccagtggagcctgtggcctgagataccatgcaatctcatcgctaaatataaaggcctgttgacctggttggaaaagtgtaggctgccctttttttgcaaaacaaatctgtgcttccactacatactttgccaggagtttatcagcttcatcaaatctccagagggtggcgaggagctcgtagatttctggatccttgctgaaaatattttatcaatagacgagatggacttggaggtgcgggattactacttgagccttctccttatgttgagagccacgcacctgcaggaaggaagccgggtcgttaccctctgcaacatgaatataaagagtcttttgaacctgagcatctggcaccctaaccagtctaccacacgtcgagagattctgtcacacatgcagaaagtggctctctttaaattgcagagttactggctcccaaacttctatactcacactaagatgacgatggcaaaggaggaggcatgtcatggattaatgcaagagtacgaaacccgcctgtatagcgtatgttatactcacatcggcggccttcccctcaacatgtccatcaagaaatgtcaccatttccagaagcgctactcctctcggaaggctaagagaaaaatgtggcaactcgtagaccctgactcatggtcactggagatggacctcaaacctgacgctatcgggatgcctcttcaggagacgtgtccacaagagaaggtggtgattcagatgcctagcttaaagatggccagctcaaaagagacccgtatatctagcttagagaaggacatgcactatgccaaaatctcttccatggaaaacaaagccaagtctcatctccacatggaggctccgtttgagactaaggtgagtacacacctgagaacggtgattcccattgtgaaccactcttcaaaaatgacaatccaaaaggccataaagcagagcttcagtctgggctatatacatctcgcactatgtgccgacgcttgtgcaggcaacccctttcgggaccacttaaaaaaactcaatctcaaagtggaaatccaactgctggatctctggcaggatctccagcacttcctttccgtcctactgaataacaagaaaaacgggaatgcgattttcagacacctgctgggtgataggatctgcgaactgtacctcaacgaacagatcggtccttgcctgccgctgaaatcacagaccatacagggactgaaggaactcttaccctctggcgacgtaataccctggataccaaaggcgcaaaaagagatctgcaaaatgttgagcccgtggtacgatgaatttcttgacgaagaggactattggttcttgctgttcacaacgcagaaccggttcatctccagccggcagcacaaaagggaattcatcggtaaagaggaaaacatcttgctgtataaaagaatccaacagtcgctcgagttaagtcaggccctggcagatatgaaagagatggactatcgtcagtggcgcaaaatcgccacagaagatctgaaacagggcggatctctgcaggtggaattgacctcaccagttttcctcacagacatcactaagatgtccttcgaggagctgtgctacaagaatcctaagatggctattcagaaaatcagtgatgactacaaaatatactgcgaaaaggcccccaaaattgatttcaagatggagatcataaaggagacaaagacagtatccagaagtaaccgaaaaatgagtctacttaaaaggacactggtaaggaagccgagtatgcggcctaggaacctcactgaggttctgttgaacacccagcatctcgagttctttagagaatttctgaaggaacggaaagccaaaatcccactccagtttctgaccgccgtgcagaagatctcaatagagaccaatgagaagatttgtaaatccctaattgagaatgtgatcaagacatttttccagggccagctgtcccccgaagaaatgctgcagtgtgacgcaccaatcatcaaggagatagccagtatgaggcatgtgacaaccagtacactgctgacactgcaaggacacgtgatgaagagcatcgaggaaaagtggttcaaggactaccaggatctgttccctccccaccaccaggaagtcgaggtccaatcagaggtgcaaattagcagccgcaagccgagcaaaattgtatcaacctatttgcaagagtcccagaaaaaaggttggatgcgaatgatctcctttattagatcattttgtaaatataggaggttcatgttgaacccctctaagcgccaggaatttgaggattaccttcatcaggaaatgcaaaactcgaaggaaaatttcactacagcgcacaatacctcaggacgtagtgcacccccaagcacaaatgtgaggtctgctgatcaggagaacggtgaaattaccctggtgaagagacggatttttggtcacaggatcattacagtgaattttgccatcaatgatctgtatttcttctctgaaatggagaaatttaatgacctggtgagcagtgcacacatgttacaggtaaatcgggcctataacgagaacgacgtgattttgatgaggtcaaagatgaatatcatccaaaaactgttcctgaattcagatattccgcccaaactccgagttaatgtcccggagttccagaaggatgcaatcttggcggctatcaccgagggatacttggatcggtcagtgtttcacggagctatcatgagcgtgtttcctgtagttatgtacttttggaagcggttctgtttctggaaggccacacgctcttacctacagtatagaggtaagaaatttaaagacagaaagtctccacctaagtccaccgacaagtatcctttctcttctggcggggacaatgctatcttgagattcaccttattacgtgggatcgagtggctccaaccccagcgggaagctatctcctcggtgcagaacagcagctccagcaagctgactcagcctcgactggtagtgtccgccatgcagctgcatccagtccaaggtcagaagcttagctacatcaaaaaggagaagtag

SEQ ID NO: 33066 - DNA, 309 bp, Artificial Sequence
  Description of Artificial Sequence: Synthetic coding sequence
atgctgtccgtgcggcgggtatccgaggatatctgcagccgtatctacgagtccgcgcagagaatcgattccataacattcctgccaagcagcggattccatttgaaatggaagattcaaacaagaatagccaatgaaaaatacctgaggacacacaaagaggtggagtggcttatttcaggtttcttccgggagattttccttaaacgacccgacaacatactggagtttgctgcagactactttacggacccgcgcctccctaacaaaatccacatgcagcttattaaggacaaaaaggcagcttag

SEQ ID NO: 33067 - DNA, 1176 bp, Artificial Sequence
  Description of Artificial Sequence: Synthetic coding sequence
atggaccagtgcgtgactgtcgaacgagaattggaaaaagtgttacataaattttccggttatggacagctgtgtgagagaggcctggaggagctcatcgattacacaggcggcctaaagcacgaaatcctgcagagtcatggccaagatgctgaactgtctgggaccctcagcctcgtgcttacacagtgctgcaagaggatcaaagataccgtgcagaagcttgcatccgaccataaagatatccatagcagtgtctcccgggtgggcaaggctattgacaaaaatttcgatagcgacatctcctcagtcggaattgacggctgttggcaggccgattcccaacgtttgctgaatgaagtgatggtagagcactttttccgccagggaatgttagacgtagctgaggaactctgtcaagagagcggtttgtctgtcgatccgagtcagaaagaacccttcgtagagttgaatagaattctggaggccttaaaagtgagggtgctgcggccagccctggaatgggctgtgtccaaccgagaaatgctaatcgcacagaatagctcattagagttcaagcttcatagactttactttatctcgcttttgatgggaggtaccacgaatcagcgcgaagcccttcagtatgccaaaaattttcagccattcgctctgaaccatcagaaggacatccaggtgctgatggggagcctggtctatctcaggcagggaattgagaacagtccctacgtgcatctgctggatgcgaatcagtgggccgatatttgcgatatcttcactagggatgcatgcgccctactcggactctctgtagagtctcctttgtcggtgtccttctcagccgggtgcgtagccctgccggccttgattaatatcaaagccgttatcgagcagcggcaatgtactggcgtttggaatcagaaggatgaactgccaatagaagtggatctggggaagaagtgttggtaccattctatcttcgcttgccctattttgcgccagcaaaccaccgacaataaccctccgatgaagcttgtgtgtgggcatatcattagccgcgatgctctgaacaagatgttcaatgggtctaaactaaaatgtccttattgtcccatggagcaatcccccggagacgccaagcagattttcttctag

SEQ ID NO: 33068 - DNA, 1182 bp, Artificial Sequence
  Description of Artificial Sequence: Synthetic coding sequence
atggagcagtgcgcttgcgtcgagagggaattggacaaggttttgcagaagttcctgacctacggacagcactgtgagaggtccctggaggagctgctgcactatgttgggcaactgcgggccgagcttgcttcagccgcccttcaaggcacgccactctctgccactctgtcactggtgatgtcccagtgctgtcgaaaaattaaggacacagtacagaagctggcctcggatcacaaggatatccactcatccgtgagcagagtgggtaaagctatagaccgcaatttcgattctgaaatttgcggggttgtctctgacgctgtgtgggacgccagagagcagcaacaacagatcctgcagatggccattgtggagcacctgtatcaacagggtatgctctctgtggcggaggaactgtgtcaagagagcaccctgaacgtggatctagacttcaaacagccattcctggagttgaaccgaattctggaggcgttgcacgaacaggatcttggaccagccctcgaatgggcagtttcccatagacagcgcctgctcgaactgaactccagtctcgaatttaagctccaccgtttacacttcatacggctgcttgcagggggccccgccaaacagctcgaagcactgtcctacgccaggcacttccagccgtttgctcgtctgcaccaacgagagattcaggttatgatgggcagtctcgtgtatttaagactcggcctggagaagagcccctattgtcacttactggattcctctcattgggcggagatctgcgagacttttacccgtgacgcatgcagccttctgggcctgagcgtggagtcaccgctgtcggtttcattcgcttcgggctgcgtcgctctgccagtgctgatgaacataaaagccgtaattgagcagagacagtgcacgggagtgtggaatcacaaggacgagctgccaatcgagattgagctcggcatgaagtgctggtaccactccgtctttgcttgtcccatactgcggcagcagacatccgatagcaaccctcccataaagctgatttgtggtcatgttattagccgcgacgctctgaacaagttgatcaatggcggtaagcttaaatgcccatactgtcccatggagcagaaccccgccgacggcaagcgtataatattctag

SEQ ID NO: 33069 - DNA, 345 bp, Artificial Sequence
  Description of Artificial Sequence: Synthetic coding sequence
atggaacagtgtgcctgcgtggagcgggagctggataaggtgctccagaagtttctgacttacggacagcactgtgagcggagtttggaggaacttcttcattacgtgggacagttgagagccgagttagcctctgcagcattacaagggacacctttatcagccaccctgagcctggtcatgagtcagtgttgtcgtaaaatcaaagatactgtccagaaacttgcttctgatcacaaggatatccattccagcgtgtctagagtcggaaaggctatagaccgaaactttgatagcgaaatctgtggggtagtctctgacgccgtttgggatgcccgtgagtag

SEQ ID NO: 33070 - DNA, 447 bp, Artificial Sequence
  Description of Artificial Sequence: Synthetic coding sequence
atggagcagtgcgcatgcgtggagcgagagttagacaaagtgctgcagaagttccttacttacggacagcattgcgaaaggagcctggaagagcttctgcattatgtcggccaactcagagcagagctggcttcagcagcacttcagggtacacccctgtctgccacgctgtctttggtgatgtctcaatgctgccgtaagatcaaagacacggtgcagaagctggcatcagaccacaaggatatccacagcagcgtgtcaagagtgggaaaggctatcgatagaaattttgactctgaaatatgtggcgtggtgtccgatgcagtgtgggatgcacgagaacaacaacagcagatcttgcaaatggccatagtcgagcacctctaccagcaaggtatgctctcggttgccgaggaattgtgccaggagagcacactgaacgtctag

SEQ ID NO: 33071 - DNA, 174 bp, Artificial Sequence
  Description of Artificial Sequence: Synthetic coding sequence
atggaacagtgtgcttgtgttgagagggagctcgacaaggtactccagaaattcctcacttatggccagcactgcgaacgtagcctcgaagagctgctgcattacgttgggcagctgagagccgagctagcatcggcagctctgcagggcacccccctgtcagccaccctctag

SEQ ID NO: 33072 - DNA, 1182 bp, Artificial Sequence
  Description of Artificial Sequence: Synthetic coding sequence
atggaacagtgcgcttgcgtggaacgagaacttgataaggtgctgcagaaatttctgacatatggccagcattgtgaacgttcccttgaggagcttctccactacgtgggccagctcagggccgagcttgcatctgcggcacttcagggaaccccgctttccgccaccctttctctggtgatgtcccagtgttgccggaaaattaaggatactgttcagaagctggccagcgatcacaaagacatccactcctccgtatcacgcgtcggaaaggccatcgatcggaattttgatagcgaaatctgcggtgtggtgagtgatgccgtgtgggacgcccgggaacagcagcagcaaatcttgcagatggcaattgtggagcacttgtaccaacaaggaatgctctctgtggccgaggagctctgccaagagtccacccttaatgtggacttggactttaagcagccattcctcgagctgaatcggattcttgaggccctgcacgagcaggatctcgggcccgcattagagtgggcggtctcccataggcagcggctgctggagcttaactctagtttagaattcaagttgcatcgcttgcatttcatcagacttcttgctggaggtccagctaaacagcttgaggcactgagttacgccaggcactttcagcccttcgcacgccttcaccagagggaaatacaggtcatgatgggaagtctggtgtatctgcgcctggggctggagaaatccccatactgtcacttgctcgacagtagtcactgggccgaaatatgtgagaccttcactagggacgcctgtagcctactgggtctttctgttgagtcacccctgtctgtgtctttcgcaagtgggtgcgtggcgctgcccgtgctgatgaacataaaagctgtgatagaacagagacagtgcactggtgtgtggaatcacaaggacgaactcccaatagaaatcgagctcggcatgaagtgctggtatcactcagtctttgcatgcccaattcttcggcagcaaacgtccgactccaatcctcccatcaaactcatctgtggacatgttattagtagggacgccttgaataagctgatcaatggcggaaaacttaagtgcccttattgtccaatggaacagaatcccgcggatggcaaacggattatattttag

SEQ ID NO: 33073 - DNA, 1143 bp, Artificial Sequence
  Description of Artificial Sequence: Synthetic coding sequence
atggccgattgttcattggatttgccagggagcagttctcctccgagtcatctgtctctgctccgctcttgggaccatcgtagagttccaccttgtccagcactgcaagggacccctctgtctgccaccctgtcccttgtgatgtcgcagtgctgtagaaagatcaaagacacagttcaaaagctcgcaagcgaccacaaagatattcactcatctgtgtccagggtgggaaaagcaatcgatcgtaactttgactcagagatctgcggcgtggtgtccgacgccgtctgggatgcccgcgaacagcaacaacagattctccagatggccatcgtggaacatctctatcagcaagggatgctgagtgtcgccgaagagctgtgccaagaatccacactgaatgtggatctcgatttcaagcagcctttccttgagctgaaccggatccttgaggctttacacgaacaggacctcggaccagccttggagtgggcagtttcccacagacagcggcttctggagctgaattcatcattggagttcaaactgcaccggcttcatttcattcgactgctggccggcggccccgccaagcagcttgaagcgctctcttacgccaggcatttccaaccattcgccaggttgcaccagagggaaatacaagtgatgatggggtcattagtttatctgcgcctaggcctcgagaaaagcccctattgccacctattggatagttcccattgggccgaaatttgcgagactttcacacgggatgcgtgttcactgctgggactaagtgtcgagagccccctgagcgtttcattcgcgtctgggtgtgttgctctcccagttcttatgaatatcaaggccgtaattgagcagcgccagtgcacaggagtatggaatcacaaggatgaactgcccattgagattgaattaggcatgaaatgctggtaccactctgtgttcgcttgtcccattttacggcagcaaacctccgacagtaacccacctataaagctaatttgtggccacgttatttcccgggacgctctgaacaagcttatcaacggtggaaaactgaaatgtccatattgtccgatggagcagaatcctgccgacgggaaaaggattatcttctag

SEQ ID NO: 33074 - DNA, 804 bp, Artificial Sequence
  Description of Artificial Sequence: Synthetic coding sequence
atggtgctcgggaactctcatttgtttatgaaccgttccaataagctggcggtcattgccagccatattcaagagagtagattcctctaccccggaaaaaatggtagattgggcgattttttcggggaccccgggaaccctcctgagtttaacccatccggatcgaaggacggtaagtatgagctactgacctccgcgaacgaagttattgtcgaggagattaaagatctgatgaccaagagtgacatcaaggggcaacacactgagaccctgttggcaggctctctcgcgaaagctctgtgttacattcaccgcatgaacaaagaggtaaaggacaaccaggagatgaagtccaggatcctagtcattaaggccgccgaagattcagccctacagtatatgaactttatgaatgtaatcttcgctgcgcaaaaacagaatatacttattgatgcatgcgttctggacagcgatagtggactgctgcagcaggcatgcgacatcacgggcgggctatacttgaaggtgccccagatgccatccctgctgcaatacttgctgtgggtattccttcctgaccaagaccaaaggtcccagctgattttacctccccccgtccacgtggactacagggctgcctgtttctgtcataggaacttgatagagatcggttacgtgtgcagcgtatgcctaagtattttctgcaacttcagtcctatttgtactacttgcgagaccgcatttaaaatctccctgcctcccgtcttgaaagccaagaaaaagaaactaaaggtgagcgcttag

SEQ ID NO: 33075 - DNA, 864 bp, Artificial Sequence
  Description of Artificial Sequence: Synthetic coding sequence
atggcagagcactttaaacagattatacgatgtcctgtgtgcctgaaagacctggaagaagccgtgcagctgaagtgcggctatgcctgctgcctgcaatgccttaacagcctccagaaagagcctgatggagagggcctcctctgccggttctgctccgtggttagccagaaggatgatataaagccaaagtacaagctgagagcactggtgagcataattaaagagttagagccaaagctgaagagcgttctcactatgaaccctaggatgcgaaagtttcaagttgatatgacctttgacgtggacactgccaataactacctgattatttctgaggatttgaggtccttccgcagcggagatctgtcccagaatcgcaaagagcaggctgaacgatttgacacagcattgtgcgtattgggcaccccccgatttacttctggccggcactactgggaggtggacgtgggtaccagccaggtctgggatgttggagtctgcaaggagagtgttaatagacagggaaaaatcgttttaagtagcgagcacggttttctgacagtgggatgtagagaaggcaaggtcttcgctgcctccacggtcccaatgacccccctgtgggtgagcccacagctgcaccgcgtggggatttttctggatgtgggaatgcggtcgattgcattttacaatgtaagtgacggttgtcatatatacacatttattgaaatccctgtgtgtgagccttggaggccatttttcgcgcacaaacgtggctcgcaggatgatcagagcattttatctatctgcagcgtgatcaatccgagtgccgcttcagctcccgtgagctctgaggggaaatag

SEQ ID NO: 33076 - DNA, 792 bp, Artificial Sequence
  Description of Artificial Sequence: Synthetic coding sequence
atggccaagaggctgcaagcggaattatcctgcccggtgtgcttagattttttttcctgctcaattagcctgtcatgtacacatgtgttctgcttcgactgtattcagagatatattctggagaaccatgatttcagggctatgtgtcccctgtgtcgcgacgttgtgaaggtcccagctctcgaagagtggcaggtgagcgtgctgactctgatgactaagcagcacaacagcagactggaacagtctttgcatgtgcgcgaggagctgcgccactttagggaggatgtgaccctggatgccgctaccgcttcttccctcttagtattctcgaacgacctgcgtagtgcacaatgcaaaaaaatacaccacgacctgactaaggatcccagacttgcctgtgtgctgggtaccccatgctttagctctggccagcattactgggaagtcgaggtgggggaggtgaagtcttggtctctcggcgtttgtaaggaaccagccgaccgaaagtctaatgatcttttccccgagcatgggttttggatatctatgaaggccggggcaattcacgcgaatacacatcttgagcgtattcctgctagtccacgcctgcgcagggttggcatcttcctggacgccgatctagaggaaatccaattctttgacgtggataacaacgtcctcatatacactcatgatggtttcttcagccttgagcttctgtgcccatttttctgcctggagctgctaggtgagggcgaatccggcaatgtgctgacaatttgtccctag

SEQ ID NO: 33077 - DNA, 597 bp, Artificial Sequence
  Description of Artificial Sequence: Synthetic coding sequence
atgccactatttgggtggatgaagtggcccaagaatgattcctataagcctactcattatccgggttccgacatcgtgacaaagactctcctcagagagctcaaatggcatctgaaagagagagaacgtcttatacaggaaattgaaaatgaacagaaagtgaagaagacaggagttgactataattggctccggaattaccagaatccacatacaacaattcccgttaccgagcaaagacagcttgaagtgttgtgttctcaggtccagccttgccagaccggaaccattttgtcgcgattccgtgaggtacttgctgaaaacgatgtgttgccatgggagattgtgtatatctttaagcaggtcctgaaagactttttaagtagctccgataggggtagcgagcaggaggacctggaggattcaggctctatggactgttccgccccttccgttattcagggtgattcaagtaagcgcgccgataaagatgaaattcctaccatctcctcttacgttgacaagaacacaaaggatcgcttccctgtctttagtcaccgtatttggaatttgccatactaccacccgagctcctag

SEQ ID NO: 33078 - DNA, 4167 bp, Artificial Sequence
  Description of Artificial Sequence: Synthetic coding sequence
atgagcatcccccttcacagtcttcggttcaacaatactatgcgggaagagaatgtggaaccccagaataagcagatggcattttgccgacctatgaccgagaccagagcagatgtacagatcctgcactcacacgtgcagcttcccattgtctccacttcagcctctgatcctggcggaaccagcactcagctgatgacgtcccccgttttcgatactatgagcgcgccactgatgggtgtgcccaactccggcgccttaagccctcccctcatgccagccagtgatagtggagccttgagcccattgctcatgccagctagtgatagcggtgccctgagtcctctcctcatgccagcgctggactctggcaccctgagtccccttctgtccacctctgaatatggagtaatgagccctggcatgatgacgatccccgacttcggtacaatgtccgctacactcatggtggcgcccgatagcgccgagatcagtccactggccatgccagcccctagtagcggcgtagtctgcacgccaatcatgtcgacctcttcatctgaggctatgagtactcctctgatgctggctccagacagcggagagcttagccccattttgatgcaggatatgaaccctggggtcatgtctactcagccagtgcctgctccctcctccgaggctatgagccccctccagatcacagatgaggacaccgaagccatgagcaaagtactaatgacggccctggcatctggggagatctcttccttactaatgtcaggaacagatagcgaagctattagctctctcataatgtcagccgtggcatcagggggaaccagccctcaacctacttccacgcagaattcaggggggattcctacccctctaatgagcgacctggacagtggaattatgagttcacttttgatgagttctcctgggagcgaggtcatgtcaacgccactcctgtccgtgcccgacgccggcgaaatgagcacgctccctaagccggccccagacgctgaagcaatgagtccagctctgatgacagccttacctagtggcgtgatgcctacacagaccatgcctgcccctggaagtggcgccatgtccccctggtctacccagaatgtcgactcagaaatgatgagcaacccaccggtgagggcaaccgctagtggcgtgatgagcgctcccccagtgcgcgcactggactccggcgcaatgagtacacccctgatgggggccccagctagtgggaatatgagcaccttgcaaaagacagtccccgccagtggcgctatgacaactagcttgatgactgtgcccagcagcggcgtgatgagcaccgaacaaatgagtgccacagccagtagggtcatgtctgcacagctcactatggcaaagactagcggagctatgcctacagggtctatgaaggccgtggccaagcaatataagcgggctactgcctccggaaagatgtccactccattacggagagctccaacaagtggagctatgagcacacaaccagtcaccgccaccgcaagcgagaccatgagcatgcctcaattaactgtcccagcttccggctccatgtctatgctccagatgagggcacctgtgagcgaagcaatgagtatgccacaaatgagaaccatggccagcggcctgactagcgccgctcagatgaaagcaatgacgtcaggggccatgagcacaccgttaatgacagctcagacttcgggatcgacgtccacactcctaatgagggatacagcatcgggcgtgatgagttgcccccaaatgcgtagtttggcaagcggagccctcagcaagccgctgatgactcccaaagcatccgggacaatgttcacagaaaagatgactaccaccgcaagcgaggccatgccaacccttcttatgcgagataccgttagcggagccttgagtatgccacagatgactgataccgcttctggcggcctatccgcatctctgatgcgggacaccgcaagcggtgctatgagtacaagccaaatgactgccaccgttagtggagggatgtccatgcctctcatgcgggctcaagaccctggtgttatgccagcgagtctcatgagggccaaagtttccgggaaaatgttatcccagccaatgtctacacaggaccctggaggaatgagtatgagccccatgaaatccatgacagccgggggaatgcagatgaattctcctactagcgatgtgatgtctactccaacagtgcgagcgtggacatcagaaaccatgtcgacaccactcatgaggacaagcgaccctggggaacgtcctagccttctgacacgcgcatccagtagtggggaaatgagcttaccacttatgagggctccagcatccggagagattgcaactccgctgaggagccccgcttacggtgctatgtccgccccacagatgactgccactgcgtctggcatgatgtcaagtatgccacaggtcaaagctcctatcagcggggcaatgtcgatgccgctcacgcgatccaccgcttctggcgggatgagtatgcccctgatgcgggccccagattctagagtcacgtccacctcccagatgatgccaacggcctccggagacatgtgtacccttcctgtccgtgccccagctagtggtggtgtgtcatccccactagtgcgcgcccccgccagtggcaccatgtccaccccactgaggaggccaagcgcctgcgagacagtgtccaccgaattgatgagagctagcgctagtggtcatatgagtacagcccagaccacggctatggtgtccggaggtatgagcaagccacttatgagggctcccgcttcaggcacaatgccaatgcctttgatgtccgccatggccagcggtgaaatgtcaatgcctctcatggagacgatggcctcaggcgcgactagtactctccagacatcagtcgcaaattcacggagcatgagtctgtcacagaccacttatactgttagcggcagaatggcaaccgcccctatcagagcctcagcttccggggcaaggtccacatcattcatgcgcgcatccgtgagcggaagtatgcccatgccactgccacgggccacagcctcgggctgtgggatggggatgagtatgccacaaatgacagccacagactcccgcggcatgagtaccccccttatgagggcgagtggccctggaactatgagtactcctcagacggcttttggagtgatgtccacgccggagattaaagcaaccgattctggtgaagcctcgacctcccatattaatattaccgcttcgggatccaagcctaccagccacatgacggcaaccaccccagagaccgcaaagccccccccgaaggaagtgccgagcttcggtatgctaactccagccttatgctatctgcttgaggaacaagaggcggcacgggggagctgctccgtggaggaggaaatggagatcgatgaagagaaacagatgaaaggctttctagacgatagcgagcgcatggcgttcttagtttcactccaccttggagctgcagaaaggtggtttatcttgcagatggaggtaggcgagccactgagccacgaaaataagagcttcctgaggagatctcaggggatctacgatagtttgagcgaaattgatattcttagtgcagttctgtgtcaccccaagcagggccagaaatctgtgcgacaatacgctactgattttctcctgctggcacgtcatttgtcgtggagtgacgctatcctcagaactagatttttggaggggctgtccgaggctgtgacgactaagatgggccgaatctttctgaaagtcgctggaagtctgaaagaactcattgatcgaagcctctataccgaatgccagctggccgaggaaaaggactcgcctggtaacagttcccaggttctgcccaccgcctgtaagaggaataatgaggaggccatgggaaacgaactgagctcccagcagcaaaccgaggaacatcagcacgtttctaaaaggtgctattacctcaaggaacacggggacccgcaggagggactccatgatcatctgggccagtccactgggcaccaccagaaggcacatacaaacaagtag

SEQ ID NO: 33079 - DNA, 267 bp, Artificial Sequence
  Description of Artificial Sequence: Synthetic coding sequence
atgtccatcccattacacagcctgagattcaataatactatgcgggaagagaatgttgaaccacagaataagcaaatggctttctgtcgccctatgacggaaacccgggccgacgtccagattctgcacagccacgtgcagcttccaattgtatcaacaagcgcttccgatcccggcgggacctcaacccagctgatgactagcccagtctttgacacaatgtctgctccattaatgggggttcctaattcaggggcattgtcctag

SEQ ID NO: 33080 - DNA, 4167 bp, Artificial Sequence
  Description of Artificial Sequence: Synthetic coding sequence
atgagcatccctctgcactctctgcgcttcaacaacacaatgcgagaagaaaacgtcgagcctcagaataaacagatggcattctgcaggcccatgactgagacaagggctgatgtgcagatcctgcacagtcacgtgcagctgcctatcgtgagtacgagtgcgtcagaccccggtggcactagcactcagctgatgacatcccctgtgtttgataccatgtccgctcccctcatgggagttcccaatagcggggcactaagcccccctctcatgcctgcctccgactcaggagctctctcccccctgctaatgccggcctccgactcgggtgccctgtcccctctcctgatgcctgccctcgattcaggaaccctaagtccgctgctgtccacatcagagtatggagtgatgtcaccagggatgatgactattcccgacttcggcactatgtctgcaactctgatggttgcccccgactccgctgaaatttcacctctggccatgcccgcaccctcctcgggtgtggtgtgcacgcctattatgagtaccagttcatctgaggcgatgagcacccccttgatgctggctcccgactccggtgaacttagtcccatcctgatgcaggacatgaatccgggtgtaatgtcaacccagccggtgccagcaccctcatcagaggcgatgagcccactgcagattaccgatgaggatacagaggctatgtcaaaagtcctaatgacagctctcgcctccggcgagatctcctctcttctgatgtccggtaccgatagtgaggctatctcttcactgattatgtctgccgtggctagcggcggcacctcgcctcagcccaccagcacacaaaatagtggtggaattccaacgcctcttatgtccgacttagactcgggtataatgtcctcattgttgatgagtagtccaggttctgaagtgatgtcaactcctctgcttagtgtgccagatgccggcgaaatgtccactctccctaagccagcaccggatgcagaggctatgagtcctgccctaatgacagcactaccaagcggcgtcatgcccacccagactatgccagcccctggctctggagcgatgtcaccatggtccacacagaacgtggattccgagatgatgtcaaatccacctgttcgggctaccgcctcaggtgttatgagcgcccccccagtccgcgccctggactccggcgccatgtccacccctctgatgggtgccccagcttcgggcaatatgtcgaccctgcagaaaaccgtgcccgcctctggcgcgatgacaacttccttgatgacagttccctctagtggcgttatgtcaaccgagcagatgtcagcgactgcctctcgcgtgatgagcgcacaattgacaatggcaaagacttcaggggccatgccaacagggagcatgaaagccgtggcgaagcagtataaacgggctacggcaagtggaaagatgtctacccccctgcgacgcgcacctacttctggggctatgtcaacacaaccagtgacagccacagcttctgagactatgagtatgccacagctgacagtgccagccagcggaagtatgtctatgcttcagatgcgagctcccgtttccgaagccatgagtatgccccaaatgcgaacaatggccagcgggctgacctccgccgctcagatgaaggccatgacatcaggcgccatgtccaccccattgatgacggctcagacctccgggagcacttctactctactcatgagagatactgcatccggcgtgatgtcctgtccacaaatgagaagcctagccagtggcgcccttagcaagcctctcatgacaccaaaggcttcgggcactatgttcacagaaaaaatgactaccacggcatcagaagctatgccaaccctgctgatgcgcgacacggtctcaggggctttgagtatgccacaaatgaccgacacggccagtgggggactaagcgcttcactcatgcgagacactgcatctggggctatgtctacttcgcagatgactgcaaccgtatcgggggggatgtcaatgcccttgatgagggcgcaggacccgggtgtgatgcccgccagcctgatgagggccaaagtgtctggaaaaatgctgtcacagccaatgagtacacaggacccaggaggtatgagcatgtcccccatgaaaagcatgaccgcgggagggatgcagatgaactctcctaccagcgacgtcatgtccacaccaacggtcagagcgtggacgtctgaaacaatgagtactccccttatgagaacttcagatccaggcgaacggccgagtctcttaaccagggcgtcctcatccggggagatgtctctccctctgatgcgcgccccggcttcaggtgagattgccacccctctgagatcacccgcctatggcgcgatgtctgcaccgcagatgaccgccaccgcatctggtatgatgtcttccatgcctcaggtcaaggcccctatttctggggctatgagcatgcccctgactcgcagtactgccagtgggggtatgtcaatgccactcatgcgtgcacctgactccagggtcacatctacttctcaaatgatgccaacagcttcaggcgatatgtgcacccttcccgtgcgggctccagcatccggcggggtttcctctcctctcgtgcgagcacccgcatctgggaccatgagtacacccttacgacgcccaagcgcctgtgagacagtgtccacagagctcatgagagcaagcgcttccggacatatgtccactgcacaaactaccgccatggtctccggtggaatgtcaaagccactgatgcgtgctcctgcaagcggcacaatgcccatgccactcatgtcggcaatggcatcaggagaaatgagtatgcctctgatggagactatggccagtggagccactagcacactccagacctcagtggccaactcccggagtatgtcacttagccagaccacttataccgtgtcaggaagaatggctacagcccctataagggcgtccgcgtctggggctcgttccactagcttcatgcgggcgtcagtgtccggcagtatgcccatgcctctcccgagggcgaccgcgtccggctgcggaatgggaatgtcaatgccccagatgacggcaactgacagtcgtggcatgtccactccgctcatgcgtgcttccggcccggggacgatgtctacgcctcagactgcattcggagtgatgagcactccagagattaaggctactgactccggagaggcctctacatctcacatcaacattacggccagtgggagtaaacctacttcccacatgacagccacaactccagaaacagctaagcctccccctaaggaggtaccaagcttcgggatgctgacaccagctctttgctatctgctcgaggaacaggaagccgcccggggaagctgtagcgtggaagaagagatggaaatcgacgaagagaagcagatgaaaggctttctggatgacagtgagaggatggcatttctggtgtcccttcaccttggagctgcggagcgctggttcatactgcaaatggaggtcggcgagcccctcagtcatgaaaataaatctttcctcagaaggtcccagggcatctacgatagtttatctgagatcgatatcttgagcgccgtcctgtgtcaccctaagcagggccagaagtccgtgcgccagtatgccaccgacttcctgttgctcgcccgacacctttcgtggtccgacgccatcttgcggacaagattcctggagggtttaagcgaggcggttaccaccaaaatggggcggatcttcctgaaggtcgcgggcagcctaaaggagctgatcgataggtcgttatacaccgagtgtcagctggcagaagaaaaagatagcccaggaaattcctcccaagttctgcctaccgcatgtaagcgcaataatgaagaggccatgggcaatgagctgtcttctcaacaacagaccgaagagcaccagcatgtctctaaacgctgctactaccttaaagaacacggggatccacaggagggactgcatgatcacctgggacagtctacagggcaccatcagaaggcgcacacgaataagtag

SEQ ID NO: 33081 - DNA, 2850 bp, Artificial Sequence
  Description of Artificial Sequence: Synthetic coding sequence
atgtcgatacccctccattctctccggttcaataataccatgcgtgaagaaaacgtcgagccgcagaataaacagatggccttctgtagacccatgaccgaaacccgcgcagacgtgcagatcctccattctcatgtccaactgccgatcgttagtacatccgcctctgacccgggtggtacatccacccagctgatgacctcccccgtttttgataccatgtctgcccccttgatgggcgtgcctaactccggagccttgtctccgccactgatgccagcttccgacagcggggctctctctcccttactgatgccagcgtccgactccggagcattgtccccccttttaatgccagctctcgactctggcactctcagtcctcttctttcgacctcagagtacggagtgatgtctccagggatgatgactattcctgattttggaacgatgtctgcgacccttatggtggcccctgatagcgccgagatcagtcctcttgcgatgcctgcaccatcctccggggtggtgtgcacccctattatgtctacttcatcttctgaggctatgagcacccccctgatgctggctcccgattccggagagctctccccaatcctgatgcaagacatgaaccctggtgtgatgagtacacaacctgtccccgcaccttctagcgaagcaatgagccccctccaaatcacagacgaagatacagaggcaatgtctaaagtcttgatgactgctttggcctctggcgaaatttcgagtctgttaatgtccgggacagatagcgaggcaatctcatccctgatcatgtctgcagtcgcatcgggcggcacaagcccgcagcccacaagtactcagaacagtggaggaatccccacccccctcatgtcagatttggacagtgggattatgtcctccctcctcatgtccagcccggggagtgaagtgatgtcaaccccactcttgtctgtgcccgacgctggcgagatgtctaccctgcccaagcccgcccccgatgcagaggcaatgtcccccgcactcatgactgccttgccaagcggggtaatgcccacccagaccatgcccgcacccggctcaggtgcaatgtctccctggtcaacgcaaaatgtggacagtgagatgatgtccaacccccctgtccgtgctacagcgtccggcgtcatgtcagcacccccagtgcgtgctttagatagcggggccatgagtacccctcttatgggtgctcccgcctctggtaatatgtcaaccctgcagaagacggtacctgcgtcaggggcgatgaccaccagtctgatgacagttcctagttcaggcgtgatgtcaactgaacagatgtcagcaaccgccagtagagttatgagtgctcagttaaccatggcaaagacctcaggcgcgatgcctacagggtctatgaaagctgttgcaaaacagtataagagagctactgctagtggcaagatgtcaacaccactccggcgagcaccgacctcaggcgccatgtctacgcagcccgtgacagccaccgcctccgagacaatgagcatgccacagctcacggtgccagcatctggatccatgtctatgctgcagatgagagctcccgtgagtgaagctacatcgaccctgcagacatccgtggccaatagtcgtagtatgagtctctcccagacaacctataccgtttccggtcggatggcaacggctccaatccgggcctccgcctcgggggcacgatccacgtcattcatgagagctagtgtcagcggctccatgcctatgccgcttcctcgcgctacagccagtgggtgtgggatgggcatgtcaatgccccagatgactgcaactgactcgcgcggcatgtcaacacctcttatgcgggcctctgggccaggcacgatgtctacaccccagacggcctttggagtgatgtctactcccgaaataaaagcaaccgattcaggtgaggcttctacctcacacattaatattaccgcttcaggcagtaagcccacgtcccacatgactgcgaccactccggaaacagccaaacctcccccaaaggaggtcccctccttcggcatgcttacccctgctctctgctaccttttagaagagcaagaagccgctcgcggatcttgtagcgtcgaagaggagatggagatcgatgaggaaaagcaaatgaaggggtttttggacgattccgagcggatggcctttctggtttcattgcacttaggcgcggctgagcgttggtttatccttcagatggaggtgggcgagccgctgtctcacgaaaataagtccttcctgagacggagtcagggaatctacgactcattgtccgaaatcgacatcctcagcgcagtcttatgccatcctaagcaaggacagaaatccgttcgccagtacgccacagattttttacttctggctcggcacctctcatggtccgacgccattctccgaacacggtttctcgaaggcctgtccgaggcggtgaccacgaaaatgggccggatctttctgaaagtggccggatccctcaaagaacttatcgaccggtctctctacaccgaatgccaacttgccgaggagaaagacagccctggcaacagctctcaggtgctgcctaccgcctgcaagcgtaataatgaggaggccatgggtaatgagctgtcatcacagcagcagaccgaagaacaccagcacgtgtccaaacgctgctattatcttaaggaacacggcgatccacaggagggtttgcacgatcacctcggccagtccaccggacaccaccaaaaagcacatacaaataagtag

SEQ ID NO: 33082 - DNA, 1710 bp, Artificial Sequence
  Description of Artificial Sequence: Synthetic coding sequence
atgtcagaagcctccggtaatctgaattcccttagaatggctaatgtagccttgcgggaggaattgaacgccctccgcggcgagaacgctaacttaggactccagctgggcagggccctggcagaagtgaattcactgcgggggaacgtttcttcatatattagatggccggtcccaatcgtccctgtgctcgcggaagaaaacctggaattcgcattgagcgagattgaggtgattccagggggcgaattgcccttcctatgccggcctccacccagagcggaacccgattgcatttccgatgacctgcttattaacgttattcaggaccggtctactccggatggcccagctgacccacccttgctgcccatcccacccccacccgcgcttccccctcccgcttccaaagagccaccgccccagccccctctggctcccctggagaggcctgaaatcgagccattcagtggagaccccgtttatctcgccgaatttcttatgcagttggagaccttcatcgccgaccacgaagttcacttccctggaggcgctgaacgtgtggcatttcttatcagcttcttcactggagaagccaaagactgggcaatctctgtgacccaggaggggtcgcctttgcatgccaactttcctaggtttctcgacgaaatcaggaaagagttttgtggtccaatacctcctcgcgttgccaagaaagcgatcaggaagctgaagcagggacattgcacgctgggcagctacgctgatgcctttcaattcctggcccagtttctgagctgggatgactgcaggctccagaaccagttcctcaaaggattaagcgagtttttcagaaaagagctgttgtggtccacagaaatggctgatctggacgagctcatcttggagtgtgtcgagatcgaaagaaaggtcagagtaccgaagccaataccactgccaggcgtgcgtaatattatttttccattcgccccatctcccaatgaggaggagtcggaggatgaagaatactattcagaagacgaagatcaggaagctcggcggcaccggctgcattctaaagatcagcggaaaaggatgagggccttccagcaggagatgaaagagaaggaggaggaagaaatgaaaaaagaggaagaaatgaaaaagaaggaggagaaggaggaggaggaggaggaggagatgaaacagaaggaagaggaggaagagattaggaataaaaatgaggaagaaggcgaatctaaggacgaggaggacgaggatgaggatggtggacagaagcccgagggcgaaccgcagcaggacccaggaacggaagaaacatacggagaggttgaagaggagcccttggacgaagcacaggacgacgacctggatgaactgatggagatggaaccaaccttcgtgcatgcctcttcacagacctccggaccgacttctggataccacgctgagaactttctaggtgccagtccaccaattattcaaccctcccggcgcagaaatcaaaacagggtccccctgctggaggggttacctgggacaaattcgcctttttatagtagcccccagctgatcagaaggactgggcggcttggacagcggcaggtacgacgcagacctcccgtcctgtttagacttaccccccgccagggcggccatagggccgccaggggcaggattcgcgtgtag

SEQ ID NO: 33083 - DNA, 1710 bp, Artificial Sequence
  Description of Artificial Sequence: Synthetic coding sequence
atgagcgaagcgtcaggcaatctgaatagcctcaggatggcgaacgtagcccttcgtgaagagctgaatgctctgaggggggagaacgctaacttggggctgcaattaggccgggccctagctgaggtgaatagcttaagaggtaatgtgagctcctatatcagatggcccgtgcccatcgtgccagtgctagccgaggagaacctggagtttgccctgagcgagatcgaagtgatcccggggggggaactgccatttctatgtcgtcctcccccacgggcagagccagattgcatatctgatgatcttctcatcaacgttatccaggaccgctccactcccgatgggcctgcggatcctcccctcctgcctatcccccccccgcccgctctccccccccctgcgagcaaagaacccccaccccagccacccctggctccgctggaacgccctgaaatagagccattcagtggggaccctgtatatctcgccgaattcctgatgcagctggagaccttcatagcggaccatgaggtgcactttcctggtggggctgaacgcgtggccttcctgatctccttcttcaccggggaggcaaaggactgggccatctccgtgactcaggaagggagccccttgcacgccaacttccccagatttctcgacgagattaggaaggagttttgcggcccaattcccccccgggtagctaagaaggctatacgcaaactgaaacagggacactgcacactggggtcgtatgcagacgcattccagtttttggcccaatttttgtcctgggacgactgtcgactgcagaaccaattccttaagggtctcagtgaatttttcagaaaggaactcctttggtccacagagatggctgacctagacgagctcatccttgagtgcgtggaaatcgaaaggaaggtgcgggtgcccaagcccatccctcttccgggcgtccggaatattattttccctttcgcaccttcacccaacgaggaggagagtgaagatgaagagtattacagcgaagacgaggatcaggaggctagacgccaccgcctgcattctaaagatcaacgtaagcgcatgagagcctttcagcaggagatgaaggagaaagaagaggaggagatgaagaaggaggaagagatgaaaaagaaggaggagaaggaggaggaggaagaggaggaaatgaaacagaaagaggaagaggaggagatcagaaataagaacgaagaggagggtgagagcaaagatgaagaagatgaggacgaggacggcggccaaaaaccggaaggagaaccacagcaggaccccggtaccgaggagacctatggcgaagttgaggaggagcccttggacgaggcccaggacgatgacctggacgagctgatggagatggagcccaccttcgtccacgcttcatcccagacctcaggcccaacctcaggctaccatgctgagaacttccttggcgcctctccccccattatacagccttctaggcgaaggaaccagaacagagtacccctcctggaaggcttacctggcactaactccccattttacagctctccccaactgatcagacggacgggccgcctggggcagagacaggttagacgccggcctccagttctttttcggctgactccgcggcaggggggccatagggccgccagaggccgcatcagggtctag

SEQ ID NO: 33084 - DNA, 2028 bp, Artificial Sequence
  Description of Artificial Sequence: Synthetic coding sequence
atgcttagagcgaccgcgccatgctggtttcctccggggtatcctgaagccaaaaaagttgctgaggaggccgctttagaggcctcgagacatctgggtggcgaacagtcacaggcaggagcgccagagggatccaagatgctgagagctacagctccttgttggtttcgtcctggctatccagaagccaaaaaagtagctaaggaagctgcacccgaggcttccagacacctgggcgctgaacagagccctgctggagctcccgaaggctccaaaatgctgcgagctactgccccatgttggttccccccgggctacccagaagctaaaaaggtcgcggaggaggccgctctcgaagcacccgaatttcccctgccttcccatcagcccgcccagagctttggcctctgggtgccacaaatgcataaacaggcatccgcattcgtggacattcaggccgagccacagaaccgagggcccgcagtgccacctgcttggccgaaaatggtgaccgaaagttgctattttcctgcacagcgtggctctgcatgtagactgcctgcagcgcccagacttactgagagaccctccggagtgcggataagcgcgcctcggaaacgtaagactattgcccattccagcagcccctgcctggtgacaggctatacggacgctaaaagaaccagggtcgccagcagctcccaaagatcacgtgggtccaaagtgggcagacagccagggaagacacgaaaccgctccgggatggcatgcaagacaacagctacaacttccagtaagcgcattgttcggagagcttctctgccttccctgtctttgaaaaagcctatcatcttaaggtcttctggatgccaggtcccgactgtactgagacgcggatatctgcagctctttacagaggaatgcctcaaattctgcgcctcgaagcaggaggccgaggaaaaggcactcaatgaagagaaagtggcttacgactgtagccccaataaaaataggtatcttaatgtggtgctgaatacattgaagaggctgaaaggccttacaccctccagcatgcccggcctgtctcgagccgccttgtattccagactccaggaattccttctgacacaagaccaacttaaagaaaatggctatcccttcccgcacccagagcgccccggcggggccgtgttattcaccggacagggcaaaggtcccggcgactcatcttgccgcgtctgttgtcggtgcggtaccgaatacttggtctcttcatctggaaggtgtgtccgcgatcagctgtgctactaccactggggccgagtaagatcttctcaggtggcaggcggacgggtgtcacagtatacttgctgtgccgccgccccaggcagtgtggggtgtcaggtggccaaacagcatgtgagagacggtcgcaaagaatcactggatggctttgtggaaacatttaagaaggagttgtcaagggacgcataccctggcatatacgccctggactgcgagatgtgctatacaactcacggtctggaactcacccgcgtgaccgtggttgacgccgatatgagggtggtttacgatacgtttgtgaagccagacaatgagatcgtcgactacaacacccggttttcgggcgttactgaggctgacgtggccaagacctcaataacactgccgcaggtgcaggccatcttgctgtcctttttcagcgcacagaccattctgatcggccacagtctggaatcagacttactggcccttaagctcattcacagtaccgtcgtggataccgctgtcctgtttccgcactatctggggttcccctataagaggtccctacgtaacctggccgccgactacctggcgcagataattcaagatagccaggacggacataacagtagcgaggacgcaaacgcctgcctgcagctggtgatgtggaaggtccgccagcgcgcgcagatccagccccggcaccggtccgcctcccctgcagctcttgcctgtccctag

SEQ ID NO: 33085 - DNA, 2028 bp, Artificial Sequence
  Description of Artificial Sequence: Synthetic coding sequence
atgctaagggcgacggctccttgttggtttccccctgggtaccccgaagctaaaaaagtggctgaggaggccgcactggaggccagtcggcacttgggcggtgaacagtcgcaggccggggccccagaaggctccaagatgctgagggccaccgcaccttgctggtttaggcctggctacccagaggccaagaaggtggccaaagaggcagcccccgaggcatcaaggcacctgggcgctgaacagtcgcctgcaggggctcccgaaggatctaagatgcttagagctaccgctccctgctggtttccacctggctaccccgaagccaagaaagtggctgaagaagctgccctcgaggcccctgagttccccctgcctagccatcagcctgctcagtcctttgggctctgggtcccccaaatgcacaagcaagcttccgcattcgtggatatacaagcggaaccacagaaccggggaccagcagtccccccagcctggccgaagatggtgaccgaatcatgttatttccccgcccagcggggatcagcctgccggctaccggccgcaccacgtctcacagagagaccatccggggtgcgcatctccgcgccacgcaaaagaaagacaattgcacactccagttctccctgcctggtaaccggatatactgacgctaaacgcacaagagtggccagtagctctcagcggtcccggggctctaaggtcggaagacaacccgggaagacacgaaataggtcaggcatggcctgcaagactacggccacgacaagttccaaaagaattgtgcgccgtgcttcactgcccagcctgtccctcaaaaagccaattatactgcgtagttccggttgccaggtacccaccgtcttgaggagaggatatctacagctcttcaccgaggagtgtctgaagttttgtgcctctaaacaggaggcagaggagaaggccttgaacgaagagaaggtggcctacgactgtagccctaacaagaatcgttatctgaacgtggttttgaataccctgaaaagactgaagggcctgaccccaagctccatgccgggtttgagtagggccgcactgtactcacgtctgcaggaatttctcctcacccaagaccagctcaaagagaatggctacccctttccacatcctgaacggcctggaggagcagtgctttttacagggcaggggaaaggccctggtgattcaagttgcagagtgtgttgccgctgcggtacagagtacttggtgtcttcatcaggcaggtgtgttcgagaccagctgtgctattatcattggggaagagtcagatcgtcgcaagtggcaggaggcagggtctcccagtacacttgctgcgcggccgctcctggctcagtgggatgtcaagtggctaaacagcacgtgcgggatggccgaaaagagtcactcgatggatttgtagaaaccttcaaaaaggagctttcgcgtgacgcttacccgggcatctacgccctggactgtgaaatgtgttacacaacccatgggttagagctgacccgcgtcacagtggtcgacgccgatatgcgagttgtttacgacaccttcgtaaagccagataatgaaatcgtggactacaatacccggttctcaggtgtaacggaagccgatgtggcaaagacaagcattactttgccacaggtacaagccatactgctaagcttcttttcagcacagaccatcctcattgggcactccttggagtctgatctgctggccttaaaattaattcactcaacagttgttgatacagcggttctgttcccccattacttaggattcccttacaaacgtagcctaagaaacttggcagccgactatcttgcacagatcatccaggactcacaggacggtcacaatagctccgaggacgccaacgcatgtctccagctggtgatgtggaaggtcagacagagagcgcagatccagcctagacatcgatccgcttcacctgcagcacttgcttgcccgtag

SEQ ID NO: 33086 - DNA, 3864 bp, Artificial Sequence
  Description of Artificial Sequence: Synthetic coding sequence
atggtggcccgaagcacagacagtttagacgggcctggggaggggagtgtccagcctctacctacagccggcggaccgtctgtgaaaggcaagcccgggaagcgcctctcagctcctagggggcccttcccacggctcgccgactgcgcccacttccattatgagaatgtggacttcggacatattcagctgttactgtcaccagaccgcgaaggcccctctctgagtggtgaaaatgagctcgtgttcggtgtgcaagttacctgtcagggccggtcctggcccgtcctcagatcttatgatgatttccgaagtctggatgcccacctgcaccgctgcatcttcgaccgtagattctcctgtctccctgagttacccccaccccctgaaggggccagggctgcacagatgctcgttcctctgttgcttcaatatctggagacactcagtggactagtggacagtaatctgaattgcggccccgtgctgacgtggatggaactcgacaatcatggacggcgcctgctcctgtccgaggaagcctcactgaatataccggccgtcgccgcggcccatgtgatcaaacgctacactgcccaagccccagacgaactgtcgtttgaagttggagatatcgtgtcagtgattgatatgccacctacagaggacaggtcctggtggcgcggcaaacgtgggtttcaagtgggcttttttcccagcgaatgcgtggagctctttacggagcgtcccggccctggactgaaagctgacgcggacggcccaccgtgtggaatacccgcccctcaggggatttccagcctgacctccgcagttcctagaccaagaggcaagctggcagggctactgagaacctttatgagaagccgtcctagcagacagcgcctacgtcaacgtgggatcctgcgccagagggtgttcggctgcgacctgggcgaacacctgtccaatagcggccaagatgttccacaggtgctgcgctgctgctcagaattcattgaagcccacggtgtcgtggacggaatctaccggctttccggtgtgagtagcaacatccagcggctgcgccatgaatttgactccgagcgcatccccgaactctccggccccgcgttccttcaagacatccatagcgtgtccagcctttgcaaactgtactttagggaattaccaaaccctcttctgacctaccagctgtacgggaaattttcagaggcgatgagtgtacctggagaggaggaacggcttgtgagagtgcacgatgtgatccaacaattaccacccccccactacaggaccttagaataccttctgcggcatctggctcgcatggcacggcattccgccaatacaagtatgcacgccaggaacctagctattgtctgggcaccaaacttgcttagatcaatggaactggaatccgtggggatgggcggagctgccgctttcagggaggtgcgtgtgcagagtgttgtcgtggagttcctcctcactcacgtggacgtgctctttagcgatacttttaccagcgcagggttggatcccgcggggcgctgcttactgcctcggcccaaatcccttgctggctcctgtccctctactagattactgactctagaggaagctcaagccagaacacaggggcgcctggggacacccactgagcccaccacacccaaagctcccgcatcgccagccgaacgtcggaagggtgaaagaggcgaaaaacagcgcaagccagggggatcatcttggaagacattcttcgcgctggggagggggccaagcgtgcccaggaagaaaccacttccctggctgggcggcacccgagcccccccacagccttctggatcccgacctgacactgtaaccctgcgtagtgccaaaagcgaggaaagcttatccagtcaggcttcaggagcaggtctgcagcgcctgcacagactcagaagaccccatagttctagcgacgcattcccggttgggccggcacccgccggctcctgtgagagcctgtcaagctccagctcttctgagagttcctcttccgagagctcgtcttctagcagtgagtcctctgcagctgggctcggtgcgctgtcaggaagtccaagtcatcgcacttcagcttggcttgacgatggggatgagctcgactttagcccaccacggtgcctggagggacttcgcgggttagacttcgacccactgacgttcaggtgttcctcacctaccccaggagacccagccccgccagcttcccccgccccacccgcacctgccagtgccttcccaccaagagtcacaccgcaggccatctctccgcgcggcccaacatctcccgccagccccgcggccctggacatttcagagccactcgccgtatctgtgcctcctgcagtgttagaactactgggggccggaggcgctcccgcttcagctactccaacccccgcgttgtcacctggacgtagcctccgcccccatcttattccactgctgctgagaggcgcagaagctcccttaactgatgcctgtcagcaggagatgtgcagtaagctgcggggagcccagggaccgctgggcccggatatggagtctcccttaccaccccctcccctaagcctgttacgtcctggcggagcccccccaccgcctcccaagaatcccgcccgcctcatggctctggccttagccgagagagcacagcaagtcgccgaacagcaaagccaacaggaatgcgggggcaccccccccgctagccaaagcccattccatagatcactgtcgctcgaggtgggaggggaacccctcggcacaagcggcagcggacccccccccaactctttggctcatcctggggcctgggtacctggtccgcccccttatctccctagacagcagtcggacggcagtctacttagaagtcagaggccgatgggaacttcaaggagaggtctgaggggccccgcacaggtctcagcccagctgagagctggcggtggggggagggatgcacctgaggctgctgcccagtccccgtgtagcgtcccatcccaggtccctacccccggattcttcagcccagcgcctagagaatgtctacccccctttctcggggttcctaagcccggcctgtatcctttgggcccaccttcatttcaaccctcttcaccagcccctgtgtggcgaagttcgctaggtccacccgcccccctggacaggggggagaatttgtattacgaaatcggggccagcgagggctccccgtactcaggacctacacgtagctggtccccctttagatctatgccccctgatcgcttaaatgcatcctatggcatgctggggcaatccccacccctgcacaggagccctgactttctgctgagctatccccccgccccttcatgctttccccccgaccacctcgggtacagcgcaccacagcacccagcgcgcagaccaacgcccccggaacctctgtacgtgaaccttgcgcttggtccacggggccccagtcctgcctcttcttcatctagtagcccaccagcccatccccgcagtaggagcgatcccggcccaccggttcctcgcctgcctcagaaacagagggccccgtggggtccacgcactcctcaccgggttcccgggccatggggccccccggagccgttactgctctaccgcgcggcaccacctgcctacggccgtggaggtgagctacatcggggatccctttatagaaatgggggccagcgcggggaaggagctggcccgccacctccctacccaactcccagttggagcctgcactccgagggtcaaacacgcagttactgctag

SEQ ID NO: 33087 - DNA, 2604 bp, Artificial Sequence
  Description of Artificial Sequence: Synthetic coding sequence
atgaggagccgctctcccccccgtccaaaatggcactcccgggacgggagtagtcagagcgactccggtgaagaacagtctaggggtcagtgggctagacgtaggaggcgcgccaggtcatggagtccttccagcagcgcctcttcaagcgcttcacctggcagaagtcagtccccgagggcggctgccgccgcattaagccaacagcagtctttacaggagcgccttagactgcgcgaagaaaggaagcagcaggaggaactgatgaaagcttttgagacacccgaagagaagagagcccgccggctggcaaaaaaagaggcaaaggaacgtaagaagagggagaaaatgggctggggtgaggaatacatggggtataccaatacagataacccatttggcgataacaatctgttagggacctttatctggaacaaagccttagaaaagaaaggcatttctcaccttgaagagaaagagctgaaggaacggaacaagcgtattcaggaggacaataggctggaactgcagaaagtgaaacagctgcggctagaaagggagagagaaaaggcaatgcgtgagcaggagctggagatgctgcagcgggaaaaggaagcagagcacttcaaaacctgggaggagcaggaggacaatttccatcttcagcaagcaaagttgcgctccaagattcgtatcagggacggcagggctaaacccatagacctgctggcaaaatatatcagtgctgaggatgatgatcttgctgtagaaatgcatgaaccgtacaccttcctgaacggtctgaccgtagccgatatggaggacctcctggaagacatccaggtgtacatggaactagaacagggcaaaaatgctgacttctggcgtgacatgaccacgatcacagaggatgagatcagtaagcttcgcaaacttgaagcatctggcaagggtcctggcgaacggagagaaggtgtgaacgctagcgtctcctcagacgtgcagagtgtctttaagggcaagacttataaccagctacaggtcattttccagggcattgaggggaagatccgcgcagggggacccaatctggacatggggtattgggagtctctactccagcaactcagagcacacatggcaagggcgcgtctcagggaacggcatcaagatgtgctccgtcagaaactgtacaagctgaaacaagagcagggcgtggagagtgagccccttttccctatacttaagcaggagccacagtcaccatctaggagtcttgaacccgaggacgcagcccccaccccacctggtccatcatcggaggggggcccagccgaagcggaggtggatggggccacacccaccgaaggcgacggagacggcgacggggagggcgagggcgagggtgaggccgtcttaatggaagaggaccttatacagcagagcctggatgactatgatgctggcaggtacagcccaagactgctgaccgcccacgaacttccccttgacgcccacgtgctcgaaccagatgaagatttgcagaggcttcagctgtcaagacagcagttacaggtgactggtgacgcgagtgagtctgctgaggatattttttttcggcgagcgaaagaagggatgggtcaagacgaagcccagttctctgtggagatgcccctgacaggcaaggcttacctgtgggctgacaaataccgtccacgaaagcctcggttttttaacagggtgcacacaggcttcgagtggaacaagtataatcagactcactacgactttgacaaccctcccccaaagattgtccaaggatataagttcaatatcttttaccccgaccttatcgataaacgcagtacgcctgaatattttctggaagcctgtgctgacaacaaggacttcgccatattacgttttcacgccggcccgccttacgaggacattgcgtttaagatcgttaatcgagaatgggaatatagtcaccgacacggcttccgatgtcagtttgccaacgggatctttcagctgtggttccattttaagcgctatagatatcggcgccccggcccctgttggaggccaattcgacactgccggcgcgatcccctgtggacacccacgctgtgtagggattggccgccgacccaccctgtacttgctggaggcgtccactttccagcagctgggatcccaccccctggcctgctgactgggccgtggagcatgcgcccagttaccccttcatttgcccacattaggaccgtggccccctcccactccccgttctccggacaggagggacgcggcccacatgggtgtcacagtcccggtcgttcgggccccgcaggacggctcgtgctccaacaccctaccggaactagcccaacagaagccaaacggaaggtcccgcctggtccacccgaagggcatccaacatccccagtgacgtctccccgcccacccactgctccaccacgacatcccgcgagttcaggaaacagctcagtttgtttttccaagaaaacttgtcggtgggagaaaaagtcgtttgtgctgatggaacttgcctactggcaggaccgaatgtttttctag

SEQ ID NO: 33088 - DNA, 3381 bp, Artificial Sequence
  Description of Artificial Sequence: Synthetic coding sequence
atggtggcacggtcgacagactccctggatggtcctggtgagggatccgtgcagccccttccaaccgctggagggcccagtgtgaagggaaagccagggaaacggctttctgccccacgtggccctttcccccgcctagccgattgtgcacactttcactacgagaatgtggattttggacacatccagctgcttttgtccccagatcgcgaaggtccaagtttaagtggtgagaatgagctggtgttcggcgttcaggtgacctgccagggacggtcctggcctgtccttcggtcatatgatgatttccgtagcttggacgcccatctgcacaggtgtatttttgaccgtcgcttttcctgtctcccagaacttcctccacccccggagggagccagggccgcccagatgctagtacccctgttactgcaatacctggaaaccctcagtggcttagtagactctaatcttaactgtggacccgtgctgacgtggatggaactggataaccacgggcgacgcctgttgctgtcggaggaggctagtctaaatattccggccgtggccgccgctcacgtgatcaagcgttatacagcccaggctccggatgagctctctttcgaagtgggagatatcgtgagcgttatcgacatgcctccaactgaggatcggtcatggtggcggggaaagagggggtttcaggtgggattcttccctagcgagtgcgtggagctgttcaccgaaagacctggccctggtctcaaggctgacgccgacggcccaccatgcggcatccctgccccgcaaggaatcagtagccttacttccgcggtacctagaccccgcggcaaactcgctggactgcttcgtacttttatgaggtccagaccctctcggcagaggctgcgacagaggggtattttgcgacagagggtcttcggttgcgatttaggggagcacctctccaactcaggtcaggacgtgccccaagtgctacgctgctgttcagagtttatcgaagctcatggagtcgtcgacggcatttatcggttaagcggggtcagctccaatattcagcgactgaggcatgagtttgactctgagcgcatcccggaactcagcgggcctgctttcctacaggacattcattccgtttcgagcctgtgtaagctttatttccgggagctgcctaatcccctgttaacctatcagctgtatgggaagttctcggaggcaatgtcagtccccggcgaagaggaacggttggtgcgggtgcacgatgtgatccagcaactgccacccccacactaccggaccctcgagtatctgctcaggcatctcgcacggatggcccgtcactctgccaatacatctatgcacgcaaggaacctggccatagtgtgggcccctaacctgttaagaagcatggaactggagtctgtcggcatgggcggcgctgctgcatttcgggaagtgagagtgcagagtgtcgtcgtcgagttcctgctcactcacgtggatgtgctcttctcagacaccttcacctcagccggtcttgatccggcaggtagatgcctgctgccgaggcctaaaagcctggccggctcctgcccttcgacacggctgcttaccctggaggaagcacaggctcgaactcagggcaggttaggaactccaactgagccaaccactcctaaggctccagcctctccggccgagagaaggaagggggagcggggggaaaaacaaagaaagcctggtgggagtagctggaagactttcttcgccctcggccgcgggccctccgtgccacgcaagaagccactaccatggttaggaggcacccgggcccccccccagccatccggcagcagacctgatacggtgacgttgcggtcggccaaaagcgaggagtcccttagttcccaggcatcaggagcagagctgctgggggccggcggtgcgcctgctagcgccactccgacccctgcactcagccctgggcgatctctgcggccacatctcattcccttgctcctaaggggcgccgaagccccccttaccgacgcctgtcagcaggagatgtgttctaagctccggggagctcagggaccacttggaccagacatggagtcacctcttcctcctcctcccctaagcctactgcgccctgggggagctcccccgcctccccctaaaaatccggcccgtttgatggctctcgctctggctgaacgcgcccagcaggtggctgaacagcagagtcagcaagagtgcggaggtaccccaccagcctcacagtccccattccacagatcactgtctttggaggttggtggggaaccgctaggaaccagcggctcaggtcctccgcctaactcactggcccaccccggagcttgggtgccaggaccccccccctaccttcctaggcagcagtctgatggtagcttgctgcggagccagcggccaatgggcacttccagacgcgggcttcggggacccgcacaggtgagtgcccagctccgcgcgggcggaggcggacgggacgccccagaggccgccgcacagtcaccatgttctgttccctcccaggttccaactcccggattcttctctccagcaccccgtgagtgtctgccaccgttcctaggtgtaccaaaacctgggctctatccgctaggacctccgagctttcagcccagcagccccgctcctgtatggcgctcatccttggggccccctgcccccttggatagaggagaaaacctctactatgagattggggccagcgaaggttctccttactctggccctactcggtcttggagcccctttaggtccatgccacctgaccgattgaatgcctcctacggtatgctggggcagtcccccccattgcacagatcgccagatttcctgctgagttaccccccagcaccaagttgctttccgcccgatcacctgggatactctgctcctcagcaccccgctcgccggcccacgccacccgagccactgtacgttaacctcgcactggggccccgtggcccatcaccagcctccagctcgtcgtcatccccaccagcccaccccagaagtagaagcgaccctggtccgccagtgcccagactgcctcagaagcaacgagccccttggggccctcgcacacctcaccgcgtccccggcccatggggccctcctgagccactgctgttgtatcgagccgcgccgcctgcttatggtcgcggcggtgagctccatagaggttcgctgtaccggaatggaggtcagcggggagaaggggcaggtcctccccccccatacccgacaccctcatggagtttgcacagcgagggtcagactcgttcctactgttag

SEQ ID NO: 33089 - DNA, 3372 bp, Artificial Sequence
  Description of Artificial Sequence: Synthetic coding sequence
atgctggtgcctttactactgcagtatctggagaccttatctggtctcgtggattccaatcttaactgcggcccggtgcttacctggatggaactcgacaatcacgggcgccggctgctcttgtctgaggaggcatcgctgaacatccccgctgtagcagccgcccatgtaatcaaaagatacacagcacaggctcccgacgaacttagctttgaggttggtgacatcgtctctgtcatcgacatgccaccaactgaagacagatcctggtggcggggcaaacggggtttccaggtcgggttcttcccctctgaatgcgtggaattattcacagagcgtccgggcccaggcctcaaggccgatgccgatggtcccccatgcggtattcctgcccctcaggggatctcctccttgacatctgccgttccacgtcctcgaggcaagttagccgggttgctgcgcacattcatgcgcagtcgcccgagccgtcagagactgaggcagcgagggatccttcgtcagagagtcttcggttgtgatcttggtgaacatctctccaactccggccaggatgtcccccaggttctgaggtgttgcagcgaattcatcgaagctcacggcgtcgtagacggcatttatagattatccggggtgtcttctaacattcagcgcctgaggcacgagttcgacagtgaaaggattccagagctgtcaggaccagctttcctgcaggacatacacagcgtttccagcttgtgcaaattgtacttcagagagctgccgaatcctctcctcacctatcagctgtacgggaaattttccgaagctatgtcagtgcctggcgaagaggagaggctggtgcgggttcacgatgtgatacagcagctgccccctccccactatagaacactagaatacctactgcgccacctggctcgaatggcaagacacagcgccaacacatctatgcacgccagaaatcttgcaatcgtgtgggcccctaacctgctgcgtagcatggagctcgaatcagtagggatggggggcgccgcagccttccgggaggtgcgagttcagagcgtggtcgtggagttcttgttgactcacgtggatgtacttttcagcgacacattcacctcagccggactggaccctgctggacgctgcctgctaccccgcccaaaaagcttggccggctcctgcccttccacacgtttactcaccctggaggaggcacaggcgagaacacaggggaggctgggcacacctactgagccaacaacccccaaggcaccggcaagtccggctgaacgcagaaagggcgaacgcggagagaagcagcggaagccaggcgggagtagttggaaaactttcttcgccctgggccgagggcctagcgtgcctcgcaaaaaaccattaccttggcttggagggacccgggcccccccccaaccatctgggtcaagacctgacaccgtgaccctgagatccgcaaaatcagaggaatctctttcaagccaggctagcggagccggactccaaagattacatagactgagacgccctcattctagcagtgacgcctttccagtgggccccgcccctgctggcagctgcgaaagcctgagttcatcgagcagtagcgagtcttcatccagcgagtccagcagcagttcctccgagagtagcgccgctggtctcggcgccctgagcggaagcccatcccatcggacttctgcctggctcgacgatggagacgagctggacttttcacccccacggtgcctggaggggcttcgtggccttgattttgacccacttacgtttaggtgctcatctcctactcccggcgatcctgccccaccagcctcccccgcaccccccgccccagccagcgcttttccgccccgcgtgaccccgcaggctatttccccgaggggaccaactagtccagcatctccagccgcgttagacatctctgagccactagccgtgagtgttccacccgcagtgctcgaactgcttggcgccggcggagctcccgcaagcgcaacccctacccccgctctgagcccaggccgcagtctcaggccacacctgattccacttctgcttaggggcgctgaagccccgctgactgacgcctgccagcaggagatgtgctcgaaattgcgcggggcccagggccccctgggacccgacatggagtcgccgcttccacctcctcccttgagcttgctgaggcctggaggggcccctcctcctccaccgaaaaatcccgctaggctgatggcactcgccctcgctgagagagcacagcaggtcgcagagcagcagtctcaacaggagtgtggtggaactccaccggccagccagtccccatttcacaggtctttgagtctggaagttgggggagagccccttggaactagcggatccggccctccccccaattctctggctcaccccggggcctgggtgcctggtccccccccttatctgccacgacagcagtccgatggatctttgctgcgtagtcaacgccccatgggaacttcccgtcgaggcctgcgcggacccgctcaggtcccaacgccgggatttttcagtcctgccccaagagagtgtctgcctccttttctcggtgtgcccaaaccggggctgtacccactgggccctccttcctttcagcctagctcacccgcgcccgtgtggcgttcatcattgggaccacctgcgcccttggatcgaggggaaaacctgtactatgagataggcgcatcggagggcagtccctactccggaccaaccagaagctggagtccattcaggtccatgcccccagatcggcttaatgcttcttatggaatgctgggacagagtcctcccctccatcgatctcctgacttcctgctctcctacccaccagcccccagctgtttccccccagatcatttgggatatagcgccccacagcaccctgctagaagaccaacccctcccgagcccctgtacgtgaacctagctcttgggccaaggggaccctctcctgcctcgtctagtagctcctccccccccgcccacccaaggtccaggagcgacccggggcctccagttccacgactaccccagaagcagagggctccttggggcccacgaaccccccaccgtgttcccgggccctggggtccccccgagcccctgctcctctatcgtgccgcacctcccgcctacggccgtggaggagaactgcacagaggtagcttatatagaaatggtgggcagcgtggcgaaggagctggcccccccccaccgtatcctactcccagttggtccctacattccgagggacagacgcgctcttactgctag

SEQ ID NO: 33090 - DNA, 2625 bp, Artificial Sequence
  Description of Artificial Sequence: Synthetic coding sequence
atgggtctccctacccttgaattctcggatagttaccttgactcccctgactttcgagagcgcctgcagtgtcatgagattgaactggagagaaccaataaattcatcaaggaattgatcaaagatggctccttattaattggcgctctgcggaatttgagcatggccgttcagaaattttctcaatccctccaggatttccaattcgaatgcattggagatgctgagaccgacgatgaaatctctatcgcacagagcctgaaagagtttgctcggttgttgatcgccgtcgaagaagaaagaagaagactgattcagaatgcaaatgacgtgcttatagcccccctggagaagttcaggaaagagcagatcggcgctgcgaaagatggaaagaagaagtttgacaaagagtccgaaaaatattacagtattctcgaaaaacacttgaatctgtcggccaaaaaaaaagagtcacacctgcaggaggctgacacccagatcgaccgcgaacatcaaaatttttacgaggcatctttggaatatgttttcaaaatccaagaagtgcaggaaaagaaaaagtttgagttcgttgaacccctgttgagctttctgcagggactatttactttctatcacgagggctacgaactggcacaggaatttgcaccttacaaacagcagcttcagtttaacctgcagaatacacgcaacaattttgaaagcacaagacaggaggtggagcggcttatgcaaagaatgaagagtgctaatcaggactataggcccccatctcaatggaccatggagggctatctttacgtgcaggagaagcgcccattgggcttcacgtggatcaagcactactgcacctatgacaaaggctcaaaaaccttcacaatgtcagtttcggagatgaaatcatcaggcaagatgaatggcttggtaacatcatctccagagatgttcaagctcaagagctgcatcaggcggaaaaccgactccatcgacaagagattctgcttcgacatagaagtcgtggagagacatggcatcataaccctacaggcctttagcgaggcaaatcgcaagctatggctagaagccatggacggcaaggaaccaatctatacccttccagctatcatcagcaagaaagaagaaatgtacctgaatgaggctggcttcaatttcgtacggaaatgtattcaggccgtggagacacgcggaatcactatactcggattgtaccggatcgggggggtcaactctaaggtccagaagctgatgaacaccactttcagcccgaagtcgccacccgatatcgacattgacatagaactgtgggataacaagactatcacctcagggctaaagaactacctgcggtgtctggctgagcctctcatgacatataagctgcataaggactttatcatcgctgttaagtctgacgaccagaactatcgtgttgaggccgtccatgctttggtacacaagctccctgagaaaaacagggagatgctggatatccttattaagcatctagtcaaggtgtctttacactctcagcaaaaccttatgactgtgtccaatctgggtgttattttcgggccaaccctgatgagagcccaggaagaaactgttgctgcaatgatgaacataaaattccagaacatcgtagtggagatacttatcgaacactatgaaaagatttttcatacagccccggatccatccattcccctgccacagccacagtccagatctgggtccagaagaaccagggccatctgtctttctactggcagcagaaagccgaggggacgttatacgccttgtctcgctgagcctgacagcgacagctattctagctcgccggactcgacccctatgggcagtattgaaagtttgagctctcactcaagcgaacagaactcgaccacaaagtctgcatcttgtcagccacgggagaagagcggcgggattccttggatcgcaacaccttcatcttccaatggacagaagagcttagggctttggaccacatctcctgagtcaagctctcgcgaagatgcaacaaagacagatgcagaaagcgattgtcagtcagtcgcaagcgtaacgagtccgggggacgttagcccacctatcgatcttgtgaaaaaggagccctacggacttagcggtttgaagcgggccagtgctagcagccttcgatccatcagcgctgctgagggaaataagagttactctggtagcatccaatccctgacctctgttggctccaaggaaacacccaaggcatcccccaatccagacttgccccctaagatgtgtcggcgcttgagactggataccgcatcgagcaatggctaccaacggccaggatccgtagtggcagccaaggcacaactgtttgaaaatgtaggttcccccaagcctgtgtccagcggacggcaggcgaaggcaatgtactcctgcaaagctgaacatagccatgaactgtcattcccacagggggcaattttctctaatgtgtaccctagtgtggaacctggttggctcaaagccacttacgagggcaaaacaggactggtgcccgaaaactatgtggtgtttctctag

SEQ ID NO: 33091 - DNA, 1647 bp, Artificial Sequence
  Description of Artificial Sequence: Synthetic coding sequence
atgcagccagggcttagtcccggcagccccggggatccccgacctcctacccccgagacagattaccccgaatctctgacatcctaccccgaggaagattacagtccggtgggcagtttcggtgagcctggccctacatctccactaactaccccccctgggtggagctgccacgtttcccaggacaaacaaatgttatacacaaatcactttacccaggagcagtgggtgcgcttggaagacccacatggtaagccgtatttttataatccagaggattcttcagttcgatgggaacttccccaggttcctgtgcccgcaccccgcagcattcacaagagttctcaggacggagatactccagctcaggctagtccacccgaggaaaaggtgcccgcggagttggatgaggtaggctcttgggaagaggtatctccggctacagccgctgttcggaccaagacccttgataaggccggagtgctacacaggactaagacagcagacaaggggaagcgcctcagaaaaaagcactggagtgcctcctggactgtgcttgagggaggtgtgctcaccttcttcaaagattcaaagacaagtgccgcgggcgggttgcggcagccctccaaattttctaccccggaatacactgtcgagctccggggcgcgactctttcatgggccccgaaggacaaatcatctaggaagaatgttctcgagcttaggtccagggacgggagtgagtatctcattcagcatgattctgaagctattatcagtacatggcacaaggcaatcgctcagggaatacaggagctcagtgctgaactccctcccgaggaatctgaatcaagccgggttgacttcggaagcagcgaacgactaggtagctggcaggagaaggaagaggacgcacgccctaacgcggccgcccctgctcttggaccagtaggcctcgaatcagacctgtcgaaggtgaggcataaattgagaaaattccttcagagacgtcccacactccagagcctgcgcgagaaagggtacattaaggatcaagtattcggctgcgcactggctgccctgtgtgaacgagagaggtctagagtgccgcggtttgtccagcagtgtatacgggccgtggaggcacgaggcctggatatcgatggcctttataggatttcaggaaaccttgctaccatccaaaaactacggtacaaggtggatcatgacgaacgattggatctcgacgatggacgctgggaagatgtccacgtgataacgggggcgctcaagctgtttttcagagaactgccagagccccttttcccatttagtcacttcagacaatttattgccgcaatcaaactgcaagatcaggcccggaggagcagatgtgtacgcgatcttgttagatcgttaccagcaccaaatcacgacacactacgtatgcttttccagcatctgtgcagagtgattgaacatggggagcagaatcgcatgagtgtccagagcgtggccatcgtgttcggacctacgctgcttagaccagaggtcgaagagacctctatgcccatgaccatggtttttcagaaccaggtagtcgaactgattctccagcagtgtgcagatattttcccaccccattag

SEQ ID NO: 33092 - DNA, 1200 bp, Artificial Sequence
  Description of Artificial Sequence: Synthetic coding sequence
atggtcgacattattgccaaggtgacacgcagacagtcccgggcactacccgcacaggtagacgacccgcctgagcccgtatatgccaacatcgaacgacagccccgtgccacttcgcccggggcagccgctgcaccgctacccagccctgtttgggagactcacaccgacgcgggaaccggacgcccctactactacaacccagacaccggagtgaccacgtgggagtcaccctttgaagcagccgagggtgcagcctcacccgcaacatcaccagcctccgtcgacagtcatgtctccttagagactgaatggggacagtattgggatgaagaatctcgcagagtcttcttctacaatccactgaccggtgaaacagcctgggaagacgaagcagagaacgaacccgaggaagagctagaaatgcagccgggccttagtccgggcagccccggcgatccacggccaccgacccccgagacagattacccagaaagcctcacctcgtatcccgaagaagattactcacccgttgggtcttttggagaacccggcccaacttccccactcactactccaccaggctggtcttgccacgtctcgcaagataaacagatgctgtatacaaatcacttcacgcaggagcaatgggtacgcctggaggacccgcatggcaagccctatttctacaacccagaggacagcagcgttcgatgggaactgcctcaggtgccagttccggctcctcgtagtatacataaaagctcccaggatggcgataccccggctcaggccagcccacccgaagagaaaactaaaacactggacaaggccggcgttctccaccgaaccaaaacagctgataaggggaaaagactgagaaagaagcactggtcggcatcctggaccgtgctcgagggtggcgtgctgaccttctttaaagatagcaagacttcagccgctggtggtctccggcaaccatccaagttctcgacccccgagtacacggtggaactgaggggggctacattgtcttgggcccccaaagataagagcagccgaaagaatgtgctggaactgcgcagcagggacgggtcggagtatttgattcaacatgattcggaggcaattatttccacatggcacaaagccatcgctcaaggaatccaggagctggtgagcagggcccagggactgtag

SEQ ID NO: 33093 - DNA, 1647 bp, Artificial Sequence
  Description of Artificial Sequence: Synthetic coding sequence
atgcagccaggtctgtcccccggcagtcctggcgacccaagaccacccactcccgagacagattaccccgaaagtttaaccagttaccccgaagaagactatagcccagttggaagcttcggcgagcctggcccaaccagccccctgacgaccccccctggttggtcttgccacgtatcccaggataaacagatgttgtacaccaatcacttcactcaagagcagtgggtgcgcctggaagatccccacggaaaaccatacttttataatcctgaggattcctcagtgagatgggaactgccccaagttcctgtaccggcccctcgttctatccataagtcgtctcaagatggcgatacgcccgcgcaagcttcccctcctgaggagaaggttcctgcggaactcgatgaggttggcagttgggaagaagtctcacctgccacagccgccgttcggactaagacactggataaggctggtgttcttcaccgaactaagacggcagacaaaggcaaaagacttagaaagaagcattggtctgcctcttggactgtcctggaaggtggcgtgttgacattctttaaggatagtaaaactagtgccgccggcggattacgtcaaccaagcaagttttccaccccggaatacactgtcgagcttcggggagcaactctgtcttgggctcccaaagataagtcctcacggaaaaatgtgctggaattaagatcccgtgacggatccgagtatctcatccagcatgacagcgaggcaataataagcacctggcacaaagctatcgcccaagggatccaggaacttagcgctgaactccctccggaagaatcagagtcctctagggttgacttcggcagctcagagaggctcggcagttggcaggagaaggaagaggacgctagacctaacgcggcagccccagcgctgggtcccgtcgggctggagtccgatctctcaaaagtgcgtcacaaactcagaaagtttctccagcgtcggccaactctgcagtcgctcagggagaagggctatattaaagatcaggttttcggctgtgccctcgctgccctctgtgagagagagagatctcgcgttccccggtttgtgcagcagtgcatacgtgctgtagaggcgagaggcctggatatcgatggtctctatcgaatctctggcaacctcgcgaccatccagaagcttcggtacaaggtggatcacgatgagcggctggatctggacgatggtcggtgggaggatgtccacgtgataacgggcgcactcaaactctttttccgcgagcttccagaaccactttttccattcagccactttaggcagtttatagctgccattaagttgcaagatcaggcccgtcgctctaggtgtgtgcgagacctggtccggtctctccctgccccaaatcacgacacactgcgcatgctttttcagcatctctgcagggtgatcgagcacggtgaacagaacagaatgtctgtccagagcgtggccatcgtgttcggccctacactgctacgccccgaagtggaggagacctctatgccaatgactatggtgttccaaaaccaggtggtcgaattgatcctccagcagtgcgctgatatatttcctccccattag

SEQ ID NO: 33094 - DNA, 2589 bp, Artificial Sequence
  Description of Artificial Sequence: Synthetic coding sequence
atggctgctgatgtggtcggagatgtctatgtactcgtggaacacccattcgagtacactggaaaggatggaagaagggttgccatccgacccaacgaaaggtataggcttctgcgtagaagtactgaacactggtggcatgtgcggagggagcctggggggaggcctttttaccttccagcccagtatgttcgtgaactgcccgcactggggaatcctgcagcagcagccccgccaggtccacacccatctcctgccgccccagagcctttggcctacgactacaggtttgtcagtgccgcggccacagctggacctgacggtgcacccgaggagtctggcgggaggacaagttctctgtgcgggcccgcacaacgtggagctgcaacccagcggtcttcattggcacccggtctgccagcctgtctatatcttcggcccgcagcgccagtgcgtccagcccagagccttaatgatcttgcctgcgccgcagtgtctccgcccgcaggactcctgggatcttccggatcgttcaaggcctgctctgttgccgggtcctgggtgtgccctcgccccctggctcggagcgattccgaaaacgtgtacgaagtgatccaggacttgcacgtgccccctagagaagaaagcgccgaacaggtggacgatcctcctgagcctgtgtacgcaaatattgagaggcagccaagggcaacctcgcctggggccgcggccgccccactgccatcacctgtttgggagacccacaccgatgccggaaccggccggccctattattataacccagacaccggagtgaccacctgggagagccctttcgaggcagctgaaggagccgcgtctcccgccacaagccctgcgagtgttgactcccacgtctccttggaaacagaatgggggcagtactgggatgaagagtcgagacgggtgttcttttataaccccctcacgggtgagacagcctgggaagatgaggccgaaaatgagcctgaggaagagttagagatgcagcccgggctgagtcccggcagccccggcgaccccagacctcccactccagagaccgattaccctgagtctctgacatcttatcctgaggaagattatagccctgtgggatcatttggtgagcccggacctacatcccccttgaccacccctcccggctggtcttgtcacgtcagccaggacaagcagatgttatacacaaatcacttcacccaggaacaggtgcctgtacccgctcccagaagcattcacaagtctagccaggatggagatactccagcccaggcctcaccacccgaggaaaaggtgcctgcagagctggatgaggtaggtagttgggaggaagttagtccagcaaccgctgcagtgcgtacaaaaacactggataaagccggcgttcttcataggaccaagacggccgataagggtaaaagattacgcaagaagcattggtccgcatcctggaccgtgctcgaggggggggtgctgacgttttttaaagactcaaaaacttcagccgccggcggcctgcgccagccatccaagtttagcacacccgagtataccgtcgagctgcgcggggccacacttagctgggcccctaaagacaagagctcacgcaaaaacgttctggagttacgctctcgtgatggatccgaatacttaatccagcatgatagcgaagcaattatttccacatggcataaagctattgctcaaggaattcaagagctgtcggctgagctgccccctgaagagtcagagtcctccagggtggattttggctcctctgaaaggttgggttcttggcaggaaaaagaggaggacgcccggcccaatgcggcggcacccgctctgggcccggtgggtctcgaaagtgacctgtcaaaggtccgccacaagctacgcaagttcctccaacgcaggcctacgttgcagtctctccgggaaaaaggctacatcaaggaccaagtgtttggatgtgctctggccgccctgtgcgaaagagaacgctctcgggtgccccggtttgtacagcagtgcatccgtgccgtagaagcacggggactggatatcgacggattatatagaatcagcggtaatctggcaactattcagaagctccgatacaaagtggatcatgatgagaggctggacctggacgacggacgctgggaagacgtgcatgtgatcaccggcgctctgaagctgttcttcagggaactgcccgagccactctttccgttcagccactttcggcagttcattgctgccatcaaactccaggaccaggcccgaagatcccgttgcgtcagggatttagtgaggagtctgccagcccctaaccacgacacactgcgcatgttatttcagcatctgtgtcgcgtaattgagcatggagaacagaatcgcatgtctgttcagtcggtcgcgatcgtcttcgggcccactctcctgaggcccgaggtggaggagacctccatgcctatgaccatggtcttccagaaccaggtggtggaactcattttgcagcaatgcgctgatatcttccctccacattag

SEQ ID NO: 33095 - DNA, 792 bp, Artificial Sequence
  Description of Artificial Sequence: Synthetic coding sequence
atggctgctgacgtggttggcgacgtatatgtactcgtggagcacccatttgaatataccggcaaggacggccggcgcgttgctatccgcccgaacgaacgttatcgtcttctgagaaggtctactgagcattggtggcacgttagaagggagcccggggggcgccccttttatctgcccgcccaatacgtgagagaactgcccgctctgggaaaccccgcagctgccgcaccaccaggtccccacccctctccagcagccccggagcccctggcctacgactatcgcttcgtgtctgccgcagccaccgctgggccagacggcgcaccagaggagtcaggtgggcgcacttcttccctgtgcggcccggcgcagagaggagccgccactcagcgctcgagcctcgccccaggcctgcccgcctgtttatatctgcgtccagctgctccagttaggcccgcacagtctctcaatgacctggcctgcgctgctgtctccccccccgccggcctactgggtagcagcggcagctttaaggcctgtagcgtcgcaggctcatgggtttgtccacgtcccttggctaggtctgactctgaaaacgtgtatgaggtgatccaagatttgcatgtcccaccccgcgaggagagcgcagaacaagtgcctccccgtgccctcgggagaggcggcggttggcgcgcccgggaccgtgcaagaactgagcctggcagaaaagagacacggtctgctcagcgaagggctcgtcggccccccctaagcgaggacttcggatag

SEQ ID NO: 33096 - DNA, 2526 bp, Artificial Sequence
  Description of Artificial Sequence: Synthetic coding sequence
atgagtgcccagtcgttgcccgccgcaacgcctcccacacagaaaccaccccgcattatccgcccacggcctccgagccgcagccgggctgcacagtcacccggcccaccacataatggctcatctccgcaagaactgccccgtaatagcaatgatgcccctacccctatgtgcactcctattttttgggagcctccagccgcatctctgaagcctcccgccctgctaccaccctctgcctctcgcgcctctctggatagccagacaagccccgacagcccttcgtccacacccacgccatcccccgtgagccgtcgctcagcgtcaccagagcctgcgccccgcagtccagtacccccccccaagcctagcggcagtccatgcacccctctcttacccatggctggtgtgttggcacaaaatggcagcgcctcagcacctgggactgttcgccggttggccggcagattcgaggggggggcagaaggtagggctcaagacgcggacgccccggagccaggcttgcaggcgagagctgacgtcaacggggaacgggaagcgcctttaactggaagcggctcccaggaaaacggcgctccagacgccggcctggcctgccctccatgttgcccctgcgtatgtcacactacgcgcccagggctcgaactgcgctgggttccagtggggggctacgaagaggtgcccagggtaccaaggcgcgcctcgcccctgcgaacatctcgcagcagaccccaccccccttcaatcggccatccagccgttgtgctcacatcctacagatccacggcggagcgtaagttgttgcctctgttaaagccacccaagccgactagagtgcgacaagatgccactatcttcggagacccaccacaaccagatctagacctcctaagcgaggacgggattcagaccggagactcacccgacgaggccccccagaacacaccccctgctactgtagagggccgcgaggaagaaggcctcgaagttttgaaggagcagaattgggagctgcctttgcaggatgaacctctgtaccaaacgtaccgagctgcggtgctgtcggaagagctatggggcgtgggcgaggacggatctccatccccagccaacgctggtgatgcccctacgttcccccgaccccctgggcctaggaacaccctctggcaggagctccccgctgtgcaggcatcaggcttactggacacattaagcccccaggaacgacgcatgcaggagtccctgttcgaggtagttacatcagaggcttcatatctgcgatctctcagactgctgaccgacacgttcgtgctttcacaggccttaagagatacactcactccccgggaccatcacacattattctccaatgtccaacgggtgcagggagtcagtgagcgcttcctcgctaccctgctgagcagggtgaggtctagcccccacatctctgatctctgtgacgtcgtgcatgcccacgccgtcgggccgttcagcgtttacgttgactatgtgcggaaccagcagtaccaagaagaaacatatagtaggctcatggatacaaacgtccggtttagcgctgaattgcgccgacttcaatcactgcccaaatgcgagcgcctgcccttacccagctttctgctgctgcctttccagcggattaccaggttacgaatgctgctccaaaatatcctccggcaaacagaggagggctcatctcgtcaggaaaatgcccagaaggccctgggcgccgtttccaaaatcatcgagagatgctctgcagaggtcggccgcatgaagcaaacagaagaactgatacgactgacccagagattgcgctttcacaaggtgaaagccctccctctagtgagctggtctagaaggctggaatttcagggtgagttaaccgagctcggctgccgccgaggaggcgtcttgttcgctagccggcccaggttcacacctctgtgcctgcttctcttctcagatctgctgctgattacgcagcctaagagcggccagcggcttcaggttctggactatgcccaccggagtcttgttcaggcacagcaagtgcccgatccttccgggcccccaaccttccggttgagtttgttgtctaaccatcaaggacgtcctactcacagactcctgcaggcaagctcactctctgacatgcaaaggtggctgggcgcattcccaactcccggaccgcttccctgttctccagataccatatatgaagactgcgattgttctcaagaactctgttccgagtcgtcagcaccagccaagactgagggtagatccctggagtccagggcagcccctaagcatcttcacaagacacctgagggctggctaaaaggcctgcccggcgctttccccgctcaattggtctgcgaagtcaccggcgaacatgagcggaggcgacacctacggcagaatcaacgcctcctggaggccgttggaagtagctccggaacaccgaatgccccacccccatag

SEQ ID NO: 33097 - DNA, 2526 bp, Artificial Sequence
  Description of Artificial Sequence: Synthetic coding sequence
atgtcagctcagagccttcccgcagctaccccccccactcagaagccgccgcgcatcattaggcctcgaccgccgagtaggtccagagccgcccagagccccggcccaccacacaacggcagctcgccacaggaactccccaggaacagcaacgatgcaccaaccccaatgtgtactcctatcttctgggagcctcccgccgccagtcttaaaccccccgcgttgctccctccctccgcttcaagggccagtctggattctcaaactagccctgattcaccctcttcaactcctaccccaagcccagtgagccggcggtcggcaagcccagagccggcccctcggtcccctgtccccccacctaaaccttccgggagcccttgcacaccacttctcccaatggccggcgtgctagctcagaacggaagtgcctctgcgcccggcaccgtgcgtcggctggcaggccgcttcgagggaggagccgaggggcgcgctcaggacgcagacgcaccagaacctggacttcaggctcgcgcggatgtcaatggcgaacgggaggccccgctgactggtagtggaagtcaggaaaatggcgccccggacgcagggctggcttgccccccctgctgcccctgcgtctgccatacaacacgtcctgggctggaactgaggtgggtccctgtcggcggatacgaagaggtccccagggtcccacgccgggcatcacccctgcggacaagccggtccaggcctcatcctcctagcatcggtcatcctgccgtagtgctgacctcttaccgcagcaccgccgaaagaaaactgctgcctttgctgaagccccccaaacccacccgagtgcgacaggatgcaaccattttcggggatcctccccagcccgacctggaccttctgtccgaggatggaatccagaccggggattccccagacgaggcgccccagaatacacctccagcgaccgttgaaggacgcgaagaagaaggactggaggttttaaaggaacagaactgggagctcccactgcaggacgagccactctaccagacatatcgagccgctgtgttatcagaagagctgtggggagtcggagaggacggtagccctagcccagcaaatgccggcgatgcccccacttttccacggcccccaggtcctaggaacactctgtggcaggagcttcccgcagtgcaagccagcggcttgctcgacaccctaagtccacaggagagaagaatgcaggaaagtttgttcgaggtcgtaacttccgaggcgtcttacctacgcagcctgcggctcctcactgatacattcgtcttgagtcaggcgcttcgggatacattgaccccgagagatcaccatacattgtttagcaacgttcagcgagtgcagggtgtcagtgagcgcttcttagccacccttttgtctagggtgcgctccagcccccatattagcgatctttgtgatgtagtgcatgcccacgccgtcggacccttttcagtgtacgtggattatgtcagaaaccagcagtaccaggaagaaacctacagccggctgatggacaccaatgtccgcttcagtgccgagctcaggcgtttgcaatcccttccaaagtgtgagagactccccctacctagcttcctgctgctgcctttccaacggatcactcggctccgaatgttactgcaaaacatacttaggcaaacagaagaggggtccagcagacaagaaaatgctcagaaagccctgggcgcagtgtctaagatcatcgagcgctgttcggccgaggttggccggatgaagcagacagaggaacttattcgtttgacacagagactgcgtttccataaagtcaaagctttacccctggtctcatggagccgtagactggaatttcagggagagttaactgagcttggctgccgtaggggtggtgttttgtttgcaagccggcctaggtttacccctctttgcctgttgctgttctcggatctcttgttaatcactcagcctaagagcggtcagaggctgcaggtcctggattatgcccacaggtccctggtgcaagctcagcaggtgcctgacccatcaggaccgcctacatttagactcagcctgctatccaatcatcagggtagaccaacgcatagacttctccaggcatcctccttgagcgacatgcagagatggttgggagcctttccaacacccgggccccttccctgtagcccagacactatctacgaggattgcgattgtagtcaggagctttgctctgagtcaagcgccccagcaaagacagaggggcggagcctggagagccgggcggctcctaagcacctgcacaagacccctgagggatggctgaagggcctgcccggagcgttccctgcccagctagtttgtgaagtgaccggggagcacgaacgccgtaggcatctaagacagaatcaaaggcttttggaggcagtggggtcttcaagcggaacaccaaatgcaccccccccctag

SEQ ID NO: 33098 - DNA, 1896 bp, Artificial Sequence
  Description of Artificial Sequence: Synthetic coding sequence
atggctccccttcacaaaaattatcccgagacccccatgatgcatcaaccccagtgtgccccccccagctccggatctcctcaactgcacccatcctcgcctctgctcttctgcccacctcagaacggatccgcctccgccccaggaactgtccggaggctcgctgggcgcttcgagggcggcgctgaggggagggcccaggacgctgacgcccctgagcccggcctccaagcgcgtgcagatgtgaacggagaacgggaagcccctctgaccgggtccggatctcaagagaacggggccccgggcgacagcccggacgaggcccctcagaatacccctccagcaacagttgagggcagagaggaagaagggctcgaagtgctgaaggaacagaattgggagctaccacttcaggacgaacctctctaccagacatatagggccgcggtgttgtctgaagaactgtggggtgtaggcgaagatggaagcccctcacccgcaaatgcaggcgatgcccccacctttccccggccgcctggcccccgtaatacattatggcaggagctgcccgctgtccaagcctcaggcctgcttgacaccctgagcccccaggagaggcggatgcaggaaagtttgtttgaggtggttacttcggaagcaagctatcttaggtcactgagacttctgacggacacatttgtccttagccaggccctaagagacacattaacaccaagagatcaccatacactctttagtaatgttcagagggttcagggcgtgtccgagaggttcctggcaaccctcctgagccgtgttcgttcttctccccacatctcggacctttgcgacgtcgtacacgcccatgcggttggaccctttagtgtgtacgtagactatgttaggaatcagcagtaccaggaggaaacctattcacgcctgatggataccaatgtgaggtttagtgccgagctccggaggttacagtcacttcccaaatgcgagcgcctccccctgccttctttcctgctacttccatttcagagaatcactcgtctacggatgttgctccagaacatcttgagacagaccgaggaaggcagtagcagacaggagaacgcacagaaggccctcggagccgtgtcaaaaattatcgaaagatgttccgccgaagtcggaagaatgaagcagactgaagaactaatccgactgactcagcggcttcgattccacaaggtcaaggccctacctctggtgagctggtcgagacgcctagagtttcaaggagaactcacagagctgggctgccgtcggggcggtgtgctgtttgcatcgaggccgcgctttactcctctgtgtcttttactgttcagtgacctgctgttgattacccaacctaagagcgggcagcggttacaggtgctagattatgcacaccggtccctggtgcaggcacagcaggtgcctgaccccagcggaccgcccacttttcggctttctctcctcagtaaccatcaggggagacccacccaccgactactgcaggcctcaagcctcagcgatatgcagcgttggctcggtgcttttccaacacccggtcctcttccttgtagtcctgacactatatatgaagactgcgattgtagccaggagctctgttcagaatcttctgcccctgcgaaaacagagggccgcagccttgagagtcgggctgcacccaagcacctgcacaagactcccgaaggatggctgaaaggcctacctggggccttccctgcccagctagtgtgcgaagttacaggcgaacacgaaagacgccggcatctgagacagaatcagcgtctccttgaagccgtggggagcagtagcggaactcctaacgcaccccccccctag

SEQ ID NO: 33099 - DNA, 2616 bp, Artificial Sequence
  Description of Artificial Sequence: Synthetic coding sequence
atggatggagagagcgaagtggacttcagctccaatagcatcacccccctgtggcgccgtaggtctatccctcagccacaccaggttctcgggcgtagcaaacctaggccccagagctatcaaagccccaacggccttctcattacagatttccccgtcgaggacggcgggacattactggcagctcaaattccagcccaggtaccaacagccagtgactctcggaccgtacatcgctcccctctgctgttaggagcccaacgtcgagctgtagcaaatgggggaacagcctccccggaataccgcgccgcctctccaagattaagaaggcctaagtcacccaagctgcctaaggcagtccctgggggcagcccgaaaagcccagctaacggtgcagttaccctgccagctccccctcctccaccagtgctcaggcccccgagaacccccaacgcacctgccccttgcaccccagaggaagacctaactgggctgaccgcaagccctgtgcctagtcccactgccaacggtctggccgctaacaacgatagccccggatcagggagtcagagcggacgtaaagccaaggaccctgagcgtggactgttccctggccctcagaagagctcctcagaacaaaagctgcccttacagagactaccctcacaggagaacgagctgcttgagaatccctcagtggtgctgtccacaaatagtcctgctgccctgaaagtaggcaagcagcagattatcccaaagtctctggcgagtgaaatcaagataagcaaatccaacaatcaaaacgtcgaaccccataaacgcctgctgaaggtccgctccatggttgaggggctcgggggacctctcggccatgccggagaggagtcggaggttgataacgacgtggattcccctggttccctgcgaagggggctccggtcaacttcatatagaagagccgtagtctctggctttgactttgactcccccacgagtagtaagaaaaagaatcggatgtcccagccggtgctcaaggtggtaatggaggataaagagaaattttcatcccttggacggatcaaaaagaagatgctcaagggacagggaaccttcgacggtgaagagaacgctgtgctgtatcagaactacaaggagaaagcactggacattgatagcgatgaggaatctgagccaaaagagcagaagtcagacgagaaaattgtcatccatcacaagcctctccggtccacttggtctcaactaagcgcggtgaagaggaaaggcctgtcccaaaccgtttcccaggaggagcgcaagcggcaagaagccatctttgaagttataagttccgaacactcctaccttctgtcactggagattcttatccgaatgttcaaaaattctaaggaactctcagacacaatgaccaagactgaacgacaccacctgttcagcaacattaccgatgtatgcgaggccagcaaaaaatttttcatcgagctcgaggccagacatcagaacaacatatttatcgacgatataagcgatatcgtcgaaaagcatacagcctctacattcgacccatatgtcaaatactgtacgaatgaggtataccaacaacggacactgcaaaagttactcgctactaacccttcattcaaagaggtactgtccagaatcgaatcccatgaggactgtagaaatctccctatgattagcttcctcatcctgccaatgcagcgcgtgactcgcctgcccctacttatggacacaatctgccaaaagactcctaaggatagccctaagtacgaggtctgcaagcgggcactgaaggaggtgagcaaactggtgcgtctgtgtaacgaaggcgctaggaagatggagcggaccgagatgatgtataccataaatagtcagctagagttcaagattaagcctttccctctcgtgtcgtcgtctcgatggctggtgaagcggggtgagttaacagcatacgtggaggacactgtgttgttctctcgaaggacatccaaacagcaggtgtacttctttctgttcaacgacgtgctcatcatcaccaaaaagaaatccgaggaatcttacaacgtgaacgattacagcttgagagatcaactcttggtcgaatcttgcgataacgaggaactgaacagcagcccaggaaaaaatagctcaaccatgctgtattctaggcagagttccgcgtcccaccttttcactcttaccgtcttgtctaatcacgccaacgagaaagtcgaaatgctcctaggcgcagagacgcagtccgagagggcccgctggatcaccgcactcggccattcctccggaaaaccacccgcggatcggacatcgctgactcaggtggagatcgtacggtcattcaccgccaaacaaccagacgagctgagccttcaagtagccgacgtggtcctcatctatcagcgtgtatccgatggatggtacgaaggagaacggctgcgcgacggtgaacggggctggtttccgatggagtgcgcaaaggagattacttgccaggctaccatagataagaacgtcgaaagaatggggagattactgggtctggaaaccaatgtgtag

SEQ ID NO: 33100 - DNA, 2616 bp, Artificial Sequence
  Description of Artificial Sequence: Synthetic coding sequence
atggatggtgagagcgaggtggacttctcgagtaattccattacccctctgtggaggcgtcgatccattccacagccccaccaagtgttgggtcgctctaagccaagacctcaaagttatcagagcccaaatgggctgctcattacagatttcccagtggaggacggcggcacattgttggctgcgcagattcccgctcaggttcccaccgcttccgattctcgcacagttcatcgctctcccctgctgctcggggcccagagaagagcggtcgccaacggtgggacagcttctccagaataccgagccgcctctccaaggttgcgccggcccaagtcaccaaagctacccaaggccgtgcccggtggctccccaaagtcccccgctaacggagccgttaccctgcctgcccccccacctcctcccgtgcttcggccgccacggaccccaaacgctccagctccctgcacgcccgaggaggaccttaccggactaactgcaagtccggtgccttctcccaccgccaatgggttggccgcgaataatgactcccccggttccggcagtcagagtggacgcaaggccaaggaccccgaaagaggactgtttcctggcccccaaaagtctagcagcgagcagaaattgccactgcaaagacttccatcacaggagaacgaattgctggagaacccctccgttgtgctgtctaccaactctccggctgccctcaaagtgggcaaacaacagattattcctaaaagtctcgcctctgagataaaaatcagtaagagcaacaaccagaacgtggagcctcataagagactgcttaaggtacgtagcatggtggagggactgggcggcccattgggccacgccggtgaggagtccgaggtcgacaatgacgtggacagcccaggatccttgaggaggggactcaggtctacctcctatcggcgtgccgtggtatcgggattcgatttcgattcgcccacatcctctaaaaagaaaaacaggatgtctcagcctgtgcttaaggtggttatggaggataaggaaaaattcagctcgttaggaaggatcaagaaaaagatgttaaagggccagggaacgttcgacggggaggagaacgctgttctgtaccagaactacaaggagaaggcattggatatcgatagcgacgaggagtcggaaccaaaggaacaaaaatcggacgagaagatcgtgattcatcacaaacccctgcgctcaacttggagccagctatctgccgtgaagcgaaaaggcctgagtcaaaccgtgagtcaggaagagaggaaaagacaagaggcaatcttcgaggtcatcagtagcgaacattcctacctccttagcttagagatcctgattcgcatgtttaagaattccaaagagttaagcgacaccatgacaaaaacagagaggcatcacctcttttccaacattaccgacgtttgcgaagcaagcaagaaattcttcatcgagctggaggcccgccaccagaataacattttcatcgacgacatttctgacatagtggagaaacatacagcctctacctttgacccttatgtgaagtactgtactaatgaggtgtaccagcagcgcacgctgcagaagctacttgctacaaacccttcttttaaagaggttcttagtcggatagagagccacgaggactgtcgaaatcttccaatgattagctttctgatcctaccgatgcagagggtgacacgactgcccctgctgatggatactatttgtcagaagactccaaaggatagtccaaagtatgaagtctgcaagcgcgctctaaaggaggtgtcaaagttagtgcggctttgtaatgaaggggcccgcaagatggagaggaccgaaatgatgtacactatcaacagccagctggaattcaagattaaaccttttccactggtatcgagttctcgttggctggttaaacgcggtgagctgaccgcctatgtggaggatacagtgctgttctcgcgccgtacctcaaagcagcaggtttattttttcctgttcaacgatgtcctcatcattacaaaaaaaaagtctgaggaatcatacaatgttaatgattatagtttgagggatcaacttctggttgagtcttgtgacaacgaggagctgaacagctcgccaggaaagaactccagcactatgctttactctaggcaatcctctgccagtcacttgttcactttaacagtgttgtctaaccacgctaatgaaaaggtggagatgctccttggagccgagacccagtccgagcgtgcgcgttggatcaccgccctcggacactctagtggcaagcctcccgctgacaggaccagccttacgcaagtcgaaatcgtgcgttcctttacagccaagcagccagacgaattgtcattacaggtcgcagacgtggtccttatctatcagcgagtttccgatggctggtacgaaggtgagagactgcgcgacggcgagagagggtggtttccaatggagtgtgcaaaggaaataacttgtcaagctacaatcgataagaatgtagagcgcatgggcaggttactgggcctcgagaccaacgtctag

SEQ ID NO: 33101 - DNA, 1341 bp, Artificial Sequence
  Description of Artificial Sequence: Synthetic coding sequence
atggacggggaatccgaggtggattttagttccaacagcatcactcctctctggcgaaggcgtagtatcccacagccacaccaggtattaggccgttccaaacctagaccgcaatcctaccagtcacccaatgggttgctgattactgacttccccgtagaggatggtggcactcttctggctgctcagattcccgcacaggtgcctaccgcgtctgactctcggactgtgcaccgctctcctctcctgttgggcgctcagcgtagggccgtggccaatgggggaactgcaagcccggagtaccgggctgcctcaccccggttgcgaagaccgaagtcacccaagttgccgaaagctgtcccaggcgggagtcccaagagccctgccaacggcgccgtcactcttcctgctccaccaccacccccggtgttgcgcccaccacgcacaccgaacgcaccagctccctgtacaccagaagaggacctgacaggtctcaccgcctctccagtgccatcccccacagccaatggactcgccgccaacaacgacagcccaggctctgggtcgcaatccgggagaaaggccaaagatcctgaaagaggcctattcccaggtccacagaagtctagcagtgaacagaagctaccgttacagagactgccatcccaggagaatgagctgctcgagaatcctagtgtggtgttgagtactaacagtccagcagcccttaaggtggggaaacagcagattatcccgaaatccctggcgtcagaaatcaaaatttcgaaaagcaacaatcagaatgtcgagcctcacaaaaggctgctaaaagttaggagcatggtggaaggtttaggcgggcctctgggtcacgccggagaggagagcgaggtggataacgatgttgattctccggggagcctaaggcgaggactgaggagcacctcatataggcgagccgtggtttccggattcgattttgactccccaaccagctccaaaaaaaaaaaccgcatgtcccaacccgtcctcaaagtagtgatggaagacaaggagaagttttcttccctgggcagaatcaaaaagaaaatgctcaagggacaaggcacattcgacggcgaggaaaacgcagtgttgtaccagaattacaaggaaaaagccttagacattgattccgacgaagaatctgagccaaaagaacagaaaagcgacgaaaagatcgtcatccatcacaagcctctccggagcacatggtctcaattgtctgcggtcaagaggaaggtcatccttatcgtgggattcatggagatgaaggacggtaggcttcgcggtggcaaatag

SEQ ID NO: 33102 - DNA, 2376 bp, Artificial Sequence
  Description of Artificial Sequence: Synthetic coding sequence
atggacggagagtccgaggtcgactttagctcaaattccattactcctttatggcggaggaggtcgattccccagccccatcaagtcctgggacggagcaagcctaggccgcagtcttatcagagtccaaatggactgctgatcactgattttcccgtagaggacggcggcacactgttagccgcgcagattcctgcccaggttcccaccgcctcagacagcagaactgtacatcgctcaccactactgctgggagcgcagaggcgtgctgtggctaatggcgggactgccagcccggaataccgtgctgccagccctaggctccgccgtcccaaaagtccaaaattgccaaaagccgtgcctggaggctctcccaaatccccagccaacggggcagtcacattgccggccccaccaccgccgccagtgttgcgaccaccgcgcacgcccaacgctccagcgccatgtacacctgaagaggacctgacgggtctcaccgccagcccagtgccctcccctacggctaatgggctggccgccaacaacgactcccctggatcaggatcccaatccgggcgcaaggccaaagatcctgaaagaggtctcttccctgggccccaaaaaagctcttccgagcagaaactgcccctgcaaagattgccatcccaagagaacgagctattggagaatccaagtgttgtccttagcaccaattctcctgcagctcttaaagtgggcaagcagcagatcattccaaagagtttggctagtgaaattaagattagtaaaagtaataatcagaacgtggagccacataagagactactgaaagtccgatcaatggtggagggcctgggggggcccctgggccacgcgggagaagagtctgaggtggataatgatgtggacagtccaggtagcctgcgaagaggactcagatccaccagctaccggagagccgtcgtgtcgggatttgacttcgacagcccaacaagctccaaaaaaaagaatcggatgtcgcagcccgtattgaaggtggtcatggaggacaaagaaaagttctcttccctgggccgaataaagaagaagatgttaaaaggccaagggactttcgatggggaagaaaatgctgtgttgtatcagaattataaggaaaaagcacttgatatcgacagtgacgaagagtccgagcctaaggagcagaaatcagatgagaaaattgtgattcatcataagcctttaaggtccacatggagtcagctgtctgccgtaaagagaaaggggctttcacagacagtttctcaggaggaacgcaaaagacaggaagccatctttgaggttatctcttccgagcactcctatctgttaagtcttgaaatcttgatccgcatgtttaagaatagcaaggagctgtccgacaccatgactaagaccgagcggcatcatctgttcagcaacatcaccgatgtctgtgaggccagcaagaaattcttcatagaactggaggcgcgccaccagaacaatatattcattgatgacatctctgatattgttgagaaacacacggccagcacctttgacccgtatgtgaaatattgtacaaatgaggtgtaccagcaaagaacactgcaaaaactattggcgacaaatccttccttcaaagaggttctctcacgcatagagtcgcacgaagactgccggaacctgccaatgattagctttcttattttacccatgcagcgggtgacgcggctccctttgttgatggatactatctgccagaaaacccctaaagacagccctaagtacgaggtgtgtaagcgagccctgaaggaagtgtctaagctggtgagattgtgcaacgagggggccaggaaaatggagaggacagagatgatgtacacaatcaattcccagctagaatttaagatcaaacccttccctctcgtctcctcttcacgctggctcgtgaagaggggcgaactcacagcttatgtcgaggacactgtgctgttcagtcgcaggaccagcaaacagcaggtatacttctttctgttcaacgatgtgttaatcataactaagaagaagagcgaggagagctacaatgttaacgactactctctccgcgatcagctgttggtggaatcatgcgacaacgaggaactcaattctagtcccgggaagaattcaagcacaatgctctacagtagacagtctagcgcatcccacttattcactctgacagtgctttctaaccatgccaatgaaaaggtggagatgctcctgggcgctgagacccagtcagagcgggcccggtggattacggcccttggtcactcctcaggaaaaccaccggcggatcggacctgcggctag

SEQ ID NO: 33103 - DNA, 2613 bp, Artificial Sequence
  Description of Artificial Sequence: Synthetic coding sequence
atggagaagaccaaaactaaacagggagagaacgaacatatgccagtgaataatcccagcacacagatctaccagttgcaggccctggcatccgagctgaagactggatttaccgaagctatgcaggagctttccagaatacagcatggcgaatatgccttggaggagaaagtcaaaagctgtcgctgttccatggaagaaaaagtcacggagatgaaaaatagcctgaactatttcaaagaggagctttcaaatgccatgagcatgatacaggccatcacgtccaagcaggaagagatgcagcaaaaaatcgaacagctacaacaagagaagcgaagggagagccgcaaggtaaaagcgaaaaagacgcaaaaggaagagcactcaagtcaggcgggaccagcacaagcccaaggctctccatttagatccatcaatatacctgaacctgtccttcccagcgaggactttaccaatctcctgccttctcaggcctatgaaaaagctcaggagagtcggtctgttcacgttggagatagtaatgtgaaaggaatgatggggccgggggtaaacccaactacccccgaagctgaggagaatctgaagtcctgcttatcagccgatatccagagtaagggtcacctcccgagcgggatgtggaggcagcctaaagatgggaaagaatggggtgaagaatatgtcacaaaggatcatccagacaagttaaaagaggctggccagggaaggcattcatccttagaaaacgtcctgtgcgaaacttccctggccgcaaagagacagactgttgctctggagctcctggaaagcgagcggaagtacgtgatcaatatttctctcatcctgaagatcaaagccactttccagggatcagacggcaagcggaacagcaaggaaagatccctttttcctggatccctccggtatcttgtgcagcagcaccttgaccttctgcacgcgttacaggaacgagtactaaagtggccacggcagggagtcctcggcgacctgttcctgaagctcactaatgacgagaataactttctggactactatgtggcatacctgagagatctccccgagtgtatttctctggtgcatgtcgtggtgctgaaggagggcgacgaggagatcaaatcggatatttacaccctgttcttccacattgtacagcggatcccagagtacctgatacatttgcagaatgtcttgaaattcaccgagcaggagcatccagattattatttactcctggtttgtgtgcagagactgagggtctttatctctcattacactctcttattccagtgcaacgaggatctgctgatccagaagagaaaaaaactgaaaaagtcatccatggctaaactgtataaaggactagcgagccagtgcgctaatgcaggacaagacgctagtccaaccgctggaccagaggcagtgcgcgatacaggaattcacagtgaagaactcctgcagccctacccatctgccccttcttccggccctgccattacccacttgatgcctcccgtcaaaaaatcacaacaacagcagagcttgatggagagtatgcaacctgggaaaccaagcgattgggaactagaaggacgtaaacacgaaaggccggagtctttactcgcaccaactcagttctgcgcagcagagcaggacgtcaaagcgctcgctgggcctcttcaggccatcccagaaatggactttgaatcatctcccgctgagcctcttgggaacgtggaacggagcctccgtgctccagccgaactgctcccagacgccagaggctttgtgcccgctgcctatgaggaatttgagtatggcggtgagatcttcgctctgcccgctccgtatgatgaagagccattccaagcgcccgcccttttcgagaactgttccccggccagctccgagtcaagcctggatatttgcttcctaaggcccgtgtctttcgcgatggaagctgaacggcctgagcacccgcttcagcccctcccaaagtcagcgacctccccggcggggtccagttctgcttacaagctagaggctgctgctcaggcacacgggaaagccaagccactctcacggagtctcaaagaattcccccgtgctccccctgccgacggtgtcgctccaagactgtatagcacccgtagcagctctggcggcagagctcctatcaaggcagagcgcgcagcacaggcgcacggccctgcagccgcagccgtagctgccaggggcgcttccagaacattcttcccccagcagagatcccagtcagagaaacagacctatcttgaggtgcgccgggagatgcacctggaagacaccacacgcttctgcccgaaagaggagcgggagtccgaacagacttccttttctgatcagaacccgagacaagaccagaagggcggcttccgatctagctttagaaaactgtttaagaaaaaatcttctggtagtgagtacagagaaaaaactaacgaaaaccccagtatggatcctagtccgaccaagcaggattttttccggaaccggctggctctagctaacgatctcgatcaggggaccgccgtttag

SEQ ID NO: 33104 - DNA, 2535 bp, Artificial Sequence
  Description of Artificial Sequence: Synthetic coding sequence
atggagaagaccaaaacgaagcaaggtgaaaatgagcacatgcccgtaaacaacccctctacccaaatctaccagctgcaggccctggcttccgagctgaaaacgggatttactgaagctatgcaggaattgagccgtattcagcatggtgagtatgctcttgaagagaaagtgaagtcctgtcgctgctcaatggaagaaaaagtgacagagatgaaaaacagcctcaattattttaaggaggagctctctaatgctatgagtatgatccaagccatcacaagtaagcaagaggagatgcagcagaagattgagcaactgcagcaggaaaagaggagggaatctagaaaagttaaagccaagaaaacgcaaaaggaggagcactctagccaagccggtcctgcgcaggcacagggcagtccgttccggtccattaacatccccgagcctgttctgccctctgaggacttcacaaacctgctgccctcacaggcctatgaaaaggctcaagagtccaggagcgtacacgtcggggattcaaacgtgaaaggcatgatggggccaggtgtcaatccaactacccccgaagccgaggagaacttgaaatcctgcttatcggcagacatccagagcaagggtcatttaccatccggcatgtggaggcagccaaaagacggcaaagagtggggcgaagagtacgtgaccaaagaccatccggacaaactgaaagaggccggacagggccgccattctagtctcgagaatgtgctctgcgaaactagtctggccgcaaagaggcaaaccgtagccctggagcttctggaaagcgaaagaaaatacgtcattaacatcagcctcatcctgaaaataaaagctacctttcagggcagcgacggcaagagaaattcaaaggaaagatccctcttccctggcagcctccgctacctcgttcagcaacatctcgatttgcttcatgccctgcaagagcgtgttctcaagtggcctcggcagggagtgctgggcgaccttttcctgaaattaaccaatgacgagaataattttttggattattacgtggcatacctgcgcgacctgcccgagtgcatttccctcgtgcatgtcgtggtcttaaaggaaggcgatgaggaaattaagtctgatatatatacactgtttttccatatcgtacagaggattcccgaatacctcatccacttacaaaatgttctaaaattcacggaacaggaacaccccgactattatttactgctggtgtgtgtgcagagattgcgcgtcttcatcagtcattacacattattgttccaatgcaacgaagacctgctgattcagaagcgcaagaagctcaagaaaagttccatggccaagctgtacaaaggtctggccagccaatgcgccaacgctggccaagatgcctcccccactgcgggacccgaggctgtgcgagacaccggcatacactccgaggagctgttacagccctacccgtcagctccaagctccggtccagctatcacccacctgatgccgcctgtgaagaagtcccaacagcagcaaagtttaatggaaagcatgcaacccggaaagccctccgattgggagctggaagggcggaaacatgagaggcccgaatcacttttagctcccactcaattctgcgccgctgagcaggatgtgaaagccctggcgggaccccttcaagccatccccgaaatggatttcgagtccagcccagctgaaccgttaggaaacgtggagaggagtctgagagcacctgccgaactgctcccagacgcacgggggttcgtacccgctgcctatgaggaattcgaatacggcggcgagatattcgccctgcctgctccttacgatgaggagccctttcaggcgcccgcattattcgaaaattgcagccccgcatcctctgagtcctcactggacatctgctttctacggcctgtgtctttcgccatggaggccgaacgccccgagcatccccttcagcctttgccaaagtccgcaacttcccccgctgggtcatcatccgcttataaactcgaagctgctgctcaggcccacggaaaggctaaacctctgagccgtagtctgaaagagtttcccagagctcctccagccgacggcgttgctccgcgtctgtattcaacaagatcatcttcaggcgggcgagcaccaattaaggcagaaagagcggcccaagcacacgggccggctgccgctgccgtcgccgctagaggcgctagccgcactttttttccacagcagagatcccagtcagagaaacagacatacctcgaggttcgccgcgagatgcatctggaagatacaactcggttctgccccaaggaagagcgcgaatctgagcaaacgagcttctctgaccaaaacccccgccaggatcagaagggaggattccgctcctcttttagaaaactcttcaaaaaaaaaaacggcaatgcaacaggagaagatttctgcgggccctggggatggtggtag

SEQ ID NO: 33105 - DNA, 2613 bp, Artificial Sequence
  Description of Artificial Sequence: Synthetic coding sequence
atggagaagacaaagacaaaacaaggagagaacgaacacatgcctgtcaacaatccttctacccaaatttatcaactccaggcgcttgcaagtgagctgaaaaccgggttcacagaggcaatgcaagagctttctcgtatccagcatggtgagtacgccctggaggagaaagtaaagtcgtgtcgatgtagcatggaagaaaaggtcaccgagatgaaaaattctctcaactatttcaaagaggaactgtctaacgcgatgtccatgattcaggcaattacatccaagcaggaggagatgcagcagaagatcgagcagctgcagcaggagaagaggcgagaatccaggaaggtgaaggccaagaagacacaaaaggaagagcattcatcccaggccggtcccgcccaagcacaggggagccccttccggtccattaacattcctgagcccgtgttaccaagcgaagattttactaacctgttaccttcacaggcctacgaaaaggcacaagaaagtcggtctgtgcatgtgggcgactctaatgtgaaaggaatgatggggcctggagtgaatccaactacaccagaagctgaggagaatctgaaatcttgcctgtctgcagatattcaatctaaagggcacctcccttccggtatgtggcgccagcccaaggacggcaaagagtggggcgaagaatacgtgacgaaagaccacccagataagcttaaggaagccggccagggacgtcactcttctttggagaacgttctctgtgaaaccagtcttgctgccaagaggcagaccgttgctctcgagcttctcgagtccgagaggaaatatgtaatcaatatctcattgatcttgaaaatcaaggccaccttccagggatctgatggcaagcgtaattccaaagaaagatcattgttccccggaagcctccgttacctcgtccaacagcacctggatctgctgcacgccttgcaggagagggtgcttaagtggcctaggcagggtgtcctgggagatttgttcctcaagctgacaaatgatgagaataacttcctcgattactacgtcgcctacctccgcgacctgccagaatgtatatccctggtgcacgtggtcgtactcaaggagggggacgaagagatcaagagcgatatttacaccctctttttccacattgtgcagcggatcccagaatacttgatccacctccaaaatgtgctgaagttcacagagcaagagcatcctgattactaccttctgttggtatgcgtgcagagactcagggtgtttatttcccactacacactgctatttcaatgcaacgaagacctgctcatccaaaaaagaaaaaagttgaagaaatccagtatggcaaagctctacaaaggccttgcaagccaatgtgccaacgccggccaggacgcttcgcccacagctggcccagaagcggtccgggacactgggatccactcggaagagctgcttcagccttatccgtcagcaccttcttcgggcccagcgataacacacctgatgcccccagttaaaaaatcccaacagcagcaatccctcatggagtccatgcagccagggaaaccttccgattgggaactcgagggccggaaacacgagaggcctgagtctctactggctcccacacagttctgtgcagctgagcaagatgtaaaagcactggccggtccactgcaggcaatccccgaaatggattttgaatcctctccagctgaacctcttgggaatgtcgaacgatcgctgagagcccccgcggagttgctgccagacgcccgggggttcgtgccagccgcctacgaagagtttgaatacgggggcgaaatcttcgcacttcccgctccttatgatgaggaacccttccaggctcccgcactttttgaaaattgttcgcctgcctcctcagaatcatccttggacatctgctttcttcggcctgtcagttttgctatggaagctgagcggccagaacaccccctacagcccttgcctaagtcagctacaagtcccgcgggatcaagtagcgcctataaacttgaagcagcggcacaggctcacgggaaggcaaaacccctgtcccgttcattgaaggaattcccccgggcccctcccgccgatggagtcgctccccgtctctacagcacacggtctagctctggcggcagggctcctattaaagccgagagggccgctcaggcccacggccccgcagccgctgccgtagccgcgcgtggcgcatctcggaccttctttccccagcagcggtctcaaagcgaaaagcaaacctacctggaggtcaggagggagatgcatttggaggatacaacacgattctgccccaaagaggagagggaaagcgagcagacttccttcagcgatcaaaatcctagacaggaccagaagggcggcttccgtagttcatttaggaagctttttaagaaaaagtcctctggatctgagtaccgagaaaagaccaatgaaaatccatctatggacccatccccaaccaagcaggattttttccgcaataggttggctctggccaacgatctggaccaagggaccgccgtatag

SEQ ID NO: 33106 - DNA, 1455 bp, Artificial Sequence
  Description of Artificial Sequence: Synthetic coding sequence
atggaggccgaggaagcccagcatggcgctagcccacctattagtgccatagaggagttcagcattatcccagaggctccaatgcgctcatctcaagtgagtgcattggggttagaggcacaagaagatgaagatcctagctacaagtggcgagaagagcaccgtctttctgccacccaacagagcgaactccgtgatgtctgcgactatgctatcgaaaccatgccttccttccctaaggagggaagtgcagacgtggaacctaaccaggagagcctcgtggccgaggcgtgcgacacacctgaacattgggaagccgtgcctcaaagtctggccggtcgccaagcgcggactttggcccccccagagctctgggcctgcccaatccaaagcgagcatctggatatggctccattctcctccgacctcggatccgaagaggaggaagtggagttctggcccggtcttactagtttgactttggggagcggtcaagccgaggaggaagaggaaacctcgagtgacaattccggccaaacaaggtattatagcccctgcgaggagcatccggccgaaaccaaccagaacgagggggcggagtctggcacgatacgccagggagaagaactgccaagtgaagagctgcaggagtcacagggtctacttcacccacaggaggtccaggtactggaggaacaggggcaacaggaagccggttttcggggggaaggcacccttcgggaggacgtctgcgccgatggcctgctcggtgaagagcaaatgatcgagcaggtcaatgacgagaaaggggaacagaagcagaaacaggagcaagtgcaggatgtgatgctggggaggcagggggagagaatggggctgacaggtgaacccgagggcctgaatgacggcgaatgggaacaggaggacatggaaagaaaggcacagggccaaggcggccctgaacagggggaggaacgaaagcgcgagctgcaggtgccggaggaaaatcgggccgattcgcaggacgaaaaatctcagacctttctaggtaaatccgaggaagtgacggggaaacaagaggatcatggcatcaaggaaaaaggggtacctgtctccggccaggaggcaaaagagcccgagtcgtgggacggaggacgcttaggggcagtcggccgcgctaggtcccgggaagaggaaaatgagcaccacggaccctctatgccagcacttattgcgcctgaggatagcccacactgcgacctttttccaggagcatcttatctggtcacgcagattcctggtacccaaaccgagtccagggcggaggaactgagtcccgccgccctatctcccctgctggaacccattcgctgttcacaccaaccgattagcctgctcggttcatttctgaccgaggaaagtcctgataaggagaaactcctcagtgtgctgtag

SEQ ID NO: 33107 - DNA, 1455 bp, Artificial Sequence
  Description of Artificial Sequence: Synthetic coding sequence
atggaggccgaagaggcccagcacggggcctcccccccaatctccgcaatcgaggaattctcaatcattccagaggcccccatgaggtcaagccaggtaagcgctcttggcttggaggctcaggaggatgaggatccgagttacaagtggcgcgaggaacaccgtctgtcagctactcaacagtccgagcttcgcgatgtgtgcgattatgccatagagacaatgccaagttttccaaaagaagggagcgcagatgtcgaacccaaccaggagagcctcgttgcagaggcgtgcgacactccagagcactgggaggccgtgccccaaagtctggcaggccgacaggcccggaccttagcaccacccgagttatgggcctgccccatccagagtgaacacttggacatggcacccttcagttccgacttggggagtgaagaagaagaagtagagttctggcccggcctcacaagcctgacgcttggatctggccaggcagaggaggaagaagaaacgtcctccgacaattctggccagacccggtattacagtccttgtgaggagcaccctgcagagacgaaccagaatgagggggccgagagtgggaccattcgtcagggcgaggaattgccaagtgaagagctgcaagaaagccagggtctcctacacccccaagaagtacaggtgctggaggaacaggggcagcaggaagccgggttccgtggagagggaacactacgggaggatgtgtgcgcagacggtcttctgggcgaggagcagatgattgaacaggtcaatgacgagaagggcgagcagaaacagaagcaagaacaagtccaggacgtgatgttgggccggcagggagagcggatgggcttgaccggcgaaccagagggcctgaatgatggtgagtgggagcaggaggacatggaacgtaaggcccagggtcagggaggccctgaacagggcgaggagcgcaaaagggagctgcaagttccagaggagaatcgcgctgattcacaggatgagaagagccagaccttcctgggaaaatctgaggaagttacagggaagcaggaagaccatggcataaaggaaaaaggggtaccagtttcgggccaggaggccaaggagccagagtcctgggatggtggacggctcggggctgtaggcagggcccggtcccgtgaggaggaaaacgagcatcacggcccctcgatgcccgcgttgatcgcaccagaggatagtcctcactgtgacctgttccctggtgcgagctatcttgttacacagatccctggcactcagaccgagtctcgggcagaagagctctcacccgccgcactaagccctcttctggagcccatccggtgcagtcaccagcccatatctctactgggaagttttctcactgaagaatccccggacaaggagaaactgctttcagtcttgtag

SEQ ID NO: 33108 - DNA, 672 bp, Artificial Sequence
  Description of Artificial Sequence: Synthetic coding sequence
atgctcggggtgactaccgtcagatctaggatgaggcgggcccttgtttttggaatggttgtcccttctgtgctcgtgccctggctcttgcttggagcaagctggctgattccacagacatctttcctgtcaaacgtctgcggcttatcaatcgggttggcctacggtttaacgtactgttactccatcgatctaagcgagagggtcgctctgaagcttgatcaaactttccctttttcattgatgcgcagaatctctgtgtttaagtacgtgagcgggtccagtgccgagcggcgggccgcccagtcacgcaaactgaatccagtgcccggctcctacccgacccagagttgccatcctcatctctccccatctcacccagtctcccagactcaacacgctagcggacagaagcttgcaagctggcctagttgcacaccaggccacatgccgactctgcccccctaccagccggccagtgggctgtgttacgtgcagaaccactttggtccaaaccccacatctagctccgtgtaccctgcaagtgcagggacctcactaggcatccagccaccaacccccgtgaactcacccggcactgtatactcgggagccctgggaactccaggggccgccgggagcaaggagtcaagccgtgttccaatgccctag

SEQ ID NO: 33109 - DNA, 2013 bp, Artificial Sequence
  Description of Artificial Sequence: Synthetic coding sequence
atgatattggaagagagacctgatggtgctggcgccggtgaagagtctccgcgtctccaaggatgcgactccctgacacaaatccagtgtggccaattgcaatctcgcagggcacaaatccaccagcagattgacaaggagctgcagatgagaacaggagccgaaaatctgtaccgcgcgacgtcaaataatagggtcagggaaacagtcgccttggagctctcctacgtgaactctaacctacagctcttaaaggaagaactggaggaactcagtggaggggtcgaccctggtcgccacggtagcgaggccgtgaccgttcctatgattcctttgggattaaaagagacaaaggaactcgattggagcacacctttgaaggagctgattagtgtgcatttcggtgaagacggagcttcatatgaagcagagatcagggagttggaggccctgcgacaggccatgcggaccccttctcggaacgaatctggcttggaactgctgactgcctattacaatcagctgtgttttctcgacgccagatttctcacccccgcaaggagtctgggcctcttttttcactggtacgactctctcaccggagttcccgcccagcagcgagccttagcatttgagaagggcagtgtcttgttcaacatcggcgcgttacacacacagattggtgccagacaggataggagctgtacagagggtgctcgacgggcaatggaggcctttcagagagccgccggagcattttcactcctgcgcgagaattttagccatgcccctagtccagacatgtccgcagccagcctctgtgcccttgagcagctgatgatggcacaggcccaagagtgcgtgttcgagggacttagtccgccagcatcaatggccccccaggactgtcttgcccagttgcgtctcgctcaagaggccgcccaggttgcagccgagtaccggttggtgcaccgcacgatggcgcagccccctgtgcacgactacgtgccggtatcttggacagctctcgtacacgtaaaagccgagtactttcgctccctcgctcactatcacgtggcaatggctctgtgcgacggcagccccgccactgagggggagctccctacacacgaacaggtattcctgcagccgccaacttccagcaagccaaggggccccgtcttgccacaggaactagaggagaggaggcagctgggaaaagcccatctgaaacgggccatcctcggtcaggaagaggcactgcgcctgcatgcgctctgccgcgtcctccgggaagtggacctgttaagggcagtcatttcccaaaccctgcagcgttccctggctaagtatgctgagctagaccgcgaggacgatttctgtgaagccgctgaggccccagacattcagccaaagactcaccagaaaccagaagcccgcatgccgcgcttatctcagggaaaaggtccggacatctttcataggctgggacccctcagtgtattctccgctaagaataggtggcggttagtgggacccgttcacctgacccgcggggagggtgggttcggtctcacactgaggggtgacagccctgttctgatagccgctgtcatccctgggtcgcaggccgcggcggctggactgaaggaaggagattacatcgtgtccgttaacgggcagccatgccgctggtggcgccatgcggaggtagtcactgaactcaaagccgcaggcgaagctggggcttccctgcaggtggtgtcgttgttgcctagctcacgtctcccctctctgggtgaccgacgaccagttttactgggaccaagaggactcctgcggagtcaacgcgagcatgggtgcaagactcctgcatccacctgggcctccccccggcccctgctgaattggtcccgcaaggctcagcaaggcaaaacaggcggatgcccgcagccctgcgctcccgtgaagccagcgcccccatcaagccttaagcacccaggttggccctag

SEQ ID NO: 33110 - DNA, 546 bp, Artificial Sequence
  Description of Artificial Sequence: Synthetic coding sequence
atgtataatattaaacaatctactgacacaaaagaagcagctgctatcgaggctcggcggaaccgggaaaaagagcgtcagaatcggttctttaatgttaggaatcgcgtgatgggagtcgatgttcaggctctcaataaccaggtaggcgaccggaaacgaagagaggccgcagagcgttcaaaggaggccgcttacggcacttcccaggtccaatatgatgtcgtggttcagatgcttgagaaagaggaggctgatcggacaagacagttggctaagaaagtacaagaatttagggaacagaagcagcagttgaagaacggccgggagttctcactgtgggacccagggcaggtgtggaagggcttgcccacctatctgtcatatagcaatacctacccaggcccagcttccttacagtacttttccggggaagatctggatcgggatactaggctccggatgcagcaggggcagtttaggtataatcttgaacgtcaacaacaggagcagcaacaggctaaggtggatgagaattacacttag

SEQ ID NO: 33111 - DNA, 1140 bp, Artificial Sequence
  Description of Artificial Sequence: Synthetic coding sequence
atgtacaacatcaagcagagtacggacacaaaagaagccgctgcaatcgaagcccggcggaatcgggagaaggagcgccagaacaggttttttaacgttcgcaatcgggtaatgggggtggatgttcaggcccttaacaatcaggtcggcgaccggaaacgaagagaggcagccgaaagaagcaaggaggctgcctatggaacaagccaggtgcagtatgatgtggtggtgcagatgctcgaaaaggaggaagccgatagaactagacagctggccaaaaaagttcaggagtttagggaacagaagcagcagctgaaaaatggaagagaattctctttgtgggaccccgggcaagtgtggaagggactccctacctatctgtcctactctaacacatatccagggcccgcttctctacaatatttctcaggcgaagatctcgacagagatacaagactgagaatgcaacaaggacagttccggtacaatctggaaagacagcagcaggagcaacagcaggccaaggttgacgagaattataccgacgccctgtcaaatcagctgaggctggctatggacgcccaggcaacccatttggcaagattagaggaatcatgccgggctgctatgatgtgcgccatggccaatgccaataaggcacaggcagccgtgcaggccggcagacagaggtgcgaaaggcaaagggaacagaaggccaacctagctgaaatccaacatcaatcaacctcagatttgctgacagaaaacccacaggttgcccagcatccgatggcgccatatcgggtgttaccatattgctggaaaggcatgacacccgagcaacaggcagcaatcagaaaagagcaggaggtccagcgcagtaagaagcaggcccaccggcaagctgagaaaacacttgacactgagtggaagtcccagacaatgtcaagcgctcaggcggtgctggagctggaggagcaggaacgggagctatgtgctgtcttccagcgcgggcttgggtcttttaaccaacagttggccaacgagcagaaggctcaacaggactacctgaatagcgtcatctacaccaaccagcctacagcgcagtatcaccaacagtttaacacctcaagtcggtag

SEQ ID NO: 33112 - DNA, 717 bp, Artificial Sequence
  Description of Artificial Sequence: Synthetic coding sequence
atgtacaatatcaagcagagcacagatacaaaggaggcagcagctatcgaggcccggagaaacagggaaaaagaacggcaaaataggttctttaacgttcggaacagggtgatgggagtcgatgtgcaggccttaaacaaccaggtcggcgacaggaaacgccgggaggccgcggaacgatcgaaggaagctgcctatgatgccttgagcaaccaactgagactggctatggacgcacaggctacgcacctggctaggttggaggagtcttgcagagcagcaatgatgtgcgccatggccaacgccaacaaggcacaggcagcggtgcaggcgggcagacagaggtgtgagcggcaacgggagcagaaagccaacttggcagagatccaacatcagtcaaccagcgacttgctgacagaaaatcctcaggtggcccagcatcctatggccccctaccgcgtcttgccttattgctggaagggcatgacacccgaacagcaagcagctattcggaaggaacaggaggtgcagcgcagcaagaagcaggcacaccgccaggcagagaagacattggacaccgagtggaaatctcagactatgtctagtgcccaggccgttctggagctggaggaacaggaacgtgaactgtgtgcagttttccaaaggggactcggatctttcaaccagcagcttgctaatgaacagaaggctcagtag

SEQ ID NO: 33113 - DNA, 579 bp, Artificial Sequence
  Description of Artificial Sequence: Synthetic coding sequence
atgtataatatcaaacagagcactgatacaaaggaagccgctgcgatcgaggcccggaggaaccgagagaaggaacgccagaataggttttttaatgtgaggaatagggtgatgggtgtcgatgtgcaggccctcaataatcaggttggtgaccggaagaggagagaggccgctgaaaggtcaaaagaggccgcttatgggacctctcaagtacaatacgacgtcgttgtgcagatgctggagaaagaggaggcagataggaccagacagctcgccaagaaggtccaagagttcagggaacaaaagcagcagttgaaaaacgggcgtgaattcagcctgtgggacccaggacaggtatggaaagggctgcccacctacctgagttactctaatacctatcctgggcccgccagcctccagtatttctctggtgaggatctggaccgcgacaccaggctgaggatgcagcagggccagtttaggtacaatctggaacgccagcagcaggaacagcagcaagccaaagtcgacgaaaactacacaggcaaacagccgggcccccctgactcagaaacgtag

SEQ ID NO: 33114 - DNA, 930 bp, Artificial Sequence
  Description of Artificial Sequence: Synthetic coding sequence
atgagacagaacgacaaaatcatgtgtattctcgaaaacagaaagaaacgggaccgcaagaacctgtgtcgcgccattaatgactttcagcagtctttccagaagccagaaacccgacgggagtttgatctgtctgaccctctagccctgaaaaaagaccttcccgcccgacaaagcgataatgacgtcaggaatacaatctctggtatgcaaaaattcatgggggaggacctcaacttccacgaacgtaagaagtttcaggaggaacaaaaccgggaatggtctctgcagcagcagcgggaatggaagaacgcgagagcagaacagaaatgcgccgaagccttgtacaccgagacacgcctccagttcgatgaaacggcgaagcatctccagaagctcgaaagcacaacgagaaaagcagtatgtgccagcgttaaggactttaacaagtcccaagcgattgagagcgtcgagcgaaagaagcaggagaaaaagcaagagcaggaagataatcttgccgagatcaccaacttgctcagaggcgatttactgagcgaaaatcctcagcaggcagcatctagttttggtcctcaccgcgtggtgccagacagatggaaagggatgacacaggaacagctggagcagattcgacttgtgcagaaacagcagattcaagaaaagttgagactgcaggaagagaagcggcaacgtgaccttgattgggataggcgaaggatacagggtgctagggcaactctgttgttcgagagacagcagtggcgaagacagagggacctgagaagggccctggactcaagtaaccttagcttggccaaagaacagcacttgcagaaaaagtacatgaacgaagtctacacaaaccagcctactggcgattacttcacccagtttaacaccggcagtagatag

SEQ ID NO: 33115 - DNA, 1134 bp, Artificial Sequence
  Description of Artificial Sequence: Synthetic coding sequence
atggcggtcgctcttcctcgagacttgcgccaagacgcaaacctggccaagcgcagacacgccgagttatgccgccaaaaacgcgttttcaacgctcggaataggattatcggaggagacaccgaagcctgggatgtgcaggtgcacgaccagaagattaaggaagccaccgaaaaggcacgccacgagacattggccgcagaaatgcggcagaatgataagatcatgtgtatcctggagaaccgaaagaaaagggaccggaagaatctatgcagggccatcaatgatttccaacagtcttttcagaaaccggagactaggagagagttcgacctgtctgatccactcgctcttaaaaaagacctgccagcccgtcagtccgataatgacgtgcgcaacaccatttctgggatgcagaagtttatgggagaagatcttaattttcatgagcgaaaaaaattccaagaggaacagaaccgagagtggtccctacaacaacagcgggaatggaagaatgcccgtgccgagcagaaatgtgcggaagctctctatacagaaacaagactgcaatttgacgaaacagccaagcatctgcagaaattggaaagcactactcgtaaggccgtgtgcgcgtcagtcaaagattttaataagtctcaagcaatcgaatctgtggagcggaaaaagcaagaaaagaaacaggagcaggaggataacctcgccgaaatcacaaaccttctgaggggtgaccttttgtccgaaaaccctcaacaggctgccagcagctttgggcctcatcgggtagtgcctgaccggtggaaagggatgacccaagagcagctggagcagatcagactggtacaaaaacagcaaatccaggagaaactgcggctgcaggaggaaaaacggcaacgagatctggattgggaccgcagacgcattcagggggcaagagccacgctcctctttgaacgtcagcagtggaggaggcaaagggaccttaggcgggccctggatagcagtaatctgtcactggcgaaggaacagcatctgcagaaaaagtatatgaatgaagtatacacaaatcagcctaccggcgactacttcacacagttcaataccggctctaggtag

SEQ ID NO: 33116 - DNA, 432 bp, Artificial Sequence
  Description of Artificial Sequence: Synthetic coding sequence
atggaaaccttccccctgctgcttctatcactcggcctcgtacttgctgaggccagcgagtctaccatgaagataatcaaggaagaatttaccgatgaagagatgcaatatgatatggccaagtccgggcaggaaaaacagaccatagagattctgatgaacccgatcctactggttaagaatacatccctgtccatgtcaaaggacgatatgtccagtacgctcctgacattcaggtctctgcactataatgatccaaagggaaactcctcgggaaacgataaagagtgctgcaatgacatgaccgtgtggaggaaggtaagtgaagccaacgggagctgtaagtggtcaaacaatttcattcgatctagcacagaagtgatgcggcgcgtccaccgcgccccttcttgcaaatttgtgcagaacccttag

SEQ ID NO: 33117 - DNA, 555 bp, Artificial Sequence
  Description of Artificial Sequence: Synthetic coding sequence
atggttcggtacagcttagaccctgagaatcccaccaagagctgtaagagccgagggagcaatttgcgggtgcatttcaagaacaccagagaaacagcgcaggccatcaagggaatgcacattcgaaaggcgaccaaatatctgaaagatgtcacattgcagaagcaatgcgtgccctttaggcggtataatggaggcgtggggaggtgtgctcaggccaagcagtggggctggacacaaggccgctggcctaaaaaatctgcggagtttttacttcatatgctgaagaatgcagagagcaatgccgagctgaaggggttggacgtcgactcgctggtgatcgagcatatccaggtcaacaaggcacctaaaatgaggaggcgcacctaccgagctcacggtaggatcaacccgtacatgtcctcaccgtgtcatatcgaaatgattctcacggagaaggagcagatcgtgccaaaaccagaggaggaggtggcccagaagaaaaagatttctcagaaaaagcttaagaagcagaagctcatggctagggaatag

SEQ ID NO: 33118 - DNA, 441 bp, Artificial Sequence
  Description of Artificial Sequence: Synthetic coding sequence
atgcacatcagaaaggctaccaagtacctgaaagacgtgacactacaaaaacagtgtgtaccattcagacgatataatggcggagtaggccggtgtgcacaggccaaacagtggggatggacacaggggcggtggcccaagaagagcgctgagttcctgctccatatgttaaagaacgccgaaagcaacgctgagctgaagggactggatgtcgattctctcgttattgagcatatacaggtcaacaaagcgcccaagatgagacgcaggacttaccgggcacacggcaggattaatccttatatgtccagtccttgtcacattgaaatgattctgactgagaaggagcagattgtgccgaaaccagaggaggaggttgcacagaaaaaaaaaataagccagaagaaactcaaaaagcaaaagctaatggcaagggagtag

SEQ ID NO: 33119 - DNA, 525 bp, Artificial Sequence
  Description of Artificial Sequence: Synthetic coding sequence
atggttcgatattccctcgaccccgaaaacccaactaagtcttgtaagtccagggggagcaacctgagggttcatttcaaaaatacaagagaaactgcacaggcaattaaaggcatgcacataagaaaggccacaaagtatcttaaggacgtgacgttacagaaacagtgtgttccgtttaggagatacaacggtggggtcggtaggtgtgctcaggccaaacagtggggttggacccagggacggtggccaaaaaaatccgctgagtttctccttcatatgctcaaaaatgccgagtctaatgccgagttaaaagggctcgacgttgactctctggtaatcgaacacattcaggtaaataaagctcctaaaatgcgtagacgtacctacagggcacacggacgtatcaatccatatatgtctagcccatgccatattgaaatgatcctgaccgagaaggaacagatcgtgcctaagccagaagaagaggtggctcagaagaaaaagattagccagaagaagtag

SEQ ID NO: 33120 - DNA, 585 bp, Artificial Sequence
  Description of Artificial Sequence: Synthetic coding sequence
atgccggtcgcaagatcctgggtgtgccgcaagacatatgtaacccccaggcgcccgttcgagaaatccagactcgatcaggagctgaagcttatcggtgaatacggactgcgaaataagagagaagtgtggcgcgtaaagtttactctggccaagatccgaaaagccgccagggaattgctgactctcgatgaaaaggaccctagacggctgttcgaaggtaatgcactgctacgacggctggttcgaatcggagtccttgatgagggaaagatgaagcttgactacattttaggactgaaaatcgaggatttcctcgagagacggcttcaaacccaggtttttaagctgggactcgccaagtcaatccatcacgccagagtgctaattcgacagcggcatattcgcgtacggaaacaggtggtgaacatccccagctttatcgtgcggttggattcccagaagcacatagacttttctctccgcagtccatatggtggaggtcgtcctggtcgtgtgaaaaggaaaaatgcgaaaaaggggcaaggtggggccggggccggcgatgatgaggaggaggattag

SEQ ID NO: 33121 - DNA, 888 bp, Artificial Sequence
  Description of Artificial Sequence: Synthetic coding sequence
atgtccggggcacttgatgtgctgcagatgaaagaagaagatgtgcttaagttccttgcggctggaacacacttgggcggaacaaatctggattttcaaatggagcattacatatataagcggaaatcagacggcatttatatcatcaatttgaaacggacctgggaaaagctcctgctcgctgcacgcgccattgtcgctattgaaaaccccgccgacgtgtccgtaatctcttcaaggaacacggggcagagggccgtgctcaagtttgctgcagcaacgggggctacgccaatcgcaggaaggttcacacctgggacctttaccaatcagattcaggccgctttctgggagccacgattactggtagttaccgatccccgtgcagaccaccagccactgactgaggcctcttatgttaatctgcctactattgctctgtgtaatacagactcccctctacggtatgtagatatagcaattccatgtaacaacaagggagctcattccgtgggccttatgtggtggatgctggctagggaggttttacgcatgaggggcactatctcccgggagcacccatgggaggtcatgcccgacctgtatttttatagagaccctgaagaaatcgaaaaagaagagcaggcagctgcggagaaagccgtgacaaaagaagaatttcaaggcgagtggactgccccctccccagaatttactgctactcaacccgaggtagccgactggtccgagggagtgcaggtgccatctgtaccgatacaacagtttcccaccgaagactggtctgcccagcctgccacggaagattggtcagccgctcctaccgcacaggctacggaatgggtgggcgcaactacagactggagttag

SEQ ID NO: 33122 - DNA, 843 bp, Artificial Sequence
  Description of Artificial Sequence: Synthetic coding sequence
atggtagctaggcgacgaaagtgcgccgcccgagatccggaagataggatcccatccccactgggctatgctgctatcccaatcaaatttagtgagaagcagcaggcctctcactatttgtatgtgcgggctcatggagtgaggcaggggactaagagcacatggcctcagaagcggactctctttgtcctgaacgtacctccatactgcacagaggagtccctgagtaggctactatctacctgcggtctggtccagagtgtcgagctacaggaaaaacctgacctggctgagtcaccgaaggaatcccggagcaaatttttccatcctaagcccgtacccggattccaagtcgcctacgtggtgtttcagaagcctagcggggtgagcgcagccctggccctcaaaggccctctgctcgtatcaacagagtctcaccccgtcaagagcgggatccacaaatggatctccgattacgccgactctgtgccagacccagaggcgctgagagttgaggtggacactttcatggaagcatatgaccaaaaaatagccgaagaggaagccaaggcaaaggaggaggagggcgtgcctgacgaagaaggttgggtcaaggtaaccaggagagggcgccggcctgtgctcccaaggacggaagccgccagcttgcgtgtccttgagcgagaacgccgcaaaaggtctcgaaaggagctgctgaatttttacgcctggcagcaccgggagtctaaaatggagcatctcgcacagctgcgaaagaagtttgaagaggataagcagagaattgagctgctacgggcacagaggaagtttaggccatattag

SEQ ID NO: 33123 - DNA, 735 bp, Artificial Sequence
  Description of Artificial Sequence: Synthetic coding sequence
atggcagcaccgtctgatgggttcaagcccagggagcgctcgggcggcgagcaggcccaggattgggacgcgctgccacctaagcgcccacggctgggcgcaggcaataagattggcggccggaggttgatcgttgtcctggagggtgccagtctcgagactgtcaaagtgggcaaaacgtatgagctcttaaattgtgataaacacaaatcaatcttgctgaaaaacgggcgtgatcccggagaagctcggcccgacataacccaccagtccctgctgatgttgatggactcccctcttaatcgagcaggtctcttacaggtgtacattcatacacagaagaacgtcttaatcgaggtcaatccacagaccaggattcctcgtaccttcgatcggttctgcgggctgatggtccaactgttgcacaaactctctgtaagggcggccgatggccctcagaaactgctgaaggtaatcaagaaccctgtttctgaccatttccctgtggggtgtatgaaagtgggaacctccttttctatccctgtggtctctgacgtccgtgagctagttcccagtagcgaccctatagtgttcgtagtgggtgccttcgcgcatgggaaggtctcggtcgagtatactgagaaaatggtgtccatctccaattaccccctcagcgcagcactgacttgtgcaaaactgaccaccgcattcgaggaagtttggggagttatatag

SEQ ID NO: 33124 - DNA, 474 bp, Artificial Sequence
  Description of Artificial Sequence: Synthetic coding sequence
atgaatctggatggttcggcccaagatccagaaaagcgcgaatattcaagcgtatgtgtgggccgcgaagacgatataaaaaagagcgaaaggatgaccgcagtagtgcacgaccgggaggtggtgattttctaccacaaaggcgaataccacgcaatggatattcgatgttatcacagtggcggccctctgcatctgggcgatattgaggacttcgacggaaggccctgtatcgtatgtccctggcacaaatacaagatcacgctagccacgggggaagggctgtatcagtcaatcaatccaaaggacccgtcagcgaaaccaaagtggtgttccaagggaatcaaacagcgaatccataccgtgactgttgacaatggcaatatctacgtcaccttgtccaatgaaccgttcaaatgcgactctgacttctacgccactggggacttcaaagttattaaatcctcatcttag

SEQ ID NO: 33125 - DNA, 633 bp, Artificial Sequence
  Description of Artificial Sequence: Synthetic coding sequence
atgctgaagtgcttccgcaattgcctcagaccaagttcgctgtctaccctgcctctgcagtatggcatcttgtttccaaaactgttggcctgtttggtccatctgcatttcggccatttctcctccgcagtgatttcagtcacaagtttctacctcagcatgaatttggacggcagcgcacaggacccggagaagcgggagtactcttcggtttgtgtagggcgggaagacgacatcaagaagtctgaacgaatgaccgcagttgtgcatgacagggaggtggtgatcttctaccacaagggcgaataccacgccatggatattcgctgctatcatagcgggggcccgctccatctgggcgacatagaagatttcgacggcagaccgtgtatcgtgtgcccctggcacaaatataaaattaccctcgccactggggaagggttgtatcaaagtatcaatcctaaagacccatccgccaaacccaaatggtgttcaaaggggataaaacagcggattcacaccgtcactgtcgataatggaaacatctacgttactctatcaaacgaaccctttaaatgcgattccgatttttatgctacaggggacttcaaagtaattaaatcctcctcctag

SEQ ID NO: 33126 - DNA, 633 bp, Artificial Sequence
  Description of Artificial Sequence: Synthetic coding sequence
atgctgaaatgctttcgcaattgcttgagacccagttcacttagtactcttccccttcagtacggaatcctttttcccaagttgttggcctgtctcgtccaccttcatttcggacacttctcaagtgctgtgattagcgttacaagcttctacctttccatgaacctggatggctccgcgcaggatccagagaaacgggagtactcttcagtgtgcgtgggccgggaggatgacatcaaaaagtcggaacgcatgacggccgttgtccatgatagggaagtggtcatattttaccacaaaggagagtaccacgcaatggatattcggtgctaccattcaggtggcccccttcatctcggcgacattgaagactttgatggtagaccatgcattgtctgtccctggcataagtacaagatcacccttgcaacgggcgagggtttgtaccagagcatcaacccaaaagacccctccgcaaagccaaaatggtgctccaaaggaattaaacagagaatccacactgtgaccgtggacaacggcaatatctacgtcaccctatcaaacgaaccttttaagtgtgattcagatttctatgccactggcgattttaaggttatcaagtctagcagctag

SEQ ID NO: 33127 - DNA, 357 bp, Artificial Sequence
  Description of Artificial Sequence: Synthetic coding sequence
atgaatctggacgggtcagcgcaggaccctgagaagcgtgagtactcgtctgtttgtgttggcagggaagatgatataaagaagtcagagaggatgaccgctgttgtgcatgaccgtgaggttgtgattttctatcataaaggtgaataccacgctatggatataagatgttatcactccggtggacctcttcacctgggcgatattgaggactttgatggccggccgtgcattgtatgtccttggcacaagtacaaaattaccctcgccactggagagggattgtaccagagcatcaaccctaaggatccctctgccaagcctaaatggtgctctaaaggtatcaagcagcggtag

SEQ ID NO: 33128 - DNA, 1032 bp, Artificial Sequence
  Description of Artificial Sequence: Synthetic coding sequence
atggcggagcagttatcacctggtaaggcggtcgaccaggtgtgcactttcttgtttaagaagcctggaaggaaaggcgctgccggacggagaaagcggcctgcttgtgatcccgagcctggtgaaagcgggagctcctcagatgagggttgcaccgttgtccgcccagaaaagaaacgggtgactcataacccaatgatccaaaaaactagagactccggtaaacagaaagcggcctatggcgacctctcctccgaggaggaggaggagaatgagcccgaatctttaggagttgtctataaatcgactcgatcagcaaagccagtcggacccgaggatatgggggccaccgctgtatatgagctggacaccgagaaggagagggatgctcaggctatctttgaacgctctcagaagattcaggaggagctgcggggaaaagaagatgataagatatacaggggtatcaataattatcagaagtatatgaaaccgaaagacactagtatgggcaatgcttcctccggtatggttaggaaaggcccaatccgcgcgcccgaacacctaagggcaaccgtccgatgggattaccaacctgacatttgtaaagactataaggagacaggattttgcggcttcggcgactcgtgtaaatttctccacgatcggtccgattacaagcatggatggcagattgaaagagagttagatgaagggcgttatggagtgtatgaggatgagaattatgaggttggctctgacgacgaggagataccgtttaagtgctttatatgcagacagagctttcagaatccagtggtcactaaatgccgccattatttctgtgagtcatgcgcactccagcatttcagaaccactccgaggtgttacgtctgcgaccagcagacaaatggcgtctttaatcctgccaaggagctgattgccaaattggagaagcaccgtgcaactggagaggggggagcatcggatctgccagaagacccagacgaagatgccatccctattacatag

SEQ ID NO: 33129 - DNA, 969 bp, Artificial Sequence
  Description of Artificial Sequence: Synthetic coding sequence
atggccgcacccccttccccaggacggaccgctgatcaggctgaccaggtttgcacgtttctgttcaaaaaacccggtcgaaagggggccgccggactgcgaaagcgccccgcatgtgatcccgaacacggggagagctcgtcatctggcgatgagggtgatactgtcgctcagccaccacgggtggctcctcggcctaggggactccactcttggcagaaggccgcacatggagatcgccgcggcgaggaggccgcccctgaatcacttgacgtggtttatagaagcacccgcagtgctaagccagttggacccgaggatatgggcgccaccgcagacttcgagcaggatactgagaaggagcaccatacgcccacaatcctgaagtgctcccaaagagtgcaggaggccctccgcggacgcgagcatgaccacatctataggggaatacactcctacctcagatatctcaagcctaaggacacctcaatgggtaattcctccagtggtatggccagaaaaggccccattagagctcctggtcacctgagagcaaccgtgagatgggattatcaaccagatatttgtaaagattacaaagaaaccggattttgtggattcggcgatagctgtaaattcttacatgacagaagcgactataagctggggtgggaaatagaacgcgagctcgaagaaggccggtattgtatatgtgaagatgaaaatcacgaagtaggcagcgaggaggaggaaatcccgtttcggtgcttcatttgcaggcaagcctttcagaaccctgtcgtgaccaaatgcaggcactacttctgtgagagctgtgcgctggagcacttcagagcgacgccgaggtgttacatatgcgaccagcccaccggagggatttttaatcccgcgaaggaactcatggctaaattacagaaactgcaggcagctgaggggaagaagcggtag

SEQ ID NO: 33130 - DNA, 516 bp, Artificial Sequence
  Description of Artificial Sequence: Synthetic coding sequence
atgtcatctaagcgaacaaaaaccaagacaaagaagcgcccacaacgcgccacctctaacgtttttgctatgttcgatcagtctcagatccaggaatttaaagaagccttcaacatgatcgaccagaacagagatggcttcattgataaagaagatctccacgatatgctcgcttccctggggaaaaatcccactgacgaatacctggacgccatgatgaatgaggccccaggacccataaactttaccatgtttctcacaatgttcggtgagaagttgaacggtacagacccagaggacgtaatcagaaacgcgttcgcatgctttgacgaagaggctaccggaactatccaggaagattaccttcgtgaactactgaccaccatgggcgataggtttacggatgaagaagtggacgaattgtacagggaggcaccaattgacaaaaagggtaattttaattatattgagtttacccgcattttaaagcatggtgccaaggacaaagacgattag

SEQ ID NO: 33131 - DNA, 936 bp, Artificial Sequence
  Description of Artificial Sequence: Synthetic coding sequence
atggccgaagcatctccacatccaggtaggtacttttgccattgttgttctgtggagatagtccccagactgcctgactacatttgccccaggtgtgaatctggcttcattgaagaattgccagaagagacaaggagcaccgagaacggatccgcaccatcgaccgccccaacagaccagagccggccaccccttgaacatgtggaccaacacttattcaccctcccgcaggggtacggacaatttgcattcggcatattcgacgactcatttgagattccgaccttcccgccgggtgctcaggctgatgatgggagggaccccgagtcccgacgcgagcgcgatcacccttcaaggcaccgctacggtgcccggcagcctagagccaggttaacaactcggagggccacaggcagacatgaaggggtccctacacttgaggggatcatccaacagctggtgaatggtattataacccctgctaccattcccagtctgggaccatggggagtgctccacagcaaccctatggactacgcatggggcgccaacggattggatgcgataataacacaactgctgaatcagttcgagaacaccggtcctccccccgctgacaaggagaagatccaggctcttcctacagtgcccgtgacagaggagcacgtcgggtccgggcttgaatgtcctgtgtgtaaggacgactatgcactcggggaaagagtcagacagctcccctgcaatcacttgttccacgacggttgtatcgtaccctggcttgagcagcacgatagctgccccgtgtgccggaaaagtctaaccggccagaacacagccaccaatccgcccggtttgacgggcgtcagcttctcttcctcctcatcctcgtcctcttcctcctctcccagcaacgagaacgctacctcgaacagttag

SEQ ID NO: 33132 - DNA, 984 bp, Artificial Sequence
  Description of Artificial Sequence: Synthetic coding sequence
atggccgaggcatccccccacccaggtaggtatttttgtcactgttgcagcgtggagattgttccgagactacctgactacatctgcccccggtgcgaatccgggttcatcgaggaactcccagaagaaactcgaagcaccgagaatggaagcgctccttctaccgctccaactgatcaaagccgccctcccctagagcatgtggatcagcatctgtttacactcccccagggctatggtcagttcgcatttggcatatttgatgattcatttgagatccctacattccctcccggagcccaagccgacgacggtcgcgatccagaatctaggcgtgagcgtgaccacccttctagacatagatatggagcaagacagccccgggctagactaacgactcgaagggcgaccggtagacacgagggcgttcctaccctcgaaggcataatacagcagctggtcaatgggatcattaccccagccactataccctcacttgggccatggggagtgttgcacagcaatccaatggactacgcttggggagccaatggactggatgctattatcacgcaactcctaaaccagttcgagaatactggcccgccccccgccgacaaagaaaagatccaagcactgcctacagtgccggtcacagaagagcacgtgggctctggattagagtgcccagtctgcaaagacgattacgctttgggggaacgggtgagacagctcccatgtaaccatctgttccatgatggctgcattgtgccttggttggagcagcatgatagttgtccagtctgccgaaaatcccttaccggccagaatacagctaccaatcctccaggcctgaccggtgtgtctttctcatcatcctcctctagctcttcttcctcttccccaagcaacgagaacgcaactacctggtcaccattgggacggccccaaccacctcgccctctctcaaacctgactctctag

SEQ ID NO: 33133 - DNA, 456 bp, Artificial Sequence
  Description of Artificial Sequence: Synthetic coding sequence
atggccgaagacctttccgcggccacttcctacacagaggatgacttttattgtccagtttgccaggaggtactgaagacgcccgtccgtaccacagcctgtcagcacgttaacagaagcgaaacttcaacatctgataatactgagacttaccaagaaaacacttccagtagtggacatcccaccttcaagtgtccactctgccaggagtcaaatttcacaaggcaaagactcctggatcattgcaactctaatcacctattccagatcgtgcccgtcacctgccctatttgtgtgtccctgccctggggggacccctcgcaaataacccggaatttcgttagccatctgaatcagcgtcatcagttcgattatggcgagttcgttaacctccagttggatgaagagactcagtatcagactgccgtggaggaatcttttcaggtaaatatatag

SEQ ID NO: 33134 - DNA, 738 bp, Artificial Sequence
  Description of Artificial Sequence: Synthetic coding sequence
atggctgaagatcttagtgccgcaacgtcttacacagaggacgatttctactgtcctgtttgccaggaagtgctgaagactcccgtgcgcacgaccgcctgccagcacgttttctgtaggaagtgtttcctcacagccatgagggagagcggagcccactgtcccctatgtcgtggcaacgtcactaggcgtgagagagcctgcccggaacgggcactcgatctcgagaacatcatgcgtaaatttagtggcagctgtaggtgttgtgccaagcagatcaaattctacagaatgcgccaccattacaaaagctgtaagaagtaccaggacgagtacggcgttagttctatcatcccaaactttcagatttcccaggattccgttggcaattcaaacagatctgaaaccagtacgagcgataatacggaaacgtatcaggagaataccagtagcagcggtcacccgacttttaaatgccccctgtgtcaggagtccaacttcacacgtcagcgacttcttgaccactgcaactctaaccatctattccagatcgttcctgttacttgtccaatctgtgtgagtttaccttggggcgatcccagccaaataacacgcaatttcgtttcgcaccttaatcagaggcaccagtttgattatggcgagttcgtcaatttacagttagatgaggagacccaatatcagaccgccgtggaggagagttttcaggttaacatatag

SEQ ID NO: 33135 - DNA, 693 bp, Artificial Sequence
  Description of Artificial Sequence: Synthetic coding sequence
atggggcagcagatcagtgatcagacccagctggtgatcaacaagcttcccgaaaaggttgcaaagcacgtgaccctggtcagggagagcgggagtctcacctacgaggaatttttggggcgcgtggcggaacttaatgacgttacagccaaagtggcctccgggcaggaaaagcatctgctgttcgaagttcagccaggatccgattctagtgctttctggaaggtggtggtccgcgtagtgtgtacaaagataaacaagagcagcgggatcgtggaagccagcaggattatgaacctgtatcagttcattcagctgtacaaagacatcactagtcaggcggcaggcgtgctggcccagagctccacgagtgaggaacccgatgagaactccagttctgttaccagttgtcaggctagcctctggatgggacgcgttaagcagcttactgatgaggaggagtgttgcatttgcatggatggaagggcggacctgattctcccatgcgcgcatagcttctgtcagaagtgcatagataaatggtctgacagacaccgcaattgtcccatatgtcgccttcagatgacaggtgccaacgagagctgggtggtgagcgacgcccctacggaggacgacatggcgaattacattctgaatatggcagacgaggctgggcaaccccatcggccatag

SEQ ID NO: 33136 - DNA, 543 bp, Artificial Sequence
  Description of Artificial Sequence: Synthetic coding sequence
atgggacaacaaatatccgaccagacccagctagtcattaacaagcttcctgagaaagtggcaaagcacgtgacattggtgcgggagtcagggtctctcacgtatgaggaatttctcggacgggttgccgaactgaacgatgtcaccgccaaagtggcatctgggcaggagaagcatctcctcttcgaggtgcagccaggttctgatagtagcgcattctggaaagtcgtcgtcagagtagtgtgtacaaaaattaataaatccagcgggattgtagaagctagtagaattatgaacttgtatcagttcattcaactttacaaagacatcacctctcaggctgctggcgtgctggctcagagttccacctccgaggagcccgacgagaacagttccagcgttacctcttgccaggcaagcttgtggatggggagagttaagcaacttaccgacgaggaagaatgctgtatctgtatggatgggcgagccgacctgatcctgccatgcgctcacagtttctgtcagaagtgcattgacaagtag

SEQ ID NO: 33137 - DNA, 2040 bp, Artificial Sequence
  Description of Artificial Sequence: Synthetic coding sequence
atgggggccctcactagccggcagcacgcgggggtggaggaagtggatatcccaagtaattctgtttacagatatccgccgaaaagcgggtcatattttgctagtcatttcatcatggggggggaaaagttcgacagcactcatcccgagggctacctctttggcgaaaattccgatctgaatttcctgggtaacaggccagtggtgtttccttatgccgccccgccgccgcaggaacccgtcaaaactttgcgcagtctagtgaacatcaggaaggacacactgagactggtcaagtgcgcagaggaagtcaaatcaccaggtgaagaggcatcaaaggcaaaagtacactataacgtagaatttacgtttgatactgacgcaagggttgctataacaatctattaccaggctacggaggaattccagaatggcattgccagctatattcctaaggacaactctctgcaatctgaaaccgtccagtacaagcgaggcgtttgtcagcagttctgccttccctcccataccgtagaccccagcgagtgggcagaggaggaattgggctttgaccttgacagggaggtttaccctttggtggtgcacgccgtcgtggacgagggagatgaatattttggccattgccacgttctactcgggacctttgagaaacatactgacggaaccttttgcgtgaaaccacttaagcaaaagcaggtcgtcgacggggtctcctacttgctccaggagatctacggtatcgaaaataaatataatacgcaggacagcaaagtggcagaagatgaggtgagcgataattccgcggaatgtgtggtctgtctgtccgatgtcagagacactctcatcctcccttgccgtcacctgtgcctgtgtaatacttgtgcagacaccctccggtaccaagctaacaactgtccaatttgccgcctccccttccgagccttgttgcagatccgagccatgcggaagaaactgggtccactcagtcccacttcctttaaccctataattagtagtcagacaagtgattccgaggagcacccatcgtccgagaacatccctcctggctatgaggtggtctccctgctcgaggctcttaatggccccctcacacctagtccagccgtgccccctctgcacgtgttgggagatggccacttaagtggcatgttgccctcctacggcagcgatggccatttgccaccagtgcgtacgatctcacccttagacaggctatcagattcaagtagtcaggggctgaagttgaagaagtccttgagcaagtctacaagtcagaactccagtgtgctgcatgaagaagaggacgagcactcatgcagtgagtcagaaacccaactgtctcagagaccctctgtgcagcacctaggtgaggagtgcggagtgacgccagagtctgagaatctaaccctgagttcaagtggagctatcgatcagagctcatgcacaggaacacctcttagctctacaatcagctctcccgaggggccagcaagttcgtccctcgctcagtccgtgatgtctatggcgtccagccaaatttctacagataccgtgtctagcatgtcagggtcctatatcgcccccggaaccgaggaggagggcgaggcactttcatctccccagcccgcttccagagcccccagcgaggaaggggaaggtctgccagctgaaagcccggattcaaacttcgcaggactccctgctggagagcaggatgcagaaggcaacgacgtgatcgaagaggaagatggctctcctacacaggaaggacagcggacatgcgcattcctggggatggagtgcgataacaacaatgattttgatatcgctagcgtcaaagccctggataacaagctgtgtagcgaggtgtgcttacctggggcatggcaagcagacgacaacgctgtttccaggaatgctcagcggcggcggttgtcctcatcaagtcttgaggattccgaaactcggccttgcgtgtggggtccgctggcagtttag

SEQ ID NO: 33138 - DNA, 1143 bp, Artificial Sequence
  Description of Artificial Sequence: Synthetic coding sequence
atgggtggtgagaaattcgatagcactcatcctgagggctacttgtttggagagaacagcgatttaaacttcctagggaaccggcctgtcgttttcccctacgccgctccacccccacaggagccagtgaaaacattaaggtctctcgtcaacatacggaaggatacactccggcttgttaagtgcgctgaagaagttaaatccccaggggaggaggcctctaaagcgaaggtgcactacaacgtggaattcacgtttgacactgatgcccgcgtagcaattaccatttactaccaggctaccgaagaattccagaacggcatcgcgtcatatattcccaaagataactccttacaatctgaaacagtgcagtacaagcgtggagtctgccagcagttctgtttgcctagtcacacagtcgatcctagcgagtgggctgaggaggagcttggcttcgacctcgaccgtgaggtataccctctggtggtgcatgccgtggtggacgaaggggacgagtatttcggacactgccacgtcctgcttggtactttcgaaaaacacaccgacgggacattttgtgtcaagccactgaaacagaagcaagttgttgacggagtaagttatttactgcaggaaatctatgggattgaaaacaagtataatacccaggattccaaggtcgcagaagatgaagtgtccgataattccgccgagtgtgttgtctgtctgagcgacgtgagagacacactgattttgccttgtcgccacttgtgtctgtgtaacacttgtgctgataccctgcgataccaggccaataattgtccaatctgtcgactgccattccgcgcgcttctgcagatacgggctatgaggaaaaagctgggacctctgtcaccgacatccttcaaccccatcataagtagtcagacatccgacagtgaggaacacccatcatctgagaatatacctcccgggtatgaggtggtctccctcctcgaggcactgaacggccccctcacgcccccatcacttctgaagatccagaagatctcttgggcttggttgcaggctcctgttgtaccagctacttgggaggccgaggctggggagtggcccgagccagggcgccggtccctccagtag

SEQ ID NO: 33139 - DNA, 1974 bp, Artificial Sequence
  Description of Artificial Sequence: Synthetic coding sequence
atgggggccctcacaagcagacagcacgccggagtggaagaggtggacatacccagcaacagcgtataccgctatcctcctaagtccggttcctacttcgcttctcattttatcatgggcggtgagaaatttgattccacccaccccgagggctacctgttcggcgaaaacagcgacttaaactttctcgggaatcgacctgtggtatttccatacgctgccccacctcctcaggaacccgtgaagaccctgaggagtctggtcaatattcggaaggatacactcagactcgtaaagtgtgcagaggaagtgaaatctccaggcgaggaagccagtaaagccaaggttcattacaatgtagagtttacgtttgacaccgacgcccgtgtggcaatcaccatttattaccaagcaacagaagaatttcagaacggcatcgcctcttatatacctaaagataattctttgcagagcgagactgtccagtacaaacgaggagtgtgccaacagttttgcctaccctcccatacggtggaccccagcgaatgggccgaggaggaattgggattcgaccttgacagggaagtgtatccactggtagtgcacgctgtggtggacgagggagacgaatattttggtcattgccacgtcctcctgggtacctttgaaaaacacaccgacggcacattttgcgtaaagcctctgaagcagaagcaggtggttgatggcgtgagttaccttctccaggagatctacgggattgagaataaatacaacacccaagacagtaaggtcgctgaggatgaagtaagcgataattctgccgaatgcgtggtttgtctgtccgacgttagggatacactgatcttgccctgtcggcacctgtgcttgtgcaacacatgcgcagacactctgagataccaggcaaacaattgccccatctgtcggctgccattccgggcactcctacagattcgggccatgcgcaagaaattagggccgttgtcacctacctcctttaaccccataatctcatctcagacctcagatagcgaagagcacccatcaagcgaaaacatcccacccggatacgaggtcgtcagtcttcttgaggctctgaacggcccactgacaccctctcctgccgttcctccccttcacgtcctcggcgatggacacctctctggcatgcttccatcatatggtagcgatggccaccttccccctgttcgtaccataagccctcttgaccgtttgagtgatagctcgtctcaaggactgaagctcaagaaaagcctcagcaagtccactagtcagaatagctcagtgctgcacgaagaagaggatgagcactcatgcagcgagagcgagactcagctgtctcagcgcccaagtgttcagcacctcggtgaggaatgcggagtgacgccagagtcagaaaacctgacactcagttcctcgggggctattgaccaatcctcgtgtaccgggaccccactctcaagcactattagtagtcctgagggtccggcgagctcatcgctggcccagtccgtgatgtccatggcgagtagtcaaatctccaccgatacagttagcagcatgagtggatcctacatagcccccggaacagaggaggagggcgaagccctcagctctcctcaaccagcaagccgcgcaccctctgaggagggcgagggcaatgacgtgatcgaggaggaagatgggtctcccactcaggaaggacagcggacatgcgcgtttctgggtatggagtgtgataacaacaacgattttgatatcgctagcgtcaaggccctcgacaacaagctctgctctgaagtatgtctgcccggtgcctggcaagccgatgacaatgcagtaagtcgcaatgcacagcggcggagactgtcgtccagctcactcgaggactctgagacacgaccttgcgtttggggtcctttggcagtgtag

SEQ ID NO: 33140 - DNA, 1041 bp, Artificial Sequence
  Description of Artificial Sequence: Synthetic coding sequence
atggttctcgtgcatgtcggctatctagttttgcccgtcttcggttctgtgcggaatcgcggtgccccgttccagaggtcccagcatccacacgccactagctgtagacattttcatttggggcctccccaaccccagcaactcgcccccgactttcctctggcacaccctgtgcagtcgcagcccgggctgtccgctcacatggccccagcccatcagcacagcggtgcacttcatcagtcccttactcccttgcctacactacagttccaagacgttactggtcctagctttctgcctcaggcacttcaccagcagtacctgctgcaacagcaattgttggaggctcagcaccgacgcctcgtgtctcatccccgccgttctcaggagagagtgtcggtgcatccccaccgtcttcatcctagctttgatttcgggcagttacagactccacagccccggtatctagccgagggtactgactgggatctatcagtcgacgcagggctgtctccagcccagttccaggtcaggcctatcccacagcactaccagcactatctcgccacaccaaggatgcaccacttccctcgcaactctagctccacccaaatggtggtgcacgagatccggaattatccttatccgcagctgcatttcctggctttgcaaggcctgaatcccagtcggcacactagtgccgtccgcgaaagctacgaggaacttctgcaactggaagaccgattgggtaatgtcacccgcggtgcagttcagaatactatcgaaagatttacattccctcataagtataaaaagaggcgaccccaggacggcaaagggaaaaaggacgaaggcgaggaaagcgatactgatgagaaatgcacaatctgtctgagtatgctggaagacggggaagacgtgcggcggttaccttgtatgcacctgttccatcagctctgtgtcgaccagtggctggccatgtcaaagaaatgtcccatctgccgcgtcgacattgaaactcagctaggggccgactcctag

SEQ ID NO: 33141 - DNA, 465 bp, Artificial Sequence
  Description of Artificial Sequence: Synthetic coding sequence
atgcaccatttcccccgaaactcgagcagcacacagatggtggtgcacgagatacgcaattatccctatccgcagctgcattttctggctctccagggtctcaatcctagtaggcacacctctgctgtacgagaatcttacgaggagctgctgcaactcgaagatagattgggtaacgtgacgcggggtgccgtgcagaacaccatcgaacgctttacgttcccgcataaatacaagaaacgacggcctcaggatggcaagggaaaaaaggatgaaggcgaagagtctgacaccgatgagaagtgtacaatttgcctgtctatgctcgaagatggagaggacgtgcggagacttccctgcatgcacctattccaccagctctgtgtggaccaatggctggccatgtctaagaaatgtccgatctgccgcgtcgatatcgagactcagctgggcgccgactcatag

SEQ ID NO: 33142 - DNA, 87 bp, Artificial Sequence
  Description of Artificial Sequence: Synthetic coding sequence
atggttctggtgcacgtcggctacctggtgttgccagtgtttggcagtgtccgcaacagaggtatatccgtgtggatgttggcttag

SEQ ID NO: 33143 - DNA, 714 bp, Artificial Sequence
  Description of Artificial Sequence: Synthetic coding sequence
atggcaatgttccggagcttggtggccagtgcccaacaacgccagcctcctgccggaccggcaggcggggactccgggttagaagcacaatacacctgtcctatatgcctggaagtataccaccgccccgtcgcgatcggcagctgcggacatacattctgcggcgaatgtctccagccttgtctgcaggtgccaagcccactttgccccctgtgtaggctcccatttgaccctaagaaggttgacaaggcgacacatgtggaaaagcagctgtcatcttataaggcgccatgtcgcggctgtaataagaaagtcacgctcgccaaaatgagggtgcacatctctagttgcctgaaggttcaggaacagatggcgaactgtcctaagttcgtcccggttgtccccacctcccagcccattccaagcaacataccaaaccggtcaaccttcgcgtgcccctactgcggagccagaaacttggatcaacaggagctagtgaagcactgcgtggagtcccatcgctctgatcccaaccgggtggtgtgtcccatttgcagcgcaatgccatggggggacccgtcctacaagtctgctaatttccttcaacacctgctgcaccggcacaagttctcctacgatacatttgttgattactccattgatgaagaggccgccttccaggcggcgcttgctcttagcttgtctgaaaattag

SEQ ID NO: 33144 - DNA, 471 bp, Artificial Sequence
  Description of Artificial Sequence: Synthetic coding sequence
atggctatgtttaggtccctggtagcgtccgcgcagcagaggcaaccaccagctggaccagccgggggagactctgggctggaggcccagtacacatgtcctatctgccttgaggtgcaggaacaaatggcaaactgccccaagttcgtgcctgtggtgccaaccagtcagcctatcccctccaacattcccaaccgctcaacattcgcatgtccatattgcggcgcaaggaatctggaccaacaggagctcgtgaaacactgcgtcgagtcccatcgctctgatccgaatcgcgttgtgtgccctatctgctcagccatgccgtggggtgacccgtcctataagagcgccaacttcctccagcatctcctccatcggcataaattttcctacgatactttcgtcgattattctattgatgaggaagcagcttttcaggcagctttggctctgtcactgagtgaaaactag

SEQ ID NO: 33145 - DNA, 387 bp, Artificial Sequence
  Description of Artificial Sequence: Synthetic coding sequence
atgcgcgtacatatatcctcttgcctgaaggtccaggagcagatggcaaactgtcctaaattcgtgcccgtcgtgcctacctcccagccaatcccttccaatattcctaacaggtccacctttgcctgcccctactgtggcgctcggaacctggatcaacaagaactcgtgaagcactgcgtggagtcccaccgatctgacccaaaccgcgtggtctgtcctatctgctctgccatgccttggggggatccgagctacaagagcgctaattttttacagcacttacttcacagacacaagttttcttacgatacattcgtggattatagtatcgatgaggaggctgcgttccaggctgctctggccctttcgctctctgagaattag

SEQ ID NO: 33146 - DNA, 471 bp, Artificial Sequence
  Description of Artificial Sequence: Synthetic coding sequence
atggccatgttcaggtctctggtcgcttccgcccagcagcgccagcctcctgctgggccagccggcggagattctggactggaagcccagtatacctgtcctatctgcctagaagtacaggaacaaatggctaactgcccaaaatttgtgccagttgtgccgacttcccagcctatacccagtaacatacctaacagaagtaccttcgcttgtccttactgcggggcccggaacctggatcagcaggagctggtaaagcactgcgtagagtcacaccgtagcgatccaaatagggtggtgtgtcctatttgcagtgccatgccctggggagatccgtcctataagagtgccaacttcctccagcacctgcttcatagacacaaattcagttatgatacttttgtggattattcgatcgacgaggaggccgcatttcaggctgcactggccttatctttgtcagagaattag

SEQ ID NO: 33147 - DNA, 2127 bp, Artificial Sequence
  Description of Artificial Sequence: Synthetic coding sequence
atggcagcagctggccccagcactagggcttcatccgccgccgctgcagctgcactcagccgtagaggacgccgtggcaggtgcgatgagacagcggcggctaaaactggagcccctggacctgcgagtggcccctcactgctcgtgttgagtccaccactgttgcagccaccactgccacccagacccgaagagtctggttgcgccggctgtctagagccccctggggaagccgctgctctcccttgcggacactcactgtgccggggctgcgctcaacgtgcggccgatgccgctggaccagggtgcccaagatgcagggccagaggcccagggtgggctcgaaggcgcgccagggacgacggccaggccgattcagaagtcctcggtgaatgcgctaggcgctctcaaccagaacgttgtcggcctcggcgagacggaggggctgcagccgccggcccccgccccgagcaagaaccaagggccgcacctgctgagccagatttcatctttagggctcccatcaagctttcaaagcccggcgaattgagagaagagtacgagtctctcaggaagttgcgtgaagagaagctgcaggaagagaagccaagtgaagatcaaatccacaaactgctgccggaagacacagagacaggcaagagaaagatggacgagcagaagaaacgcgacgaaccccttgtgcttaaaaccaacctcgagcggtgtccagcaaggctgagcgattccgaaaacgaagagccatcacgtgggcagatgactcaaacacatcgaagcgcattcgtgtcgaaaaacaattcatactccctcgcatttctcgctgggaaattgaactccaaggtcgagcgatcgcagtcttgctcagacacggcccaagaacgggccaagagccgggtgagggctgtccctgggaacaaagccaaagtgacaaccatgacccccgcctccaatccaatcataggtgtgctcctctctacccagaataaccggtgtgtgtctgctcccgaccttactatagaaaaaagactcccctttagtagcctgagctccctagcaagcctccataaaccagagaggtccgtgagtcctgagtctaacgacagcatctcagaggagcttaaccatttcaagcccatcgtctgcagcccttgtacacctcccaagagacttcccgatggtcgcgtcctgtccccccttataatcaaaagcactcctcgaaaccttaacagaagcctccagaagcagaccagctacgaggcgtcgccaagaatactaaagaaatgggagcagatcttccaggagcgtcaaatcaagaagactctatcaaaagccaccctaacaagtctggccccagagatgggcgaagagctgctgggtagtgaagggatccactcttccaaagaaaagcccctggtagctgtcaataccagactcagcggcggccaggttctctcagagtataccgggcccacatcagccgacctggaccacttcccgagcgtttcccagacaaaagctgagcaggacagcgacaacaagagcagcactgaaattcctctggaaacctgttgctctagtgagcttaaaggaggcggatctggaaccagccttgagagagaacagtttgaaggactgggtagtacgccagatgctaaactggataaaacgtgcatctcacgagccatgaagataacgaccgtgaacagcgtgttacctcagaactccgttctgggtggggtactcaaaacgaaacagcagctcaagactctgaaccactttgatctcacaaacggagtgctagtcgagtcactcagcgaagagcccctcccatccctgcgtaggggaaggaaacgccattgcaagacgaagcatctggagcaaaatgggagcttgaaaaagctgcgccagacgtccggcgaggtcggattagcacccaccgaccccgtgctgcgcgagatggagcagaagctacaacaggaggaggaggacagacaactggccctgcagctgcagcgaatgtttgataacgagagacggacggtatctcgacgcaagggctctgttgaccagtatctactccggtcaagcaacatggccggagccaagtag

SEQ ID NO: 33148 - DNA, 240 bp, Artificial Sequence
  Description of Artificial Sequence: Synthetic coding sequence
taactggagcagaacggctccctcaagaagctgcgccagacatccggtgaggtcggtttagcccccactgaccccgttcttagggaaatggaacaaaagctccagcaagaggaagaggacaggcagctcgccctgcaacttcaacggatgttcgacaatgagagacggaccgtctcccgcagaaaagggagtgtggatcagtacttgctgcgcagctcgaacatggccggggcgaaatag

SEQ ID NO: 33149 - DNA, 579 bp, Artificial Sequence
  Description of Artificial Sequence: Synthetic coding sequence
atggctgagcagcagggcagagagttggaggcagagtgtcccgtctgttggaacccatttaataacaccttccatacacctaaaatgctggattgttgccatagtttctgtgtcgagtgtcttgcccacctgtctctggtgacacccgcgcgccgacgactcctttgccctctctgtagacagcctacagttttggcctccggccagccggtgaccgacctgccaacagacaccgccatgctggccttgctgcgcctggaacctcatcacgtgatcctggagggccaccagctctgcttaaaggaccagcccaagagtagatacttcctgagacagccccaagtatacaccttagacttgggcccgcagcctggtggccagacaggaccaccaccagatactgccagtgccaccgtcagcaccccaattctgataccatctcaccacagcctccgggagtgtttccgtaacccccagtttagaatctttgcttatctaatggccgtgattctgagcgtgactcttctactcatcttcagtattttttggacgaagcagtttctttggggcgtggggtag

SEQ ID NO: 33150 - DNA, 579 bp, Artificial Sequence
  Description of Artificial Sequence: Synthetic coding sequence
atggctgagcagcagggccgcgaactcgaggccgagtgtccggtttgttggaatcccttcaacaacaccttccatacaccgaaaatgctggactgttgccactccttttgcgtcgaatgtttggcgcatctctcccttgtgaccccagcccggcggaggttgctgtgccccttgtgtcggcagcccactgtgctggccagcggccagcccgtcacagacctgcctacagacacagccatgctggctctccttcgtctcgagcctcaccacgtgattctagaggggcatcagctgtgccttaaagatcagcccaaatctagatacttcttaaggcagcctcaggtgtatacactggacctgggccctcagcctggcggacagacggggccccctccagatacagcttcagcgaccgttagtactccaattctcattccttctcaccacagtcttcgggagtgttttcgaaacccgcagttcagaattttcgcctatctcatggctgtcattctctccgttactctgctgctaattttctctattttttggaccaagcagttcctgtggggggtgggttag

SEQ ID NO: 33151 - DNA, 579 bp, Artificial Sequence
  Description of Artificial Sequence: Synthetic coding sequence
atggccgaacagcaagggagagagttagaagcagaatgcccggtgtgctggaatcctttcaacaacacgtttcacacaccgaagatgctcgattgctgccacagcttttgcgtcgaatgcctggcgcatctgtccctggtgacacccgcacgccggcgactcctgtgcccgctgtgcaggcagcccactgttctggccagcgggcaacccgttacagatctccctacagatacagccatgttagcactcctacgtctcgagccacaccatgttatcctggagggccatcagttatgcctcaaagaccagcccaaatcacggtactttctccggcagcctcaagtctacaccctggacttgggaccccaacccggcggccagactggaccgcctcccgacacagcttccgccacggtcagcactcccatattaattccttcacaccacagcttaagggagtgcttccggaacccacagttccgcatcttcgcttacctaatggccgtgattttgagtgtgacactgcttttaatcttctctatcttctggaccaaacagtttctgtggggcgtggggtag

SEQ ID NO: 33152 - DNA, 579 bp, Artificial Sequence
  Description of Artificial Sequence: Synthetic coding sequence
atggcagagcaacaaggtcgggagttagaggcggaatgcccagtctgttggaaccctttcaataacacgtttcatactcccaagatgctcgattgttgccatagcttttgtgtcgagtgcttggcccatctctccctcgtgacacccgctcgccggcggttgctgtgccccctgtgtcggcagcccacagtactcgcgtctggccaacctgtaactgacctgccaaccgacacagcaatgcttgcactgctgagactggaaccacatcacgttattttggaggggcaccagctctgcctgaaggatcagcccaagtcccgatactttcttcgccagccgcaggtgtataccctcgaccttgggccacagccagggggccagacgggtcctccgcccgacaccgcctccgccaccgttagcactcctattctcattccttcacatcacagcctgagagagtgcttcaggaatcctcagttccggattttcgcctacctgatggccgtgatcctgagtgtcaccttactgctaatattttctatcttctggactaaacagtttctatggggcgttggatag

SEQ ID NO: 33153 - DNA, 1905 bp, Artificial Sequence
  Description of Artificial Sequence: Synthetic coding sequence
atgagcggagcgattttcggtccgttagaaggcccctcatctctcgatgctccctccattcatcctcttgtgtgtcccctctgccacgtgcagtacgaacggccgtgtctcctggattgcttccatgatttctgtgccggatgcctaaggggtcgggctactgacggacgcctcacctgtcctctctgtcagcatcagactgtactgaaaggaccatctggcctgccacccgtggatcggttactgcagttcctcgtcgattccagcggcgatggcgtcgaagcggtcagatgcgccaactgcgatttggagtgctctgagcaggatgtggaaaccacatatttttgtaacacctgtgggcagcctctgtgcgctcgctgtcgagatgaaacccaccgcgctcgtatgtttgcacgccacgatatcgtggccctgggtcagcggtctcgggacgtgcctcaaaagtgcactttacatgctgaaccctatttactgttcagcactgataagaaactgttactgtgcatcagatgtttcagagacatgcagaaggaaagtcgcgcgcattgtgtcgatctggaatccgcgtatgtgcaaggttgcgagaggttggaacaagctgtcctggcagtcaaggccctgcagaccgctacaagagaagccatcgctctccttcaagctatggtggaggaggtcagacactccgccgctgaggaggaagacgctatacacgccttgttcggctctatgcaagacaggctcgccgaaaggaaagcgcttctgcttcaggcagtgcagtcgcagtatgaggaaaaagacaaggcctttaaggagcagctgagccacttggccacattactccctacacttcaggtccacttggtgatttgttctagcttcctctcattggccaataaagcagagtttctagacctaggttacgaactcatggagaggctgcaaggtatcgtgaccagaccccatcaccttaggccaatccagtccagcaaaattgcctcagaccacagagcggagtttgcaagatgcttagagcctctgctcttgcttggaccgagacgggtagcggctgccgccagcggcgccaatacgctggctggcggcttaggacctaaggcccttacaggtcctcactgcccttctccggtcggtaagatgagcggaagcccggttcagaagcccacactgcacagatcgatttctacaaaagttttgctggcagagggggaaaacacaccctttgcagagcactgccggcactacgaagattcttaccggcacctgcaggccgagatgcagagtttgaaagatcaagtccaggagttacatagagatttaacaaagcatcactcacttataaaagccgaaatcatgggagacgtcctccacaagagcctgcagctggacgtacagattgcgagtgaacacgcgagcctcgagggcatgcgggttgtttttcaggaaatatgggaggaagcctaccagcgagttgccaacgaacaggaaatttacgaggcccagcttcatgacctgctccaactccggcaggagaatgcatacctgaccacaatcacgaagcagattactccctacgtgagatcaatcgcaaaggtgaaggagcgtctggagccaaggtttcaggccccggtggatgagcagagtgagtcgcttcagaacacccacgatgatagcagaaataatgcagcaagcgcaaggaataaccccggaagtgttcctgaaaaacgagagaaaaccagcgaacccaaaggtaattcgtgggctccgaacggactgtccgaggaacccctcctgaagaatatggaccaccaccgctcaaagcagaagaacggcggggacgtgccaacctggagagagcatccaacatag

SEQ ID NO: 33154 - DNA, 435 bp, Artificial Sequence
  Description of Artificial Sequence: Synthetic coding sequence
atggtagaagaggtacgccactcagcggctgaggaggaggatgccattcatgctctgttcggcagcatgcaggatagactggcagaacggaaggctcttctgctgcaggcggtgcagtcccaatacgaagagaaggataaggcatttaaagagcagctaagtcacctcgctacactgcttccgacactacaggtccaccttgtcatctgtagcagtttcttgagcctagctaacaaggctgaattcctggatctcggctacgccgggcggggactgcgcccccagggtgctgatggcgcccccctgccgctcccaagcagaaaggacgtgggggtgacaagacccaaagctcatgcggcacctgtgcatcagcaccagggcgccgctggtgggggccgcgagcatgcgcttcggcgggcactgcctcctctttag

SEQ ID NO: 33155 - DNA, 786 bp, Artificial Sequence
  Description of Artificial Sequence: Synthetic coding sequence
atgccatcagaccctggtcctgaggcaggcagtggctggccaggactcttgatgtcctgtctgaaagggcctcatgttatcttaaaaatggaggccatgaagatcgtccaccctgagaagtttccagagctgccagctgccccctgcttcccacctgccccacggcctactccgaccctagcccccaagcgggcctggccgagtgataccgagatcatcgttaaccaggcctgtgggggagatatgccggctctggagggggcgccacatacaccaccgcttcctcgccgacctaggaagggcagcagcgagctgggcttccctcgggttgctcccgaggacgaggtcatcgtgaaccaatacgtgattcggcctggaccctccgcatccgctgcctcttcagccgctgctggggagcccctggagtgtccaacatgcggccactcttacaatgtcactcaaagaaggcccagagtgttatcatgcctccacagtgtctgcgaacaatgccttcagattctctatgagtcatgcccaaaatataagtttatatcttgtccaacttgtcgaagagaaaccgttctttttactgactatggattggcggcacttgccgtgaacaccagcattctgtccagactgccacccgaggctttgacagcacccagcggtggtcaatggggcgcggaacctgaggggagctgctatcagaccttcaggcagtattgcggagctgcgtgcacttgtcacgtgagaaatcccctgagcgcgtgttcgatcatgtag

SEQ ID NO: 33156 - DNA, 786 bp, Artificial Sequence
  Description of Artificial Sequence: Synthetic coding sequence
atgcccagcgatccaggacctgaggcaggttcaggttggccagggctcttgatgagttgcctgaaaggcccacatgtgatattaaagatggaagctatgaaaatcgtgcatccagagaagtttccagagctgccagctgccccctgttttccgcctgccccgaggcctacgcctacattggcgccaaagagagcatggccctcagatactgagattatcgtgaatcaggcatgtggaggagatatgccggccctcgagggcgccccccacactccgccactgccccggcgccccagaaagggctcgagcgaacttggttttcccagggttgccccagaggacgaagtcatagttaatcagtacgtaattagaccggggccgtccgcctccgccgcctcttcagcagcggccggcgagccacttgaatgtccgacctgcggtcactcctataatgtgacccagagaagaccgcgcgtgttgtcctgcctgcactcagtctgtgagcagtgcctgcaaattctgtacgaatcgtgccctaagtataagttcatctcatgcccgacctgccgacgcgagaccgtacttttcactgactacggactcgcggccctggctgtgaacacaagcattctctctaggctgccccctgaggctctgactgccccctcaggaggacagtggggcgcggaacccgaaggttcctgctaccagacgtttcgccagtattgcggcgctgcctgcacatgccacgtgaggaaccctctcagtgcctgctccattatgtag

SEQ ID NO: 33157 - DNA, 2112 bp, Artificial Sequence
  Description of Artificial Sequence: Synthetic coding sequence
atggcggccagtgaggtggccggcgtggtggcaaacgctccgagccctccggagtcctcatccttatgcgctagcaagtcagatgagggcctgccagatggcctgagcactaaggactcggcccagaaacagaagaactctcctctcctcagcgtgtcctcccagacaataaccaaggagaataatcgcaacgttcacctggaacatagtgagcagaatcccggatccagcgcaggagatacatcggccgcccaccaggttgtactcggtgaaaatctgatcgccaccgccttgtgcctctcaggcagcgggagtcaatctgatctgaaggatgtggcaagcaccgctggagaagaaggagacacgagtctgcgcgagagcctgcatccagtaacacgtagcttgaaggcaggctgtcacaccaaacagctggcttcccgaaactgctccgaggaaaagagcccccagacttctatcctaaaggagggcaaccgggatacctccctcgacttcaggccagtggtctctcctgctaacggcgtggaaggggtaagggtcgatcaggacgacgaccaggattcctcaagcctcaagcttagtcagaacatcgctgtgcagacggattttaagactgccgatagcgaagtcaataccgatcaggacatcgaaaaaaacctcgacaaaatgatgaccgagagaaccctccttaaggagcgttaccaggaggtgcttgacaaacagcggcaggttgaaaatcaactccaggtgcagctgaaacagctgcaacagcgcagagaggaagagatgaaaaaccatcaggagattctcaaagcaattcaggacgtcaccattaaacgggaagagaccaagaaaaaaattgagaaggaaaaaaaggagtttcttcagaaggagcaggacctcaaagccgagattgaaaagctgtgtgaaaaagggagacgagaagtctgggagatggagctggaccgtcttaagaaccaggacggtgaaattaatagaaacattatggaggaaactgagagagcctggaaggccgagatacttagtctggaaagccgcaaggagctcctcgtgctcaagctggaggaagctgaaaaggaagctgagttacatctgacgtacctgaagtccaccccaccaaccctggaaaccgtgagatctaagcaggagtgggaaacccgcctcaatggcgtgaggatcatgaagaaaaacgtgagagaccagttcaacagccatatacagctggtgcgcaatggtgccaagctcagcagccttcctcagattcccacacccacactaccaccccctccgtctgagacagattttatgttgcaggtcttccagccttcccccagcctcgcccctagaatgccgttctcgattggtcaggttactatgccaatggtgatgcctagcgctgaccctcgaagtctgtcattccctattctgaacccagctttaagccagccttcacagccctccagccctctgccagggagccacggcaggaacagcccgggtttaggctcattggtaagtcctcacggcccgcatatgccgccagcagcgagcatcccaccaccaccaggactgggcggggtcaaagcctccgctgagacccccaggccacagcctgttgataaactggagaagatcttggaaaagttgctcactagattcccgcaatgtaacaaggcccagatgacaaatatactccaacagatcaagaccgctcgaaccaccatggcaggactgaccatggaggagctgatccagctcgtcgccgcaagactcgccgagcacgaacgggtggcggcttcaacacagccactagggagaatccgtgctctgttccccgcccccctggcccaaatctccacgccaatgtttcttcctagcgcccaggtgtcctatcctggcaggtcttcccatgcccccgccacctgcaaactatgcttgatgtgtcagaagttagtccagccaagtgagctgcacccaatggcttgtacacatgtcttgcataaggagtgtattaagttctgggcccaaactaacaccaacgatacttgtccgttctgtcctacccttaaatag

SEQ ID NO: 33158 - DNA, 2112 bp, Artificial Sequence
  Description of Artificial Sequence: Synthetic coding sequence
atggctgcgtcagaggtagccggggtggtggccaacgcgccgagccctcccgagagtagcagcctatgtgcctccaagtctgacgagggtctgcccgatgggctgtccactaaggactccgctcagaaacagaaaaactcacctctcctgagcgtgtctagccaaacgatcaccaaggagaacaacagaaatgtgcatcttgagcatagcgagcaaaatccaggctcttctgccggggacacttccgctgcgcaccaggttgttctgggagagaatctgatcgccacagcgttgtgcctttccggcagcggcagccagtccgacctcaaggacgtggcctctactgcgggagaagaaggagatacatctctgagagagtcattgcacccggtgacccgcagtttgaaggccggttgccacacaaaacagctagctagtcggaattgctcagaggaaaaaagcccccaaacaagcatcttaaaagagggaaaccgggacacgtcgcttgacttccgccctgttgtcagccccgccaatggggtggagggtgtgagggtggatcaagatgatgatcaagactcttcaagtctgaagttgagtcagaacattgccgtgcagactgattttaaaacagccgactctgaggtcaatacagaccaagatatagagaaaaacctcgataagatgatgacagagagaaccttgttgaaagagaggtaccaggaggtgttagacaaacagcgtcaggttgagaatcagctccaagtgcagctgaagcagcttcagcagaggagggaggaagaaatgaagaaccaccaggaaatactcaaggcaattcaagacgtgaccatcaaacgagaggagaccaagaaaaagatagagaaggaaaaaaaggaattcctccagaaggaacaggacttgaaggcagaaatagaaaagctgtgcgagaagggccggcgggaggtatgggagatggagctggaccggctgaaaaatcaggacggcgaaatcaatcgaaatatcatggaggagactgaacgtgcttggaaggcagagattctatcccttgaatccagaaaggaattactggtgctgaagctggaggaggcggaaaaggaggccgagctgcacctgacatacctcaaatcaacgccccctactctggaaaccgttagatcaaagcaggaatgggaaacgcgactgaatggagtgcgaatcatgaagaagaatgtgcgggatcagtttaactctcacatccagcttgtgagaaacggagcgaaactctcttctctgccacagatccctacgccaacgttgcccccccccccctccgaaaccgattttatgctccaagtgttccagccgtcaccgtccctggctccaagaatgcccttttcgattggccaggtgaccatgccaatggtgatgccgtccgccgatcctcggtctctcagcttcccgattttaaatccggccctttctcagcctagccaacccagctcgccactgccaggctctcatggcaggaatagcccaggcctaggatccctggtgtctccgcatgggcctcacatgccaccagcggctagcatccctccacccccaggactcggaggggttaaggccagcgccgagacgcctcggccccagcctgtagataagctggagaagattctcgaaaagctcttaaccagattcccacagtgtaataaggctcagatgaccaacatcctgcagcagatcaagactgcccgcacgaccatggcggggctgacaatggaagagctcatccaactcgtcgccgcccgcctggctgagcatgagagagtagccgcaagcactcagcctctcggacgcatacgcgcattatttcctgcaccattggcccaaatctccacaccaatgtttttaccctctgcccaggtgagctacccgggcaggagtagccatgctcccgcaacatgtaaactctgcttaatgtgtcagaagcttgttcagcccagtgagcttcatcccatggcgtgcacgcacgtcttgcataaagaatgcataaaattctgggcacagaccaatacaaacgatacctgtcctttctgtcccacactcaaatag

SEQ ID NO: 33159 - DNA, 441 bp, Artificial Sequence
  Description of Artificial Sequence: Synthetic coding sequence
atggccgcgtcagaagttgcaggggtggtggctaatgccccaagtccacctgagagctcctccctgtgcgcgtcaaaatctgatgaggggttaccggacgggctgagcacgaaggattctgcccagaagcagaagaatagtccgctgcttagcgttagcagtcagaccattactaaggaaaataatcgcaacgtacatttggaacactcggagcaaaacccaggctcctctgccggtgacacttccgcagcacatcaggtggtgttaggggaaaacctgattgccactgccctgtgcctgtcaggatccgggtcccagtccgacctcaaagacgtggccagcacagctggcgaagagggagataccagcctgcgggaatctctccatcctgttacccgatctctgaaggccggttgtcacaccaaacagctcgcttcatag

SEQ ID NO: 33160 - DNA, 2181 bp, Artificial Sequence
  Description of Artificial Sequence: Synthetic coding sequence
atggcacagaccgtacagaatgtcacactcagtctcacgctgcccatcacctgtcacatatgtcttggaaaagtccggcagcctgtgatctgcatcaataatcatgtgttttgctcgatatgcatagatctgtggctgaaaaacaacagtcagtgccctgcatgcagagttccgatcaccccggagaacccatgcaaggagatcatcggtggaaccagtgagagcgaaccaatgctgagccacactgtgagaaagcacctgaggaagacaaggctcgaactgctgcacaaggagtacgaggacgagattgattgtttacagaaagaggtagaggaactgaagagtaagaacctgtccctggaatcccagataaagaccatactggaccctctgacactcgtacagggcaaccagaacgaggacaaacacttagttacagataatcctagtaagattaaccccgaaactgtcgccgagtggaaaaagaaattacgcaccgccaacgagatttatgagaaagtgaaagacgatgtggacaaactgaaggaggctaacaagaagctcaagctcgaaaacggtggcttggtgagagaaaatctccgactgaaggctgaggttgataacaggagtccacaaaagtttggcaggttcgccgtggcagccctccagtctaaggtggagcagtacgagagggagacaaaccgcctgaagaaagccctggagcgatccgataagtatatcgaagaactagaaagtcaggttgcccaactcaagaacagttccgaagagaaggaggcaatgaacagcatttgtcagactgccctgtccgctgacggcaagggctccaagggtagtgaagaagatgtcgtgtcaaagaatcagggcgacagcgcccgaaagcaacccggctccagcacttcttcctcgtcgcatcttgccaagccatcctctagccggctctgcgataccagctccgcccgccaggagtccacgtctaaggccgatctcaattgctcaaaaaacaaagatctgtaccaggagcaagtagaagtgatgcttgacgtcactgacaccagcatggacacatacctcgagcgagaatggggtaacaaaccctccgactgtgtaccgtacaaggacgaggagttatatgacctccctgcaccgtgcacccctcttagcttgtcgtgtctgcagctgtccacccctgaaaatcgcgagtcaagtgtggtgcaggcgggcggcagcaaaaaacatagcaatcacttgcgcaagctggtttttgacgatttctgtgattcatccaatgtttccaacaaagacagttcggaggacgatatttcccggtctgagaatgagaagaaatcggaatgtttctcctccccgaagacaggtttttgggattgttgctccacaagctacgcccagaaccttgattttgaatcatcggaaggaaacacaatcgccaactcagtgggagagatatcaagtaagctgagtgaaaagtccggtctgtgcttgagtaaacgtcttaatagtattcggagctttgagatgaatcggacccggacctccagtgaggcatcaatggacgcggcgtacctggataaaatctctgaattggatagtatgatgagcgagagcgacaatagcaaatcgccgtgtaacaacggcttcaagtctctagacctggacggtttaagtaagagttctcagggatcagaattcctggaagaacctgacaaactagaggaaaagacagagctgaacctgagcaagggttcactcactaatgaccaactggaaaatgggagtgaatggaagcccacatcgttttttctattatctccatctgaccaagaaatgaacgaggactttagtctgcattcatctagttgccccgtgacgaatgagatcaaaccgccaagctgcttatttcagacagaattctcccagggaatattactgtcttcatcccaccggctctttgaggaccagcgatttggtagctcactcttcaaaatgtccagcgaaatgcattcgctgcataaccacctccagagcccatggtccacctccttcgtgccagaaaaacgtaataagaacgtcaatcagtccactaagagaaagatccagtctagtctgtcctccgcttccccttccaaagccacaaagagttag

SEQ ID NO: 33161 - DNA, 663 bp, Artificial Sequence
  Description of Artificial Sequence: Synthetic coding sequence
atgtccgagggcgagtccaaggactccagcggctctgaatgtccagtctgctacgagaaattccgcgatcttgagggcgccagccgaaccctgtcatgtgggcatgtgttttgtcatgactgccttgtgaagtatctgctgtcaaccagggtggacggtcaggtgcagcgaacactggtgtgcccaatttgtaggtatgtgaccttcttgtctaagaagtctagccggtggcccagtatgctggataagagctctcagactttggctgtgccagttgggctcccgtctgtcccccccctggacagccttgggcacaccaaccctctcgcagcgtcctcaccagcttggcggccacccccggggcaggctagacctcccgggtcacccggtcaaagcgcccagctgcccctggatctcctgccatccctgcccagagaatctcaaatctttgttatctcgaggcatggcatgcctctcggtgagcaagactccgtcctccccagacggtcattagcggagctctctgaggcatctctggctccgagatctgcccgcgcattctgctgccggtcaagagcgctgcttctcatcaccctcatagctgtcgtggccgtcgtagccgctatcctaccttgggtactgctagtgaggaagcaagcttag

SEQ ID NO: 33162 - DNA, 663 bp, Artificial Sequence
  Description of Artificial Sequence: Synthetic coding sequence
atgtcggaaggtgagtccaaagactctagcggtagcgaatgtcctgtgtgttatgaaaaattccgggacctagagggcgcctcaaggaccttgtcatgcggtcacgtcttttgtcacgactgtctagtgaagtacctgctaagcacccgtgttgatggccaggtgcagcgcactttggtgtgtccgatatgcagatacgtgacattcctctcgaagaagagttccaggtggcccagcatgcttgataagtccagccagacgctggcagtgcctgttgggctacctagtgtgcctcctctggattccctggggcacactaatcctctggccgcaagtagtcccgcttggagaccccctcccggccaagccaggccccctggaagtcctggtcagagcgcccagctgccactcgatttgctccctagcctgccccgcgagagtcagatcttcgttatcagtcgccatgggatgccacttggcgaacaagattctgtgctcccccggagatctctggcggaattgagtgaagccagcctggccccccgcagcgcacgcgccttctgctgcagaagccgcgcactgctgctgattacgctaatcgcagtcgtggcagtcgtagcagcgattctaccttgggtgctcttagtacggaagcaagcatag

SEQ ID NO: 33163 - DNA, 471 bp, Artificial Sequence
  Description of Artificial Sequence: Synthetic coding sequence
atgcaggacgcggcggccggaggcccccccgggctcggaggcgggggcccacccgaagagcgaaccgactgcattatttgctgtagtgcctatgacctgtccggccatctccccagaaggctatactgcggtcacaccttttgtcaggcttgcgttcggcggttagacacgcccgcccctgaacagcgctggatcccttgtcctcagtgccgtcagtcgacccccacaccacggggcggcgtcgccatgctggacctggatctggctgccttcctggcagtcaaagctgagcgcgagccagcccggctggagcctctcccgctgacaagcctgaagggaagtgccatcacgagacaacctgcaggcctgtgtccggcactcgggcctcagccccatttcccacaacctcggtactgctgttggggctgcgggtctctctgttgtcctcctctgggcagcccggaagtgtag

SEQ ID NO: 33164 - DNA, 954 bp, Artificial Sequence
  Description of Artificial Sequence: Synthetic coding sequence
atgggatatgacgttaccagattccagggcgacgtagacgaggacttgatttgcccaatttgctctggggtgctggaggagcccgtgcaggccccccactgtgagcatgccttttgtaatgcctgtataacacaatggttttcccagcagcagacctgccctgttgatcgctctgtggttacagtcgcacacctaaggcccgttcccagaatcatgagaaatatgctgagcaagctgcagatcgcgtgcgacaatgcggtgtttgggtgttctgcggtggtcaggctcgataatttaatgagccatctgtccgactgcgagcataaccccaagcgtcctgtcacctgcgaacagggctgcggcctcgagatgcctaaggacgaattacctaatcacaattgtatcaagcatctgcggtctgtcgttcagcagcagcaaacaaggatcgcagagttggagaagacatcagcagagcacaaacatcagctcgcggagcagaaacgggatatacagctcctgaaggcctatatgagggcgatccggtctgttaatcctaatctgcaaaacctcgaagagactatcgaatataacgaaatcctcgaatgggttaacagcctgcagcctgctcgggtgacaagatgggggggcatgatatctacgcctgatgctgtgctgcaggctgtaattaagagaagcttggttgaaagcgggtgtcccgcctccattgtgaatgagctaatcgaaaacgctcacgagagaagctggccccagggtttggccaccctggaaacccgccaaatgaataggcggtattatgagaactatgttgccaagcgaattcctggaaagcaggctgtcgttgtaatggcatgcgagaatcagcacatgggcgatgacatggtgcaagagccaggactcgtgatgatttttgctcacggcgtggaggagatatag

SEQ ID NO: 33165 - DNA, 741 bp, Artificial Sequence
  Description of Artificial Sequence: Synthetic coding sequence
atgaggaacatgctgtcaaagctacagattgcatgcgacaacgcagttttcggctgttcagccgtggtacgcctcgacaatctcatgtctcacctgagtgattgtgagcataacccaaaaaggccggttacatgtgaacagggttgcggcttagagatgccgaaggacgaactgcccaaccacaactgtattaaacacctcagatctgtggtgcaacagcagcagacacggattgccgagctggaaaaaacgagcgcagaacataagcatcagttggccgagcagaagcgggacattcagcttcttaaagcatacatgcgcgccatccggtcggtgaatcccaacctgcagaaccttgaggagactattgagtataacgagatccttgaatgggttaacagtctgcagcctgctcgggtcactcggtggggggggatgattagtactcccgacgctgttctacaggccgttatcaagagatccctggttgaatcaggatgccctgctagcatagttaacgagttgatcgaaaacgcgcatgaacggtcgtggccacagggcctggctacactggagacccggcagatgaacagaagatattatgaaaattatgtcgccaagcggatccctggcaaacaggcggttgtggttatggcctgcgaaaaccagcacatgggggacgacatggtgcaagagcccggactggtgatgatctttgcacacggggttgaagagatctag

SEQ ID NO: 33166 - DNA, 915 bp, Artificial Sequence
  Description of Artificial Sequence: Synthetic coding sequence
atggggtacgatgtcacccggttccagggcgatgtagacgaggatctgatctgtcccatatgctcaggcgttctggaggaaccagtgcaggctccacactgcgaacatgccttctgtaatgcatgtatcacacagtggttctcccagcaacagacgtgccccgttccccgcatcatgcgaaacatgctatctaaactccagatagcctgcgacaacgccgtgtttggctgctctgccgtagttcgcctggacaacctgatgtcgcacctgtcagactgtgagcacaatcccaagcgcccagtgacttgcgaacagggctgcggactggaaatgcccaaagatgaacttcctaaccacaactgtataaaacatttgcgcagcgtcgtacagcaacaacagacacgcattgccgaactggagaagacatccgccgagcataagcatcagctggctgagcagaaaagggacattcaattactcaaggcttacatgcgggcaatacggagtgtgaatccgaatctgcaaaacctagaagagactattgagtataatgagatactggagtgggtcaactctcttcagcccgccagggtgaccagatggggcggaatgatatctacaccggacgccgtcttacaggctgtgatcaagcggtctttagtggaaagtggctgtccggcctccatcgtgaacgagctgatagagaatgcccacgaacgcagttggcctcagggcctcgcaactctcgagactaggcaaatgaatagaaggtactatgaaaattatgttgccaagcgaattcccggcaaacaagcagtggtcgtgatggcttgcgaaaaccagcatatgggcgatgacatggtccaggagccaggcctggtcatgatatttgctcacggcgtggaagaaatatag

SEQ ID NO: 33167 - DNA, 573 bp, Artificial Sequence
  Description of Artificial Sequence: Synthetic coding sequence
atgggctacgacgtaaccagattccagggagacgtggacgaggacctgatctgccctatttgtagtggcgtcctggaagaaccagtccaggcaccacattgcgagcacgcattctgtaatgcctgtattacacagtggtttagccagcaacagacatgccccgttgatcgcagcgtggtgaccgtggcccatctgagacctgtgcctagaattatgcggaacatgctctcaaagctccaaatcgcttgtgataatgctgtcttcggatgcagcgccgtggtgcggctcgacaacctgatgagtcacctcagtgattgcgaacacaatccgaagaggcccgtcacctgcgagcagggttgtggcctcgaaatgccaaaggatgagttgccgaatcataactgcataaaacacttgaggagcgtggtgcagcagcaacagactcggatcgccgagctggagaagacaagcgcagaacacaagcaccagctcgcagaacaaaaacgtgatatacagctgctaaaagcctacatgcgtgccatccgtagcgtgaatccgaatttacagaacctgtag

SEQ ID NO: 33168 - DNA, 441 bp, Artificial Sequence
  Description of Artificial Sequence: Synthetic coding sequence
atgaggaatatgctgtcaaaactgcaaatcgcctgtgacaatgctgtgtttggatgctccgccgtggtaaggctagataaccttatgtcacatctaagtgattgtgagcataatccaaagaggccagtaacatgtgagcagggctgcgggctcgagatgccaaaggacgaactaccaaatcacaactgcattaaacatttaaggtcagtggtgcagcagcagcagacccgcatcgcggagctcgaaaaaacaagtgccgagcataagcatcagttagccgaacaaaagagagatattcagctgttaaaggcctacatgagagctatccgaagtgtaaacccgaatcttcagaacttggaggagactattgaatacaatgaaatcctggaatgggtcaactccctccagccggcccgggtgacccgatgggggggcatgtag

SEQ ID NO: 33169 - DNA, 606 bp, Artificial Sequence
  Description of Artificial Sequence: Synthetic coding sequence
atggggtacgatgtgaccaggtttcagggagatgttgacgaagacctgatatgtccgatctgttcgggagtcctagaggaacccgtacaggctcctcattgtgaacatgccttctgcaacgcttgtatcacgcagtggttcagccaacagcagacgtgccccgtggaccgcagcgtggtgacagttgcccatctccggcccgtgccaagaatcatgagaaacatgctgagcaaactccaaattgcctgcgacaacgccgtgttcggctgttccgcagtcgtgcggttggataatctcatgagtcacctgtccgattgtgagcataatcccaagcgtccagttacctgtgagcagggctgtggtctcgagatgccgaaagacgaacttcccaatcataactgcattaaacacctcagatctgtcgtgcagcagcaacagacacgaattgcagaactcgaaaagacctcagccgagcacaagcaccaactcgctgaacagaagcgggacatccagctcctcaaagcatatatgcgggcaatacgttctgtgaatcccaacctccagaacctcgaagagacgattgagtataacgaaatactggaatag

SEQ ID NO: 33170 - DNA, 954 bp, Artificial Sequence
  Description of Artificial Sequence: Synthetic coding sequence
atgggatatgacgtaacccgcttccagggcgacgtcgacgaggatctcatctgtcctatctgctccggagtactagaagaacctgtgcaggctccacattgtgaacatgctttctgcaatgcctgtatcacccaatggttctctcagcagcagacctgccccgtcgaccgctcagtggttaccgttgcgcacctacgaccagtgccacgaattatgagaaacatgctgagcaagttgcagattgcctgcgacaacgccgtatttggctgctcagccgtcgttcgcctcgataatctcatgtcgcatctgtctgactgcgagcataaccctaagaggcccgtgacctgcgagcaaggctgcgggctagagatgcccaaggacgaactgcccaaccataactgtattaagcacttacgttccgtggtccaacagcaacaaacaagaatcgccgaactggagaaaacttctgccgagcacaagcatcagctcgccgagcagaaaagagacatccagcttttgaaagcttatatgcgcgcgattaggtcggtcaaccccaatctccagaatctagaagagacaattgagtataacgaaattctggagtgggtgaacagcctgcagcctgctagagttaccaggtggggtgggatgatttccaccccagacgctgtgctgcaagctgtcatcaagcgttccctggtcgagtccgggtgtcctgccagcattgtcaacgaactgatcgaaaacgcgcacgaacggagctggccccagggtctcgccaccctcgagacgaggcagatgaatcgaagatactatgaaaattatgttgcaaagcgcataccaggcaaacaggctgtggttgttatggcatgcgaaaatcagcatatgggggacgacatggtccaggagccaggcctagtgatgatctttgctcacggagtggaagagatatag

SEQ ID NO: 33171 - DNA, 1299 bp, Artificial Sequence
  Description of Artificial Sequence: Synthetic coding sequence
atgcggccctgggccctggccgtcacacggtggcctccatccgccccagtgggccagagacggtttagcgccgggcccggaagcactccaggacagctttggggaagtccaggcctggaggggccccttgcctcccccccagctcgagatgaacggctcccgtcgcaacagccaccatcaagacctccccacctacccgttgaggaaagaagggcctcagcgcccgccggtggcagcccaaggatgctccaccccgccactcagcagtctcccttcatggtcgacctgcacgagcaagtccatcagggtcctgtacccctctcttatactgtgactaccgtcaccacccagggtttcccattgcctaccgggcagcacatcccaggatgttccgcccagcagcttcccgcttgtagcgtgatgttctctggccagcactaccccctgtgctgccttccaccgccacttattcaggcatgcaccatgcagcagttacctgtgccctaccaagcctatccacatctcatcagcagcgaccactacattctccaccctccgccacccgctcccccccctcagcctacacacatggctccactcggccaatttgtttctctgcagactcaacaccctcgcatgcccctgcagcggctggacaatgatgtggacttacggggagaccagccttctttggggtcatttacctattccacatcagctcccggtccagctctctccccatctgtgccgctgcattatctgccccatgacccattgcaccaggaactgagcttcggggttccctactcccacatgatgcccagaaggttatcaactcagagataccgtctgcaacaaccattgcccccacctcccccccctcctccgcctccaccatactaccccagttttttgccgtactttctgagtatgctcccaatgagcccaactgctatgggccccacaatttccctggacctggatgtggacgacgtggagatggagaactatgaagctctcttgaacctggccgagagacttggagacgcaaagcctcgtggactaacaaaggcagacatagagcagctgccgtcttaccgctttaaccccgattctcatcagagcgagcagacactatgtgttgtctgtttcagtgattttgaagcaaggcagctccttcgcgtcctgccatgcaaccatgagtttcacacaaagtgcgtggacaaatggctgaaagcaaacaggacatgccccatttgtcgggccgacgccagtgaagtgcctcgggaagccgagtag

SEQ ID NO: 33172 - DNA, 1056 bp, Artificial Sequence
  Description of Artificial Sequence: Synthetic coding sequence
atgctacatcctgccacccagcagagtcccttcatggtcgacctgcatgaacaggtacatcagggccctgtgcctttatcgtacaccgtcactaccgttaccacccaagggtttcctcttccgaccggccagcacatccctggctgtagtgcgcaacagctcccagcttgttccgtgatgttcagtggacagcattatcctctgtgttgtctccccccccctcttatacaagcctgcaccatgcaacaactgcccgttccgtaccaggcgtacccccatctgattagttctgaccactacattctgcatcctcctcctcctgctcctccaccgcaacctactcacatggcacctctaggacagtttgtgagtctacaaacccagcaccctaggatgcctctccagagattggataacgacgtcgacttgaggggtgatcagccgagtcttggaagtttcacatacagtaccagcgcacccgggccggctctctctccgagtgtgccgttacattatctacctcatgaccccctgcaccaggaactatccttcggcgtgccatacagccatatgatgcccaggagactttcaacgcaaagatacagactgcagcagccacttcctcccccacccccgccccctcctccacctccctattacccttccttcctcccgtactttttgagcatgctgccaatgtcacccacagctatgggcccgactatctctctagatctggacgttgacgatgtcgagatggagaattacgaggcacttttgaatctcgccgaacgcctaggagacgcgaagcccagagggctgaccaaggccgacatcgaacagttaccgtcttacagattcaaccccgacagccaccaaagtgagcagacattatgcgtggtgtgcttctctgacttcgaagcgcgtcagcttctgagggttctgccttgcaaccacgaattccacaccaaatgcgttgacaagtggctgaaagcaaatcgcacttgtccaatttgccgagcggacgcgtccgaggtaccccgagaggctgaatag

SEQ ID NO: 33173 - DNA, 1707 bp, Artificial Sequence
  Description of Artificial Sequence: Synthetic coding sequence
atggattatcgacggctgcttatgtccagggtggtgccagggcagttcgatgacgctgattcctcagattccgagaaccgtgacctgaaaacagtcaaagaaaaggatgacattctcttcgaagatttacaggacaacgttaatgaaaatggcgagggcgagatcgaagacgaggaggaagaaggttatgatgacgatgacgacgattgggactgggacgaaggggtgggcaaactggcaaaaggctatgtgtggaatggtggcagtaatcctcaggccaatcgacaaacgtcagacagcagctccgcaaagatgagcacccccgcagataaagtattgcgcaaattcgaaaacaagatcaacctggacaagctgaatgtgacggactcagttattaataaggtcaccgagaaatcaagacagaaggaggctgacatgtaccggatcaaggataaggcagatagggccaccgttgaacaggtgctggatcccaggaccagaatgatccttttcaaaatgctgacaagaggaatcataaccgagatcaacgggtgcataagcacaggaaaggaggcgaatgtgtatcacgcctccactgctaacggagagagtcgcgctataaaaatctacaagacatccattctggtcttcaaggatcgcgacaaatatgtcagtggagagttcaggttcagacacgggtattgtaaggggaatcctagaaaaatggtgaaaacctgggccgagaaggaaatgcgcaatcttattagactgaatactgctgagataccgtgtcccgagccaattatgttacgttcccatgtgctggtgatgagcttcatcggcaaagacgatatgcccgcaccacttctaaagaacgtacagctgtctgaaagtaaagcacgcgagctgtatcttcaggtcatccagtacatgcggcggatgtaccaggacgcccggttggtacacgccgatctgtccgagttcaatatgctttaccacggtggtggagtgtacattatcgatgtgtcacaaagcgtggagcacgaccatccgcatgcccttgagttcctacgcaaagattgtgctaatgtgaacgacttttttatgcggcattccgtggccgttatgactgttcgcgagctgttcgagtttgtcacagacccctccataacgcatgagaacatggacgcgtatctgtctaaggcgatggaaatagcttcccaacgcactaaggaagaaagaagttctcaagaccatgtggacgaggaggtctttaagcgcgcatacattccacgtacccttaatgaggtcaagaactacgaaagggatatggacatcatcatgaaacttaaggaggaggacatggcaatgaacgcgcaacaggataacatcctctaccagaccgtgaccggcctgaagaaagatctgtcaggcgtgcagaaagtacctgcgctgttggaaaaccaggtcgaagagcggacctgttctgatagcgaggacatagggtccagcgaatgctccgacacagattcagaagagcaaggcgaccatgccagacccaaaaagcatacaacagacccggacatcgataagaaggaacgcaaaaagatggtaaaggaggcccagcgagaaaagaggaagaataagattcccaaacacgtcaagaaaagaaaagagaagactgcaaagaccaagaagggcaagtag

SEQ ID NO: 33174 - DNA, 1659 bp, Artificial Sequence
  Description of Artificial Sequence: Synthetic coding sequence
atgggcaaggtaaacgtggcaaaacttagatatatgtctcgcgacgactttcgcgtgttgactgcagtagaaatggggatgaaaaaccatgagattgtccccggctcactaatagcctccatcgcttcactgaagcatggtggctgtaacaaggttctccgcgaactagttaagcataagctcattgcttgggaacgcactaagacagtgcaagggtaccgtctgacaaatgccggctacgattacttagcgctcaagactctgagtagccggcaagtagtggaatccgtgggtaaccagatgggggtggggaaggagtctgatatctacatcgtggccaacgaggaaggtcaacagtttgctcttaagcttcaccggctgggccgaacaagctttcgcaatctgaagaacaaacgcgattatcataagcatcgccacaacgtgtcctggttgtacctaagcagactgagcgcaatgaaggagtttgcctacatgaaagccctctatgaaagaaagtttcccgtgcctaaacctattgattataatagacatgctgtggtgatggagctgatcaacgggtacccgctctgccagatccaccacgtggaggatccagcctctgtttatgatgaggccatggaactgattgtaaaactcgcaaaccacggcctcatacacggcgacttcaatgaatttaacctgattctggacgagtcagatcacattactatgatcgacttcccccagatggtctcgacttcacaccccaatgcagagtggtattttgatagggacgttaaatgtattaaagactttttcatgaaacggttctcgtacgagagcgagctgttccctacattcaaagatattcggagagaggacaccctggacgtcgaggtgtccgcctcaggctataccaaagaaatgcaggctgacgacgagctgttgcacccactcggccctgatgacaaaaacatcgaaacaaaagagggaagcgaatttagcttttctgatggggaggtggccgaaaaggccgaggtttatggcagtgaaaacgagagcgagcgaaactgcctagaggaatcagaaggttgctactgccgcagcagtggagacccagagcagatcaaggaagactcattgtctgaagagagtgctgatgcccgttctttcgagatgacagagtttaatcaagcgctggaggagattaaaggtcaggtggtcgagaacaattccgttactgagttcagtgaggaaaagaatcgcaccgagaattacaaccggcaggacggacagcgagtccagggcggagtccccgccggctctgacgaatacgaagacgaatgcccccacctgatcgcattaagtagtctgaatagagagttcagaccatttagagacgaagaaaatgtgggcgcgatgaaccaatatcggacgagaacgctctcaatcacaagcagtggcagtgctgtctcatgctcaaccattccacccgagcttgtgaagcagaaggtgaagagacaattgactaagcagcaaaagagcgcggttagaagacgcctgcaaaagggggaagccaatatcttcaccaaacagagaagggagaacatgcaaaacatcaagagcagtctcgaggccgcatctttctggggcgagtag

SEQ ID NO: 33175 - DNA, 1425 bp, Artificial Sequence
  Description of Artificial Sequence: Synthetic coding sequence
atggggaaagtcaatgttgcaaagctgcgctacatgtcccgcgatgattttcgggtcctcaccgcagtcgaaatgggcatgaaaaaccacgagattgttccagggtcattgatcgcctcaatcgcaagtctgaagcacggggggtgcaataaggtgttgagagagctggtgaaacacaaattgattgcgtgggaacgaactaaaacagttcaaggttaccgcctcaccaatgccggatacgactacttggcccttaagacgctcagcagcagacaggtggtagaatctgttggcaaccagatgggcgtaggcaaggagtccgatatttacattgtcgcgaatgaggagggtcagcagttcgctcttaagctgcatcgcttgggcaggacatcctttcgaaatctgaagaacaaacgagattaccacaagcataggcacaacgtaagttggttgtacctgtctcgtttatcggccatgaaggaatttgcttatatgaaggcactttacgaaaggaagttcccggtgcctaaacccattgactacaaccggcatgcagtggtcatggagctgattaacgggtatcccctgtgccagatacaccacgttgaggaccccgcctccgtgtatgatgaagccatggagctgatcgtgaagttagctaatcacggcctaattcacggggatttcaacgagttcaatctgattttggatgagagtgaccacattaccatgattgacttcccccagatggtctccactagccaccctaacgcagagtggtactttgacagggatgtcaagtgtataaaggactttttcatgaagagattcagctacgaaagcgagctctttccaacatttaaagacattagacgagaggatacactggacgttgaggtgagtgcaagcggttacaccaaggagatgcaggccgacgacgagctcttacacccccttggaccagacgataagaatattgagacaaaggaagggagtgaattttccttctctgatggggaggtcgctgagaaggctgaggtatacggcagtgaaaacgaaagcgaaagaaattgtctggaggagtctgaagggtgttactgtagaagctccggggatcctgagcagataaaagaggactctctttcggaagagtctgccgacgctagatcctttgagatgacggagtttaaccaggccctggaagagatcaaggggcaggtggtggagaacaactccgtgacggagttctctgaggagaagaatcgcaccgagaattacaaccgccaggacggtcagcgggttcaaggaggtgtccccgcgggcagtgacgagtacgaagacgagtgcccccatctgatagcattatcctccctgaatcgggagttccgccctttccgctacaggctgctgtctatagcattttag

SEQ ID NO: 33176 - DNA, 1560 bp, Artificial Sequence
  Description of Artificial Sequence: Synthetic coding sequence
atggacctcgtgggcgtggcgtccccagagcctggaactgctgccgcctggggccctagcaaatgtccgtgggctatcccacagaatacaataagctgctccctggccgacgtcatgtccgaacagcttgcaaaggagctccagctcgaagaagaggccgcggtcttcccagaggtcgccgtagctgaggggccgttcatcacaggcgagaacattgatacgtccagtgacctaatgctagcccaaatgctgcagatggaatatgatagagagtacgatgcccagctgaggcgcgaggagaagaagttcaatggggacagcaaagtttctatctcattcgaaaactatcgaaaagttcacccctatgaagactcagacagttctgaagatgaggtagattggcaggacacgcgagacgatccataccgccccgccaaacccgtacccactcctaaaaaggggttcattggaaagggcaaagatatcaccaccaagcacgacgaagttgtatgtggccgcaaaaataccgctcgcatggagaattttgcccctgagttccaggtgggtgacggaatcggcatggatctgaagctttccaatcatgtgttcaatgctctgaaacagcatgcttattctgaggagcgtcgatccgcacgactgcacgagaagaaggaacattccaccgcggaaaaagccgtggacccgaaaacaaggctgttgatgtataaaatggtcaatagcggcatgcttgagacaatcaccggctgcatcagcacaggaaaggagagcgtcgtatttcatgcctacggaggcagtatggaagacgaaaaggaagatagcaaagttatacctacagagtgcgccattaaggtgtttaaaactactctcaatgagttcaagaatcgcgacaaatacatcaaggacgatttcagatttaaggatcggttctccaagctgaaccctcgaaagatcattcgcatgtgggcagaaaaggaaatgcacaacttggcgcgcatgcagcgggccggtattccctgtccgacagttgtactgttgaaaaaacatatcctggtgatgtcctttataggccacgatcaggtacctgctcctaaattaaaagaagttaagctcaattccgaggaaatgaaggaggcttactatcagacattgcatctgatgcggcagctttaccacgagtgtacactagtgcacgcagacttgtctgagtataatatgctgtggcatgccggaaaggtttggttaatcgatgtgagtcagtcggtagagccaactcaccctcacggtctggagtttcttttccgcgactgtcggaatgtgagccagttttttcagaaaggtggagtcaaggaagcactaagtgagagagagctgtttaacgcagtgtccggcctgaacatcaccgcagataatgaggccgacttcctcgccgagattgaagctttggagaagatgaacgaggaccatgtgcagaagaacggacgaaaggctgcctccttccttaaggacgatggggaccccccccttctatatgacgagtag

SEQ ID NO: 33177 - DNA, 1248 bp, Artificial Sequence
  Description of Artificial Sequence: Synthetic coding sequence
atgaacgtcacatccatagccttgagggcggaaacttggctgctagccgcctggcacgttaaagtgccccccatgtggctggaggcctgcatcaattggatccaagaagaaaacaacaatgtgaatctctcccaggcacagatgaataagcaagtattcgagcagtggctactcacagatctccgagatcttgaacatccactgcttccagacggcatcctggagatcccaaagggggaactgaatgggttttacgcgctgcagattaactcactggttgacgtctcacaacccgcttatagtcagattcagaagctgaggggaaagaatactacaaatgatctcgtcaccgctgaggctcaggttacccccaagccatgggaagctaaacctagtagaatgctgatgctgcaactgaccgacggtatcgtccaaatccaagggatggagtatcaacctatacctatactgcattcagacctgcctcctggaaccaagatccttatttatggaaacattagcttccgcctcggtgtgctgctcctgaagcctgagaatgtcaaagttctagggggggaggtcgacgctcttctcgaggagtacgcacaagaaaaagttttagcccggttgatcggggagccagatttggttgtgtcagtgattcccaacaacagcaatgagaatatcccccgggttacggatgtgcttgatcctgctctggggccttcagacgaggaactccttgctagcttggatgagaatgatgaactaactgctaacaatgacacttcctccgaaaggtgttttaccaccgggtcttccagcaacaccatccccactcggcagagtagttttgagccagaattcgtaattagccctaggcccaaggaggaaccctcaaatctttcaattcatgttatggacggagagttggatgactttagcctggaagaagcccttttacttgaggagaccgtacagaaagaacaaatggagaccaaggaattgcaaccactgacctttaacaggaacgcggaccggagcatcgagcgctttagccataacccaaatacgactaacaactttagtcttacatgcaagaatggtaacaacaattggtcagagaaaaatgtttcagaacagatgactaacgaggacaaatcgtttggctgcccatctgttcgagaccagaaccggtccatcttctcagtacactgcaatgtgccgctcgcccacgacttcacctag

SEQ ID NO: 33178 - DNA, 1020 bp, Artificial Sequence
  Description of Artificial Sequence: Synthetic coding sequence
atgagctcagaaatgctgccggcctttatagaaacaagcaatgtggataaaaagcagggaataaacgaagaccaggaggaaagtcagaagccccgtctgggtgaaggctgtgaacctattagcaagaggcagatgaagaagctgattaaacagaagcaatgggaagagcaacgggaactcaggaaacagaagagaaaagagaaacggaagcggaagaaactggagcggcagtgtcagatggaacccaattccgacgggcacgacagaaaacgggtccggcgggatgtagttcattccaccctgcgactcataattgattgcagctttgatcacctcatggtcctcaaggatatcaaaaaactgcacaaacagatccaacgatgttacgcggagaatcgccgcgcattgcacccagtacagttctacctgaccagccatggtggccagctgaaaaagaatatggacgagaacgataagggttgggtaaattggaaggacatccacatcaaaccagaacactattctgagctcatcaagaaagaggatctgatatatctgacatcagacagtcccaatatattgaaagaactagatgaatccaaagcctatgtgattggaggcctggtagaccataaccaccacaaaggtttgacatacaagcaagcgtccgattacggcatcaaccatgcccagctgcccctcggcaacttcgtgaaaatgaactccagaaaggttctggcagtgaaccacgtattcgagataattctggaatacctggagactcgagactggcaggaggctttttttacgatcttgccacagcgtaaaggggccgtgccgactgataaagcatgtgaaagcgccagccacgataaccagagcgtgagaatggaggaaggaggaagtgactcggacagttctgaggaggaatactcacggaacgagcttgactcccctcatgaagagaaacaggataaggaaaaccataccgagtccactgtcaactcccttccgcactag

SEQ ID NO: 33179 - DNA, 1020 bp, Artificial Sequence
  Description of Artificial Sequence: Synthetic coding sequence
atgagttctgagatgctgcctgcttttatcgaaacatcaaacgtggataagaaacagggcattaacgaggaccaggaagagagtcagaaaccaagactcggtgaaggctgtgaacctatatcgaaacgtcaaatgaagaaactgataaagcagaaacagtgggaagagcagcgggagcttcggaaacagaagcggaaggaaaagcggaaacggaaaaagctcgagaggcagtgccagatggagcctaattcagatggccatgaccgaaagcgggtgaggcgagatgtggttcactcaactttgcggttgattatagactgttcatttgatcacctaatggtcctgaaagatatcaaaaagctccataaacagatccaacgctgctacgccgagaataggcgggccttacatccagtccagttttatctcacgagccatgggggtcagctgaaaaagaacatggacgagaatgacaaggggtgggtcaactggaaagacatccacatcaagccagagcactactcggaactcatcaagaaagaggacctgatttatctgacaagtgattctccaaacatcctcaaagagctggacgagagcaaggcttacgtgattggcggattggtagatcataatcatcacaagggccttacttacaagcaagcatctgactacggtattaaccacgcccaactgcctttaggaaatttcgttaagatgaactccaggaaggtgctggccgttaatcacgttttcgaaattatactggagtacctagaaacaagagactggcaagaggccttcttcaccatcttaccccagaggaagggagccgtgcctacagacaaagcatgcgagagcgcctcccatgacaatcagtctgtgaggatggaggaaggagggagcgactcggatagtagcgaggaggaatacagccggaacgaactagactcccctcatgaggagaaacaggataaggaaaatcacacggagtcaactgtaaattccttgcctcactag

SEQ ID NO: 33180 - DNA, 1020 bp, Artificial Sequence
  Description of Artificial Sequence: Synthetic coding sequence
atgagcagcgaaatgctgcctgctttcatcgagacttcaaacgtggataagaagcaggggattaacgaggaccaggaggagtcccagaaaccacgcctgggcgagggctgtgagcctatctctaaacgccagatgaaaaaactaattaaacagaagcagtgggaggagcagcgagaactgcgcaagcaaaaacggaaagaaaagcgaaagcggaagaaactggaacggcaatgtcaaatggagccaaattcggacgggcatgaccggaaacgagtgagacgggatgtggtccattccacactcaggctcatcattgactgcagctttgaccacctcatggtgctaaaagatatcaagaaacttcacaagcagattcagagatgctatgctgagaatcgtcgcgccctgcatccagttcagttctacttaacctcacatggggggcaactcaagaagaacatggatgagaacgataagggatgggtcaactggaaggacatccacattaagcctgaacactatagcgagcttatcaaaaaggaagacttgatttacctgacctctgactcaccgaatattctgaaagaactagacgagtcaaaggcatacgttattggaggtctggtggaccataatcatcacaagggactgacctataagcaggcgtctgactatgggatcaatcatgcgcaattgccactaggtaactttgtgaagatgaacagcagaaaggtcctcgcagtgaatcacgtgttcgagataattttggaatatttggaaacaagggactggcaggaggctttttttacaatcttgccacagcgaaagggcgctgtccccaccgacaaggcctgtgagtccgcctcccatgataatcaatctgtgaggatggaggaaggaggttccgactctgactcttcggaagaggaatattcccgtaatgagctcgattcccctcatgaagagaagcaagataaagaaaaccataccgagagtaccgttaacagcctgccacactag

SEQ ID NO: 33181 - DNA, 621 bp, Artificial Sequence
  Description of Artificial Sequence: Synthetic coding sequence
atgtcttctgaaatgctgcctgctttcatcgagacctctaacgtcgacaagaagcagggaatcaacgaggatcaggaagagtcacagaaacctcgcctcggcgaaggctgcgagccaatcagcaaacgtcagatgaagaaactcatcaagcaaaaacagtgggaggaacaaagggaacttcgaaaacagaagcggaaggaaaaaaggaagagaaagaaactggagaggcaatgtcagatggaaccaaatagtgatggccatgatagaaagagggttcggcgagacgtggttcacagcaccctgaggctgataattgactgctccttcgaccatctgatggtactgaaggatattaagaaactgcacaaacaaattcaacgatgctacgccgagaaccggcgagctctgcatcccgtgcagttctatctgacaagccacggcggccagctgaagaagaacatggacgagaacgataaaggctgggtgaactggaaagatattcacatcaagccggaacattatagtgagttaattaaaaaggaggacctgatctacctgacctccgacagccccaatattctgaaggaattagatgagtcaaaggcatatgttattgggtag

SEQ ID NO: 33182 - DNA, 603 bp, Artificial Sequence
  Description of Artificial Sequence: Synthetic coding sequence
atgtcatctgagatgctaccagctttcattgagactagcaatgtggacaagaagcaaggaataaacgaagatcaggaggagtctcaaaagcctcgcctgggggaaggttgcgagcctatctcgaagcgccagatgaagaagctcattaaacagaagcagtgggaggaacagagggagctgcggaagcagaagcggaaagaaaagagaaaacggaagaagttggaacgacagtgccagatggaaccgaattctgatggtcatgaccgcaaacgcgtgagaagggatgtggtgcacagtactctgcgcctcattattgactgctccttcgatcatctgatggtactcaaggacataaagaagctgcataagcaaattcagcgttgctacgcggaaaataggagggcactacacccagtgcagttctacttgacatcccatggcggccagctcaaaaagaatatggatgagaacgataaggggtgggtaaattggaaggacatccacattaaacccgagcactattcggaactgatcaagaaagaagacctcatatacttgactagcgattcaccaaacatactgaaagagctggacgaaagttag

SEQ ID NO: 33183 - DNA, 951 bp, Artificial Sequence
  Description of Artificial Sequence: Synthetic coding sequence
atggactggaaactggagggctctacgcaaaaggtggagtccccggttctccagggtcaggaaggtatcttggaagagactggggaggacggactgcccgaggggttccagcttctgcagattgacgctgaaggagagtgtcaagaaggtgaaatcctcgccaccggcagtacggcctggtgctcaaaaaacgtgcaaagaaaacagcgacattgggagaaaatcgtggccgcaaaaaaaagtaagaggaaacaagagaaggaaagacgcaaagcaaatagagcagaaaaccctggcatctgccctcagcactccaagaggttcctgcgagccctgactaaggataaactgctcgaggcgaagcactccggcccaaggctttgcatagacctgtctatgacccactacatgtctaagaaagaattatcacgtctggcaggccaaatccgtcggctgtatgggtccaacaaaaaggccgaccgccccttttggatctgcttaaccggctttaccactgactctccactctacgaggagtgtgtaagaatgaatgatggttttagtagttacctgctcgacatcactgaagaggattgtttctcactgtttcctctggagacactcgtgtatctcacacctgacagcgaacacgctcttgaggatgttgacttgaacaaggtctacatcctcggcggactggtggatgaaagtatccaaaagaaggtgactttccagaaagccagggagtattcagtgaaaaccgctcgccttccgattcaggaatacatggttagaaaccagaatggcaagaattaccactccgaaattcttgcaatcaaccaggtttttgatatcctgtcaacctacttggagacccacaactggcccgaagcattgaaaaagggtgtgtcatcaggtaagggctacatccttcggaactcagtggagtag

SEQ ID NO: 33184 - DNA, 690 bp, Artificial Sequence
  Description of Artificial Sequence: Synthetic coding sequence
atggattggaagctcgaagggagcacccagaaggtggagagccccgtgttacaaggccaggagggtattctggaggaaactggcgaggatgggctccccgaggggttccaattacttcaaattgacgctgagggcgaatgccaggagggcgaaattctggcgacgggaagtaccgcttggtgctcagaactgagtagattagcaggacagattaggcggttgtatggctccaacaaaaaggctgatagaccattctggatttgcctcactggctttacaacggattcacctctctacgaagagtgcgtgcgtatgaatgacggattctcttcttatttactggacatcacggaagaggattgcttctcactattcccactggagacattggtgtatttgacccctgattctgagcatgccttggaggacgtcgacctgaataaggtgtacatattgggaggtctcgtggacgaatctattcagaagaaagtgactttccagaaggctcgggaatacagcgtgaagactgcacgcctgcccatccaggaatacatggtgcggaatcagaacggaaaaaactaccattcggagattttggctatcaatcaggaaactcataattggccagaagccctcaaaaaaggagtcagctcaggaaagggctacatcctaaggaactctgtagagtag

SEQ ID NO: 33185 - DNA, 771 bp, Artificial Sequence
  Description of Artificial Sequence: Synthetic coding sequence
atggactggaaactcgaaggtagcacccagaaagttgagagccctgtgcttcagggccaagagggcattctagaagaaacaggagaggacgggttaccggagggcttccagctgcttcagatcgacgccgaaggcgaatgtcaagaaggggaaattctcgctaccggaagcacagcctggtgctccaaaaatgttcagcggaaacagcgccattgggaaaaaattgtggccgcaaaaaagagcaagaggaaacaggaaaaagagcgccggaaggcaaatagagctgagaaccccggcatctgtccccagcacagcaagagattcctgcgcgcgctgactaaagacaagcttttggaggcaaagcattccgggcctagattgtgtattgacttgagcatgactcactatatgtcaaagaaacttgatattacagaggaggactgtttctcccttttcccccttgaaactctggtgtatctcacaccagactccgagcatgctctggaggacgtcgacctgaataaggtgtatattctcggtgggctggtggacgagtctattcagaagaaggtaacatttcagaaagcacgggagtatagcgtaaagacagcccgtttgcctatccaagagtacatggtgaggaatcaaaacggcaagaactatcactctgaaattctagccattaaccaggagacgcacaactggcccgaggcattaaagaaaggcgtgtcttctggcaaaggttacattctacgaaatagcgttgaatag

SEQ ID NO: 33186 - DNA, 474 bp, Artificial Sequence
  Description of Artificial Sequence: Synthetic coding sequence
atgagtagtgaggagggcaaattgtttgtgggcggcttgaacttcaacacggacgaacaggcccttgaggaccatttcagttcattcggccccatttctgaggtggttgtggtcaaggaccgggaaactcagcgcagtagaggttttggctttatcacctttacaaatcccgagcatgcttcggtggcaatgcgcgcaatgaacggtgagagcctggatgggcggcagattcgggtcgatcatgcagggaagagtgcaagaggtaccagaggcgggggcttcggggctcatggccgcggacgcagctactcccgtgggggaggagaccaaggatatggaagcggccgttactacgatagcaggccaggcggttatggctacggctacggtagatcccgcgattacaatgggcgaaaccagggaggatatgacagatacagtggcggaaactacagagacaattatgacaactag

SEQ ID NO: 33187 - DNA, 846 bp, Artificial Sequence
  Description of Artificial Sequence: Synthetic coding sequence
atgtttcctgctcaggaagaggcggaccgaacagtgttcgtggggaatcttgaagcccgagtaagggaggagatcttgtatgagctatttctgcaggccggcccactgactaaggtcaccatctgtaaggaccgggagggaaaaccgaaatctttcgggttcgtctgctttaaacacccagaaagtgtgtcttatgctattgcgcttctgaatggtattagactctatggacgacccattaacgtgcagtacagattcggcagtagtcgatctagtgagccagcgaatcagtcgttcgagtcttgtgttaaaattaacagccataattataggaacgaggagatgctcgtgggcagatcctcttttcccatgcaatatttccctatcaacaatacaagcctgcctcaggagtactttctgttccagaagatgcagtggcacgtatacaacccagtgttgcagttgccttactatgagatgacggcaccattgcctaattccgcctctgtgtcaagttcactgaatcacgtgcctgacctcgaggccggacctagctcatacaaatggactcaccaacagcccagcgatagtgacctttatcagatgacagcccccctccccaactccgcatctgtgtcatcttccctgaaccacgtgccggatcttgaggcgggccccagctcctacaaatggacccatcagcaaccttctgactcagatctataccagatgaacaaacgaaagagacagaagcaaacgtccgactcagacagcagtaccgacaacaatcggggcaacgaatgcagccagaaatttaggaaaagcaagaaaaaaaagcgttactag

SEQ ID NO: 33188 - DNA, 3006 bp, Artificial Sequence
  Description of Artificial Sequence: Synthetic coding sequence
atggccgttgtcattaggctgctgggcctcccttttattgctggaccggtggatattcgacacttctttaccggactgacaatcccagatggtggcgtgcacatcatcggcggcgagattggagaggcctttatcattttcgcaaccgacgaggatgcccgtcgagcaatttcaagaagcggcggattcataaaggactccagcgttgaactgtttctgtcaagtaaggccgagatgcagaagacaatcgagatgaagaggacagatagagtgggtcgcggacggccaggttcgggaacctctggagtagacagcctgtctaattttattgaatctgtgaaggaggaagcctccaacagcggctatggttcaagcattaatcaagatgctgggttccatacaaatggaaccggacatggcaatctacggccaaggaagacaaggccactaaaggctgagaacccctatttattccttagaggtttaccgtatttggtgaacgaggacgatgtccgggtgttcttcagtgggttatgcgtggacggcgttatttttctgaaacatcacgacggccgcaataacggagatgccatagtcaagttcgcgtcgtgcgtggatgcttccggcggcctgaagtgtcacagatcattcatgggctcacggtttattgaggtcatgcaaggttcagaacagcagtggattgaatttggcggaaatgctgtcaaggagggggacgtgttacggcgcagcgaagagcacagtccacccaggggcataaatgatcgccatttcagaaaaaggtcgcatagcaaaagccccagacgtacacgatcccggtcaccactgggattctatgtgcacctcaagaacctgagtttgagcatcgatgagagggacctgcgtaactttttcagaggcactgacctgaccgacgagcagatccggttcctgtataaggatgagaaccggacccgctacgcatttgtcatgtttaagaccttgaaggactataacaccgctttgtccttgcataaaaccgtgctgcagtatcggcccgtgcacattgacccaatttcaaggaaacaaatgttgaaattcattgcgcgctacgaaaaaaaaagatctggttctctggagcgtgatcgaccaggacatgtcagtcaaaaatactctcaagaggggaacagtggacagaagttgtgtatttatatcagaaatttccctttcgacgtcaccaaagtcgaagtccaaaaattcttcgccgattttctcctggccgaggatgatatttatctcctttatgacgataaaggagttggactgggggaagctttagtcaaattcaagtcagaggagcaggctatgaaggctgaacgactaaaccggagacgatttttggggacggaggtcctactccgattgatcagtgaagcccagatccaggaattcggagttaactttagcgtaatgagtagtgaaaaaatgcaggccaggtctcagagccgagagaggggggatcactcacatctcttcgattccaaagatcccccgatttattccgttggagcttttgagaactttcggcaccagttggaggacctgaggcaacttgataacttcaagcatccacagcgagacttccgacagccggaccgccatcctcctgaggactttaggcacagtagcgaggatttcagatttccccctgaggactttcgtcactcaccagaggacttcagacggccccgagaagaggatttcaggaggccctctgaggaagacttccggcgaccctgggaggaggattttcgtagaccgcccgaggacgacttccgacatcccagggaagaggactggcggagacccctcgaagaggattggcgacggccactggaagaagactttcggcgttccccaaccgaagactttcgtcagctgcccgaagaagattttcgacagcctccagaggaggatctgcgttggctccccgaagaggactttcgtcgacctccagaggaggattggaggcggccacccgaagaagactttaggcgcccactacagggtgagtggagacgccctcccgaggacgacttcaggcgtccacctgaggaggacttcaggcattcaccagaggaggactttaggcagtctccccaggagcatttcagaagacctccgcaagaacactttcgacgtcccccaccagaacattttcggcgtccgcctcctgaacactttaggaggcccccgcccgagcacttcagaagaccacctccagaacatttcaggaggcctcctcccgaacactttcgcagaccgcccccagagcattttcgccgacccccccaagagcactttcgaaggcctccgcaggaacattttcggcgttcccgtgaggaggattttagacatccaccagatgaagacttcagagggccgccagatgaggacttcagacatcctcccgacgaggacttcagaagcccccaggaagaggatttcaggtgcccaagcgatgaggattttaggcagctccctgaagaggatctaagggaggctcctgaagaggacccccgcctgcctgataatttcagaccccccggcgaggactttcggtcacctcccgacgattttcgctctcaccggccgtttgtgaattttggccggccagagggcggcaagtttgatttcggtaagcacaatatgggatcatttcctgaaggacggtttatgcccgatcccaaaattaattgtgggagcggccgggttacacctattaaaatcatgaatctaccttttaaagccaatgtcaatgagattctagatttcttccatggttaccggatcatacctgatagcgtcagtatccagtacaatgagcagggactaccaactggtgaagctatagtggccatgatcaactataatgaggccatggcagccatcaaagacctgaatgacagacccgtgggtccacggaaagtgaagttgaccctgctatag

SEQ ID NO: 33189 - DNA, 2646 bp, Artificial Sequence
  Description of Artificial Sequence: Synthetic coding sequence
atggccgtcgtgattcgcttgctcgggctcccattcatcgccggtccagtagacattcggcatttcttcacaggtttgaccattcccgacggtggggtgcacatcatcggtggggaaattggagaagcatttataattttcgcaactgatgaagacgcgcgcagggcgattagccgctctggtggtttcatcaaagatagttccgtggaattattcctgtcctcaaaggctgaaatgcagaaaaccatcgagatgaagcggacagatcgagtaggacgtggaagacccggctcaggtacttctggggtggatagcctgagcaacttcattgagagcgtgaaggaagaagccagtaattcaggctacggtagttccattaaccaggacgctggttttcacacgaacgggactgggcatggaaacctgcgccctaggaagacaagacccctgaaggctgagaacccatacttatttttgcgaggtctgccttacctcgtcaatgaagatgacgtgcgggtgttcttttccggactgtgtgtggatggagtgatctttcttaagcaccatgacggccggaacaatggcgatgccattgtaaaatttgcaagctgcgttgatgcaagcggcgggctcaagtgccacaggagctttatgggttctaggttcatcgaagtcatgcagggctctgagcagcagtggatcgagttcgggggcaatgccgtcaaagagggagatgtcttgcggaggagtgaagaacactctccacccagggggatcaatgatagacattttcgcaaaaggagccactcaaagtccccccgtaggacccgctcgagaagtccactgggcttctatgtgcacctgaaaaacctctcccttagcatagatgaacgcgatctccggaacttcttcagaggcactgacttaacagatgaacaaattaggttcctgtataaggacgagaatcggactcgatacgcgtttgtgatgtttaagacattgaaggattacaacactgcactgagcttgcataagaccgtgctgcagtaccggcctgtgcacatagatcccatcagtaggaagcagatgctcaagtttattgccagatacgagaaaaaaagatcagggagcctggagcgtgataggcctgggcacgtgtcgcagaagtactctcaggaaggcaacagtggacaaaaactgtgcatttatatccggaatttcccattcgatgtcacaaaggtcgaggtccagaaattcttcgcggacttcttgctggccgaagacgacatatatctgctgtacgatgacaagggcgtgggactgggggaggccttagttaaattcaaatccgaggagcaggcaatgaaagccgaaagacttaataggagacgattcctgggcacagaggtactcctgagactgatttctgaggcacagattcaggaattcggtgtgaacttctccgtaatgagctctgaaaaaatgcaggctcggagtcagagcagggaacggggcgaccattctcacttgttcgactctaaagatccaccgatatactctgtcggtgccttcgaaaatttcaggcaccaattagaggacctgcgtcagttggacaatttcaaacatccccaaagagatttccgtcagcccgatagacatccacccgaggactttagacatagcagcgaagacttcaggtttccaccagaagatttcagacattcgcctgaggacttcagacgcccgagggaggaagatttccgtaggccctcggaggaggactttcggaggccatgggaggaggatttccgccggccccccgaggacgactttcggcacccaagagaggaggattggaggcgtccgccgccggaacattttaggcgcccccctcctgagcactttagacgtccaccccccgagcactttcgcaggccccccccggagcattttcgccgacctcctccagaacattttcgcaggcccccgcaagagcacttcaggcgcccgccacaagagcattttcgtaggtcccgcgaggaagacttccgccaccctccggacgaggattttcgcggcccacctgatgaagactttcgacaccccccggatgaggactttcgctccccccaagaggaagacttcaggtgccccagtgatgaagactttcgccagctgcccgaagaagatctgagggaagccccagaagaagacccaagactgcccgataatttcaggcccccaggtgaagactttcgcagtccaccagacgatttcagaagccacaggcccttcgtaaacttcggcaggccagaggggggcaagtttgacttcggaaaacataacatggggtcatttccggagggacggttcatgccagaccctaaaatcaactgcggatcaggcagggtcaccccaatcaagataatgaatctgccgtttaaggctaatgtgaacgagatcctcgattttttccacgggtaccggattatcccagacagcgtttctatccagtataacgaacagggtctgccaacaggagaggcaatcgtcgccatgattaactataatgaggctatggcagcaatcaaagatcttaacgaccgaccggttgggccccgcaaggtgaagctcacacttttgtag

SEQ ID NO: 33190 - DNA, 432 bp, Artificial Sequence
  Description of Artificial Sequence: Synthetic coding sequence
atggctgtggtgatacgtttactcggcctccctttcatcgccggtccggttgacatccggcacttcttcaccggattgactatccctgacggtggagtgcacatcattggcggcgagatcggtgaggccttcattatcttcgcaaccgacgaggacgcacgcagagcgatctcccgcagcggtgggttcattaaggattcttctgtggagctcttcttgtcatccaaggcagagatgcagaagactatcgaaatgaagcggactgatcgagtcggacgcggacgtcccggctccggcacttcgggcgtagactccttgagcaacttcatcgagtcagtcaaagaggaagccagtaactccgggtatggtagtagcatcaatcaagacgctgggtttcataccaatggcacaggccatggaaatctcagatag

SEQ ID NO: 33191 - DNA, 450 bp, Artificial Sequence
  Description of Artificial Sequence: Synthetic coding sequence
atggcagtggttatccgactgcttgggctcccgttcatcgccggcccagtggatatcagacacttctttaccgggctcactataccagacggaggggtgcatataatcggcggagaaattggcgaagcattcattatcttcgctacggatgaagatgctcgacgggccatctcacgtagtggcggcttcatcaaagactccagcgtcgaactgtttctgagctctaaagctgaaatgcaaaagacaatcgaaatgaagcggactgacagagtgggacgtggccgaccaggctcaggaaccagcggagtggattcactcagtaactttatcgagagcgttaaggaggaagcctcaaatagcggctacggatcatctatcaaccaggatgccggatttcacacaaacgggaccggtcatggcaatttacgtccacggaaaactcggccatag

SEQ ID NO: 33192 - DNA, 369 bp, Artificial Sequence
  Description of Artificial Sequence: Synthetic coding sequence
atggcggttgtaattaggttattggggctgccgtttatcgcggggccagtagatattaggcacttcttcaccggtttaactatccccgacgggggtgtccatattattgggggggagattggtgaagctttcataatctttgccaccgatgaagacgcacgacgagcaatctcccgaagcggtggcttcattaaggatagtagcgttgaactcttcctttcctccaaggccgagatgcagaagaccattgaaatgaagcggacggacagagtgggtcggggcagaccaggctccggaacctccggcgtagactctctctcaaactttatcgagagcgttaaggaagaagcaagtaatagcggctattag

SEQ ID NO: 33193 - DNA, 249 bp, Artificial Sequence
  Description of Artificial Sequence: Synthetic coding sequence
atggcagtcgtgatccggctactgggactgccctttatagcagggccagtcgacatccgccacttcttcactggtctaaccattcccgacggaggagtgcacatcatcgggggtgagatcggcgaagccttcattatttttgccacagacgaagacgcaagacgcgccatctccaggagcgggggcttcattaaggacagttcagtcgaactgtttttatcttcaaaagccgaaatgcaaaagacctag

SEQ ID NO: 33194 - DNA, 573 bp, Artificial Sequence
  Description of Artificial Sequence: Synthetic coding sequence
atggaggcggagaccaaaaccctgcctcttgagaatgcctccatactttctgaggggtctcttcaggagggacatcggctctggatagggaacttggaccccaagatcaccgaatatcacctgctcaaactccttcagaagtttggcaaggtgaagcagttcgactttctatttcataaatctggagccctggagggtcagcccagagggtattgcttcgtaaactttgagactaagcaggaggccgaacaggcaatacagtgtcttaatggtaaactcgccctgagcaaaaagttggtcgtgaggtgggcccacgcacaggtgaagaggtacgaccacaataaaaatgacaagatcctgcccattagcctggaaccttccagttccacggaacccacacagtctaacctgtcagtaactgctaagatcaaagctatagaggcaaaattaaagatgatggcggagaatcctgatgctgagtacccagctgcccccgtgtatagttattttaagccaccagataaaaagagaactacaccctacagccgaacggcctggaaaagtcggcgctag

SEQ ID NO: 33195 - DNA, 2943 bp, Artificial Sequence
  Description of Artificial Sequence: Synthetic coding sequence
atggtgagtaagatgataatagaaaacttcgaggcattgaagtcatggctttctaagactctggaaccaatttgtgacgcagatccgagcgccctggctaaatatgtcctggccctggtaaaaaaggacaaatccgaaaaggaactgaaggcgctctgcattgatcagttggatgtatttctccagaaagagacccagatttttgtagagaaactcttcgatgctgtgaataccaagagctatttgcccccacctgaacagccgagctcaggatcacttaaagtggagttttttcctcaccaagagaaggatatcaagaaggaagagatcactaaagaagaagagcgggaaaaaaagttttctcgccgactcaaccactcccctccacaaagctcaagcaggtaccgggagaaccgaagccgcgacgaaaggaaaaaagatgatcggagccgcaagagggattatgacagaaacccacccagaagggattcttaccgagacaggtataatagacgcagaggacgaagtcgcagttactctcgctctcgctcccgctcctggagcaaagaaagactgcgggagagggatcgggacagaagcaggacgagatctcgtagcagaactcggagccgcgagagggacctcgtgaagccaaaatacgatctggataggacagaccctttggagaacaattacacccccgtatctagcgtgccatccatctcgtctggacactatcccgtgcccaccctgtcctccaccattaccgtcatcgctcccacccatcatggtaacaacaccaccgagtcctggagcgaattccacgaggaccaggtcgaccacaacagctatgtgcgtccgcctatgcccaaaaagagatgcagggattacgatgagaagggcttctgcatgagaggcgatatgtgcccattcgaccatggttctgaccccgtggtggtggaagatgtgaacctccccggtatgctccctttcccagcccagccccccgtggtggaagggccccctccgcccggcctgcccccaccgccacccatcttaacacccccccccgtcaacctgaggccccctgtccctccccctggaccgctgcctccgagtctgccacccgtgactggccctccgccgccccttcccccattgcagccgtcaggtatggacgcgccgcccaattctgccacatccagtgtgcccacagtggtgactaccggcatccaccatcaaccccctcccgcgcctccatccctgttcacagccgacacttacgatacggacggctacaacccagaggcaccttctattacaaacacctcccgcccaatgtatcgccatagggtgcatgcccagaggcctaatcttattggcttgaccagcggcgacatggacctgcctccccgggaaaagccacccaataagagttcaatgagaattgtggtggacagcgaatccagaaaacgaactattggctccggagagcctggagttccaactaagaagacatggttcgacaaacctaattttaaccggaccaactccccaggcttccagaagaaagtccaatttggcaacgaaaacacgaagctggaactgcggaaggttccccccgagctcaacaacatttccaaacttaatgaacacttcagccgcttcggcacgctggtgaatctgcaagtggcctacaatggcgatcccgagggggcgttgattcagttcgcgacttacgaagaggctaaaaaggcaattagttccaccgaagctgtcctgaataataggtttatcaaggtatattggcatcgggaggggtcaacacagcagctgcagaccacctctccaaaacccctcgtgcagcagcccattctcccggtcgtgaaacagagcgtcaaggagcggctgggcccagtcccgtcatccaccattgagcccgccgaagcccagtccgcatccagcgacttgccacaagttctctcgacaagcactggtctcacaaagaccgtgtataatccagccgccttgaaagccgcacagaagacactgttggtttctacgtcagctgtggacaacaatgaggcccagaagaagaaacaggaggccctgaaactacagcaggatgtgagaaagcgcaagcaggagattctagagaaacacattgaaacccagaagatgcttatttcaaagctcgaaaaaaataaaaccatgaagagcgaggacaaggctgagattatgaaaactcttgaggtcctgactaagaatataaccaagctaaaggacgaggtgaaagccgccagtccgggaaggtgtctgccaaaatctatcaagactaaaacacagatgcagaaagagctgctcgacacagagctggatttgtataagaaaatgcaggccggcgaagaggtcactgagctgcgtaggaaatacacagaactccagttggaggcagccaagcgagggattcttagctccggcagagggcgcggcattcactctcgcggaagaggcgctgttcacggccgaggtaggggccgaggaagggggcgcggtgtcccaggccatgcagttgtagaccacagacccagagcgctcgaaattagcgccttcacagagtctgaccgtgaggatcttctgcctcactttgcgcaatacggcgaaattgaggactgccagatcgacgactccagtctacatgccgttatcactttcaaaacccgggccgaagccgaagccgccgctgtgcatggcgctcgattcaagggccaggatctgaaactggcttggaacaagcctgttactaatattagtgcagtggagaccgaggaagtggaacccgatgaggaggagttccaggaggaaagtctggtggatgacagcctgttacaagacgacgacgaggaggaggaagacaatgagtcccggtcatggagacgttag

SEQ ID NO: 33196 - DNA, 3024 bp, Artificial Sequence
  Description of Artificial Sequence: Synthetic coding sequence
atggtgagcaagatgatcatagaaaatttcgaagctttaaaatcatggctgtccaagacccttgagccaatctgcgatgcagaccctagtgctctagccaaatacgtcctggccctcgtgaaaaaggacaagtcagaaaaagaacttaaagcgctgtgtatcgaccagttggatgtgttcttacaaaaagagacacagatcttcgtcgaaaagctgttcgatgcagtcaacaccaaatcatacttaccaccccccgaacaaccctcttcaggtagtctcaaggtggaatttttcccacatcaagaaaaagatataaaaaaggaagagatcaccaaagaggaagagagggaaaaaaaattcagccgaagacttaaccacagccctccccagtcatcttcacggtacagggaaaacaggtcccgtgacgagaggaaaaaggacgaccgcagcaggaaaagggattatgaccggaatccacctaggcgtgattcgtaccgggataggtataaccgtaggagggggcgttcccggtcgtacagcagatcacggtccagatcttggtctaaagagcggcttagggagagggatagagacaggtcacgcaccagatctagatctagaactcgttcaagggaaagagatcttgtcaaaccaaaatatgatctagacaggacagaccccctcgaaaacaactacactcctgtctcctccgtgccaagcattagcagcggacactacccggtccctacactgagttctacaattaccgtgatcgcccctacccaccatggaaacaatacaactgaaagttggtccgaatttcatgaagaccaggttgatcacaattcctacgtgcggccccctatgccgaaaaagaggtgccgtgattatgatgagaagggtttctgtatgcgtggggatatgtgcccttttgaccatgggtcggaccctgtggtcgtagaagacgtgaacttgcctggaatgttaccattcccagcccagccccctgtcgtggaaggacccccaccccctgggctacccccaccgcccccaatactgactccgcctcccgtgaatctgagaccccctgtccctccacctggtccactccccccttccctacctccggtgaccgggccgcccccacccctcccgcctttacagcctagcggaatggatgctccacctaattcagccacaagttcagtgcccactgtagtgacaaccggaattcaccaccagccacctcctgcgcccccctcgctgttcacagctgatacctacgataccgatggatacaatccagaggcgcctagcatcaccaatacctctcgacccatgtacagacaccgcgttcacgcccagcggcccaatcttatcggcctgacaagtggtgatatggaccttcctcctcgtgagaagccccctaataagtcttccatgcgtatcgtcgtggactccgagtcgcggaagagaactattggcagcggtgagcccggagtccccaccaagaagacttggttcgacaagcccaacttcaacagaactaactcgccgggatttcagaaaaaagtgcagttcggaaacgagaataccaaactggagcttcgcaaggtgccccccgagcttaacaatatcagtaaattgaacgaacacttttcccgcttcggtaccctagtgaacctgcaggtcgcttacaatggcgatcccgaaggtgctctcatccagtttgccacctatgaagaggcaaagaaggctatctcttctactgaggccgtgttgaacaaccgattcataaaagtgtattggcatcgggagggcagcacccagcaactacagaccacctctccgaaagtcatgcagcctctcgtgcagcaaccaatacttcccgtagttaagcagtctgtaaaggagcgactagggccagtaccaagctccactatcgaaccagccgaggcccaaagcgcaagcagcgacttgcctcaaaatgtgaccaaactcagtgttaaggatagactgggatttgtgtccaagccctccgtgtccgctactgaaaaagtgctgtcaacctccacaggactgacaaagactgtctacaatcctgccgctctaaaagcagcccaaaaaacgctgctcgtttctacatcggcagtcgacaacaacgaggcccaaaaaaagaagcaggaggcacttaagctccagcaggacgtgagaaagcgcaaacaagaaatcctcgagaagcatatagagactcagaagatgctcattagtaagctggagaaaaataagactatgaagtctgaagataaagccgaaataatgaaaacactggaggtgctgaccaaaaacatcactaagctaaaagatgaagttaaggcagccagtccgggccgctgcctccccaagagcatcaagaccaaaacacaaatgcagaaggagctcctggatactgagctggatctctataagaagatgcaagcgggcgaggaggttaccgagctgaggaggaagtatactgaattgcagctggaagcggccaagcgaggcattcttagcagcggccgtggccggggaattcatagcagggggaggggagccgtgcacgggaggggccgaggccgagggcgcggtagaggggtgcctgggcatgcggtcgtggatcacagacccagagccctggagattagcgctttcacagagtctgaccgagaggacctgctcccccatttcgctcagtacggcgaaattgaggactgtcagatcgatgattccagcttgcacgccgtgatcacattcaagacccgcgcagaagccgaggcagcagctgtacatggggcgcgctttaaaggccaggacctgaagcttgcatggaataagcctgttacgaacatcagtgccgtcgaaacagaggaagtggagccagacgaggaagaatttcaggaagaaagcttagtcgatgactccctcctccaagacgacgacgaagaggaagaggacaatgaatcgaggtcatggcggagatag

SEQ ID NO: 33197 - DNA, 2952 bp, Artificial Sequence
  Description of Artificial Sequence: Synthetic coding sequence
atggtgtccaagatgataatcgagaacttcgaagcactgaagagttggctgagtaaaaccctggaacccatttgcgatgctgatccaagcgcattggctaaatacgtgctggctttggtgaaaaaggacaagtctgagaaagaacttaaagccttatgcattgaccagcttgatgttttccttcaaaaagagactcagattttcgttgaaaagcttttcgatgctgttaacacaaaaagttacctgccacccccagaacagccttccagcggatctctaaaggtagaattttttccccaccaggagaaggacatcaaaaaggaggagattactaaagaagaagagagggaaaaaaagttcagtagaaggctgaaccattcccccccacaatcctcttcccgctacagggagaacagaagccgtgatgagcgcaaaaaggacgataggtctcgaaaacgtgactacgaccgaaaccccccacggcgggatagctaccgcgacagatacaaccggcgccgcggccgctcaaggtcctacagtcggagccggtctcggtcatggtccaaagaacggctccgtgaaagagaccgggacagatcacgtacaaggtcccgatcccggacacgaagccgggaaagagacttagtcaagccaaaatacgatctggaccggacagatcctctcgagaataactacacgcccgtctccagcgtgcctagcatctcttccggtcattacccagtgcctactctgtcctccaccattacagttatcgcacctactcatcatggaaacaacaccaccgagtcttggtcagagtttcatgaggaccaggtagatcacaactcgtacgtccgcccaccaatgccgaaaaaacggtgtagggattatgacgagaaaggattttgtatgcgcggggacatgtgtccctttgaccatggctccgatcctgtggtggtggaggatgtgaatctgccaggcatgcttccatttccagcgcagccgcctgtagtggaaggaccccccccccctggcctgccccccccacctccaatcctgacaccaccccccgtaaacttaagaccgcctgtgcccccccctggcccacttcccccttccctgccccccgtgacggggcccccacctcctttaccaccactacagccctcaggcatggacgccccaccgaacagcgcgacctcctctgtcccgacggtcgtaacaaccggaattcaccaccaaccgccacccgccccaccctccctcttcacagcagatacctatgatacagatggatataacccggaggctccgtccatcaccaacacgtctaggcctatgtaccggcaccgtgtgcatgcccagaggcctaatctaatcggccttactagcggcgacatggacctcccgccacgcgaaaagcccccaaataagtctagcatgaggatagtggtggatagcgagtccagaaaacgcaccatcggatcaggcgagccaggcgtgcctacaaaaaaaacatggttcgataaaccaaactttaataggacgaattcccccggcttccaaaagaaagttcagttcggtaacgaaaataccaaactcgagctgaggaaggtgccccctgagctcaataacatttcaaaactgaacgaacactttagtagattcggcacactggttaacctgcaggttgcatataacggcgaccccgagggcgcactcatacagttcgcaacttatgaagaggcaaagaaggcgataagtagtacagaggctgtactgaataacaggttcatcaaggtctactggcaccgtgagggctctactcagcagttgcaaaccacctcccctaaagttatgcagcccttggttcaacagccgattctgcctgtggtgaagcagagcgtgaaggagcgactggggcctgtgccttcaagcacgatcgagcccgccgaggcgcagagcgcctcgagcgatctcccccaagtcctgtccacgtcgaccgggctgactaagaccgtatataatcccgccgccttgaaggccgctcagaaaaccctgttggtctcaacatctgccgtagataataatgaagcacagaagaagaaacaggaagccttgaaattgcagcaggacgtaagaaaaagaaagcaggagatccttgagaaacatatcgagactcagaaaatgcttataagtaagctggaaaagaataagacaatgaagtccgaggataaggctgagattatgaagacgttggaggttctgacaaagaacattaccaaactgaaggatgaagttaaagctgctagccctggtcgctgtcttcccaagtccatcaaaaccaaaacccagatgcagaaagagctgcttgataccgagctcgatctgtacaagaagatgcaggctggtgaagaggtcacggagctgcgtagaaaatacaccgaactgcagttggaggctgcgaaacgaggtatcctgtcaagtggtaggggccggggaatccactcccggggccgtggtgcagttcacggaaggggaagagggagggggcgcggcaggggagttcctggccatgcagttgtggatcataggccccgcgcacttgagatctccgccttcacagagtctgaccgggaggacctgctaccccattttgcgcaatacggagagatcgaagattgtcagatcgacgatagcagtctgcacgccgtgattaccttcaaaaccagggctgaggccgaagcagccgcagtccatggggccagatttaagggacaggatctgaagctggcctggaataaaccagttaccaacatctcggccgtcgaaacggaggaggtagagcccgatgaggaggagttccaggaggagtcattagtggacgacagtcttttacaggatgatgacgaagaagaggaggataacgagtcccggagctggcggcggtag

SEQ ID NO: 33198 - DNA, 807 bp, Artificial Sequence
  Description of Artificial Sequence: Synthetic coding sequence
atggccgcggctctcggtgcgtctggtggagccggggcaggcgacgatgatttcgatcagttcgacaaaccgggcgcagagcgatcatggcgccgcagggccgccgatgaggactgggattctgagctagaagatgacctactgggcgaagacttactgagcgggaagaagaaccaatcagatttgtccgacgaggaactgaacgatgatctgctgcaaagcgacaatgaggacgaggagaatttctcctctcagggtgtgaccatatccctgaatgctacttccgggatggttacatctttcgagctctcagataatacaaacgaccaatcaggtgaacaggagagcgagtatgaacaggagcagggcgaggatgagttggtttaccataaatctgatggatccgaattgtatacacaggaatatcccgaggaaggccagtatgaggggcatgaggccgaactcaccgaggaccagatcgagtatgtggaggagccggaggaggaacaactgtacaccgacgaggttttggacatagagataaatgagccattggacgaatttaccggcggcatggaaacattagagctccagaaggacatcaaagaggagagcgatgaggaggaagaggatgacgaggaaagcggccgactgagatttaaaacagaacggaaagaggggaccataatacgcctcagtgacgtgacccgagagcggcgaaacatcccagagaccttaggcaacttttttgcctgcctgccgtcttcgttcacgctgattagcactagcagtattgttctcctttag

SEQ ID NO: 33199 - DNA, 321 bp, Artificial Sequence
  Description of Artificial Sequence: Synthetic coding sequence
atgcacggtaggggtcggggagtggcagggcctatgggcagaggacgactgatgcctaacaagcagaatctgcgggtggtcgaatgcaagccacaaccctgtgtggtgtccgttgagggtttgtcttcatccaccacagatgcacagctgaagagcctacttatgtcagtggggcccatacagtccttacagatgctgcctcagcagcgcaaggccatagcaaaattcaaggagcccgcacatgccctggctttccagcaaaagttccacaggcatatgatagaccttagccacatcaacgtcgccctgatcgtggaatag

SEQ ID NO: 33200 - DNA, 3513 bp, Artificial Sequence
  Description of Artificial Sequence: Synthetic coding sequence
atggcggcagctctgggcgcaagcggtggcgccggagctggggacgacgatttcgaccagtttgataaacctggagcagagcgcagctggcgaagacgcgccgcagacgaagactgggatagcgagttggaggatgacctgctgggggaggatctgttatcagggaagaagaaccagagcgatctgagtgacgaggagctgaacgatgatctcctgcagtctgataatgaggatgaggaaaatttctcctcccagggggttacgattagcctgaatgccactagcggaatggtgacaagtttcgagctgtctgacaacacaaatgatcaatcaggagaacaagaaagtgagtacgagcaggagcagggggaggatgagctggtgtaccacaaatccgatgggtcagagctgtatacccaggagtaccctgaggaaggacagtacgaaggccatgaggcggagttaacagaggaccaaatagaatacgtggaggagcccgaggaagagcaattgtatactgatgaagtactggatatcgaaattaacgagcccctggatgagtttaccggcggaatggagactttggagctccagaaggatatcaaggaggagtcagacgaagaggaggaggacgatgaagaatcaggcagattaaggtttaaaacggaacggaaagagggcaccattatccgcctctcagacgtcacccgggaaaggagaaatatccccgagactctggagctttccgctgaagccaaggcagccctgctggaatttgaggaacgcgagcggcaacataaacaagggcgctattctagcaggagaggcggcagacgtggggggccattgatgtgccggggggttggagatcagaggcgggaatcaactgagcgggggcgtatgaaagatcatagaccggctctgctgcccactcagccccctgtggttccccaagccccgcccccacctccaccacccccccaacagcagcccattcggtccctttttcagccacagccactgcagcccctcctgcccgtgcagcatccccaccatccttctcctcctcaaggaatgcacatgccgccccaactggaaactcctagaatgatgatgaccccccctcccgtcaccccccagcaacctaaaaatattcatattaacccacactttaaaggcactgtggtgactccagttcaggttcccctccttccagtcccgtcccaaccccgtcccgccgtggggccccagcggtttccggggccacccgaattcccacagcacacccccgggcccgtacccaattctttctctcagccgccccgcctccccctccaggatcagtggcgggccccccctcccccccaggaccgagaccctttcttcctgggagtatccggcgagccacgattcccgtcacacttgttcctggagcagcgttctcctcccccgcccccacctccgccgacccttttgaattcctcccatcctgtcccaactcagagccccctgcccttcactcagccaggcccagcctttaaccagcagggacaacagccagtcttcccacgagaaaggccggtccggccagcgttgcaaccccccggtcctgtcggaatcctgcacttcagtcagcctggctcggctaccacacggcccttcattcccccaaggcaaccatttctgcctgggccgggccagccctttctaccaacacacacccagccgaacctgcagggtcctctgcatcccccactgccacccccccatcagccacaacctcagcaaccacaacagcaaccaccaccccagcatcagcccccccatcaacccccacaccagccaccgcctcaacaccagccacccccacaacatcccccacagcatcctcctcagcaccaacaccaccaccatcatcaccatctatccgtgcccccaccccccctgatgcctatgtcccaaccccagtttcgtcctcatgtgcagaccgcgcagcctcaagctagcagcagcagaatgcagtgtccacagagacagggcttgaggcacaacacaactagtcagaacgtgtccaagcgacctatgcagcaaatgcagcctacagctcctcgaaactctaacttgcgagagttacccattgcccccagccacgttatcgaaatgtcttcaagcaggtgcagcgccacacctagcgcccaggtgaagccaatagtttccgccagtcccccaagtcgtgccgtagcggggagccgaagctcacaggggaaaactgaagtcaaagtgaagcctgcttcccccgtcgctcagcccaaagaggaggcaaagacagaaactgagttcccggatgaagatgaagaaacaaggctttacagactgaaaatagaggagcaaaagcgactccgtgaagagatcttgaagcaaaaggagcttcgccggcagcaacaggctggcgccaggaaaaaagagctgctcgagaggttagcccagcagcagcaacagttgtatgcgccacccccccctgccgaacaggaggagcaggccctgtctccgtctcctaccaacggaaatcccctgttaccattccccggtgcccaagtgcggcagaacgtcaaaaaccggttgcttgtcaaaaaccaggacgtttctatttcaaatgttcagcccaagacttctaacttcgtcccctcatctgcaaacatgcagtatcagggccagcaaatgaaggccctaaagcacttgcgccagacaagaactgtgcctcagagtcagacacagccgctccataaggttcttcctatcaagcccgccgacgtcgaggagcctgctgtaccccagacgccaagggtggccagtatacagggcaggccacaggacacaaagcccggcgttaaaagaactgtcacccaccggacaaactccggcggcggtgacgggccgcacatttcttccaaggtgcgtgtaatcaagctcagcggcggtggaggcgagtctgatggcttctttcacccagagggccagccccaaaggctgccccagcctcctgaagtcggcccacagcccgcccgcaaggtcacactgactcggggcggcctgcagcagcctccgcacctgcccgcaggaccacacgcccactctcccgtgcctccaggaatcaagagcatccagggcatccaccctgccaagaaggccattatgcacggaaggggacgcggagtggcagggcccatgggacgcggacgtctgatgccgaacaagcaaaatctgcgcgtggtcgagtgcaagcctcaaccatgtgtggtatccgttgagggcctgtctagcagcactaccgacgcacagctaaagtccctgctaatgtctgttgggcccatccagtctctccagatgctcccacaacagcgtaaggcaattgctaagttcaaggagccagctcatgcattggcctttcagcaaaaattccaccgtcacatgatcgacctatctcacatcaatgtcgccctgatcgtggaatag

SEQ ID NO: 33201 - DNA, 87 bp, Artificial Sequence
  Description of Artificial Sequence: Synthetic coding sequence
atgcatgggcggggaaggggcgtggcagggcctatggggagagggaggctgatgcctaacaagcagaacctgcgcgtggtcgagtag

SEQ ID NO: 33202 - DNA, 1278 bp, Artificial Sequence
  Description of Artificial Sequence: Synthetic coding sequence
atgagtaagaggaagaggaaacggagcgtacaagagggggagaatccagacgacggcgttagaggctccccgcccgaagactaccgcctcggccaggttgcctcctcacttttcagaggcgaacatcactctaggggcgggacgggtcggttagcaagcctcttttctagtcttgaacctcagattcagcccgtgtacgtgcctgtacccaagcaaacaatcaagaaaacaaagagaaatgaggaggaggagtccaccagccagatcgaaagaccccttagccaggagcccgctaagaaggtaaaggccaagaagaaacacaccaacgcagagaagaaactggcagaccgggagagtgcactagctagcgcggacctcgaggaggaaatccaccagaagcagggccagaagaggaaaaactctcagcccggagttaaggtggccgatagaaagattcttgacgacactgaagatactgtcgtgtcacagcgcaagaagattcagattaatcaggaggaggagaggctcaagaatgaaagaacggtgttcgtgggcaatctgccagtgacatgcaataagaaaaaactgaagtcctttttcaaagagtatggacagatcgaatctgtacggttcagaagcttaatccctgcagaggggacattgagcaagaaacttgcggcaatcaagcggaagatccaccccgaccagaagaacatcaacgcctacgtcgtatttaaggaggagtccgctgccacacaagctttgaagaggaatggggctcagatagccgatgggtttcgtattcgtgtcgatctcgcgtctgagacctctagccgtgataagagaagtgtctttgtagggaatctgccatacaaagtcgaggaatccgctatagagaaacacttccttgactgcggctcaataatggctgtcaggatcgtgcgcgacaaaatgactggtatcggaaagggcttcggctacgtcctcttcgagaacacggattccgttcatctggctcttaagttgaacaattcagaactgatgggccgaaaattgagagtgatgcggtcggtgaacaaagagaagtttaaacagcagaattctaatccccgcctcaaaaacgtgagcaaacccaagcagggtctcaacttcacaagcaagactgccgagggtcaccccaagtccctgtttataggggaaaaagctgtgcttctcaagaccaagaagaagggtcagaaaaagagcggtaggcccaagaagcagcgcaagcagaaatag

SEQ ID NO: 33203 - DNA, 936 bp, Artificial Sequence
  Description of Artificial Sequence: Synthetic coding sequence
atgaagcgagtaaactcttgcgttaagagtgatgagcacgtgttagaagaactcgaaactgagggagagcgccaactgaaaagtttgctgcaacaccagctggatacctctgtctctattgaagaatgtatgtccaagaaagaaagcttcgcgccaggcaccatgtacaaacccttcggaaaagaagccgccggtaccatgacactgtcgcagttccagaccctccacgagaaggatcaagagacagcctctctgagagagctaggcctgaacgagactgagatcctcatctggaaaagccacgtctctggggaaaagaagaccaaactgcgcgcaaccccagaggcaatccagaatagactgcaggatatagaggaaaggatctccgaaaggcagcgtatcctctgtcttccgcagcgtttcgccaagtcaaaacagctaacccggcgagagatggaaattgaaaaatcgttgtttcagggcgccgacaggcattctttcctcaaggcattatattatcaggcttaccacaagaaaacttctgctgataagtatatgacatcgatgaagagaaagatcaagctcggtaccaaggacgagccccagaaaaagaacaagggagacccaatgaataatttggagtcattttaccaggagatgataatgaaaaaaagactggaggagttccaactgatgaggggactgacatccttcccccgagaggacttccaaaatctgtcttacgagggaacaacctccgttctgggggccaagtggcagaaacggacaggacggacgtcaactttttccatattattagtgtcactactgagcgaaactgttttcaccagttccgccatgtacggtatccctcacctgctcactatgagtctaaagttcagcacgagaattggcaaactcagctttacgccctag

SEQ ID NO: 33204 - DNA, 1242 bp, Artificial Sequence
  Description of Artificial Sequence: Synthetic coding sequence
atgaagagggttaacagttgcgtgaaatccgatgagcatgtcctggaagagttggagacagagggagagcggcaactcaagagccttttgcagcaccagctggatacttctgtcagcatagaagaatgtatgtccaagaaagaatcgttcgccccaggcactatgtataagcccttcggcaaagaggctgctggtacgatgacgctgtcccagtttcagacccttcacgaaaaagaccaagaaactgcctctctccgcgagctcgggctcaatgagactgagatcctgatctggaaaagtcatgtctccggagagaaaaaaacgaaactgagggccactccggaggcaattcagaatcggctgcaggatatagaggaaaggatatctgagagacagcggatcctctgtctcccccagcgctttgctaagtcaaagcaattgacaaggagagaaatggaaattgagaagtccttgttccagggtgcagatcgccactcatttctgaaagctctctactatcaggacgaaccacagaagaaaaacaaaggagatcctatgaacaatttggagagtttttatcaggagatgatcatgaagaagcggctcgaggagttccagctcatgcgcggggaaccatttgccagtcactccctggtgtcagctaccagcgtaggtgactcggggactgctgaaagcccaagcttactccaggataaaggaaaacaggctgcccaaggaaaagggccatctctgcacgtggccaatgtaatagacttttcgccagagcagtgttggaccggacctaagaagctcacacagcctattgagttcgtgcccgaggatgagatacagcgcaatcgcctttctgaggaggaaataaggaaaatccccatgttttcgtcttacaaccctggcgagcccaacaaggtgctgtatctgaaaaatttatcacccagggtgacagagagggatttggtgagcctgtttgcaagattccaagaaaagaaaggcccccccatccagttccggatgatgaccgggcgcatgagggggcaggctttcattacctttcccaataaggagatcgcttggcaggctcttcacctggtgaacgggtataaactgcacgggaaaattctggtcatcgaatttggcaagaataaaaaacagcggagtaacctgcaagccacaagcctcatctcttgcgcgaccggcagcacaactgagatttcaggatcttag

SEQ ID NO: 33205 - DNA, 618 bp, Artificial Sequence
  Description of Artificial Sequence: Synthetic coding sequence
atgaagagagtgaactcctgtgtaaaatcagatgaacatgtcctcgaggagctagagaccgagggggagcgccaactgaagtctctgttgcagcaccagttagatacctcagtctccatagaggagtgtatgagcaaaaaggagtccttcgctccaggtacaatgtataagccattcggaaaggaggcagctggtacaatgactctaagccagtttcagacactacacgagaaggaccaagagactgcctctctgcgcgaactcggcctgaacgaaactgaaattctgatctggaaatctcacgtctctggggaaaagaagaccaaattgcgggcgacccctgaggccattcaaaacaggctgcaagatatcgaggaaagaataagcgagcgtcaacgtatcttgtgccttccccaaaggttcgcgaagagcaagcaacttactaggcgtgagatggagatcgaaaagtctctattccagggcgccgatcgacactcattcctcaaggcactgtactatcaagcctatcataagaagacctccgctgacaagtatatgacatctatgaagcgaaaaatcaaactcggtacgaagggtataatcccgaacccgccttag

SEQ ID NO: 33206 - DNA, 1218 bp, Artificial Sequence
  Description of Artificial Sequence: Synthetic coding sequence
atgaaaagagtcaactcatgtgtcaagtctgacgaacatgtgctggaggagctggaaacagagggggaacgccaacttaagtctctgctgcagcaccagctcgacacttcagttagtatcgaggagtgcatgtctaagaaggaatcattcgcgcccggcacaatgtataagccttttggaaaggaagcagccggaacaatgaccctgagccagttccagacactacacgagaaagatcaggagaccgcatctcttcgcgaacttgggttgaatgagactgaaattctcatctggaagagccatgtgtcaggcgaaaaaaaaacaaagctcagggctaccccagaggccatccaaaatagacttcaggatattgaggaacgcattagcgagaggcagagaatcctttgtctcccccagaggttcgcaaagtctaagcaattaactcggcgcgagatggaaattgaaaaaagtcttttccagggcgccgacagacacagcttcctcaaagccctctattaccaggacgaaccgcagaagaagaataaaggagacccgatgaataacctggaaagtttctatcaagagatgattatgaagaagcgcctcgaggagttccagttaatgcgcggcgagcccttcgcctctcactctcttgtgtctgccaccagcgtcggcgatagcgggacggcagagtctccttctttactccaagacaaaggaaagcaggctgcccaaggcaagggccctagtcttcacgtggccaatgtcatcgacttctcgccagaacagtgttggacgggcccaaagaaattgacacaaccaattgaattcgttcccgaggatgaaattcagagaaaccgcctgtctgaggaagagatcagaaaaatccccatgttctcttcttacaaccctggcgaacccaataaggtgctgtacctgaagaatctatctcctcgtgtgactgaacgtgatctagtttctctctttgcaaggttccaggaaaagaagggcccgcctatacagttcagaatgatgaccggcaggatgcgtggccaggcatttatcacctttccaaacaaggaaattgcatggcaagccctgcacttggttaacggatacaaattgcatgggaaaattctcgttatagagtttggtaagaataagaagcaaaggtctaatctccaagccacttctctcattagctgcgctactggttag

SEQ ID NO: 33207 - DNA, 612 bp, Artificial Sequence
  Description of Artificial Sequence: Synthetic coding sequence
tgagttaatagctgcgtgaaatctgatgaacatgtgctggaggagctggagaccgagggtgaaaggcaactcaaatcacttctccagcatcaacttgatacctcagtaagtatcgaagagtgcatgagtaagaaagaatcatttgccccgggaactatgtataagcccttcggaaaggaggcagcaggcactatgacactgagtcaatttcaaacactgcatgaaaaggaccaagagaccgcctcgctgagagagttgggtctcaacgaaaccgagattcttatatggaagtcccacgtgtcaggggagaagaaaacgaagcttagggcgactccagaggcaatccaaaatcgcttgcaagatatcgaggaaaggattagcgaaaggcagaggatcctctgtttgcctcagaggttcgcaaaaagtaagcagttgacgcggagggaaatggaaattgaaaagtcactgttccagggggccgacaggcactcatttcttaaggcactatactatcaagcataccacaaaaagacatcagcagacaagtacatgaccagtatgaaacgaaagataaagctgggtacaaagggcattatccccgaagaaccttag

SEQ ID NO: 33208 - DNA, 3159 bp, Artificial Sequence
  Description of Artificial Sequence: Synthetic coding sequence
atgatgcaagctacagctgtagtggagacagcttcagggaagggttaccacagcaacgggggcaacttgcaaaaggacaagccatcaaacccaaaaaaggagaaccttctgctttcttccaatgggtgtgatgaagtgaagctgacattccccgatgatgattggaacagctccacactcgagcaacgcgccaataataaggaaatctcgaacattgacaagatggatctgttggaaccctttttctctgtgtctcaagacaccaataccgagagcacccaattccagtcctccgaacttgaagattccacagactatgctttcctgaacaagacctacagcattccatacagcgagagcaaactgaagaaggagtctcttacgccgctaagcagtgaactggaccctgaagtccagaagaaggaagaggtgttcttcaatattttagaacaccaggataagaccgtgggactcgagcggatttacaacatcagtgatgccaactatagagagtcagccgaggatacccaaaaacatgatacggacgaggattctcagcaggagtatcattccgccgaggagcaggagtacatctccaatcatctctcttttgatcagacaaaggcccttgacatcagtaatcctgaggttgtggaactcggcaactctggttacgaggtcaaatgtgcttccaacgtggaggataatagagtgaactccggtagcggttcaatcatcagctttgactctcttgatgtgtatggccaggaggagtctctgcatgtttctaaattccagaatagcgtgatgctccgggaataccatgatttgaagcacgaaaaatacaaggaacaggagaccaatagcatgtatcatacagtgtttgacggttccgtcctgagatctaacagcccgggcaatcaggagtcacaatccaaatcgggtagcctgtcaccacaaaaagtgctcaagatgaaaatttatacagaaaatatgaagtcccagataaacgaggggaaggatttctgtgggaataagatagtcgagaataagatcctcttgcatctcgagaaccccagtaccctgccacaggacaaggcactcgaaaccctcctccagccctgtaaggattgccaaaccagctggacgtctgtcttcgacgactctattatttctgcatgcgggtattacgagtcactgcaaaacaccgccgactctgccttagatttctcagccatgctgccaaagattgcggtgcgggataaccaggccatcgaggacaatacgtcattgaaggtcgcccatagtagtaccactaagaaaacctgtttccataacatcggcgagatgtgcaccaaatctctgaccgatgctgccagttgcacggtcacgatcaaccagactgtcgacgtttctactgactttcgggcatgcttcaccactagtcgcgccacaagtgcgagaccctctgtggtatctaccagttctaataccgaaattaccatgatgaacaaaaagcgccctgacgaatggcagaatgaaaagcagaaaagcgtcgcatgttccacagactggtcatatagtgaggattgcatcgatacacaaatggccattacaaaggggtcagggaaatctctttctgtcgatagtctgaaacctaacgggaatttcttaaacaaggattttctggagctgagaaaggcgtgtgggattaccgatctcaagaagcaccctgagagggagttccaactgttcaaggatacagaaaaagacctgccctcaatgtgctgtcagaagatcatgcagcgcgcaattaaagcagagctgcatctgcttaacgtacattaccagatgtgcagacgccattgttgcgatatttacaaactcgtgatggagaatcgggagggtctgaacatgaacctttcatcaaattccgctaagaaagaacttggaagtgccctcttgagcttgctgggagaccttaaggtaaggtacgtgacactgaaagaaaagatacacaagggcatccctctggaggaactgccccccctatccttggagtcgaaacttctctctactttcagcacattcgcttctcgtcttatgaaaaaagaaacccatgtgttctccgaagctgacgccgaacaggacaatcagcgtgctcacgacgtggatgtgtcatctaatctcaagaaaaccctgtctcagatgagcctgtctagcgataattcacacgctacccagaatatctccccaaagaaagacgattttaagaatggcgacataaatgccgatttcagccaactcaaactcggagacaaggactgcaggcactaccaggaaacgtctgaggattggagtgacgcgaaggagagcctcaccggagtggacgtctccggaactcagggaaatcaagtggaacaagacacttggaacctcgacctgactggggagatgaaaaacgttgagcccagccagcgcgataaaggttacctcattcacgtaggcgggctgtgtccttcagtgtccgaggctgacctacggtcccattttcagaaatatcaggtttccgagatcagtatctatgatagcactaattatcggtacgcatccctggcctttactaagaactctgacgccaagattgccgtgaaggagatgaatgggatcgaaattaacgggaaatcagtgaatgtgtggcctgtaaaaatactgggagagtatacatctcctctctctagcaagaacggcaatagaatctcatccaataatctggagaaaagcaccaataaacaaatccacagcgaattcagcatttcgcgccttccacgaacacggccccgtcagctgggtagcgagcaagacagcgaagtgtttccatcagaccagggcgtgaaaaagaactgtaagcagatcgaatctgcaaaactgctccctgatactcccgtgcagttcataccaccgaacaccctgaatctgcgctcttttaccaagatcatcaaaagattagcagaactgcatcctgaggtttctcgggatcatattatcaatgccctgcaggaggtgaggataagacacaaaggttttttgaacggcctctccatcacaaccattgtcgagatgacttccagtctcctcaaaaattccgccagttcctag

SEQ ID NO: 33209 - DNA, 3159 bp, Artificial Sequence
  Description of Artificial Sequence: Synthetic coding sequence
atgatgcaagcgactgctgtggtggaaacagcctcgggaaagggctaccattcgaatggtggcaatttacagaaagacaagccctcgaaccccaaaaaagagaatcttctcttgagtagcaatggctgtgacgaggttaagctcaccttcccggatgatgactggaacagttctaccctagagcaacgggctaacaacaaagagatctctaatattgataaaatggatctgctcgagccattttttagcgttagccaggataccaacacagagtccactcagttccaatcgagcgagcttgaggacagtactgactacgcctttctgaataagacttactcgatcccctatagcgagtccaagttgaagaaggaaagcctcacccctctcagcagcgagctggatcctgaggttcagaagaaggaagaggtgtttttcaatattctcgaacatcaggataaaaccgtcgggctggagagaatctacaacatctcggatgctaattatagggaaagtgcggaagacacacaaaagcacgacacagatgaagatagccaacaagaatatcattccgcagaggaacaggagtacattagcaatcatctgtcatttgaccaaacgaaagccctggacattagtaatcctgaggttgtcgagctcggaaactcaggctatgaagtaaagtgcgctagcaatgttgaggataatcgggtcaattccggctcagggtcgataatctcatttgacagtctcgacgtctacggacaggaggaaagtctgcatgttagtaagttccagaactccgtaatgctcagagaataccatgacctgaagcacgaaaagtacaaagaacaggagacgaactccatgtaccatactgtgtttgatgggtcagtcttgagatccaattctcctggtaatcaggaaagtcagtccaagtccggtagtctgtcccctcagaaggtcctgaagatgaagatctataccgagaatatgaagtcccaaatcaatgagggaaaggacttttgtgggaataagatcgtggagaataagattttgcttcatctcgagaatccctcaactctgccacaggataaagcattggaaaccttgctccagccatgtaaagactgccagacctcctggacctccgtgtttgacgatagcatcatttccgcctgtggctattatgagtctttacagaatactgccgattccgctctagactttagcgcaatgcttcccaagatagccgttcgcgacaaccaagcaatagaggacaacacatctctgaaggtggcccactctagcactactaagaaaacttgcttccataacatcggcgagatgtgtacaaaaagtttgaccgacgctgcttcctgcaccgtgacaatcaatcagaccgttgacgtgtccacagactttcgagcttgctttacaacctcccgagccacttctgccaggccatcagtggtgagcacatcctccaatactgagatcacgatgatgaacaagaaaaggcctgacgaatggcagaacgagaagcagaaatcagttgcctgctccaccgattggtcttacagcgaggattgtatcgatactcaaatggccattactaaaggaagtgggaaatcactgagcgttgatagcctaaagcccaatggcaattttctgaacaaggattttctggaattgcggaaagcctgtggaatcactgacttaaaaaaacacccagaaagagaatttcagctgtttaaggacactgagaaagacttgccatcaatgtgctgtcagaagatcatgcagcgggccatcaaagctgagctgcatcttttgaacgtccactaccagatgtgtaggcggcactgttgcgatatctacaaattggtaatggagaacagagaaggactgaacatgaacttgtcttctaactctgccaaaaaggaattggggagcgcactcctgagcctgctgggggacctgaaagttagatatgtaaccctgaaggaaaagatccataagggcattcccctggaagaactcccccccctaagcctggagtcaaagctcctatcgactttctctacgttcgcctccaggctgatgaagaaagaaacccacgtgttttctgaggccgacgcggagcaggataatcagagagcacacgatgtcgacgtctcaagcaaccttaaaaaaaccctgtcacagatgagcttgagcagtgataacagccatgccacacagaatatctcacctaagaaagatgatttcaaaaatggcgatatcaacgccgatttctcacagctaaagctcggggacaaggactgccggcactaccaggagacatcagaggattggagcgatgccaaagagagcctgacaggcgtagacgtctcggggactcaggggaatcaggttgaacaggacacctggaacctcgatcttacaggggagatgaagaacgtcgaaccatcacaacgggacaaaggctacctaatccacgtaggcggcctgtgccccagtgtcagtgaggctgatttaaggtcccatttccagaaatatcaggtgagtgagatctcgatttacgatagcactaactaccggtatgcatccctggccttcactaagaattccgacgccaaaatcgctgttaaggaaatgaatgggatcgagatcaacggaaagagcgtcaacgtgtggcctgtgaagatcctgggagagtacacttcccccctatcaagtaagaacggtaatcgcatttcctcaaacaacctggagaagtccactaataagcaaatacacagtgaattctcaatttcccggctgcctcgaacacggccccgacagttggggagcgagcaggactccgaggtttttccctcagatcagggagtgaagaagaactgtaagcagattgagtccgctaaactgttgcctgacacccccgtgcaattcattccgcccaatacactaaatttgcggtcgtttaccaagattataaagcgcttggctgaacttcatccagaagtttcgagggaccacattattaatgcactgcaggaagtgagaattagacataagggcttcttgaatggccttagcataacaacaatcgtagaaatgactagctctttgctcaaaaattctgcatcgagttag

SEQ ID NO: 33210 - DNA, 1602 bp, Artificial Sequence
  Description of Artificial Sequence: Synthetic coding sequence
atgaacgaagagaatattgacggtacaaacggctgctcaaaggtgaggacaggcattcagaatgaagcagcccttttggctttaatggagaagaccgggtataacatggtgcaggagaacggacagcgcaaatttggcggacctcctcctggatgggagggtccccctccacctcggggatgcgaggtgtttgtcggcaagatccctcgcgacatgtacgaagacgaattagtgcccgtattcgagcgagccgggaagatatatgaatttagactgatgatggaatttagtggcgagaacaggggatacgcatttgtgatgtatacaacaaaggaggaggcacagctcgccatcagaattctgaataactatgagatacggccgggaaagttcatcggtgtgtgcgtgagtctggacaattgccggctgttcattggagcaattcccaaagaaaaaaagaaggaagaaatcctcgatgagatgaaaaaggtgacagagggagtagtcgacgtgatcgtgtatcctagcgcaacagacaaaaccaaaaatcgtggcttcgcttttgtcgagtatgaatctcatcgagccgcagccatggcacgacggaagttaattcctggaacatttcaactttggggtcatactattcaggtcgactgggcggatccagaaaaggaagtggacgaggaaacgatgcaacgagtgaaggtcttatatgtcaggaaccttatgatctctactaccgaagagactatcaaggcggaatttaacaagtttaagcccggagcagtggagagagtgaagaaactgcgagattatgcctttgtccatttctttaatagggaggatgccgtggcggccatgtcagtcatgaatggcaaatgcattgatggcgcctctatcgaggtcactctggccaaacccgtgaataaagaaaatacatggaggcagcacctcaatgggcagatctcgcctaactccgagaaccttatcgtctttgcgaacaaggaggaaagccacccaaagacacttggtaaactcccgaccctgccagcgcgtcttaacggtcaacactctcccagtcccccagaggtggaaaggtgcacgtatccattctacccggggacaaagctgacccccatatctatgtactcactgaagagcaatcattttaactcagcagttatgcatctcgattattactgtaacaaaaataactgggcccctcctgaatactacctatactctacgacaagtcaagacgggaaagttttgctggtgtataagattgtcatccccgccatcgccaacggaagccagagctactttatgccagataagctatgtactactctggaggacgccaaggagctggctgcccagttcacgctgctgcatctggactataatttccacaggagcagcatcaattctttatccccagtaagcgccaccctgagtagcgggaccccttcagtcctaccgtacacgtcaagaccttatagctaccctgggtaccccttatcccccacaatctctttagccaacggaagccatgtgggccagcgactgtgtatatccaaccaggcctctttcttctag

SEQ ID NO: 33211 - DNA, 1104 bp, Artificial Sequence
  Description of Artificial Sequence: Synthetic coding sequence
atggccagtagcggtggggaactcggatccttgtttgaccaccacgtccagcgcgccgtgtgtgacacgcgcgccaaataccgggagggccggaggccccgagcggtgaaggtgtacacaattaacttggaaagccaatacctgcttatccagggagtccctgccgtgggggttatgaaagaactggttgagcgtttcgcactatatggagcgattgagcagtataatgctctggacgagtatccagccgaagatttcacagaggtatatttgataaagtttatgaacctgcagtcagcccgaaccgctaaacgaaaaatggatgagcaatcattctttgggggtctactgcacgtttgttacgcacctgaatttgagactgtcgaagagacacggaaaaaactgcagatgagaaaagcttacgtggtgaaaactacggagaataaggatcattatgtgacaaagaagaaacttgtaactgaacataaagacactgaagactttcgccaggatttccactcagagatgtcagggttctgcaaagccgccctcaatacttccgccggcaatagcaacccctacttgccatattcatgtgagttgcccctctgctatttctcatccaaatgcatgtgttcgtccggcggccctgtcgaccgtgcacccgatagctccaaggatgggaggaatcatcacaaaaccatgggtcactataatcacaatgacagccttagaaagacccagattaactccctcaagaactccgtggcatgtcccggtgctcagaaggccatcactagctctgaggccgtggataggttcatgccccgcacaacgcagttacaggagaggaagcgaaggagagaggacgatcgaaaactggggacctttcttcagacgaatccaacgggaaatgagattatgattggcccactcctgccagacatctccaaagtggacatgcacgatgactcgttaaacactacggcaaatctcattcgccacaaactgaaagaagtcatttccagcgttcccaaaccccccgaggataagcctgaggacgtgcatacgtcacatcctctcaagcagcgcaggcggatttag

SEQ ID NO: 33212 - DNA, 1083 bp, Artificial Sequence
  Description of Artificial Sequence: Synthetic coding sequence
atggctagctccggcggggaacttggctcccttttcgatcatcacgtgcaacgggccgtgtgcgacacacgtgccaagtacagagagggaaggagacccagggccgtcaaggtgtacactatcaatctggagtctcaatacctcttaattcagggggttcccgcggttggcgtgatgaaagaactggttgagcgcttcgccctctacggcgctatagagcaatacaatgccctggacgaatatccggctgaggactttacagaagtctatcttatcaagttcatgaatttgcagtctgctaggactgctaagaggaaaatggatgagcagagctttttcggcggactgctgcacgtctgctacgctcccgaattcgagaccgttgaggagactaggaaaaagcttcagatgcggaaggcgtatgttgtgaaaaccaccgagaataaggaccactacgtcaccaagaagaagctggtaactgaacataaagacactgaggatttccgtcaggatttccatagtgagatgagcggattttgtaaagccgcactaaacacgtctgcaggtaactccaacccttatttgccgtacagctgcgaactgcctctgtgttacttctcatccaaatgtatgtgtagcagcggtggcccagtggaccgggcccctgactcaagtaaagatggaaggaaccatcacaaaacaatgggccactacaatcacaacgattcattgcgtaagacccagatcaacagcctgaagaatagcgtggcctgtccgggcgcccagaaagcaatcaccagttctgaggccgtggaccgttttatgccaaggacaacacagctccaggagaggaagcggcgtcgagaggatgacagaaaactcggtacattcttacagacaaatcctacaggcaatgaaataatgattgggcccctgcttcctgatatatccaaggtcgacatgcacgacgactccttgaatactactgccaacttgatccgccataagctgaaggaagtattccacttatgccaaagtctgcagaggacttcccagaagatgtacatacaggtaatccactag

SEQ ID NO: 33213 - DNA, 381 bp, Artificial Sequence
  Description of Artificial Sequence: Synthetic coding sequence
ggcaagatggcaagttccgggggagaactaggcagtctctttgatcatcatgttcagagagctgtatgcgatacacgggcgaagtaccgggaaggaagacgccctagggccgtgaaagtgtatactattaacctggaaagtcagtaccttctcatacagggtgtgcctgccgttggagttatgaaggagcttgtcgagcgcttcgccttgtatggtgcaatcgaacagtacaacgctcttgatgagtatccagccgaagactttaccgaggtctatttgataaaatttatgaatctgcagtcggctcgtactgccaagcgcaagatggacgagcaatcatttttttggattgcctcctgtgtcttgtgcagtaggatttag

SEQ ID NO: 33214 - DNA, 969 bp, Artificial Sequence
  Description of Artificial Sequence: Synthetic coding sequence
atgaacccactgacaaaggttaagctgatcaacgagctgaacgaacgtgaggtgcagctgggcgtagcagataaggtgtcctggcattcagagtacaaagacagtgcctggatctttctcggggggcttccatatgaactcacagagggagatatcatttgcgtgttctcccagtatggggaaattgtcaatattaatctggtgagagacaagaaaactgggaaaagcaaagggttctgcttcctctgttacgaggatcagcgctctaccatcctggctgtcgacaatttcaatggtattaagataaagggaaggactataagggttgatcatgtgtccaattaccgcgcacctaaagatagtgaagaaatcgatgacgttaccagacagcttcaggagaaaggttgcggagccaggaccccttccccgtctctctcggagtcgtccgaggatgaaaaacccaccaaaaagcacaagaaggacaaaaaggaaaagaagaagaagaagaaagagaaggagaaggccgacagggaggtgcaggccgaacagccaagttcatcctcccctcgaagaaaaacagtcaaagaaaaggacgacacaggccctaagaaacactcctcgaaaaacagcgaaagggctcagaaatcagagccccgggaagggcaaaaactgcccaagtcccgtactgcttattccggaggagctgaggacttggagcgcgaattaaagaaagaaaaacccaaacacgaacacaagagttcttccagaagagaggcccgcgaagaaaagacgaggatccgggatagaggccgcagttccgacgcacatagctcttggtataatgggagaagcgaaggaagatcttatcggtcaagaagccgaagcagagacaagagtcaccggcacaagcgtgcccggcgttcacgcgaacgtgagtcgtctaatccttcagaccgctggagacattag

SEQ ID NO: 33215 - DNA, 177 bp, Artificial Sequence
  Description of Artificial Sequence: Synthetic coding sequence
atgaatcccctcacaaaagtgaagttaatcaacgagctgaacgagcgtgaggtccagcttggggtggcagacaaggttagctggcactccgaatataaggactctgcatggatcttcctggggggtctgccctacgaactcacggagggggacatcatttgcgtgttcagccagtag

SEQ ID NO: 33216 - DNA, 828 bp, Artificial Sequence
  Description of Artificial Sequence: Synthetic coding sequence
atgaatccccttactaaggtgaagttgatcaacgagttaaatgagcgggaagtgcagcttggcgtggccgataaggtctcctggcacagcgaatataaggactccgcctggatctttctcggagggctgccctacgagctgaccgagggggacatcatttgcgttttttcgcaatacggggaaatagtgaatattaacttggtgcgcgataagaaaacagggaaatccaaaggattctgtttcctgtgctacgaggaccagcggagtactatcctggccgtggacaatttcaatggaattaaaattaagggtaggacaattagagtggaccacgtgtcaaattaccgggcccccaaggattcagaggagatcgatgatgtgactcgacagttgcaggaaaaagggtgtggagctcgaactccatctccaagtctgtcagaatcttctgaggatgaaaagcccactaagaagcacaagaaagataagaaggagaagaagaagaagaaaaaagaaaaagagaaggcagacagggaggtccaggcggagcaaccctcgtcttcctctcccagaaggaaaacagtgaaggagaaggacgataccggtccaaagaaacatagttctaaaaactctgaaagagctcaaaagtctgagcctcgggaaggccagaaacttcctaaaagtagaactgcctacagtggcggcgccgaagacctcgagagagaacttaagaaggaaaagcctaagcacgagcacaagagtagcagccgacgagaagctagggaagagaagactcggattcgcgaccgcggcctgaggtgcaccttttag

SEQ ID NO: 33217 - DNA, 3204 bp, Artificial Sequence
  Description of Artificial Sequence: Synthetic coding sequence
atgatggaggctgacaggccagagaagcttttcatagggggactgaacctcaaaaccgatgagaaggccctaaaagccgagttcggaaagtatgggcatattattaaggtgttcttaatgaaggaccggaagactaataagtctcgtggattcgcgtttgtaaccttcgagagtccagccgatgcaaaggcagccgcaagagatatgaatggaaaatatcttgatgggaaagctattatggtcgcccaaacaatcaagcctgcctttaagagcagtaggtgggtccctcctactcccggcagcggatctaggtcccgcttcagccatcgtactcggggaggaggaagtagccctcaaagacccccctcgcagggccgcccagatgacggaaggggctacgcggggtattttgacctgtggccttatagagctcccatgccccggaaaagaggccctcccccgaggcattgggccagtcctcctcacaagcgggctacccccagttccctggcccacagcgtgggatgcggcatgagagggaaggcccctacagtatcaggacaggatggctattctggcctgcagccccgacgctgggctggacccccccacaagagggcagttcccagaagctcactcgcccggattggaggtagtggaatgccaggaaaggcccccgccgtgtggggccaggacggatattcgggacccagggtgcgggaaccattgcctccgtgccgggatccaggagacttcgtgccggcactccgggactatagccgaaggtattatggtcattcctctgtaccggattacaggcctctacgcggggacggtaaccagaatggatatagagggcgggaccatgaatacactgatcacccaagtaagggctcctacagagagccacttaagagttacggcggcccatgtggggcagctcccgtgtggggaacacccccgagctacggcggcggatgccgttacgaggaatatcaggggaactcccccgacgcctgcagtgaaggtagaagctccgaggctctccctgtcgtccttcccgacgcctatagtcgggaccattccccgaaggcctattcgggagggagatcttcgtcttctaatggttactcgcgatctgataggtacggggaagaagggtgttacgaagagtatcgggggcgaagtcccgacgcccactccggcggcaggaactcctcttcaaatagctacggtcaatctcaccactacggaggcgaaggtaggtacgaagaatatagaggacgatctcacgaagccaggagcgggggacgctctactgatgctcacagccggggccggtcagatgatgcctacagcgggggacacgatagcagtagctggagcgattgttgcggaggtggtggccggtatgaggagtaccaagggcggtccctggacgctaacagcggtgggtgctcaccggaggcctatagtggtgggcatgacaactcctcatggtctgaccgctatggcgtgggcggacactacgaggaaaatagggggcacagcctggatgctaatagcggtggacgctctccggacacacactccggcggccactcatccagctctaactcatacggccaatctcacagatatgggggggaaggcagatatgagtaccgaggccgtagccacgatgcgcacagtggtggctgttcagcagatgcgtattctggaggacatgactcttccagccagtctaaccgatacggaggtgggggatgctacgaggagtatcgtggtaggtccttagacgcgaatagcggtggacgtagtccaaatgcctactctgggggccatgattcgagttcatggagtcacaggtatggcgggggcggcagatatgaggagtatcgcggacggtcactggacgcaaactccggtgggcggtcccctgatgcatattctgggggacatgacagtagcggccaaagcaattgctatggaggcggtggcagatatgaagagtaccgcgggcgtctcctggatgcgaactcaggaggacgctcacccgatgcctacagcggaggccatgactcttcttctcaaagcaataggtatgggggtggcggccggtacgaagaatacaggggccatagcctggacgcaaacagcgggggacggtcccctgacacttacagtagagggcatgatagctcctctcagtccgatcattacggagggggtggacggtcgctggacgccaactcttccggaagacttcctgatgcctactctggcggacatgatagttcgtcgcggtcccacaggtatggcggagggggaagatatgaagagtatagaggacgtagtctggatgctaatagcggaggcagatcaccaaatgcttacagcggaggccataacagttcgagcagaaacgacccttgccgcggtgggggaagatatgaggagaatcgcggacactccttggacgcaaactccggcgggcattcacccaacgcatattctggcggacgggattctagttctaactcttacgatagatcccaccggtacgggggagggggccactacgaggagtaccggggtaggtcccacgacacacactctaggggacgctcgccagatgcacattctggggaccattacaccgaagcctattcccgcggccgtgattcctttagcaattcttatggtaggtctgaccactacggccgcggcgggtgctatgaggagtatcaaggacggagcccgaacgcatatggcgggggacgagggctaaacagctccaacaatagccacgggcgctctcatagatacggaggcggagggcggtacgaggagtacaggggacccagtcccgatgcccacagtggtggcagagactcatccatcaagtcttatggcctcagcgaccgctatggtggcggagggcattacgaagagtaccagggatcactgcccgatgcctattcaggcgaccatgatcggagctctaatagctatgggaggtcagaccgctattcccgcggaagagaccgggtcggccggccagaccgtggtctgccacttccgatggaaactggttcgccgccgctgcatgatagttattccagatcaggttgccgcgtacccaggggtggtggtaggcagggcggaaggttcgagcgtggggaaggtcgctcccggtactag

SEQ ID NO: 33218 - DNA, 1491 bp, Artificial Sequence
  Description of Artificial Sequence: Synthetic coding sequence
atggtggaggccgatcatccaggcaagctatttattggtgggctcaacagggagacgaacgaaaagatgctgaaagccgtgtttggaaaacacggtccaatctccgaagtcctcttaattaaggacagaacatccaaaagtagaggatttgcgtttataacgttcgaaaacccggccgatgccaagaacgccgccaaagatatgaacggcaaatctctacacgggaaggccatcaaggtggagcaagcaaagaaaccgtccttccagtctggcggacgtcgacgtccacccgcttccagcaggaacagaagtccctccggttcccttcgctcggctaggggcagccgtggtggaactagaggctggcttccatcccaagaggggcatctggatgatggcggctacacacctgatctcaagatgtcttactcccgggggctgatcccagtcaaaagggggccatctagccgctctggaggtccaccccctaaaaagtctgctccctccgctgttgcccggtcaaattcatggatgggatcacagggtcctatgtctcagcgtcgcgagaattacggtgtgccgccgcgccgagccacaattagctcttggaggaacgatcgcatgtccacacgccatgatgggtatgccacaaacgatgggaatcatccaagttgccaggaaacccgcgattacgccccaccatcacgcggatatgcctatcgggacaatggtcacagtaatagagatgaacattcctcaaggggttacagaaaccacagatcttctcgagaaacccgggattacgctcctcctagtcgcggtcacgcttaccgggactatggccactctcggagggacgagtcctacagcagaggataccgcaaccgccgctcctcgcgcgagacccgggaatacgcccccccatcccgcgggcatgggtaccgggattacgggcattcccgaaggcacgagagttactctagaggctaccgcaatcatccgagttcccgagaaactagggattatgctcctccccaccgcgattacgcctatcgggactacggccactccagctgggacgagcactcttcaaggggttattcctatcacgacgggtacggggaggccctgggaagagatcactccgaacacctgagtgggagctcttacagggacgctctccagcggtatgggacctcacacggggcaccacctgcccggggaccccggatgtcttatggaggctcaacctgccacgcgtattccaacacacgcgataggtacggaagatcatgggagtcatatagtagctgcggcgacttccactactgcgacagggagcacgtgtgccggaaggatcagcgcaatccaccttcactgggaagagtccttcccgaccccagggaggcatatgggagtagttcatacgttgcttccatcgtggacggaggagaaagtcgcagcgagaagggagattcaagccggtactag

SEQ ID NO: 33219 - DNA, 1491 bp, Artificial Sequence
  Description of Artificial Sequence: Synthetic coding sequence
atggtagaggctgatcacccgggcaagttgtttataggtgggctgaatcgggagacaaacgagaagatgttgaaggctgtattcggaaaacacggacccatttctgaagtacttcttatcaaggatcgtactagcaagagccgggggttcgctttcatcactttcgagaatcccgccgacgcaaaaaacgcagcgaaggacatgaacggtaaatcactgcatggcaaagcaattaaggtggagcaggctaaaaaaccgtccttccagtccggtgggaggcggcgacctccagcgtcaagccgaaacaggtccccttccggcagcctgcggagcgccaggggtagcagagggggcactcgcggatggctcccttctcaggaggggcacttggacgacggagggtatactcctgatctgaagatgtcctactctcggggattgattccagtgaagcgcgggccctcaagtcgcagtggtggaccccctcctaaaaagagtgccccttcagccgtagccaggtctaattcctggatggggtctcaggggccaatgtctcagcggagagagaactacggcgtgcctcccagaagagccaccatcagttcttggagaaatgaccgtatgtccacacgacacgatgggtatgctactaatgatgggaatcaccccagctgccaggagactcgcgattacgctcccccatcccgcggatacgcttaccgagacaacgggcactcaaatagggacgaacacagctcccggggttatagaaaccacagaagcagtagagaaaccagggattatgctccgccttcgcgaggacacgcctatcgggattacggtcattctcggagggacgagagctacagtcgggggtaccggaatagaaggtctagcagagaaacaagagaatacgccccaccttccaggggccatgggtacagagactatggacacagcaggcgccatgaatcatacagtaggggctaccggaaccacccgtcatctcgcgagacacgggattatgcgccgcctcaccgggattatgcctatcgtgattacggccactcttcttgggacgagcatagcagtagaggttactcctaccatgacggctatggcgaggctttgggccgggaccattcagaacacctatctgggtcatcgtaccgggatgccctgcagcgatacgggaccagccacggggcccctcctgccaggggaccacggatgtcctacggggggagcacgtgtcacgcatatagtaacacaagagaccggtacggacggtcctgggagagctacagcagttgcggagatttccactattgcgacagagagcatgtttgtcgcaaggatcagcgcaatccgccatctctgggccgagtcctgcccgacccaagggaagcatgtggatccagttcatacgtggcctctattgtggacggaggggagagtaggagtgaaaaaggagacagtagccgatattag

SEQ ID NO: 33220 - DNA, 1491 bp, Artificial Sequence
  Description of Artificial Sequence: Synthetic coding sequence
atggtcgaagctgatcatccagggaagctgttcatcggagggctcaacagggagaccaacgagaaaatgctcaaagctgtgtttggcaagcacggccctatctccgaagtactgttaatcaaggacagaacaagcaaatccaggggattcgcattcataacctttgagaatcctgccgacgccaagaatgccgccaaggatatgaatggaaagtccctgcatggaaaggctattaaggtggagcaggccaaaaagccctccttccagagcggcggacgtagaaggcctcctgcctcaagtagaaacaggtcacccagcgggagcctgagatctgcaaggggctctaggggaggcactagaggatggcttcctagccaagagggccacttagacgacggaggttacacccccgatctcaagatgtcttattcaaggggcctgatccccgtgaagaggggcccaagcagtagaagcggcggcccaccacccaagaagagcgcgccaagtgccgtagcccggagtaattcctggatgggctcacaaggccctatgtcccagcgccgggaaaactacggggttccaccgcgaagagccaccatatcctcttggagaaacgatagaatgagtacaaggcatgacgggtacgcaactaatgatgggaaccatccttcatgtcaggagacacgcgattatgcacccccctcccggggttatgcctacagggacaacggccatagtaacagagatgagcattccagcagaggataccgaaaccatagatcatcacgcgagacccgagattacgccccccccagtcgtggtcatgcataccgagattatggacattccagaagagatgaatcatacagcagaggctatcgcaataggaggagcagtcgcgagacaagagagtacgccccaccctctcgagggcatggctaccgcgattatggacacagtcgtcggcatgaatcctattcacgcgggtacaggaaccatccctcctcccgagaaactcgggactacgcacccccacatcgtgactacgcctatagagactacggccacagttcctgggatgaacacagttccaggggatattcgtatcatgatggctatggcgaggctctggggcgcgaccactctgagcacctgagcggatctagttacagggatgccctccagagatatggaactagccacggcgctccacctgcccgcggaccccgtatgtcctacggcggcagtacctgccacgcgtactcaaacacaagagaccggtacggcagatcttgggagtcttactcttcatgcggagactttcactactgcgaccgtgagcatgtgtgtaggaaagaccaaaggaacccaccttcgttaggccgggtgctacccgatccgagagaggcctgcggctctagctcttatgtggcttcaattgtagacggaggtgagagtcgatctgaaaaaggcgattctagccgctactag

SEQ ID NO: 33221 - DNA, 1380 bp, Artificial Sequence
  Description of Artificial Sequence: Synthetic coding sequence
atggtggaggccgaccacccgggcaagttgttcattgggggtcttaaccgggagacaaatgagaagatgctgaaagcggttttcggcaaacacgggccaatttccgaagttctgctaatcaaggaccgcactagcaagtcgaggggcttcgctttcatcacattcgagaacccagccgatgcgaagaatgcagcaaaagatatgaacggcaagagcctgcacgggaaagccatcaaagttgagcaggcaaaaaaaccttctttccagtccggcggcagacgtcggcccccagcatcgtcacgcaaccgctcaccttccggcagtctgcgcagcgcacggggatcaaggggtgggacccgagggtggctgcctagccaggagggacatctagatgacggcgggtacactcctgacctgaaaatgtcttattcacggggcttgattccagtcaagcggggaccttctagcagaagcgggggacccccaccaaaaaagagcgccccctccgcagtagccagatctaatagttggatgggttcccaggggcctatgagccagcgccgggaaaattatggcgtgccacctcgccgtgctaccatctcgtcctggagaaacgatcgcatgtccacacgacatgatggttatgctacaaatgatggtaatcacccatcttgtcaggaaacccgggattacgcaccaccaagccgagggtatgcctatcgggacaatggtcacagtaatagagacgaacattccagcaggggttatagaaatcacaggagttcacgcgagacacgcgattacgcgcccccatcaagagggcacgcatatcgcgactacgggcactcccgacgggatgagagttactctcgcggctaccgcaatagaaggagctctcgtgagacccgagagtatgctccaccttcgcgaggccacggctatagggactacgggcattctagacgccacgagagctactctcgggggtatagttaccacgacggctacggagaggccttgggtcgcgaccacagtgaacacctgtccggttcttcataccgagatgccctgcagcgatatggaacctctcatggggccccccctgccaggggtccccggatgtcctacggaggctcaacatgtcacgcttacagcaatacccgcgatcgctacggacgcagctgggagagctatagttcctgcggggattttcattattgcgatagagagcacgtgtgcaggaaggaccagcggaaccctccctctctgggacgcgtcctgcctgatccccgggaggcctgtggaagctcttcctatgtcgccagcatcgtagacgggggcgagagccggtccgagaaaggggacagctctcggtattag

SEQ ID NO: 33222 - DNA, 1380 bp, Artificial Sequence
  Description of Artificial Sequence: Synthetic coding sequence
atggtagaggccgaccaccccggcaagctctttataggcggcctgaatagagagactaacgaaaagatgctcaaagccgtgttcggcaagcatggtccaatatcagaagtgctgctaattaaggatcggactagcaagtcaagggggttcgcatttatcacattcgaaaatcctgcagacgcaaaaaatgctgcaaaggacatgaacggaaagagcctgcacgggaaggcaatcaaggttgagcaagctaaaaaaccgtcttttcagtctggtggccggaggaggccgcctgcatccagccgcaacaggagccccagcggatcccttagatccgctcgtgggtcccgcggggggacacgaggctggctgcccagccaggagggccacctggatgacggaggctacaccccagacctgaaaatgtcctattctcgggggctgatacctgtgaagagaggcccatcttcccggtcaggtggccctccccccaagaagagcgctccttcagctgtcgccagaagcaacagctggatggggagccagggccctatgtcccaacgacgcgaaaattacggggtccctccacgtcgcgccaccatcagttcatggcgtaacgaccgtatgagcacccgacatgatggttatgccaccaacgacggcaaccacccctcatgtcaggaaactcgagactacgcacctccctctaggggatacgcttacagggataatgggcatagcaaccgcgacgaacactcctcaagaggctataggaaccaccgtagctctagggaaactcgcgactacgctcccccctccagggggcacgcgtaccgggactacggccatagtaggcgagatgagtcttattcaaggggatacagaaatagacggagctctagggaaacacgtgaatacgctccacccagcaggggtcatggctacagggattacggccattccagacgtcacgagagctacagccgcggctattcttatcatgatggctacggcgaggcgcttggccgtgatcattcagagcacttatctggaagctcttatcgcgatgccctgcaaagatacgggactgcccacggcgcgcctcctgcccgcggacccaggatgtcttacggaggatcaacttgccacgcttattcaaataccagagatcggtacggccgctcctgggagtcttactcttcttgcggagattttcactactgcgatagggaacatgtgtgcagaaaggaccagagaaatccaccaagtctcggcagagtcctgccagaccccagagaggcatgtggcagctctagttacgtagccagcatagtggatgggggagaaagcagaagcgaaaagggcgacagtagccgctactag

SEQ ID NO: 33223 - DNA, 1491 bp, Artificial Sequence
  Description of Artificial Sequence: Synthetic coding sequence
atggtagaggccgaccatccgggaaaacttttcatcggaggtcttaaccgcgagactaacgagaagatgttaaaggctgtgttcggcaaacacggccctatcagcgaagtgctactgattaaggatcggacctcaaagagcaggggattcgccttcattacctttgaaaatcccgccgatgccaaaaacgccgccaaggatatgaacggtaaaagtttacacggtaaggccatcaaagtcgaacaggcaaagaagccttcctttcaatctggagggaggcgccgcccccccgcctctagtagaaacaggtctcccagcggatccctgaggagtgcccgtggcagcaggggagggaccagaggctggttgccctcccaagaaggccacctggacgacggcggctatacaccggatctgaaaatgtcatattctcgcggtctgattccagtcaaaagagggccttctagtcggagcggcggcccccctcccaagaaaagtgctcctagtgccgtggcgaggagcaatagctggatgggcagccaggggcccatgtctcagcgccgcgagaattacggcgtgccacctaggagggccaccatcagctcttggcgcaacgaccgtatgtccaccagacacgacggatacgccactaatgacggtaatcatccctcatgtcaggagacacgggattacgcgccaccaagtaggggctatgcctacagagacaatgggcacagcaatcgggacgagcactcctcacggggatataggaaccatcggtcgtcgagagagacacgagattatgcacctcctagtcggggccacgcgtatcgcgattatggccactctcgccgggacgagtcatatagccgcgggtacagaaacaggcgatccagtcgagaaacaagagaatacgcccctcccagcagggggcacggctacagagactacggccactctaggcggcacgagagctactctcgcgggtatagaaaccacccttccagccgagaaacaagagactacgcaccaccccacagggactacgcctatcgtgactacggccacagtagctgggatgaacatagttcacgtggttactcgtatcatgatggctatggggaagccctgggacgggaccactctgagcacctgtccgggagcagctatcgggacgcattgcagagatatggaacggcccacggggcccccccagctcggggccccagaatgagctacgggggttccacatgtcacgcgtactccaacacccgggacaggtacgggagatcttgggagagttactcttcctgcggcgattttcactactgcgacagagaacacgtgtgcaggaaggatcagaggaatccaccaagcctgggcagggtgctaccagacccccgggaagcttgcggatcttcatcatacgtggccagtatagtcgatggcggcgagagccggtctgaaaagggagacagtagccggtattag

SEQ ID NO: 33224 - DNA, 1491 bp, Artificial Sequence
  Description of Artificial Sequence: Synthetic coding sequence
atggtggaagctgaccaccccggtaaactgttcattgggggcctcaaccgagaaaccaatgagaagatgctgaaagcggtgtttgggaaacacggtcctattagcgaagtgctccttattaaagatcgtacgagtaagtcacgcgggtttgcgttcatcacctttgaaaaccccgccgacgcaaagaatgccgccaaagacatgaacggtaaaagcttgcacggtaaagctatcaaggtcgagcaggccaagaagcccagttttcaatccggcggaaggaggcgaccacccgcatccagcaggaacagatcaccttctggctccctgagatctgcgcggggaagccggggtggaaccagggggtggctgcccagccaggagggccatctggacgacggtggctacacccctgacctcaaaatgtcctactcccgcggactgattccagtgaagcgaggtccaagtagcagatctggcgggcctccacctaagaaaagcgccccaagcgccgtggcccgttctaattcttggatgggcagtcaaggacccatgagccagaggcgggaaaactatggcgtgcccccaagaagggctaccatctcttcctggcgcaacgaccggatgtccacgcgtcatgacggatacgctactaatgatggaaatcacccttcttgtcaggaaactagagactatgccccacctagcaggggatacgcttatagagacaacggacattctaacagggatgagcatagttcccgcggctaccggaatcaccgctcaagccgagaaactagggattacgccccgccaagtagaggccacgcctatagggattacggccactcacgtagagacgagtcctattcaagaggctataggaatagaagaagctctcgcgagacccgggaatatgcacccccctcacgagggcacggttacagagattatggtcacagcagacggcatgagtcatacagcagggggtatcgtaaccacccttcatcccgcgagacgagagattacgccccaccccaccgcgactacgcctaccgggattacggacacagtagctgggacgaacattcttccagaggttattcataccacgatggctacggtgaggcactgggaagggatcatagtgagcacctgagtggcagttcctatcgggacgcccttcaaagatacggcacctcacatggtgcccctcccgctcgcggccccaggatgtcttatggcggctcgacgtgccacgcctactcgaacactcgtgatcggtatgggagatcgtgggagtcttattcttcatgcggagacttccactactgcgatagagaacacgtgtgcagaaaagaccagcggaatcctccatccctgggccgagttctgccagaccctagggaagcttgcggctcatcaagctacgtggcctctatcgttgatggaggggagtcccggtccgagaaaggggactcaagtcgatattag

SEQ ID NO: 33225 - DNA, 630 bp, Artificial Sequence
  Description of Artificial Sequence: Synthetic coding sequence
atgtcaaatctgaaaccagacggtgaacacggcggctccaccggcactggatccggcgctggctccggtggcgcccttgaggaggaagtgcgaacgctgtttgtgtcagggctgcccgttgacattaaacccagagagctctacctcctgttccgcccctttaagggttatgagggctcactcatcaagttgaccgcccgtcagccagtcggattcgtgatattcgatagcagagctggagccgaggccgccaaaaacgctctgaatgggattcgattcgaccctgagaatccacagaccttgaggcttgagttcgccaaggctaataccaaaatggcaaaatctaaactgatggccacacctaacccttctaatgtgcatcctgctctaggtgctcattttatcgccagggatccttatgacctgatgggcgccgcgctgatacctgccagtcccgaggcatgggctccttaccctctgtatactactgagctgacccctgcgatctctcatgctgccttcacctacccaacggccaccgccgctgccgccgcgttacatgcccaagtgcgctggtacccttctagcgatacaactcagcagggatggaaatacagacagttctgttag

SEQ ID NO: 33226 - DNA, 1731 bp, Artificial Sequence
  Description of Artificial Sequence: Synthetic coding sequence
atggacgtcagattctatcctgccgcagctggagacccagcctcactggactttgcacagtgcctaggctactacggttactcaaagtttgggaacaacaataattacatgaacatggcggaagccaataacgccttcttcgctgcctccgagcagacttttcatactccatccttaggagatgaagagttcgaaatcccacctattactccccctcccgaatcagatccagccctcggcatgcctgacgtgctactgccctttcaggccctttcagaccctctgcccagccagggtagtgaattcactcctcagttccccccccagtctctggacttaccctccatcaccatcagtcggaacctggtcgaacaggacggtgtgcttcactcctccgggctccatatggatcagtctcatacccaggtttctcagtatcggcaggatccatcactgattatgcgttctatcgtgcatatgaccgatgcagcgaggagcggcgtcatgccaccagcccaactaacaactatcaatcagagccagctgagtgcccagctcggtttgaacttgggaggtgccagtatgccccatacaagtcctagcccccccgcgtccaagagtgccactccaagtccttctagctccatcaatgaggaggacgccgacgaagctaatcgcgcaattggtgagaaaagagccgcccccgattctggaaaaaaaccaaagaccccgaagaagaaaaaaaagaaggacccaaatgaaccccagaaacccgtttccgcctacgcgctgttctttcgagatacacaagcagcaattaaaggccagaatcccaatgcaacttttggcgaggtatctaaaatcgtggccagcatgtgggacagcctgggtgaggaacagaaacaggtctataagcggaaaacggaggccgctaaaaaagaatatctgaaggcgctggccgcctacagagcctccttggtgtccaaagcggctgccgagtcggccgaggctcagaccatccggagcgtccagcagacactggcttccacgaacctaacgtcctctctgttgctgaatactccgttgtcccagcacggcacggtgtccgctagtccccaaaccttgcaacagagtctcccccgcagtattgctccgaaaccactcacgatgagattgccaatgaaccagatcgtgacgagtgttaccatagctgcaaacatgccgagcaacataggcgctccgctgatttctagcatggggactaccatggtcggcagtgctcccagcacacaggtctcaccatcggtccaaacgcagcagcatcaaatgcagctgcagcagcagcagcagcaacagcagcaacagatgcagcagatgcagcagcagcagctccaacagcaccagatgcaccaacaaattcaacaacagatgcagcaacagcattttcagcaccatatgcaacagcacctgcaacagcagcagcagcatttacagcaacagattaaccagcagcaactccagcagcagcttcagcagagattgcagcttcagcagcttcagcacatgcagcatcaatcacagccctcaccccgccagcacagtccggtcgcgtcacaaattacatcaccaattcccgcaatcggttctcctcagccagcttcacaacagcatcagagtcaaatccagtcccagactcagacacaggtgctctcccaagtgagtattttctag

SEQ ID NO: 33227 - DNA, 1023 bp, Artificial Sequence
  Description of Artificial Sequence: Synthetic coding sequence
atggctgccccgctgctgcatacacgtttacccggtgatgccgccgcctctccttcagcagtcaaaatgctgggtgcgagcaggacaggcatcagtaatatgagagccctggagaatgatttcttcaacagcccacccagaaagacagtccaattcggtggtacagtgactgaggtgctgctgaagtataaaacaggagagactaatgacttcgagctgctaaagaatcagttgttagacccggacattaaagacgatcagatcatcaactggctcctggaatttaggtcatcaattatgtacttgactaaagattttgagcagttgatcagcattattctccgcctgccctggctgaacagatcgcagaccgttgttgaagagtatttggccttcctgggcaatctggtcagcgcccaaacggtgtttcttagaccatgcctgagtatgatcgcttctcactttgtgcctccgagagtgattatcaaggagggagatgtcgacgtttcagatagcgacgacgaggacgacaatctgcctgccaacttcgatacgtcgcaatccctggcaaacaattctaaaatctgcaccatcgagtgctatgtgcacaatctcctcaggattagcgtctattttcctacactgaggcatgaaatcctggagctgataatcgagaagttactgaaactggatgtaaatgcctctaggcagggtattgaagatgctgaggaaacggctaaccagacttgtgggggcacagatagcacagaaggcctctgcaatatgggtttcgctgaggcttttctggaaccgctttggaagaagcttcaggacccttccaatcctgcgatcattaggcaggctgccggcaactacatcggcagttttttagcaagggccaaatttattcctctcatgatacgggagcagcgacactccgccatgcttctctctatggatcactttacccagcccgcaaagctttgttcaacaccattgttcctggataccagctctttctag

SEQ ID NO: 33228 - DNA, 1461 bp, Artificial Sequence
  Description of Artificial Sequence: Synthetic coding sequence
atggctgcccctctgttgcacacgaggctgcctggggacgccgccgctagcccttccgcagtcaaaatgctgggagcctccagaactggcatctcgaacatgcgagccctagagaatgacttcttcaatagtccccctcggaaaacagtgcagttcgggggcactgttacagaagtcctcctgaagtataagacgggggaaactaatgattttgagctgttaaagaaccagcttctggatcctgacattaaaaggctgccttggctaaacaggtctcaaacagtggtcgaagaatatctggccttcttagggaacctggtgtctgctcaaaccgtgtttctcaggccatgcctatccatgatcgccagtcacttcgtccctccaagagttatcataaaggaaggagacgtggacgtgtccgactcggatgatgaagatgataaccttcctgccaatttcgatacctcacagagcctagcgaacaactctaagatctgtactattgagtgttacgttcataatctcctaagaataagcgtttacttccctacactgagacacgaaattctggagctgatcatcgagaaactgttgaaattagacgtgaacgcttctaggcaggggatcgaggacgctgaggagacagccaaccagacatgcggaggcacggatagtactgagggtctctgcaatatggtgtctagtctgctaatgaaggtcgaaatgaagtttattattataaagggatggaagcagctcgtgctgctgattttcggcttcgccgaagcttttctagaaccactttggaaaaagcttcaagatccatcgaatccagccatcatcaggcaggctgctggaaactacataggctccttcctggcacgggcgaaattcattccgttaatcacagtgaaatcttgtctcgatctgctggtcaactggctgcacatatacttaaataatcaggacagcggcacaaaagccttctgtgatgtcgctctccacggtcctttttactcggcgtgccaagcagttttctacactttcgtcttcaggcacaaacaattgctgagtgggaacctaaaggaagggttgcagtacctgcagtccctgaatttcgagtggatcgtcatgtcacaattaaatccgctaaagatttgcctccctagcgtagtgaactttttcgccgcaattacaaacaaatatcaactggtcttttgctacaccatcatagagcggaacaacagacagatgttgcctgtgattcggagcactacaggcggggatagtgttcaaacgtgtaccaacccactcgataccttctttcccttcgacccatgtgtgctcaaacggtccaagaagtttatagatccaatttaccaggtgtgggaagacatgagcgcagaagagctccaggagttcaaaaagcccatgaaaaaattgttttggcggattatgtag

SEQ ID NO: 33229 - DNA, 939 bp, Artificial Sequence
  Description of Artificial Sequence: Synthetic coding sequence
atggaaccaggcagcgtcgagaacttatccatcgtgtacagaagcagagatttccttgttgtgaataaacactgggacgttagaattgatagtaaagcctggagggagacactcacattgcagaaacagctcagatatcgcttccccgaactcgctgacccagatacatgttacgggttccggttctgtcaccagcttgatttcagtaccagcggagctctctgcgtggccttgaacaaggctgccgccggtagtgcctacagatgtttcaaagaacggagagtgacaaaagcgtacttagctttgttgcgcgggcacatccaagagtctagggtgactatttctcacgctattggaagaaacagtacagaaggccgggcccatactatgtgcatagaaggttcacaggggtgcgaaaatccgaaaccatctctgaccgacctggtcgtgttagagcatgggctgtacgctggggaccctgtcagtaaggtcctgttgaagccactaacgggtcgcacccatcagctgcgtgtccattgttcggcgctggggcatccagtagttggcgacctcacgtatggagaggtctcgggcagggaggacagacccttccgaatgatgctgcacgccttttacttgcgaatccctaccgatactgaatgcgtggaagtttgtacacccgatccttttctcccatcactcgacgcctgctggagccctcacacacttcttcagtcacttgatcagctggtccaggcgctccgcgctacccctgatcccgatcccgaggacagagggcccaggccaggaagtccttctgcactgctcccgggcccaggcagaccaccaccaccacccaccaagcctccagagacagaggcacaacggggaccatgcctgcaatggctttccgagtggactctggagcctgactcatag

SEQ ID NO: 33230 - DNA, 1638 bp, Artificial Sequence
  Description of Artificial Sequence: Synthetic coding sequence
atgtggttggaccggcgaggatggctcagggtacttggacactggagatatgatctacgaagacccagctttactcgcacctggtccggggacaagggacccatggcggagacagtgtcaacacaggttgggactgagggaggcttacgagcatcacaccagcaaaatggcgacgcaggcggcgatgccaaggttgaactgtccccaggaccccccaagcccgccggccgtgaagtggaacctgcacccgtgggaggcgagcatcctagcgcagctgccccaggtcccggcaagcataagaaaaggcgaggggctacacgcgagagagtagtccccccaccgaagaagcgtaggactggcgtgagcttcggtgacgagcatttcgcagagacctcttattatttcgagggtggactgcggaaggtgcgaccctattacttcgatttccggacctattgcaagggtcgctgggtcggccactcacttctgcacgtgttttcgaccgaattccgtgctcaaccgctggcctattacgaagcagccgtccgcgcgggacgcctgcagcttaatgagaaacccgttcaagacctcaatatcgtcctcaaggataacgattttctgaggaatacagtgcatcgtcatgagccgccagtgacggcagaaccgattagattactggcagaaaatgaggacgtggtggtggtggataaaccctcctcaattccagtgcacccttgtgggcggtttcggcacaacacggtcatcttcattctcggtaaggagcaccagctgaaagagctccatcccttacatcggctcgataggctgacttcaggcgtgctgatgtttgctaaaacagccgccgtgagtgagagaatccatgaacaggtaagggacaggcagctggaaaaggaatacgtttgtcgcgtggagggcgaattcccaacagaggaagttacttgtaaagaaccgatattagtggtgagctacaaagttggcgtttgtcgtgtcgatcccaggggtaagccctgtgagaccgtctttcagcggcttagctataatggccagagttccgtggtgagatgccgtcccttgacgggaagaacacaccaaattcgggttcacctgcagtttctagggcaccctattctcaatgaccccatatataatagcgtggcttggggaccttcccgagggagaggcggctacattccaaaaactaacgaggaattgctgcgggacctggtggcagaacatcaggccaagcagtccctcgacgtgttggacctgtgcgaaggggacctcagccccggactgactgactccacagcgcctagctccgagttagggaaagatgacctcgaggagctggccgccgcagcacagaagatggaagaggtggccgaggccgcaccacaggaactagacaccatcgcgcttgcctcagagaaagccgtggagacagacgttatgaatcaggaaactgaccctctatgtgccgagtgccgcctcgtgcgtcaggaccccctccctcaggatttagtgatgtttctgcatgcactgcggtataagggaccaggatttgaatatttttccccaatgcccgcatgggcccaggacgattggcagaaggattag

SEQ ID NO: 33231 - DNA, 1575 bp, Artificial Sequence
  Description of Artificial Sequence: Synthetic coding sequence
atgtggctggaccggcgcggatggttgagagtcttgggccattggagatatgacctgagacgaccttcttttaccagaacctggtccggcgacaaaggccctatggctgagaccgtctctacacaagtcgggaccgaaggcgggctgcgggcaagccaccagcagaacggcgacgccggaggtgacgctaaagtcgaattgtccccaggaccacctaaaccggccggtcgagaagtggagcctgctcctgtggccagggaacgggtggtcccgccaccaaagaaacgccgcaccggggtttccttcggcgacgaacacttcgcagagaccagctactatttcgagggcgggctgcgcaaggtcagaccatactacttcgatttccggacttattgtaagggaagatgggtaggccactccctattgcacgtcttttcgacggaatttcgggcccagcccctcgcttattatgaggccgcagtccgcgccgggcgcctgcagctgaacgagaaacccgttcaggacctgaacatcgtacttaaggacaacgacttcctgagaaataccgtgcaccggcatgagcccccagtcactgcggagccaatccggctgctggccgagaacgaggatgtcgtggttgtggacaagccttccagtattcccgtgcacccatgtggcagattcaggcacaacaccgtgatttttatcctgggtaaagaacaccagcttaaagaactccatcccctccacagactcgacagactgacgagtggtgtcctgatgtttgctaagactgccgctgtgtctgaacgcattcatgagcaggtgagagacaggcaactggagaaagagtacgtgtgtagggtcgagggcgaattccccaccgaagaggtgacctgcaaagaacctattctggtggtttcgtataaagtcggtgtttgccgggtcgacccaagagggaagccctgtgaaactgttttccagagattatcttacaacggccagtcctcggtcgtccgatgcaggccactgaccggccgaacccatcaaatccgcgtgcacctccagttccttggccaccctatcttgaacgatcccatttataattctgtcgcttggggcccatccagaggccgcggaggatacatcccaaaaactaatgaggaattactcagggaccttgtggcagaacaccaggcgaaacagagcctcgatgtgctggatctgtgcgaaggggaccttagtcccgggctaaccgacagtaccgcaccatcttccgagcttggaaaagacgacctcgaggagctcgctgcagcggcccaaaagatggaagaggtggcggaagcagccccgcaagagctcgacactatagccctggcctccgagaaggcggtggaaaccgacgtcatgaaccaggaaactgaccctttgtgtgcagaatgtcgactggttcgccaagaccctctaccccaggatctcgtcatgttcttgcacgctttgcggtataagggccccggctttgagtacttcagccctatgcccgcgtgggcccaggacgactggcagaaggattag

SEQ ID NO: 33232 - DNA, 1056 bp, Artificial Sequence
  Description of Artificial Sequence: Synthetic coding sequence
atgcgtgctgtgctagcacgtgaaatggatggccggcgagtactgggtcgcttctggtcagggtggagaagaggcttgggcgtgaggcctgttcccgaggatgccgggtttggaaccgaggcgagacaccagcggcagccgagaggctcctgtcagagatccggaccactcggggatcaaccatttgcgggcctcctgccaaaaaacctgtccagggaggagctggtagatgcactacgcgcagccgtcgtcgacaggaagggccccctcgtgacactaaacaaaccccagggcctgcccgtcacaggcaaacctggagagctaacacttttttcagtcttacccgagctgagccagtctcttggcctgagggagcaggagctccaggttgtccgggctagtgggaaagaatcaagtggccttgtactcctgtcttcatgtcctcaaacagccagcaggctccagaaatactttacccatgcccggcgtgcacagcgacccacggccacttactgtgcagtcaccgacgggatccccgctgcttccgaagggaagatccaagctgcccttaagctggaacatatcgacggagttaacctcacagtgccagtcaaggcccccagtagaaaagatatcctggaaggagttaaaaaaaccctcagccattttagagtggtcgccacagggtcaggttgtgcccttgttcagttgcaaccactaactgttttctctagccagctacaggttcacatggttctccagttgtgtcctgttttgggagatcacatgtacagcgctcgcgtcgggaccgtgctgggacagagattcctcctccctgccgaaaataataaaccacagcggcaggtgctggatgaagccctgcttagacgactccatctgacgcctagtcaggccgcccagctgcccctacacctgcatctgcatcgactactgctacccgggacaagggccagggatacgccggtcgaacttctcgcccctctgcctccttatttttctcgaaccctgcaatgcctcgggctcaggttgcaatag

SEQ ID NO: 33233 - DNA, 1011 bp, Artificial Sequence
  Description of Artificial Sequence: Synthetic coding sequence
atgcgggcggtgctcgcgcgcgaaatggacggtcgccgcgtgttgggacgattttggtccggctggagacgagggctgggagtgcgcccagtgcctgaagacgcaggctttggaaccgaagcaaggcatcagcggcagcctcgcggctcgtgtcaaagaagtggacctttgggcgatcagccatttgccgggctcctgcctaaaaacctgtctagagaagaacttgtggatgcattacgtgccgcagtggttgatcggaaaggcaagccaggcgagctgacactgttttctgttcttccagagctctctcagtccctgggtctgagagagcaggaactgcaggtagtcagagcctcagggaaagagagcagcggtctggtgcttctaagctcctgtcctcagaccgcatcgagactgcaaaagtacttcacccacgctagacgcgctcaaagacctaccgcgacctactgtgctgtgactgacggcattcctgcagcgtctgaaggcaagatccaggccgcactaaagttagagcatattgacggggttaatctgacggttccggttaaggccccttccaggaaagacatcctggagggcgtcaagaaaacattaagccacttccgggtggtagctaccgggtcaggttgtgccttggttcagctgcagcccttgaccgtcttctccagccagctgcaagttcatatggtacttcaactgtgcccggtgttgggggaccatatgtactccgccagggtgggaaccgtgttaggccagcgattcttattgcctgctgagaataataagccacaaagacaagtcctggacgaagccttgttacgacggctccacctgaccccatctcaggccgcacagttgcccctacacctccacctgcatagactgcttcttcctggcacgagagctagagacacaccagtggagttgcttgcccccctacctccttatttcagccgtacgttgcagtgcttaggactgcgcctccagtag

SEQ ID NO: 33234 - DNA, 864 bp, Artificial Sequence
  Description of Artificial Sequence: Synthetic coding sequence
atggccacggtaatggcagctacggccgcggagcgggcagtcctggaagaagaattccggtggctgctacatgatgaggtgcatgccgtcctaaagcaactgcaggacatcctcaaggaggcttccttgcgctttacccttcccgggtccggaaccgaaggacctgctaaacaggaaaatttcatcctgggaagctgtggcactgaccaggtcaagggggtgcttacactacaaggggacgcattgtcccaagccgacgtgaacctgaagatgcccagaaacaaccaactcctgcacttcgccttccgcgaggacaagcaatggaagctgcagcaaatacaggacgctagaaaccacgtgtcacaggcgatctacctattgacaagccgggaccagagctatcagttcaagactggggcagaggtcttgaaactgatggacgccgtaatgctgcagcttaccagggctagaaacaggctgacaactcccgccacactgactctcccagagattgccgcatcaggccttactcgcatgttcgcccctgccctgccctccgatctgttggtgaacgtgtacattaaccttaacaagctgtgtttaaccgtgtatcaactccacgccctgcagcccaacagcaccaagaactttcggccagctgggggagccgtgttacattctcctggggcaatgtttgaatggggatcccagcggctggaagttagtcatgtgcataaagtggagtgcgtgattccatggttgaatgatgctctggtctatttcaccgtctcattgcaactgtgtcagcagctgaaagataaaataagcgtgttttcctcctactggtcctatcgaccattctag

SEQ ID NO: 33235 - DNA, 6681 bp, Artificial Sequence
  Description of Artificial Sequence: Synthetic coding sequence
atggtcctcgcgggcctgattcgtaagctggggcaccagttggccgagatccgggaacgagccctcaaatctattctctgtaagatcgagcataatctaatctgttacgctgatctgattcaggaacggcagcttttccttcacctgctcgagtggttcaatttcccttcggtgcctatgaaggaggaggtgttgaacttgttgtcgcgcctggtgaagtaccccccagccgtccaacacttggtcgatgtgggggccgtggagttcttatcaaagctgcgttcaaatgtagaacccaacctgcaggcggagattgacgggatccttgatgggctgttccttctgccatctgaggtgcccgcactgtctagcgcgtcctaccagacaaaccagaccgaactctcgaagaacccagagatcctgaccggttacttcccccaggataaatccaacttccaacagatggaggtgccccctcgcccagtggtgaatcagaccgttaagtgcttgaaattttcaacttttccctggctgcccctgacaactactgatcgccacgtcctttcatcaaatgagtcttctctcagatctagtaaccacaccctgatctggaatacatgtgagctcctgaaagatgtgatcatgcaggactttccggcagaaatcttcctccagcgccctaaaatagtccagagcctactttccctgctgaagctcgctttcggtgacggtaaacataggcttgccctccagagtgtatcctgcctgcaacagctgtgtatgtacttgagaaatagactgaactttcatcgggatcctggctttttcagcaacaagcacgatactgtcagccagaattccagcttatcttactgtcatgaggctaggggaacccatcactctcagaacccttcaccaggaagcagctccccgcgcccctcagtcgtgggccggacaggccagaggccgagaggggacggtcaagattgggatgccgcaagcagcagcgggagttccagccacgctcatgtcaatagtcgaataagcgtgcacagcccactggatatgggtcacattgacctgccagagctcgaaacagaggacaccctggagttgcaatttcaacagctatctctgccccaattctgtgttagcatcctcgagagtgctgttccactgctgcggaccggaagccgacaggtcatcatcagggtcttggagctgctgaccgaggacatgacccttatcggagaggccatcagcaccgatatttgggacgatagctccctgtttggtatagatatgaaggaaaagcttcttctggtcctgggggcactcggagaaaccatgtgttatcacaagtcttcaatttcactcgaacaacccgaggtgatgctggtccatcaccggatggcatttatatcaatctccctatttgccgtgcgcttactgcagacccttctgccagtcgaaaaagcctcggaattcttgtctgagccaatgagcacagcattatttttactcagcctggacatgccaatctcactcgaatacccaaatatccacgaagcagtagtcgcctatctggagcagcttaactccgagaattactcaatctacaaacgaaccgccgaggctgtctactccatagagtgcacatgcaattttctgtcagatatcgggaaggagggcgaaaaaaatcttctggaactcgtggagttggcagaccaggcattgcggagctttagctatcaccagcatttccccttaatcaaggaaatcatttctatatgctcaaaaatttggaaatccgctcaggctagcccccttcttcaaggagagagccaaaaagtcctattgcacatgctctctcaccccctgccccgcgtgaaggccgaaacgtatcactgttgcttggaaataactaaagaatgtctgggagtacacaatgtgactaaaccggtatcctcattgtgcaacggcattcattttctgcttcatcccaaggtgctctacgagataagcgtgtttggtatccaggagcccgaaagtgaagtcaataccgctgcaaaggctatcctgctgtatttgctccaaggccggttgatgatgaccgcactgacctggaacaagttcattgaatccctttgtccagtcatcccgattctccaaggctacgctgataccgaggatccactgggtaattgtatcctgttgctctctaaagcctcatcagacacagaagagatgcttccctgcaccacacgtcttaagagtatgctgagacttttgctggttaaaaagccctcagtgagatcgttagcactaaagctgcttgcgttccacttaaccagcgaagagggagccgatacaaagaggccgctgatagatgcccgtgtgctgagtagagtgaccgacctgtttatcggcaagaaacctattgagcttaggcttgatgaccgacgcgagctcgtgattaaactggagacagtcgaaaaggtgtatgaaatctttacttcggacgacgttgatctcgtgttgagaaagtctgccgcagaacagctcgctgtgatcatgcaagatattaagatgcacgccgttgtgaagaaactgtgcctcattgataagatcatcgagtatctcaacgaatgcgtatctcaggatggcaaagtggttgagtgtcttgtgcagccgtgtctgactctcctgcggaaagtgctatgcggtgacccggtgatgagagtatcactgagtcagcaaagctccctgctgacagttcttttccgtgtctcactcatttttcatgaagattgcagtgtggttacagaagtcggcgcgctgttttgcctcttgctcttcgatgaagtttcaagaatggacatgtggtctgtgaaccccagcaataaaccctccctgccttccgtgttctccctgcccgtgtctgtcttccggagataccatttgcctgtgcacgtgatcggacaccacgcggtgagcccatatagtatcgttctgcccctgtcagccgattgcctggctttgaagccggtcagcgatatgctgagaatcgcttggaacctgagctggtatcatggatccgacaaccttctgaaacagatgaattcggaaactaaaacccaggagattttggatgctctcaagttaagcactgaggatatactaacactgaaaatcactcacatggcttctggcctgcaggactgtctgcacagtatagttcaagcagccacccacagagaggtgcgagctgcggttacgaggatgtccttctatcttctcaacgataggctcagcctcaagggatgtccaggaccatgcggagttaccctgaaatcattagcatggcatactgctctaaatagattcttacaggtcctccccgcttgcacagaggatgagaagctgctcatagacataattcactttctcaacaagctaatcaaggaacagaggaagaactctagccttgaattgctgaattggattcttgagctccttctgcgccattccgcgaaccctctgctggacctgctggtcctgacggagtcccaggctagagaagagaccgacgacatcaggactgctgtgagacaacagctccaaaaggagctgatcgcattgtttgatacactgttgttgaacttcatggaagttacggacagaaaatgctctgagttgctgtacgttttccaaactcagctcgccctgaagctgcttcagtgtctcaaggtgaccgatgctccacatttctatggactgccgtccttagagcgcacactaagaggcatggccaatcttacagcatttcccggctggtcgagtcactcccctctgacaaaaccgctggacatttgcgtgaagtacctttccgggttgctagaggtgatcacatcattttatgtggagcggggggggaacgctatgtccttcatgggaaagggagtgaccaaatccaccatcttgtgtctgctacatcttagccacgaaatgatggctcaggctggttcgctggaatggatgtctctgtggttcctgcccctgggttctcacagtgaggagcacatcccgacccagcaggggctcgcctggttgatccctctctgggtcgatagggacccagaagtaaggtttacctcactgggtctggggtcggccctgaccaccctcgagaccggctgtgtcgccctggcaaatagttgtcagaatatcagtggcggcctctggggcactgtagtgaatatcctactcgaccagtcagagtgttccatggtgcgtagggaggcagccttcattctgcagaacctgctcgtgattccaatgccaactgagatcattaaggactacacgtggcagggcccgtgcgtgcatgatgaggacagcggactttctctaatcggcaagccagccctccaggcactgctgtaccactgtcatttctatgaacacctgaatcagatggttaaacattgttatcttggcagatgtatgttcgacttaaactttagcgcgttcgataggaacagcgaaagcaacgatctgaacggcctcgacgattccttcaaattctggcgggccccctccagaacgtcacaggatcgggacccatcgagcctgtctacaagtgagactaccgtcgctccttcacttgggagcacagagtttcagcctttagtccagagtaccacattactaccggaagccagccacgatcagttcgtggcccaagggcaccaagaaagtacctcgcctcggcctccgcatgattcatctcttagtgcccccctacccaagctgtgcgtttttgtgacaccatcccttctgtccgccatgtgttctctccttgacaatttacttacaatcgctccacgtgacacggctaaagcctttcgccaggctcaccttattgagctgctctgttccattgcggacgcaactctgattcagacatgtgtgcaagaattgagggcactgctgccctcctctcctcccgccgaacacacgcaggctcaggtgtcttttctgcttgaatacctctcctcgctgagtcggctgctgcagtcatgcctcctagttgagcccgatctggttatccaggacgagctagtgaagccactgatcaccaacattatcggaatcctgacaatatgcaccaaggatgttttagacaaagaattgatcagcgctttttaccatacctggactcatctgtttaacctgctggcaatgttactccgaaaagccggcgccattacattgcccttcgtgactgtggctctcgcaaagcattggaccgctgctatcgatatgttttgcacttgcgcagggttgagtgcaacgtgccctgcgctgtatactgcctctcttcagtttctctcggttctgctgaccgaagaagccaaggggcatctgcaggcaaagtccaagactcacctatgctgtagtcccactgtggccagcctgttagacgactcccaagaaaaccagaagagtctcgagcagctgtctgatgtgattctgcaatgctatgagggcaagtcgagcaaggacattctgaaacgggtggctgccaacgcactgatgtctctgctggccgtgtcaagacgagcacagaaacacgcacttaaggctaacttgattgataactgcatggagcagatgaagcacatcaatgctcagctgaacctagatagcctaaggcccggcaaggccgccctgaagaagaaagaggatggggtgattaaggagctgtctatcgccatgcaactcctccgcaactgcctctatcagaacgaagagtgcaaggaggctgcactggaagcccatctggtgcctgtgctccacagtctttggccatggatccttatggatgacagtctcatgcagatttctctgcagctgttatgcgtgtacactgccaactttccaaatgggtgtagttcactgtgctggagtagttgtggccagcatcccgtccaggccacccaccggggcgcagtatcaaactctctgatgctctgcattctgaagctcgcctcacagatgcccctcgagaacaccacagtccaacagatggtctttatgctgctgagcaatctcgccctgagtcacgactgcaaaggagtgatccagaaaagtaacttcttgcagaattttttgtccttggccctgcccaaagggggcaataaacatcttagcaatctgactattctctggttgaagctgttgttgaatatttccagtggtgaggacggacagcagatgatcctgcgtttggacgggtgtctcgacttgctgaccgagatgagcaagtacaagcacaaatcctcccccctcctgcctctcctaatcttccataacgtgtgcttctcacccgcgaacaaaccgaaaattctggccaatgaaaaagtaataactgtgctggccgcttgtctggagtctgaaaatcagaacgcccagcggattggcgcagccgccctttgggctctgatttataattatcaaaaggcaaagacagccctgaagtcaccaagcgtgaagagacgggtggacgaagcctatagcttggcaaagaagaccttccccaactctgaagcgaatcccctaaacgcctactatctgaaatgtctagaaaatctggtgcagctgcttaacagctcttag

SEQ ID NO: 33236 - DNA, 4782 bp, Artificial Sequence
  Description of Artificial Sequence: Synthetic coding sequence
atggtcctcgctggtctgattcgcaagctgggccaccagctggccgagattcgggaacgagcgctgaaatccatcctgtgtaagatagagcacaatctcatctgttacgccgatctcatccaggaacgacagctctttcttcaccttctggaatggtttaacttcccatccgtaccgatgaaagaagaagttctcaacctcctttccagactcgtcaagtatcctcccgctgtgcaacacctcgttgacgtgggggccgttgagtttcttagcaaactacgatccaatgtagaacccaacctgcaggccgaaatcgacggtatcctggacggcttgtttctactgcccagcgaggttcccgcactgtcatcagcatcatatcagactaatcagacagaactatctaaaaaccccgaaattttgaccgggtacttccctcaggataagtcaaacttccagcagatggaggttcccccgcgcccagtggtgaatcaaaccgtgaagtgtttaaaattctcaacttttccctggctaccattgaccactaccgatcgtcatgtcttatcatccaacgagagcagtctaaggtcatccaaccacaccttgatctggaacacctgcgagctgctgaaagacgtgattatgcaagacttcccagccgaaatctttcttcagcgtcccaagatcgttcagtctctgctgtcgttactgaagttagctttcggggatggaaagcaccgtctggcgttgcaatccgtcagttgtctccagcagttgtgcatgtaccttagaaacaggctgaactttcaccgtgaccctgggtttttttccaacaaacatgatacagtgagccagaactcttccctctcctattgtcatgaggcaagaggcacccatcactctcaaaatccttccccgggcagctcaagtccccgtccttccgttgttggcagaaccggccaacggcccaggggcgacgggcaagattgggatgctgcatcaagttccggctcatcctctcacgctcacgtgaactcccgaataagtgttcattcgccacttgatatgggacatatcgatttgccagagctagagactgaggacactctggagctgcagtttcagcagctatcattgccacagttctgtgtaagcattctcgaaagtgctgtgccacttctgcggaccggttctaggcaggtcatcattcgtgtcctggaattgttaaccgaagatatgactctgatcggagaggccattagtaccgacatatgggacgactcaagtctgttcggtattgacatgaaggaaaagttactcctcgtgttgggggcgttaggagagacaatgtgctaccataagagtagtatctctcttgagcagcccgaggtgatgctcgttcaccatagaatggcctttatttctatctctttattcgcagtgcgcctactgcagaccctgttgcccgtggagaaagcttcagagttcctgtcagagcctatgtcaacggccttgtttttattgtccttagacatgccgatttcactggagtaccccaacattcacgaggctgtcgttgcctatctcgaacaactgaattcagagaattacagcatatacaaacgcacagctgaggccgtgtacagcattgaatgtacgtgtaacttcctgtctgacattggaaaggaaggggaaaaaaacttgttggagctggtggagctcgccgaccaagcactgcgcagcttttcctatcaccagcacttccccctcattaaagagataatatccatttgttcaaagatctggaagtccgcacaggcctcaccactgttacaaggagagtcacagaaagtcctgcttcacatgctttcgcaccccttgcctcgcgtgaaggccgaaacataccattgttgcttggagattactaaggagtgtctgggcgtccacaacgtgaccaaaccagtctcaagtctttgcaatggaattcactttctgctccaccccaaggtactgtacgaaatcagcgtgttcggaatccaggaaccagagtccgaggtgaatactgcagcaaaggccatcctgctgtacctcctgcaaggaagacttatgatgaccgcactgacgtggaataagtttattgagagtctttgtcccgtcataccaattcttcaagggtacgcagatacagaagacccactcggaaattgcatcttgctgctgagcaaagctagtagtgatactgaggaaatgctcccctgcacaacgagacttaagagtatgttgaggctccttctggtcaagaagccatcagttcgcagcctggcactgaaactcttggccttccacctaacaagcgaggagggtgcagataccaaacgtcctctcattgacgcccgggtgttgagtcgggtgactgacctatttattggaaagaagcctatcgagctcagattggacgatcggagagaactggtgataaagctggaaactgttgaaaaggtttatgagatcttcacctccgatgacgtggatctggtgctgcgaaagtctgcggcggagcaactggccgtgattatgcaggacatcaagatgcacgctgtagtgaaaaagctgtgcttaatcgataaaattattgaatatctgaatgaatgcgtgagtcaggacggaaaggtggtagagtgcttggtgcagccttgcctgaccttgctgagaaaggttctctgcggggatccggtcatgagagtctcgctcagtcaacaaagtagcctcctcactgtgcttttcagggtgagcctgatcttccacgaagactgctcagtcgtaacagaggtaggggccctgttttgcctgttgctgttcgatgaagtgtccagaatggacatgtggtctgtgaacccctcaaacaaaccatccctcccaagcgtgttttcacttccagtaagcgtgttcagacggtaccacctgcccgttcatgtgatcggccaccatgcagtctccccttatagcattgtgctgcctttgtctgccgattgtttagcgttaaagcccgttagcgacatgctcagaatagcttggaatctatcatggtatcacgggtcagataacctgctgaagcagatgaactcagagaccaaaacccaggagatcttggatgcgctaaaactgagtaccgaggacattctgaccctgaagatcactcatatggccagcggtttgcaggattgtctgcattccatcgtgcaggcagccacacacagggaggtgcgagccgccgttactcggatgtctttctacctactgaatgatcgcctgagcttgaaaggatgtccagggccgtgcggcgtgaccctcaagtcactagcgtggcacacagctctgaatcgcttcctccaggtgctgcccgcttgtactgaagatgagaagctcttgatcgatattattcactttctgaacaagttgatcaaggaacagagaaaaaacagctcgctggagttactgaattggatactggaactactgctgcggcattctgccaatccgttgctggacctgctggtactgaccgaatcccaagcccgagaagagactgacgacatccgaactgcagtgagacagcagctgcagaaggaactcatagcactgttcgacactctgctgcttaatttcatggaggtaaccgatcgaaagtgctccgaactactctacgtgtttcagactcagttggcactgaaactgctgcagtgcctgaaggtgacagatgcaccacatttttacggcctcccaagcctggagagaactttgcgcggaatggcaaatctgactgcattccctggatggagttcccattcaccgcttactaaacccctggacatctgtgtgaagtatctgagcggacttttggaggtgataacctctttttacgtggaacgcggaggtaacgcaatgtcttttatggggaaaggcgtaaccaagtccacaatattatgcctcctccacctttcacatgagatgatggcccaggccgggtccttagaatggatgtcattgtggttcctgcctctgggcagccattctgaagaacacatccctactcagcaaggcctagcctggctgattcctctgtgggtcgatagggatcctgaggtgagattcacatccttggggctaggctccgccttgacaactctggaaacagggtgcgtagccctggccaacagctgtcagaacattagcggtgggctatggggtaccgtggtgaacattcttcttgaccagagcgagtgctccatggtgcgccgtgaagccgccttcatcctgcagaatctcctggtcataccaatgcccacagagataattaaggactacacttggcaggggccatgcgtccacgatgaggactctgggctatcactaatcggcaaacccgcacttcaggctctgttgtaccattgccacttttatgaacacctcaaccagatggtcaagcactgttacttggggagatgcatgttcgatcttaatttttctgccttcgatcggaactccgagagcaatgacctcaatggcctcgacgacagcttcaagttctggcgcgctccttcgcggacgtcacaggatagagatccctcctccttgtctacttccgaaactacagttgccccgtcactggggtcaacggaattccagccactcgtccaatcgaccaccctgctacccgaggcatcccacgatcagtttgtcgcccaggggaaccggcatttcggaactaacatccagttttag

SEQ ID NO: 33237 - DNA, 2640 bp, Artificial Sequence
  Description of Artificial Sequence: Synthetic coding sequence
atggttttggccggcttgatacgcaaactgggccatcaactcgccgagatccgggaacgagcacttaaatctattctgtgtaagatcgagcataacctcatctgctacgctgatctcatccaagagaggcagctctttctgcacttgctggagtggttcaatttcccctccgtgcccatgaaagaggaggtgctaaacctactcagtcgactcgtcaaatacccaccagccgtgcagcatctagtggatgtaggagcggtagagttcctgagtaagttgcggtcgaacgtcgaacccaatctgcaggccgaaatagacggaattcttgatggtctgtttctcctcccaagtgaggttccagctctcagtagtgcatcatatcagactaaccagacagagctgtcaaagaaccccgagatactcacgggctacttcccacaggataagtccaacttccagcagatggaagtcccacccaggccagtggtcaaccagacggttaagtgcctgaagtttagtacctttccatggctaccgctcacaacaacagaccggcatgtactatcctctaatgagtcctctctgcggagctccaaccacactctgatctggaacacctgcgaactacttaaggacgtcatcatgcaagattttccagcagagatatttctccagcgacctaaaatagtccagagcctgttgagtcttctgaagctagccttcggggatggcaagcataggctggctctccagtccgtctcttgtttgcagcaactttgtatgtacctgcggaatcggctcaactttcatcgtgatcctggcttcttcagtaacaaacatgacaccgtgagccaaaacagcagtctgagctactgtcacgaagcccgcggaacacaccactcccagaaccccagccccggttcatcctcgccaaggcctagcgttgttggacggaccggccagcgcccaaggggagatggacaggattgggatgccgcctcttcaagcggcagttcttcccacgctcacgttaactctcgcataagcgttcactcacccctcgacatggggcacattgatctgcccgagctagagactgaggacaccctagagcttcagtttcaacagctaagcctcccacagttttgcgtgtctatccttgaatccgctgttccactgctccgaaccggtagtcggcaagtcatcattcgcgtgcttgagctgctcacagaggatatgactctgatcggagaggccatcagcaccgatatatgggatgactcttctcttttcggcattgacatgaaggaaaagctgcttctagtgcttggagccttgggggaaacaatgtgttatcacaaaagctccatctccctggagcaaccagaggtgatgctggtacaccatcggatggcgttcatctccatatcactgttcgccgtgcgactactccaaacattgctgcccgtcgaaaaagcctcagagtttttgagtgaaccaatgtcaactgccctttttctgcttagtctggacatgcccattagccttgaatatcccaacattcacgaggcagtggtggcttacctggagcagttgaacagcgaaaattatagtatctataaacgcactgccgaggcagtgtatagcattgaatgcacatgtaacttcctctccgacatcggcaaagaaggagagaagaatctgcttgagctggttgagctggccgaccaagcccttagaagttttagctatcaccagcactttccactcattaaagagataatttctatttgttctaaaatttggaagagcgcacaggccagcccactgctgcaaggggagagccaaaaggttctgttacatatgcttagtcatccccttcctagggtgaaagcagagacctaccactgctgcctagagatcaccaaggagtgtctgggagtgcataacgttacaaagccagtaagctccctctgtaacgggattcacttcctacttcacccaaaagtgctgtacgagatctctgtatttggcatacaagaaccagagtctgaggttaacaccgccgctaaagccattttgctctatctactgcaaggacgactcatgatgacagctttaacgtggaacaagtttatcgaatcactttgcccggtaataccaatcctacaaggttacgcagacacagaggatccactgggtaattgtatcctcctgttgagtaaggcctcatccgacacagaagagatgttgccatgcactaccaggctgaagagcatgcttagactcttattggtaaagaaaccatccgtgagatcgctcgctctcaaactactggcatttcacttgaccagcgaggagggcgccgacacgaagcgccctctgatcgatgctcgagtcctttctagggtgaccgatctctttatagggaagaagcccatagagctccggttggacgataggcgagagctcgtaattaaactggaaaccgttgaaaaggtatacgaaatctttacatctgatgatgttgacctggttctgcgcaaaagtgccgccgaacagttggccgtgataatgcagggatgcaggatgttcggcaccaccatgccacacaccctggaggaaggcttcatgtggtag

SEQ ID NO: 33238 - DNA, 438 bp, Artificial Sequence
  Description of Artificial Sequence: Synthetic coding sequence
atggcagaatctcttcgtagccctaggcgctcactgtacaagctggtgggtagtcctccatggaaagaagcatttcggcagaggtgcctggaacggatgagaaattctcgcgaccgcctactgaatagatatcgccaggcaggttcgagcgggcctggaaacagtcagaactccttcctcgtgcaggaagttatggaagaggagtggaacgccttgcagtctgtggaaaactgtcctgaagacttagcacagctggaggagctgatcgatatggccgtgctggaagagattcagcaggagcttattaatcaggagcagagcataatctccgagtacgagaagtccttgcaattcgacgagaaatgtctctctataatgctggctgagtgggaggcaaacccgcttatttgtccagtttgtaccaatcttctctcttag

SEQ ID NO: 33239 - DNA, 519 bp, Artificial Sequence
  Description of Artificial Sequence: Synthetic coding sequence
atggcagagtctctcaggtccccaaggagaagcctctacaaactggtcggctcacctccatggaaggaagcctttaggcagcgctgcctggagcggatgcgcaactctcgtgatcgcctcttgaatcgctatcgccaagccggctcctctggacccgggaactcgcaaaactcctttctggtccaggaggtgatggaagaggaatggaacgcgctgcaatctgttgaaaactgcccagaggatctcgctcaattggaggaactgatcgacatggcagttttagaggaaatccagcaggagctgataaaccaggagcaaagcattatttccgaatacgaaaaatctctgcagtttgatgaaaagtgcctgagtataatgctggctgaatgggaagctaatccattaatttgcccggtgtgtacaaagtataacctccggataacttctggtgtcgtggtgtgtcagtgcggcttgagtatcccttcacatgcatgtgatacgtgggcggtgattctatag

SEQ ID NO: 33240 - DNA, 660 bp, Artificial Sequence
  Description of Artificial Sequence: Synthetic coding sequence
atggcagaatcactacgctcacctcgtcggtccctgtataaactggtggggagcccgccttggaaggaagcatttcgtcagagatgtttggagcgcatgagaaactcaagggaccgactgctgaaccgctatagacaggcagggtcttctgggcctggaaactcccagaattcttttcttgtgcaagaggtgatggaagaggaatggaacgctctgcagtctgtcgaaaactgccctgaggatctagcgcagctggaggagcttattgacatggcagttctcgaggaaatccagcaagagttgatcaaccaagaacagagcataatctctgaatacgaaaaatccttgcagttcgacgaaaaatgtttgtccatcatgcttgccgagtgggaggcaaacccgctcatatgccccgtctgcacaaagtacaatttacgaattacctctggagtagttgtatgtcagtgcggactcagtatcccctcacacagctccgagctaactgaacagaagctcagagcctgcctggagggtagcattaacgagcattccgcccattgcccccacacaccagagttcagcgtcacagggggcactgaagagaagagttcactgctgatgtcctgcctcgcctgtgacacttgggctgtgatcctgtag

SEQ ID NO: 33241 - DNA, 696 bp, Artificial Sequence
  Description of Artificial Sequence: Synthetic coding sequence
atggcagagtcactccggagtccaagaagatcactttataaactggtcggaagtcctccgtggaaagaagctttccgccaacgatgcctcgaaagaatgaggaattccagagaccggctgctaaatagatacaggcaggcaggctcctctggacctggaaactcacagaattcatttttagtccaggaggtgatggaggaggaatggaacgccctgcagagcgttgaaaattgcccagaagatttagcacaattggaggaactgattgacatggctgtgctggaggaaatccaacaggagttaattaatcaggagcagagcatcataagcgagtatgaaaaatccctgcagttcgatgaaaagtgtctcagcatcatgctcgcagaatgggaggccaacccgctgatctgtcctgtgtgcactaagtataacctgcggatcacgtctggtgtagttgtttgccagtgtggtctgtcaatccccagtcactcctcagagctgacagagcagaaactgcgcgcgtgcctggagggctctattaacgagcattccgctcattgcccacacacacctgagttcagcgtgacgggtggcaccgaggagaagtcttcactcctgatgagttgcttggtgtctgtgagctgggaccccttatgtggaaagagggatttgtggctggtcctttttccaccttag

SEQ ID NO: 33242 - DNA, 321 bp, Artificial Sequence
  Description of Artificial Sequence: Synthetic coding sequence
atggcagagagtctccggagcccgcgcagatcactgtacaagcttgtgggatcacctccctggaaagaagcctttcgccagcggtgcctggagagaatgagaaactcacgcgaccggctcctaaacagataccgtcaggctgggtcttccgggccaggtaattcccaaaattcttttctagtccaagaggtcatggaagaagaatggaacgcccttcagagtgtcgaaaactgcccagaagatctggcgcaactcgaagaactgatcgacatggccgtgcttgaggagattcagcaagaactcataaaccagggcctgtag

SEQ ID NO: 33243 - DNA, 447 bp, Artificial Sequence
  Description of Artificial Sequence: Synthetic coding sequence
atggcggagtctctcagaagtccaaggagaagtctatacaagctcgttggatctcccccttggaaggaagcattcagacaacgttgcctcgagagaatgcggaatagtagggatcgacttctgaacaggtacagacaggccgggagctcaggtcccgggaattctcagaactctttcctcgtccaggaagtgatggaagaggagtggaatgcccttcagtccgttgaaaactgcccggaggatctggcacaacttgaggaacttatagatatggcggtcctcgaggaaatccagcaggaactcatcaatcaggaacaaagtatcatctctgagtacgaaaagagtctgcagtttgatgaaaagtgtctctctatcatgttggctgaatgggaggctaaccctctaatctgtcctgtctgcactaaaccggtgatcttggggctttag

SEQ ID NO: 33244 - DNA, 321 bp, Artificial Sequence
  Description of Artificial Sequence: Synthetic coding sequence
atggctgagagcctacgctctccacgacgatcattgtataagctggtgggctctcctccatggaaagaggctttccgccagcggtgcctcgaaaggatgcgcaacagtagggaccgcttattaaaccgataccggcaggctggcagtagtggcccaggaaacagccagaactcttttttagtccaggaagtgatggaggaggaatggaacgccctccagagcgttgaaaactgcccggaagaccttgcacaactggaggaactaattgacatggctgtgcttgaagagattcagcaggaactgataaatcaggtattttag

SEQ ID NO: 33245 - DNA, 591 bp, Artificial Sequence
  Description of Artificial Sequence: Synthetic coding sequence
atggaggctgaggatgaagatgagaagtatctgcaggagtgcctgagtaaatccgactccctgcagaagcagatatctcagaaagagaagcagcttgttcagttggagacagatctgaagatagaaaaggagtggcgtcagaccctgcaggaagatttgcaaaaagagaaggatgcgttgagtcacctccgaaacgagactcagcagattatatccctgaaaaaagaattcctcaaccttcaggatgagaatcagcaattaaaaaaaatctatcacgaacaggagcaggcactgcaagagctggggaataagctgtccgagagcaaactcaaaatcgaggacattaaagaggctaataaagccctacaaggcctggtatggttgaaagataaggaggctacacactgtaagctctgtgaaaaagaatttagcctttccaagaggaaacatcactgtcggaattgcggcgagatcttctgcaacgcttgtagcgataacgaactgcccctcccaagcagtcccaagcctgtccgggtgtgcgactcctgccacgcccttctgatacagaggtgtagcagtaatctgccatag

SEQ ID NO: 33246 - DNA, 699 bp, Artificial Sequence
  Description of Artificial Sequence: Synthetic coding sequence
atggccaccaaggacccaacagctgtggagcgcgctaacttactgaatatggccaaactcagcataaaaggattaattgagagcgctctgtccttcggtcgaacgctggattccgattaccctcccttgcagcaattcttcgtggtcatggagcactgccttaagcacggcttgaaggtgcgcaagtctttccttagttacaacaagacgatatggggaccactggaactcgtggaaaagctgtaccctgaagctgaggaaatcggagcttccgtgcgcgatctcccaggcttgaaaacccccctaggacgcgcccgcgcatggctccggctggccctgatgcagaagaagatggctgattatttacgatgcttgattatccagagggaccttctctccgagttctacgagtaccacgcgcttatgatggaggaagagggagccgtcatcgttggactgctcgtgggattaaatgtgattgacgccaacctgtgtgtgaagggggaggatctggactctcaggtgggggtgatcgacttcagcatgtacttaaagaatgaagaagatatcgggaacaaggagaggtatgattttcacaagttattccacatcctgggcttcttgtactctagcctccagatcattatcagatccatttatctgcaatgcggattcatcctcctcttctcgccattgtag

SEQ ID NO: 33247 - DNA, 1926 bp, Artificial Sequence
  Description of Artificial Sequence: Synthetic coding sequence
atgacatttcaagtgtggggctggaggcgagaggacgcctctcaagttctggcctgggttccagacgcagagggaggaagacggggaatgctcacccgtaggagcttggccaccaaagacccgactgctgtagaacgagcgaatttattgaatatggcaaaactctctatcaaagggctcattgagtctgctctgtcattcggtaggacactggactccgactaccctccactacagcagttctttgtagttatggaacactgtcttaagcatggcctcaaagtgaggaagagctttctttcgtataataagaccatttgggggcccctcgaactggtggagaagctgtatcccgaggcggaagagataggggctagcgttcgtgacctaccagggttaaagaccccccttggcagggcgcgtgcttggttgagactggctctgatgcagaaaaagatggcagactatttacggtgtctaataatccaaagagatctcctgagcgagttttacgagtatcacgctctgatgatggaggaagaaggagccgtcatcgtcggtttactggtgggtctcaacgtcatcgacgccaatctgtgcgttaaaggggaggacctggattcacaagtcggtgtgattgacttctccatgtatctgaagaatgaagaggacattggtaataaggagcggaatgtgcagatcgccgccattcttgaccaaaagaactacgttgaagagttgaatagacagctgaattctaccgtgtccagcttgcactccagagttgactctctggaaaagagcaacactaagctcatcgaggagcttgccattgccaagaacaatattatcaaactccaagaagagaatcatcagcttcggagcgagaataagctgatcctgatgaagacacagcagcaccttgaggtaacgaaggtggacgttgaaaccgaactgcaaacatacaaacattctcggcagggactcgatgaaatgtacaacgaggctagacgtcagctcagggacgagagccagctcaggcaggacgtggaaaacgagttggctgtacaggtgtcaatgaaacatgaaattgagttggctatgaagctgctggaaaaagacattcacgaaaagcaggacacgctgataggccttagacagcagctggaggaagtgaaagctatcaacatagaaatgtatcagaaactgcaggggagcgaagatggcctgaaggagaagaatgagattatcgccagactcgaggagaagacaaacaagatcaccgcagcaatgagacagcttgagcagcgcctccagcaagccgagaaggcacaaatggaagcagaagatgaggatgaaaagtacctgcaggaatgcctctcaaaaagtgatagcctgcagaagcagatctcacagaaggagaaacagcttgttcagctcgagaccgacctaaagatagagaaggagtggagacaaaccttgcaggaggacctgcagaaggagaaagatgccctctctcatcttcggaatgagacccagcaaatcatatcactgaaaaaagaattcctcaatctgcaagacgaaaaccagcaattaaaaaagatttatcacgaacaagaacaggctctgcaggaactgggcaataagctaagcgagagtaagctgaaaatcgaggacattaaggaagcgaataaggccttgcagggtcttgtctggttgaaggacaaagaggctactcactgtaagttatgcgagaaggaattttcactctcaaagcgtaagcatcactgtcgcaattgcggcgagattttctgtaacgcctgtagcgataacgaactgcctctgcctagtagtcccaagcccgtgagggtttgcgacagctgtcacgccctgttgattcagcgctgcagctcaaatctgccctag

SEQ ID NO: 33248 - DNA, 1212 bp, Artificial Sequence
  Description of Artificial Sequence: Synthetic coding sequence
atggcaacgaaggaccccactgccgtggaacgcgcaaacctattgaacatggctaagctgtccatcaaagggcttatcgagtctgcgctgtccttcggcagaaccctggactccgattatccgccgctgcagcaattttttgtcgtgatggagcattgcctaaagcacgggttaaaggtacggaagagcttcctgagttataataagaccatttggggtcccctcgagcttgttgagaagctgtacccagaagccgaagaaatcggcgctagtgtgcgtgacctcccgggcctcaatgaattctatgaataccacgctctgatgatggaggaggaaggtgcagttatcgtgggcctcttagtcgggctcaatgtcattgacgccaatttgtgcgtgaaaggagaagatctggactcccaggtgggtgtgatcgactttagcatgtacctcaagaacgaagaagatatcggaaacaaggaaagaaatgttcaaatcgccgccatcctagaccaaaagaactacgtcgaggaattgaatagacaactgaattctaccgtgtcatccttacactcgagggtggacagcttagagaagagtaacaccaaactgatcgaggaactcgcaatagccaaaaataatatcattaagcttcaggaagaaaatcatcagctgcggagtgagaataagctgatcttgatgaaaacgcagcagcacctagaagtgaccaaggtagacgtggaaaccgaacttcagacttacaagcactcgcgtcaagggctggacgagatgtataacgaggcacgtcgacaattgcgtgatgaatctcagttacgccaagatgtggagaacgaacttgctgtgcaagtgtccatgaagcatgagatcgagctggctatgaaactactcgagaaggacattcatgagaagcaagacaccctgattgggctgcgccaacagctggaagaggtaaaggcgattaatattgagatgtatcagaaactgcagggatctgaggatggtctcaaagaaaaaaacgagatcatcgcaaggctcgaggagaaaactaacaagatcacggcggccatgcgtcagttggagcagtcagataacgacctgttaacacagactagaactatcgccatgagtctggtgaagtgcgcttcctcagatacccaggatcaatataagctcgtgaaggatatatcattctag

SEQ ID NO: 33249 - DNA, 1140 bp, Artificial Sequence
  Description of Artificial Sequence: Synthetic coding sequence
atggtgaggaagtcctttctgtcttataataaaactatttggggcccacttgaattagtcgaaaagttatacccggaagctgaggagattggcgcatctgtcagggacttacctgggttgaaaaccccactggggcgggcaagggcttggctgaggttggccctgatgcaaaaaaagatggcggactacttgcgatgcctgattatccaaagggacctactgagcgagttttatgagtaccacgcgttaatgatggaggaggagggcgctgttatcgttggactgttggtggggctcaatgtgatagatgcaaacctttgcgtgaagggtgaagacttagattcccaggtgggagtcatagatttttccatgtacctcaagaacgaggaggacatcggcaataaagaaagaaatgtacagattgctgccatcctcgaccagaaaaattatgtggaagaactcaaccgacagctcaatagcaccgtctcaagtctccattcgagagtagacagcctggagaaaagcaacacaaaacttattgaggaactggctatcgcaaaaaataacattattaaactacaggaggaaaaccaccagctgcggtctgaaaataagttgattttgatgaaaactcagcagcatttggaggtaacaaaggtagacgtggagacggagctgcaaacgtataaacacagccgccaaggcctagacgaaatgtacaacgaggccaggcgacagttaagagacgaaagccaactgcggcaagacgtggaaaatgagctcgctgtgcaggttagcatgaaacacgaaatcgagctggctatgaagttactcgagaaagatattcacgaaaagcaggataccctgattggattaaggcagcagctcgaggaggtgaaagccatcaatatagagatgtaccagaaattacaggggtcggaagatggacttaaagagaagaacgagatcatcgcaaggctggaagagaaaaccaataagatcactgcagccatgcgacagctcgagcaatcagacaatgaccttcttacacagacccgaaccatcgcgatgtctctggtgaaatgcgccagctcggacacacaggaccagtacaaactggtgaaagatatctcattctag

SEQ ID NO: 33250 - DNA, 2529 bp, Artificial Sequence
  Description of Artificial Sequence: Synthetic coding sequence
atgaagcgcgggaggctcccaagcagttctgaggattctgatgataatggctccctttccaccacctggagccagaactcacgctcgcagcatcgccggagttcatgcagtaggcacgaagataggaaaccatccgaagtttttcgaaccgacctgatcacagctatgaagctgcatgatagctaccaactgaaccccgacgagtattatgttctcgccgatccttggcggcaggaatgggagaagggtgtgcaggttccggtttcaccagggaccattccccagccggttgcgagagtggtgtctgaggaaaagtcgttaatgttcatccgacccaagaagtatattgtgtcatcgggctcagaaccaccagaactggggtatgtcgacattcggacactggcggatagtgtatgtaggtacgatcttaatgatatggatgcggcatggcttgagctaactaatgaggaattcaaggaaatgggtatgcccgaattagacgaatacactatggagagagtattggaagaatttgagcagcggtgctatgataacatgaaccacgccatcgaaacagaggagggcctcggtattgagtatgacgaggacgtcgtgtgcgacgtctgccaaagccctgacggcgaggatggtaacgagatggtgttctgcgacaagtgcaacatctgcgtgcatcaggcctgctatgggattctcaaggtccccgagggttcttggctttgtcgaacatgcgcccttggggtgcagcctaagtgcctgctgtgtccaaagaagggaggggcaatgaagccaacgcggtccggaaccaaatgggtgcatgtgtcatgtgcgctatggatccctgaagtaagcatcggatcacctgaaaaaatggagcctatcacaaaggtgagccacataccttccagtagatgggccctcgtgtgctcactgtgcaatgagaaattcggagcgagtattcagtgttcggttaaaaactgcagaacggcatttcacgtgacctgcgcattcgatcggggactcgaaatgaagacaatcttagccgaaaatgacgaggtgaagttcaagagctactgtccaaaacattcctcgcaccgcaagccggaagagtccctgggcaagggagccgctcaggagaatggcgctccggagtgttcccctcggaatccgttggaaccatttgctagtctggaacagaacagagaagaggcccaccgtgtttcagtgcgtaaacagaaactccagcagttagaagacgaattttacacctttgtcaacctgttagacgtggcccgtgccctccgcctgcccgaggaagtggtggatttcttataccagtattggaagcttaaaagaaaagttaattttaacaagccactgattacccccaagaaagatgaggaagataatttagctaagagggagcaggatgtgcttttcagaagactgcaattgttcacccacctgcgccaggacctggagcgggttcgcaacctgacttatatggtgactcgccgcgagaagatcaaacggagtgtctgcaaggtgcaagagcagattttcaacctgtatacgaaattgctggagcaggagagggtcagcggggtgccttctagttgctcttcctcttctttagagaatatgctgctgttcaatagcccatcggtcgggcctgatgcacctaagattgaagacttgaagtggcacagtgccttcttccggaagcagatgggtacctccctggtgcatagcctgaagaagccccataagcgtgacccactccagaacagccccggaagcgaaggcaagactcttcttaagcagccagatctgtgtggcaggcgggaaggcatggtggtgccagaaagctttcttggactagaaaaaacatttgcggaggctagactaatctcggcacaacagaaaaatggcgttgtcatgcccgatcacgggaagagacgagacaatagattccactgcgacctcattaaaggagaccttaaggacaagtctttcaagcagagccataagccactgcggagcactgatgtttcacagcgccacctcgacaacacccgagctgctacatctccgggcgtggggcagtcggcccccgggactagaaaagaaattgtgcccaaatgcaatggaagtctgatcaaggtgaattataaccagaccgccgttaaggtgcctactactcctgcatctcccgtcaagaactggggtggctttagaatcccaaagaaaggtgaacgtcaacagcagggcgaagcacatgatggggcttgtcatcagcattcagattatccatatctggggcttgggcgagtccccgccaaagaacgggccaaatcaaaactgaaatccgacaatgagaatgatgggtatgtccccgacgttgaaatgtctgatagtgagagtgaggcatcagaaaaaaagtgtatccacacctcctcaactattagccgccgaaccgacatcatccgccggagcattctcgcatcttag

SEQ ID NO: 33251 - DNA, 1521 bp, Artificial Sequence
  Description of Artificial Sequence: Synthetic coding sequence
atggcagagactccacccccacctacggccggcgccgaaagttgcagtgaagagcccgcacggggaggcgagtggcgacccgaagaaccccgccgtgcacctgctggtggcactgatagagagggagaagcaggaccgccgcccgcgagtccagctggacagtctgagccagacagccccgtcgcagccccattttttctgttatatcccggtgatggcggtgcagggttcggggtccgacctcccccccaacaacagagaagctggcgcacccctccttcccctggctcaccattaccctttcttttgctctcctatcctagcgggggagggggcagcagcggctccggcaaacatcatccgaattatttgatggcaaatgagcggatgaacctgatgaacatggccaaattgtcaattaagggcctgatcgaaagtgccctcaatcttgggcgcaccctcgactcagactacgctcccttacagcagtttttcgtggtaatggagcattgcctcaagcacggactcaaagccaaaaagacttttctcggccaaaacaagtcgttctggggacctctggaacttgttgaaaaactggtcccagaggcggccgagatcacggcttccgtgaaggatctgcccggacttaagactccggtgggacgtggcagggcctggctcagattggctctcatgcaaaagaagctgagcgagtacatgaaagcccttattaataaaaaagagctgttgtccgaattttatgagccaaatgctctcatgatggaagaagaaggcgccataattgccgggttgttagtcggcctgaacgttatcgatgcaaatttctgcatgaagggagaagacctggactcccaggtaggcgtgatcgacttctccatgtatttaaaggacgggaactctagcaagggtactgagggcgatggtcaaatcaccgccatccttgatcagaaaaattatgtggaggagcttaaccggcatctgaacgcaacggtaaataatctccaggccaaggtcgatgccctggagaaatccaatactaagctcactgaggagcttgctgtggcgaacaatcgcatcatcactctacaagaagagatggagcgggtaaaggaggaatcctcctatatcctggagtctaaccggaaaggaccaaagcaggatcgcaccgcagaggggcaggcactcagcgaagcacggaaacatctcaaagaagaaacccagctccggctggatgtggaaaaggaactggaaatgcagatctccatgcgccaggagatggagctggccatgaagatgttagagaaggatgtgtgcgagaagcaggacgccctagtgtccttaaggcagcagttggacgatctccgcgcgttgaagcacgagctcgccttcaaattgcagagctctgacctgggggtcaaacagaagtcagagctcaattctcgcctcgaagagaaaaccaatcagatggcagctactattaaacagctagagcagaggtag

SEQ ID NO: 33252 - DNA, 297 bp, Artificial Sequence
  Description of Artificial Sequence: Synthetic coding sequence
atggccgaaacacccccgccccctaccgccggagccgaatcttgttccgaggaacccgctcgcggaggcgagtggaggccagaagaaccccgaagggcgccggcagggggtactgacagagagggtgaagctggccccccccccgcgtcgccggctgggcagtctgaacccgattctcctgtggctgccccgtttttcctgctatatcccggagacggtggggctggatttggggtgcgtccgcccccccagcagcagaggtcctggagaaccccgcccagtcccggttctccctag

SEQ ID NO: 33253 - DNA, 1362 bp, Artificial Sequence
  Description of Artificial Sequence: Synthetic coding sequence
atggatggagaatggctctgtctgagggaacttgacgacatatcccttacccctgacccagagccgactcatgaagacagttgggaggatctgacagatttagtcgaacaaatgcgggatgatacagaagatcccaattatctgatggccaatgagcgcatgaatttgatgaacatggctaaactgagcatcaaggggctgattgagagcgccctgaacctcggtcgaacactggactcagactacgccccactccaacagttcttcgtggtgatggagcattgcctgaaacatgggctgaaggctaaaaagacttttctgggccaaaacaagtcattctggggacctttagagctggttgaaaagctggtgccagaagctgcggaaatcaccgctagtgtcaaggacctccctggtctcaagacaccggtaggacgcgggcgcgcctggctgcgacttgcactgatgcaaaaaaagttgagtgagtatatgaaagctcttatcaataaaaaggaactgctttctgagttttacgagccgaatgcactaatgatggaggaggagggagccattatcgctgggctgctggtagggttgaatgtgattgatgcaaatttctgcatgaaaggagaggacttggactcacaggtaggtgtgatcgacttttcgatgtatctgaaagatggtaattcaagtaaaggtacagagggggacggacagataacggccattctcgaccaaaaaaactacgttgaggaactgaatagacaccttaacgccactgtaaataatctgcaggccaaagttgacgcactggaaaaatctaacactaagctgacagaagagctggccgttgccaacaatcgtatcatcacccttcaagaggagatggagcgggtgaaggaggagtccagctatattttggaatcgaaccggaaaggtccaaaacaggatcgtaccgcggaaggacaggccctcagtgaagcccgcaagcacctcaaagaggagacacaactgagactggatgttgagaaagagttagagatgcagatttctatgcggcaggagatggaacttgccatgaaaatgttagagaaagatgtgtgtgagaaacaagacgcactggttagcttgagacaacaactggacgatctgagagctctgaagcacgagctagccttcaagctccagtctagcgacttaggcgttaagcagaagagcgaactgaatagcaggctggaggaaaagactaatcagatggcggccacaataaagcagctggaacagagtgaaaaagatcttgtgaaacaggctaagacactcaattctgccgcaaacaagttaatccccaaacaccactag

SEQ ID NO: 33254 - DNA, 1863 bp, Artificial Sequence
  Description of Artificial Sequence: Synthetic coding sequence
atgtcagccttaactccacctaccgacatgccaactcctacaaccgacaagatcacacaagcggccatggaaacaatctacttgtgcaaattccgggtgtccatggatggcgagtggctgtgcctccgggaactggacgacatttcccttacaccggatcctgagccaactcacgaggaccctaattacctcatggccaacgaacgcatgaacctgatgaatatggccaagctctccataaaagggttgattgaatccgcactaaatctgggaaggaccctggactcagattatgctcccctgcagcaatttttcgtcgttatggagcactgtctaaagcacgggctcaaagcgaaaaaaacatttctaggccagaataaatccttttgggggcccctggagctcgtcgagaagttagtccctgaggcggcagaaatcactgcatctgtcaaggacttgcccggtctcaaaactccggttggacgcgggagagcctggttgaggttggctctcatgcaaaaaaaactttctgaatacatgaaggcgctgatcaacaaaaaggaactcctgtcagagttctacgagccgaatgccctgatgatggaggaagagggcgctatcattgcaggtttgctggtgggcctcaacgtgatagatgcgaacttttgcatgaagggggaggatttggacagccaggtaggtgttatcgatttctcaatgtatctgaaggatggaaacagctctaagggtacagagggtgatggccagatcaccgctatcctcgatcaaaagaactatgtggaagagctaaatcgacacctgaatgcgacggttaataatctgcaggccaaggttgacgcccttgaaaagtcgaacaccaagcttacagaagaactggcagtcgcaaataatcgtataatcactctgcaggaggaaatggagcgggtcaaggaggaatcctcatacatcttggagagtaaccgaaagggtccaaaacaggaccggacagcagagggacaggccttgtcggaagcacggaaacatctcaaggaggagacgcaactgagattggacgttgagaaagagctagaaatgcaaatcagcatgaggcaggagatggagctcgctatgaagatgcttgagaaggatgtgtgtgagaagcaggatgcactcgtttcattgagacagcagttggatgacctgcgggccttaaagcacgaattggcttttaaacttcaatcatccgacctgggcgtaaaacaaaagagtgagctgaacagccggttggaagagaagaccaaccagatggctgccacaattaagcagctggagcagcgcctgaggcaggctgagagaagcagacagagcgccgaactggataataggctcttcaagcaggactttggtgataaaattaattcactgcagctcgaagtcgaggaattgaccaggcagaggaatcagctcgaactggaactcaagcaggaaaaggaaagacggttgcagaacgacagatcgatcccaggaaggggttcccaaaaaagcgaatcaaaaatggatggaaagcataagatgcaggaggagaatgttaagctgaaaaagcccctggaggaatcccaccgtctgcaacctcacccaatggacgaacaagaccagctgctgctctccgaaaagccccaactgtgtcaactatgtcaggaggatggatctctaaccaaaaacgtgtgcaagaattgttcaggtactttctgtgatgcctgttcaactaacgagctgcccctgccatcaagcattaaacttgagcgcgtctgcaacccctgccacaaacaccttatgaagcaatattcaacttccccaagttag

SEQ ID NO: 33255 - DNA, 1716 bp, Artificial Sequence
  Description of Artificial Sequence: Synthetic coding sequence
atggccgaggagggcgccattctgaaggtgactaaggacctcagggctgcagtgagcgctatcctgcagggctatggagatgggcagggaccagtcacagacacatcggcagagctccacagactctgcgggtgtttggagctcctgctgcagtttgatcagaaggagcagaagtcttttctagggccgagaaaagactactgggatttcttatgcactgcactgcgtcggcagaggggaaacatggagccaattcacttcgtgaggtcacaggacaaactgaagactcctctcgggaaaggaagagcctttatccggttctgcctagcacggggccaactcgccgaggcactgcagttatgcctcctgaacagcgaacttacacgagagtggtacggccctaggtcgcccctgctttgccctgaacgccaggaggacattctggatagcctgtatgctttgaatggagtggcctttgagctggatttgcagcaacctgaccttgatggggcctggccaatgtttagtgaatcaaggtgctccagttccacccagacccagggacgtcggccccgaaaaaacaaagatgcgcccaagaagattcctgcggcctacgggggccctgagaacgttcagattgaggattctcacacgtcccaggctatttgcctccaggatgcccctagcggacagcagctcgcgggccttccgcgctcccagcagcagagacacctgcccttcttcttggaaaaaaagggtgaatcgagcagaaaacatagatatccccagtctatgtgggaacctgagggtaaagaacttcaactcgaccaggaggaacgcgccccttggatcgagatcttcttgggaaactccactccaagtactcagggacagggcaaaggtgctatgggcacccagaaggaggttatcggaatggaagctgaagtgacaggggtgctgctggtcgcggagggccagagaacaactgaggggacacacaagaaagaggccgagtggtcccatgtgcagagactgctgatgccctctccacgcggggcagtggaaggcgcagtgtcaggaagccggcaaggttcaggaggctcaagcattttgggagagccttgggtccttcagggccatgccacaaaagaagatagcaccgtcgagaacccccaggtgcagacagaagtcacattggtggcccgcagagaggagcaggcagaggtatctctccaagatgaaattaaatcattgagacttggactacgcaaggcggaggaacaagcgcaaaggcaggagcagctcttaagggaacaggagggagaattgcaggcactcagagagcagctctccaggtgccaggaggaaagagctgaactgcaggcacaactcgagcaaaaacagcaggaggctgagcgtcgagatgctatgtaccaggaagagctaggcggacagcgggatctagttcaagcaatgaagaggcgcgtgctcgagctgattcaggagaaggataggctatggcagcgactgcaacacctgtcatcaatggcccccgaatgttgcgtagcctgcagtaagattttcggaagattctccaggcggtatccttgccgcctgtgtgggggcttgctctgccacgcctgttctatggattataagaagcgtgatcgttgctgtcctccttgtgctcagggtcgagaagcgcaggttacttag

SEQ ID NO: 33256 - DNA, 1824 bp, Artificial Sequence
  Description of Artificial Sequence: Synthetic coding sequence
atggcagaggagggggctatacttaaggtaacaaaggacctgagggcggctgtctctgccatactgcaaggctacggcgatggacagggtccagttaccgatacgagtgccgaactgcataggctgtgtgggtgtctggaactcctcctccagttcgaccagaaagagcagaagtcttttcttgggcctagaaaggactattgggattttctctgtactgcactcagaagacaaagaggcaacatggagccgattcactttgtaaggagccaggacaagctgaagacccccctcggaaaggggcgcgcttttatccgcttttgcttagctcgcggccagttagcagaagccctgcagctgtgtctgctcaacagcgaactgacgcgggaatggtatggccccaggtccccactgttgtgtcctgaacgccaggaagacatactcgattcgttgtatgctctgaacggggtcgctttcgaactggatctccagcagcccgacctcgatggtgcctggccaatgttttcggagagtcgatgctcttcctctacacagactcagggcagacgtcctcgcaagaataaggacgcacccaaaaaagtgcccctgccttgccttcactctgagctgccattgccgcatctcctggggatcctcaaaatccctgctgcatacgggggacctgaaaacgtgcagattgaagactcacatacttctcaagccatctgtttacaggacgccccctccggacagcagcttgcaggactcccacggtcccagcagcagcgccacctgccttttttcctggagaagaagggggagtcctctcgcaaacacagatacccgcagtcaatgtgggagcctgaaggcaaagagctgcaactcgaccaggaagagagggctccttggattgaaatttttctgggcaatagtactccttccacgcaggggcagggcaagggcgctatgggcacgcagaaggaagtcattggcatggaggccgaagtcacaggagttctactggtggcagaaggtcagcggacgactgaagggacccacaagaaggaggctgagtggtcacatgtgcagaggctgctcatgccctctcctaggggcgccgtcgagggcgcagtgagtggaagcaggcagggtagtggcgggtcatctattttaggcgaaccttgggtcctacagggtcacgctactaaagaggattccactgttgaaaatccccaggtgcagaccgaggtaacgctggtggcgagacgggaagagcaggcagaggtctcacttcaggatgaaattaagtcccttcggctgggcctgcgcaaggctgaggagcaggctcaaagacaggagcaactgctccgtgagcaggagggcgaacttcaggcgctacgcgagcaactgtcccggtgtcaggaagagagggccgagctgcaagcacagctcgaacagaaacaacaggaagctgaacgccgagacgcgatgtaccaagaagagttgggtgggcaaagagatctggtgcaggccatgaaacgcagggtgctggagctcatccaggagaaggaccgcctctggcagcgattacagcatttatcctctatggcccctgagtgctgtgtggcatgctcaaaaattttcgggcgattctccagacgctacccgtgttccgcacgcacttcccttggccgcgaggaatccgagccccccggggaagctgctatgtggaggtggcggctctggagaggccgcgcgtccgggcacccaagcggcgagggacggccacccgagaccaatcagggacattccactggaagatag

SEQ ID NO: 33257 - DNA, 519 bp, Artificial Sequence
  Description of Artificial Sequence: Synthetic coding sequence
atggctgaggagggcgcaattctgaaggttacgaaagacttgcgtgccgctgtttccgccattttgcagggttatggtgacggccagggccctgttacggacacctccgcggagttgcaccgcctgtgcggatgtctggagttactcctgcaatttgaccagaaagaacagaagagcttcctcggacctcggaaggattactgggactttctttgtacagcactcaggcggcagcgggggaatatggaacctatccattttgtgcgtagtcaagacaaaggcatggtctggaccccagagccctccgctctccctaggaccccacggcggcatccaggcctatcattgtgtagccagtggggcgggctacgagtcggtccccctgcagcacgcccggggtggtccctcgcccacgtgctccgcgtgacactgctgcagttccatcctaacccgggaaaagagacccagaaaaaacaacggtgtccaaaggaggaccctagtagaatctggagagcctag

SEQ ID NO: 33258 - DNA, 1842 bp, Artificial Sequence
  Description of Artificial Sequence: Synthetic coding sequence
atggctgccgtcgaggcagcagcagaacctgtcacggtggtggcagccgtgggccctaaagccaaggatgaagaggaagaggaggaagaacctctgcctccttgtgaggccgtgcggtgggcacccgttggagcagtcgccgaagcacgcccaggagctaccgccttcttagaggaggccaccgcggaagaacctggggcagctcctggcagcccgccagacagtccaggacgtactctcaggcgtctgagggctgagaggaggcgcttagacagcgcccttctggctctgtcaagccactttgctcaggtgcagtttagactcagacaggttgtgaggggcgcccctgcagagcaacaacggcttctgcgggaactcgaggactttgccttccgtgggtgcccgcacgtcctaggttacgagggaccaggagacccagctagcgatgaaggggatggactgcccggtgatcgtccatggcttaggggagaagatcagtcggaacaagagaagcaagaaagactcgagactcagcgcgagaagcagaaggaactcatacttcagctgaagacccaattggatgacctggagaccttcgcttatcaagaaggtagctacgactctctccctcagtccgtggtgctggaacgccaaagagtgatcatcgacgaactgatcaagaagttagatatgaacttgaatgaggatatcagcagcctgagcacagaggagctgaggcagcgggtggacgctgccgtggctcaaattgtgaacccagcccgagtgaaagaacaactcgtggagcagctcaagacacaaatccgagacctggagatgtttataaatttcatacaagacgaggtaggaagtcccctccaaactggcggcggtcattgtgaatgcaaggcaggcgggaagaccggtaatggctgttcccggacaggctcctctcgtactccgcctggcaatagtaagactaaagcagaggacgtcaaaaaagtccgagaaacaggcctgcacctgatgagacgagccctcgcagttctccaaatttttgctgtgtcccagttcgggtgtgccacaggccaaattccccctactctgtggcaacgggttcaggcggatcgtgactactctcccctcctcaaaaggctcgaggtgagcgtcgatcgggtgaagcagctcgctctccgccagcagccccacgaccatgttatcacctctgccaacctacaagacctctccctcggagggaaagacgagctgactatggcggtcaggaaggaactaaccgttgcagtgagagatctcctcgctcacgggctatacgccagttccccgggtatgagcctggtgatggctccaattgcttgccttctgccagctttttcctcggctcctgaggccatgcatccctgggaactgtttgttaagtattatcacgctaagaatggtcgtgcgtacgtcgaatcgccggccagaaaactctcccagtctttcgcactacccgtgactggcggtaccgttgtgacccctaagcagtccctcctgaccgccattcacatggtgctcactgagcacgatccattcaaacggtcggctgacagtgagctgaaagctctggtgtgtatggccctgaatgagcagaggttggtcagctgggttaacctgatctgcaagtccggctctctaatcgaaccccactaccagccttggtcttatatggctcacaccggctttgaatcagccttgaaccttctgtcaagattgtcctcactgaaattcagcctgccagtggacctggcagtgcggcagctgaagaacatcaaggatgcattctag

SEQ ID NO: 33259 - DNA, 1422 bp, Artificial Sequence
  Description of Artificial Sequence: Synthetic coding sequence
atggcttcgcgcagccttggtggactttccggaattcgcggcggaggagggggaggtggaaaaaagtccttgagcgctaggaatgccgccgtggaacgcaggaacctgattaccgtctgcaggttttctgtaaagacactgatcgatagatcatgtttcgaaaccattgacgacagttctcccgaatttaataattttgccgccatcctggagcaaatacttagccatcggctgaaagagatttcacagagctgccgctggctggctcaccttcagatacctttgcaggggcaggtgacttggttcgggtatgagagtcccagatctttttgggattatataagggtcgcatgtagaaaggtttctcagaactgcatctgcagcatagaaaacatggagaatgtgtcctcctcgcgggcaaagggacgcgcatggataagggtcgcactgatggagaaacacctctccgagtatatctctacagcccttagggactttaagaccactcgcaggttctacgaggatggagcaatcgtgttaggcgaagaagccaacatgttagcaggcatgctgctgggccttaacgccatcgactttagcttttgtctaaagggagaggggttggacggatcctttccggccgtgattgactataccccatatctcaaatacattcagagcagcgattctatctcctccgatgaagaggagctgaggacactcggtagttcagggagcgaatccagtacacctgagaatgtcggcccgcccttcctgatggatgagaacagttggttcaacaagtgcaaacgggtcaagcaaaagtaccaactgaccttggaacagaaaggttatttggaagagctccttagactccgcgagaaccagctgagcgagagcgtgtctcaaaacaaaatactactgcagcggattgaggactctgacttggcacacaaactggagaaagagcagcttgagtacatcatcgtcgagctgcaagaccagctgacagtgctgaagaacaacgacctgcggagccggcaggaactcactgctcaccttacaaaccaatggccctctccaggcgcactggatgtgaatgcagtcgcactcgacaccctgctgtatcgtaagcacaataagcaatggtacgagaaatcctaccagagcctggaccagttgtccgccgaggtcagtctgtctcagaccagtctggatccaggccagagtcaagaaggcgacggcaaacaggacaccctcaatgtgatgtctgaagggaaagaagacaccccatcgcttctgggactgtgtgggtccctgacaagcgtggcatcttacaagtcactcacatctttgaagtctaacgactacctcgcttcaccgaccaccgagatgaccagtcccggactaactcctagctag

SEQ ID NO: 33260 - DNA, 1371 bp, Artificial Sequence
  Description of Artificial Sequence: Synthetic coding sequence
atggcgtccagatccctgggtggtctgagtggcattaggggaggcggtggaggcggtgggaagaagtctctaagtgccagaaatgccgctgtcgaacggaggaaccttatcactgtgtgcagattttctgtcaaaactcttatcgataggtcctgctttgagaccattgatgattcttcccccgaattcaataatttcgccgcaatacttgaacagatcctttcacacaggctcaagggtcaggtgacatggtttggctacgaatccccccgaagtttttgggactacattagagtagcctgtcgtaaagtctcacagaattgcatctgttcgatagaaaatatggaaaatgtgagtagttctagagcaaagggacgagcctggatccgggtcgcactcatggagaagcatctgtcagagtacatcagcacagcccttagggattttaagacaacgcggagattttatgaagatggcgctatcgtcctgggggaagaagctaacatgctggccggcatgctcctgggcttgaacgcgatagactttagcttttgcttgaagggtgagggcctggacggcagttttccagccgttatcgactatacaccctacctgaaatacatccagtcttctgactcaatctcttccgatgaggaagagctcagaacccttggtagctctgggagcgagtcctctacccccgagaacgttggtcctccttttcttatggatgagaactcctggttcaataagtgcaagagggttaaacagaagtaccagctgacactggagcaaaaagggtatctcgaagaactgctgcggcttcgggagaatcagctgagtgaatctgtgtctcagaataagatccttctgcaaagaattgaggattcagacctggcacataagttagaaaaggaacagctcgaatacatcatcgtcgaacttcaggatcagttaacagtgctgaaaaataacgacttgcgctccaggcaggagttgactgcgcacctgactaaccaatggcctagcccaggagctttagatgtaaatgcagtggccctggacaccttactctatcggaagcataataagcagtggtacgaaaagtcataccaaagtctggatcaattaagcgccgaagtctctcttagtcaaacgtctctggatccaggacagtcccaggaaggtgatgggaagcaggacaccctgaacgttatgagcgaaggaaaggaggataccccctctctgttaggactgtgtgggtcccttacgtccgtggctagctacaaatcactgacttcactgaagagcaatgattacttggctagtcctacaactgagatgacctcccctggcctgacccctagttag

SEQ ID NO: 33261 - DNA, 1224 bp, Artificial Sequence
  Description of Artificial Sequence: Synthetic coding sequence
atggcatctcgttcactaggtggcctgtcaggcattcgtggagggggaggaggcgggggcaaaaaatcgctgtctgcaaggaatgctgccgtggaaagacggaatttaatcacagtgtgccggttcagtgtgaagaccttgatagacagaagctgcttcgagaccattgatgatagttcaccagaattcaataacttcgccgctatcctggagcagatcctgtcgcatcgcctgaaagggcaggtgacatggtttggatacgagtccccacggagtttttgggactatattagggtggcctgcagaaaagtgtctcagaactgtatctgttccatcgagaacatggagaacgtttcgtcctctagggccaagggtcgtgcttggattcgcgtggccctgatggagaagcacctttctgaatacatttcaactgccctgcgagactttaaaacgactaggaggttctacgaggatggtgcgatcgtacttggggaggaggctaatatgctggctgggatgttattgggattaaacgccattgatttctcattctgtctgaaaggcgagggactcgatggttcttttcccgccgtcatcgattatacaccctacctgaaatatatacagtccagcgacagcatcagtagcgatgaggaggagctcaggacgttaggctcttccgggtccgagagctcaacccccgagaatgtgggtccaccttttctgatggatgagaacagttggtttaataagtgcaaacgtgttaagcagaaatatcagcttaccctggaacagaaaggatatcttgaagagctgttaaggctcagagagaaccagctatccgaatccgttagtcagaacaagatcctgttgcagaggattgaggactctgacctggcacataagctggagaaagagcagctggagtacataatcgtcgaactgcaggatcagctcaaatcttaccagtcccttgatcagctctctgcggaagtgagcctgagtcagacatcactggaccccggccagagccaagaaggcgatggcaagcaggataccctcaatgtgatgagcgagggtaaggaggacacaccttccctgttggggctgtgtggatctttgacaagtgtcgcttcttataagtctctaacatccctcaagtccaacgattaccttgcctcccccactaccgagatgacatcacccggccttacaccttcgtag

SEQ ID NO: 33262 - DNA, 156 bp, Artificial Sequence
  Description of Artificial Sequence: Synthetic coding sequence
atggtcatgatctttactcttgttaccgctgtgcaagaaaagcttaatgagatcgtcgatcagattaaaactaggcgcgaggaggaaaagaaacagaaggagaaggaagcagaggaggcagagaagcagttgtttcacggaacaccagtgacatag

SEQ ID NO: 33263 - DNA, 444 bp, Artificial Sequence
  Description of Artificial Sequence: Synthetic coding sequence
atggttatgatattcaccttggtgactgcagtgcaggaaaaattgaacgagatcgtggatcagatcaaaactcgtagggaggaagaaaagaaacagaaagagaaggaggcggaggaagccgaaaagcagctgttccacggtacccccgtgaccattgagaacttcctgaattggaaggcaaaattcgatgcagagctgttagaaatcaaaaaaaaacggatgaaggaggaggaacaggccggtaaaaacaaactgtcagggaaacaattgttcgaaaccgaccataatctggacacatccgatattcaattccttgaagacgcgggaaataatgtcgaggtggacgagtctttattccaagagatggatgatctggagctggaggatgatgaagacgatcctgactacaaccctgcagatcctgagagcgatagtgccgattag

SEQ ID NO: 33264 - DNA, 732 bp, Artificial Sequence
  Description of Artificial Sequence: Synthetic coding sequence
atgacagattacggggaagagcagcggaatgagctggaggccctggagtccatttacccggattcctttacagttctcagtgagaacccgcccagcttcaccattacagtcacaagcgaggcgggtgaaaacgacgagactgtgcagaccaccttaaaatttacttatagcgaaaagtatccggacgaagctccgttatatgagatatttagccaggagaatctggaggataatgacgtgtcagatatcttgaagttactagccctgcaggccgaagagaatctcgggatggtcatgatatttacattggtgacggcagtgcaagaaaagctgaatgagatcgtagaccaaattaagacccggcgtgaggaagaaaaaaaacagaaggagaaagaagccgaagaagccgaaaagcagctatttcatggaacccctgtgacaatagaaaactttctgaattggaaggccaagtttgacgcggagcttttggaaattaagaagaagagaatgaaggaggaagagcaggctggaaaaaataagctttccggcaaacagctgttcgagactgatcacaacctggatacgtcggacatccaattcctggaggatgccggcaacaacgtggaggttgatgagtctctctttcaggaaatggacgatcttgagctagaggacgatgaggatgaccccgattacaatcccgccgatccggaaagcgatagtgccgattag

SEQ ID NO: 33265 - DNA, 204 bp, Artificial Sequence
  Description of Artificial Sequence: Synthetic coding sequence
atggtaatgatcttcacactggtgactgccgttcaggaaaaattgaatgagatcgtcgaccagatcaagacgcgccgggaggaggagaagaaacaaaaagaaaaagaagctgaagaggctgagaagcaactcttccatggcaccccagtgacaattgagaactttctgaattggaaagcgaaatttgacgccgaactcctgtag

SEQ ID NO: 33266 - DNA, 444 bp, Artificial Sequence
  Description of Artificial Sequence: Synthetic coding sequence
atggtgatgatatttacactagtgacagcggttcaggagaaactaaatgagatagtggaccagattaaaactagaagggaggaggagaaaaaacaaaaagagaaggaagctgaagaagccgaaaagcagctgtttcacgggacccccgtgaccatcgaaaacttcttaaattggaaagctaagtttgacgcagaactcctggagattaaaaagaaacgtatgaaggaagaggaacaggcgggaaaaaacaaactgtcaggaaagcaactctttgagacggatcacaatttggatacctctgacattcagtttctcgaggacgctgggaacaacgtggaggtggatgagtctcttttccaggagatggatgacctagagctggaggacgacgaagacgatcccgactataaccccgccgacccagagagtgacagcgccgactag

SEQ ID NO: 33267 - DNA, 219 bp, Artificial Sequence
  Description of Artificial Sequence: Synthetic coding sequence
atggtcatgatctttacattggtcactgccgtgcaggagaaattaaatgagatagtcgaccagattaaaacacgcagagaggaagagaaaaaacaaaaagaaaaagaggccgaggaagctgagaaacaactatttcatggaaccccggtgaccatcgaaaactttctgaattggaaagccaaatttgatgctgagttactcgagatcaagaagaaatag

SEQ ID NO: 33268 - DNA, 879 bp, Artificial Sequence
  Description of Artificial Sequence: Synthetic coding sequence
atgagtgcatccgttaaggagagcctccagctgcagttgttagagatggaaatgctgttctcgatgtttcctaatcagggggaggtcaagctggaggacgtgaacgcccttactaacattaagaggtatctagagggcacacgggaggccctccctcctaagattgaattcgtaattacactgcagattgaagagcccaaggtgaagatcgacttgcaggtgacaatgccccattcctacccttacgtggcactgcagttatttggaagaagctccgagctggatagacatcagcaactgcttctgaataagggactgacttcatatatcggaaccttcgatccgggcgaactgtgtgtctgtgccgcgatacagtggctgcaggacaacagtgccagctattttcttaatagaaaactggtctatgaaccttctacacaggccaagcctgtgaagaacacattcctaaggatgtggatatactctcaccatatctatcaacaggatctcagaaagaaaattctcgatgttgggaagcgattggatgtaacaggcttttgcatgaccggcaagcctggcattatttgcgtggaaggctttaaagagcactgcgaggaattttggcacactattaggtatccaaattggaaacacatctcgtgcaagcacgccgagtccgtcgagaccgagggaaatggagaggatttgagactttttcactcatttgaggaacttctacttgaagctcacggtgattacggtttacggaacgactatcatatgaatctggggcagttcctggagttcctcaagaagcacaagagtgaacacgtgtttcaaatcctattcgggatcgagagcaaaagttccgattcttag

SEQ ID NO: 33269 - DNA, 717 bp, Artificial Sequence
  Description of Artificial Sequence: Synthetic coding sequence
atgttatggtaccttaacttgtttgactttcatttcaaagtgaagattgatctgcaggtgacaatgcctcattcatatccgtacgtggctttgcaactgtttggacggagttccgagctggatcgccatcagcagcttctgctcaacaaaggactcactagctacatcggtacttttgatcctggcgagctgtgcgtttgcgctgctattcagtggctacaggataatagcgctagctacttcctgaatcgcaagctagtgtacgagcccagtacccaggctaaaccggtgaagaacacctttctgagaatgtggatttatagccatcacatctatcaacaggatttgcgcaagaagatactggacgtgggtaagaggctcgacgtgacaggtttttgtatgaccgggaagcccgggataatctgtgtcgaaggttttaaagaacattgcgaggaattctggcacacaatccgctatcccaattggaagcacatctcttgcaaacatgctgagtctgtggagacagagggcaacggagaagacttgcgactgttccattcctttgaagaactgcttcttgaagctcatggtgactatgggctgcggaacgattaccacatgaatctggggcagtttttggaatttctcaagaaacacaagtcggagcatgttttccagatcctgttcgggatagaaagtaagtcctccgatagctag

SEQ ID NO: 33270 - DNA, 960 bp, Artificial Sequence
  Description of Artificial Sequence: Synthetic coding sequence
atgaaaattgaattgtctatgcagccatggaacccgggatatagctcagaaggagcaaccgcacaggagacctatacctgccccaagatgatcgagatggaacaggccgaagcccagctggcagagcttgacctgctggcctccatgttccctggcgaaaacgagctaatcgtgaatgatcagttggcagtcgctgagctgaaagactgcattgaaaagaaaactatggaagggagaagctctaaagtctatttcacgatcaatatgaatctagatgtctctgatgagaagatggcgatgtttagcttggcctgtatattgcctttcaaataccctgccgttctgccagagatcaccgtcagaagtgtgctcctgtcacgctcccagcagacgcagctaaatactgatctgactgcttttttgcagaaacactgccatggagacgtgtgcattctgaatgccactgagtgggtgagagagcatgcctctggctatgtgtcacgcgatacctcttcatcccccacgacaggatccactgtgcagtccgtagatttaatcttcactcgactgtggatctattcacaccacatttacaataaatgcaaaaggaaaaatatcctggaatgggccaaggaactttccctgtccggcttcagcatgcctggtaaaccaggagtggtttgcgttgaaggaccccaatccgcctgcgaagaattctggtcccgcctgcggaagttgaactggaagaggatcctcatccgccacagagaagatataccattcgacggcacaaacgacgaaacggaacggcagaggaagttttccatcttcgaggaaaaagtattttctgtaaacggcgctcggggaaatcatatggatttcggtcagctgtatcagtttcttaatactaagggttgtggggacgtgttccagatgttttttggcgtggagggccagtag

SEQ ID NO: 33271 - DNA, 567 bp, Artificial Sequence
  Description of Artificial Sequence: Synthetic coding sequence
atgagcgccaatgaagaccaggaaatggagctggaagcacttcgctcgatttatgaaggcgatgaatcctttagggaactgtctccagtctcatttcagtataggatcggcgagaacggcgaccccaaggcctttctcatcgagatcagctggacagagacctacccacagaccccccctattctctcaatgaatgcttttttcaataacactatttcctcagccgtcaagcagtcaatcctggcgaagctacaggaagcggtggaggcgaacctagggactgcgatgacctacacgttgttcgaatatgccaaagataacaaggagcaattcatggagaaccataaccctatcaactccgctacatctatctccaatatcatttctatcgagacacctaacactgcaccttcaagcaaaaaaaaagacaaaaaagaacagctgtctaaggcacagaaaagaaagctggctgataaaaccgatcataaaggagaattgcccagagggtggaattgggtcgacgttgtgaaacatctgagtaaaacagggtcgaaggatgacgaatag

SEQ ID NO: 33272 - DNA, 564 bp, Artificial Sequence
  Description of Artificial Sequence: Synthetic coding sequence
atgagcgccaacgaagatcaagagatggagttagaagctttgcgttctatctacgagggggacgagtcattcagagagctcagccctgtctctttccagtatcgaattggcgagaacggagatccgaaggctttcctgattgaaatttcctggactgagacctacccgcagacccctcctatactttcaatgaatgcatttttcaacaatacgatctcaagcgctgtgaagcagagcatcctggccaaactccaggaggcggttgaagccaacttgggaaccgctatgacctatacgctgttcgaatacgctaaggataacaaggaacagtttatggagaaccataatccaatcaattcagccacttccatttccaatattatctccattgaaaccccaaatacagctcctagctccaaaaaaaaagataagaaagaacagttgagtaaggcccaaaaacgcaagctggcagataagactgaccataagggtgagctccctagggggtggaactgggtcgacgtggtaaaactgtcaaagactggctccaaagatgacgagtag

SEQ ID NO: 33273 - DNA, 2988 bp, Artificial Sequence
  Description of Artificial Sequence: Synthetic coding sequence
atgagcagcctgccccgtagagccaaggtacaagtgcaggacgtagtgttgaaagatgaattttcgagttttagcgaactgagctctgccagcgaggaggatgataaggaggattccgcctgggagcctcagaagaaggtaccaagatcccgaaaacaacccccccccaaggagagcaagccaaaaaggatgcctcgggtgaaaaagaatgccccccagatatctgacgggagcgaggtggtggtggtaaaagaggaactaaacagctccgttgccattgcagacaccgctctggaagatcgcaagaataaactcgatactgtacagaccctcaaaacagcaaagactaagcagaagtgcgccgcacagccccacacagtcagacggactaagaaactgaaggtggaggaagaaacaagtaaagcttctaacttggagggcgagtccaatagctcagaaaccccttcgacatccactgtgtggggcggcacatgcaagaaggaggagaacgacgatgacttcaccttcgggcagtcagccttgaaaaaaattaagaccgagacctatcctcaggggcagcctgtgaagtttcccgctaatgcgaactctactaaagaagaagtagaaatgaactgggacatggttcaggtactgtctgagaggaccaacatcgaaccttgggtctgcgcaaatatcatcagattgttcaacgatgacaataccattccttttatcattcgttataggaaggaacttatcaataacttagatgccgatagtttgcgcgaggtgcaacagaccttggaggaactgcgagccgtggccaagaaggtgcactccacgatccagaaaattaagaaggagggcaagatgtccgaatgtctattgaaagctatgctgaattgcaaaaccttcgaagagcttgagcatgtgagcgcgccctataaaactggcagcaagggcaccaaagcccaacgggctaggcagctaggtttagagggagccgcgcgggcactattggagaagccaggcgaactgtctctcctgagttatatacgaccagacgttaagggtctgtctacactgcaggatatcgaaataggagtgcagcacattttagctgacatgatagccaaggacaaagatactctggacttcattaggaacttatgccagaaacggcatgtatgtatccaatctagcctggcgaaagtgtctagtaagaaggtgaacgagaaggacgttgacaagtttctcctgtatcagcacttcagctgcaacattagaaacattcaccatcaccagatcctcgccatcaaccgtggcgaaaatctgaaagtgctgaccgtgaaagtgaacatttcagacggagtgaaagatgaattctgtcggtggtgtatacagaacagatggcgcccaagaagtttcgcgagaccagaacttatgaagatcctgtataactctcttaatgactcctttaaaagactgatctatccactactttgcagggagttccgggcgaaactgacctcagacgccgaaaaggaaagcgtcatgatgtttggcagaaatctgcggcagctgcttctgacatccccagtccccgggcgaactttgatgggagtggatccaggatacaagcacgggtgcaaacttgcaattatctcccccacaagccaaattctacataccgatgtcgtctatctgcattgcggccagggcttcagggaagcagagaaaatcaagaccttgctgctgaattttaactgcagcacggtcgtcattggtaacgggaccgcctgtagagaaacggaggcttattttgccgatttaataatgaaaaattactttgcacctctggacgtggtgtattgtatcgtgagcgaggcaggcgcaagtatctattccgtcagtcccgaagctaataaggaaatgcccggacttgatcccaatctgaggagcgcagtctcaattgcccgtagggtccaagaccccctggctgagttagttaagattgagcccaagcatattggtgtcggtatgtatcagcatgacgtgtctcagactctgttgaaggccactctggactctgtggtggaggaatgcgtgagcttcgtgggcgtggacattaacatttgttccgaagtcctgctgaggcatatcgccggtcttaacgcaaaccgggcaaagaacatcattgaatggcgtgagaagaacggcccattcattaatagagagcagttgaagaaggtcaagggcctggggcccaaatcgtttcaacagtgtgcaggctttatacgcatcaaccaagactacattcgaacattctgctcacagcagaccgagacaagcggacagattcaaggtgtggcagtgactagctctgccgacgtggaggttacaaacgagaaacaaggcaagaagaagagtaaaacagcagtaaatgtactgctcaagcccaatcccctcgaccagacttgcatccatccggagtcctatgatattgccatgcggtttctatcttctatcggcggaacgctctatgaagtgggaaagcccgaaatgcagcagaaaatcaattctttcctcgagaaagaaggcatggaaaagattgcagagcgtctccaaacgaccgtgcacacccttcaggttatcatcgatgggctctcccaaccggagtccttcgattttagaacggatttcgataagcctgactttaagcgcagcattgtctgtctggaggatctccagatcggaacagtgctgaccgggaaagtagagaatgccaccctgttcggaattttcgtggacattggagtcggcaagtccggcttaatcccgataaggaacgtgacagaggctaagctcagtaagaccaagaaacggaggtccctgggactaggccctggggaaagggtggaagtacaggtgttgaacatcgatattccgcggagtcgtattactctggacttaattagggttctgtag

SEQ ID NO: 33274 - DNA, 1545 bp, Artificial Sequence
  Description of Artificial Sequence: Synthetic coding sequence
atgaagatcctgtataatagtctgaacgattcctttaagcgcctgatctacccactactgtgcagggaattcagagccaaactcacctctgacgctgagaaagaatctgttatgatgtttggcagaaatcttcggcagcttttactgacctcgcccgtgccgggtaggacgctgatgggagtggaccccggttataaacatgggtgcaagctcgccatcataagtcccacatcccagattctccatacagacgttgtttacctccattgtggccagggtttcagggaggcggagaagataaagactcttttgcttaattttaattgctctacagtggtcatcggaaatgggacggcatgtcgagagaccgaagcgtatttcgcagacttgatcatgaagaactacttcgcgcctctggacgtggtatactgcattgtgtccgaagccggagcgtctatttactccgtgtcccctgaagctaacaaggaaatgcccggcctggacccaaaccttagatcagcagtgtccatcgcgaggagggtgcaggacccactggctgaacttgtgaaaatcgagcctaagcacataggagtcggcatgtatcagcatgacgtttctcagactctgctgaaagctaccttagattcagtcgtggaggagtgtgtgtccttcgtgggggttgatatcaatatttgctctgaggttcttctgaggcatatagcgggattgaatgccaacagggccaaaaatatcatcgagtggcgcgagaaaaacgggccatttattaacagggaacagctgaaaaaggtaaaggggctgggccctaagtcgttccagcagtgcgcaggcttcatccggataaatcaagactatatcaggacattctgcagccagcagactgaaacttccggacagattcaaggggtcgcagttacctcatctgctgatgtcgaggtgaccaatgagaaacagggcaaaaaaaagagtaagaccgcagtgaacgtgctcctcaaacccaatcctctggaccagacatgtatccacccggaaagctacgacatcgcgatgcgatttctctcaagcattggaggcaccctgtatgaagtggggaaaccagagatgcagcaaaagattaacagtttcctggagaaggagggcatggaaaaaattgccgaacgactgcaaactactgtgcatacccttcaggtgatcatcgatggcctttcccaacctgagtcctttgacttcagaactgacttcgataagccagactttaagcgctccattgtgtgcctagaagatctgcagatcgggacagtactcacagggaaggtggagaatgctaccctcttcggcatctttgtggatatcggagtgggaaaaagtggactgatccctattaggaacgtgacggaagctaaactctcaaaaaccaaaaagcgtaggtcactcggcctgggccctggcgagagggttgaggtgcaagtgctgaacattgacattcccagatctcggataacgctggacctgatccgtgtcttatag

SEQ ID NO: 33275 - DNA, 306 bp, Artificial Sequence
  Description of Artificial Sequence: Synthetic coding sequence
atgaacatccctcttggcgaaaaggtgatgctggatatcgttgccatgttcagacagtactccggggatgacggacgcatggatatgccagggctcgtcaatctgatgaaggaaaattttcccaacttcctgagcgggtgtgagaagtccgacatggattatctgtccaatgctttagagaagaaggacgataataaggataaaaaggtgaattacagtgagtttctaagcctgttgggggacataacaatagaccatcataagattatgcacggggtggcaccctgctctggaggctctcagtag

SEQ ID NO: 33276 - DNA, 306 bp, Artificial Sequence
  Description of Artificial Sequence: Synthetic coding sequence
atgaatatccccttaggcgagaaggtcatgttggatattgttgctatgttcagacagtactccggagatgatgggaggatggatatgcccgggctcgtcaatctgatgaaggaaaactttccgaattttctctccggctgtgaaaaaagcgatatggattacctcagcaatgcgctagaaaagaaagatgataataaggacaagaaagtgaattactccgagtttctttcgctgctgggcgacatcacaatcgaccaccacaagattatgcacggggtggcaccttgttccggcggatctcaatag

SEQ ID NO: 33277 - DNA, 339 bp, Artificial Sequence
  Description of Artificial Sequence: Synthetic coding sequence
atgctcccttcttccggctttctgaaagcaaagatgaacattcccctgggggagaaggtgatgcttgacattgtggccatgtttagacaatattctggggatgacggccgcatggacatgccgggcctcgttaatctcatgaaggagaacttcccgaattttctaagtggctgtgagaaatccgatatggactacctctctaacgctttagagaaaaaggatgacaacaaggataaaaaagtaaactactctgagttcctgtcacttctcggtgacattacgattgatcatcacaagattatgcacggtgtcgccccctgttcaggcggctcacagtag

SEQ ID NO: 33278 - DNA, 2715 bp, Artificial Sequence
  Description of Artificial Sequence: Synthetic coding sequence
atgcaggcaagcccactgcagacgtctcagcccaccccgcccgaggaactgcatgcagccgcttatgtctttactaacgacgggcaacagatgcgctctgacgaggtgaacctagtggccaccgggcatcaatccaagaaaaagcactcccgaaaatcaaagcgccatagtagttccaagaggagaaagtccatgagttcttggctggacaagcaggaggatgcagctgtgacacactcaatttgtgaagaacgcatcaataatggacagccggtggcggacaatgttctgtccaccgcacccccgtggcctgacgctactatagcacacaatattcgagaagaaagaatggaaaacggacagtctagaaccgataaggtgctgtccacggcccccccccaactcgtccatatggcggcagccggcatccccagtatgtctacaagggatctgcactcaaccgtcactcacaatatccgggaggaacgcatggaaaatggccagccacagcccgacaacgtccttagcactggtcccaccggcctgataaatatggctgctacacccatccctgcaatgtccgcccgagacctctacgctacggtgacgcacaatgtttgcgagcagaagatggaaaacgtgcagcctgctcccgacaacgtcctcctgactttgcgtccaagacggatcaacatgaccgacacaggcataagcccgatgtcaactcgggatccctacgcgaccattacctataacgtgccggaggaaaagatggagaaggggcagccccagcctgataatatcttatcgactgcatctaccgggttgataaacgtggccggcgcgggtaccccagccatctctacgaatggtctgtactctacagtgccccacaatgtctgcgaggagaaaatggaaaacgaccagccacaacccaacaatgtgctaagcacagtccagcctgtcattatttatcttacagctacgggaattcctgggatgaacactcgcgatcagtatgccaccatcactcacaatgtgtgtgaggaacgggtggttaataatcagccactgcccagtaacgcattgtccaccgtcctgccaggattagcatatttagctacggccgacatgccggccatgtccacgagggatcaacatgctacgattattcataatctgagagaggaaaagaaggataattctcagcctacacccgataatgtgctgtcagctgttacaccggagctgattaacttagccggcgctggaataccccccatgtcgactcgggaccagtacgccaccgtgaaccaccacgtgcatgaagcacgcatggagaacggccagcggaaacaggacaacgtcctctctaacgtgttgagtgggctgattaacatggccggcgccagcatcccagctatgagttcccgggacctgtatgccacgatcacgcactctgtgagggaggaaaagatggagtcgggaaagccacagacagataaggttataagcaacgatgccccccagctgggacacatggctgcaggtggtattccaagcatgagcacgaaagatctctatgctacagtgacacagaacgtgcatgaagaacggatggagaataaccaaccacaaccctcctacgatttgagcaccgtattgccaggcttaacatatctgaccgtagccgggatcccggccatgtcaaccagggaccaatacgctactgtcacacataatgtccatgaagagaaaattaaaaatggacaggctgcctcagataacgtgttttcaacagtccctcctgcctttatcaatatggccgcgaccggggtgtcaagtatgtctactcgcgatcagtacgccgccgtaactcataacatacgtgaggaaaaaatcaataactcccagccagcccctggcaatattcttagcactgcccccccctggctacggcatatggcagcagccgggatcagttccactatcactcgggacctgtatgtcacagctactcattcagtacatgaagaaaaaatgaccaacggccagcaggcacccgataattctttgagcaccgttcctcccggttgtatcaatttgtcaggcgctggaatcagttgccggagcacccgagacctctacgcaaccgttattcacgacattcaggaggaggagatggagaatgaccagactccaccagacggcttcctcagcaactccgatagtccagaactaatcaatatgaccggacactgtatgccccctaacgctctggattctttttcacacgacttcacatccctgtccaaggacgaactcttatataagcccgattcaaatgagttcgcagttgggaccaagaactactccgtgagcgccggagatcccccagtgacagtcatgtctctcgtggagacggtgcctaatacacctcagataagcccagctatggccaaaaagatcaacgacgatattaagtaccagctgatgaaggaggtccgccggttcggccagaattacgagagaatattcattctgctggaagaggtgcaggggtccatgaaagtaaagcggcagttcgtcgagtttacgatcaaggaggcagcccggttcaaaaaggttgtgctcattcagcagctcgagaaagctctgaaagagatcgactcccactgtcatctgcggaaagtcaagcacatgaggaagcggtag

SEQ ID NO: 33279 - DNA, 2715 bp, Artificial Sequence
  Description of Artificial Sequence: Synthetic coding sequence
atgcaggcctcccctcttcagaccagccaacccaccccaccggaggaactgcatgccgctgcttatgtgtttacaaatgatggtcaacagatgaggtccgacgaggtgaacctggttgcaactgggcatcagtcaaagaagaagcactctaggaaatccaagaggcatagctctagcaaacgacggaaatcaatgagtagctggttagataagcaagaggacgccgccgtgacccacagcatttgtgaggagaggataaataatggccagccagtcgccgacaacgtattgtctactgcccccccatggcctgacgccacgatcgcccacaatataagagaagaaaggatggagaatgggcagagccggaccgataaggtgcttagcactgccccaccccagttggttcacatggcagcggctggcattccttcaatgtccacacgcgatttgcacagtacagtcacccacaacatccgcgaagaaaggatggagaatggacagcctcagcccgacaatgtgctcagcacgggccctacaggtctgataaatatggcagccacaccaattcccgcaatgtccgctcgggatctgtacgcgacagtgacacacaacgtctgtgaacagaaaatggagaacgtgcagcctgcgccagataatgtcctgcttaccctccgaccacgcagaattaatatgacagatacggggatctcacccatgtccactagagacccatacgccacaatcacgtataatgttcccgaggaaaagatggagaaagggcagccccagcctgacaatatccttagtaccgcgtctaccggacttataaacgttgccggagcgggaacccccgccatctccacaaacggcctgtactccactgtgccccataatgtgtgcgaggagaagatggaaaacgaccagccacagcctaacaacgtgctgtctactgtgcagcctgtaattatctacctgacggccactggcatccccggaatgaatacccgagatcaatatgcaaccatcacccacaacgtttgcgaagaacgggtagtcaataaccagccattgccttctaatgctctgtccacagtgctgcccggactggcctacctggcaactgcagatatgcctgccatgtcaacccgcgatcagcatgccaccatcatccacaacttacgcgaagagaaaaaggacaactcacagcctacccctgataatgtactaagtgcggtgactcctgagttgatcaatctcgccggcgctggtatccctccgatgtccactagggatcagtatgcaaccgtgaatcaccatgttcacgaggcccggatggagaacgggcagagaaaacaggataatgttttatctaatgttctaagcggtcttatcaatatggctggggccagcattcctgctatgagcagccgcgacttgtacgctactatcactcacagcgtgagagaagaaaaaatggagtctggcaagccccagacggataaagtaatttcaaacgacgctcctcaactggggcacatggccgctggaggtatcccctccatgagtaccaaagacctgtatgcaacagtcacacaaaacgtgcatgaggaaagaatggaaaacaaccagccacaacccagttacgatctgagtaccgttctccctggattgacttacttaacggtggccggaattcctgctatgagcactagagaccagtacgcaactgtgacacacaatgtgcacgaagagaaaatcaagaacgggcaggctgcctcggacaacgttttcagcactgttccgccagcatttattaacatggctgccacgggagtgtcctcaatgtcgaccagagatcagtacgcggctgtaacccacaacattagagaggagaaaataaataacagtcagcctgcccccggtaatatactgtcgactgcccccccttggttaaggcacatggcagccgctggaatctcatctacaattacacgtgatctgtacgtcacggccactcacagcgtgcatgaagagaaaatgacgaatggccaacaagctcccgacaactctttgagcacagtgcccccaggctgcattaatctgagcggagcggggatcagctgccgcagcacgcgtgatctgtacgcgaccgtgatccacgatattcaggaggaagaaatggagaatgatcagaccccccccgacggctttctgtctaactcggactctcccgagctgataaacatgactggacactgtatgccccccaacgctctggattcattttcccacgacttcacttctctctctaaggacgaactgttgtataaacccgacagtaatgagtttgccgtcggcaccaagaattactcagtatcagcaggcgaccctcccgtgactgttatgagtctggtcgaaaccgtccctaacactcctcagatctcgcctgctatggctaagaaaatcaacgatgacataaagtatcagctgatgaaggaagtcagaagatttggccagaactacgagaggattttcatactcctggaggaggtccagggaagcatgaaagtgaagcggcaatttgtggaattcactatcaaagaggctgcccggtttaaaaaggtggtcttgattcaacagttggaaaaggcgctgaaggagatcgacagccattgccatctgaggaaggtcaagcacatgaggaaaagatag

SEQ ID NO: 33280 - DNA, 2715 bp, Artificial Sequence
  Description of Artificial Sequence: Synthetic coding sequence
atgcaggcctccccactccagaccagtcaacccacacctcctgaagaactgcatgctgcagcttacgtgttcactaacgacggacaacagatgagaagcgacgaagtgaacttagtggctactgggcaccagtcaaaaaaaaaacatagtcggaaaagcaagaggcacagttccagtaaacgtcggaagtctatgtcaagctggttggataaacaagaggacgccgccgtcacgcattctatatgtgaggagagaataaataacgggcagcctgtggccgacaatgttctgtcaaccgctccaccttggcctgatgccaccatagctcacaatatccgtgaggaaaggatggagaatggacaaagcagaacagataaagtgttatcaactgccccaccgcaattggtgcatatggccgccgcaggtattccgagtatgtccacccgggacttgcactctacagtgacacacaatattagagaggagagaatggagaatggccagccgcaaccagataatgtcctcagcaccggcccaacaggattgataaatatggccgcaacacctattccagccatgtctgctcgcgacctctatgctaccgtgactcataatgtgtgtgaacaaaagatggagaatgtgcaaccagcccctgacaacgttttgctcaccctcaggcctcggaggattaatatgacggacaccggcatatcgcctatgagcaccagagacccttatgctactattacctataacgtccctgaagaaaagatggagaagggacagccccaaccagacaacatcttgtcaactgcctctactggcttgattaatgttgccggggccgggacaccggcgatatccaccaacggcctgtattctacagttcctcataacgtgtgtgaagagaagatggagaatgatcagccccagcccaataatgtgctgagcacagtccaacctgtcattatttacttaaccgcaaccggtattcccgggatgaataccagggatcaatatgccaccattacacacaacgtttgcgaagagagggtggtgaacaatcagcctttacccagcaacgcactgagcacagtcttgccaggtcttgcctaccttgctactgcagatatgccggccatgtccacacgtgaccagcacgctacgatcatccacaatctccgtgaggaaaagaaggataactcgcagcccacccctgataatgtcctatccgccgtcactcctgaactgataaatctcgctggagccgggatccctccgatgtccacacgtgaccagtacgccactgtcaatcatcatgtgcacgaggcaagaatggagaacggacagcggaagcaggataatgtattaagtaatgtactgtcaggcttaattaatatggcaggagcctcaatcccagccatgtccagtcgtgatttgtacgctactatcacgcactcagtccgcgaagaaaagatggagtccggcaagccacaaacagacaaggtgatatcaaacgacgcgccccagctggggcacatggcagctggaggaatccctagcatgagtaccaaggatctgtacgctacagtgacacagaacgttcatgaggaacggatggagaataaccagccacagccctcttacgacctgtccaccgttctcccagggttgacctatttaaccgtggccggaatccctgctatgtcaaccagggatcagtatgcaacagtgactcataatgttcacgaggagaagatcaaaaacgggcaggccgctagcgacaacgttttcagcactgtccctcctgcctttatcaacatggccgctacgggagttagtagtatgtcaacccgcgaccaatatgccgccgtaacacacaacattcgggaggagaagatcaacaactcccagcccgccccaggcaacattctatccactgccccgccctggcttcggcacatggcggccgccggtatcagcagcaccattacccgcgatctgtatgtgacagcaacgcactcggtgcatgaagaaaagatgacaaacggccaacaggcgcctgataactctttgtctacggtgcctcccgggtgcatcaacctatctggagccgggatatcctgccgtagtacccgggacctctacgctaccgtgatacacgacattcaggaagaggaaatggagaacgatcagacaccgccggatgggtttctgagtaatagtgatagtccagagcttattaacatgactggccactgcatgccgcccaacgccctagacagcttcagccacgattttacaagtctgtcaaaagatgagttactctataagcccgattctaatgaatttgcggtggggacaaagaattatagcgtttccgctggcgatcctccagtaacagttatgtccttagtggaaactgtgcctaacacaccacagattagccccgctatggccaagaaaattaacgatgacataaaataccagctcatgaaggaggtgcgtcgcttcggccagaattacgaacgcatcttcatactcctggaggaggttcaggggtctatgaaggtcaaaagacagtttgttgagttcacaattaaggaagccgctcggttcaagaaggtggtcctgattcagcagctagagaaggcattgaaggaaatcgactctcactgtcatttacggaaagtgaagcatatgagaaagagatag

SEQ ID NO: 33281 - DNA, 1587 bp, Artificial Sequence
  Description of Artificial Sequence: Synthetic coding sequence
atgcaggccagccccctccaaacatcccagccaacaccccctgaggaactccacgcggctgcctacgtctttaccaacgatggccagcagatgcgcagtgacgaagtgaatctcgtggccacaggccaccagagtaagaaaaagcacagcaggaagtctaagcgccattcttcctctaagaggcgtaaaagtatgtcatcatggctcgacaagcaggaggacgcagctgtcactcatagtatctgtgaggagcggatcaacaatgggcagcccgtggccgataatgtactttctactgcccctccatggcccgacgccacgattgctcataacatccgggaagaacgcatggagaacgggcagtccagaaccgacaaagtgttgtctactgcgccacctcaactcgtgcacatggctgctgccggaatcccatccatgagcaccagagacctccacgctaccgtcacacagaatgtccacgaagaaagaatggaaaacaaccagccacagccttcttatgacctgtctaccgtgctccctgggcttacatacctcactgtggcaggtattccagctatgagtacaagggatcaatacgcaaccgttactcataacgtccacgaggaaaaaattaaaaatggacaggccgcttctgataacgtcttcagtaccgtgccacccgccttcatcaacatggccgcaacaggcgtctctagcatgagtacccgagaccaatatgctgctgtaacccacaacattcgggaggaaaagatcaacaactcccaacccgcacctggaaacatactctctaccgcccctccctggctgagacacatggcggccgccgggattagttctactatcacccgggacttgtacgtcacggcaactcacagcgttcatgaggagaagatgaccaacggtcagcaagctccggataactcgttgagtacagtgcccccaggatgcattaatctgagtggagctggtatctcttgccgctccaccagagacctgtacgccacagtgatccacgatatccaggaggaggagatggagaatgatcagactccccctgacggatttctcagcaacagtgattctcctgaactgatcaacatgaccggccactgtatgccccccaacgcacttgacagtttttctcacgacttcacatcattgtcgaaggatgagttactgtataaaccagacagcaatgagtttgctgtgggcacaaagaattactcagtctctgccggagacccccctgtgaccgttatgagtcttgtggaaaccgtgccgaacaccccacagatttctcctgcgatggcgaagaaaatcaatgacgacatcaaatatcagctcatgaaggaggtgagaagatttgggcagaactatgagcgcatcttcatcctgctggaggaagtccaagggtcaatgaaggtgaagcggcagttcgtcgagtttactattaaagaagccgccaggttcaagaaggtggtgctaattcagcagctagagaaagctttaaaagaaattgactcacattgccaccttaggaaggtgaaacacatgcgaaaacggtag

SEQ ID NO: 33282 - DNA, 2715 bp, Artificial Sequence
  Description of Artificial Sequence: Synthetic coding sequence
atgcaggcttcccctctacagacctcccagcccactcctccggaagaactgcatgcggcagcatacgtttttaccaatgacggccaacagatgcggtctgacgaggtgaacctggtcgctaccggccatcagtccaagaaaaaacactctcgcaaaagtaagcgccattcctcttctaaaaggcgtaaaagcatgtcgagctggttggataagcaagaagacgcagccgtgacgcactctatctgcgaggagcgcatcaacaatggacagccggttgccgacaacgtgctatctacagcccccccctggcccgatgcaaccatcgcccacaacattcgggaggaacgaatggagaatggacagtccagaactgacaaggtactgagcacggcccctcctcagctggtgcacatggctgccgccgggattcctagcatgtctacccgggacctacactccactgtaacacacaacattagggaggaaagaatggaaaacggacaaccccagcccgataacgtattgagcactggccccaccggcctgattaacatggcagcaacacccatacctgccatgtctgcccgcgacctatacgcgacggtgactcacaatgtatgcgagcagaagatggaaaacgtgcaacccgctccagacaatgtgcttctgaccctgagacctaggcgcatcaacatgacggatactgggatttcccccatgtctacaagggatccctatgcgactatcacgtacaacgtgcccgaggagaaaatggagaaagggcagccgcagcctgataacattctcagtacagcttctaccggcttgatcaacgttgccggcgccggtacacctgccatcagcaccaacggcctgtatagcaccgtgcctcataatgtctgtgaagaaaaaatggagaatgaccagcctcagcccaataacgtactcagcaccgtccagccagtgattatttacctgacggccacaggcatccccggcatgaacacaagggaccagtacgcgactattacccacaacgtttgcgaagaacgcgtggtgaataatcagcccttgccttctaatgcgctctccaccgtgctgcccggcctcgcctacctcgctaccgcggatatgcctgcaatgtccacacgcgatcagcatgccacaataatacacaatctgcgagaggagaaaaaggacaatagccagccaaccccggataacgtgttgagtgccgtgacacctgagcttattaatctcgccggagctggaataccccccatgagtacacgggatcagtatgctactgtgaatcaccacgtgcacgaggcccgcatggagaacggacagaggaagcaagataacgtcctttccaacgtgttaagtgggctgattaatatggccggggcaagcatacccgcaatgagctcccgcgacctctacgccactatcacccactcagttcgagaggagaaaatggaatcaggaaagccccagaccgataaggtaattagtaacgacgccccacagctgggtcacatggctgcagggggaataccatccatgtctacaaaagatctgtatgccacagttacccaaaacgtgcacgaagagcgaatggagaacaatcagccccagccctcttatgatctttccaccgttctgccgggcttgacttatttgactgtggcaggaatccccgccatgtcaaccagagaccagtatgcaaccgtgacacataatgtacacgaggaaaagattaaaaacggccaagccgctagtgacaacgtcttctcaactgtccctccggcattcattaacatggccgcaacaggagtttctagcatgtccacgcgcgaccagtatgccgcggtcacccacaatatacgggaagagaagatcaataattcccaacccgcgcccggtaatattctgagcaccgccccgccctggctccggcacatggccgccgccggaattagcagtactataacacgggacctgtacgtaaccgcaacccatagtgtgcacgaagaaaagatgaccaacgggcagcaggcgcctgataatagtctgtcaaccgtgcctcccgggtgcattaacctgagcggcgctggaatatcttgccgtagcacccgagacttatacgcaacagtgatccacgacattcaggaggaagagatggaaaatgatcagactcccccagacgggttcctctctaacagtgattctcctgagttgatcaacatgactgggcactgtatgccgcccaatgctctcgactcattttctcatgatttcacctccttgtcgaaggatgagcttctgtataagcccgattccaacgagtttgctgttggaactaagaattattctgtttccgcgggagatccacccgtgaccgtgatgtcacttgtggaaactgtccctaatactccacagatcagccccgccatggcaaagaaaatcaacgatgatatcaaataccagctgatgaaggaggtccgcagattcggtcagaactatgaaagaatattcatcttactcgaagaggtccaaggaagcatgaaggtcaagcgccagttcgtcgaatttacgattaaagaggctgcgcgcttcaagaaggtagttctcatacagcagttagagaaagcgttgaaggaaattgacagccattgtcacttgcgaaaggtgaagcatatgagaaagcggtag

SEQ ID NO: 33283 - DNA, 225 bp, Artificial Sequence
  Description of Artificial Sequence: Synthetic coding sequence
cgaggcagtcgaggacgacaccactggtcgggaggcgccgcagtgagttccggctatccctcgaatattgagaagaaagagtatcaggaacaatcggtgctcagttgctgttctgaacgtaaagacgcaaatcctaagtcagtcgtgtgctcctttttcatgcaggaacagtgcaccaaaggagagaagcaggcggtcgtgatctcagatttcggcgaaagctag

SEQ ID NO: 33284 - DNA, 2385 bp, Artificial Sequence
  Description of Artificial Sequence: Synthetic coding sequence
atggaggctgtgtctagagtgtttcctgccctggccgggcaggctcctgaggaacagggtgagataatcaaagtcaaggtcaaggaagaggaccacacctgggaccaggagtctgccctgcgcaggaacctctcctacaccagagaactcagtcgccaaaggttcagacagttttgttaccaagaaacacctgggcctcgggaggcactgtctcagctccgcgagttatgtcgccagtggctgaacccggaaatccatacaaaagaacaaatcctggagctgctcgtgctggagcagttcctgaccatcctgccagaagaactccagtcttgggttagggagcacaatcctgaaagcggtgaggaggtggtcaccttgcttgaagacttggaacgcgaactggatgagccaagacagcaggtgagccaaggtacctacgggcaggaggtatctatggaagaaatgatcccgcttgacagtgccaaagaaagcttgggcacacagctgcagagcatggaggatcgcatggagtgtgagagcccagaaccccacccattgcaagacaatggttcctttctctggttttctatgatgtcccaatctatggggggagataacctgtcctcccttgacactaatgaggctgagatagaacctgagaatatgcgcgaaaagttttttcgttcccttgcaaggctactggaaaacaaaagcaataacaccaaaattttttcaaaagctaagtattgtcagctgatcaaagaagtgaaggaagctaaggcaaaagcaaaaaaggaatcggtagactatcggcggcttgcccggttcgatgttattctggtgcaggggaacgagaaattaattgaagctgtgaacggagagacggataaaatcagatactacctgcactctgaggacctgtttgacatcctgcataatactcacctgtctattggtcacggcggcaggacaagaatggaaaaggaacttcaggccaagtacaaaaacatcaccaaagaggtgattatgttgtacctcacactgtgcaaaccatgtcaacagaagaatagcaagttaaaaaaggtcctgacatctaagagcataaaagaagtaagttcccgatgtcaggtggatctgattgatatgcagctgaatcccgatggcgagtatcgatttatccttcactaccaagatctttgcactaagctcaccttcctccgttccctgaagagcaaacggcccacagaagtggcacatgcacttttggacatctttactatcattggggcaccgtctgtactccagtctgataatgggagggagttttccagtcaggtggtgtcagaactcagcaacatctggcccgagcttaaaattgtacacggcaaatcacagacgtgccagagtcagtcgtccgcagagcaaactgaggatattcgtaagagaatcttctcctggatgcaaactaacaattcatcccattggacagaattcctctggtttattcaaatgtctcaaaaccagccatatcataggagtatgcagcagaccccatgtgagagcgccttcagctccgaggcgaagctcggactgtcccacagccagcttacagaggagttggtggcgtccctacatacagaaaatgaactagaccaggccgacaaggagcttgaaaacacactccgcgcccagtatgaagagaatatcgagactgggactgattcgtccgatatcgaggagaacctgagtgtaacccctaaagtagcagaaaagagtccccccgagtctcggctcaggtttcttagctgtgttgtttgcgaaaaggaatgtacaggcgtgaactcctgtattagctgtgacggcaatattcacgctatttgtggagtaccttctcagcacggcacagagggatgtggcaggcagatcacatgttcactctgttatgagacgtcaaccatgaaacgcaaacatgacgagatccaacgatcattgccggtcaaaccgtccaagatgctcaaaccaagtggaacacctttcagcccagataaggttggtgattggatggcgaagcaggccagtctggatttcttcgtaaagaaacgccatgcattctctgaacacagtagctcaaataagaggaatgtgaataaccgatcctacccagaggagggaaagacaaagcgcgtccacgcctcattcactagaaagtatgatccgagctatattgagttcgggttcgttgccgtgatcgatggtgaggtccttaaaccccagtgtatcatctgtggagatgtcctggccaacgaagccatgaagccaagtaagctgaaacgccatctctactccaagcataaggagatctccagccagccaaaagagttctag

SEQ ID NO: 33285 - DNA, 1737 bp, Artificial Sequence
  Description of Artificial Sequence: Synthetic coding sequence
atgaatatcagcgtcgacctggaaactaattatgcggagcttgtgctggacgtgggccgtgttacactcggcgagaactccagaaagaagatgaaagattgtaagctgcgcaagaagcaaaacgaatctgtttcaagagctatgtgtgcactcttaaattctgggggaggcgtgatcaaagctgaaatcgagaacgaggactattcctacaccaaagatgggattggcctcgacctggaaaattcatttagtaacatcctactctttgtacccgagtaccttgattttatgcaaaatggtaattattttttgatctttgtgaagagctggagtctgaacacctccggtctgcgcattacaaccctgtcttctaacctctacaaaagagacatcacctccgccaaagtgatgaatgcaaccgccgctctagaatttttgaaagatatgaagaagacacgtggacgactttatctgagacctgaattacttgccaagcgaccctgtgtggacattcaagaagaaaacaatatgaaggccctggctggggtgtttttcgacaggaccgagctggaccggaaagagaaactcacattcaccgagagcactcatgtagagattaaaaattttagcactgaaaaattgctccagagaatcaaggagattctgcctcaatacgtgagcgcctttgccaacacggacggcggttatctcttcatcgggctcaacgaggacaaggagattatcggcttcaaggcggagatgtccgatctggacgatcttgaacgagagatcgaaaagtcgatcagaaaaatgcccgtacatcatttctgcatggaaaagaaaaaaatcaactacagttgcaaattcctaggtgtttacgacaagggctcactgtgtgggtacgtttgtgcactgcgcgtagagagattctgctgtgctgtctttgcaaaggagcctgacagttggcacgttaaggacaatagagtaatgcaacttacaagaaaggagtggatacagttcatggttgaagccgaaccaaagtttagtagttcatatgaggaagtcatttctcagattaacacgtccctccctgccccccactcctggcctttgttagagtggcagagacagcgccaccactgtccagggctgtccggacgcatcacttatactcccgaaaatctgtgccggaaactgttcctgcagcatgagggtctgaagcagcttatctgtgaagaaatggactccgtgaggaagggatctctgatcttttcacgcagctggagtgttgacctggggctgcaggagaatcataaggtcttgtgcgacgccctgcttattagccaagacagcccaccggtgctttataccttccatatggtgcaggacgaggaattcaaggggtactccacacagacggctctgaccctgaagcagaagctggctaagataggaggatatactaaaaaggtctgcgtgatgaccaagattttctatctgagccccgagggtatgaccagctgccagtacgatttaagaagccaggtgatctaccccgaatcatattatttcactcggcgtaagtatctgcttaaggccttgttcaaagctttgaagcgcttgaagtccctccgcgaccaattcagcttcgcagagaatctgtaccagataattggcattgactgtttccagaagaacgataaaaaaatgtttaaatcctgtagacggctgacgtag

SEQ ID NO: 33286 - DNA, 1737 bp, Artificial Sequence
  Description of Artificial Sequence: Synthetic coding sequence
atgaacatttctgtggacctggagaccaattacgctgaacttgtcttagatgtaggacgggtgacactgggcgagaatagccggaaaaagatgaaggactgcaagctccgtaaaaaacagaatgagagtgtgtccagggctatgtgcgcgcttctgaactctgggggtggggtcatcaaagcggagatcgagaatgaagactacagctacaccaaggatggtatcggtctagatctggaaaactcatttagcaacatcctcctcttcgtgcccgagtacctggacttcatgcaaaacggaaattattttcttatatttgtcaagtcctggtcgctgaacacttcaggactccgcattacaactctgagtagtaatttatataaacgcgatatcacatcagcaaaggtgatgaatgcaacagccgctctggaatttctgaaagacatgaagaaaactagaggaagactgtacctcagacccgaattgctggcaaagcgtccctgtgtcgacattcaggaggagaataatatgaaagccttggccggcgtatttttcgaccggacagagctagacaggaaagagaaactaactttcacagagtccacccacgtcgagatcaaaaacttttctactgagaagttactccaaaggatcaaggaaatcttaccacagtatgtctctgcttttgccaacactgatggcggctacctgtttattggactaaatgaggataaggagatcatcgggtttaaagctgagatgtcagacctggatgacctagagcgcgaaattgaaaaaagtatcaggaaaatgcctgtgcaccacttctgtatggaaaagaaaaagattaactactcctgtaagttcctaggagtgtatgataaaggctccctttgcggttacgtttgcgctcttagggtcgaacgcttttgttgtgccgtctttgcaaaagagccagattcctggcacgtaaaggacaacagggtaatgcagctcaccagaaaggagtggattcagttcatggtggaggccgagcccaagtttagtagtagctatgaggaggtgatcagccagatcaacacctctcttccagcccctcattcttggccccttttggaatggcaacggcagaggcatcattgcccgggattgagcggaagaattacttatacgcccgagaatctttgccggaaactgttcctccagcatgaggggctgaagcagttgatttgcgaggaaatggacagcgtaagaaaaggctctctcatattctcaaggtcttggtctgtcgacctgggcctacaggagaatcataaagtgttgtgtgatgctttgctgataagtcaggactccccaccagtactgtacacgttccacatggtgcaggacgaggaattcaaaggatatagcactcagactgccctcacgctgaaacagaaactggccaagatcggtggatacacgaagaaagtgtgcgttatgacaaaaattttctacttatccccagagggcatgacctcctgccagtacgatctgcggtcccaggtcatctaccctgagagttactactttactagacggaaatacttactgaaagccctctttaaggcacttaaacggctcaaatcgctcagggatcagttcagctttgccgagaacctataccaaatcatcggtatcgattgtttccagaagaatgacaaaaaaatgttcaagagttgcaggcgactcacctag

SEQ ID NO: 33287 - DNA, 48 bp, Artificial Sequence
  Description of Artificial Sequence: Synthetic coding sequence
atgaatatttctgtggacctggagactaattatgccgagctagtttag

SEQ ID NO: 33288 - DNA, 210 bp, Artificial Sequence
  Description of Artificial Sequence: Synthetic coding sequence
atgaacatttccgttgacctcgaaactaattatgcggagttggtgctggacgttggtcgcgttacccttggggagaattctaggaagaaaatgaaggattgcaagctaagaaagaagcagaatgaatccgtgagccgcgctatgtgcgcactgttgaattcaggtggaggagttattaaagccgagattgagaatgaagactatagttag

SEQ ID NO: 33289 - DNA, 387 bp, Artificial Sequence
  Description of Artificial Sequence: Synthetic coding sequence
atgaatattagtgtggacttggagaccaattatgccgagctggttctggatgtgggcagggtgactctcggcgagaatagccggaaaaaaatgaaagattgtaagctgcggaaaaaacagaacgagtccgtgagtagggcaatgtgtgctcttctaaactcaggcggcggcgtaatcaaagcagagatcgaaaatgaggattattcctataccaaggatgggattgggctggacctggagaatagctttagcaacatcctcctcttcgtgcctgaatatctcgactttatgcaaaatggaaactattttcttatttttgtcaagtcgtggtctctgaacacgtccggtttgcggattacgacgctctccagtaacctctacaagtag

SEQ ID NO: 33290 - DNA, 1737 bp, Artificial Sequence
  Description of Artificial Sequence: Synthetic coding sequence
atgaacatctccgtagatctcgagacgaattacgccgagctggtcctagatgtgggaagggtaaccctcggagaaaacagccgcaaaaagatgaaagattgcaagcttaggaagaagcagaacgagtccgtctctagggccatgtgcgctctgctgaatagtgggggaggcgtgattaaggctgaaattgaaaacgaggactactcctacaccaaggacggcatcgggttggatctggagaattcgttctccaacattctactgtttgtgcccgagtacctggattttatgcagaacggcaattatttccttatctttgtgaaaagttggtcgcttaacacaagcgggcttcgcatcacaacactcagctctaatctatataagcgggatatcacaagtgcaaaagtgatgaacgccacagcagcgctggaatttcttaaggatatgaagaagaccagagggcggctataccttaggccagagctgcttgccaaacgcccttgcgttgatattcaggaggagaataatatgaaagctcttgccggtgtattctttgaccgcaccgaattggatcgcaaagagaagctgacctttacggaatccactcatgtagagattaagaacttcagcaccgaaaagctgctgcagaggattaaagaaattctgcctcagtatgtatcggcgtttgcgaataccgacggagggtatcttttcatcggtcttaatgaggataaagaaatcattgggtttaaagctgaaatgagtgatctggacgatctggaaagggagatcgagaaatctattcggaagatgccagttcaccacttctgcatggaaaagaagaaaattaattacagctgtaaattccttggcgtgtatgataaagggagtctgtgcggttatgtgtgtgccttgcgggtcgagaggttctgctgcgccgtcttcgctaaggagcctgattcgtggcacgttaaggataacagggtgatgcaattgaccagaaaagaatggattcagttcatggttgaggcagaacctaaattcagctcttcatatgaggaggtcatctcccaaatcaatacatccctccctgccccccatagttggcctctgcttgaatggcagaggcagaggcaccactgccctgggttatctggtagaatcacctacacacccgaaaacctttgccgcaagttgttcttgcagcacgaagggctgaaacagcttatctgcgaggagatggactctgtccgcaaaggaagtctgatattcagcaggtcttggtctgttgacctgggcctgcaagaaaaccacaaagtcctatgtgatgccctgctcatttcccaggactccccaccagtactctacacgttccatatggttcaggatgaggagtttaagggttatagtacacaaacggcgctcaccctgaagcagaagctcgccaaaattggcgggtacacaaagaaggtatgcgtgatgaccaagatcttctatctgagtcccgaggggatgacatcctgtcagtacgacttgagatctcaggtgatatatccagaaagctactatttcactagacggaaatatctgctgaaggccctgttcaaagccctgaagcgcctaaagtctctgagggaccaattctcatttgcggagaacttataccaaattatcgggatcgattgcttccagaaaaacgataaaaagatgtttaaatcctgtagacgtctgacatag

SEQ ID NO: 33291 - DNA, 1854 bp, Artificial Sequence
  Description of Artificial Sequence: Synthetic coding sequence
atggctatgaagataatggaaaaaattcgcaacgtgtttcattgcgaggcccaccggattttatatatttgtgaaagccagtttcttcggaatttcattcgaaaggagtttctccgaggaaacggtcttgcagctgggaagatgaatatcagcattgatctggacaccaattatgccgagctcgtgctgaacgttggccgggtgacccttggggagaacaaccggaaaaaaatgaaagactgccagctccgaaaacaacagaatgaaaatgtctcccgcgcggtttgtgctttgttaaatagcggaggcggggtgataaaggccgaagtcgagaacaaaggatacagttacaagaaagacggcatcggactggacttggagaattctttttctaacatgctgccctttgtgcccaatttcctcgacttcatgcagaacggcaattattttcacatcttcgttaaaagctggagtctcgaaaccagcggaccacaaatcgccactctgagttccagtctatacaagcgagacgtcacctctgccaaagttatgaacgcttccgcagcattggagttcttgaaggatatggaaaaaactggtggacgggcctacctcagacctgagttccctgccaaacgagcatgtgttgacgtacaggaggagagcaatatggaagccttggcagccgacttctttaatagaactgaattgggatacaaggaaaaattaacgttcacggagtcaacacacgttgagatcaagaatttctccacagagaaactgttgcagcgtatcacagagatattgccacagtacgtttccgcattcgctaacaccgacgggggatatctatttgtagggttaaacgaggacaaggaagttattggtttcaaggccgaaaagtcgtatcttacaaaacttgaagaagttaccaagaactcaatcggcaaactgcccgtgcaccacttctgcgtggaaaaaggaaccattaattacctctgcaagtttctgggggtctatgataagggcaggttgtgtggatacgtgtacgcgttgcgggttgaacggttctgttgcgccgtcttcgctaagaagcctgacagttggcacgtgaaggacaaccgcgtgaagcagctaactgagaaggagtggatccagtttatggtggacagcgagcccgtttgtgaagagttgccttcgcccgcctccacaagtagccctgtgtcacaaagctaccctctacgagagtacattaacttcaaaatacaaccgcttaggtaccatcttccaggtctcagcgaaaaaattacttgtgcgcccaaaaccttttgcaggaatctcttttcccagcacgagggattgaagcaactcatttgtgaagaaatgggctctgttaataaaggttctctgattttcagcagatcatggagtttggacctgggcctgcaagaaaaccataaggtcttgtgtgatgcactgcttattagccaggataagccacccgtactctatactttccacatggtccaggatgaggagtttaaggattactcaacacagacagcgcaaacgctcaagcaaaaactggcgaagattggagggtacactaagaaagtctgtgttatgacaaaaatcttctatttgtctccagaaggtaaaacgagctgccagtacgatcttaactcgcaagtcatatatcccgaatcatactattggaccacggcccagacgatgaaggatctggaaaaggccctaagtaacatcctcccaaaggagaatcagatctttctgttcgtatgtttgttccgcttctgcctgttcgtgtgttggttcgtgtgtttttttctccggtag

SEQ ID NO: 33292 - DNA, 1860 bp, Artificial Sequence
  Description of Artificial Sequence: Synthetic coding sequence
atgcagctgtccgagggcctagctgcgcacacgcgaagggcaggtaagtggaagaggacacaggtgccactgctgggcgaggagtgcgcagacatggatctggctcgtaaggaatttctcagaggaaatggactggcagcgggaaagatgaatatctcgatcgacctggataccaactatgccgagctggttctgaacgtcggcagggtgactctgggggagaacaaccgaaagaaaatgaaggactgccagctgagaaagcagcagaacgaaaacgtctcaagagcagtctgcgccctgctaaacagtggcgggggtgtgatcaaagcagaggtcgagaacaagggctacagttacaagaaggatggtatcgggctcgacctggagaactccttctctaacatgctcccctttgtgccaaatttcctggactttatgcagaacggcaattacttccacatatttgtgaaatcctggagtctcgagacctccggcccccaaattgcaactctgagcagtagtctgtataagagggatgtgaccagcgccaaagtcatgaatgcctccgccgcactcgagttccttaaggatatggaaaagacaggcggccgcgcctacctaaggcctgaattccctgcaaagagagcatgtgttgacgttcaggaggaatccaatatggaggcgctagccgccgatttcttcaacagaaccgaactcggttacaaagagaagttaaccttcactgaaagtacccacgtagaaatcaagaattttagcaccgagaaacttcttcagaggataacagaaatcttgcctcagtacgtaagcgctttcgctaatacagatggcggctacttattcgtgggtctgaatgaggataaggaagttattggctttaaagctgagaagtcctatcttaccaagctggaggaggtcacaaaaaactcaatcgggaaacttcccgtacaccatttctgcgttgagaagggaaccattaattacctctgtaagtttctcggcgtatacgacaaagggcggctgtgcgggtatgtctacgcactgcgggttgaaagattctgctgtgcagtgttcgctaagaaaccagatagttggcatgtcaaagacaatcgtgttaagcagctgactgagaaagagtggattcagttcatggttgacagcgagccggtgtgtgaggagctgccttcccctgcctctacatcatcacccgtgagccagtcttatccactccgcgagtatataaatttcaaaattcagcctctcaggtaccatctgccaggcttgtccgagaagattacctgcgcacccaagaccttttgtagaaatctgttctcccagcatgaggggcttaaacagcttatttgcgaagaaatgggcagcgtgaataagggttcattgatctttagcagatcctggagcttggatctgggcctgcaggagaatcacaaggtcctctgtgacgcactactgattagtcaggacaagccccctgtgctgtacacttttcatatggtccaggacgaggagtttaaagactattctacgcagaccgcgcagacactgaagcagaagctggcgaaaattggcggctatactaagaaggtttgtgtgatgacaaaaattttttatttgtctcccgagggtaagacctcttgccagtatgacctgaattcacaggtgatttatccagaatcctactactggacgaccgcccagacaatgaaagatctggaaaaggcactgtccaacattctgcccaaggagaaccagatctttctcttcgtctgtcttttccgtttctgtctgtttgtgtgctggttcgtatgcttttttctccgctag

SEQ ID NO: 33293 - DNA, 2694 bp, Artificial Sequence
  Description of Artificial Sequence: Synthetic coding sequence
atggaggccaaccactgttctctcggagtgtacccaagctacccagacctcgtcatcgacgtcggagaggtaacactgggagaagagaacaggaaaaagctgcagaagacgcaacgggaccaggaacgggcccgggtgatcagagcggcctgtgccctgttgaactctggcggcggggtgattcagatggaaatggcgaaccgagatgaaagaccgaccgaaatggggctggacctcgaagaatcgctccgtaagttaattcaatatccatatcttcaggccttcttcgagacaaaacaacacggtcgctgtttctatatctttgttaagagttggtcaggtgatccttttctgaaagacggaagtttcaattcacggatctgttctctgtcaagttccctttattgcagaagtggcacatctgtacttcacatgaactcaagacaagcttttgactttttaaagactaaagagcgccagtccaagtacaaccttataaatgagggaagtcccccatccaagatcatgaaagcggtctatcaaaacatcagcgagtccaaccccgcctatgaagtcttccagactgataccatcgagtatggggagatcctgtcatttcccgagtccccctccattgaattcaagcagttttctacaaagcatattcagcagtatgtggagaatataatccctgagtacatttccgcgttcgcgaacaccgaaggaggatacctgttcatcggggtcgatgataagtcccggaaggtgcttggatgtgccaaggaacaggtggatccagactctttgaaaaatgtcattgcgcgggcaatttcaaagttgcctatagttcacttctgttcatcgaaacccagagtggagtattctaccaagatcgtcgaggtcttctgcggaaaagagctttatggctatttgtgcgtgattaaagtgaaagcattctgttgtgtcgtctttagcgaagcccctaagtcctggatggtcagagagaagtacattagaccacttacaacagaggaatgggtcgaaaagatgatggatgccgaccccgaattcccaccggatttcgctgaagcgttcgaatcccagctctccctcagcgatagcccctcactctgtcgccctgtctacagtaaaaagggactagagcacaaagcagacctgcaacagcatttatttccagtcccgcctggacatctggagtgcactcctgagagcctttggaaagaactcagcctgcagcacgaaggactgaaggagctgatccacaaacaaatgcgtcccttttcacagggaatcgtgatcttatcacgatcctgggcggttgatttaaacctccaggagaagccaggtgtgatttgtgacgcgttgttgatcgctcagaattcaacccctatcctgtacacaatacttcgcgaacaagatgccgagggccaggattactgcacgcggaccgcctttacactgaaacagaaactggtgaacatgggaggctacacgggaaaggtgtgtgttcgagcaaaagtgctatgtctcagcccggaaagctcagccgaagccctggaggctgcggtgtcccctatggactatccagcatcgtattccctagccggaacgcagcatatggaggccttactccagtctcttgttatcgtcctactgggtttccgcagtctgttgtccgaccaattagggtgtgaggttcttaaccttctcaccgcgcagcagtatgaaatattctccagatcattacgcaaaaaccgcgaattgtttgtacacggtctgcccgggtcagggaagacaatcatggccatgaagatcatggagaaaatccgaaatgtgtttcactgcgaagctcaccgcatcctctacgtttgtgaaaaccagccactacgcaacttcatctcggaccggaatatctgccgggcggagacacgcgagacctttcttcgagagaaatttgaacatattcagcacatcgtgattgatgaggcccagaacttcagaaccgaagatggcgattggtatcgaaaggcaaagactattacccagcgtgagaaggattgtccaggagttctttggattttcctcgactatttccagacgtctcacttgggccattccggccttccacctctcagcgctcaatacccccgcgaagagttgaccagagtggtgcgtaacgcggacgagattgccgagtatattcagcaagaaatgcagttgataattgagaatccgcccataaacattcctcacgggtatctggccatcttgtcagaagccaagtgggtgcccggggtcccaggcaacaccaagatcataaaaaactttaccttagaacaaatcgtcacatatgttgcagatacctgtaggtgtttcttcgaaagaggatacagccccaaggacgttgccgtcttggtgagtacggtcactgaggtcgagcagtaccaatctaagctcttgaaagctatgaggaaaaaaatggtggtccaattgagtgatgcgtgtgacatgctgggtgttcacattgtcttggatagcgtaaggcggtttagtggcctcgaaaggtccatcgtgttcggaatccatccccggacagccgacccggccatcctgcctaatattttgatctgccttgcaagccgagcgaaacagcatctctatatcttcctctag

SEQ ID NO: 33294 - DNA, 1740 bp, Artificial Sequence
  Description of Artificial Sequence: Synthetic coding sequence
atggaggcaaaccactgctccctagcccccaagtcctggatggtgcgcgagaagtatattagaccactcaccactgaagaatgggtggaaaagatgatggacgccgacccagagtttccaccggacttcgcggaggcttttgaatctcagctctccctttcggatagcccctctctgtgtagacccgtatacagcaagaaaggattggagcataaggccgatcttcaacagcacctcttccccgtgccccctgggcatctggaatgcacccccgagagtctgtggaaggagttgagcctgcagcacgaagggcttaaagagctgatccataaacagatgcggccattctctcagggaatcgtcatactgagcagatcgtgggccgtggacctgaatctgcaggagaaacccggcgttatctgtgatgcactcctgatagcccagaactctacccctattctctacactatcctgagggagcaggacgcagaaggtcaggactactgcacccgtacagcctttacactaaagcagaaactcgttaacatggggggatatacaggaaaagtttgcgtccgagcaaaggtgctgtgcctctcgcccgaatcttctgccgaggccttagaagccgctgtatccccaatggactacccagcatcatattccttagcaggcacgcaacacatggaggccctcttacagtcactcgtgatcgtcttactaggctttagaagtttacttagtgatcagttgggttgcgaggttcttaatctgcttaccgcacagcaatatgagatcttctcccgctcactgcgcaaaaatagggagctctttgtccacggcctccccgggagcggcaaaacaatcatggccatgaaaattatggagaaaataaggaacgtgttccactgcgaagctcacaggattctctacgtatgcgaaaaccagcctctacgcaattttataagtgaccgcaatatctgcagagccgaaacaagggaaacctttctcagagaaaaatttgagcacatccagcatatcgttatcgacgaagctcagaacttccggaccgaagatggcgactggtataggaaggctaagacaatcactcagcgcgaaaaggactgccctggcgtgctgtggatctttctggattacttccagacctcccacctcggccattcaggcctcccacctctgtcagcccaatacccccgggaggagctgacacgtgtggtgcgcaatgcggacgagatcgccgagtacatccagcaggagatgcagctgattatagagaacccacctattaatatccctcacggatacctggccatcttgagcgaagccaagtgggtccccggggtgcccggcaatacaaaaatcattaagaattttaccctggagcaaattgtcacttacgtcgcagacacttgtcggtgcttcttcgaacgtgggtacagtcccaaggatgtagcggtactggtctccacagtcaccgaagttgagcagtatcagagtaagttgttaaaagcaatgcggaagaagatggttgtgcaactgagcgatgcctgtgacatgcttggcgtacacattgtactcgattctgttcgcagattcagtggattggaacggagtattgtgtttggaatacacccaagaacagccgacccggcaattttacctaacatccttatctgcctcgcgagccgtgccaagcagcatttgtatatatttctgtag

SEQ ID NO: 33295 - DNA, 321 bp, Artificial Sequence
  Description of Artificial Sequence: Synthetic coding sequence
atggaggctaaccactgctctctcggcgtgtatccctcttacccggacctggtaatcgacgtgggtgaggtgacactcggcgaagaaaaccgcaagaaactgcagaagacacagagggaccaagaaagggctcgcgtaatcagagccgcatgcgcccttttgaattctgggggcggggttatccaaatggagatggctaatcgggacgaacgtcctacagagatgggcctggatttggaagagtcattgcggaagctgattcagtacccctacctccaggccttttttgaaaccaaacaacacggaagatgcttctattag

SEQ ID NO: 33296 - DNA, 2694 bp, Artificial Sequence
  Description of Artificial Sequence: Synthetic coding sequence
atggaggctaatcattgttccctcggggtgtacccatcatatccagaccttgtcatcgacgtgggggaagtgacactgggcgaggagaaccgaaaaaagttgcagaaaacccagagagaccaagaaagggctagagtgattcgcgccgcgtgtgcccttctgaatagcggaggcggagtgattcagatggagatggccaaccgagacgagagaccaacagagatggggctggatctggaagaaagcctgcgcaagctgatacagtatccatacctccaggctttctttgagactaaacagcatggcagatgcttctacatatttgtgaaatcctggtccggcgaccccttcttgaaagatgggtcgttcaactctaggatatgtagcctgtccagttctctgtactgtagaagcgggactagtgtgcttcacatgaattcaaggcaggcatttgatttcctcaagaccaaggaaaggcagagcaagtacaatctcattaacgagggctcccccccctcgaaaatcatgaaagccgtttatcagaatattagcgagtccaacccggcttacgaagtgtttcaaaccgatactattgagtatggcgaaatcctgtccttcccagaatccccctctatagagttcaaacagttcagcacaaaacatatccagcaatacgtggagaacataattccagaatatataagtgcctttgcaaatactgagggggggtacctgttcatcggagtggatgacaagtctcggaaagtgctgggctgtgccaaagaacaagtcgatccggatagcctgaagaatgtgatcgctagggctatcagcaagctcccaattgtgcatttctgctcgagtaaaccgagagtggagtattctaccaagatcgtagaggtgttctgcggcaaggaactgtatgggtatctgtgcgtgattaaagtgaaggcattctgttgtgtggtattcagtgaagctcccaagtcgtggatggtgcgggagaagtatattcgacctcttactacagaggagtgggtcgagaaaatgatggacgccgacccagaatttccacccgacttcgcggaagccttcgaatcacaactttcactctctgattcaccctccctgtgtaggccagtctacagcaaaaaaggcctcgagcataaggccgacttgcagcagcatttattccctgtgccgccaggtcaccttgaatgcacgcccgaatccctctggaaggaactgagtctgcagcacgagggtctgaaagagctgattcacaagcagatgcgcccttttagtcagggaatcgttattctgtcccgctcgtgggccgtggatctcaacttacaggaaaagcctggtgttatttgcgatgccttgttaattgctcagaattcaacaccgatcttgtacacaatactgagagagcaagacgccgaaggccaagactattgcactcggactgccttcacattaaagcagaagctcgttaacatgggcggatacaccggcaaagtatgcgtgagagccaaggtgctgtgtcttagtcctgagagttctgccgaagcgctggaagcagccgttagccccatggactaccccgcctcctattctctcgccggaacacagcatatggaggccctcctccagtcactcgtcattgtcctgctggggttcagatccttgctgagtgatcagctgggctgcgaggttttgaatctgctgacagctcaacagtatgagattttctctcgatcgctaagaaaaaatagggaactcttcgtacatgggttgcccggttcaggtaagaccattatggccatgaagataatggaaaagattcgcaatgtcttccattgcgaagcccatcgtattctgtacgtgtgcgagaaccaacctttaaggaacttcatctcagatcgaaatatttgcagggccgaaactcgggaaacgtttttaagagagaagttcgagcatattcagcacatcgtaatcgatgaagcacaaaattttaggaccgaggacggagactggtatagaaaggccaaaactatcactcagagagaaaaagattgtccaggtgttctgtggatatttctggactatttccaaacttctcatctgggccacagcggccttcctcctctgtccgcccagtatcctcgggaagaattgaccagagttgttaggaacgctgatgagattgctgaatacattcagcaggaaatgcagctgattattgagaatcctcccataaacattcctcacggctacctggctatcctgtcagaggctaagtgggtgcccggagtgccgggaaacaccaaaatcattaagaatttcacccttgaacagattgtgacatacgtggctgatacctgcaggtgcttttttgagaggggatactcacctaaggacgtcgctgttcttgtgtccactgtgaccgaggtggagcagtaccagtcaaaacttctaaaggccatgcgtaagaagatggtagttcagttaagtgacgcctgtgacatgcttggtgtgcacatcgttctggattctgtgcggcgcttcagcggccttgaaaggtcaattgtgttcggcatacatccacggactgccgatccggctatcctgccgaatatcctcatctgccttgcttcacgagccaagcagcacctttacatttttctgtag

SEQ ID NO: 33297 - DNA, 1740 bp, Artificial Sequence
  Description of Artificial Sequence: Synthetic coding sequence
atggaggccaatcactgcagtctagcccctaagtcttggatggtgcgcgagaagtatattcgccccttgacaactgaagaatgggtggaaaaaatgatggatgccgacccagagttcccaccggatttcgctgaggcctttgagagtcagctgagcctgtccgattcgcctagtctctgtcgtcccgtctatagtaagaaggggcttgaacacaaagcagacctgcagcaacacctattccctgtccccccaggacaccttgagtgcacccccgagtccctctggaaggaacttagtctccagcatgaaggacttaaggaactgatccataagcaaatgagaccgttcagccaagggatcgtgatactcagccgaagctgggctgtggacctcaatctgcaagagaaaccgggcgtcatatgcgacgcccttcttatcgctcagaattcaacccctattttgtacacgatcttgagggagcaggacgctgaggggcaagactattgcactagaaccgcattcactctcaagcaaaagcttgtcaacatgggcggctacactgggaaggtgtgtgtgcgcgctaaggtactctgtctgtcgcctgagagttctgcggaggcactggaagcggccgttagcccaatggactaccccgcatcctattctctggcggggacgcagcacatggaagccctactccagagcctggttattgtgctccttgggtttcggtccctgctgtcggatcagcttggatgcgaagtcctgaatctcctaactgcccaacagtacgaaatattttccagatcacttcgcaagaacagagagctttttgttcacggcctgcccggcagcggcaagactataatggctatgaagattatggagaaaatcaggaatgtgttccattgcgaggcacatcgcatcctgtacgtatgtgagaatcaacctctgagaaacttcatcagtgaccgcaatatctgcagggccgaaacccgcgaaacatttcttagggagaaatttgaacatatccaacacattgtgattgacgaggctcaaaattttaggacagaggatggtgattggtatagaaaggctaagaccatcacccaacgggagaaggattgccccggcgttttgtggattttcctcgactactttcagacatcccatctcgggcattcaggcctccctccactttctgctcaatacccacgagaagagcttacaagagttgttaggaacgcagacgaaatcgccgaatatatccagcaggaaatgcagctcattatcgagaacccacccatcaacatacctcatggttacctcgcaatcctcagtgaggcgaaatgggtaccaggtgtccctggcaatacaaagattatcaaaaatttcaccctggaacagattgtgacgtacgtcgctgacacatgtaggtgtttctttgagcgcggatacagccctaaggatgtggccgtgcttgtgagcactgtgaccgaggtggagcagtaccagagcaagctgctgaaggccatgaggaaaaaaatggttgttcagttgtccgatgcctgcgatatgcttggagtgcacatcgtacttgacagtgtgcgccggttttcgggactggaacggagtatcgtatttgggattcaccctaggacagctgatccagccatcctgcctaatatccttatttgccttgcgtccagagccaagcaacacctttacattttcctctag

SEQ ID NO: 33298 - DNA, 2694 bp, Artificial Sequence
  Description of Artificial Sequence: Synthetic coding sequence
atggaagcaaatcattgtagtctcggcgtgtacccgagttaccctgacctggtcatcgacgtaggagaagtcacgcttggtgaggagaatcggaagaaactgcagaagacacagcgagaccaggaaagggcgagggtcatacgtgccgcatgcgccctcttgaattctggaggcggtgtcatacagatggaaatggctaatcgggacgagcggccaacagagatgggcctcgatctggaagagagcttacggaagctgatccagtacccatacctgcaggctttcttcgagactaagcaacatggccggtgtttttacatattcgtaaagtcttggtccggggacccttttttgaaagatggctcgttcaattcacggatttgtagcctttcttcatcactgtactgcaggagtggtacctccgtgctgcacatgaactctcggcaagcattcgacttcctcaagactaaagaacgacagagtaagtataatctgatcaacgaaggctcccccccaagcaagatcatgaaggctgtgtaccagaacattagtgagtcaaatcccgcttatgaggtattccagaccgataccattgaatacggggaaatccttagctttccagaaagtcccagtatcgaattcaagcaattcagtacgaaacatatccaacaatacgttgagaacattattcctgagtatatttctgcatttgccaatactgaagggggctatctgtttattggagtagatgacaagagccggaaggtattaggttgcgcgaaggagcaggtagaccctgactcactcaaaaatgtcattgccagggccatctccaagcttcccatcgtgcacttctgttcgagcaagcctcgagttgagtactccacaaagatcgtcgaggtattttgtggcaaggagctatatggttatctttgcgtcatcaaagtaaaggccttctgttgcgttgtcttctctgaggctccaaagagttggatggtgcgtgagaagtatattagacccctcacaaccgaggaatgggtagagaagatgatggatgcggaccccgaatttccacctgacttcgccgaagcctttgaaagccagctgagtctttccgacagcccctctctgtgtcgccccgtgtactccaagaaaggactcgagcataaggccgatctgcagcagcatctgttcccagttccacccggacatctcgagtgtacgccggaatccctgtggaaagagctgtcactgcagcatgaagggttgaaagagcttattcacaaacaaatgcggcccttctcgcaaggcatcgtcattttgagccgaagctgggccgtcgatctcaacctgcaggaaaagcccggggttatctgcgatgctcttctcattgcgcaaaactccactcctattctttatacgattctgagagagcaggacgctgagggacaagactattgtacccgcacagctttcacgctgaagcagaaactggtcaatatgggaggttatactgggaaggtgtgcgtgcgagcaaaggtgttgtgcctgtctcctgagagctccgccgaggctctcgaagccgcggtctcccctatggactacccagccagctatagtcttgctgggacacaacatatggaggctctgctccagagcctggtgattgtgctgcttggctttagaagcctgttgtccgatcagttaggatgcgaggtccttaatctcctaactgcccagcagtacgagatcttcagtcggagtcttcgcaaaaacagagagctgtttgtccacgggttacccggcagcggaaagaccatcatggcaatgaaaataatggagaagatccgaaatgtgttccactgcgaggcccaccggatattgtatgtctgcgagaaccaacccctgcggaattttatcagtgatcgtaacatctgtcgagcagagactagagagaccttcctgagagagaagtttgagcacattcagcacatcgtgattgacgaagctcagaattttcggactgaggatggtgactggtatcgaaaagccaaaaccatcactcagagagaaaaagattgtccgggcgttctttggatttttcttgattacttccagaccagccatctcggacactccggcttaccccctctgagcgcccagtatcctagggaggaattaaccagagtggtgagaaatgccgacgaaattgcggagtacatccagcaggagatgcagctgatcatcgagaacccaccaattaatataccgcacggttatctcgcaatcctgtccgaggccaagtgggtgccaggcgttcccggaaacaccaaaatcatcaaaaatttcactctggagcagattgtgacttatgtcgcagacacatgccggtgcttttttgaacgggggtacagcccgaaggatgtcgcggtccttgtgagcacagtaaccgaggtcgaacagtaccagtcaaagctcctgaaagctatgcggaagaagatggtcgtgcagcttagcgacgcatgtgatatgttaggggtgcacatcgtccttgatagtgtgcgcaggttcagtggtttggaaagaagcatcgtgtttggcattcaccccagaactgcagaccccgccatcctccctaacatcctgatctgcctcgctagtagagctaagcagcacctgtacatctttctgtag

SEQ ID NO: 33299 - DNA, 2739 bp, Artificial Sequence
  Description of Artificial Sequence: Synthetic coding sequence
atggaatcactgaaaactgacacagaaatgccatacccagaggtcattgtcgatgttgggcgcgtaattttcggcgaagaaaatagaaagaagatgaccaacagctgtctgaagcgttctgagaactcccgaattatcagggccatatgcgcactcctgaactccggtgggggcgtgataaaggctgagattgacgacaagacatattcatatcaatgtcatgggctcggacaggaccttgaaacgtcatttcagaaacttcttcccagtggttctcagaaatatttagactatatgcagcagggtcacaatctccttatctttgtcaagtcatggtctcccgacgtgttcagtctgcctctgcgcatttgttctctccgcagcaacctgtacagacgggatgttaccagcgccatcaacctcagcgcgagctcagctctggaactgctccgcgagaagggctttagggcccagcggggacggccccgtgtcaaaaagctgcatcctcagcaggtgctgaatagatgtatccaagaggaggaagacatgcgcatcctggcctcagaattcttcaaaaaggataagcttatgtacaaggagaagcttaattttaccgagagcactcacgtcgagtttaagcggtttacgactaagaaagtgattccccgaattaaggaaatgctgccgcattacgtgtccgcctttgcgaacactcaaggcggctacgtattgataggcgtggatgataagtctaaagaggtagtcgggtgcaagtgggagaaagtgaatcccgatttgttgaagaaggagattgagaactgtatcgaaaagctgcccactttccatttctgttgtgagaaacccaaagtcaatttcaccacaaagatcctgaacgtttatcagaaagacgtcctggacggctacgtatgtgttatccaagtcgaaccattctgctgcgtggtgtttgccgaggcaccagatagctggataatgaaggacaacagtgtaactagacttaccgcagagcaatgggtggtcatgatgctcgatacccagtccgcaccacccagccttgtcaccgattacaattcctgcctgatatcctccgcctccagcgccaggaagtcaccggggtacccaattaaagtgcataaatttaaggaggccttgcaaaggcaccttttccctgtgacgcaggaagaggtgcagttcaagccagagtccctgtgcaagaagctgttttccgaccataaggagcttgagggcctgatgaagacgctcattcacccatgcagccagggtattgtgatctttagtcgttcctgggccggggacgtaggcttccgtaaggagcagaacgtgctgtgcgacgctcttttgatcgctgttaacagtcctgtggtgctgtatactattctgatcgatcctaactggcccggtggcctggaatatgctcggaacaccgctcaccagctgaagcagaagctccagaccgtgggaggctacaccggcaaagtgtgcattattccccgcctcatccatctgagttcaactcagtccagacccggtgaaatccccctccgctacccccgcagctatcgactggctgatgaggaagagatggaggatctcctccaagctttagtggtggtgtccctgtcaagtaggagcctcctgagcgaccagatggggtgcgaattttttaacctgctcatcatggaacaaagtcagctcctttcagaatccctgcagaagactcgagaactctttatttattgctttcccggagtgcgcaaaactgcccttgcaatcaaaattatggagaagattaaagacctgtttcattgcaagcccaaggagatcctctatgtgtgtgaatcggactccttgaaggacttcgttacacagcaaactacgtgccaggccgtcactcgtaagaccttcatgcagggggagtttctgaagattaaacatatcgtcatggatgaaaccgagaatttttgttcaaagtacgggaattggtatatgaaggccaaaaatatcacacacccaaaagccaagggtacaggatcggagaatcttcaccacggtatcctctggttgtttctcgaccccttccagattcaccatgcagatgtgaacggacttccccctcccagtgcacaattcccacggaaaaccatcacatccgggatccactgtgcgctcgagatcgccaaagtcatgaaggaagagatgaagagaatcaaagagaacccaccttcaaacatgtcacccgatacacttgcactgttttctgagacagcgtacgaagaggccacgtgcgcacaggcactgccaggcgtgtgtgagacaaagactaacctcactactgagcagatcgctaactacgtcgcgagaaaatgtcatagtctgtttcagtgcggatacctgcccaaggacatagccatcctgtgtaggcgtggtgaagaccgcggaaggtaccgcttggcactgctcaaggccatggagcttattgaaacccaccgcccttccgaggtggtctttagcccagcgactggagtttggggatcccacatcgtgcttgacagcatccagcagttctcggggcttgaaagaaccgtggttttcggcctgtcccccgagtgcgaccagagcgaggaattccataaactgtgctttgcctcaagagccattaagcacctgtacttgctctatgagaagcgggccgcctactag

SEQ ID NO: 33300 - DNA, 2676 bp, Artificial Sequence
  Description of Artificial Sequence: Synthetic coding sequence
atgtccctgcgaatcgacgtggatacgaactttcccgagtgtgtcgtggacgccgggaaagtgactctggggacccagcagcgtcaggagatggatcctagacttagagagaaacagaacgagattatattacgtgcggtctgtgccctgttgaacagcggaggggggatcataaaagcagaaatcgagaataaggggtataactatgagcgccatggagtcgggctggacgtgcctccgatctttcggtcccatttagacaaaatgcagaaggagaatcacttcctgatcttcgtcaaaagttggaatacagaagctggagtccccctggctactttgtgctcaaacctgtatcaccgggaaaggaccagcacagatgtgatggattcccaggaggctctggctttcctcaaatgcaggactcagaccccgactaatattaacgtatccaatagtctgggaccgcaggctgcccagggttccgtccagtacgaagggaacattaacgtgagtgcagccgctctttttgatcgcaagaggctgcagtatcttgaaaagttaaatctgccggagtcaacccacgtggagtttgtcatgtttagtactgacgtatcacattgtgtaaaagaccgactgcctaaatgcgtgtctgccttcgcgaatacagagggggggtatgtgttctttggtgttcatgacgaaacctgtcaggtaattggttgtgagaaagagaagattgacctgacaagtctgagagcatccatagacggatgtatcaagaagctgcccgtccaccacttctgcactcagcgccccgaaatcaagtatgtgctcaatttcttagaagttcatgacaaaggcgcactccgcggatacgtctgtgcaatcaaggtggaaaaattttgctgcgcggtgttcgcaaaagtcccttctagttggcaagtgaaagataatagggtgcggcagctgccgacccgcgaatggacggcttggatgatggaagccgaccctgacctgtccaggtgtccggaaatggtgctccagttatctctctcatcggcaacgccccgctctaaaccagtctgcatccacaagaatagtgagtgtcttaaagagcaacagaagcgctactttccagttttctccgaccgcgtggtgtacacccctgagtccctgtataaagaattattctcacaacataagggtcttcgggatctcattaataccgagatgaggccattcagccagggcattctcattttctctcagtcatgggccgtggacctgggcctgcaagagaaacagggcgttatttgtgacgcactcctcatctcacagaataacacccctatcctttatactattttctccaagtgggacgctggatgcaagggctatagtatgatagtggcctatagtctcaagcaaaagctcgtgaacaaaggtgggtacactggtcgtctttgcattacgccactggtttgcgtgctaaacagcgatagaaaagctcagtccgtttacagtagctatttacagatttatcccgagtcttacaatttcatgacccctcagcacatggaggccctcttgcagtcactggtgatcgtgctgcttggttttaaatcattcttgagtgaggagctgggctctgaagtgcttaatttgctcacaaataagcagtatgaactgctgagtaagaacctgcgaaaaacacgagagctatttgtccacggcctccctggcagcggtaaaacaattttggccctgagaatcatggagaagatcaggaatgtcttccattgtgagcctgctaacatactttatatctgtgaaaaccagccccttaaaaagctagtctcgttctccaaaaaaaacatctgtcagcctgtgaccagaaagacttttatgaaaaacaatttcgagcatatccagcatatcattatcgatgacgcccagaattttaggaccgaagatggagattggtatggtaaggctaagttcataacccagacagcacgagacggacccggcgtgctgtggattttcctggattactttcaaacttatcacctgtcatgcagcgggctgccccctccatctgatcagtatcctcgggaagagattaacagggtggttcgcaacgcagggccaattgctaattacctccaacaagtgatgcaggaggctagacagaatcctccaccaaatcttcctccaggaagtctggtgatgctctacgagccaaaatgggcccagggcgttcccggcaatctagaaatcatcgaagatcttaacctcgaagagattctgatatacgtcgctaataaatgccgtttcttgctgagaaatgggtacagccccaaggatattgcagttctgttcaccaaagccagtgaggtggaaaagtataaggatcgattattaacagccatgcgtaagagaaagcttagccagctacatgaggaatctgatctgctgttgcaaatcggcgatgcctcagatgtgcttactgaccacatagtactggactccgtgtgcaggttctctgggcttgagcggaatattgtctttggaattaatcccggggtcgcacctcccgccggcgcttataatttactgttatgcctagcctcccgggccaagcggcacttgtacatcctgaaagcctcagtatag

SEQ ID NO: 33301 - DNA, 1170 bp, Artificial Sequence
  Description of Artificial Sequence: Synthetic coding sequence
atgtccctcaggatcgacgttgacacaaacttcccggaatgtgtcgtggacgccggcaaagtgacgttgggcacccagcagcgacaagagatggacccccggcttcgagagaagcagaatgaaattatcctgcgagccgtgtgcgccctgctcaacagcggcggtggcataattaaagcagaaattgagaacaaaggatataattatgagcgtcatggcgtaggcttagacgtgcccccgatctttcgttctcacctcgacaagatgcagaaagaaaatcatttcctcatcttcgtcaagagttggaataccgaggctggggtgccacttgcaacgctctgcagcaatctgtatcaccgggagcggaccagcaccgatgtcatggatagccaggaggccttagcattcctaaagtgccgcacacaaaccccaacgaacataaatgtcagtaattccctgggaccccaggctgcacaagggtctgtacagtacgagggaaacatcaacgtgtctgctgcagccctgttcgaccgcaagcgcctgcagtacctcgagaaattgaacctccccgagtctacgcatgtggagttcgtgatgttttccaccgacgtctctcattgcgtcaaagaccggcttcctaaatgtgtgtcagcctttgccaacactgaaggagggtacgtgttttttggcgtgcatgacgaaacctgtcaggtcataggatgcgagaaagaaaagattgatctgacaagtttgcgcgcttctatagacggatgtataaaaaagctgccggttcaccacttctgtacacagagacctgagataaagtatgttcttaacttccttgaagtgcatgataagggggctctaaggggctatgtgtgtgctatcaaggtggagaaattttgctgtgcagttttcgcaaaagtgccgtcctcctggcaggtcaaagacaacagggttcgtcagttgcccactcgcgagtggaccgcctggatgatggaagcagaccccgacctttcccggtgtcctgaaatggtgctgcagttgtctttgagcagcgcgactcctcgtagcaagcctgtgtgtattcataagaactcggaatgtctcaaagagcagcaaaaacgctatttcccagtgtccgccaggaaaaccagtgcctctcagtag

SEQ ID NO: 33302 - DNA, 1224 bp, Artificial Sequence
  Description of Artificial Sequence: Synthetic coding sequence
atgacaccaatgaaacggtcagtccaaactcaggtatccgagcccttcatggagagctggggcgaggagagcctccccgaactacccgccgagcagtcactgactgaatattccgacctcgaggaggcccccagcgcacacaccctgtatgtgggtcatctgaacccccaattttctgtcccggtgctagcatgtcttctgcgtgacactctggagaggctggaaatgcccgtggctcgcgagcatattgaggtcgtgcgccgaccaaggaaggcgtatgcactcgtgcaggtgaccgtccaccgtgacaccctggcaagtctcccatggcgcctgcagacagccctggaagagcatctaatactgaaagagctggcagcccgcggaaaggaccttttgctgtctgaagctcaggggcccttttcacaccgcgaagaaaaagaggaagaagaggaagatagtggtctgagcccaggaccatcgccaggtagtggtgtccccctgcctacgtggcccacgcacactttgccagacaggccacaggcgcagcagctgcagagctgccaaggacggccttcgggagtgtgctcagatagtgcaatcgtccaccaacagatcgtggggaaggaccagttgtttcagggtgccttcttgggcagcgagacacggaatatggagttcaagaggggttcgggcgagtacctctcactggccttcaagcatcacgtgagaagatatgtgtgtgccttcctcaattccgagggcgggagtctgctggtgggcgttgaggattccgggctagtccaagggatcagatgctcccaccgagacgaggacagagcccggcttttggtagactctatcctccagggctttaaaccccagatcttcccagacgcctacactcttactttcatccccgtcatttccacatctgagacatctgtgccgctcaaagtaattcggctgacagtgcacacccccaaagcacaatctcaaccccaactgtatcaaaccgaccaaggagaagtgtttttaaggagagatggctccattcagggtcctctgagcgcgtccgccatccaggagtggtgtcgacagagatggctcgtggagttaggcaagctggaggagaagatgaaggccctgatgatggagaaggaacagttacagcaacaattgcaacaacatggcccggtcagctgcacgtgctgcgtcctgtag

SEQ ID NO: 33303 - DNA, 1224 bp, Artificial Sequence
  Description of Artificial Sequence: Synthetic coding sequence
atgacacccatgaagaggagtgtgcagacgcaggtatctgaaccctttatggagtcatggggcgaggagtcgttgcccgagctgccggctgagcagagcctgaccgaatattccgatttagaggaggctcctagcgcccatactctatacgtggggcacctgaacccacaatttagtgtccccgttctggcatgtctgcttcgggataccctggaacggctcgagatgcccgtggcgagagagcacatcgaagtggtaaggagacccaggaaagcttatgctctagtgcaagtgaccgtccatcgcgatacccttgcctcactgccatggcgactgcaaacagccctcgaggagcatctgattttgaaagagcttgccgctcgcgggaaggacctgctgctttccgaagctcaggggccgttcagccaccgcgaggagaaagaagaagaagaggaggactccggactttcccccgggccctcaccaggctctggggtgccccttcccacttggcctacgcataccctgccagacaggccccaggcccagcagctccagagctgccaggggcgacctagcggggtttgctccgattcagctattgtccaccagcagattgttggaaaggaccaactattccagggagcctttctggggagcgagactagaaacatggagttcaagaggggctcgggagagtatctcagcttggccttcaagcatcatgttcggcgctatgtatgtgcctttctcaatagcgaagggggaagtcttttggtaggggttgaagactctggtttagtgcagggaatccgctgttctcacagagacgaggatagggcacgccttctggttgattcgatcctgcaggggtttaaaccccagattttccccgacgcatatactctcacctttatccctgtgatctccacgtcggagacctcagtgcccttaaaggtgatccgcctgactgtgcatacacctaaggcccaatctcaacctcagctgtatcaaacagatcagggcgaagtgtttttaaggcgggatggcagtatccagggccctctgtccgccagcgccattcaggagtggtgtcgccaacgttggctggtcgagctggggaaactagaggaaaagatgaaggccttgatgatggagaaggagcagctgcagcagcagctgcagcaacacggacccgtttcctgcacatgttgcgttctatag

SEQ ID NO: 33304 - DNA, 1047 bp, Artificial Sequence
  Description of Artificial Sequence: Synthetic coding sequence
atgacaccgatgaagagaagtgtgcagactcaggtctctgagcctttcatggagtcctggggtgaggagagtctacctgagttacctgctgagcagtctctcactgagtatagcgacctagaggaggcccccagcgcccatacgttatatgttggccacttaaatccacagttttctgtgcctgttctggcctgcctactacgggacacactagagcgtctggagatgcccgtcgcacgtgaacatattgaggtggtacggagaccgcgtaaggcatatgctttagtccaggtcactgttcacagagatactctggcaagcctgccatggcggctccagaccgccctggaagaacacctgatcctcaaagagttggccgcccgcggaaaagatctgctgctgtccgaggcccagggtccattcagtcacagagagcagatcgtcggaaaagaccagctctttcagggggccttcttgggctcggaaacgcggaacatggagtttaaacgtggtagtggtgaatatctgagcctggcgttcaagcaccacgtaagaagatatgtctgcgcttttttgaatagtgagggcggatcattgttagtaggggtggaagactcaggtctggttcagggaattcgctgttctcacagagatgaagacagggccagacttcttgtggattccatactgcagggctttaagccgcagatctttcctgacgcatatacacttacgtttatacctgtcatatctacttcggagactagtgtgcctctcaaagtcatcaggctcactgttcatacacccaaagcccagtcacagcctcagctgtatcagaccgatcagggcgaggtattcctgcgtcgcgacgggtcaatccagggtcccctgagcgcatccgccattcaagagtggtgccgccagagatggctagtcgagctcggcaagctggaagagaaaatgaaggctctgatgatggaaaaagagcaactgcagcagcagttacagcagcatggccccgtatcatgcacttgctgtgtgctctag

SEQ ID NO: 33305 - DNA, 1080 bp, Artificial Sequence
  Description of Artificial Sequence: Synthetic coding sequence
atgactccaatgaaacgttcagttcaaacgcaggtgagcgaaccgtttatggaatcctggggtgaggaatcccttcctgagctgccagctgagcaatcactgacggagtactcagatctggaagaggcaccttcggctcatacactgtatgttggccatttgaacccacaattctccgttccagtccttgcatgcctgctgagagataccctggagcggcttgagatgccggttgctcgtgagcatattgaagtggtgcgaaggcccagaaaagcttatgcactcgttcaggtcacagtgcaccgagataccctggcatctcttccttggcggttgcaaaccgccttggaagagcatcttatcctgaaggaactcgctgccagggggaaggacctcctactcagcgaagcccagggacccttctcccatcgcgaagagaaggaagaagaagaggaggatagtggattgagccccggtcccagtcctggctccggagtccctctgccgacctggcctactcatacccttcccgataggccccaggctcaacaattacagtcttgtcagggacggccctcaggcgtgtgctccgattcagcaatcgtccatcaacagatcgtaggtaaggaccaactctttcagggggctttccttggaagcgagactcgcaatatggaatttaagcgtggtagcggtgaatacctgagcctggcgttcaagcaccacgtccgcaggtacgtgtgcgcattcctgaattctgagggtggatctctactggtgggggtggaggactccggactcgtccagggaatcaggtgcagtcatagggatgaggatcgcgctcgactgttggtcgactctattttacaggggttcaaaccccagatattcccggacgcatacacactgactttcattcccgtgatctcaacaagcgaaactagtgttccactgaaaaggtggctggtcgaactgggtaagttagaggaaaagatgaaagcactcatgatggagaaggaacaacttcagcagcagctgcagcagcatggtcccgtgtcctgcacctgttgcgttttgtag

SEQ ID NO: 33306 - DNA, 1080 bp, Artificial Sequence
  Description of Artificial Sequence: Synthetic coding sequence
atgacccctatgaagaggagtgtacagacccaggtctccgaaccatttatggaatcttggggcgaagaatctctcccggaactcccggcagagcagtcattgaccgagtatagtgacctggaggaagcaccgagcgcacacactctgtacgtgggccatctgaatcctcagttctctgtaccagtcctggcatgcttgttacgggataccttagaacggcttgagatgcctgttgctagagagcacattgaggtggtgcgccgccccaggaaggcttacgcgctggtccaggtgacagtccaccgcgacaccctggcctctctgccatggaggctgcagacagctctggaggaacatttgattctgaaggaactggccgctcgcgggaaagacctgttattaagcgaggcccagggccccttctcacacagggaggaaaaagaggaggaggaagaagacagcgggctgagtcctggcccatccccaggcagcggagtccctctccctacatggcccactcacaccctgccagacaggccccaagcacagcagctacagtcctgccaggggcggccctcaggtgtgtgttcagactccgccatagtgcaccaacagatagtggggaaggaccagctgttccaaggggcattcctcggctcagagacccgtaatatggagttcaaaaggggctccggggagtatctgtccctggctttcaaacatcatgtccgccggtatgtgtgtgcattcctgaattcagagggtggcagccttcttgtgggcgtggaagattcaggacttgtacaggggattcgttgttcccatcgcgacgaggaccgtgcacgtttgctggtggatagtatactacaaggattcaaaccacaaatttttccggatgcgtatacacttacttttatccccgtaatcagtacctctgaaacaagcgtgccactgaaaaggtggttggtggagcttggaaagttagaagagaagatgaaagcactgatgatggagaaggaacagctccagcaacagttgcagcaacacggccctgtgagctgtacctgctgcgtactgtag

SEQ ID NO: 33307 - DNA, 1224 bp, Artificial Sequence
  Description of Artificial Sequence: Synthetic coding sequence
atgacacccatgaagaggagcgtccaaacgcaggtgagcgaacctttcatggagtcgtggggggaagagtccctgcccgagctcccggccgagcagtccctaacagaatattccgatttagaggaagccccctctgctcataccctttacgtgggacacctcaacccacagttttctgtgcccgtgcttgcatgccttctgcgagacacgcttgagaggcttgaaatgccagtcgcgagggaacatatagaggtggtgcggagacccagaaaagcctacgctttggttcaggtgaccgtgcatagggatactcttgcaagtcttccgtggcggctgcaaactgcccttgaggagcatttgattttgaaagagctggctgccaggggtaaggacttactcctttctgaggcgcagggacccttttctcacagagaggagaaagaggaggaggaagaggacagcggcttatcccccgggccttccccggggtccggggtacccctgcctacctggcctacacacacactgccagaccgtccacaggcccagcaactccagtcctgtcagggacgcccgagcggggtgtgcagcgactcggccattgtgcatcagcagatagtcggaaaggaccagcttttccagggagcctttctcgggagcgaaacacggaacatggagttcaagcgcggcagcggcgagtacctatccttagccttcaagcaccatgttcgaaggtacgtttgcgcttttctcaattctgaggggggaagtctactggtgggtgtggaggacagtggtctggtccaggggatcaggtgcagccatcgcgacgaggatagggctagactgttagttgattctattttacaagggttcaaacctcagatctttccagacgcctacactctcaccttcatcccagtgatatcaactagcgagacctctgttcctctcaaagttattaggctaactgtgcacacccccaaagcacagtcccaaccacaactctaccaaactgaccagggtgaggtgttcctccgtcgcgatgggtccatccaggggcccctgtccgcctctgccattcaggagtggtgtcgtcaacgatggcttgtggagctcggtaagttagaagagaagatgaaggccctcatgatggaaaaggagcagctgcaacagcagctccagcagcatggaccagtgtcatgtacatgttgtgttctctag

SEQ ID NO: 33308 - DNA, 1920 bp, Artificial Sequence
  Description of Artificial Sequence: Synthetic coding sequence
atgtcagctagtggggtgttgagcttcacccagcaaggctgggagcaggtgcttgccaaggtgaagcgcgccgtcgtgtatttagacgcggcctgtgccgaatctctgcactggggatgcggtagtactagactgcttgaggccgtcggaggtcctgattgccatcttcgggaattcgagcctgatgccatcggaggaggcgccaagcaacctaaggcagtttttgtgctcagctgtctgcttaaagggcgaacggtggaaattcttcgggacatcatttgcagaagccattttcagtattgcgttgtggtaaccactgtgtcccatgccgtacacctgacagccaaccacgtcccagcggcggcagcggcggaaatggaagggcaacaaccagtcttcgagcagcttgaagagaagttatgtgaatggatgggcaacatgaattacacggccgaggtctttcatgtccctctcctcttggcacctgtggcaccacatttcgctctgaccccagcctttgcttctctcttccctctgctgcctcaggacgtgcacctgcttaattcggcccggccagataagagaaagctcggcagtctgggtgatgtggattctactactctcactcctgagctgctcctgcagatccggtgcctagtgtcgggcctctcctccctgtgcgagcacttgggggtgagagaagagtgctttgctgtgggttccctttctcaggtgattgccgccgacctggctaattacgcccccgctaaaaaccggaagaagactgccgcggggcgtgccagtgtggttttcgtcgatagaactctggacctgaccggggccgtggggcaccacggagataacctggtcgagaagatcatatcagcactaccccaacttccagggcacacaaacgacgtcatggtgaacatgattgccctcacggctttgcacaccgaggaagaaaactataacgtggtagcccccggatgcctgtcccagagctccgacaccaccgcaaaggcgctctgggaagctctccttaacacaaaacataaagaagctgtaatggaagtccgccgccacctggtggaagcggccagtcgggaaaatcttcctattaaaatgagtatgggcagagttacgccgggacagctcatgtcttatattcagctcttcaagaacaatctgaaggcgctgatgaatcactgcgggctattacagctgggcttggccacagctcagaccttaaagcatcctcagactgcgaagtgggataacttcctcgccttcgagcggcttttgctccagtcaatcggtgaaagtgccatgtccgttgtcctcaaccagctcttaccaatgatcaagccagtgacccagagaactaatgaggactacagtcccgaggaacttctcatcttgcttatatacatctatagtgtgacgggcgaactgacagtcgacaaagatctctgcgaagccgaagagaaggtgaaaaaggccctggcccaagtgttttgcgaagagtctggcctgtctcccctgttacagaagatcaccgactgggattcaagtattaacttaaccttccataagagcaaaattgctgtggatgagctgtttactagccttcgtgacattgcaggagcccggtccctgctcaagcagtttaagtctgtatacgtgcctgggaaccatactcaccaagtcagtcgaccccatcccagtgactaccctctcctgatcctgttcgtagtgggaggggtgacggtgtccgaggtgaaaatggtaaaagacctggtggcctcattaaaacctgggacccaggtcattgtcctctctacacgattgcttaaaccgttgaacattccagagctactgttcgcaacagacaggctgcaccctgatctaggcttttag

SEQ ID NO: 33309 - DNA, 2055 bp, Artificial Sequence
  Description of Artificial Sequence: Synthetic coding sequence
atgtctgcatcaggagttctgtcatttactcagcaggggtgggagcaggtgctcgccaaagttaaacgagccgtcgtgtatcttgatgccgcatgcgctgagtcactccactggggttgcgggagtacccggctcctagaagcagtaggcggaccggattgccatctccgcgaattcgaacccgatgccatcggcgggggcgcaaagcagcccaaagctgtgtttgtcctatcatgtctcctgaaaggccgcaccgttgagatcctgcgagatataatctgccgttctcactttcagtattgcgtggtggttactactgtgagtcacgccgtgcacctaactgctaaccacgtccccgccgctgccgccgccgaaatggagggacagcaaccagtcttcgagcaactggaagagaagctgtgtgagtggatgggcaacatgaactataccgcagaggtgtttcacgtcccactgctgttagccccagtcgcaccccacttcgccttgacccccgctttcgctagcctttttccacttctcccccaggacgttcatctcctgaattcagctcggcccgataaacgaaaacttgggtcccttggcgatgtcgattccactaccctaacacccgaactcctgctgcaaatccgatgtttagtttcaggactcagttccctttgtgagcatcttggcgtacgcgaggaatgcttcgcagttgggagccttagccaagttatcgcagcagaccttgcaaactatgcccccgccaagaataggaagaagaccgctgccgggcgcgcttccgtggtgttcgtagacagaaccctggacttgaccggggcggtgggccaccacggcgacaatttggtggagaagattatctctgctctgcctcaactccctggccatacaaacgacgtgatggtgaatatgattgccctgacggccctgcacacagaggaggaaaattataacgtcgtggcccctggttgtcttagccagagctctgatacaactgctaaagcactgtgggaggcgctgttgaacacgaaacataaagaggcggtcatggaagtgcggagacatctggtcgaggctgcatcacgcgaaaaccttcccattaagatgagtatgggccgagtcaccccgggtcagctcatgagctacatccagctttttaaaaataatctgaaagcactgatgaatcactgtggactactgcagctcggcctggccactgcgcaaaccctgaaacaccctcagaccgcaaagtgggataattttctggcttttgagagactgctcctgcagtccatcggcgaatcggcgatgtccgtggtcctcaaccagctccttcctatgattaagccggtaactcagaggaccaatgaggattacagcccggaggagctccttatcctgctcatttacatctatagcgttaccggggagctgactgttgacaaagatctgtgtgaagcagaggaaaaggttaaaaaggcactggcccaggtgttctgtgaggagagcgggttgagtcccctgctccagaagatcaccgattgggacagctcaatcaatctcactttccacaagagtaaaatagccgtcgatgaactgttcaccagcctccgcgacatagcaggagcgcgatctttactcaaacagtttaaatctgtgtatgttcctggcaatcacacacatcaagctagctacaagcctctgcttaaacaggtcgtggaggaaatcttccacccagagcggccagacagcgtggacatcgaacatatgtcatccggactcacggacctgctgaagaccgggttcagcatgttcatgaaagtgtcccgcccccaccccagtgactaccccttacttatcctgtttgtggtcggcggcgttaccgtgagtgaggtgaaaatggtcaaggatctggtggccagcctcaagcccggtacccaggtgatcgtgctatcaacgcgactgctgaaacccctgaatattcctgagctgttgtttgctactgatagattacaccctgacttaggattttag

SEQ ID NO: 33310 - DNA, 777 bp, Artificial Sequence
  Description of Artificial Sequence: Synthetic coding sequence
atgcagatcagcggcgctgtcgccccggctcccccctccagcggactggggttcggaccacctacgtcgctggcaagcgccagcggtagttttcccaatagcgggctgtatggatcctacccacagggacaagcacctcccctgagccaggcccaggggcacccagggatccagaccccacagagatccgcgccatctcaggcgagctcttttacacctcccgcctctggaggccctcggctgcctagcatgacgggccccttattacctggccaatcctttggcggcccttctgtgagccaacccaaccacgtgtctagtccaccccaggcccttcctcctggaacacaaatgacagggcccctcgggcctcttccccccatgcactccccgcagcagcctggctaccagccccagcagaatggaagcttcggacctgcaagggggccacagagcaattacggtggcccttatcccgctgcgcccacatttggcagtcagcctggtcctcctcagccactcccgcctaaacgactggaccccgacgccatcccttctcccgccagcccttacgtggtggatcacggggagtcaggaccgcttaggtgcaaccggtgtaaggcgtacatgtgtccatttatgcagttcatcgagggcggccggcggtttcagtgctgtttctgctcctgtattaatgacgggcgcgtgggacagaagtctcagcagtctgcactggctctcagcccaactatccgctgttcaacttccattatgtag

SEQ ID NO: 33311 - DNA, 1278 bp, Artificial Sequence
  Description of Artificial Sequence: Synthetic coding sequence
atggcgtcttcgagtccagatagcccatgttcctgtgattgctttgtgtctgtgccccctgcctcagctatccccgcagtaatcttcgcgaaaaatagcgacagaccaagggacgaggttcaggaagtcgtctttgtcccagccggcactcacacacctggctctcgtcttcagtgtacctacatcgaagtggagcaggtgtctaagacccacgcggttattctcagtagaccaagctggttgtggggcgctgagatgggcgcaaacgagcacggcgtgtgcatcggtaatgaggcagtgtggacaaaggagcctgtaggggagggagaggcccttctggggatggacttgctcagattagccctagagaggtcctcctccgctcaggaagccctccatgtgattaccgggctcttagagcattatggccaaggcggcaactgcctggaggacgccgcccctttttcatatcactccacattcctgctggctgaccgtactgaggcttgggtgctggaaactgctggtcggctgtgggccgcacagcggatccaggagggcgctcgaaatatttccaaccaactctccatcggtaccgacatctctgctcagcaccccgaactcaggacacacgctcaggcaaaggggtggtgggatgggcaaggagcctttgactttgcccaaatcttttcgctcacccagcagcctgtgagaatggaggccgccaaagcacgattccaggcagggagagaattactgcgtcagagacaaggcggcatcaccgcggaggtgatgatgggaattctgagagataaagagagcggaatatgcatggattctggaggcttccgcaccaccgcttcaatggtgtcagtgctgccccaagaccctacacagccctgtgtgcatttcctgaccgccacacccgacccatctcggagcgtgtttaaacccttcattttcggcatgggggtagcacaggcccctcaggttctgagcccgacctttggcgcccaggatcctgtcagaacattaccacgattccagacccaagtggatcggagacacacattgtaccgcggacatcaggctgcactgggactgatggaacgagaccaagacagaggccaacagctgcagcagaagcaacaggatcttgaacaggaggggttggaagctacacaaggcctcctggccggcgagtgggccccgcctctctgggagcttggttccctattccaggctttcgtcaaaagggagagccaggcatacgcctag

SEQ ID NO: 33312 - DNA, 1137 bp, Artificial Sequence
  Description of Artificial Sequence: Synthetic coding sequence
atggcttccagctctcctgactctccctgttcctgcgattgtttcgtgagtgtgccccctgcctcagccatcccagctgttatcttcgctaaaaactctgacagaccgcgagatgaggtacaggaagtggtatttgtgccagcaggcacacacacgccagggagcagattgcagtgtacctacatcgaagttgaacaagtgagcaaaactcacgccgtgatcttatccaggccttcgtggctatggggtgctgagatgggcgcaaacgaacacggagtttgcatcggcaatgaggcagtgtggacaaaggagcccgtgggggaaggggaagcattgctgggcatggacctactccgcctcgcactggagagatcaagttcggcccaagaggcattacacgtgatcactgggttgctcgaacactatggccaggggggcaattgcctggaggatgcggcgccattcagctaccacagtactttcctgctggccgatcgcaccgaagcttgggttctggagacagccggtagactgtgggcggctcaaagaatacaggagggagccaggaatatctccaatcagttatctattggaacagacattagcgcccaacatcctgaactgcgcacacacgcccaggcgaagggttggtgggacgggcagggagccttcgactttgcgcagattttcagcttaacacaacagcctgtgcggatggaggcagctaaggccagatttcaagccggcagggagctgctccgacaaagacaagggggcataacggccgaggtcatgatgggtatcctccgtgacaaagaaagtggcatctgcatggattccggtggcttccggacaaccgccagtatggtgtcggtcctcccacaggacccgactcaaccatgtgtgcacttcctaacagccacccccgatccgtctcgcagtgtgttcaaacctttcatttttggtatgggtgtggcccaggcaccccaggtgctgtcccccacttttggggcccaggatcctgttcgaaccctccctcgcttccagacccaggtggatagaagacatactctgtatcggggtcatcaggccgccttaggtctcatggaaagagaccaggtgagcccaagggagtag

SEQ ID NO: 33313 - DNA, 1275 bp, Artificial Sequence
  Description of Artificial Sequence: Synthetic coding sequence
atggaacctttctcctgcgacactttcgtcgcattgccgccagcaaccgtcgacaatagaatcattttcggaaaaaactctgatcggttatatgacgaggtgcaggaagtggtgtactttcctgctgttgtccacgataatcttggggagagacttaagtgtacctatattgaaatagaccaggtgcccgaaacgtatgccgttgtcttgtccagacccgcctggctgtggggcgcagagatgggcgcaaacgagcacggcgtgtgtatcggcaacgaagctgtctggggcagggaagaggtttgcgatgaagaggcccttctcggtatggacttggtgcgtctaggtctggaaagagcagatactgctgagaaagctctaaatgtgatcgtggacctgctcgagaagtatggtcaagggggcaattgcaccgagggccgaatggtcttttcctatcacaattcctttttgatcgcggatcggaacgaggcttggatcttagaaacagcaggcaagtattgggcagctgagaaggtccaggaaggcgtgagaaatatttctaaccagctgtccatcaccaccaagatcgctcgcgaacatccagatatgagaaattatgccaagagaaaaggctggtgggacggaaaaaaagaattcgatttcgcggccgcgtactcctatttagacacagccaaaatgatgacaagtagtggaagatattgtgagggctataagctgctcaataaacacaaaggaaacatcacatttgagacgatgatggaaatcctgcgcgataaacctagcggtattaacatggaaggggagttcctcacgacagccagcatggtgagtatcctgcctcaagacagctctctcccatgtatccacttcttcacaggtacgcccgaccccgagagatctgtatttaagcccttcatcttcgttcctcacattagccaactattagacaccagctcgcccaccttcgaactggaggacctggtgaaaaaaaagagtcatttcaagccagacagacgccaccccctctatcagaagcatcagcaagccctggaggtggtcaataataatgaggagaaggctaagattatgctggacaacatgcgtaagctcgaaaaagagctgtttagagaaatggaatccatcttgcaaaataagcatctggacgtagaaaagatcgtgaacctgttcccccagtgtaccaaggacgaaatccagatctaccagagcaacctgagcgtcaaggtgagctcctag

SEQ ID NO: 33314 - DNA, 342 bp, Artificial Sequence
  Description of Artificial Sequence: Synthetic coding sequence
atggagccattttcgtgcgacactttcgtggctctgcctcctgcaacagtggacaatcggatcatattcggtaaaaacagcgatagactatatgatgaagtgcaggaggtggtctactttccagccgtggtccacgacaacctgggggagaggctgaagtgcacatatatcgagatcgatcaagtgccagagacgtacgctgtggtcctctccagaccagcttggctctggggtgcggagatgggcgccaacgaacacggggtatgcattggtaacgaggccgtttggggccgcgaggaagtatgtgatgaggaggctctgttgggcatggacctggtgtag

SEQ ID NO: 33315 - DNA, 408 bp, Artificial Sequence
  Description of Artificial Sequence: Synthetic coding sequence
atggagccgttctcttgtgatacgtttgtagccctcccccccgcaaccgttgataatcggattatctttgggaagaatagcgatcgcctatatgatgaggtgcaagaggtagtgtacttccccgccgtcgtgcatgacaatctaggagagcgcctgaaatgtacatacatcgagatagatcaggtcccagagacctatgcggtagtcctgtcacggcctgcttggctttggggggccgagatgggtgccaatgagcatggggtctgtatcggaaacgaagccgtgtggggccgagaagaagtctgcgacgaagaggcactactagggatggatttggttaggctcggactggagcgggctgatacagccgaaaaagcactgaacgttatagtggatctgctcgagtag

SEQ ID NO: 33316 - DNA, 33 bp, Artificial Sequence
  Description of Artificial Sequence: Synthetic coding sequence
atggagccattcagttgcgatacgtttgtctag

SEQ ID NO: 33317 - DNA, 651 bp, Artificial Sequence
  Description of Artificial Sequence: Synthetic coding sequence
atggagccattttcctgtgatacattcgtggcgttgccaccagcgacagtcgacaaccgaatcatctttggtaagaacagcgatagactgtacgacgaggtccaggaagtcgtttactttccagccgttgtccacgataacctgggtgagagactgaagtgtacttacattgagatcgaccaggtgcctgaaacatatgctgtggtgcttagccggcccgcgtggctttggggagccgagatgggggctaacgaacacggggtgtgcatcggcaatgaggctgtctgggggagagaagaggtttgcgacgaagaggccctactcggcatggacctggtacgtctcggcctcgaacgtgccgacacagccgagaaagctttgaacgtcatagtggacctgctggagaagtacgggcagggtggcaattgcactgagggaagaatggtttttagctatcataactctttcctcatcgccgataggaatgaggcctggatcctggaaacagccggcaagtattgggccgcggagaaagttcaagaaggagtgcgcaacatctccaatcagctctcaatcaccactaaaattgcacgcgaacatcctgacatgcgaaattatgccaagagaaaagggtggtgggacggcaaatag

SEQ ID NO: 33318 - DNA, 630 bp, Artificial Sequence
  Description of Artificial Sequence: Synthetic coding sequence
atggagccattctcttgtgacacctttgtggccttaccccccgccacggtcgataaccgcatcattttcggcaaaaattctgatcggctgtatgatgaagtgcaggaggtggtttactttccggctgtggtccacgacaacttgggagagcggctgaagtgcacatatattgagattgaccaggtacctgagacatacgctgtggtgctgagtaggcccgcttggctgtggggagctgaaatgggagccaatgagcatggcgtatgtatagggaacgaggctgtttggggaagagaggaagtctgtgatgaagaagcactgcttggcatggatctcgtacgactgggcctcgaacgagctgatactgctgagaaggcccttaatgttatcgtagacctgctcgaaaaatatgggcagggaggtaattgcaccgaaggacgcatggtcttctcctaccataactcctttttgatcgctgatcgaaatgaggcatggatcctggagacggccgggaaatattgggccgccgagaaggtccaggaaggggtgcgaaacatcagcaaccagcttagcattactacaaaaattgctagggaacaccctgacatgagaaattatgccaagcggtag

SEQ ID NO: 33319 - DNA, 1254 bp, Artificial Sequence
  Description of Artificial Sequence: Synthetic coding sequence
atgcctccactggccacaccaccatctgtgcacttgagcctgcgagtcgccgggagacccgatcggttatatgacgaagtgcaggaagtggtgtattttccagccgtcgtgcacgacaatctaggcgagcgactgaaatgtacctacattgagatcgaccaggtgcccgagacctacgccgtagtgctgtcacggcctgcttggctttggggagccgaaatgggcgctaatgagcatggcgtctgtataggcaatgaagccgtgtggggacgcgaggaggtgtgcgatgaagaagccctgcttggaatggaccttgtgaggcttggcctcgagcgcgcagacactgcagagaaggctttaaacgtgatcgtcgaccttctcgagaaatatggtcagggcgggaactgcacagaaggacgcatggtcttctcttatcacaattcttttcttatcgccgacaggaacgaagcctggatcctggagaccgccggaaagtactgggcagctgagaaagtgcaggagggagtccgaaacatcagtaaccagctgtcaatcactaccaaaattgccagagaacatcctgatatgcggaactacgccaagaggaagggatggtgggacggaaagaaggaattcgactttgccgccgcctactcatatctggacacagccaagatgatgacctccagcgggcgatactgcgagggctacaagctgttaaacaagcacaagggcaatatcacctttgaaactatgatggagatcctccgtgacaaaccctccggtatcaacatggaaggcgagtttttgaccactgctagcatggtgtccattctgcctcaggattctagtctgccttgtatccacttcttcaccggaacacccgatcccgagaggtcagttttcaaaccattcatattcgtgccacatatatctcagctgctggatacgtctagtccgacttttgaactggaggatctggtgaagaagaagagtcatttcaaaccagaccggcggcacccactttaccagaaacatcagcaggcactggaggtcgtgaacaataatgaggagaaggccaagattatgcttgacaatatgaggaaacttgaaaaagaattattccgcgagatggagtcaatcctccaaaacaagcatttggacgtggaaaagattgtaaatctgttcccacagtgcacaaaggacgaaatccagatctaccagagcaacttaagcgtgaaggtgtctagttag

SEQ ID NO: 33320 - DNA, 3171 bp, Artificial Sequence
  Description of Artificial Sequence: Synthetic coding sequence
atggatagggctccaactgagcaaaatgtcaagctgtccgctgaagtcgagccctttatcccacagaaaaagtccccagacaccttcatgattcccatggcactcccgaatgataacggttctgtgagtggcgtcgagccaactccaataccgagctacctcattacgtgctacccgttcgtacaggagaatcaatccaatcgccagtttcccctatacaataacgacattcgttggcaacagcctaaccctaacccaactggtccctatttcgcgtaccccatcatttcagctcagccaccagtgtccaccgaatacacttattaccagctaatgcctgctccatgtgcccaagtcatgggcttttaccaccccttcccaactccctactcaaacaccttccaagcggccaatacagtgaacgctatcaccaccgagtgtacagaacggcccagccaactggggcaggtgttccccctgtcctctcataggagccgcaactccaatcggggttctgtcgttccgaaacagcagctgcttcagcagcacattaagtccaagcgccccctggtgaagaatgtggctacacagaaagaaacgaatgccgcagggccagactctcgcagcaagatagttctgttggtggacgcaagccaacagactgacttcccgtctgacattgccaacaagtccctttctgagactacagctacaatgctatggaagtcaaaggggcggaggcgaagagcttcccacccaacagcagagtcttcgagtgaacaaggggcctcagaagctgacatcgatagtgatagtggatactgcagtcctaaacattctaacaatcagccagctgccggggccctacggaatcccgactctggaaccatgaatcacgtggaatcgagcatgtgcgctggcggggtaaactggtccaatgtaacgtgtcaggctactcagaagaaaccctggatggagaagaaccagacattcagtcgcggcggaaggcaaaccgagcagcgaaataattctcaagatgaggacgggtttcaggaactcaatgagaatggaaacgctaaggatgagaatattcagcaaaaacttagtagtaaggtccttgacgatcttcctgagaattcgcccatcaatattgttcaaactcctattcctatcactacatctgtgcccaaaagagctaaaagccagaaaaaaaaggccctggccgcagccctcgccactgcacaggagtacagcgaaatctcaatggaacagaaaaagctccaggaagccctttccaaggctgcaggaaagaagaataaaactcccgtacaactcgacctgggggatatgttggccgctctggagaaacagcagcaggctatgaaggctagacagataactaacacacgccctctgtcctacaccgtggtgaccgccgcttctttccacaccaaggactcaaccaaccggaaacctcttacaaagtcccaaccgtgcctgacatcctttaacagtgtggatattgcgagctccaaggcaaaaaaaggcaaagaaaaggaaatagccaagctcaaacgccccactgctctcaagaaggttatcctgaaggaacgggaggagaaaaaaggacggttaaccgtcgatcataacctgctgggttcggaggaaccaacagagatgcatctggattttattgatgatctgcctcaagagattgtttcgcaggaggatacaggtctgtctatgccaagcgatacaagcctctccccagcctctcagaattctccctattgtatgacacccgtgtcccagggcagcccggcaagttcaggcattggctctccaatggcctcttcaaccataaccaaaatacactcgaagcggtttcgggaatactgcaaccaagttctctgtaaggaaatagacgagtgtgtaacactgcttctgcaggagcttgtctccttccaggagcggatttatcagaaagatccagttcgagcaaaagctagaagaagactggttatgggtctgcgggaggtcacaaaacacatgaagctgaataaaatcaagtgtgtcatcataagccctaattgtgagaagattcagtcaaagggtggcctggacgaggctctatacaacgtcatagctatggctcgcgaacaggagattccatttgtttttgccctgggtagaaaagctttgggacggtgcgtcaacaaactggtacctgtttccgtggtaggaatcttcaactatttcggtgcagaaagcctttttaataagctggtggaacttacagaggaagcgaggaaggcgtataaggacatggtagcagcaatggagcaagaacaggctgaagaggcgctgaagaacgtcaaaaaagttccccatcacatggggcatagcaggaatccatccgccgcctcggctatatctttctgttcagttatttctgagcctatatccgaggtgaacgaaaaagagtacgaaaccaactggaggaatatggtagagacatcggacggcctggaggcatccgaaaacgagaaagaggtgagctgcaagcacagcacctctgagaaaccttccaaactgccattcgatacccctcccatcggaaagcagccgtccctagtggccacgggatcaaccacatcagcgacaagcgcaggaaaatccacagcttcggacaaggaagaggttaagcccgacgatttggaatgggcttcgcaacaatccacagaaaccgggtcactcgacggctcctgtcgtgatctgctgaactccagcattacctcaacaacttcaactcttgtccccggaatgttggaagaggaggaggacgaggatgaagaggaagaggaggactatacgcacgaacctattagtgtagaagtgcaactcaacagccggattgaatcgtgggttagcgagacacagaggaccatggaaaccttgcagctggggaaaactctcaatgggagcgaggaggataacgtcgaacagagcggagaggaagaggcagaagcacctgaagtgctggaaccgggcatggatagcgaggcctggactgccgaccagcaggcaagccccggacagcagaagtcatctaattgctcatcgctgaacaaggagcactcggattcaaattatactacacaaactacctag

SEQ ID NO: 33321 - DNA, 3306 bp, Artificial Sequence
  Description of Artificial Sequence: Synthetic coding sequence
atggatagagcccccacagaacagaatgtgaaactgtcggcagaagttgagccctttatcccccaaaagaagtctcccgacacttttatgatccccatggctctgcccaatgacaatggatcagtgtccggggtggagcccacacctattccatcatacctgatcacctgttaccccttcgtgcaggagaaccagtccaataggcaattccccctgtacaataacgacatcagatggcagcagccgaaccctaatccgacaggtccctacttcgcctacccaatcatcagtgcccaaccccccgtctctactgagtatacatactaccagctgatgccggcgccctgtgcccaggtgatggggttctatcacccgttcccaacaccttacagcaatacctttcaggccgcgaacactgttaatgcgatcaccaccgagtgtacagagaggccttctcagttaggacaagtgttcccactgtctagccaccgtagtcggaactcaaatcgtggatcagtggtgcccaagcaacaactccttcagcagcatattaaatcgaagcggcctctcgtgaagaacgtggcgacacagaaggaaaccaatgctgcgggacctgatagcaggtccaagatcgtgttacttgtggatgctagccagcaaaccgactttccttccgatatcgcaaacaaaagcctgtctgaaaccacggccaccatgctctggaaaagtaaaggaagacgccgacgcgccagtcatccaacagcggagagctcgtcagagcagggggctagcgaggcagatatcgatagcgattcgggctattgtagccccaaacattcgaacaatcagcctgcggctggagccttgagaaaccccgactctggtaccatgaaccacgtggaatctagcatgtgtgccggcggcgtcaactggtcaaatgttacctgtcaagccacacaaaaaaagccatggatggaaaaaaatcagactttttcacgcggaggacggcagactgagcaaagaaataacagccaagttgggttcagatgtaggggacactctacctcctctgagcgtcggcagaacctgcagaagcgccccgacaataaacatctctcctcttcacagtcacatcggtctgatccaaattctgagtccctttattttgaggatgaggacgggttccaggagttgaatgagaatggtaacgctaaagatgagaacatccagcaaaaactaagttctaaagtgctggatgatttgcctgagaatagccccatcaacatcgtgcaaaccccaatcccgatcactacctccgtgcccaaacgcgccaaatcacagaaaaagaaggctctagccgcagctctggccaccgcccaggaatacagtgaaattagcatggagcagaagaagttgcaggaggctttatctaaagcagcagggaaaaaaaataagacgcctgtccagctggacctgggagatatgctagccgccctggagaagcagcagcaggcaatgaaagcccgtcagatcacaaacactaggcccctatcctatacagtcgtgaccgccgcctctttccacactaaagattctacaaaccgcaaacctttaaccaaatcccaaccctgtcttacctctttcaattccgtggacatagcaagcagcaaggctaaaaaagggaaagagaaggaaattgccaagttaaagcgcccaactgcactcaagaaagtgatcctcaaagaaagagaagagaaaaaaggccgactcaccgtggatcacaatctccttgggtcggaagaacctacagagatgcacctggatttcattgacgaccttccacaggaaattgtgtcccaggaggacacaggcctgagcatgcctagtgataccagtttgagtcccgcctctcaaaattctccttactgcatgacccctgtgagccaaggaagcccggctagctccggaatcgggagccctatggcatcatccaccattacaaagatccactctaaacggtttagggaatattgcaaccaggttctatgcaaagaaatcgacgagtgtgtgacactgctccttcaggaactagtgtcatttcaggagagaatctaccagaaggatccagtgagagccaaagcccgcaggcgcctcgtgatgggactgcgggaggtgacaaaacacatgaagctgaataagatcaagtgcgtgatcatcagcccaaattgtgagaagattcaaagtaaaggtgggctagatgaggccctgtacaatgtgatagctatggcgcgagaacaggaaatccctttcgtgttcgcacttggacgcaaagcactgggaaggtgcgttaacaagttggtacctgtgtctgtagtgggaatcttcaactatttcggagctgagtccctgtttaacaaactggtggagctgacggaagaggctcggaaggcttataaagacatggtggctgcgatggaacaggaacaggccgaagaagcacttaagaacgttaagaaagtgccacatcacatgggccactctcggaacccgagcgctgcttccgccataagcttttgcagtgtcatcagcgaacctatatctgaagtgaacgaaaaagaatacgaaactaattggcgcaatatggtcgagactagcgatgggctcgaagcttccgagaacgagaaagaggtgtcctgcaaacacagcacctcggaaaagccctcaaaactgccattcgatactccacctatcggcaaacaaccatctctggtggcaaccggttcaacaacctcagccacatccgcaggcaaaagcacagctagcgataaggaggaggtcaaacccgatgatctagagtgggcgtctcagcagtctacagagacgggttctctcgacgggtcgtgtcgagacttgctgaattccagcattactagcacaacaagcaccctggtgcctggcatgttagaagaggaagaagacgaggatgaagaagaagaagaagactacacgcacgaacctatttccgtagaggtgcaacttaattcccggatcgaatcctgggtttcggagacccaacgtacgatggagaccctgcaactggggaaaactctgaacggcagcgaagaggataacgttgagcagagcggcgaggaggaggcggaagctcctgaagttctggagccagggatggactccgaagcttggactgctgatcagcaagcttcacctggtcagcagaagtcttctaattgttcttcactcaacaaagaacatagtgattcaaattacacaacccaaacaacttag

SEQ ID NO: 33322 - DNA, 288 bp, Artificial Sequence
  Description of Artificial Sequence: Synthetic coding sequence
atgaaggggtcgcgagccctgctcctggtggccttaacactcttctgcatttgccgtatggccaccggtgaggataatgacgagttttttatggattttctgcagactctactcgttggcactcccgaggaactatacgagggcacactgggtaaatataacgttaatgaggatgcaaaggctgccatgactgagctgaagtcttgtagggacgggttgcagcccatgcataaggccgagttggtgaagttgctggttcaagtgctcggatcacaagatggcgcgtag

SEQ ID NO: 33323 - DNA, 543 bp, Artificial Sequence
  Description of Artificial Sequence: Synthetic coding sequence
atggccagcgagcgccccgaaccggaagttgaggaggcaggtcaggtgttcctgctaatgaagaaagattacaggatcagccggaatgtccggctcgcctggtttctgtctcatctccaccagacagtccaggcaaccccccaggaaatgctgctgcagagcgagcaagagctggaggtgcttagcgtgctaccacccgggtggcagcccgatgagcccgtggtgcctcgaccctttctgctcgtaccctcaaccagggtgacctttctggcatggcagtaccggtttgtcatcgagctggacctttcaccctctacgggcatcgtggacgattccacaggagagattttattcgatgaggtgtttcacgctctgtcgcgatgtctagggggtctactcaggcccttccgggtaccagggtcttgtattgacttccagccagagatttatgtgacaattcaggcctactcctccattatcggtctgcagtcccaccagagacagggatttacaatgcttgcgaggctccctagtaatttttag

SEQ ID NO: 33324 - DNA, 507 bp, Artificial Sequence
  Description of Artificial Sequence: Synthetic coding sequence
atggcatcggaacggccagaacctgaggtggaagaagcagggcaagtttttctcctgatgaagaaggactatcgcatttctagaaatgtgaggctggcttggttcctcagccacctacaccagactgtccaggcaacgccccaggagatgctgctgcagagcgagcaagaactggaagtgctgtctgttcttcctccagggtggcagcctgatgaaccagtcgttcctcgccctttcctgctggtgccgtctacacgggtcacattcctggcttggcagtaccgatttgtcattgagctcgatctatcgcccagcaccgggattgtggatgacagcactggagagattttgtttgatgaggtatttcatgccctgtcccggtgtttggggggattgctgcgcccttttcgcgtccctggtagctgcattgacttccagccggaaatctacgtcacgatccaggcttatagctcgatcataggcctccagagtcaccaaatgatttag

SEQ ID NO: 33325 - DNA, 7602 bp, Artificial Sequence
  Description of Artificial Sequence: Synthetic coding sequence
atggtactagagctacccatacagaacgagccgcccgggcaggccgcagccgaggagaagcacacctgcgtcgtgcaatatatactctttcccccccacagcacttcaactaaggactcctttagcacagacgacgataatgacgtagaggtcgaagccctggagggagattctgaactcaatttggtgaccgaggtttgggtcgagccccaatacggccgagtgggcccaggcccaggaatttggaaacaccttcaggatctaacttattcggaaataccccaggccttgcaccctcgggacgcagcttgtatcggttcgatgctgtcctttgaatacctaatacagctgtgccagtccaaggagtggggaccactgcctccggaaccacgggttagtgatggactggaccagggcggtgacacttgtgtgcatgagatcccatttcattttgacctgatggggttgttgccacagtgccaacagctgcaaatgtttttcctcctgctggcacgcggtgccgagggacctttacttggcgtgcacggcatcccaaaagagcaggccgtgggatcaacccaggccaccggcgactctgcttttactagcctgtctgttggactgcccgaaacccttaaacccctaatatctgcgcagcctccccagtggcggtgctatgctaggctggtgaacccacagcatgtctttctcacatttctgcccgcaacttttagcgatgtccagcgcttggctgcttgtggactggagggacccccccaggaggagacaaagcccaagtttggcgattggtctggcgccccaagcctcaaggatctgggcggcaccggcatcaaggcaacaaaaagtcacgtgcctgttctctcagtgactctggcctctgataacgctcaaaatcaaggtgaactgtctcccccctttagacgcgatttgcaagcatatgcgggccggcaggccagtcagactgagagtgccgacggcccccgtaccagatgtcccgtttacatttacagctgtagcctggaggctctgcgggaacaaatggtcggcatgcagcctccacaggctccaagagacttaatctttaggacacagttcctggatcatcctagcccgtccagtgcctggatggagcctcggtataaggaagctgccaatcactgtgccttacttcaggaacatgcacaaagatgttacgttcgaggcctatttaggagccttcagcaggctcagtcagtgacatcccaagatctcctcacagccgttgacgcgtgcgaggagcttctgcaagagatagacatcactccctttttactcgctctctgcggtcatacatggggtctgccacacgcaccaccatcacccggccccctgtcccccggacctttcagcagttcaatggaggaaggggccgagcctagggagcgggcaattcttgctagtgagagctccatagaaacagaagacctgtccgagccggaattccagagcaccagggttccgggaatcccagatcctggtcctgaaataagtttgaccgacgtgtgccagctaagaggagaggcacacggggctctgcattcagtgatccaggagaagtttttagagataagtaggttacactttaggacagtcccatcaaacccgcattactttttctattgccccccctcatctcggagagaggatgagggtcctcgcgataccgttgataggaagatcagcgacctggagttcagcgaggccgagttgatgggagaggaaggggacacttccgcctgttgtgtcgtgactgagagtgatcccgaacttgaagtggaataccgggagagccgtgagagcgatctcggccccgcaggattagatagcgcttcactgagcgatgtggatactgtgaatccagatgaggactctttcagtatcctggggggggacagcccgaccgggcccgaaagcttcctccacgatttgcctcccctgttcctgcatctcacatgttccgtcagactgcgcgggcagcatagctcagttccggtatgctcacttccgacttgtttggggcaagtcctcagttctctcgagggaccccctgtcgggggacgggttccccttcgagacctatcggtcacactcgatgtattcatgctcacactgcccctagaagtcgaactcccaaccgcttctgacccacagcaccatcggtcaacttctgaaagctccgcttcttttccacgttcgcccggtcagccttcctctctgagaagtgacgatgggctagggccacctctcccgccaccagaggaggagaggcatcccggcttgtccaacctcgcaaccccccacaggctggccatcgaaaccaccatgaatgagatcaggtggttgctggaggacgaaatggtgggagccctccgccggggaggaattccccagtcacctgccctacatcgggccgctgcgcatatacattccagtcccgggcgatctacttgcttgcggcaaacattaccactctctttcgtcttcggccctgagcgcagtttaacacagttcaaagaggagttccgccgcctgcacctgcctgggcatgtgttattagaggacccagattccgggttcttctttgtggctgcaggccagcagcccggcggttctcatggcgaaccaagcagcgctgcctgggcttggcattcccacgaggaccgagcggagggcattgaaggtgagaccctgaccgcctcccctcaggcccccggctcacccgaggattcagagggagtgccgttgatctccctcccccgggtgccacaaggaggtagccaacccgggccgagccggggtctgtcattgatgtctagtcagggaagcgtggacagcgaccatctgggttatgacggcggcagctcaggaagcgattccgaaggaccgaatgataccctgggagaaaaagctccattcacgcttagaacacctcccgggcccgcccccccgcagccgtccctaagtggtctgccaggaccctgtctacctgacttttggctcatcgtgagggtcctgcaggatagggttgaagtgtatgcgcacgcccgtagtttgattagggaagacggcggtcctgggaccgaatgtcggcacctgcagcaactcctggttcgtagggtgggggagatttgccgcgaggtcaatcagcgcttacttcttcaggatctgcacgattcgcatgtgtgcaattccttattggtagctgaatccgaggaggatctgtggcggtccgagacgccattccatagtcggcaaagagctcctctgcctagcgatgactatgccgccgacgagtcatgcgcaccacggggctatctcgcggcgaccatgcagtttgtgccgggtcacttttcctgcgacgtggtgtggggcactgttataagagtgcatagccgattgaagatggggcccagtatgggggtgtctcgcgcaatacaagccctgcggtcagtgcttaacgccttttccgtggtgaatcggaagaacatgtttgtgtatcaagaaagagctacaaaggccgtttactacctgaggcttctcgagaccagctgctctgatcggccctggaagggggatgcgctgcctccttcgctagccctgtcacggagtcaagagcctatctatagcgaagaggcctccggacctcgctctcctttagatatggtgtccagccgatctagcgacgcagcccgccccgttggccaggttgataggcatatccagcttctcgtgcatggcgtgggtcaggcgggtcccgaaatcaccgatgagctggtgagagtgctgtgccggaggctcgacgaggccacactagacgtgatcacagtaatgctcgtccggaattgtaaattaacgcctgccgatgtggagtttatccagcctccgggctccttaccgtccgaggtcctccacctggcactgccgacctcctgtagaccatggctgccagccctcgcttggtacctgaggcagaatcttctcattttcctgcacagcccaaagtacactgatagcaatagtagaaaccatttccaacaccccctgccaccccaaggggggctcccggatctcgacatttatctctataacaagccaggtggacagggaacaggcggcaaaggggttgcatgtatcaccctggcttttgtcgatgaaggtggcgcaccactgtcgctggctctctggcctccgtcatccccaggaccaccagaccctctccgggaagaagagttcgagcaactcacgcaggttattcgctgtcctgtggtggttgactcaagttctgcacagaacggggctccacggctgcggttagatgtctgggagaagggaaacattagcattgtgcagctggaggagaaactaaggggtgccgcacggcaggccttggccgatgctattatcgagctgcagcttctgcctgcgtctctttgtaccgaggacacaccaaccggctcactgagaaacggctcacttgagacaaaatcttccgcggggcgggcgtctacattcccccccgctcccgttccaggtgagccagtaactccccccagcaaggcagggcggaggagtttctgggacatgctctctaaaacggagtgtggcgaccttggttcccctaagacaactgatgacattgtcctcgaccggcccgaagacacccggggcaggagaagacataagaccgaatctgttaggacccccggcggagctgagcgagcccccgggtcagactcgggggcccagcgccagaagaggcggactacccagcttgaggagggggaagtggggactctccatcccgttttcgcccgtgtagcgcagagatggatggagtttatggtacagatcgggtgtgcaagcgtttcacgttcgtcagcgcacatggtgagcaggtttcttttgccaagcattctgtcagaatttaccgctctggtaaccagtatggcaggggatacctctgtcaggatcttcgaacagcatctgggctcagagccggaaattttcggcccctgcagtcctgggcagctgggaccgtcgccccgcccagccgctgagcgccatctgttacttcttgggagaaactttcttcaatggcgcaggcctacccagcaggcagcaaaggccatgcaacgcttcgaacctggaggagacggcagttccggcaggaatgcccccagacaaaggcttctcttgctggaggttgtcgacaagaaactccagcttctgacatacaactgggcacccgacctgggggccgctctggggcgcgctctagtcagacttgtgcaatggcagaatgccagagctcatctgattttttgcctgctaagccagaaactcggactattccatcactacggacagctcgatttcccagtgagagacgagaaagagcctaacccatttttgctacctaccatggaggtagaaacattgattcgatcggctagtccacccttgtcaagagaacaaggtcgccttagtggctcctcacgcggcggcggacccctgccattagataccttccccttcgatgaagcgctgcgcgacattaccgcagccaggcctagctctgtactggggccggttcctcggccccccgatccagtgacttaccacggacagcagttcctcgagatcaagatggctgagcgccgggagttggagcggcagatgaagatggagaacctcttcgtaacttggcagcagaggtccacccccgccactatgcctatcagcgctggggagcttgagaccctgaagcaaagcagccgcttggtccactattgtgccaccgcaatgctgttcgatcccgcagcctggctgcatgggccccctgagacatccggccctcccgacggccagaggagacatcgcccagaaagcgggtctggcagtagggaagcgccaacatcctgtgaatctctggatgttagtcctccaggcgcgagagaagaaccatggctaaaagagctctccctggctttccttcagcagtacgtgcagtacctccagagtatcggattcgtcctcgtcccgctccgcccccctagcccggcccggagcacctcgcgtcctcgtgcgatggcaattctgggtaccgaagggagggggagctttagctgccccaagacaaagactgacggatccccgaaatctactagtagcccggtgacaacatatcatctgcagagggccctgcctggaggcattatccttatggaacttgcctttcaggggtgttacttttgtgtaaagcagtttgctcttgagtgtagccggattccaatgggccaggccgttaactctcagctaagtatgttgtttacagaggagtgcgataaggttcgcgatctcatgcacgtgcacagttttagctatgattttcacctacggctagtgcatcagcatgtgcttggtgcccatttggtgctgcgccatggctaccaccttactacctttttgaggcattttctggctcatcacccagacggaccccatttcggccgaaaccatatttaccaggggacactggagttgccgactcccctgatcgctgcacatcaactgtataattatgtggcagaccatgccagctcataccacatgaagcctcttcggatggcacggcccgggggcccagagcacaatgaatacgcacttgtgtctgcatggcactcaagtgggagctatcttgatagtgaagggctacggcaccaagacgacttcgatgtgtccttgctggtatgccattgcgccgctccctttgaagaacaaggcgaagccgaacgccacgtacttagactccagttcttcgttgtgcttacttcacagagagagctgttcccccggctgacagccgatatgcggagattcaggaaacctccaaggctccccccagagcccgaggcaccaggctctagcgccggaagccccggcgaggcttctggcctcatcctggcgccaggcccggcccctctctttccaccccttgcagcagaggtggggatggccagagcccgcctcgcgcagctcgtacgcttggctggcggccattgtcgtcgcgacacgttatggaaacgactcttcctgctcgaaccacccggtcccgacagactcagactgggcggacggcttgcccttgccgaattggaagagttgctggaagctgtgcatgccaagagcatcggcgatattgacccccaactggattgttttttgtccatgacagtgagctggtaccagtcactcatcaaggtgttgctgtctcgcttcccacaatcatgcaggcatttccaaagccctgatctgggaacgcagtacctagtggttttgaatcagaagtttactgactgctttgtgctcgtgtttctggattctcaccttggcaagacatccctcactgtggtctttcgcgagcctttcccggtacagccgcaagattctgagtcccctcccgctcagctggtttccacctatcatcacctggagtctgtcatcaacactgcctgcttcacgctgtggacccgattgttatag

SEQ ID NO: 33326 - DNA, 537 bp, Artificial Sequence
  Description of Artificial Sequence: Synthetic coding sequence
atggccagtgagcgacctgaacctgaggtggaagaagctggccaggtgttcctgctcatgaagaaggattaccgcatctctaggaatgtgaggttggcttggttcctgtcccacctccaccagaccgtacaagctaccccacaggagatgctgtccgagcaggagcttgaagtactttcggttctgcctccaggatggcagcctgacgagccggttgtacctaggcctttcctgctggtaccttctactcgtgtgactttcttggcatggcagtacaggtttgtgatcgagctcgatctgtcccccagtactgggatcgttgatgacagcacaggggagatcttgttcgatgaggtatttcacgccctctcccggtgcctgggtggtctgctgcggcctttccgcgttcctggtagctgtatcgattttcaacccgagatatacgtgacaatacaggcatattcttcaattatcggccttcagtcacatcagcgacaaggattcaccatgctggcgcgcctcccttcgaatttctag

SEQ ID NO: 33327 - DNA, 10128 bp, Artificial Sequence
  Description of Artificial Sequence: Synthetic coding sequence
atggccagcgagagaccagagcctgaagttgaggaggccggtcaagtgttccttctgatgaaaaaagactatcggatcagtcgaaacgtgcggctggcttggttcctttcacatcttcaccagacagtccaggccacccctcaggagatgctgctccaatccgagcaggaactggaagttctgtccgttttgccgccgggatggcagcctgacgagccagtcgtgccgcgacctttcctccttgtgccctcgaccagggtcacctttttggcctggcaataccgattcgtgatcgagctggatctgagtccttctaccgggatcgtagatgacagcaccggagagatcttgttcgatgaggtgttccacgccctctcacgttgtttgggcggactgctaaggccgtttagagtgcctggcagttgcatcgacttccagcccgaaatttacgtgacaattcaggcgtattccagtattattggactacaaagtcaccaggtattagtgcagggttgtctattagatcccagtcagagagaggtgtttctccagcagatttatgagcaactgtgcctgttcgaggacaaagtggccacaatgttacagcagcagtatgatccccaatcacaggctgaggaccagtcccccgacagtggagacttgcttgggcggaaggtgggcgtgtcgatggtcacagccgatctcggattggtgtctatgattagacagggaattctggcgcttcaattgctgccaagtaactcatcagccgggattatcgtgatcaccgatggggtcactagcgtacctgacgtggcagtctgtgagactctgttgaaccagcttcgatccggtacagttgcatgtagttttgtgcaggtgggaggcgtgtatagttacgactgcagtttcgggcacgtcccaaacgtcgaactgatgaagtttatagcaatggctactttcggctcctatttgtcaacctgcccagagcctgaaccaggcaacctggggctgacggtctaccacagggcctttcttctgtactcctttctcagatccggggaggccttgaatccagaatactactgcggatctcagcaccgtctgttcaatgaacacctggttagtgcctcaagtaatccggcccttgccctgcgacggaagaaacatactgaaaaagaggtccccgccgacctggtgtcgactgttagcgtcaggctccgcgagggatattccgtgcgcgaggtcaccctcgcaaaaggcggtagccagctggaggtcaaactggtgctgctgtggaagcataacatgagaatcgaatatgtggccatggccccttggccattggaacccgaaggtccgcgtgttacgcgggtggaggtgacgatggaaggaggctacgacattctccacgacgtgagttgcgcactgagacaaccaattcgctctctgtatcgtactcacgtcattagaaggttctggaatacactgcagtcaataaaccaaacagaccagatgctggcccacctgcagtcctttagcagtgtgccagaacattttacacttcccgattccaccaaaagcggcgtccctcttttctacattccacctggatccacaactcccgtcttatcactccagccaagcgggagcgatagtagccacgctcagtttgcggcatattggaaacccgtgctcagcatggatgccaattcctggcaaagatggctccatatgcatcgtctcgttttaatcctggaacacgacacccctatcccaaaacacctgcacactccgggaagtaacggaagatatagcaccattcagtgccgtatttctcatagttctctgacctctcttcttcgcgactggagctcctttgtgctggtggaaggctacagctatgttaagctgctgagctcagcacccgaccagccccctaatagcttttacatggtgagaatcatatctaaggctccttgcatggtgcttaggttaggattccctattggcacccctgcaccagcgcgccacaagatcgtcagcggtttgagggaagagatccttcggttaagatttccccaccgggtgcaatctaaggagcctaccccgaaggtgaagcgtaaggggctgggtggtgccggaggtggatcatctcccagcaaatccccccccgtgttagggccccagcaggctctgtccgatcggccctgtctggtcgtcctgcacaagccattagacaagctgctgattcgatacgagaagttacctctcgactaccgcgcaccttttcttctcactctggagccacctggccccctgccgctagtcagcgggcgctctgcctcttccagcctggctagcctgtcacgctacctgtatcatcagcgctggctctggtcagtgccatccggactagccccagccctgcctctctctgctatcgcacagctgctaagtattctcacggaggtgaggctgagcgaggggttccactttgcctgttccggcgaaggcattattaacatggtgctcgaactccccattcagaacgagcctccgggccaagcggccgccgaagagaagcatacctgtgttgttcaatacatcctctttcctccacattcaaccagcacgaaggactcgtttagcactgatgacgataatgacgtcgaagttgaagccctggaaggcgattccgaactgaatttggttacagaagtgtgggtggagcctcagtacgggcgcgtcggccccggcccaggcatttggaaacatctacaggacctgacttactctgaaatacctcaggctctccatccaagagacgcggcatgtatcggcagtatgttatccttcgagtatctcatccaactgtgccagagcaaggaatgggggcctcttccgcctgagccccgcgtgtccgacggtctggatcagggcggtgatacttgcgtgcatgagataccatttcacttcgacctgatgggtttacttcctcagtgtcagcagctacagatgttctttctcctcctcgcacgtggagcagaggggcccctcctcggggttcacggcattcccaaggagcaggccgtcggatcgacacaggccactggtgattcagctttcaccagcttatccgttggcttgcctgagactctaaaaccacttatttcagcacaaccccctcagtggaggtgctatgctcggctcgtgaacccacagcatgtcttcctgacctttttgcccgctactttttccgatgtgcaaagactggctgcttgtggcctggaggggcccccccaggaggagacaaagccaaagttcggggactggtcgggtgcgccctcacttaaggatcttggcggtacaggtatcaaggcaacaaagtcccatgtgccagtgttgtctgtcacattggcttctgacaacgctcagaaccaaggtgaactctctccaccatttcgtagggacctgcaggcgtatgctgggaggcaggccagccagacagagtcagcggatggcccccggacaagatgcccagtgtatatctattcttgcagcctagaagccttgagagaacagatggtgggtatgcaacctccacaggccccccgagatctgattttcaggactcagtttctggatcatcctagccctagctccgcttggatggagccccgctataaagaagccgcaaaccattgcgccctattgcaggaacatgcacagagatgctatgtgcgcggtctgttcaggagcttacagcaggcacagagtgtgacgagccaggacctattgacagctgtggatgcatgtgaggaactactgcaggagatagatattacgcccttcctactcgctctctgcgggcatacttggggcctaccacacgcccctccttccccaggtccgctgtcacccggacctttcagtagcagcatggaggagggagctgagcctcgagaaagggcaatcctggccagcgagtcttccatcgagaccgaagacctgtctgagccagaatttcagagcactagagtgcccgggattcctgacccaggacccgagatcagcctcacagatgtgtgccagctcaggggtgaggctcacggcgcattgcattcagtgatacaggagaaatttcttgaaatctctcgcttgcattttcgcaccgtgccttctaatccccactactttttttattgcccaccttcctcgcggcgtgaggatgagggccctcgcgataccgtggataggaagattagcgacctagagttcagcgaggcagagctgatgggggaggaaggagatacgtccgcatgttgtgtcgtcaccgagagcgaccctgagctggaggtggaatatcgggaatctagggaaagcgacctcgggcctgctgggctggacagtgctagtctctccgacgtggacactgttaatccagacgaagacagcttttccatactgggcggcgattcgccaacaggccccgaaagttttctccatgatcttcccccactgtttctgcacctgacatgctctgtccgcctgagaggacagcactcttcagtgcccgtttgcagcctgcctacctgccttggccaggtcctgtcctcacttgagggtccacccgtcggcggacgtgttcccttacgggatctctccgtgaccttagacgttttcatgttgacactgccactcgaggttgaactgccgaccgccagcgacccccagcaccacaggagcacttccgagtctagtgcaagcttccctaggtcaccggggcaaccctcttccctgcggagcgacgacgggcttggacccccgctgccgccaccagaagaggagaggcaccccggtctctcaaatcttgccactccgcaccgcctggcaattgagacaacaatgaatgagatacgctggctcctcgaggatgagatggtgggagccctgcgacggggagggattccccagtccccagcgctacacagagccgcagctcacatccactctagtccaggcaggtccacctgtcttcgccagactcttcctctcagtttcgtgtttggcccggagaggtctcttacacagttcaaagaagaatttcgacgcctccacctgccaggccacgtcctgctggaggatcccgatagtggattcttttttgtagcagctggacagcagcctggcggtagccatggtgagccctcctcagcagcctgggcctggcattcccacgaggaccgagctgagggcattgagggcgagacactcaccgcgtcaccgcaagcgccagggtcccccgaggattcagagggggtgcccctaatttccctcccgagggtgcctcaagggggatctcaacccgggccgagccggggcctcagcctcatgagctcacaaggatccgtggactccgaccatctggggtacgatggtggatctagtggttccgattctgaaggccccaatgatacgctcggggaaaaggccccattcaccctgagaactccaccaggacctgcaccaccgcaaccttcactctcaggattgcctggaccttgcctgccggacttctggctgatcgtccgtgtcctccaagatagagtcgaggtttatgcacatgcacgaagtttgataagggaagatggcggccctggcacagaatgccggcatctgcagcagctgctggtgagaagagtcggcgaaatctgtcgggaagtaaatcaacggctgttactgcaggacctgcacgacagccacgtgtgcaacagcctgcttgtggccgagagcgaagaggatttatggagaagtgaaaccccgtttcacagccgccagcgggcacccctcccatccgatgattacgccgctgacgagtcttgcgctccgagaggatacctcgccgcaactatgcaatttgtgccgggacactttagctgtgacgtggtttggggcactgtgatccgtgtgcactcccgactaaaaatgggcccctctatgggggtgtcaagggccatccaagccctgaggagcgtgctcaatgcattttccgtggtgaaccgcaaaaacatgttcgtttatcaagaacgggctacgaaagcagtgtattacctccgattactggagacatcctgtagcgaccgcccatggaaaggtgatgccctaccacctagtctggccctttcccggagccaggagcccatatattcagaggaggccagcggacctagatctcccctcgatatggtttctagcagatcttccgatgccgcccgcccggtgggccaggttgacaggcatatccaactgttagtacatggtgtcggtcaggctggccctgagatcacagatgagctcgtgagggttctttgccggagactggatgaggccacactggatgtgattacagtaatgctagtgcgtaactgcaaactgactccggctgacgtcgagttcattcagcctccaggatccctaccaagcgaagtgctgcatctggccctccccacaagctgcaggccctggcttccagcactggcctggtacctccggcagaaccttttgatattcttgcacagccccaaatacactgattcgaacagcagaaatcactttcagcatccgctgcctccgcagggcggcttgcctgacttggacatctatctttataacaagcctggaggacagggcactggcggcaagggcgtggcatgcattactctggcttttgtcgacgaagggggtgcccctctgagtcttgctctgtggcctccctcttctcctggtccccccgaccctcttagagaggaggagtttgaacagttaacccaggtaattcgctgtcccgttgtggttgacagcagctccgcccagaacggcgccccacggctacggctggatgtctgggagaagggaaacatctctatagtacagctcgaagagaaactgagaggcgctgcccgacaggctcttgcggacgccataatcgaacttcagcttttgcccgcctcgctctgcacagaagatacacccactggctccttaaggaacggctctcttgagacaaagagttcagcgggccgggccagtacctttccacctgctcccgtgcctggcgaacccgttacccccccctccaaagcagggagaaggtctttctgggatatgctgagcaagacagagtgcggtgaccttggcagtcctaagaccacagatgatattgtgctggaccgtccagaggatacccggggcagacgccggcataagaccgaatccgtgaggacaccaggcggagctgaacgggcgccaggcagcgattctggtgcccagcggcagaagagacgcaccacacagctggaggagggcgaggtgggcacccttcacccagtgttcgcaagggtggctcagagatggatggaattcatggtccagatcgggtgcgctagcgtgtcccgatctagtgcgcacatggtttcccgatttctccttccttcgattctctctgaattcactgcgttggtgacctcaatggctggggatacatcagtgcggatcttcgagcagcatctcggcagcgagcccgaaattttcgggccttgctcacctggccagctcggcccctccccccgaccagcggctgaaaggcacttactgctgttaggaagaaacttcctgcagtggagaagacccacccaacaggcggcgaaagccatgcagcgctttgaacccggaggagacggatcatccggccggaacgctcctcggcagagactgcttctgttagaggtagtcgacaagaaactgcaattactcacctacaattgggctccagatctcggcgccgccttaggtcgagcactggtgcggcttgtgcagtggcaaaatgctagggctcacctgatcttctgtctcttgtctcaaaaacttgggctcttccaccactatggccagcttgatttccctgtccgtgacgagaaagaaccgaatccctttctgttacccacgatggaagtggaaaccctcatccggtccgcatcgccccccttatctcgagaacagggaagactaagcggttctagtcgaggaggcggacccctgccgctggacacttttccatttgatgaagccttgcgcgatataaccgccgccaggccttccagcgtcttaggcccagtgccgcgtcccccagatccagtgacttaccatgggcagcaatttctggagattaaaatggccgaacgccgagagctggagcgacagatgaagatggaaaaccttttcgttacgtggcaacagcgctcaaccccagccacgatgccaatctccgcgggcgagcttgaaactctgaagcaatctagtaggttggtgcattactgcgccacggcgatgctgtttgaccccgctgcgtggctgcatggccctccagaaacttccggaccccccgatggccagaggcgccacaggccagaatcaggctctggctcgagggaagcgccgactagttgtgagtctttggatgttagcccccccggggctagagaggaaccatggctcaaggagttaagcctcgcgtttttgcagcagtatgtgcaatatctccagtcaatcggatttgtgctggtaccacttcggcccccttcacctgcccgatccacaagtagaccgagagccatggccattttgggaactgaagggcggggctccttttcttgtccaaagaccaaaacagacgggagtcctaagagcacgtcatcacccgtcactacctaccaccttcaacgggccctgccgggcggcatcatcctgatggaactggccttccagggctgttatttctgtgttaagcagtttgcgctggagtgcagcaggatcccgatggggcaggctgtgaattctcagttgagcatgctgttcaccgaggaatgcgataaagtccgcgacctcatgcatgtacatagcttttcctatgatttccatttacgcttagtgcaccagcatgtgctgggtgcacacttggtactccggcatggctaccatctgacaacattcctgaggcactttctggctcatcacccagatggccctcatttcgggcgtaatcatatctatcagggcactctggagctccccacaccacttatcgcggcccatcagctctataactacgtggctgatcatgcatcctcttaccatatgaaaccacttcgcatggcgaggccgggtggacctgagcacaacgagtatgccctcgtgtccgcctggcactcgtcgggcagttacctggacagcgaagggttgagacatcaggacgatttcgacgttagccttctggtgtgccattgtgcagctccattcgaggaacagggggaggccgagagacatgttctccgcctgcagttttttgtggtgctcacatctcagcgagaactattcccgcgcctcacagccgacatgagacggttcagaaaaccacccagattacctccagaaccagaggccccagggtcttcagccggttcccccggagaagctagtggcctgatattggctcccggtcctgctccgctgtttcctccacttgctgcagaagttggaatggcacgcgccaggctcgcccagctggtgaggcttgccggaggtcactgccgcagagatacactctggaagagacttttccttctggagccgccggggcccgaccgcctgcggttgggtggccgcctggccctcgccgaactggaagaactactagaggctgtacatgccaaatccattggggatatagatcctcaactggattgcttcctttctatgactgtctcctggtatcagtcattgattaaagtactgctctcaaggttccctcaaagctgcaggcacttccagagccccgacttagggacgcagtacctggtcgtccttaatcagaagtttaccgattgctttgttctcgtcttcttagatagtcacctgggaaagacctctttgaccgtcgtgttcagggaaccttttccagtgcaaccccaggactcagagagtcctcctgcccagctcgttagcacctaccatcacctggagagcgtcattaataccgcctgcttcaccctttggacacggcttctgtag

SEQ ID NO: 33328 - DNA, 696 bp, Artificial Sequence
  Description of Artificial Sequence: Synthetic coding sequence
atggccggtatggtcgactttcaggacgaggaacaggtgaagagtttcctggaaaacatggaggttgaatgtaactatcattgttatcatgagaaggatccagatggttgttatagactggtcgactacctcgaaggaatccggaagaatttcgacgaggccgctaaagtcttgaagttcaactgcgaagagaatcagcacagcgacagttgttacaagctcggggcctactatgtcacagggaaaggcgggctaacccaggatctgaaggctgcggcaaggtgtttcttgatggcctgcgagaagccagggaagaagagtattgccgcctgccataatgtcggactcctggcacatgatggacaggtaaacgaagacggccagcccgacctaggcaaagcacgcgattattacacaagagcttgcgatgggggctatacctcttcgtgttttaacctgtctgcaatgttcctccaaggggcccctgggttccccaaagacatggacttggcttgcaaatacagcatgaaggcctgcgatctgggccacatctgggcttgtgctaacgcttcaaggatgtataaattgggcgatggggtagataaggacgaggcaaaggccgaggtcctgaaaaatagagcccagcagttgcacaaggagcagcagaagggagtccagccattgacatttggctag

SEQ ID NO: 33329 - DNA, 285 bp, Artificial Sequence
  Description of Artificial Sequence: Synthetic coding sequence
  Description of Combined DNA/RNA Molecule: Synthetic coding sequence
atggtttacatatccaacggccaggtactcgactctcgttctcagagcccttggcgcctctccctgattaccgactttttttggggcattgctgagttcgtagtgctcttctttaagaccctgctgcagcaagatgtcaagaaacgcaggtcttacggaaactcttctgattcccgctacgatgatggacgcggtcctcctggtaatccaccccggagaatggggcgaatcaatcatctgcgggggccaagcccccccccaatggccggcggcugaggccggtag

SEQ ID NO: 33330 - DNA, 276 bp, Artificial Sequence
  Description of Artificial Sequence: Synthetic coding sequence
atggtctatatctctaacggtcaggtcttggacagcagatcccaatcgccatggcgtctctctctgatcaccgattttttttggggcattgccgaatttgtggtgctctttttcaaaacactactgcagcaagatgttaagaaacgccggtcctacggaaatagcagcgactccaggtacgatgatggcagggggccaccaggaaatcctcctcgtcggatgggtcgaatcaaccatctcaggggcccatcaccaccgcctatggctggaggatag

SEQ ID NO: 33331 - DNA, 438 bp, Artificial Sequence
  Description of Artificial Sequence: Synthetic coding sequence
  Description of Combined DNA/RNA Molecule: Synthetic coding sequence
atgtcactgctgcttcctcctctcgccttgctgttgttactggccgcattggtcgctcctgcgaccgccgccacagcctatcgccccgattggaataggttgtctggtctgacccgggctcgcgtggaaacatgtggaggaugacagttaaacagattgaaagaggttaaggcttttgtcacacaggatatccccttttatcataacctggtgatgaagcaccttcccggcgccgaccctgagcttgtcctccttggccggcgctacgaggaattggagaggataccactgtccgaaatgactcgcgaggaaataaatgctctagtgcaagaactgggattttacaggaaggccgcccctgatgcacaggtgcccccggagtacgtttgggctccagcaaagcctcccgaagagacttctgaccacgccgacctatag

SEQ ID NO: 33332 - DNA, 438 bp, Artificial Sequence
  Description of Artificial Sequence: Synthetic coding sequence
  Description of Combined DNA/RNA Molecule: Synthetic coding sequence
atgagcctgcttctcccaccactggctctacttctgcttctcgccgcgctcgtagctccagcaactgctgccactgcctacaggccagactggaacagactcagtgggttaacaagagcgcgggtagagacgtgcggcggcugacagctcaacagactgaaagaagtaaaggctttcgtgacacaggatattccgttttaccataacctggtcatgaagcacctccccggagctgatccagagctggtgttgctcggccgcagatacgaggagcttgagagaattcccctgtcagaaatgactagagaggagataaacgcactagtccaggaactagggttctatcggaaagcggccccagatgcacaggtgcctcctgagtacgtgtgggcccccgcaaaaccacccgaagagacctctgaccacgccgacctctag

SEQ ID NO: 33333 - DNA, 2010 bp, Artificial Sequence
  Description of Artificial Sequence: Synthetic coding sequence
  Description of Combined DNA/RNA Molecule: Synthetic coding sequence
atggcagtgtaccgcgccgccctcggcgccagcctagccgccgcccgcctcctaccactgggtcgatgctcaccttcgccagcgcctcgaagtactctgagcggtgcagctatggaaccagctccgcggtggcttgcaggcttgagattcgacaacagggctttgcgagctttgcctgtggaagctccgccacccggcccagagggtgccccgtccgccccacggcccgtgccaggcgcctgtttcacgcgcgtgcagcctacgcctctaaggcagccgcgacttgtggcactctccgagcctgcactggcccttcttggcctgggggctccacctgctcgcgaagcagaagcggaggcagctctgttcttcagcggcaacgcgctgctgccaggagccgagccagccgcccattgttattgcggccaccagttcggccaatttgcgggccagcttggagacggagccgctatgtacttaggggaagtgtgtacagccacaggagagcgctgggaactgcagctgaagggcgcaggacccaccccattttcaagacaagccgacggacgtaaggtattgcgctccagcattcgcgagtttctatgctctgaagccatgtttcatctgggtgttcctacaactagggctggtgcctgtgtaacttctgagagtacagtggtgagggatgtgttctacgacggcaatcccaagtatgagcaatgcaccgtcgttcttcgtgtcgccagcaccttcatccggttcggctccttcgagatctttaagtcagctgatgagcacacaggacgcgccggccccagcgtggggaggaacgacataagagtacagctgctggattatgttataagttcattttatccagaaatccaggcagcgcacgcctccgattccgtgcagagaaacgctgctttctttagggaggtgacacgccgaacagcccgcatggttgcagagtggcaatgtgtgggcttttgtcacggtgtgcttaatactgataacatgtccatacttggtctgaccatcgattatggccctttcggcttcctggaccgctatgatcctgatcacgtctgcaatgccagcgacaataccggcagatatgcttatagtaaacagccggaggtgtgcagatggaacctacgaaagctggcggaagctctgcaaccagagctccccctggagctgggggaagccattctggctgaggagtttgatgctgaatttcagcgacactacctgcagaagatgagacgtaagttaggccttgttcaagtggagctggaggaagacggtgcgcttgtttccaagctgctcgagacaatgcatttgaccggagctgatttcactaataccttctacctgctgtcctccttcccagtagagctggagagcccaggtctggctgaattcctggctcgactgatggaacaatgtgcttccctggaggagttacgtctggcatttcggccccaaatggaccctcgtcaactgtccatgatgttgatgcttgcccagagtaatcctcaattgtttgcactgatgggcactcgtgctggaatagcacgagaacttgagagggtggaacagcaatccagactcgagcagctgtccgctgcagaacttcaaagccggaatcagggccattgggcggattggcttcaggcctaccgcgctcgactagataaggatctggaaggggccggggacgcagcagcctggcaagccgagcatgtccgggtgatgcatgccaataatccaaaatatgttctccggaattacatagctcagaacgctattgaagccgctgagagaggggacttttccgaagtgagacgggtcctaaagctcttggagacaccctaccattgtgaagccggggccgccactgacgccgaagccacagaagctgacggcgccgacggtcggcagagatcatatagctcaaaacctccattgtgggccgccgaactgtgcgtgacaugatcctcatag

SEQ ID NO: 33334 - DNA, 588 bp, Artificial Sequence
  Description of Artificial Sequence: Synthetic coding sequence
  Description of Combined DNA/RNA Molecule: Synthetic coding sequence
atgcgactgcttctattgcttctcgtggccgccagtgcaatggttcgcagcgaagcctcagccaatctgggaggcgtgcccagcaagagactaaagatgcagtacgcgaccgggcccctgttgaaatttcagatttgtgtcagcugagggtatagacgggtgtttgaggaatatatgcgcgtgatctcccagaggtacccggacattcgtatcgagggggaaaactatctgccacaacctatctaccggcatatcgcaagtttcctgtctgttttcaagctggtgcttatcggactcattatcgtgggcaaggatccttttgcattctttggaatgcaggctccttccatctggcagtggggacaagagaataaggtctacgcgtgcatgatggtctttttcctctcgaatatgatcgaaaatcagtgcatgtcgacaggtgctttcgagatcacgcttaacgacgtgccagtttggtctaaactggaatctggtcacctgccatctatgcaacagctggtacagatcctggataatgaaatgaaactgaacgtgcacatggatagtattccacaccatagaagctag

SEQ ID NO: 33335 - DNA, 1041 bp, Artificial Sequence
  Description of Artificial Sequence: Synthetic coding sequence
  Description of Combined DNA/RNA Molecule: Synthetic coding sequence
atgaacaatcaggcacgaacacccgctccatcgtccgctagaacttccacatccgttcgagcgtctacgcccaccaggactcctactccccttagaacaccaaccccagtaaggacgagaacccctatccgcactctgacccctgttttgacaccatccccagccggaacttccccactggtgctgacccccgcccccgcgcaaattccaacgctggtccctactcctgcattagctcgcattcccaggctggttccccccccggctcctgcttggattcctacacccgtgcccacccccgtgcctgtgaggaatcctacacctgtacctacccccgcaagaactctgaccccgcccgtgcgggtaccagcccccgctccagcacaactgctcgctggtattagagctgccctgccggtgctggattcctaccttgccccggctctgccactcgatccacccccagagccagctcccgaactgcccctcttgccagaggaggatcccgaaccagcacctagccttaaactcattccgagcgtctcatccgaggccgggcccgccccaggccccctgcctacccgcaccccgctggctgccaacagccccggtcccacccttgacttcaccttcagggctgacccatcggccatcggcctggctgatcctccaatcccatcacccgtcccttcccccatccttggcacgatccccagcgcaatttcactccagaactgtactgaaacattcccatctagtagtgagaacttcgctctcgataagcgggtgctgatcagagtgacctactgcggcttgugatcttactccctgagatacatcctactgaaaaaaagcttggagcagcagtttcctaaccatctgctttttgaggaggaccgcgcagctcaggccactggtgaattcgaagtctttgtaaatggcaggctggtccattctaaaaaaaggggcgatggatttgttaacgaaagcagactccaaaagattgttagtgttattgacgaggagataaaaaagcggtag

SEQ ID NO: 33336 - DNA, 1041 bp, Artificial Sequence
  Description of Artificial Sequence: Synthetic coding sequence
atgaataatcaggcccgcacgccggcacccagcagcgcacgtacctcgacaagtgtgcgagcctctaccccgactagaacccccacaccccttcggacccctacccccgttcgcaccagaacccccattcgcacattgactccagtgctgaccccttcccccgccggtacttcccccctcgttcttacaccagctcccgcccagattcccacactggtccccacacccgctctcgcgagaatccctcggctggtgcccccccccgcacccgcctggatcccaactcccgtacctacacccgtcccagtgcgcaacccaacacctgtgcctaccccggccagaacgctgacgcctcccgtgcgagtccccgctcctgcacctgcacagttgttagcaggcatccgcgctgcgcttcccgtcctggactcctatcttgcacccgcgctgccgctggacccaccccccgagccggcacctgaactccctctgctgccagaagaggaccccgaacctgctccctccttaaagttgatcccaagcgtttcgtccgaagcaggccctgccccaggcccactacccacacggacgccactcgcggctaactccccagggcctaccctcgactttaccttcagagctgatccatcagctatcggtctcgccgacccaccaatcccctcccccgtcccgtctcccatcctgggaacaattccctctgcaatttccctccaaaattgcaccgaaacttttcccagttctagtgagaacttcgctctcgacaaacgagtcttgattagggttacgtactgtttcatccatagttattcccttcggtatatcctgctgaagaagagtctggagcaacaattcccgaatcatctgctttttgaggaagacagagccgcgcaggcaacaggagaattcgaagtgttcgtaaacgggaggctggtgcattcgaagaagcggggcgatggttttgtaaacgaatctaggctgcagaagatcgtgtcagttatcgacgaggagatcaaaaaacgttag

SEQ ID NO: 33337 - DNA, 2250 bp, Artificial Sequence
  Description of Artificial Sequence: Synthetic coding sequence
atgggtagggccggggcagccgctgtaattccagggttggccctgctgtgggcagtagggcttggctctgcagccccatccccaccgcgtctgagacttagcttccaagagctgcaagcatggcacggattacagacattttccctggagcgcacgtgttgctaccaggctcttctggtggacgaggagaggggacgcttatttgtcggggccgagaaccacgtcgccagccttaacttagataatatctcaaaacgggccaaaaaactggcgtggccagcccccgtcgagtggcgggaagagtgcaattgggctggcaaggacattgggactgaatgcatgaacttcgtgaagctgcttcacgcctacaacagaacacacttgctcgcctgcggcaccggtgcttttcatcctacgtgcgctttcgtcgaagtaggacatagggcagaggagccagtccttcgactggacccaggccggatcgaggacggaaagggaaagtcaccctacgatcctcgccatagagcagcttcagtactggttggcgaggagctttacagcggtgtggcggcggacctgatgggacgcgattttaccattttcaggtctctgggacagcgccccagccttcggaccgaaccccatgattcccggtggttaaacgagcccaagttcgtgaaggttttctggatcccagaatccgaaaaccctgacgacgataagatttactttttttttagagaaaccgccgttgaggccgctcccgcattggggaggctgagtgtgtctcgtgttgggcaaatttgccgcaatgatgtgggcggacagaggagtctcgtcaacaagtggacgacatttctcaaggcacgactagtgtgttctgttccaggcgtcgaaggggatacccactttgatcagttgcaggatgtgtttctgctgtcctctcgggatcacaggacacccctgctgtacgccgtgttcagtacgtcatcttcgatcttccaaggtagcgcagtctgtgtttactccatgaatgatgtcagaagagctttcctaggaccttttgcccacaaggaaggccccatgcatcagtgggtttcttatcaggggagagtgccctacccccgcccggggatgtgtccctccaaaacatttggcaccttcagctccaccaaggatttcccagacgatgttatacagttcgctcggaaccacccgctaatgtataatagtgtgctgcccaccggcgggaggccgttattcctgcaggtcggggcaaactataccttcacacagattgctgcagatcgcgtggccgccgccgacggccactatgatgtgctttttatcggcactgatgtggggaccgtgctgaaggttattagcgtgcccaaaggatcacgcccctctgcagagggcctcttgctcgaggagctccacgtgttcgaggattctgcagccgttacttccatgcagatctcttcaaaaagacatcagctttacgtggcaagcagatcagccgtagcccagatcgcgctgcatagatgtgctgctcatggacgcgtctgcaccgaatgctgcctagcccgagatccctattgtgcatgggacggtgtggcatgcacacggttccaaccatcagcgaaacgcaggtttcggcgccaagacgttagaaacggtgatccaagtactctttgttccggggacagctcacggccagccttgttagagcacaaggtgttcggagtcgaagggtcttctgcgtttctggagtgtgagccccggagcctacaagcaagagtcgagtggaccttccagagagcaggagtgactgctcacacccaggtactggcggaggagaggacggagcgcacagcccgcgggctattactgcggaggctgcgccggcgagacagcggtgtctacctgtgtgcagctgtggaacaagggttcacgcagcctctcaggagactatccctccatgtcctgagtgccacccaagccgagaggctggcccgtgccgaagaagccgcccctgcagctccacccgggcccaaactatggtaccgcgattttcttcagttggtggagcccggcgggggcggaagtgccaacagccttcggatgtgccgtccgcagccagccctgcagtctctccccctcgagtcgcgtaggaaaggcaggaacaggagaacgcacgcgcccgaaccaagagcagagcgggggccccgatcagctactcactggtag

SEQ ID NO: 33338 - DNA, 444 bp, Artificial Sequence
  Description of Artificial Sequence: Synthetic coding sequence
atgggcgggtgtatgcactccacccaagataaatctctgcatctggaaggagatcccaatccttcagctgctccgacttccacatgtgctccgcgaaaaatgcccaagcggatatccatcagcaagcagctggccagtgttaaagctctgcgcaagtgcagtgatctagagaaagccattgcgacaactgcacttattttcagaaattccagtgattccgacggcaagctcgaaaaagctattgctaaggatctcctccagactcagttccgtaattttgcagaaggacaggagaccaagcctaaatatcgggagatccttagcgagttagatgagcacaccgaaaacaagctcgactttgaggactttatgatccttcttctgagtataacagtgatgtcagatctcctgcagaacatccgtaacgtgaagatcatgaaatag

SEQ ID NO: 33339 - DNA, 279 bp, Artificial Sequence
  Description of Artificial Sequence: Synthetic coding sequence
atggaacagtctaaagttctgatcaaagaaggcggagtacagctgctcttgaccatcgtggacacccccggttttggtgatgccgtggataatagtaactgctggcaaccagccataaactacatcgattccaaattcgaggattacctgaacgctgagtctcgcgtgaaccgctgccagatgcccgggaatcgggtgcagtgctgtttatactttatagcacctagcgggcacggctggcagacccgcaatatggactactgtgtggagttccactag

SEQ ID NO: 33340 - DNA, 279 bp, Artificial Sequence
  Description of Artificial Sequence: Synthetic coding sequence
atggagcagagcaaggtcttgattaaagagggaggagttcagctgctgctgacaatcgtggacacacctggctttggagatgctgtggataacagtaactgctggcaacctgccatcaattacattgatagcaaattcgaggattatctcaatgccgaaagcagagttaacagatgtcagatgccaggaaaccgcgtccaatgttgtctgtacttcattgctccatcaggccacggatggcagacacgaaacatggattactgcgtcgaattccactag

SEQ ID NO: 33341 - DNA, 1269 bp, Artificial Sequence
  Description of Artificial Sequence: Synthetic coding sequence
atggagccccctgcctctaaggtacccgaggtccctactgctcctgccaccgacgccgcacctaaacgggtggagattcagatgcccaaacccgcagaggcaccaactgcgccatcacccgcccaaacactggaaaatagcgagccagctccggtaagccaattgcagagccgcctcgaaccaaaacctcagcccccagtggccgaagcgactcctagaagccaggaggccactgaggctgcaccctcctgtgttggtgacatggccgacacaccaagggacgcagggctcaagcaagcacctgcttctcgtaatgaaaaagctcccgtggactttggctacgtgggcatcgatagcatattagagcaaatgaggaggaaggccatgaaacagggatttgaattcaacattatggtcgtgggtcagagtgggcttggcaagtcaacgctcattaataccctgttcaagtccaagattagcaggaaaagcgtgcaacctacttcagaggagcgaataccaaagactatcgagatcaaatcgatcacacatgacatcgaggagaaaggagtgcggatgaagctgactgtgatagacactcctggatttggcgaccacatcaacaacgagaactgttggcagcccataatgaagttcattaatgaccagtatgagaagtacctgcaggaagaggtcaatatcaacaggaaaaagcggattccagatacccgggtgcactgctgtttgtacttcatacccgcaacagggcatagcttgaggcctcttgatattgaattcatgaaacgattgtccaaagtggtaaacatcgtgcctgtaattgctaaagccgatacccttactcttgaagagcgggttcactttaagcagcggattacagctgacctgctgtcaaacggtattgatgtgtacccgcagaaggagttcgatgaagatagcgaggaccgtctggtgaatgagaagtttcgtgagatgatccctttcgcagtggtcggctcagaccatgaataccaggtcaacggaaagcggattctgggtcgaaagactaagtggggcactattgaggtcgagaacacaacacactgcgagttcgcatatctgcgggatctgcttatccggacgcacatgcagaacatcaaagacatcacatcctccattcactttgaagcttacagggtgaaacgactcaatgagggatcctccgccatggcaaacgggatggaggagaaagagcctgaagctccagaaatgtag

SEQ ID NO: 33342 - DNA, 1269 bp, Artificial Sequence
  Description of Artificial Sequence: Synthetic coding sequence
atggagcccccagcctcaaaggtgcccgaggtgcctacggcgcccgccacagatgccgcaccaaaaagggtggaaatacagatgcctaaacctgccgaggctccaacagccccatcacccgcacagacactcgaaaatagcgaaccagccccagtgtcccagttgcaatcaagactggaacctaagccacagccccccgtggccgaagctacgccccgctcccaggaagcaaccgaagcggctccctcatgtgtcggagacatggcagatacacctcgagacgccgggttgaagcaggcacccgcaagccgcaatgagaaggctcctgtggatttcgggtacgtggggattgatagtatcttggagcaaatgcgccgcaaagccatgaaacaggggttcgagtttaatattatggtggttggccagagcggtttgggtaaaagcactctcatcaacactcttttcaagtctaagatatcgagaaagtccgtccaacccacttcagaggagcgcattccaaaaaccattgaaatcaaatccattacccacgacattgaggagaagggagtgcggatgaaattgacagttatcgatactccagggtttggcgatcacatcaacaatgagaattgctggcagcccataatgaagttcataaacgaccaatacgagaagtacctccaggaagaggtgaacattaatcggaagaaaagaatccccgatactcgcgtccactgctgtttatatttcataccagccaccggacactcactcaggccccttgatatcgagttcatgaagcgcctttcgaaagtcgttaacatcgtgcctgtgattgctaaagcagacacactgactctagaggagagggtgcacttcaaacagcgcattacagcggacttgctaagtaatggcatcgatgtgtatccccaaaaggaattcgacgaggattccgaagaccggcttgtaaacgaaaaattcagagaaatgatccccttcgctgtcgttggctccgaccatgaatatcaggtcaatggaaagcgtatcctggggcgaaaaacgaagtggggcaccatcgaagtagagaacacaacacactgcgaattcgcctatcttcgggatctgctcatcaggacacatatgcaaaatattaaggacatcacctcttctattcacttcgaggcctaccgcgttaaacggcttaacgaaggctctagcgctatggcaaatggcatggaggagaaggagcccgaagcacccgaaatgtag

SEQ ID NO: 33343 - DNA, 1008 bp, Artificial Sequence
  Description of Artificial Sequence: Synthetic coding sequence
atggctgacacaccaagagacgccggcctcaagcaggccccggcgtcgcgaaacgagaaagccccagtggactttggatacgtaggcattgacagcatactggagcaaatgcggcgcaaggcaatgaagcagggcttcgagtttaatatcatggttgtggggcagagcggccttggcaaatctacccttatcaacaccctcttcaagtccaagatttcgaggaaatcagtccaacctacctcagaggaacgcatcccgaagaccattgagattaaaagtatcacccacgatatcgaagagaagggcgtacggatgaagctgactgtgatcgacacccccgggttcggagaccatattaacaacgagaattgttggcagccaattatgaaattcataaatgaccagtacgagaagtacctccaggaggaggtgaatatcaacaggaagaaacggattcccgacacgcgtgtgcattgctgcttgtattttatcccagccacaggtcactctcttcgccccctggatattgagttcatgaagaggctatctaaagtcgttaatatcgtgccagtgattgctaaggccgataccctgactctcgaagaaagagtccactttaagcagcgtatcacggcggacttactaagcaatggaattgacgtgtaccctcagaaagagttcgatgaggattctgaggaccgtctggttaatgaaaaattccgcgaaatgattcctttcgcggtcgtgggaagtgatcatgaatatcaagttaatggcaaaagaatcctgggtcgcaagactaaatggggcacaatagaagtagagaatacgactcactgtgagtttgcctatttacgcgatctgctgatacgaacccatatgcagaacattaaggacatcacgtcgtcaatccactttgaggcataccgtgtgaagcgcctgaacgagggttcctctgcaatggctaacgggatggaggaaaaggagcccgaggccccggagatgtag

SEQ ID NO: 33344 - DNA, 1707 bp, Artificial Sequence
  Description of Artificial Sequence: Synthetic coding sequence
atggaaagggacaggatatcagccctgaaaaggtcgtttgaggtggaggaagtcgaaacacctaattccacccccccacgccgcgtgcaaaccccactgttgagggcgaccgtggccagctcaacccagaaattccaagatctgggagttaagaattctgaacctagcgccaggcacgttgatagcctgtcgcagcgaagtcctaaggctagcttacgaagggtagaactgtcgggacccaaggcagcagagcccgtctctcgacgcacagaactgtctatcgatatcagctctaagcaggtggagaacgctggggccatcggccccagtcggtttgggcttaaaagagctgaagtcctggggcacaagacaccagagcctgcaccaaggaggacagagataacaattgtaaagccacaggaatccgcccatagaagaatggagccgcccgccagtaaggtgcctgaggtacctactgcccctgcgaccgacgcggcacctaaaagagttgaaattcagatgcccaagccagccgaggctccaactgcaccttcgccagcgcagactcttgagaattccgagcctgcacctgttagtcagctgcaaagcaggctggagcccaaaccccagccacctgtcgccgaagctacaccacggagccaggaggccacggaggcagcccccagttgcgttggcgatatggcagatacgccgagagatgcaggcctaaagcaggccccggcttcccgaaatgagaaagctccagttgactttggatacgtcggaatcgacagcattttagaacagatgcggcggaaggccatgaagcaggggttcgaattcaacataatggtagtcggacagtccgggctgggcaagtccactctgattaacacactgtttaaaagcaagatctcaaggaaaagtgtgcagcctacctccgaggagaggatccccaagaccatagagattaaaagcattacccatgatattgaagaaaaaggtgttaggatgaagttaacagttatagacacacctggcttcggcgatcacattaataacgaaaattgctggcagccaatcatgaaatttatcaatgaccagtatgagaaataccttcaggaggaggtgaacatcaataggaagaaacggatacctgacacccgggtccactgttgcttatattttattccagctactggccacagtctgcgcccgctagacatagagtttatgaagcgcctttcaaaggtggtgaatattgtgccggtgatagccaaagctgatacactgaccctggaggagagggtgcatttcaaacagagaatcaccgcggaccttctgtcaaacggcatagacgtctaccctcaaaaagagttcgatgaggactcagaggaccgcctggtgaatgaaaaattccgagagatgataccattcgccgtggtggggagtgatcacgagtaccaggtgaacgggaagcgaattctggggagaaaaactaaatggggtacaatcgaagtagagaatactactcactgtgagttcgcctacttgagggacctgctgataaggacccatatgcagaatatcaaggatattaccagttccatccactttgaggcttatagggtgaagcgactcaatgaaggttcatctgcaatggctaatgggatggaagagaaggaacccgaagctcctgagatgtag

SEQ ID NO: 33345 - DNA, 1368 bp, Artificial Sequence
  Description of Artificial Sequence: Synthetic coding sequence
atgggtgcatgtctcggagcatgttcactactgtcctgtgctagttgtctgtgcgggtccgccccatgcattctgtgttcctgttgtcctgcctccagaaattccacagtctcccgcctcattttcacgttctttcttttcctgggagtacttgtgagcattattatgctgagtcctggagtagagagccagctatataagctgccatgggtgtgtgaggaaggcgcaggcattcccactgttttgcaggggcacatagattgcggaagtctgctcggctatagagccgtgtatcgaatgtgcttcgcgacggcggctttcttcttctttttcacactgttgatgttgtgtgtgtccagctccagggatcccagggctgcaattcaaaatgggttttggttttttaaatttctgatcctcgttgggctgacagtgggggcgttttacatacccgacggctccttcaccaatatttggttctattttggggtggtcgggtcattcctctttatcctcatacagcttgtgttgctcatagactttgcccacagctggaatcagcggtggcttgggaaggccgaagaatgcgatagccgggcttggtacgctggacttttcttcttcacgctgctattctatctgctgtccatagcagctgtggccctgatgtttatgtactatacagagccatcagggtgccacgagggtaaagtgtttatttccctgaacctcacgttttgtgtgtgcgtgtccattgctgccgtacttcctaaggtacaggacgcgcagcctaatagcgggctcttgcaggcctccgttatcaccttatacaccatgttcgtgacttggtcagctcttagctccattccggaacaaaagtgcaatccacaccttccaacacaactggggaacgagacagtcgtggccggtcctgaagggtacgagacacagtggtgggacgcccctagcatcgtcggcctcatcatcttcctgctttgcactctgttcatctctctccgctcatcagaccaccggcaagtcaatagcctcatgcagactgaggaatgtccgcctatgctcgacgcaactcagcagcagcaacaggttgccgcctgtgagggtagagcgttcgacaatgaacaggacggcgtaacctattcatattcattcttccacttttgtcttgtcctagctagcttgcacgtaatgatgacactgacgaattggtataaacccggcgagacccggaagatgattagcacttggaccgctgtgtgggtaaagatctgcgccagctgggccggacttttactctacttgtggaccctcgttgcccccctgctcctgcgcaacagggactttagctag

SEQ ID NO: 33346 - DNA, 294 bp, Artificial Sequence
  Description of Artificial Sequence: Synthetic coding sequence
atgaagggcatctgctctgatgctatcctggtcctcgcgacctctatgtggatggcttttgctattgattttccccttcccatggcaagtgaacggggacaactggacaagacaatagtcgagtgtctgaagaatgtcaacaaatgttggttcctaagctacatcaagccgtctgaacccatttgcggctccgatcaagtcacatacagtagcgactgccatctttgctccaagattctcttcgaaggactcaatatcactaaactgtatgacggacagtgtgaaaacagttag

SEQ ID NO: 33347 - DNA, 1794 bp, Artificial Sequence
  Description of Artificial Sequence: Synthetic coding sequence
atgagcagtactgtgaacaacggagcagcctccatgcagtctacccctgatgcagccaatggcttcccacaacccagttcaagttccggtacatggccccgcgcggaagaagagctgagagctgccgagcctggacttgttaaaagggcacaccgggaaatcctggatcacgaacgaaaaaggcgtgtggagctgaagtgtatggagcttcaggagatgatggaggaacagggctactctgaagaagagattaggcagaaggtcggaaccttcaggcaaatgttgatggaaaaagagggagtcctgacgcgtgaggatcgtccaggtggccacattgtggccgaaaccccaagactcacggagggagctgaaccaggactggagtacgcccccttcgacgatgatgatggacccgtggactgtgactgcccagcctcatgttaccgtggacacagggggtaccggactaagcattggagctcatcatctgcaagtcccccaccaaaaaagaagaagaaaaagaagggcggccacaggagatcgagaaaaaagaggagactggagagcgagtgctcttgcggaagcagcagcccattacgtaagaaaaaaaagagcgttaaaaaacaccggcgcgataggtccgattccggtagccggaggaagagaaggcaccggtctcggtcttcaaagtgcaaacgcaaagaaaaaaataaggaaaagaagagaccccacaccgagtcccccgggcgacgctcacacaggcatagtagtggctcaagccattccccatccctgagtagccattactccgacagccggagtccctccaggttgagtccaaaacatcgggatgaggggagaaaaaccgggtcgcaacgtagcagtggtagtagaagcccctcccctagcggtgggagcggatggggttctccacagcgaaacggtggcagcgggcaacgatcgggggcacatggcggcaggcctgggagcgcccattccccccccgacaagccgtcttccccgtctcctcgagtgcgggataaggccgctgcagctgcacctaccccaccggcccggggcaaggagtctccctctccgcgctcggcccccagtagccaaggcaggggcgggcgtgccgcaggcggggcagggcggaggcggcgccgaagacgtagacggaggaggtcgcgcagctccgcgagtgcaccacgcagacgcggccgacgccgccctaggcctgcacccccccgcggaagcagccgttcactaagccgcgcgaggagcagctccgacagtggatctggaaggggggcgcccgggcccgggccagaacctgggtctgagcgcggtcatggaggacacggaaaaagggcaaaagaacggcctccccgcgcccggcctgcctcaacctccccgtccccaggagcccatgggcggaggggagggccagaaggaaagtccagttctcggtcgccgggtccacacccacggagctggtcaagcagcagatccccctccaaaagccgctcccggtctgctgaaaaacgccctcatagcccatccaggtcaccctctcccaaaaaacccttgtcaagagacaaagatggcgagggtcgggcaagacatagtgaggctgaagccactcgagctaggaggaggagccgcagttactcacctatccgcaagcgtcgcagagatagtcctagcttcatggaacctcgaaggataacatcagctgcatcagtcttgtttcatactactggcccagcacccttacctccccccgctgcttag

SEQ ID NO: 33348 - DNA, 1962 bp, Artificial Sequence
  Description of Artificial Sequence: Synthetic coding sequence
atgtcttctacagtaaataatggagcagcttctatgcagagtaccccggatgccgccaacggattcccacagccatctagcagctcaggaacgtggccgcgggctgaggaagagctgcgagcggccgagcctggactggtgaagcgcgcacaccgggaaatactcgaccatgagcgaaagcgccgcgtagaacttaagtgcatggagttacaagaaatgatggaagaacagggctacagcgaagaggagatccgccagaaggttggaaccttcagacaaatgctgatggaaaaagagggggtgttgacccgagaggacagaccaggagggcacattgtggccgagacccccagactcaccgagggagctgaacctggattagagtacgcaccttttgatgacgacgatggtccagtggattgcgattgtccagcgtcctgctatcgaggtcatcgtggataccgcacaaagcactggagcagcagctctgcctcacctccccctaagaaaaaaaagaaaaaaaagggaggacatagaagaagtcgcaagaaacgccgactggagagtgaatgctcatgcggctccagtagcccccttagaaagaagaagaagtcagtgaaaaagcatagacgagatcggagcgattcaggttcaagacggaagcgcaggcacaggtctcgatcttccaaatgcaagcgtaaggaaaaaaataaagaaaaaaagagacctcacaccgagagtcccgggcgaagaagccaccgtcatagctcagggagtagtcattccccaagcctgagctctcactatagcgacagtcgctccccctctcgactgagtccaaagcacagagatgaaggtcggaagactgggagtcagcgttcttccgggtcaagatccccatcaccttccggcgggtcaggctgggggagcccccaacggaatgggggatccggacagcggtccggagcacatgggggccggcccggtagcgcgcattcaccgcccgataagccaagcagcccgagcccaagagtacgtgacaaagccgccgcggcagcaccaactcctcccgctcgtggaaaggagagtcccagtccgcgtagcgccccgtcatcgcagggccgcggcggacgggccgccggaggcgcaggtcggcggcggcgaaggcggagacggcggcggcgcagcaggtcatctgcgtccgccccacgcaggagaggccgcaggaggccaaggccagcaccaccaaggggttcatctcgttcactctcaagggcaaggtcttcatctgacagcgggagcgggcgcggagctcctggaccaggccctgagccaggtagcgaacggggccatgggggtcatggcaagagggcgaaggaacgtcctccccgcgcccgccctgcctccacttctccaagcccgggggcccacgggcgccgcggtggacctgaagggaagagttccagtcgtagtccaggcccccacccccggtcttggtcgagctccaggagcccgtcaaagtctcgctccagatccgccgaaaaacgaccgcactctcccagtcgtagcccttccccaaaaaagccgctgtctagagacaaggatggtgaggggagagcacgccacagcgaggcagaagccacacgggccaggagacggtctagaagctatagtcccatccgtaagcgcaggcgggacagcccttcttttatggagcccaggcgaatcacaaggcgccggaaaaggcctatcccatactataggcccagcccctcatctagcagtagttgtctgagtagcgactactcaactcgtagccactctagatcaccgtctccaggacattcacacggatcttatagcagcaggtctcacggtacccggagcagaacacgctcccctagccgtacaccatccccatcataccactcaaggagctcctccgagagcggaggattttag

SEQ ID NO: 33349 - DNA, 1794 bp, Artificial Sequence
  Description of Artificial Sequence: Synthetic coding sequence
atgagctcaactgtcaacaacggcgcggccagtatgcagagcaccccagatgctgccaatggttttccccaaccatcatcctcctctggaacctggccccgggcggaggaagaattgcgggccgccgaaccagggttggtgaagagggcgcacagagagatcctcgaccacgagcgtaagcggcgagttgagttgaagtgcatggaattgcaggagatgatggaagagcaagggtactcagaagaggagatccgccagaaagtggggaccttccgccagatgcttatggaaaaagagggagtcctgactcgcgaagatcgccccggagggcacatcgtggctgagacgccccggctgactgagggagccgaacccggcctggagtacgcaccctttgacgacgacgacggcccagtcgactgtgattgtcctgccagctgctataggggccatcgcggctaccggacaaagcattggtcctcttcatcagcctctcctcccccaaagaagaagaagaaaaaaaagggtggccaccggcgcagcagaaaaaagaggcgcctcgaatccgaatgtagttgcggatcaagtagtcctctacgtaagaagaaaaagagtgtgaaaaaacaccggagggacagatcagatagcggctcccgccggaaaagacgacaccgcagtcgatccagtaaatgtaaaagaaaagaaaagaacaaggagaagaagaggccccatacggagagcccggggagaaggtctcaccggcattctagcggtagttcacactccccgtcactgtcctctcattactccgattcgcgctctccatcccgcctcagccccaaacatcgagatgaggggaggaaaacaggtagccagcgttcctcaggatccaggagcccaagtccctcaggaggttcaggatggggcagccctcagagaaatggcggatccggtcaacgcagcggagctcacgggggtcgccctggatccgcccactctcctccggataaaccttctagcccctcccctagagtgcgagacaaggctgccgcagccgccccgacacctcccgctcgagggaaagagtccccgagcccacgcagcgcaccttcgagtcagggtcgcggcggacgagccgccggaggcgctggccgtagaagacggcgtcgtcgcaggaggcggcggagcagatcttcagcatctgctccccgccggcggggccgcagacgaccccgccccgcgcctcctcggggctcctccagatctctatctagggcaaggtcgagctccgactccggaagtggccgaggggcgcccggaccgggtccggagcctggttcagaacggggccacggcgggcatggcaaaagagccaaggaacggccccccagggccagacccgcctctactagccccagccccggcgctcacggccgccgcggcgggccggaaggaaagtctagcagtaggtcacccggcccccatccacgctcttggtcttcctcaagatctcctagtaaatctagaagccggtccgccgagaaacggcctcactccccctcgcgatctccatctccaaaaaaaccacttagtcgagacaaagatggtgaaggacgagctagacactctgaagccgaagccacaagagctcgccgtcggtcccgaagctatagcccaatccgaaagagaagaagagacagcccctcatttatggaaccaagacgaattacctcagctgcttctgtgctcttccacacgacaggccctgctccactccctcccccagcagcttag

SEQ ID NO: 33350 - DNA, 1962 bp, Artificial Sequence
  Description of Artificial Sequence: Synthetic coding sequence
atgtcgagcaccgtgaacaatggcgctgctagtatgcaaagtaccccagacgcggctaacggattccctcagccgagcagctcaagtggcacctggccacgggctgaagaggagctccgagccgctgaaccaggcctagttaagcgcgcacaccgcgagatcctggaccacgagaggaagcggcgcgtcgaactgaagtgtatggaactgcaggagatgatggaggagcagggctactctgaagaagagatccgccagaaggttggcacctttcggcagatgttgatggaaaaagaaggcgtgctgactcgggaagatagaccaggtggccacatcgtcgcagaaactcctcgtctgaccgaaggggctgagcccggcctggagtatgcacctttcgacgacgatgacggaccagtcgattgcgattgtcctgctagctgttaccggggccataggggatatagaacaaagcattggagcagttcctcggcctcaccaccgcccaaaaagaaaaaaaagaaaaagggaggccacagaaggagccgaaagaagaggcggctagagtcagaatgttcttgtggaagctcttctcccctgagaaagaaaaaaaaaagtgtgaagaagcacaggagagatcgttctgactcagggagtcgtaggaaacggcgacacagaagtcggtcaagcaaatgtaaaaggaaggaaaaaaacaaggagaaaaagcgcccccatacggaaagcccgggacggcggagccataggcactcctcaggttcgagtcactcgccaagccttagttcccactattctgactcacgtagtccttctagactcagccccaagcatagagacgaaggacgcaagactgggtcacaaaggagttctggctcccgaagccccagccctagcggtggtagcggatggggtagcccccaaaggaacgggggctcaggacagcgaagtggggctcatggtggtaggcctggatctgcacactcacctcctgataaacccagctcgccctcgcccagggttagggacaaagcagcagccgccgcccccactcctcctgccagggggaaggagtcacccagcccaagaagtgcaccaagtagccagggccggggcggaagggctgccggcggcgccggacgtcgtcggagaaggaggcgtcgacggcgaaggagccggtcctccgcctcggccccaaggaggcgcgggcgacggcgcccaagaccagcaccccctagaggatcctccaggagtttgtcacgagcccgctcctcaagtgacagtggcagtggtcgcggggcaccaggcccaggtcctgagcccggtagcgaaagaggacatggtgggcacggaaagcgcgcaaaagaacgcccccccagagcaaggcccgcgagcacctcaccatctcccggcgcccacggtagacgtggtggccccgagggtaagtccagttcaaggtcccccggcccgcacccaagatcctggtcttcctctcgtagcccaagtaaaagtcgcagtagatctgccgagaagcgacctcactctccctctcgctcaccatccccaaagaaaccactgagtagggacaaagatggggaaggacgcgctcggcatagcgaggccgaggccacacgggctcgacgaaggtctcggtcgtactccccgattcggaagaggcgacgcgacagccctagttttatggaacctaggagaattacccgacgcagaaaaaggccgattccctattaccgcccatcgccctcttcctccagctcatgtctgtcaagcgattattcaacaaggtcccatagcagatctccgtcccccgggcactcccacgggtcttatagttccagatctcacggcactagaagccggacgcgctccccctctcgaactcccagcccgagctaccactctagatccagcagcgagtcaggaggtttttag

SEQ ID NO: 33351 - DNA, 2148 bp, Artificial Sequence
  Description of Artificial Sequence: Synthetic coding sequence
atgtcttcaccaaaaaggtcctccaagcctagcatgtcgctggccccctctggctctagcatgcccaccgctgatcccaagcctcctgctagccttaagtctacaaaatccgcaacccctaaccggtccttggtgccgacgaagccagctaccagccggaactctgtgatgtcaccctcgtccagcaagagcacgaagagcaccagcaccaagagagccccttcaaaccgcccctccagccggagccgcgtgcggagtaaagcccgaacccccagtagagtgagcacggacactaggacgagtaaagcttcaaaggcctctgatgtgcggtgccaccagagaagaggcacccactcaagaggacgcactcctggcaggaggggaagccgttcatccaaacgtagcccaagtcgggcgagcacacccggaaggattaggactcacggggctcgcccaggcatggcttcccgggtgcgcactccaacctctcaacagaaaggtagcagaggcaagtcctatgggagacctcgcacatccaatcgggagagaagcgacagtcagccacgtaacttgtcaaagaagagctatcggccacccgggggctcaggcatcggccggagttctgagctggccgtgaccccaagtacagcgaaatgccagacaccaacagggataccgagcaaggaaaaaagtgacaatcctagtccaagttcctctcggaaggtcaaatcttatggacagatgatcatcccaagcagagagaagtcctactcccccactgagatgtcttccagggtaaagtcctataaccaggcaagtactcggtcccggccgcagtctcattcacagagcagatctccccggcggtcccgttccggaagccagaagagaacccattccagggtgagaagtcacagctggaagcggaatcattcaagagcgagatcccgcacccgtaaggggatcctttctcagatggggcgacattctcaatctcggtctcactccaagggaaagtcccagaaccagtccaggacacctcgccgaggccggtcccacaactggtctaggaatccgtccaaggaaagatcacactcccattcacgtagcagcagtaaggagagagatcaccgtgggagctcctccccgcggaaggagtcaggccgtagccagtccggcagcccaaataaacagcgcgaccactcccgtagcaggtcaccaaacaaagcaagggataggtctaggtctcgatcaccttacaaagcacgcgacagaagcagatctagatctcccaacaaggcccgagactgcagtcggagtcgctcaccttacaaggcacgggataggtcacgttcgcgctccccgaataaagccagagaccactcaagaagtagatctcctaataaggctagggacaggtcgagaagccgcagccccagtaaagaaagggatcatagccagctcggttcacctagtaaggaacgggaccacagacgtagcaggtccccaagtaaagagaggcagtgccggcagagtcggagctctagcaaggaacgggatcacagacgttctaggtcaccctctaaagagaggcagcgccggcagtccagatctcctaataaagagcgggatagaagtcaatccaggtctccttcagaagaaagagaacacagacagtctcgcagcccgagcaaagagcgcgatcgccgcaggtggagatcaccgtctaaggaacgcgagagaaggcagagccggtcgtcctcagaggagagggatcacagccggtcccgatctccaaataaacagtcggggtactctcgtccaagagcttccagcaaggagaaagctcactctaggtcccggacaccatcaaaggaaggtaaccattcccagtcaagaactagttccaaggagtcagaccccagccagtccaccgtgcccagaagtcctgactggaaacgctctccaacaaggacttcctctctctctcaaaacaggactccgtccaaaacgtcctctcatagcccgtcaacctttccaagtggagggcagaccctgagccaggacgactctcaggccgatgcaaccacaagcaaggcgaccctgcctggggagcgctcttcctcgagctcaagcaagctggcatag

SEQ ID NO: 33352 - DNA, 2193 bp, Artificial Sequence
  Description of Artificial Sequence: Synthetic coding sequence
atgagcacagtaacttcccgcaccacatctccgtttgcgccgacaatgtcctccccaaaacggtcgtccaaaccctccatgtccctggccccatctggttcctctatgccaaccgcggatcctaaacctcccgcttcactcaagagtacaaagtccgctacacctaatcgctctctcgtccctactaaacccgctacctctcgcaatagcgttatgagcccaagcagctcaaaatcgaccaagagcacttccactaaaagagctccttctaatcgcccctcttccaggtcgcgcgtgcgcagcaaagctaggactccatccagggtgtctactgatacccgcacctcaaaggccagtaaggcttccgacgtgaggtgtcaccagcggagaggaacccacagcagggggcgtaccccggggcgccgcggctcgaggagctctaaacggtcccccagccgggcaagtacaccaggtcgaatccgaacccacggagctaggccgggcatggcttctagagtccgcactccaacatcccagcagaaaggttcccgcggaaagagctatgggaggcctcggacctcaaaccgagaacgcagcgactcccagccaaggaatctatctaagaaaagctatcggccaccagggggttcaggcatcggacgctcatccgaactggccgtcacgccctccaccgccaaatgtcaaacgccaactggcatcccatctaaggagaaaagtgacaatccaagcccctcatctagcaggaaggtaaagagctacggtcaaatgatcataccttccagggaaaagtcatattctcccacggagatgtcaagtcgtgttaagtcttataaccaagccagtaccagatcccgccctcagagtcactcccaatcacgctcaccgcgtcggtccagatcaggttctcagaaaaggacacactctagggttcgtagtcactcttggaagcgtaaccacagccgtgcccgatcaagaacacggaaaggaattttaagccagatgggccggcacagtcagtcgaggtcacactcaaaaggtaagtctcaaaatcagagtcgcacccccagacgtggaagatcccacaattggagcaggaatccgtccaaagaaaggtcccatagccacagccgctcatcttctaaagaacgcgatcacagagggtctagcagtccgcgcaaggagagcggacgcagtcagtctggtagtcccaacaagcagcgcgaccattctaggtccagatcgcctaacaaggcaagagaccgctctcgttctcggtcaccgtacaaggctagggaccgatccagaagccggtcccctaacaaggccagggactgctctagatcccggtcaccctacaaggctcgagacaggagccgtagccgctcacccaataaggcccgcgatcacagtcgaagtcgttcacctaacaaggctcgtgatcgctccagaagccgatctccttccaaggagagggatcatagtcagcttggatccccctctaaggaacgggatcataggcggtctcggtccccatcaaaagaacgacagtgcaggcaaagccgatcctctagcaaggagagagaccacaggaggtctcggagccccagtaaagagcgccagcggcggcagagcagaagccccaataaagagcgggaccggagccaatcacgcagtccgtcagaggaaagagagcatagacagagccggagcccgtctaaggaaagggacagacgccgctggcggtcgccatctaaagagcgcgaacggaggcaatccaggtcatcatctgaagagcgcgaccactcacggtctcgctctcctaacaagcagagcggatattcacggccccgggccagctctaaagaaaaagcacattccagaagccgtacgccgtccaaggaaggtaatcacagccaaagccggacatccagtaaagagtcagacccatcccagagcactgttccacgctctcctgattggaagcgcagtccaacccgtacctcttccctctcacagaacaggacaccttcaaaaaccagcagccactccccctcaacgttcccgtctggtggccagaccctgtcacaagatgattcacaagccgacgcaaccacctcaaaggcaactctgccgggcgagaggagctcctcctcatcctccaaacttgcctag

SEQ ID NO: 33353 - DNA, 1191 bp, Artificial Sequence
  Description of Artificial Sequence: Synthetic coding sequence
atgggtgctaatacaagcaggaagcccccagtgttcgatgaaaacgaagatgtgaattttgatcatttcgaaatcctacgggccattggaaagggaagctttggtaaggtgtgtatcgtgcagaaaaatgacaccaagaagatgtatgcaatgaagtacatgaataagcagaagtgtgttgagcgcaatgaagtgaggaatgttttcaaggagctgcaaattatgcaggggctcgagcaccccttcctggttaatctatggtacagttttcaggacgaggaggatatgtttatggttgtcgatcttcttctgggtggcgatcttaggtaccaccttcaacaaaatgtgcacttcaaggaagaaaccgtgaaactcttcatctgtgagcttgtcatggccctcgactatctacaaaaccaacgaattattcaccgggacatgaaaccagacaacatcctattggacgagcacggccatgtccatataaccgacttcaacatagccgcaatgctgccccgcgagacgcagattaccacgatggctggaacgaagccctatatggctcctgagatgttttcctctcggaaaggcgcagggtattctttcgccgtggattggtggagcttgggcgtgactgcctacgaacttttgcgagggagacggccctaccacatccggagctccacttcaagcaaggagatcgtccacacattcgaaaccacggtggtaacttacccatcagcctggagccaggagatggtgagtctgctgaagaagctgctcgagcccaatccagatcagcggtttagccagctctctgacgttcagaatttcccgtatatgaacgacattaattgggacgccgtgttccagaagcggctcattccaggtttcatacctaataaaggacgtcttaactgcgaccctacgttcgaattggaagagatgatcctggaatctaaacccctgcataagaaaaagaagaggctcgctaagaaagagaaggatatgcggaaatgcgattccagccagacatgtcttctgcaagaacacctcgactctgtacagaaggaattcattatatttaaccgagaaaaagtgaatcgagactttaacaagaggcagcctaatctggccttagaacagactaaagatccacagggagaagatggccagaacaacaacctgtag

SEQ ID NO: 33354 - DNA, 501 bp, Artificial Sequence
  Description of Artificial Sequence: Synthetic coding sequence
atgggagccaacacctctagaaaaccaccagtctttgacgagaacgaagacgttaactttgaccatttcgagattctgagagctatcgggaaaggatcttttgggaaagtgtgtatcgttcagaaaaatgacactaaaaaaatgtatgccatgaagtacatgaacaaacaaaaatgcgtggaacgaaacgaggtgaggaacgtctttaaggagctgcagataatgcagggtctggagcatcccttcttggtgaatctctggtattcctttcaagatgaggaggatatgtttatggtggttgatcttctcttaggtggcgacctgagatatcacctccaacagaacgtacattttaaggaggaaacggttaagttattcatttgcgagcttgtgatggccctggactatctgcagaaccagcgcatcatacaccgggacatgaagccagataacattctgctggatgaacatgtgcagcagtataccctaaagagtcattag

SEQ ID NO: 33355 - DNA, 501 bp, Artificial Sequence
  Description of Artificial Sequence: Synthetic coding sequence
atgggcgccaatacttctcggaagcccccagtgttcgacgaaaatgaagatgtgaattttgaccatttcgagatccttagagctatcggcaagggatcctttggtaaagtatgtatcgtacaaaaaaacgacacgaaaaaaatgtacgcgatgaagtatatgaataaacagaagtgcgtggagcgtaatgaggtccgaaatgtatttaaagaactccagatcatgcaaggtctcgaacaccctttcctggtcaatctatggtattccttccaggacgaggaggacatgtttatggtagtggatttgctgcttggcggggaccttcggtaccatctgcagcagaatgtgcactttaaggaggagaccgtgaagctgtttatttgtgaactagtaatggccttagactatctccaaaatcagaggattatacatagagatatgaagcccgataatatcttgctggacgaacacgacacttggctgtcctacaaaagtcactag

SEQ ID NO: 33356 - DNA, 1245 bp, Artificial Sequence
  Description of Artificial Sequence: Synthetic coding sequence
atggggggtaaccatagtcataagccacctgtctttgatgagaacgaggaagtaaacttcgaccactttcaaatcttacgggctatcgggaaaggcagttttggcaaagtgtgcatagtacagaagcgggacacaaaaaaaatgtatgcaatgaaatacatgaataagcagaaatgtattgaaagggacgaagttaggaacgtttttagggaactgcagatcatgcagggcttggaacacccattcctggtaaacctctggtacagtttccaagacgaagaggacatgttcatggttgttgacctgttgctgggcggcgatctcaggtatcacctacaacagaacgtacatttcactgagggcactgttaaactttatatctgcgaactggccctggctctcgagtaccttcagaggtaccacattatacaccgggacatcaagccggacaatatcctgctcgacgaacacgggcacgtgcatatcactgactttaatatcgctaccgtagtgaagggtgccgaaagggcttccagtatggccgggactaagccatacatggccccggaagtgtttcaggtgtacatggaccggggaccggggtactcctacccggtggattggtggagcttggggataaccgcctatgagctgttgagggggtggagaccttatgagatccatagcgtaacacccatcgatgagatcctaaacatgtttaaggtcgagagggtgcattactccagtacctggtgcaaaggcatggtagctttgctcagaaagctgttgaccaaagaccccgaatctcgcgtctcttcacttcacgatatacagagcgtgccctacctcgcggatatgaattgggatgccgtgttcaaaaaggccctcatgcctgggttcgtgcctaataaaggtaggctcaactgcgatccaacgttcgaactggaggaaatgatcctagagagcaagccactgcacaaaaagaagaagcgcctggctaagaacaggtctagagatggaactaaggactcttgccccctgaatggccatcttcaacattgcctagagacagtacgagaggagttcattatattcaatcgcgagaagctgagaagacagcagggccagggcagtcagctcctggacactgatagcaggggaggtggccaggcccagtccaaactgcaggacggctgcaacaacaacttattgactcacacttgtaccagagggtgctcaagttag

SEQ ID NO: 33357 - DNA, 1104 bp, Artificial Sequence
  Description of Artificial Sequence: Synthetic coding sequence
atgtacgccatgaagtacatgaacaaacagaaatgcatagaaagggacgaggtacgaaacgtgttcagggagctgcagatcatgcaaggcctggaacacccttttttggttaacctgtggtactccttccaggatgaagaagacatgttcatggttgtggacttgcttctgggaggagacctgaggtatcatcttcagcagaatgtgcacttcaccgagggaaccgtgaagctgtatatttgtgaactggcgctcgcactagagtacctccagaggtaccatattatacaccgagacattaagcccgacaacatcctgttagatgagcacggacatgtccatatcaccgacttcaatattgcaactgtggtgaaaggtgctgagcgcgcctcttccatggccggtactaagccttacatggctccagaagtcttccaggtgtatatggaccgcgggccagggtattcctatcccgttgactggtggtcattgggaatcaccgcttatgagcttctgagagggtggcgtccctatgagatacatagcgttacaccgattgatgagattcttaatatgttcaaagtggagagagtacactattccagcacctggtgtaagggcatggtggctctgttacggaaattgctcactaaagatccagaaagccgggtgagttccctacacgacatccaatctgttccttatcttgctgacatgaattgggacgctgttttcaaaaaagctctgatgcccggcttcgtgcccaacaagggtcgcctgaattgtgaccccacattcgagttggaagagatgattctggagtccaaacctctgcataagaaaaagaagagactggcaaagaatagatcacgcgatggcacaaaggactcgtgtccgttgaacggacacctgcaacattgcctggagaccgtcagggaggaattcatcattttcaaccgggaaaagctgaggcgacagcagggccagggatctcaactgctcgacacagattccagaggcgggggccaagcgcagagcaagctgcaggacggttgcaacaataacctgctgacccacacctgcactagaggctgctcttcctag

SEQ ID NO: 33358 - DNA, 1461 bp, Artificial Sequence
  Description of Artificial Sequence: Synthetic coding sequence
atgcgtagcggcgctgagcggcgtggcagctcagcagctgcgtctcctgggagccccccgcccggacgggcaaggcccgccggctctgacgctcccagcgccctgccgccccctgccgcaggtcaaccacgggcccgcgattcgggagacgtgaggagtcagccacgaccactgttccagtggtcaaaatggaagaagagaatgggcagcagtatgagcgctgcaaccgcaagaagacccgtttttgatgataaagaagacgtgaactttgatcactttcagatcctcagggcgattggcaaaggcagcttcggcaaggtttgtattgtgcagaagcgcgatacagaaaagatgtatgccatgaagtatatgaacaaacagcaatgtatcgaaagggacgaggttagaaatgtgtttcgggagctggaaattctgcaggagatcgagcacgtgtttcttgttaatctctggtactcatttcaggatgaagaagatatgtttatggttgtggacctgctgctgggcggcgatctgcggtaccacctgcaacagaacgtgcagttcagcgaggatacggtcagattgtacatatgtgagatggctctggccctggattatcttagggggcagcacattattcaccgggacgtgaagccggataacattctccttgatgaacgagggcacgcgcaccttacagactttaatatagctactattataaaagatggcgaacgggctactgcccttgccgggactaagccatatatggcccctgaaatttttcattcttttgtgaatggcggaacgggatactccttcgaagtagactggtggtctgtgggcgtcatggcatacgaactcctgcgagggtggcggccttacgatatccactccagcaacgccgtggagtccctggtgcagttgttctccactgtgtccgttcagtacgtaccaacctggtcaaaggagatggttgcactactgaggaagctgctcacagtcaatcccgagcatcggctgagctctctgcaggacgtacaagctgcaccggcactcgctggcgtgctctgggaccacctgagcgagaaacgggttgagcctgggttcgtgccaaacaagggccgcctgcactgcgatccaacatttgagctggaggagatgattctcgaaagccggcccctgcataagaaaaagaagcggttggcaaaaaataaaagcagggataactcccgtgatagcagccagtccgagaacgactacctacaggactgcctggatgctattcaacaggattttgtcatatttaatagggagaaattgaagaggtcgcaagatttaccaagggaacccctgccagccccagagtctagggacgctgcagaacctgtcgaggacgaggctgagagaagcgcactgcctatgtgtggacccatctgccccagtgcgggcagtggctag

SEQ ID NO: 33359 - DNA, 537 bp, Artificial Sequence
  Description of Artificial Sequence: Synthetic coding sequence
tgaggtcttgagggggtggtggtagatggacaggtggagacagctagagtgtggagaggggaccgcccagggacagaggggaaggaggagtccggaatgctaagtgccgtgtggggagctggtggccccggagcggggggcgccgctagaggacaacctagcaggaaagaactgctgctcaggcatcacctttggtctggccccaggtgcctgtcttttcccctgggttctttgccagctagtttgctaggattacccggagcaaccagccacaggagttgcctgtctcctaacctagcctcaggcctggccgctcgggggactcagacccaaagcgtcctgttcggagaggtgcgcctgcccttagatggcggagtcagaggcgccaggaagcgttcccttctgcgagcacaccccagaacaggcatcttgccaggccgctgcggcatggtgtggaaagacaagaagttacagcctagtggatgtcacgagaaggcaggaggggtgttttgcggtccatcacgagggggagtctag

SEQ ID NO: 33360 - DNA, 834 bp, Artificial Sequence
  Description of Artificial Sequence: Synthetic coding sequence
ccattctttcgagccagaggcttagaaggtgtggttgtggatggccaagtggaaacagccagggtctggcgtggtgaccgacctggcacagagggtaaagaggagtccggcatgctgtcggccgtgtggggagccggaggacccggtgcaggcggagcagctcggggtcaacctagccgaaaagaactcctgctacgccaccatctgtggtcaggtcctcgttgtctcagcttcccattggggtccctccccgcctccctgcttggcctgccaggtgctacaagccataggagctgcttgagcccaaacctggcctccggcctggcggcccgcgggacacaaacacagtctgtccttttcggcgaggtgcgcctgcccctggatggcggggtgagaggcgcacggaaacggatgaatttcgatcacttccagattctccgcgctatcggcaaaggtagcttcggtaaggtttctccccgggtcccgagaagaccacaggcgtcttgccgaactgctctttgccctccgggcgtgcattgtgcggaagccggccacggcgaagatgtgaggcacgaggtgcatgaacaggccgcagttcaccgagcgcgccgcggtccacagcgtctgcccggcgcaggcgatccggccggtgatcgagccaggttacccggtgaacctctggttctgctcccgggcagaggcggacatgtccacggacgcggacccgcaacgggacgaggccccgccctcccgccagcggcggaaagggctgtattaagaggtcacggggaggccgtgcatctgcgtgacggaaccgggagcggactgccatag

SEQ ID NO: 33361 - DNA, 1110 bp, Artificial Sequence
  Description of Artificial Sequence: Synthetic coding sequence
atgtacgctatgaagtatatgaataagcagcagtgtattgaaagggatgaagtgaggaatgtatttcgggaattggagatattgcaagaaatagagcatgtgtttcttgtaaacctatggtattctttccaggatgaggaagatatgtttatggttgtagatctgctgttggggggagatctgcgctaccatctgcagcaaaatgtgcagttttccgaggatacagtgcgcctgtatatctgtgaaatggccctggcccttgattacttgagaggtcagcacatcatccatagggatgttaaaccggataatattctcttagacgaacgagggcacgctcaccttactgattttaatatagctaccataatcaaagacggcgagcgggccactgctctggcagggacaaagccatatatggctcccgagatctttcactccttcgtcaacggagggacaggctactctttcgaagtggactggtggagcgtcggcgtgatggcctacgagctcctgcggggatggcgtccctacgacatccattcatctaatgcggtcgagagtcttgtgcaactcttctctaccgtgtccgtgcaatacgtcccaacttggtcaaaggagatggtggcgctacttcgaaagctgctgacggtgaacccagagcaccgcctctctagtctgcaggacgtgcaagcagctcctgcgttggcaggcgtgttgtgggatcacctatccgagaaacgcgtggaacccggattcgtgcctaacaagggaagactacattgcgaccccacatttgagctcgaggagatgattctggagagccggccgctgcacaaaaaaaaaaaaagactggcaaagaacaagagtagagataattcacgtgactccagtcaatctgagaatgattacctccaggattgccttgacgcgattcagcaagattttgtgatttttaatcgagagaagctcaaaaggtcccaggacttgccccgcgaacctctgccggccccggagtcgcgagacgccgctgaaccagtggaagatgaagctgaaaggtctgcacttcctatgtgtggtcccatctgtccaagcgccgggtctggctag

SEQ ID NO: 33362 - DNA, 1500 bp, Artificial Sequence
  Description of Artificial Sequence: Synthetic coding sequence
atgctgagcgccgtgtggggggccggtggtcctggggctggcggggcagcccgcggacagcccagtagaaaggagctgttactgcgacaccacctttggagcggaccaaggtgcctttcgttccctctcggaagcctcccggccagtttgctgggtctgcccggtgctacaagtcataggtcctgccttagtcccaacctggcaagtggtctggcagcccgggggacacagactcagtctgtgctgtttggcgaagtacgacttcctctggatggaggggttcgaggcgcaagaaagagaatgaactttgatcacttccagattctgcgagccatcggcaagggcagttttgggaaagtttgtatcgttcagaaaagagatactgagaagatgtatgctatgaaatacatgaacaagcaacagtgcattgagcgcgacgaagttaggaatgtgttccgggagctcgaaattcttcaggaaatcgaacacgtgttcctggtaaatctgtggtacagctttcaggacgaagaagacatgttcatggttgtggacctgctgctcggcggggatttgcgttatcacctccagcagaacgtgcagttttccgaagataccgtcagattatacatatgcgaaatggcattggctcttgattaccttcgaggacaacatatcattcatagagatgtcaaacccgataatattctgcttgatgaacgcggacacgctcatttaacagattttaacattgccacgatcatcaaagacggcgagcgcgctaccgccttggctggaactaagccctatatggcccccgaaatcttccactctttcgtaaacgggggtaccggatactcctttgaagtagactggtggtccgtgggcgtgatggcttacgagctccttcggggctggagaccatatgatatccattcttctaacgccgtggaaagtctggtgcaactcttctccaccgtgagcgtgcagtatgtgcctacctggtccaaagagatggtcgccctcctgcgaaaacttctgactgtgaacccagaacacaggctatcctccttgcaggatgtccaggcagcccctgcccttgctggtgttctttgggaccacctgtcggaaaaacgtgtagagccgggcttcgtgccaaataagggtcgtttacactgtgatcctactttcgagttggaagaaatgatcctggaaagccgacccctgcataagaaaaagaaacggctggctaagaacaagagccgcgacaatagcagagacagttctcagtcagagaacgactacttgcaggactgtctcgatgcgattcagcaggacttcgtcatttttaatcgggagaaactaaaacgtagccaggatctgccacgtgagccgcttcccgcccccgaaagtagagatgcagcagagccagtggaggatgaggctgagcgttcagccctacccatgtgcggaccgatttgcccatcagcggggagcggctag

SEQ ID NO: 33363 - DNA, 411 bp, Artificial Sequence
  Description of Artificial Sequence: Synthetic coding sequence
taggcccgagggctcgaaggggtggtggtagacggtcaggtcgagaccgccagggtttggcggggggatcgcccagggacggaaggtaaagaagagagcggcatgctgagcgctgtttggggcgctgggggccccggcgccgggggcgccgctaggggccagccctcccggaaggaattgctgttacgacatcatttgtggtccgggcctcgatgcctctcttttcctctgggcagcttgcctgcatcactgcttggcctgcctggcgccactagccatagatcttgtctctctccgaacttagcttctggactggctgcccggggcacccaaacacagtccgtgttgtttggagaagtccggctacccctagatggcggggtccggggggcccgaaagaggagatcatag

SEQ ID NO: 33364 - DNA, 942 bp, Artificial Sequence
  Description of Artificial Sequence: Synthetic coding sequence
atgcccggcctgttgttatgcgagcccacggagctttacaacatcctgaatcaagccactaaattgtctcggctcaccgacccgaactacctctgtctcctggacgtgcggtccaagtgggagtatgatgagagtcatgtgattaccgctctgcgggtcaagaagaaaaacaatgagtacctactccccgaatcagtcgacttagaatgcgtgaagtactgtgttgtatacgataacaattccagtacattagagatcctcctgaaggatgatgacgacgactctgattccgatggcgatggaaaggacctggttccccaggccgctattgagtatggtcgtatcttgacacgcctgactcaccacccggtctacatcctgaaaggcggttatgaacgcttcagcggcacttatcattttcttagaacccaaaaaatcatctggatgccgcaggagcttgacgctttccaaccttacccaatcgaaatagtgccggggaaagtcttcgttgggaatttcagccaagcctgcgaccctaagatccaaaaagatctgaagatcaaagcacacgtgaacgtgagcatggatacaggaccgttctttgcgggagatgctgataagttactgcacatccgcattgaagactctcccgaagcccagattctacccttcctgaggcatatgtgtcatttcatcgagattcaccaccatctgggctcagttattttgatattctcaactcaaggcatctcgcgtagctgcgcagctattatcgcataccttatgcattccaacgaacagaccttgcaacggagttgggcttatgttaaaaagtgtaagaataatatgtgtcccaacagggggttggtctctcagctgctggagtgggaaaagactatattgggtgacagcattacgaacatcatggatccattatactag

SEQ ID NO: 33365 - DNA, 654 bp, Artificial Sequence
  Description of Artificial Sequence: Synthetic coding sequence
atgcctggactgctcttgtgtgaacccacagagctgtataatattctgaatcaggctaccaaactgagcaggctgaccgaccccaactacctgtgcctgctggatgtgcgtagcaaatgggagtatgatgaaagtcatgtcattacagcactgcgggtgaagaaggagctggacgccttccagccttacccaattgaaatcgtgccggggaaggtctttgtcggcaatttttctcaggcctgcgatcccaagatacagaaggacctcaaaataaaagcccacgtgaatgtgagtatggacacagggccgttttttgctggcgacgccgacaaattgttgcacatcaggatcgaggatagtcctgaggcccagatactccctttcctgagacatatgtgtcattttatcgagatccatcaccaccttggttctgttatcctcattttcagcactcaggggattagccgaagctgcgcggcgattatcgcttacctgatgcactccaacgagcagacattacagcgctcttgggcctatgttaagaagtgcaaaaataatatgtgccctaacagggggctagtttcccagctgttggagtgggaaaagacaatcctcggggattccatcactaacatcatggatccactctactag

SEQ ID NO: 33366 - DNA, 942 bp, Artificial Sequence
  Description of Artificial Sequence: Synthetic coding sequence
atgccgggcctgcttctgtgtgagccaaccgagctttataacatccttaaccaggctacaaagttatcccgactgacggatccaaactatctttgcctgttggacgtgcgatccaaatgggagtatgatgagtcccacgttattactgccctccgcgtgaagaaaaaaaataacgaatatctcttgccggagtcagtcgatcttgagtgtgtgaagtactgtgtggtctacgacaataacagcagcaccctggagattctgctgaaggacgatgacgatgatagtgactctgacggtgatggaaaagatctggtgccgcaggctgccatcgaatacggaagaattctgacccgcctgactcatcaccctgtgtatattttgaaaggcggctacgaacgctttagcggaacataccacttcctccgcacacaaaagatcatctggatgccacaggagttggacgcattccagccttatccaatcgagattgtgcctggaaaggtctttgtgggaaactttagccaggcttgtgaccccaagattcaaaaggaccttaaaatcaaagcccacgtaaacgtgtctatggataccgggcctttctttgctggtgacgctgataagttactccacattaggatcgaggacagccctgaggcccagattcttccattcttgaggcacatgtgccatttcatcgagatccatcatcatttagggtccgtgattcttatcttcagtactcaggggatctcccggtcctgcgccgctataattgcgtacctgatgcattctaatgagcagacactacagcgctcatgggcttatgtgaagaagtgtaagaacaacatgtgcccaaaccgaggtttggtcagtcagctgttggagtgggagaagaccatcctcggggacagtatcacgaatatcatggatcctctttattag

SEQ ID NO: 33367 - DNA, 339 bp, Artificial Sequence
  Description of Artificial Sequence: Synthetic coding sequence
atgccgggcctcctactctgcgagccaaccgagctatataatattttgaaccaggccacaaagctgagccgattgaccgatccaaactacctttgtcttctggatgtccggtccaaatgggagtatgacgagtcccatgtgatcactgctttgagggtcaagaagaaaaataacgaatatctgctgccagaaagtgtcgatcttgaatgcgtgaagtactgcgttgtgtatgacaacaattcctctacacttgagatattattgaaagatgacgacgacgactctgactcagacggggatggaaaaggcactgggtgtatctctgcaataccgcactag

SEQ ID NO: 33368 - DNA, 957 bp, Artificial Sequence
  Description of Artificial Sequence: Synthetic coding sequence
atgccaggcctgctgctctgtgagcccacagagctttataacatcttgaatcaggcaaccaagctttcccggctgacggatcctaattacctctgccttcttgacgttagaagcaagtgggagtatgatgagagtcacgtgattacggccctcagggtaaaaaagaagaacaatgaatacttactgccggagtccgtggacctggaatgcgtgaaatattgtgttgtttatgacaacaatagttctacacttgagatactgctaaaagatgatgatgacgatagtgattcagacggtgatggaaaagatctcgttcctcaggcggccatagagtacgggaggatacttacccgtttaacccaccaccctgtgtacatcctcaaaggcggctatgagcgttttagtggtacttatcattttctgcgcacccaaaaaataatatggatgccacaggagctggatgcctttcagccataccccattgagatcgtgcccggaaaggtatttgtaggaaacttcagtcaggcgtgcgaccccaaaattcaaaaggatttgaagatcaaggctcacgtaaacgtctcaatggacaccggaccatttttcgcgggagatgctgataaactcctgcacatccggatcgaagatagccctgaggcccagattttgcccttcttgcgacatatgtgtcactttatagaggtgttggggctttgtcaggaggtccaaaagcaacatgtgagcaaatctggcattggtgagcccgctgctggcatgggagaggattacccttggcgcttccaccacaagcaccacggttctgctcttcttatctttagcgaagcccaccgaagggtactgaagtccctcacctgggggcactttgtgggcggaggtcctgagtgtgtgtaccctggcctgtcgggacgccggaggccattgctgccggagtccttgtag

SEQ ID NO: 33369 - DNA, 942 bp, Artificial Sequence
  Description of Artificial Sequence: Synthetic coding sequence
atgcccgggttgctgttatgtgagcccactgaactctacaatatcctcaaccaggcaaccaagctgagccgcttgacagatccaaattacctgtgcctgctggacgtgaggagcaaatgggaatacgacgagtcacatgttattaccgccctcagagtgaagaaaaaaaacaacgaatatttgctgccagagagcgtcgatctggaatgtgtgaaatactgtgtggtatacgacaacaattcatccaccctggagatattgctaaaggacgatgacgacgatagtgatagcgacggtgatggcaaggatcttgtgccccaagccgccatcgagtacgggagaatcctcactcgtctgacccatcatcctgtatacattctgaagggagggtacgagagattcagtggcacttatcatttcctacgaacgcagaagatcatctggatgcctcaggagctggacgcctttcagccatatcctatcgagatagtccccggaaaggtgttcgtggggaattttagccaggcatgcgaccctaaaatccagaaggacctcaagattaaggcccacgttaatgtgtctatggacacaggccccttctttgcaggggacgctgacaagcttctccacattagaatcgaagactccccagaagcccaaattctccctttccttcggcatatgtgccatttcatagaaattcaccatcatcttggcagcgtgatactgatattctccacccaaggaatcagcaggagctgtgccgcgattatcgcttatctcatgcacagcaacgaacagacgcttcagcggtcctgggcatatgtgaagaaatgtaagaacaatatgtgtcccaacaggggcctcgtttcacaattgctcgagtgggaaaagaccatccttggtgacagcatcaccaacattatggaccctctgtattag

SEQ ID NO: 33370 - DNA, 942 bp, Artificial Sequence
  Description of Artificial Sequence: Synthetic coding sequence
atgcccggcttgctgctctgtgaaccaaccgaactgtataacattcttaaccaggccactaaacttagccgtttaacagaccccaattatctgtgcctgctcgacgtacggtccaagtgggaatacgacgaaagccacgttataacggccctcagagttaaaaagaagaataacgagtacttactccctgaatctgtggatctggagtgcgtgaaatattgcgtagtctatgacaataatagcagcaccctcgagattctcctgaaggatgatgacgatgacagcgatagcgacggagatgggaaagatctcgtgccgcaggccgctatagagtatggacgcatattgactcgtttgacacaccaccctgtgtacatcttgaaaggtgggtacgaacggttttccggtacataccacttcctgagaacccagaaaatcatctggatgccccaggaacttgatgccttccagccctacccaatagagatcgtgcctggcaaggtgttcgtgggcaacttttcccaggcttgcgaccctaagattcaaaaagatctgaagattaaggctcacgtcaatgttagcatggatacaggccctttttttgctggcgatgccgataagctgttacacatcagaattgaggattcacctgaagcccaaatcctgccatttctccggcacatgtgtcattttatagaaatccaccatcacctgggcagtgttatcctcattttttccacacaggggatcagcaggtcctgtgctgcgataatagcttatctgatgcacagcaacgaacagaccctgcagagatcatgggcctacgtgaagaaatgtaaaaacaacatgtgcccgaatcgcggtctggtgtcccagcttcttgagtgggagaaaaccatcctgggcgatagcattacaaacattatggacccactgtactag

SEQ ID NO: 33371 - DNA, 1311 bp, Artificial Sequence
  Description of Artificial Sequence: Synthetic coding sequence
atgacggcagtttatatgaacggggggggattggtgaacccacattatgctcgatgggaccgccgcgacagtgtcgagtctggctgtcagacagaaagctcaaaagagggggaagaaggccaacctagacaattgaccccctttgagaaacttactcaagacatgtctcaggacgagaaagtggtgcgggaaattacactcggaaagcggattggtttctacaggatccggggagagatcggttccggcaatttcagccaggtcaagctcgggatccactccctgacaaaggagaaggtggccataaaaattctggataaaactaagcttgaccaaaaaacccagagactgctgagcagagaaatctctagcatggaaaagctccatcatcctaatattatccggctgtacgaggtcgtggagacgctttccaaactgcatcttgtcatggagtacgcaggtgggggagagctcttcggtaagataagcacagagggcaaattgagcgagcccgaaagtaagctgatttttagtcaaattgtgagcgccgtgaagcatatgcatgagaaccagatcattcatcgagatcttaaggcggaaaatgtgttctacacctctaatacatgtgtgaaggtgggggacttcgggttcagcacggtgtccaagaaaggagagatgctcaacactttttgcgggagcccaccctatgcggctcccgagctgttccgagacgagcattacattggcatctatgtggatatctgggccttgggcgttctgttatactttatggttaccgggacaatgcctttcagggcagagacagtggctaaactcaagaaaagtattctggagggtacatacagcgttccgccccacgtttctgaaccttgccacaggctgatccgcggagtgctgcagcaaatacccactgagcgctatgggattgactgtattatgaatgatgaatggatgcagggagtgccttaccccactcccctggaaccatttcagctggacccaaaacatttatcagagacgtctacgctaaaagaagaggaaaacgaggttaagtctactctcgagcacctgggcatcacagaagaacatatccggaacaaccagggaagagacgcccgttcatcgattacaggagtttataggattatccttcaccgtgtgcaaaggaagaaggctttggagtctgtgcccgttatgatgctccccgatccaaaagaacgcgacctaaaaaaaggaagcagagtctacaggggaatccgtcacacatcgaaattctgttccatcctgtag

SEQ ID NO: 33372 - DNA, 1311 bp, Artificial Sequence
  Description of Artificial Sequence: Synthetic coding sequence
atgacagcggtttatatgaacggcggcggcctggtgaatccacactacgctcggtgggaccgcagagactctgtggagtcggggtgccagacagagtcaagtaaagaaggtgaggaaggccaacctcggcagttgaccccgttcgaaaaactaactcaggacatgagtcaagacgaaaaggtcgtgagagaaattactcttgggaaaaggataggattctacagaatccggggcgagatcggctcaggaaacttcagccaggtcaagctaggcatccactctctgaccaaagaaaaagtggctataaagatactggataaaactaagctagatcagaagacccagcggctactctcacgcgagatttcttctatggagaaacttcaccacccaaacatcattagactgtacgaggtggtcgaaacgctgagcaaactgcatctggttatggagtacgctggcgggggcgaactatttggcaagattagtactgaagggaagctgtcggagccagagtctaaactgatcttctctcagatcgttagcgccgttaagcacatgcacgagaatcaaattattcaccgagacctgaaggctgagaatgttttctataccagcaatacgtgtgtaaaagtcggggactttggcttctccaccgtctctaaaaagggagagatgctgaataccttctgcgggagtccgccttacgcagcaccagagctgttcagagacgagcattatattgggatctatgtcgatatttgggccctcggggtattgctgtatttcatggttacaggtaccatgcctttccgtgcagagacggtcgccaaactcaagaagtccatcctcgaggggacctatagcgtgccccctcatgttagtgagccctgccaccgtctaattagaggagttcttcaacagatccccacagaaagatatgggattgattgtatcatgaatgatgagtggatgcaaggcgtcccatatccgacccccctggaaccatttcaacttgatccaaagcacctgtctgagacctctaccctcaaggaggaagagaatgaggtgaagtcaaccctggaacacctgggcatcacggaggagcacatccggaataatcagggacgcgatgcccggagctccattacaggagtttatagaatcatcctgcatcgggttcagcgtaaaaaggctctcgaatctgtgcccgttatgatgcttccggacccgaaagagcgggacctgaagaagggttcccgcgtctatcggggcattcgtcacacatccaaattttgcagtatcctttag

SEQ ID NO: 33373 - DNA, 1140 bp, Artificial Sequence
  Description of Artificial Sequence: Synthetic coding sequence
atggagcaactttccagcgctaatacaaggtttgccctagacctgtttctggctctgtctgagaataatccggcagggaatattttcatttccccattcagtattagcagcgccatggccatggtcttcctgggcacacgagggaacactgccgcacagctgtccaagaccttccatttcaacacggttgaggaagttcattcccggttccaatctctgaatgcggacattaataagcgcggtgctagttacatacttaagctagccaaccggctatatggagagaaaacgtacaatttcctccctgaattcttggtatctacgcagaagacctatggcgccgatctggctagcgtagatttccagcacgcaagtgaggacgctagaaagacaattaatcagtgggtgaagggtcagactgagggtaaaatccctgaattgctggcctctggaatggtcgacaacatgacaaagctcgttctggtgaacgccatctacttcaagggaaattggaaagataagtttatgaaagaggcaaccaccaacgctcctttcaggctcaacaagaaggatcggaaaactgtgaaaatgatgtatcagaaaaaaaaattcgcttacggatacatcgaggacctcaaatgtagggtactcgagttaccttaccagggagaagagttaagcatggttatactcctgccagacgatattgaggacgaaagcaccggactgaagaagattgaggagcagctgaccttggaaaagctgcatgagtggaccaagcccgagaacctggactttattgaggtgaatgtgtctttgccgaggttcaagctggaagagagctataccctgaattctgatcttgcccggcttggtgtgcaagatctctttaatagttccaaagccgatctgtccggtatgtcaggggccagagacatctttatttctaagattgtgcacaaatcttttgttgaagtcaacgaagagggtactgaagcagcagccgccactgctggcatcgcaaccttctgtatgctaatgcctgaagaaaatttcaccgcggatcatccgtttctgttttttatccgccataatagcagcgggagtatcctattcctaggtcgtttcagttctccttag

SEQ ID NO: 33374 - DNA, 687 bp, Artificial Sequence
  Description of Artificial Sequence: Synthetic coding sequence
atggtggataacatgacgaaactcgtgcttgtgaatgctatttatttcaagggaaattggaaggacaagttcatgaaagaggcaaccacaaacgccccgtttcgcctcaacaagaaggacagaaaaacggtgaagatgatgtaccagaaaaagaagttcgcctatggctatatagaggacctcaagtgtagggtgctggagctgccctatcagggagaagaactgagtatggtcatcctgctcccagatgacatcgaagacgaatccaccggcctgaagaaaattgaggagcaattgaccttggaaaaactgcatgaatggaccaaacccgagaatcttgacttcattgaggtcaacgtcagcctcccaagattcaagctagaagagagctacacactcaatagcgacctagccaggttaggagtacaggaccttttcaactccagtaaggctgacctgagcggcatgagcggggctagagacatctttatcagtaaaattgtgcacaaaagtttcgtggaagttaacgaagagggaaccgaggccgcagcggcaaccgcaggtattgctacattctgtatgttgatgcccgaggagaactttaccgcggaccacccgttcctgttcttcataaggcacaatagtagtggctccattttgtttctgggtcggttttccagcccatag

SEQ ID NO: 33375 - DNA, 1026 bp, Artificial Sequence
  Description of Artificial Sequence: Synthetic coding sequence
atggccatggttttcttgggcactcgcggaaacactgctgcccaactgtctaagaccttccatttcaacacagtggaggaagtccactcccggttccagtctctgaatgctgacattaataagagaggcgcgagttatattttgaaattagccaaccgactctatggcgaaaaaacctataatttcctccctgagttcctggtatccacacaaaagacctacggggccgacctcgcctctgtcgattttcagcacgctagtgaggatgcccggaagaccattaatcagtgggttaaaggacagacagagggtaagattcctgagctgctcgcctccgggatggtggataacatgaccaagttggtgcttgtgaatgcgatctatttcaaggggaattggaaagacaaattcatgaaggaggcaaccactaacgctccatttaggctcaacaagaaggacagaaaaaccgttaaaatgatgtatcagaagaagaaattcgcttatggctacatcgaggacctgaagtgtcgggtgcttgagctgccataccagggcgaagagctcagcatggtgatccttctgcccgatgatattgaagacgaatcaaccggcctcaaaaagatcgaagaacagttaaccctagagaaactgcatgaatggaccaagcctgagaatctcgatttcatcgaagtgaatgtctccctccctagatttaagctggaagagtcttatacgttgaactccgatctggctcgccttggagtgcaagatctgtttaactcatccaaagctgacctcagtgggatgtctggagcacgcgacattttcatcagtaagatcgttcataagtccttcgtagaggtgaatgaggagggtacagaagctgcagccgcgaccgccggtatcgccaccttttgtatgctgatgcccgaggagaattttactgcggaccacccatttttgttcttcattcgccacaatagtagtggatccattctttttttgggaaggttctcgagcccatag

SEQ ID NO: 33376 - DNA, 654 bp, Artificial Sequence
  Description of Artificial Sequence: Synthetic coding sequence
atggtactggtgaacgctatctactttaaggggcagtggcagaataaattccaggtgagagagactgtcaaaagccccttccaactgtccgaaggcaagaatgtgaccgtagaaatgatgtaccagatagggacatttaagttagctttcgtgaaagaaccacaaatgcaggtgctggaactcccctacgtaaataacaagttatccatgatcatacttctgccggtcggcatagccaacctcaaacagatagagaagcagctgaatagcggcacattccacgagtggacttcgtcctctaatatgatggaaagagaggtagaagtgcatctcccaaggtttaaactggaaacaaaatacgaattgaactccttattgaaaagcctgggggtcaccgatctgtttaatcaagtgaaggccgatctgagcgggatgagtcctacaaagggtttgtatctgagcaaagcaattcataagagttaccttgacgtttccgaggaggggaccgaagccgccgccgctaccggcgactcgattgcagtgaaatcgcttcctatgcgggctcagtttaaggccaatcatcccttcctgttcttcatccgccatacacataccaacacgatcctgttctgtggaaagttggccagtccctag

SEQ ID NO: 33377 - DNA, 573 bp, Artificial Sequence
  Description of Artificial Sequence: Synthetic coding sequence
atggggtcactgtctacagcaaatgttgagttctgcctggacgtcttcaaagagctgaactcaaacaacatcggcgataacatctttttttcttcactatctctgctgtacgcactgtcaatggtcttacttggagcccgtggggagacagaggagcaattggagaagatagaaaagcagctcaactccggaacattccatgagtggacgtcaagctcaaacatgatggagagagaggtcgaggttcacctgccaaggttcaagctggagacaaaatacgaactgaattctctgctgaagagcctcggcgttaccgatctgtttaaccaagtgaaggcggaccttagcggcatgtctccaactaagggtctctacttgtctaaagctatacacaaaagctatctagatgtgtccgaagaggggacagaagccgccgctgcaacaggagattcaattgctgtgaagtccctgccaatgagagctcaattcaaggctaatcatccgtttttgttttttatcaggcatacccacacaaatacgatactgttttgcggcaaactcgcgtccccctag

SEQ ID NO: 33378 - DNA, 1179 bp, Artificial Sequence
  Description of Artificial Sequence: Synthetic coding sequence
atgggctccctttccacagccaacgttgagttctgtctagatgtcttcaaggaactgaattccaacaatataggagataatatcttcttctcttccttgagcctcctgtacgccctgtctatggtattgctgggcgctcggggagagacggaggaacaattagaaaaggtgcttcacttctcccacaccgttgattctctgaagcccggctttaaggactccccgaagtgcagccaagccggccgcatccattctgagttcggagttgaattcagccaaattaaccaaccagatagtaattgcacgctgagtatcgctaatagattatacgggactaagacaatggcatttcaccaacagtacttgtcttgcagtgagaaatggtatcaagccagactccagacagtggacttcgaacagtctactgaggaaacgagaaagactatcaacgcttgggtagaaaataagacgaatgggaaagtcgccaacctgtttgggaagagtacaatcgatccatcatcggtcatggtgctggtgaacgccatctattttaaaggacagtggcagaacaagtttcaagtgcgcgagacggtgaaatctcctttccagctcagcgagggtaagaatgtcactgtggagatgatgtatcagatcggaacatttaagttggcatttgtgaaagagccgcaaatgcaggtgctagagctgccgtacgttaataataaattgagtatgattattttacttcctgtgggtatcgcgaaccttaaacagatcgaaaagcagctgaactctggaaccttccacgaatggacttcatcttctaacatgatggaacgggaggtggaagtgcacctgcctcgcttcaagctggagactaagtacgagttaaacagcctattaaaatcactgggggttactgatctgttcaatcaggtgaaggctgatctgtcaggcatgagccccaccaaaggtctctatctctctaaggctattcataaatcctacctagatgtcagcgaagaaggtaccgaggccgccgccgccaccggagactcaatagccgttaaaagccttcccatgcgcgcacagttcaaagccaatcatccatttctgttctttatcagacacactcacacaaatacgatcctgttctgcggtaaactagcatcaccttag

SEQ ID NO: 33379 - DNA, 1071 bp, Artificial Sequence
  Description of Artificial Sequence: Synthetic coding sequence
atgacactggtcctgtccatgaataggttttgcgagcctatcgtgagtgagggagccgctgaaatcgccggataccaaaccctatgggaagctgactcgtatggcgggccgagcccacctggaccagcccaggcacctctgcagggcgatcggggggcaggtcctcctttggccggatctcactatcggggcatttctaacccgattactacctctaagatcacatactttaagcggaaatacgtggaagaagaggattttcatccaccgctctcttcgtgcagtcacaaaacaatttcaatttttgaagaaagagctcacattctctatatgagcctggagaaattgaagttcatagacgatccagaggtctatctgcggagatcagttcttattaacaacctgatgaaacggatacatggagagatcatcatgcagaataactggtgtttccctgcatgctcattcaatggaacctctgctcaggaatggttcatggcccaagactgtccctatcgcaagagacctcgcatggccaaagaggaatgtgagaagttccacgcatgctgcttctaccaggaatgcggtggtcattatttgaacttgccgcttagtgtgaatgccaacgtcgggtccgcgagtactgccgcctcttccccatccgccagtagcagttcctcgtcatcgtcctcgagtccccccctgcctcttccaagttgctcacgccaggttgactttgacgttggatccgctagcatctacaaaagcgacggacaaatcccagcaaacgaaattttcgttaccaatgtaaggagcctgggtgtgcaagagaaggcaaaactgaacgacgagaaagcgaacgacgatactaatagagatggtggtccattgtcccatgaacccgtgggaaatgatttggctttcgagtgtaagggtcagttctatgattatttcgagacgggttataatgagcgcaacaatgtcaacgagagttggaagaagtccttgcgaaaaaaggaggccagcccgccttccaacaagctgtgttgttctaaaggatctaaaatctag

SEQ ID NO: 33380 - DNA, 447 bp, Artificial Sequence
  Description of Artificial Sequence: Synthetic coding sequence
atgcaggaggtaggcgttgggctgtatccctccatatcactgttaaaccactcctgcgacccaaactgttcaatcgtttttaacggcccccatctgctgctccgagcagtccgagatatcgaggtcggcgaggagttgacaatatgctacctcgatatgctgatgactagcgaggaaagaagaaaacagctgcgcgatcagtactgttttgagtgtgactgttttcgctgtcagactcaggacaaagacgccgatatgctgactggagatgagcaagtgtggaaggaagtccaggagagtctaaaaaagattgaagagttgaaggcacattggaagtgggagcaggtgttagccatgtgtcaggcaattatttcttctaactccgagagactgcctgatattaatatataccagcttaaggttttagattgcgctatggacgcttag

SEQ ID NO: 33381 - DNA, 396 bp, Artificial Sequence
  Description of Artificial Sequence: Synthetic coding sequence
atgcggtgctcacaatgtcgggtggccaagtattgttcagcgaaatgtcaaaaaaaagcctggcccgaccataaacgcgagtgtaaatgtttgaaatcttgcaagccccggtaccctccagatagtgtgaggctgctcggacgtgtggtgttcaagttaatggatggagcaccttcagaaagtgaaaaactgtacagcttctacgatcttgagtccaatattaacaagctcactgaggacaaaaaagaaggattgcgacagctggttatgacgtttcaacatttcatgcgagaagaaatccaagacgctagtcaactaccacccgcattcgaccttttcgaagcctttgctaaagtgatctgcaattccttcactatctgtaacgccgagatgtag

SEQ ID NO: 33382 - DNA, 225 bp, Artificial Sequence
  Description of Artificial Sequence: Synthetic coding sequence
atgagatgcagccagtgccgagtcgcaaaatattgctctgctaaatgtcagaagaaggcgtggcccgaccataaaagagaatgcaagtgcttaaagagttgtaagcctaggtatcccccagactctgtccgtctgctcggccgcgttgtgtttaaactcatggatggcgcaccatcagaatcagagaagttgtattctttctacgacctcgaaagtaacatttag

SEQ ID NO: 33383 - DNA, 1110 bp, Artificial Sequence
  Description of Artificial Sequence: Synthetic coding sequence
atgagatgctctcagtgccgagttgccaaatactgtagtgccaaatgccagaagaaagcttggccagatcataagcgggaatgcaagtgtttgaagtcttgtaaacctagatacccccccgactccgtccgcctgctggggagggtcgtttttaaactcatggacggcgccccctctgaaagcgaaaagctgtactccttctacgatctagagagcaacattaataagctgaccgaggacaagaaggaaggactcagacaactggtgatgacttttcagcacttcatgagagaagaaattcaggatgcctcgcagctgccacccgccttcgatctgtttgaggcatttgccaaggtaatttgtaactctttcacgatctgcaacgcggaaatgcaggaggtaggtgtaggcctgtatcccagcatttccctactcaatcactcgtgtgatcctaactgtagcattgtgtttaacgggccccatctgttactgagggccgtcagggacatcgaagtcggcgaggagctcactatttgctacctggacatgctgatgacatctgaagagcggcgaaagcagctccgcgaccagtattgtttcgaatgtgactgcttccggtgccaaacccaggataaggatgcagatatgcttactggagatgagcaagtctggaaagaagtgcaggagtccttgaaaaaaattgaagaattaaaggcacactggaagtgggagcaggtgttggcaatgtgtcaagcgatcatttcttctaacagtgaacgattacccgatattaatatctatcagttaaaggttctcgactgtgccatggacgcatgtattaatctggggctgctggaggaggcgctgttctacggtacacgaaccatggaaccctatagaatcttttttccagggtctcaccctgtccgcggggttcaggtaatgaaggtgggaaagctgcagctccatcagggtatgtttccacaggccatgaagaacctgcgactggctttcgatattatgagagtcactcacggccgggaacactccttgatcgaagaccttatcctcctcttggaggaatgtgacgctaatattcgcgcgagctag

SEQ ID NO: 33384 - DNA, 1110 bp, Artificial Sequence
  Description of Artificial Sequence: Synthetic coding sequence
atgagatgcagtcaatgccgcgtagcaaagtactgcagcgcaaagtgtcaaaagaaggcctggcccgaccacaagcgagaatgtaaatgcttaaagagctgcaaaccccgatacccccccgatagtgttcggctgctgggccgcgtggtctttaaactgatggacggagctccttcagaatccgagaaattgtacagcttttacgacctggaaagcaacataaacaaactgacagaggataagaaagaaggactccggcagctggtaatgacattccagcactttatgcgtgaggagattcaggatgcgagtcagctgccccctgccttcgatctgttcgaggcatttgcaaaagtgatttgcaattcatttacgatatgcaatgctgaaatgcaagaggtcggggtcggcctctatccctccatcagcttactcaaccatagctgtgatccgaattgtagcattgtgttcaacgggccacacttgctcctaagagcagtgagagatatcgaagtgggcgaagagttaacgatttgctatctcgacatgctcatgaccagcgaggaacgaagaaaacaactcagagatcagtattgttttgagtgtgattgctttaggtgccagacccaagacaaggatgccgatatgctcactggggacgagcaggtgtggaaagaggtgcaggagtccctcaagaaaattgaagagcttaaggcacattggaaatgggagcaggtactggctatgtgccaggctatcatctcctccaatagcgagcgcctcccagacatcaatatctaccagctcaaggtgctcgattgcgccatggatgcctgcattaatctgggcctgcttgaggaagctctcttctacgggacccggactatggagccttacaggatcttttttcctggtagtcatcctgtgcgtggcgtacaggtgatgaaggtggggaagctgcagctccaccaggggatgttcccccaggcaatgaagaacttaaggcttgcatttgatatcatgagagtgactcacggtcgcgagcactccctgatagaggacctcattctactgctcgaagaatgtgacgccaacataagggcctcgtag

SEQ ID NO: 33385 - DNA, 777 bp, Artificial Sequence
  Description of Artificial Sequence: Synthetic coding sequence
atggaggaggacagagacaaggtcatttgcaacagtttcactatttgtaatgctgaaatgcaggaagtgggggttggcctgtatccttcgatctctctattgaaccattcttgcgatccaaattgcagtatcgtgttcaatggccctcacctcctgcttagggccgtgagggatatcgaggtgggggaggagctgacaatttgctatctcgacatgctcatgacgtctgaggagaggcgcaaacaactcagagaccagtactgcttcgagtgtgactgcttcaggtgccaaacgcaggacaaagacgcagacatgctcaccggtgacgaacaagtgtggaaggaagtccaggaatccctcaagaaaatcgaggaactgaaggcccactggaagtgggagcaggttctagctatgtgtcaggcgattatctccagcaacagtgagcggctgcccgatataaacatttaccaactgaaggtcctcgactgcgcaatggacgcatgcatcaacctcggtttgcttgaagaagcactcttctacggcaccaggactatggaaccataccgcatcttttttcccggtagtcaccccgttcgaggcgtccaggttatgaaagtaggaaaactgcaactgcatcagggtatgttcccacaggcgatgaagaaccttcgtcttgcttttgacataatgcgtgtcacacacggccgggagcattccctgatcgaggacctgatcctgctgctcgaggaatgtgatgccaatatacgagcatcttag

SEQ ID NO: 33386 - DNA, 2415 bp, Artificial Sequence
  Description of Artificial Sequence: Synthetic coding sequence
atggacctccctgtggacgaatggaaatcatacctgctgcagaagtgggccagcctgccaacgtctgttcaggtgacaatcagtaccgccgaaaccctgcgcgacatttttcttcacagctcttcactcctgcagcctgaggatgaattgtttctgaagcgactgagcaaaggttatcttgtcgggaaagactccgatgcccctcttttttaccgcgaggagggaaacaagaaatttcaggaaaaggactacaccggcgcagctgttctctactccaaaggagtgagccattccaggccaaacaccgaggatatgagcttgtgtcatgccaatcggtctgcggcattgtttcacttgggccagtacgagacatgtctgaaggatattaaccgagcacagacgcacggatacccagagagactccaaccaaaaatcatgctgaggaaagcagaatgtctcgtggctttgggcaggctgcaagaagcatctcaaacaatctcagatctggagcggaactttaccgctacaccggcgctcgccgacgttctgccacaaacactgcagaggaacctgcatagactcaagatgaagatgcaggaaaaagactctcttacggaaagctttccggctgcgctggctaagaccctggaagatgctgccctgagggaggaaaatgagcagttgtctaacgcatcctcctctatcggcctgtgcgtggatcctctgaagggccgttgtctcgtggccactaaggatattctaccaggagagttattggtgcaggaggacgctttcgtgagtgtgcttaaccccggggaactacccccaccacatcatggactggacagtaagtgggacacgagggtgaccaatggcgacctgtactgccatagatgcctcaaacacaccctcgctaccgtgccgtgcgacggttgtagttatgctaaatattgcagtcaggaatgtctgcagcaggcatgggagctataccaccgtaccgagtgccccctggggggcttattactgacactgggagtcttttgccacatcgctcttcgccttaccctactggttgggtttgaggatgtaaggaaaattatcaccaaattatgtgataaaatttccaataaggacatatgcttgccggaaagcaacaatcaagttaaaacattaaactacggactaggagaatccgagaagaatggaaacatagtggaaactcccataccaggttgtgatatcaacggcaagtacgagaacaattacaatgccgtcttcaacctcctcccacataccgaaaatcactcccctgaacataaattcctgtgcgctctctgtgtgagtgctctgtgccgccaacttgaagccgcaagcctgcaggcgataccaacggaaagaatagtgaatagctctcagctgaaggctgctgtgacccccgagctgtgcccggacgtgactatctggggggtcgcgatgctgagacacatgctgcagctccagtgcaatgcacaggcaatgactactatccagcatactggacccaagggctccattgtgactgactcaagacaggttcgactggctactggaatctttcccgtgatatcactgttgaatcatagctgtagtcccaacacatcagtttctttcatttctacagtggcaacaatccgcgccagccagaggattagaaagggacaagagattctccactgttatgggccgcacaagtcaaggatgggggtcgctgagcggcagcagaagctgagatcgcagtacttctttgattgtgcttgccccgcttgtcagaccgaggcccacaggatggcggccggacctcgttgggaagctttctgttgcaacagctgcggagcacccatgcaaggcgatgacgtgctccggtgcggaagccgttcctgcgcagagagcgctgtgtcacgagatcacctcgtttccagactgcaagatctccagcaacaagtgagagtagctcagaaacttctgagggatggggagttagagcgtgcagtacagagattatctggctgccagcgggatgccgagagttttctgtgggctgaacatgcagtggttggggaaatcgccgatggactcgctcgcgcctgcgctgccctgggggactggcaaaagagtgccacccaccttcagagatccctctatgtggtcgaggtaaggcatggacccagctcagtggagatggggcacgaactgttcaagcttgcgcaaattttcttcaatggcttcgctgtaccagaagccctgagtactattcaaaaagcagaggaggtactgtctttacactgtggcccttgggacgatgagattcaggaactgcaaaaaatgaagagctgtctcctggacttgccaccaaccccagtagggccggccctgtag

SEQ ID NO: 33387 - DNA, 1059 bp, Artificial Sequence
  Description of Artificial Sequence: Synthetic coding sequence
atggcaagaggtaggaaaatgtctaagccaagagcagtggaggcagctgccgcggccgctgcagtagctgcgactgccccagggcccgagatggtagaaagacgtggcccagggcgcccacgtaccgacggcgaaaacgttttcacagggcagtcaaagatttactcttacatgagtcccaacaaatgctcgggcatgcgcttcccactccaggaggagaacagcgtgactcaccacgaagtgaagtgccaaggaaagccgttggcaggcatctacaggaaacgcgaagaaaagaggaacgcaggcaacgcggtgcgctccgctatgaagtcagaggaacaaaaaatcaaagacgcaagaaagggccctctcgtgccctttccaaatcagaagtctgaggctgctgaaccacccaaaacaccaccctcttcgtgcgattctactaacgctgcaattgctaaacaggctctcaagaagcctatcaagggcaaacaagccccccgcaagaaggcacagggaaaaactcagcagaatcgtaagcttaccgatttctatcccgtgcgtagatcttcccgcaaatctaaggctgagttgcagtccgaagagaggaagcggatcgatgaacttatcgagagcggcaaggaggagggtatgaagattgacctgatcgatgggaagggccgcggtgtaatcgccactaaacagttcagcagaggggattttgtggtggagtaccacggtgacctgattgagatcaccgacgcaaaaaaaagagaggccctatacgcccaggatccctcaactggctgttatatgtattactttcagtacctgtccaaaacatattgtgtcgacgctactagagaaacaaaccgcctgggacgactgattaaccatagtaagtgtggtaattgtcagacgaagctccacgatatcgacggagttcctcacctgattctcattgcgagcagagatatcgccgctggcgaagagctgttatacgactatggggatagatccaaagcctcaatcgaggcacatccatggctgaagcactag

SEQ ID NO: 33388 - DNA, 1059 bp, Artificial Sequence
  Description of Artificial Sequence: Synthetic coding sequence
atggcccgggggagaaagatgtccaaacctcgggcagtggaggccgcagccgccgcagcagccgtggcagctacggcccccggccctgagatggtggaacggaggggccccggacgacccaggaccgacggcgaaaacgtgtttactggacagtcaaaaatttacagctatatgtcacccaataagtgctcggggatgcgcttccctctccaggaagaaaattccgtgacacaccacgaggtgaagtgccaggggaagccgcttgctggcatctatcggaaacgagaggaaaagcggaacgctggcaacgccgttagatccgccatgaaatctgaggaacagaagatcaaagatgcccgcaaaggcccactggttccctttcctaaccagaagtccgaagctgccgagcctccaaaaacacctccttcatcctgcgactctaccaatgccgcaatcgctaagcaggccctaaaaaaacctattaagggaaaacaggcacctagaaaaaaggcgcaaggaaaaacacagcagaacaggaagcttacagacttttacccagtcaggcgaagctctaggaaaagtaaggcggagttacaatccgaggaaaggaaacgaatcgatgagctcatcgagagcggcaaagaggagggtatgaagatagatttgatcgatgggaaaggacggggcgttatcgctaccaaacagttcagccggggagacttcgtagtggagtatcacggcgacttaattgaaatcacggacgcaaaaaagagagaggctctatatgcacaggacccaagtactggatgctacatgtactattttcaatacctgagcaagacgtattgcgttgatgccactagagagacgaatcggttaggaaggctgatcaatcatagcaagtgtggcaattgtcagaccaagctacatgacattgatggagtaccgcacttaattctgatcgccagccgcgacatagctgccggcgaagaactgttgtatgattacggagatcggagcaaagcaagcatagaggcgcatccttggctcaagcattag

SEQ ID NO: 33389 - DNA, 1323 bp, Artificial Sequence
  Description of Artificial Sequence: Synthetic coding sequence
atgcagaagggcaagggccgaacttccagaattcgccggcggaaattgtgcggttcatcagaaagccgcggagtaaatgaaagccataaatctgagttcatcgaactgcggaagtggctgaaggctagaaagtttcaggatagcaacttggcacctgcctgtttcccgggcaccggacgcggactgatgtcgcagacttcattgcaggagggtcagatgattatcagcttgcccgaatcgtgtctcttgaccaccgacactgtgattcgctcatatctgggagcgtacataactaagtggaagcctcccccttctcctctgcttgctttgtgtacatttttggtttccgagaaacacgccgggcataggtctctctggaaaccctatcttgagattctgcccaaagcctatacatgcccagtgtgtctggagcccgaagtggtgaacttgctgcctaagagcctcaaagccaaagcagaagaacagagggcacatgtgcaagagtttttcgccagttccagggacttcttttcctccctacaacccctgttcgccgaagctgtcgacagtatattttcctacagcgccctgctctgggcgtggtgcaccgtgaacactcgcgccgtctatcttagaccccggcagcgtgaatgtctcagcgctgaacccgacacgtgcgccctcgccccgtatctggaccttctgaaccatagcccccacgtgcaggtgaaagctgcctttaacgaagagactcatagttacgagatacgtactacctcacgctggaggaagcacgaggaagtgttcatctgctatggacctcacgataaccaacggctgtttctcgaatacggttttgtgagcgtgcataatcctcacgcttgcgtgtacgtcagccgcgaaatattagtgaagtatctcccatctactgataagcagatggataagaagataagcatcctcaaggaccacggctacatagagaatttaacatttggatgggacggacccagctggagactcttgacagctctcaaactgctgtgcctagaagcagagaagttcacatgctggaaaaaagtgttgctgggcgaagttatctcagataccaatgaaaaaacaagtctggatatagcccagaaaatctgttactatttcattgaagaaaccaacgctgtgctacagaaggtgtcccatatgaaagatgagaaggaagccctcataaatcaacttaccctcgtggaaagcctgtggacggaagagctaaaaatcctgcgcgcctccgctgaaactctacactccctgcaaactgcttttacctag

SEQ ID NO: 33390 - DNA, 852 bp, Artificial Sequence
  Description of Artificial Sequence: Synthetic coding sequence
atgaacgagagccacaagtctgaatttatcgagttgagaaaatggctaaaagctagaaaatttcaggattcaaatttagcgccagcatgtttcccgggcacaggccgtggcctgatgtcacagacgtctttgcaggaaggacagatgattatctccctccctgaaagctgcttgctgaccaccgacaccgtcatccggtcatacctcggagcttacatcaccaagtggaagcctcctccaagtccgctgttggccctgtgcacctttttggtgtccgaaaaacacgctggccaccgttcactgtggaaaccttacttggaaatactacctaaggcctacacctgtccagtatgcctggagcctgaagtggtgaacttactgcccaagagccttaaggccaaagcggaggagcagcgggcacatgtccaggaatttttcgcaagctccagggatttcttctcctctttacagcctttgttcgccgaagccgttgatagcatattctcatacagcgccctcctgtgggcctggtgtactgtgaatacaagggctgtgtatctgagaccgcgtcagcgcgagtgtctgtctgccgagcccgacacatgtgcccttgctccctatcttgacctacttaatcatagccctcatgtgcaggtgaaggctgcctttaacgaggagacacattcatacgagatccggacaaccagccggtggagaaaacacgaagaagtctttatctgttacggcccccatgacaaccagaggctcttcttggagtacggatttgtcagcgtgcacaacccccacgcttgtgtatacgtgagtagaggatggaatcagttatgtagctag

SEQ ID NO: 33391 - DNA, 852 bp, Artificial Sequence
  Description of Artificial Sequence: Synthetic coding sequence
atgaatgagtcgcataaatctgagtttatagaattaagaaaatggcttaaggcacggaaatttcaggactccaacctagcgccagcgtgtttcccaggaacagggagagggctgatgtctcaaacaagcctgcaggaggggcaaatgattatttcccttcccgagtcttgtctgctcactacagatactgttatacggtcgtatctgggcgcttacatcaccaagtggaagcctccccctagcccactcctggccctgtgtacattccttgtgtccgagaaacatgcaggacatcgttccctgtggaagccttacctcgaaatcctgccaaaggcgtacacatgtcccgtatgcttggaacccgaggtcgtgaacctattgcctaagtcactgaaggctaaagccgaagagcagcgggcacacgtccaggaatttttcgcttcttccagggattttttctcaagccttcagcctctgtttgccgaggctgttgactcaatattttcctattcagctttactctgggcttggtgtacggtcaacacaagagccgtgtacctacgacctcggcaacgggagtgcttatcagctgaaccagatacttgcgcactggctccttacctagaccttctcaaccactccccccacgtccaggtgaaagctgctttcaatgaggagacccatagttacgagatccggacaacgtccagatggaggaagcatgaagaagtctttatctgttatggacctcacgacaaccaacgcctgttcttggaatatgggttcgtcagcgtgcacaaccctcacgcgtgcgtctatgtgtcgcgtgggtggaatcagctgtgcagctag

SEQ ID NO: 33392 - DNA, 924 bp, Artificial Sequence
  Description of Artificial Sequence: Synthetic coding sequence
atgcagaaaggaaagggtagaacgagtagaatccgaaggcggaagttgtgcgggtcctccgagagccgcggggtcaacgaatctcacaaatccgagttcatcgagttacgtaaatggttgaaggcacgaaagttccaagacagcaacctcgctccggcttgcttcccaggcacaggtaggggcctgatgtcccagacctctctgcaggagggacagatgatcatttccttgcccgagtcatgcctcctcaccaccgacactgtcatccgatcctacctcggggcatatatcacaaagtggaagccgccaccatcacccctcctagcgctttgcactttcctggtttctgagaagcacgcaggccatcggtctctttggaagccctacttggaaattcttcctaaagcctacacttgccctgtttgcctggagcccgaggtcgtgaatctgcttccgaaaagtctcaaggctaaggctgaggagcagagagcgcacgtacaggaattcttcgcatcttctagggacttcttctcttccctgcagcctttattcgctgaagccgtagactcaatctttagctactcagccctcctgtgggcctggtgtaccgtcaacactagggccgtttatctcagaccgagacagagggagtgcctctctgcagaacctgacacctgtgccctggccccttaccttgacttgctaaatcatagcccgcacgttcaggtgaaagccgcattcaatgaggagacacactcttacgagattaggactacctcgagatggagaaaacacgaagaagtttttatttgctatggcccccacgacaaccagcggttgttcttagaatacgggttcgtgagtgttcacaatcctcacgcttgtgtgtacgtctccagaggttggaaccaattgtgctcctag

SEQ ID NO: 33393 - DNA, 924 bp, Artificial Sequence
  Description of Artificial Sequence: Synthetic coding sequence
atgcaaaaagggaagggaaggacgagtcgaatcaggcgacgcaagttatgtgggtcttcagagagtagaggggtcaatgaatcacataaatctgagttcatcgagctgcggaagtggctaaaagccaggaaattccaggactctaacctagcacccgcttgttttcctgggactggcagaggcctgatgagtcagacttccctgcaggagggccaaatgattataagccttcctgaatcatgcctcctcacaactgacaccgtgattaggtcctacctgggagcctatattactaaatggaagccgccgcccagccctttgcttgcactgtgtacttttctcgtctcggagaagcatgctggccaccgatctctctggaagccctaccttgaaatcctgccaaaggcgtatacttgcccagtgtgtctggaacccgaagtggtgaacctgctgccaaagtcattgaaggcaaaggcagaggagcaacgggcacatgtacaggaattttttgcatcctcacgtgactttttttcatcacttcagcctctctttgcagaagccgtcgattctattttttcttatagcgccctgctttgggcatggtgcaccgtcaacactcgcgctgtatacctcaggcctagacagagagagtgtctgagcgcagaacccgatacttgcgccttggccccgtacctggatctgctgaaccactcaccgcacgtgcaagttaaggccgcctttaacgaggagacacactcctatgaaatcagaaccacctccaggtggcgtaaacacgaggaggtttttatttgctatggaccgcacgataaccagagactgtttctggagtatggctttgtgagcgtgcacaacccccatgcgtgcgtgtatgtatccagggggtggaaccagctgtgtagttag

SEQ ID NO: 33394 - DNA, 1251 bp, Artificial Sequence
  Description of Artificial Sequence: Synthetic coding sequence
atgaacgagtcccacaaatctgagttcatcgagctaaggaagtggctgaaggctcgcaagtttcaagactctaatctggcccccgcatgctttcccggcactgggcggggactaatgtctcagacctccttacaggaaggacaaatgatcatcagtttacctgagagttgccttcttaccaccgacaccgtgattaggtcttacctcggcgcttacattacaaagtggaagccaccgcccagtccgctgctagccctgtgtactttcctggtgtctgaaaaacacgcgggccatcgatcactctggaaaccctatctggaaatcctacccaaggcctacacttgccccgtttgcctcgaaccagaggttgtaaacctcctgcctaaaagtctcaaggctaaagcagaggagcaacgggcccacgttcaagagtttttcgcaagtagccgcgatttcttcagcagtcttcagcctctgtttgccgaggctgtggactccatcttctcttactccgctctgctctgggcatggtgtactgtgaataccagggcggtttatctgagacctaggcagcgagaatgtctgagcgctgaacctgacacatgcgccctcgcaccctaccttgatctcctcaaccactcccctcacgtccaggttaaggcagccttcaatgaagagacacactcatacgagatccgtactacaagtaggtggagaaaacatgaagaggttttcatttgttacggcccccacgataatcagagactgttcctggagtatggcttcgtaagcgttcataatccccacgcatgtgtctatgtctcccgggaaatcctcgttaaatacctaccatccactgataagcagatggacaaaaagatttccatattgaaggatcacgggtacattgagaacctgaccttcgggtgggacggtccctcgtggcggctgctcacggccctgaagttgctgtgtctcgaggctgaaaaatttacatgttggaagaaggtgttgttgggcgaggtgatctccgacacgaatgagaaaacctccctggatatcgcacagaagatttgctactacttcatcgaggagaccaatgcggtgctccagaaggtgtcccatatgaaagacgaaaaagaggccctgatcaatcaactgactctggtggaatctctttggaccgaagagttaaagattcttcgcgcttctgcggagacactacattctctacagacagcctttacttag

SEQ ID NO: 33395 - DNA, 1323 bp, Artificial Sequence
  Description of Artificial Sequence: Synthetic coding sequence
atgcagaaaggcaaagggcgaacgtcaaggattcgccgccgcaagttgtgcggcagtagcgagtcgaggggggtaaatgagtcccacaagtcagagttcatcgagttacgcaaatggctgaaagcccgtaagtttcaagatagcaatctcgcacctgcttgttttccaggaactggtcgaggattgatgagccaaactagccttcaggaaggtcagatgattataagtttgcccgaatcgtgtttattgacaactgacactgtcatccgatcctacttgggagcttatatcactaagtggaagccgcctcctagccctctgctggctctctgcacattcctcgtcagtgaaaagcatgctggccaccgctccctgtggaagccatacctggagattttaccaaaagcatatacatgtcctgtgtgcctggagcctgaggtggtgaatctacttcctaagtcgctgaaagctaaagctgaagagcagagagcgcatgtgcaagagttctttgcttccagtcgagactttttcagcagcctgcaacctctcttcgctgaagccgtggacagtatcttcagctattccgctctgctgtgggcctggtgcacagtaaacaccagggcagtatatctacgcccacggcaacgcgaatgtctttctgccgagcccgatacatgtgcgctcgcaccttacctcgacttactgaatcattcaccacacgttcaagtaaaagcagctttcaacgaagagacccactcctacgagatccggacaacatcacggtggagaaaacacgaagaggtgtttatatgttacggcccccatgataaccaaaggctgttcctcgaatatggcttcgtgagcgtgcacaacccccacgcttgtgtgtacgtttcccgcgaaatcctggtgaaatacctgcccagcaccgacaaacagatggataagaagatttccattttgaaggaccatgggtacatcgagaatttgacattcgggtgggacggaccaagttggagattgctaactgctctgaaactgctgtgtcttgaagccgaaaagttcacgtgttggaagaaggtcctactgggcgaggttatttctgatactaatgagaagactagcctggacatcgcccagaaaatctgttactatttcatcgaggaaacaaacgccgtcctccaaaaagtgtcccacatgaaagatgaaaaagaagccctgatcaatcagctgactttagttgaaagtctgtggacagaggagttaaagatcctaagagcgagcgctgagactctgcacagcctgcagacagcctttacttag

SEQ ID NO: 33396 - DNA, 696 bp, Artificial Sequence
  Description of Artificial Sequence: Synthetic coding sequence
atgcagaagggaaagggcagaacttctcggatccgccgtaggaaactctgcggtagctctgaatctcggggggttaacgaatctcataaaagtgagtttatcgaacttagaaaatggctgaaagctagaaaatttcaggactcaaacctcgcgcctgcctgctttccggggacagggagaggtctgatgtcccaaacgagccttcaagaagggcagatgatcataagccttccagaaagttgtttactgactacagatacggtgatccggtcctacctgggggcgtatataactaagtggaagcccccaccctcaccgttgttggccctgtgcacattcttagttagcgaaaagcatgcggggcacaggagtctgtggaagccttacttggagatcctgcccaaggcctatacctgtcctgtgtgtttagagccggaagtcgtaaacttgctccctaagtcccttaaagccaaggctgaggaacagcgcgcacacgtgcaggaattctttgcgtctagtagggattttttttcctctttgcagcccctgtttgccgaggctgtggatagtatattcagctattctgctctgctgtgggcctggtgcactgtaaatacaagggcggtgtacctgagaccccggcagagagagtgtttatccgccgagccggatacctgcgctctagctccatattag

SEQ ID NO: 33397 - DNA, 678 bp, Artificial Sequence
  Description of Artificial Sequence: Synthetic coding sequence
atgcagaaaggtaaggggaggacctcaaggatcaggcgcaggaaactgtgcggttccagtgaatctagaggcgttaacgagagccacaagagcgaatttatagaactcagaaagtggctcaaggccaggaaattccaggacagcaatctggcccccgcctgctttccgggaaccgggcggggtctcatgagccagacttccctacaagagggccagatgatcatctctcttccggagagctgtttactcactactgacactgtcatcaggagctatcttggggcctatattactaagtggaaaccgcctccttctccactgcttgctctgtgcacattcctcgtgagtgaaaagcacgcagggcacaggtcattgtggaaaccctatctcgaaatcttgcccaaagcttacacatgtcccgtgtgtttggagcctgaggtcgttaatctgttgcccaagtccttgaaggctaaggccgaggaacagcgcgcgcacgtgcaggagttttttgccagtagtagagatttcttcagctccttgcagcctctttttgcggaagccgtagactccatcttctcgtattccgccctgctgtgggcctggtgtaccgtgaacacaagagccgtgtacttaagaccacggcagcgagaatgcttgtcagccgaaccggacacctag

SEQ ID NO: 33398 - DNA, 213 bp, Artificial Sequence
  Description of Artificial Sequence: Synthetic coding sequence
atgaacgaaagtcacaaatcagaatttattgaactgcgcaagtggttgaaggctcggaaatttcaggactcgaacctggcacctgcatgttttcccggaacaggaagaggcctgatgagccagacctccctgcaggaagggcagatgatcatctctttgccagagtcgtgcttacttacgaccgatactgtgatccggagctaccttggatag

SEQ ID NO: 33399 - DNA, 204 bp, Artificial Sequence
  Description of Artificial Sequence: Synthetic coding sequence
atgcagaagggaaagggccgaacgagcaggatccgacgtcgtaagctgtgtggttcttccgaatctcgaggagtgaatgaatcacacaagtccgagtttatcgaactccgcaagtggttgaaggctcgcaaattccaagactccaacctggcccctgcgtgttttcccggcaccggcaggggcctgatgtcccaaacaagctag

SEQ ID NO: 33400 - DNA, 375 bp, Artificial Sequence
  Description of Artificial Sequence: Synthetic coding sequence
atgaatgagtcccacaagtccgaatttatcgagctgcgcaaatggttaaaggccagaaagttccaggattccaaccttgccccagcatgttttccagggacagggaggggactcatgtcccagacatctctccaggaggggcagatgattataagtctccctgagtcttgcttgctgactacagacaccgtgattcggtcctacctcggcgcctacattaccaagtggaaacctcctccgtcgccactcttggctctgtgcaccttcttggtctctgaaaagcatgctgggcaccgctctctgtggaagccctatcttgagatactcccgaaggcgtatacctgccccgtgtgcctcgagccggaggtggtatag

SEQ ID NO: 33401 - DNA, 4035 bp, Artificial Sequence
  Description of Artificial Sequence: Synthetic coding sequence
atgtccagggggaaggtgattaggttacaccgccgtaaacaggataatataagtgggggcgactcttcagccaccgagagctgggatgaggaactgagcccatctacagtcctgtacacagccacacagcacaccccgacaagtattaccctcactgtgcgcaggactaagcctaagaaacggaagaagagtcccgaaaaaggaagggcagccccaaagaccaaaaaaataaaagcctttagagaggggagcagaaagtctctccgaatgaaaaattccccttcagaagcgcagaacctggatgaaaataccaccgagggctgggaaaatagaattaggctgtggacagaccagtacgaagaggcgttcaccaatcaatactcagctgacgtccagaacgctctggagcagcacttgcactcctccaaggagttcgttgggaaacctaccatactggacactatcaacaaaacagagctcgcttgtaacaataccgtgataggatctcagatgcagctccagttgggtcgggtgacccgagtgcaaaagcaccgcaaaatattacgcgctgctcgggatcttgcacttgacacactcataattgaatatcgcggaaaagtgatgttgagacagcagtttgaggtcaatggccatttcttcaagaagccatacccattcgtgttattctattccaagtttaatggagtggagatgtgcgtggatgcaagaacatttggcaacgacgctcggtttatacgcaggtcgtgcacccccaacgctgaggtgcgccatatgatcgctgacggcatgattcatctctgcatctatgcagtctcggcaattacaaaagacgccgaggtgacgattgcctttgattatgaatatagcaattgcaattacaaggtggactgtgcctgccataagggaaaccgcaattgtcctattcagaaacgaaacccaaacgctacagagctgccacttctgccaccccccccaagcctgccaaccatcggagcggaaactagaaggcgaaaggccaggcgcaaggaattagaaatggagcagcaaaatgaggcctcggaggagaataatgatcaacagagtcaggaagttcccgagaaggtgacggttagctcagatcacgaggaggtggacaaccctgaggagaagcctgaggaggagaaggaagaggtcatagatgaccaggaaaatctggcccattcacggcgtacacgggaagatcgtaaggtggaggcgatcatgcatgcttttgagaatctcgagaagagaaagaaacgaagggatcagcctctagaacagtctaacagtgatgtggagattacaactactaccagtgagacacccgtgggcgaagaaaccaagacagaggcccccgagtctgaggtgtcaaacagcgtgtctaacgtaaccataccttctactcctcagtcggtcggagtgaacaccaggcgctcgtctcaagcaggggacattgcggccgaaaagctcgtgccgaagccccctcctgccaagccttcaagacccagacccaagtcgaggattagccgctacagaacttcctccgcacagcgcctcaagaggcagaagcaggctaacgcccagcaggccgaactctcccaggcagcactggaggaaggaggctccaactcgctcgtcacccccaccgaggctggtagtctggatagttccggcgaaaacagaccgttgacaggaagcgaccctactgtggtgtctatcacaggttcccatgtgaatcgagccgccagtaagtatcccaagacgaaaaagtacctagtgacagagtggctgaacgacaaagccgagaagcaggaatgcccagttgagtgtcctcttcggatcactactgaccctactgtgctagcaacaaccctgaacatgttaccaggcctgattcattctccactgatctgcaccacaccaaagcattatataagatttgggtctcctttcatcccagagcgtcgaaggagaccactgctgcccgacgggaccttttcctcatgtaagaagcggtggattaagcaagccctcgaagagggaatgacccaaacgtcatctgttccccaggagacgagaactcagcatctgtaccagagtaacgaaaacagcagctctagcagtatttgtaaagacaatgccgacctcctgtcccccctgaaaaaatggaagagcagatatttgatggaacagaatgtgacaaagctcctccggcccctgtctcctgtgacccccccacctcccaattctggcagcaaaagcccccagttggccaccccaggctcctcgcaccccggtgaggaagaatgtagaaacggctattctctgatgttttctccagtgacatctcttaccacagcaagccgctgcaatacccccttgcagtttgagctatgccacagaaaagatctggacctcgcaaaggtagggtacctggactcaaatacaaatagctgcgccgaccgaccttccctgttaaacagcggccattctgatctagcaccacacccaagtttagggccaacatcagagaccggttttccttccagatccggagacggccatcagaccctagtgcgcaattccgaccaagccttccgaacagagtttaatctgatgtatgcctattcgcccttgaatgctatgccacgcgccgatggcctctaccggggctcaccactcgtgggagatcgcaagcctttacacttggatggcgggtactgctcacccgccgagggattctcttcacgttacgagcacgggctaatgaaggacctgtctagaggaagtctgagtcccggcggcgaaagagcgtgcgaaggcgtgccctcagctccccagaatccgccacagcgcaagaaggtgtcgttactggaataccgaaaacgcaaacaagaagctaaagagaactctgccggtggtggaggggacagcgcacagagcaagagcaagtcagccggagcaggacagggaagcagtaacagcgtgtcagatactggtgcccacggggttcagggctcatccgcacgcactccaagcagccctcacaaaaaattctcaccaagccatagcagcatgtctcatctggaggctgttagcccttccgatagccgaggtacatccagtagccactgccgtccccaagaaaatatctcaagccgatggatggtcccaacctcagtcgaacgattgcgagaaggtggctccatcccaaaagtcttgagatcaagtgtgcgggtggctcagaagggtgaaccttccccaacttgggagagtaacattacagaaaaggactccgacccagcagatggcgaaggcccagagacacttagctctgctctcagcaaaggcgccaccgtgtattcaccttcccgttatagttatcagttgctccagtgcgacagcccaaggacggagagccagagtctgctgcagcagagcagtagcccatttcgcggccatcccacacagtctcctggttatagctaccgcaccactgcgctacggccagggaatccccctagtcacgggtcctcggagagcagcctgtcgagcacgtcctactccagtccagcccatcctgtttccactgacagcctcgcccccttcaccggtacccctggatacttctcttcccagccacatagcgggaatagcaccggctctaacttgcccaggcgtagctgcccatccagcgccgctagcccaaccttgcaggggccttcagattcacccacatccgatagcgtttctcagtcgtcaacaggtaccctgagctctacttcatttccacaaaacagccggtccagcctgccctcagaccttaggactatcagcttaccgtccgctggacaatctgctgtataccaagcaagccgtgtatctgcggtgagtaatagtcagcattaccctcaccgcggctcaggtggagtccaccaatacagacttcagcccttacagggtagtggagtgaagacgcaaaccggcttgagctag

SEQ ID NO: 33402 - DNA, 4329 bp, Artificial Sequence
  Description of Artificial Sequence: Synthetic coding sequence
atgtctatcgcgatccctcttggcgtgaccacgtctgacaccagttactcggacatggcagctggcagcgacccggagagcgttgaggccagccccgccgtgaatgagaaaagtgtgtacagtacacacaactacggcactacacagcgccacggctgccggggcctaccttatgctacaatcatacctcggtcagatctcaatggactgccctcccctgtggaggaaagatgtggggattcacccaactcagagggagaaacagttccaacctggtgtccttgcgggctatcacaagatgggttcctgttgaattgtgacaagtgtcgcggcatgtcgcgaggcaaggtgattagattgcatcggaggaagcaggacaatatttctggaggcgactcgtccgcaaccgagtcttgggacgaggaattgtcccccagcaccgtattatatacagcaacacagcatacccctacaagcattaccttaactgttaggcggactaagccaaagaagaggaagaaatccccagaaaaaggcagggcagcacctaaaacaaagaaaataaaaaacagcccctctgaagctcaaaacctggacgagaacaccaccgagggctgggaaaaccggattcgcctgtggactgaccaatacgaggaagctttcaccaaccagtactctgccgacgtacagaacgccttggagcagcacttgcactctagtaaagagttcgtcgggaagcctacaatcctcgataccattaacaagactgaactcgcctgcaataacacagtgattggcagtcagatgcagttacaactaggccgcgtaacccgagtacagaaacaccgaaaaatcctacgcgcggcgcgagacctggcactcgacacactgattatcgaatacagggggaaagtgatgctgagacagcagtttgaagtgaacggccactttttcaagaaaccctacccttttgttctgttttactctaagtttaacggtgtggagatgtgtgttgacgctcggactttcggcaatgacgctcgatttatacggagatcttgcacacccaatgcggaggtacgacacatgattgcagatggaatgatccatctgtgcatttacgccgtttctgcgattaccaaggacgctgaggtcactattgcgtttgactacgaatattctaactgcaactataaagtcgactgcgcatgtcacaagggaaacagaaactgtccgattcagaagaggaaccccaacgcaaccgagcttcccctgttgccacccccgccgtctctccctactatcggcgcggagacccggagacgtaaggccaggaggaaggagctagaaatggaacagcagaacgaggccagtgaagagaataacgaccagcagagtcaagaggtgcctgaaaaagttaccgtttcttctgaccatgaagaagtggacaatcctgaagaaaaaccagaagaagagaaagaagaagtaattgacgaccaggagaacctcgcccatagcaggagaaccagggaagaccgaaaggtagaggcgatcatgcatgccttcgaaaatctggaaaaacggaaaaaacgacgcgatcagccgctggaacaatcgaacagtgacgttgaaatcactaccaccacctcagagaccccagttggtgaagagactaaaaccgaagcccccgaatccgaagttagcaactctgtctcgaacgtcactattccatccactccacagagcgtgggcgttaatacccggagaagctcacaggcaggtgatatcgctgccgagaagttggtcccgaaaccaccgcctgctaagcccagccgcccaaggcccaaatcaaggatctcccggtaccgaacaagctcagcccagaggcttaaacggcaaaagcaggctaacgcccagcaggcagaattatctcaggctgccctcgaagaagggggttccaattccttggtgaccccaacagaggctggttctctagattccagtggggaaaaccgtcctctgactggatccgacccgacagtggtctcgattaccggctctcacgtgaatagagcagcatccaaatatcccaagactaaaaagtatctggtcactgaatggctgaatgataaagcagaaaagcaggaatgtcccgtggagtgtcctctgaggatcacaacagacccaacagtgctcgccactaccctgaatatgctgccgggcctgatccattcaccgctcatatgtaccacgcctaagcactatatccgcttcggcagcccctttataccggagcgaaggcggcgacctttgctccctgatgggacgttctcctcttgtaagaaaaggtggattaaacaggccctggaagagggaatgacccagacctctagcgtacctcaggaaacacggacacagcatttataccagtccaatgaaaatagcagctcttctagtatctgcaaagacaacgccgatttactttcaccactgaagaaatggaaaagtcggtacctgatggaacagaacgtgactaagctcctgcgcccgctcagcccagtgactcctccacctccgaactcaggctccaaatctcctcaattggctacaccggggtctagtcaccccggagaggaggaatgtcgaaacggatatagccttatgttttcccctgtgactagcttgacaacagcctctagatgcaatactcctcttcagtttgaactgtgccaccggaaggacctcgatttggccaaggtgggctacctggattcaaataccaattcctgtgctgaccgaccatccttattgaatagtggacactcagacctcgccccccatcccagcctgggaccaacctctgaaaccggtttcccaagcagaagcggggatggacatcagacactggtaagaaacagcgatcaggcgtttcgcacggaatttaatctgatgtacgcatattcccctcttaacgccatgccacgcgccgatggactgtatcgcgggtccccgctggttggagatcgtaagccactgcacctggatgggggctattgttcacctgccgaaggcttcagcagtagatatgagcatggtctgatgaaagacctgagccgcgggagtctgtctcctggcggtgagcgagcgtgcgaaggagtcccctctgcaccccagaaccccccccagcgtaagaaggtgtccctgctggaataccgaaaaagaaagcaagaagccaaggaaaatagtgctggcggtggcggggatagtgctcaaagcaaatctaagtcagccggcgctgggcagggatcatcaaatagcgtgagtgacacgggggcccacggagtccaaggcagcagcgctagaaccccctccagcccccacaagaagtttagccccagtcatagctcaatgtcacacctcgaggccgtatcgccatctgatagcagaggaactagctcgtctcattgtcgtccccaggagaacatttcaagcaggtggatggtccctacatcggttgagaggctgagggaagggggcagtattcctaaggtgctccgatcttcagttcgtgtggcccaaaaaggcgaaccttctccaacgtgggaaagtaacatcacagagaaggacagcgaccccgcagatggggagggccccgagacactgtccagcgccctgagcaaaggagcgaccgtctatagcccttctagatactcctaccagctactgcaatgtgatagtcctaggacggagtctcagagcctccttcaacagagctcctcaccctttaggggtcacccaacccagtccccaggatattcttaccgaaccaccgctctcaggccgggaaacccaccctcccacggctcatctgagagttcgctctctagcaccagttactcctctcctgcgcatccggtgagtactgatagtctggcccctttcactgggacaccaggatatttttcgagtcagccacattccggcaacagcacgggctcaaacctcccccgacggagctgtccatcctctgccgcctctccaacgctgcagggcccgagcgactcacctacaagcgactctgtgtcccagtcatccaccgggacgctgtcttcgacctcttttccacagaattccaggagtagtcttccgtctgacctccgcaccatttctctgccctcggcaggacaaagtgcagtgtaccaggcttcacgagtaagtgccgttagcaattcgcaacactatcctcaccggggttcaggaggagtgcaccagtacagactgcagcccttgcaaggatccggtgttaagactcagactgggctatcttag

SEQ ID NO: 33403 - DNA, 4035 bp, Artificial Sequence
  Description of Artificial Sequence: Synthetic coding sequence
atgtccagaggaaaggtaatccgcctgcaccgcaggaaacaggacaacataagcgggggcgacagctccgccacagaaagctgggatgaggagctgtccccgagcaccgttctgtacaccgctactcagcatacaccgacttccataactcttaccgtgaggagaactaagcccaaaaaacgaaagaagtccccagagaagggccgggccgcacccaaaaccaaaaagatcaaggcatttcgcgaggggtccaggaagagtcttaggatgaaaaattcaccctcagaggcgcagaatttggatgaaaacacaacggaagggtgggagaatagaattaggctgtggacagaccaatacgaggaggcttttaccaatcagtactctgcagacgtgcagaatgcgctggagcagcatctgcacagctccaaggaattcgtgggcaagccaacgatcctggacacaatcaataagactgaactcgcatgtaataacactgtgattggcagccagatgcagctccagctcggtagagtcacccgagtccaaaaacacagaaaaatcctgagggctgcgcgagatcttgctctagacacactgatcatcgagtacagaggtaaagttatgttgaggcagcaattcgaagttaacggccatttctttaaaaagccctacccattcgtgctcttctattcgaagtttaacggagtggaaatgtgcgtcgacgcgcgtacgtttggaaatgatgccagattcatacggcgaagctgcacccccaatgcagaagtacgacatatgatcgccgatggcatgatccacttgtgtatctacgccgtgagtgctatcacaaaggatgcagaggtaactatagcatttgattatgagtattccaactgcaattacaaagtggattgcgcctgtcataaaggcaaccgtaactgccccatacagaagagaaatcccaatgctaccgaacttcccctgctccccccaccaccgtctcttccaactattggggcggagactagaagaaggaaagcacgcagaaaagaattggaaatggaacagcagaatgaagctagtgaggagaataacgaccagcaaagtcaggaggttcccgagaaagtgacagtgtcttccgatcacgaagaggtggataaccccgaggaaaagccggaagaagagaaggaggaggtgatcgacgatcaagagaatctggcccattctagacgcactagagaggatcgcaaagtcgaggctataatgcacgcttttgagaacctggagaaaaggaagaagaggagagatcagcccttagaacagtccaacagcgatgttgaaatcacgaccaccacttctgagacgccagtaggtgaggagaccaagacagaagccccggaaagcgaggtaagcaactcagtgtccaacgtgaccattccttcgaccccacagtctgtgggtgtgaatacgaggagatcatctcaggcgggtgacatcgccgctgagaaactggttcctaaacctcctccagccaagccttccagaccacgcccaaaatctcgcatatcacgttacagaaccagctctgcccaacgcctgaagcgccaaaagcaggccaatgcacaacaggctgagctgtctcaggcggcattggaggaaggtggctccaactcactggtcacgcctacagaggctggcagcctcgacagcagtggagagaatagaccccttacaggtagtgatcctaccgtggtctcgatcaccggctcccatgtgaaccgcgccgcctccaagtacccaaagacgaaaaagtatctggttactgaatggctcaatgataaagcagaaaaacaagaatgccccgtggagtgcccgctgaggattacgactgaccctactgtcctagccaccaccctcaatatgctccctggtcttatccatagcccattaatctgcaccaccccaaaacattacattcgatttggaagcccttttattcccgaaaggaggaggcggcccctgctgccagacggtaccttttcctcttgcaagaaacgttggatcaagcaggctctggaagaggggatgactcaaacgtcctccgtgccacaggaaactcgcacccagcatctgtatcaatccaacgaaaattcctcttcctcctccatctgtaaagataacgccgacctactctcccccctgaaaaaatggaagtctcggtacctcatggagcaaaatgtgacaaagctgctacgcccgctctcccccgtcacccctcctcctcctaactctggatctaagtcgccccagctggcaacacctgggtcttcccaccctggagaggaggagtgtcggaatggatattccctgatgttctcccccgtgacatccctcactactgcgagcaggtgcaacacgcccctccagttcgagctgtgccacaggaaggacctagatctggccaaagtcggatacctggattccaacaccaacagctgtgccgatcgaccgtccctgcttaatagcgggcactcagatctggccccacacccaagcctcgggccgacgagcgaaacgggctttccctccaggtcaggcgacgggcaccagaccctcgtgcgcaattctgatcaagctttccgcacggagttcaatctaatgtacgcttatagccctctgaacgcaatgcctcgagccgacgggctctacagggggtctcctctggttggggaccgcaagcccctccatctcgacggaggatattgcagtcccgctgaaggcttcagctcacggtatgaacatgggctgatgaaagatttgagtaggggatcattgagccctggaggggagagagcttgcgagggcgtgcctagcgctccccagaatccccctcagaggaaaaaagtatctcttctggaataccgcaaacgaaagcaggaagcaaaggaaaatagcgctgggggcgggggtgattccgcccaatccaagagcaagtcagcaggagcaggtcaaggttcgagcaattcggtatctgacacaggggcacacggcgtgcaagggagctctgccaggaccccatcgtctccccacaaaaaattttcaccgtctcatagctctatgtctcatctggaagctgtgtcccccagtgattcaagagggacaagttcatcgcattgtaggccccaggagaatatctcctcgcggtggatggttcccacaagtgtagagcggctgagagagggcggctccataccaaaagtgctcagatctagtgtgcgggttgcacagaaaggagaaccatcgccaacctgggaaagtaacattacagagaaggacagcgaccccgctgacggagaggggcctgagaccttgtccagtgccctttccaagggcgcgaccgtatacagcccgtccaggtactcctatcagctgctccagtgcgacagcccccgtacagaatcccagtccttacttcagcagtcttcttcccccttcaggggccatccaacccagtcccccggttacagctacaggacaacagcgctgagacctgggaaccccccaagtcatggctcctcagagagttccctctctagtacctcatactcaagccctgcacacccagtttcgaccgacagtctggcaccttttaccggaacacccgggtacttcagctcacagccgcacagcgggaacagcaccggctcaaatttaccccgtcgaagctgccccagttcagccgcaagtcccaccctgcaagggccgtcagactctcccaccagcgactcggtgtcacagtcatccaccgggactctgagctccacgagcttccctcagaacagccgatcatccctgcctagcgatttgcggactatctctctgccctctgcaggacagagcgccgtataccaagccagtcgagtatctgccgtgtctaattcccagcattacccacataggggttctggtggggtgcatcagtacagactgcagccccttcaagggagcggcgttaagacgcagacaggattgtcttag

SEQ ID NO: 33404 - DNA, 4329 bp, Artificial Sequence
  Description of Artificial Sequence: Synthetic coding sequence
atgtcgattgccatccctctgggggttaccacctcagacacgagttattctgacatggccgcaggctccgaccctgaaagcgtggaggcctcccccgccgtcaatgaaaagtccgtctactccacccataactacgggacaacacagagacatggttgcagaggtctcccctatgcaacaataattccacgcagtgaccttaatggactgccctctccagtggaggagcgctgtggagactcgccaaattcggagggcgaaaccgttccaacctggtgcccttgcggtctgtctcaggatggattcttgctgaattgcgataagtgtcggggaatgagccgcggaaaggtgattagattacatagacgtaagcaggacaatatctcgggcggagacagtagcgcaacagagtcttgggatgaagaactgtcaccaagcaccgtgctctatacggcaacccaacatacacccacttccattacacttacagttagaagaactaaaccaaaaaagcggaagaagtctcctgagaaaggccgggcggctcccaaaacaaagaagatcaagaacagcccctctgaggctcagaacctggacgaaaacactactgaaggatgggaaaatcgtatccgattatggaccgaccaatacgaagaggcctttactaaccaatattctgccgacgttcaaaacgcccttgagcaacacttgcatagctctaaagaattcgtaggtaaaccaacgattctggacacaattaataagaccgaacttgcgtgtaacaacacggtaatcgggtctcagatgcagctacagctcgggcgcgtgactagagtccaaaaacatcggaagattttaagggcagctcgagatttagcactggatacgctgatcattgagtaccggggaaaggtgatgttgaggcagcagttcgaagtaaatggacacttcttcaaaaaaccctatcctttcgtattattctattccaaattcaatggagtggagatgtgtgtggacgctcgaactttcggcaatgacgcacgcttcatccgacgcagctgcactcccaacgcagaggttcgtcatatgatcgccgacggcatgatccacttgtgcatttatgctgtatccgctattacaaaagacgctgaggtgactatcgctttcgactacgaatactcaaattgcaactataaggtggattgtgcatgtcacaaggggaacaggaactgtcccatacaaaagcgcaaccccaatgcaaccgaattgccattgctgccacctcctccatctctgcctactataggagctgaaaccaggcgcagaaaagcaagaagaaaggagctggagatggagcagcagaacgaagccagtgaagagaataatgatcagcagtcacaggaagtgccagaaaaagtaactgtaagtagcgatcatgaagaggtggacaaccctgaggagaaacctgaggaggagaaagaagaagtgatcgacgatcaggagaatctcgcccatagcagaaggacaagagaggatagaaaagttgaggccatcatgcatgcgtttgagaacctcgaaaagcgcaagaagcggagagatcagcctctggagcagtccaattctgatgttgagattaccacaaccaccagtgagacccccgtgggagaggaaacgaagacagaagcccccgaatctgaagtctcgaattccgtgagtaacgttaccataccatccacgccccagtccgtgggggttaacacgaggcggagttcacaggcaggcgacatcgctgcagagaaattagttcccaagccacctccagcaaagccatctaggcctagacccaagagtaggatcagtcggtatcggactagcagcgcccagcgcctgaagcggcagaaacaagctaacgcccagcaagcggagctgagccaggcggctctggaggaaggcggatctaacagcctggtcacccccacagaggccgggtcactggattcttcaggagaaaatcggccacttacaggctctgatcctacggtcgtgtcaattaccgggtcccatgtaaatagagcagcctccaagtatcctaagactaaaaaataccttgttacagaatggcttaacgacaaagctgaaaaacaggagtgccccgtagaatgcccgctgcgaatcaccaccgaccctacagtcttggcaacaaccttaaatatgctgcctggccttattcactctcctctcatttgcactacaccaaaacattacatccgctttgggtccccatttatccctgaacgaaggaggagaccactgctgcccgatggcacgtttagctcatgtaaaaagcgctggatcaaacaagctttggaagaaggcatgacccagacatccagtgtgccccaggagactcgtacccagcacctgtaccagagcaatgaaaactcgtcctcatcttccatatgcaaggacaatgctgacctgctgtcacctcttaagaagtggaaaagccggtacctgatggagcagaacgtgactaagctcttacggccactgtcgccggtcactcccccgccaccaaattcaggatccaagtccccccaactcgccacccccggctcttcccaccccggagaggaggaatgtcggaatggttatagtctgatgttctcacccgttacaagcctgactaccgcctctcggtgtaatacacccctccagttcgagctgtgccacaggaaagatctcgatctcgcaaaggtgggatacctggactcaaatacaaacagctgcgccgaccgtccttcgcttcttaactccggtcactctgatctcgcaccccacccttcgttagggcctactagtgagactggattcccgtctagaagcggagatggccatcaaacactggtgcgtaacagcgaccaagcgttcagaacagagtttaacttgatgtatgcttactctcccctcaacgctatgccaagagctgacggcctgtacagagggtcaccactcgtaggcgaccgaaaaccattacacttagacggtgggtattgctcgcctgcagaaggattcagttctcgttacgagcatggtctgatgaaagacttatccaggggtagcctgagccctggaggcgaacgagcttgtgagggcgtgccaagcgctccacaaaatcctccccagcggaagaaggtaagtctcctggagtataggaaaagaaagcaggaggccaaagaaaattcggctggtggtggtggcgatagtgcccagtccaagtcaaagtcagcaggcgctggacagggatcctccaacagcgtgtcagacaccggtgctcatggggtacagggcagtagtgccaggaccccatcctcaccgcacaagaagtttagccctagtcactcatcaatgagtcatcttgaagccgtgagcccgagcgactctcggggaacctctagttctcattgtcgcccccaggagaacattagcagccgctggatggtacctacatccgttgaaagactgcgggaggggggatcaatccctaaagtgctccgcagctcagtgagggtagcccaaaaaggtgagccctcacccacttgggaaagcaacattacagaaaaggacagcgatcccgctgatggcgaaggcccggaaactcttagctccgcattgtctaaaggcgcgacagtttactctccgagccgctacagctatcagctcttgcaatgtgattcccccagaaccgagagccaatctctcctccagcagagctccagtccatttcgcggccatcctactcagagccccggatattcatatcgcaccacagccttacgccccggcaatcccccaagccatggcagttctgagtcctccttgtcttccacgagctactcctctcctgcccacccagttagtactgacagcttggcccccttcacgggtaccccaggatacttttcctcccagcctcattcgggaaactccaccggttcaaacctgccacgccgatcttgcccatcctcggccgcaagtcccacgttacaggggccatcggactctccgacatctgattcagtgtctcaatccagtactggaactctgtcatccactagctttccccagaatagccgctcaagtctgccatcggatctcaggacaattagcttgcccagcgctgggcaaagcgcagtgtatcaagcaagtagagtcagtgcagttagcaattcacagcactatcctcatcgcggatcaggcggagtgcaccagtacagactgcagcctctacaagggtcaggggtcaagacccaaacaggcctgagttag

SEQ ID NO: 33405 - DNA, 489 bp, Artificial Sequence
  Description of Artificial Sequence: Synthetic coding sequence
atgtcaattgctattccgctcggagtgaccaccagcgacacgtcctactctgatatggctgcaggctcagaccccgagagcgttgaagcttcccctgctgttaatgagaagtctgtgtactcgacccataattacggcacgacacagaggcacggatgtcggggtctgccctacgccaccatcattccaaggagcgacctcaatggtctccccagcccggttgaggagagatgcggggattcgccaaattccgagggcgaaaccgtgccaacttggtgcccctgcggactctctcaggacggttttcttctgaactgtgataagtgcagaggcatgtcccggggtaaggttatacggctccacagaaggaaacaggataacatctccgggggggattcttctgcgaccgaatcatgggatgaggagttgagcccttcaaccgtactgtacacagccacacagcacacacctacgtccatcacactttag

SEQ ID NO: 33406 - DNA, 1731 bp, Artificial Sequence
  Description of Artificial Sequence: Synthetic coding sequence
atgcaggtgcctcaggacggggaggatctcgccggacagccatggtatcatgggttgctttcccgtcagaaggctgaagcactcctgcagcagaatggcgacttcctggtcagggcctctggctccaggggtggcaatccggtcattagttgccgctggcgcggatcggcactgcacttcgaggtgtttagggtagcactgcgacctcgacctgggcgacccaccgccctcttccagctggaagacgagcagttccctagcatcccggctcttgtccacagctatatgaccggcagaagaccccttagtcaagctacgggcgccgtagtcagcaggcctgtgacttggcaaggccctctgcggaggagcttttccgaggatacgctcatggacggccctgcaaggatcgagcctctgcgggcgcgtaaatggtcaaacagccagcccgcagatcttgcccacatgggaaggagtcgggaagaccctgccggcatggaagcctcaaccatgcccatcagcgctctgcctcggacctcttccgatcccgtgctgctgaaagccccagctccactcggtaccgtggccgactccctgcgggcaagtgacggccagttacaggctaaagcccccaccaagccacctagaacaccaagcttcgagctgcctgatgcatccgaaagaccccccacatactgtgagttggtgccccgggtcccttcagtacaaggcacaagcccctcgcagtcgtgtccggagcctgaggctccgtggtgggaagcggaggaagatgaggaagaggagaaccgttgtttcacccgaccccaggccgagatctccttctgtccacacgatgcaccgagctgcctccttggaccccagaatcggccactcgaaccccaggtcctgcatacactacgcggcctgtttctggagcatcaccctggttcaacggccctacatttgctgctcgttgattgccaagctaccggtctgctcggggttacccgggatcagcggggaaatatgggcgtttcgtctggtcttgaactactcacgctcccacatgggcaccacctacgtctcgaacttctcgagcgccaccagaccctggccctggcgggcgcgctcgcggtattaggatgtagtgggcccttagaggagagggccgcggccttgaggggactcgtggaactggcattggcactgcgccctggggccgctggcgatttaccaggactggccgccgtcatgggggcattgttgatgcctcaggtgtctcggctggagcacacctggcgtcagttgcgtagaagccacacagaggcagcactcgctttcgaacaagagctgaagccactcatgagagcactggatgagggcgccggaccctgtgatcctggcgaagtcgctctgcctcacgtggctccaatggtgagattgcttgagggtgaggaagtggcaggtccgcttgacgagagctgcgaaaggcttctccgcacacttcatggtgctcgccatatggtgcgagatgcacctaaattccgcaaggtagcagcacagaggttacgcgggtttagacctaatcctgagctgcgggaagcactcacgactgggttcgtaaggcgactgctatgggggtcaagaggagcaggggcacctcgtgccgaacggtttgagaagttccaacgagtcctgggagtgctgtctcagcggctggagcccgaccgctag

SEQ ID NO: 33407 - DNA, 1452 bp, Artificial Sequence
  Description of Artificial Sequence: Synthetic coding sequence
atggagaaaactcttttagctaacctgggcacgactgcttcttgtcctgccagagccagaaaatggtcaaatagccaacctgcagacctggcacacatgggacgctcgcgagaagaccccgccggaatggaggcatcaactatgcctatctctgcactgcctcgaacctcatctgatcccgtcctgctgaaggcacccgcccccttggggactgtcgcagattctttgcgcgcttctgatggccaattgcaggccaaagcaccaactaaacccccccgtacacccagttttgaactcccagatgctagcgagcgccctccaacatactgtgagctggtgcctagagtcccttccgtccaaggcacaagtcccagccagtcctgtccggaaccagaggccccctggtgggaagccgaagaagacgaagaggaagagaatagatgctttaccaggccacaggcagagatctccttctgtccccatgatgcccctagctgcctcctaggtcctcaaaatcggcccttggaaccccaggtgcttcatactctgagagggttgtttcttgagcatcatcctgggagcacggccctgcatttactccttgtcgattgccaggccacaggcctgctcggcgtcacccgcgaccagcgggggaatatgggtgtcagttcgggtctagagttgctgactctgccacacggccatcacctcagactggaattacttgaaagacaccaaactctggccctggcaggagctttagctgtacttggatgcagtgggcctctcgaggagagggctgcagccctgcgagggctggtcgaactggctctggctttgcggccaggcgcggctggtgatttgccgggactggcagctgtgatgggagcacttcttatgcctcaggtgaggggtgaacagggcctcgaggaggccggggtgagggttaccgggaaaaccggagaggaggcctgtagtgatctgttttcgcaggtgtctcggctagagcacacctggaggcagctgagacgcagtcacaccgaggctgctctcgcgttcgaacaggaactgaagcctctcatgagagcactagacgagggagcaggcccctgtgaccccggcgaggtcgctttgccccatgtggcacccatggtgcgcttacttgagggagaggaagtggccggcccacttgatgaaagttgtgaaagactccttaggacgttacatggcgcacgtcacatggtacgggacgcgcctaaattcaggaaagtcgcggctcaaaggttgcgaggttttcggccaaaccctgaactgcgagaagccctgaccacagggttcgtgcgccggcttttgtggggaagtcggggtgccggggcaccccgagcagagcgcttcgagaaatttcagagagtgctgggtgtgctgtcacagagactcgagccagaccgctag

SEQ ID NO: 33408 - DNA, 930 bp, Artificial Sequence
  Description of Artificial Sequence: Synthetic coding sequence
atgctccctgaggattctggcggcagtcccgatgcagccgcctctgataaacacattcagtggctgcttggagctgatggagaggtatgggtgtggattatgggtgagggaccaggcgacaagccctacgaggagatttcggaagagttgattgccgaaagagcacggctgcaggcccagcgcgaggccgaagaactgtggaggcagaaggaagccgagataacaaaaaagttcagagacgctcttgccaatgaaaaagctcgcatccttgctgagaagtggaaggtggagatggaagatcggaaagccgccaaggttctagaggagcgcatccacgaggaattcaaaaggaaggaagaggaagaacgaaaacgtggtgaggagcaaatccgtctgcaagaagaacagcgagcaaaagagctgtactggacacttaagcaagcacagctgcactgccaggcgtccgagaaagaagagagagaatgggaagaacagctgaggagatccaaggccgccgatgaggaacgaagtagacgcgcccagagagctcgcgacgagtatcgccatcactcccttcgcgcaatccaaaaagggactgtggcagggttatcctccatgttccgagagctaggtcagtcacatgagcaggaggctaggctataccatcacttaccagaccccgggcttcctcagcccctggccctgccggtaagccggacttgggagagacctctcagaccagtctctcgtgatgtgatcgtgcggtggttcaaagaggagcagttgcccagacgcgccgggtttgagagaaataccaaatttattgcaccttggtttcacggaggaaattaccactgttttaggagaagggttacaagcggaaccctgcgcaccgaaggacagcccaccaggctgccatctgtggtttag

SEQ ID NO: 33409 - DNA, 1074 bp, Artificial Sequence
  Description of Artificial Sequence: Synthetic coding sequence
atgttgcagcaaatcctccacgacatgtacattgatccggaactactcgcagagctgagcgatgtgcagaagcacattctgttctataagatgcgcgaagaacagttaagaagatggaaagaaagagaaacatgggaggccctcgcccaagatgagggtctgcggccccctaagaccaaaagagctgcatccgataaacacattcaatggctactgggggccgacggagaggtgtgggtttggatcatgggcgaaggacccggtgacaagccttatgaagagatatccgaggaattgattgcagagcgagcccgcttacaggcacagagggaagcagaagagctttggagacaaaaagaagccgagataacaaaaaagtttcgcgacgccttggctaacgagaaggccaggattcttgccgagaagtggaaagtggaaatggaagatcgaaaggccgctaaagtattggaggaacggattcacgaagaattcaagcgcaaggaagaggaagaaagaaagcggggtgaggagcagattagactacaagaggaacaaagggctaaagagctctactggacgttaaaacaagctcagctgcattgtcaggccagtgaaaaagaggagcgggaatgggaggaacaactgagacgaagcaaagccgcggatgaggaacggagccgcagggcacaaagggctcgggacgagtaccgccatcattcacttcgcgctatccaaaaggggacagtggctgggctgagttccatgttcagggaactaggtcagagccatgagcaggaggcacgcctgtaccatcacttgccagaccccggcctgccccaacctctggcactgcctgtgcgcacctgggagagacctcttcggccagtatcaagggacgtgatcgtccgctggttcaaggaagagcaacttcctagaagggccggtttcgagaggaatactaagttcatcgcaccctggttccacgggggaaattaccactgtttccgccgccgggtgaccagcggcaccctgaggacagagggccagccaactagattgccgagtgtggtatag

SEQ ID NO: 33410 - DNA, 648 bp, Artificial Sequence
  Description of Artificial Sequence: Synthetic coding sequence
atgcttcagcagattctccatgacatgtatattgaccctgaactccttgcagagctcagtgatgtccagaagcacatcctgttttacaagatgagagaagagcaactgaggcgatggaaggagcgagaaacttgggaggccctggctcaggatgagggccttagacctcccaaaaccaaacgagctagcgacaagcacatccagtggctgctgggggccgatggagaagtgtgggtctggattatgggcgaaggaccaggagacaagccgtacgaagagatcagcgaggagctaatagccgagcgggcacgcctccaggcacagagagaggccgaggagctctggcggcagaaagaggctgaaatcactaaaaaattccgggatgccttagccaacgagaaagcaaggattttggctgagaagtggaaggtagaaatggaggatagaaaggctgccaaggtgttggaagagagaattcacgaagaattcaaacgaaaagaagaagaggaacgcaagaggggagaagaacagattagactgcaggaagagcagagagccaaggagctgtactggacacttaagcaggcccagctgcactgtcaggcctctgagaaggaagagagggagtgggaggaacaatgtgaatag

SEQ ID NO: 33411 - DNA, 1296 bp, Artificial Sequence
  Description of Artificial Sequence: Synthetic coding sequence
atgctccagcagatactgcatgacatgtacattgacccagaactcctggctgaactcagtgacgtgcagaagcatattctattttataaaatgagagaggagcagctcagacgatggaaagagcgcgagacctgggaggccctagcacaggatgagggccttcgtcccccgaagaccaagcgcgcatctgacaaacacattcagtggctccttggcgcagatggggaggtctgggtctggattatgggtgaaggacctggtgataaaccctacgaagaaatcagtgaagaactgatcgccgaacgagcaaggcttcaggctcagagggaggccgaagagctgtggagacagaaggaggctgagattacaaagaaattcagagatgcattagctaacgaaaaggccagaatccttgcagagaaatggaaagtcgagatggaggacagaaaggccgccaaggttctggaggaaagaatccatgaagagttcaaaagaaaggaggaagaggagaggaagcgcggcgaggaacagattagactgcaggaggagcaaagagctaaagaactgtactggaccctcaaacaggcacagcttcactgccaggcatcagaaaaagaggagagggaatgggaggagcagctgagacggtctaaagctgcggacgaggaacgatcacgcagggcgcagcgtgctcgggatgagtataggcaccatagcctacgcgccatccagaaagggaccgttgccggtctgtcatccatgtttagggaactggggcagagtcatgaacaggaagcacggctataccaccatctaccagaccccggattgccacagcccttagcccttcctgtgcggacttgggagaggcccctgcgaccagtgtcaagggacgtcatagtccgttggttcaaagaggaacagctaccacggagggccgggttcgaacgaaataccaagtttattgccccatggttccacggcattatcagccgggaagatgccgaggccttgttagaaaatatgacggagggcgccttcctggttagggtctctgagaagatctggggctacactctcagttaccgcttacagaagggttttaaacatttcctggtcgacgcttcaggggacttctactcatttctcggcgtggacccaaatagacatgctacactgactgatttggtggacttccataaagaagagattatcactgtgagcgggggtgagctcttgcaggaaccctgtggccagcgagactcaccccccgactaccacctcctgttcgaatag

SEQ ID NO: 33412 - DNA, 1020 bp, Artificial Sequence
  Description of Artificial Sequence: Synthetic coding sequence
atggcacatgcgctcaggagaattctgtactccacttggtgccccgccgattgccagtttgcctttatggcccgaaatccacgcagtccagcttctaagctgttttgtcacctgtttgtgggctcccagcccggggaggtacaaatcttacacttgctgctgtgcagatctttccagctagcgtatctcctgcagcaccccgaggagagggcccaaccagagccttgccccggcccaactggagaggttcccctgaaaccgctgagttcaagcggcggcctcgtgcgtgaacccttcgggcgggaccagctttcacaaaacgtgcacgccctggtgtcatttaggaggctgcccgcggagggactggtgggctccgggaaagagctcccggagtcagaggggcgggcacgccacgctaggctcggtaacccatattgcagcccaacgcttgttcggaagaaggcaatcagatccaaagtcatccgatcgggtgcatatcgaggatgtacctatgaaacacagctgcagctgtccgcgagagaggcgtttcccgcggcctgggaagcgtggcctcgaggacccggcgggcatagctgcctcgtcgagagtgaggggtccctgactgaaaatatctgggctttcgcaggaatatcccgcccctgtgcccttgcccttctgcgcagggacgtgctgggggccttcctcctgtggccagagctcggagcatcgggccagtggtgtctctccgtgaggacacagtgtggtgttgttccccaccaggtgtttagaaatcacctgggtcggtattgtcttgagcacttgccagctgaatttccatcactggaggccctcgtcgaaaatcacgccgtgactgagcgcagcctgttctgcccactagatatgggaagattgaaccccacatatgaagaacaagactgcggtccccctgggagaccgcctcgcacactgcggccccttagtcacgcgaagtctgaagcagagctccaggggcttggatag

SEQ ID NO: 33413 - DNA, 1272 bp, Artificial Sequence
  Description of Artificial Sequence: Synthetic coding sequence
atgcagaaggctggagcaggcggtcgcagggccagcgattgcggcctagcaccccatagacctcgctgtatcacaaagtttgctcagtacgttgggagtttcccagtcgacgacctggatacccaggagtccgtgtggctggtgcagcagcagctctgggctctcaaggactgccctagacgccgcgcagttatcctgaagttttcgttgcaggggctaaaaatttactccggagaaggtgaagtgttgttaatggcccacgccctaaggaggatcctgtattctacctggtgtcccgccgactgccaatttgccttcatggcaaggaatccaaggtcacctgcgtcgaaattgttttgtcacctgttcgtagggagtcagccaggtgaggtacagattctccatctgcttctttgtcgatccttccagctcgcatacctgttgcagcaccctgaggagagagcccaacccgagccatgccctggccccacaggggaggtcccactaaaacccctgagctcatctggtggactagtcagagagcctttcgggcgggaccagctgtcacaaaatgtccacgccctggttagcttccgtaggctccccgccgagggcctggttggcagtggaaaggagctgcccgagtcagaaggccgggcgcgccacgctcgtctgggaaacccttattgctcccctacactggtgcgcaaaaaagcgattcgttctaaagtaatcagatctggcgcttacagaggctgcacttacgaaacacagttgcagctcagcgccagggaggcgttcccagcagcctgggaggcgtggccccggggcccagggggacattcgtgcttagtggagtccgaagggtccctcacagagaatatctgggccttcgcggggataagcagaccatgcgccttggcacttctgcggcgggacgttctgggcgctttccttctgtggcccgaactgggggcatcaggacaatggtgcctctccgtgagaacacagtgcggagtcgtaccacaccaagtctttcgcaaccacttagggcgctactgcttagagcacctgcccgctgaattcccctcattagaggccctggtcgagaaccatgcagtgaccgagcgcagcctgttctgcccactggacatgggaaggcttaatcctacttatgaagagcaggactgtggaccacccggacgtccccccagaacattgaggccactttcccacgccaagagcgaggccgagctccagggcctcggatag

SEQ ID NO: 33414 - DNA, 381 bp, Artificial Sequence
  Description of Artificial Sequence: Synthetic coding sequence
atgcagaaagcaggtgccggaggcagacgggctagcgattgtggcctcgcaccccaccgcccaagatgcattactaagtttgcccaatacgtggggtcatttcctgtggatgatttagatacccaggaaagcgtctggctcgtacagcagcagctttgggcgctgaaggactgccctcggaggagagccgtgatcctgaagttcagtctgcagggtctcaagatttattcaggcgaaggtgaagtcctgctgatggcccacgctcttagacggatcctctactcaacttggtgccccgccgattgtcagtttgcttttatggcccggaaccctagatccccagctagcaagctgttctgccatctgttcgtgggatcttag

SEQ ID NO: 33415 - DNA, 396 bp, Artificial Sequence
  Description of Artificial Sequence: Synthetic coding sequence
atgcaaaaggcaggcgctggaggaaggagagcctcagattgcggactcgccccccataggcctcgttgcattactaagttcgcccaatatgtcggtagttttccggtcgacgacttagatactcaggaatccgtctggctggtgcagcagcagttatgggcactcaaagactgcccaagaagacgcgctgtcattctgaagttctcactgcaggggctgaaaatctactccggcgaaggcgaggtccttctgatggcccatgcattacgtaggattctgtatagcacctggtgcccagccgactgtcagtttgccttcatggctcggaacccccgatcacccgcttccaagttattctgccacctctttgtaggctcccagcctggagaggtttag

SEQ ID NO: 33416 - DNA, 213 bp, Artificial Sequence
  Description of Artificial Sequence: Synthetic coding sequence
atgcagaaggctggagctggcggacggcgcgctagtgactgcggcttggcaccgcaccggccccgctgcattactaaattcgcccagtacgtgggctcattccctgtggacgatctggatacccaggaaagcgtatggctcgtgcagcaacagctgtgggccctgaaggactgtccccgacgtagagcagtcattctcaagttcagtttgtag

SEQ ID NO: 33417 - DNA, 528 bp, Artificial Sequence
  Description of Artificial Sequence: Synthetic coding sequence
atgtatgcctcttcttatcctccgcctccccagctgagtccacggagccacctgtgtccgccccccccacatcctaccccaccacagttgaacaacttgctgctcctggaaggtaggaagtcatctctcccatcggtggcacccacagggtctgcatctgcggccgaggattcagatctgctgacacaaccctggtactctggcaattgcgaccggtacgctgtcgagtcagcgctcttgcacctccaaaaggatggagcttacacggttaggccgtcttctggaccgcatggatctcagccatttaccctagctgtattgctgagagggagagtgttcaatattccgattcgacgccttgatggtggtcggcactatgcattagggagagaaggtagaaatagagaagagctgttcagctcggtggcagctatggtgcagcactttatgtggcaccctcttccattagttgataggcacagtgggtcgagggaattgacctgccttctgttcccgaccaagccttag

SEQ ID NO: 33418 - DNA, 432 bp, Artificial Sequence
  Description of Artificial Sequence: Synthetic coding sequence
atgccctctggtccactgcctagaacctctgtggttcccaggcctacaaccgccccacaggaaacaagaaacggaacggccgacgcagcctcaaaagagggacggaagtcatcattgccttccgtggcccctaccggatctgcttcagcggccgaagatggggcttacactgtccgtcccagcagtggtccacacggaagtcagcccttcacgttggctgtgctgctgcggggccgtgtattcaacatccccatccgccgcctggacggcggacgccactacgcactgggacgagagggccggaatagagaagagctgttctcatccgtggccgcaatggttcaacattttatgtggcatccgctaccacttgtagatcggcacagcggcagccgagagctaacctgtttactgttcccaactaagccatag

SEQ ID NO: 33419 - DNA, 1896 bp, Artificial Sequence
  Description of Artificial Sequence: Synthetic coding sequence
atgaacggcgctggaccaggccctgcggcggctgcccccgtgccggtacccgtgcctgtccctgattggcgacaattttgcgaactgcacgcccaggccgctgccgtcgatttcgcacataagttctgtagattcctcagagacaaccccgcctacgacaccccggacgctggtgcaagtttcagccgtcatttcgccgcgaattttctggatgtttttggagaggaagtgcgaagagttttagtcgctggccccacgaccaggggcgccgcagtcagtgctgaggctatggaacccgagttagccgatacatcagcattgaaggccgccccttacggacattcccgatccagcgaggacgtttctactcacgcagctacaaaagcgagagtaagaaagggcttctccctgcgaaacatgtcactttgtgtagtagatggtgtacgggacatgtggcatcggagggcaagccccgaaccagatgctgccgctgctcctagaacagccgagccaagagacaagtggacccggagactgcggctcagccgcacactcgccgccaaagtcgagctggttgacattcaacgggaaggagctctacggtttatggtggctgatgatgcagctgccgggtctggcgggtctgctcagtggcaaaaatgtaggctgctcctgagaagagcagtggctgaagagcggtttcgactagagttcttcgtgccccctaaagcctcacgacctaaggtgtcaatcccattgtcagccatcatcgaggtccgaaccaccatgcccttggaaatgcccgagaaagacaacaccttcgttctcaaagtggaaaacggagccgaatacatcctagagaccatagactcccttcagaagcacagttgggtggctgacattcaaggatgcgtggatccggggccaggccccggagacctcgaagggagttggacacgtagttgccttcaccctaaaagggcaagcgaacattgggagctaggccgtgatggaagcgagtcccccaagggatggggcccaggcgctgtggctcacatatgcgaccctaatacgctgggtgggcctgcagtggaaacaggcttccaccatgttggacaggctgggctcgagctccagacttcttccgatcctccaaacagcgcatcgcgctcggcgacttccggtgagcaaggcgcagagacggatcctgaggcagaacccgagcttgagctgagcgattatccatggttccatggtacgctgtcccgcgttaaagcagcccagctggtgctggccgggggaccccggaatcatggacttttcgtgatccgtcaaagcgaaactaggcccggcgagtatgtccttacgttcaactttcagggcaaggctaaacacttgagactcagcctcaatggacacggccaatgtcacgttcaacatctatggttccagtctgtgcttgatatgctccgccattttcacacgcaccctattcccttggaaagcgggggctcagccgatattaccctgaggtcctatgtcagggcccaggatcctcccccggaacctggtccgactccgcctgctgccccagctagtccagcctgttggagcgacagccctggccaacactatttcagcagcctcgcagctgcagcatgtccgcctgcctcgcctagcgatgccgcaggtgctagctcttccagcgctagcagctcaagcgcggccagcggtccagcccctccgagacccgtggaaggccagctgagcgctcgttctcgttccaattccgcagaaagactgcttgaggctgtggcagccaccgctgccgaggagccccctgaagcagctccaggcagggccagagctgtcgagaatcaatattcattctactag

SEQ ID NO: 33420 - DNA, 714 bp, Artificial Sequence
  Description of Artificial Sequence: Synthetic coding sequence
taagagcaaggtgcagagaccgaccctgaggctgaacctgaacttgagctttcagactatccctggtttcacgggacactgtctagagtaaaggccgcccaactggtgctcgctggcggccctcgcaaccacggtttgttcgtaataagacagtccgagaccaggcccggtgagtatgttctgacgttcaattttcagggcaaggcaaagcacctccggttaagcctcaacggccacggacagtgccatgtccagcatctgtggtttcagagcgtactggacatgcttcgccacttccacactcacccaattcccctggagagcgggggctctgccgatatcacactgcggagctatgtgcgggctcaagatcccccaccagagcccggacccactccgccagccgcccccgcctcaccagcttgctggtccgacagccccggccaacattactttagcagtctggccgctgcggcctgcccaccagccagtccttccgatgcggctggtgctagttcctcatctgccagcagctccagcgccgcctctggtccggcccccccacgacccgtcgaggggcaactgtccgctagaagcagatctaattctgccgaaaggctgctagaagccgtcgctgccacagctgcagaggagccacccgaagctgccccaggccgggcccgtgcggtcgagaaccagtattccttctactag

SEQ ID NO: 33421 - DNA, 927 bp, Artificial Sequence
  Description of Artificial Sequence: Synthetic coding sequence
atgaacggagccgggcccggacccgccgccgccgccccagtccctgtgcctgtccctgtgccagattggcgtcagttctgcgagttacacgcacaggccgcagcggtggactttgctcacaaattttgtcggttcctccgagacaatcccgcttacgacactcccgatgctggcgcgtccttttctaggcacttcgccgccaattttttggacgtttttggcgaagaagtccggcgggtgcttgttgcaggccctactacacgcggggccgctgtatcggctgaagcgatggaacctgaacttgccgacacgtcagctctcaaagcggcgccatatggccactcaaggtcctctgaggatgtctccacccacgccgcaactaaagctagggtgcgcaagggatttagcttgcggaatatgtcactgtgcgttgtcgatggcgtcagagatatgtggcatcgcagggccagccccgaaccagatgctgccgcagctcccaggaccgccgagccacgggataagtggacacgccgacttcggctcagccgcacgttggctgcgaaagtggagctggttgatattcagagggagggggctctgcggttcatggtggccgacgacgcagccgctggctctggtggcagtgcccagtggcagaaatgtcgcctcctgttacgtagagccgttgctgaggaaaggttccgtctggaattcttcgttccacctaaggcctctaggcccaaggtttccatccctctatccgcaatcatcgaagttagaactacaatgcctctagaaatgcctgagaaggacaacacattcgtactcaaggttgaaaacggcgccgaatacatcctggaaacgatagacagtttgcagaagcactcttgggtggctgacatccagggatgcgtcgaccctggatag

SEQ ID NO: 33422 - DNA, 2016 bp, Artificial Sequence
  Description of Artificial Sequence: Synthetic coding sequence
atggacccttcatactgccctgcacatggattccctagccaagatgctttgtggcccttatccagccagcagtggtcatcagcccattactctgaacccgccgctggaggatgtgatggtactgaagcaatgaacggagctgggcccggcccggcggccgctgcacccgttcctgtgcctgtgcccgttcctgattggcggcagttctgtgagctccacgctcaggcagctgcagtggactttgcccataaattttgtcgcttcttgagagataacccggcttacgacacaccagatgcaggggccagcttttcgaggcactttgccgccaacttccttgacgtgtttggagaggaagtgcggcgagtgctggtcgccggccccacaacaagaggggctgctgtgtcagctgaagctatggagcccgagttggcggacacatccgcccttaaggctgccccttatggacacagccggagctcagaagatgttagtactcacgcagctacaaaagcccgggtgaggaaaggcttctccctacggaatatgtctctatgcgtcgtggacggcgttcgagatatgtggcatagaagggcatccccggaacctgacgcagccgcagcaccccgcaccgccgagccaagagacaagtggaccaggagactacgcttaagtcgtactctcgctgctaaggttgaactcgtagatatccagcgggaaggcgcgctacggtttatggttgctgacgacgccgccgcagggagtggcggttcagcccaatggcagaagtgcaggttattgctgcgacgtgccgtggcggaagagagattccggttggagtttttcgtgcctccaaaagcctctcgaccaaaggtatcaattccactatctgccataatcgaggtgcgtacaactatgcccctggagatgccggagaaggacaacacattcgtgctgaaggtggaaaacggcgctgaatacattctggagaccattgactccctgcaaaaacactcttgggtagccgatatacagggttgtgtcgatccaggattatggccaggagacctggaagggtcctggacacggtcatgcctgcatcctaaaagggcttccgagcactgggagttgggccgcgatggctcagagtcacccaaggggtggggtcccggggccgtcgcacacatttgctggtcccggacaccagacttaaagaggcatctgagctcgcatatctatctgtttgtaccactgagcccttcacctcatgtcccacatacagtgattcctacttccggagaacagggtgcagagacagatccggaggccgaacccgaattagagctgagtgactacccatggttccacgggactctctctagggttaaagcggcccaactggtcctcgctggaggtccccgaaaccacggcttgtttgtgatacggcagtctgagacgaggccaggcgagtacgttctgactttcaatttccaggggaaagctaaagcgagccacctcagactgagtctgaacgggcatggacagtgtcacgtgcagcatttgtggtttcagagcgttttggacatgctgaggcacttccatacccatccaatccccctcgaaagcggcggttctgccgatataacactccggagttatgtgcgggcccaggatcctccaccagagccagggccaactcccccggccgcccctgctagcccggcatgttggtctgatagtcctggccagcattactttagcagcctggcagccgcagcgtgtcccccagcctcaccatccgacgctgcaggggccagttccagcagcgcaagctccagtagtgccgcgtccggcccggccccccctagacccgtcgagggccaactgagtgctcggtcccgcagcaactctgccgagcggctgctggaagctgtagctgcgacggctgccgaagaaccacctgaggccgcccccggccgcgccagggcagtcgaaaatcagtattccttctattag

SEQ ID NO: 33423 - DNA, 1899 bp, Artificial Sequence
  Description of Artificial Sequence: Synthetic coding sequence
atgaacggcgctggcccaggccccgcagctgcggctcccgtacccgttcccgtgcccgtccccgactggcgtcagttttgtgagctgcatgcgcaggccgctgcggtggacttcgctcataagttctgtcggttcctgcgcgacaatcctgcctatgacacccctgatgccggggcctcttttagccggcatttcgctgcgaacttccttgatgtgtttggggaggaggtaagaagggtgctagttgccggacctactactaggggcgctgctgtctccgcagaggctatggagcccgaactggcagacacaagtgcactcaaagccgcaccatacggtcatagccggagctcggaggacgtctccacccacgcagcgacaaaagccagagttcgtaaggggtttagccttaggaacatgtcattatgcgttgtggatggcgttagggatatgtggcataggcgcgcttctcctgaacccgatgcagcagctgcacctcgtaccgctgaacctagagacaaatggacacgtcggctgagactgtcacggacactggctgcaaaggtcgagctggttgacattcagagggagggtgccctgcggttcatggtcgcagacgatgcagcggccggtagtggaggaagtgcccagtggcagaagtgccgcctgctgcttaggagggcagtggcggaagagcgattcaggctggaattctttgtgcctccgaaagcatcccgcccaaaggttagtattcccctttcggccattatcgaagtgcgcacaaccatgcccctagaaatgcccgaaaaggacaacacattcgttctgaaggtggagaatggggcggaatatattctggagaccattgatagcttgcagaagcattcctgggtggccgatatacaaggctgtgtcgacccgggcgatagtgaggaagatacagaattatcttgcacccgcgggggatgtctggcatcaagggtggccagctgcagctgtgaattgttgacagacgccgtggaccttcccaggccccctgagacaacagctgtaggggctgtggttaccgctccacattcacggggccgtgacgctgtgagggagagcctaattcacgtccccctggagaccttcctccagacccttgagagcccaggggggtctggttctgattctaacaatactggagagcaaggcgctgaaaccgacccagaggccgagccagagttagaacttagcgactacccatggtttcacggcactttatcacgggtgaaggcggcccagctggtactggccgggggaccacggaaccacggactattcgtgattagacagtctgagacccgccctggcgagtacgtgctgacatttaattttcagggcaaggctaagcacctgcgactgtcactgaatggccacggtcagtgccatgtccagcacctctggtttcaatccgtgctggatatgctgcggcacttccacacgcacccgataccgctggagagcggtggctcggctgacattacactgcggtcctacgtgagagcacaagacccaccccccgagccagggcccacaccccccgccgccccagcgtccccagcttgctggtccgactcacccggccagcactatttcagcagcctggctgctgccgcatgcccaccagcctctccgtctgatgcagccggcgcctcatctagctcggccagcagttctagcgcagcctctggaccggctcccccacggcccgtcgaggggcagctgtcagctcgaagccgctcaaatagcgcagaacgccttttagaagccgtggctgcaactgcggcagaggaacctcccgaagccgccccggggcgcgctcgggcggtggagaatcagtatagcttctactag

SEQ ID NO: 33424 - DNA, 1236 bp, Artificial Sequence
  Description of Artificial Sequence: Synthetic coding sequence
atgacagaaatgtccgagaaggaaaacgaacccgatgatgccgcaacacatagcccgccaggcaccgtgagcgctttgcaagaaacaaaactgcaaagatttaagaggtccttgtccctgaagacaattcttcggtccaaaagtctcgagaactttttcttgagaagtggcagcgaattaaagtgtcctactgaggtgctcctaacaccgccgacccccttgccccccccgagcccacctcctacagccagtgacagggggctcgcgactccaagcccgtccccttgtcccgtccctcgccccttggctgcattgaaaccagtcaggctgcattcatttcaagagcacgttttcaaaagagccagcccatgcgagctgtgtcaccagttaattgtaggtaactcaaagcagggtttaaggtgcaaaatgtgtaaggttagcgttcacctctggtgtagcgaggagatttctcatcagcagtgtccaggaaaaacctctactagcttccgccgaaacttttcaagcccactgctcgtgcatgagcccccaccagtgtgtgctacaagcaaagaaagccctccaactggggacagcgggaaagtagacccagtgtacgagaccctgaggtacggcacaagcctggcacttatgaacagaagctctttttctagtacaagtgagagccctaccaggagtctcagcgaacgagacgagctgaccgaggatggcgaggggagcattaggagcagtgaggaaggcccgggcgacagtgcatcccctgtgtttacagcaccagctgagtcagaaggtccaggccctgaggaaaagtccccggggcagcagttgccaaaggccacactcagaaaagacgtcggtcccatgtactcttacgtggcgctctataagttcctccctcaagaaaataatgatttagcgctacagccaggcgacaggattatgctggtggacgactctaacgaggattggtggaaaggtaaaatcggggatagggtcggatttttccctgccaattttgtccagcgggtgcgacccggtgaaaacgtatggcggtgctgccagcccttctccggtaacaaagagcagggctacatgagcctgaaagagaaccaaatttgcgtgggcgtcggccggtctaaagatgcagacggatttattcgcgtttcaagcggcaagaagagaggcctcgttccggttgatgcattgactgagatctag

SEQ ID NO: 33425 - DNA, 1095 bp, Artificial Sequence
  Description of Artificial Sequence: Synthetic coding sequence
atgaccgagaaagaggtactcgaatcaccaaaaccctcctttcccgccgagacgaggcagagcggattacagagattaaaacagctgctgagaaagggttcaaccggcacaaaggaaatggaactgcctcccgaaccccaggcaaatggggaagcagtcggagccggtggcggacctatctactacatttatgaagaagaagaggaagaggaggaagaagaggaagaaccaccgcccgagccccctaagcttgtaaatgacaagcctcacaaattcaaagatcacttttttaaaaagcctaaattttgcgacgtgtgcgcccgaatgattgtgctcaacaacaagttcggtctccggtgtaagaattgtaagaccaacatacacgaacactgccagtcatacgtcgaaatgcaacggtgctttggaaaaatccccccgggcttccaccgggcgtacagtagccccctgtattctaatcagcagtatgcttgcgtcaaggacctgagcgcagccaatcggaatgatcccgtgttcgagacactgcgcaccggagtcatcatggcgaacaaagaaagaaagaaggggcaggccgataagaaaaatcctgtcgccgcaatgatggaggaagagccggaatctgcccggcccgaggaaggcaaaccacaagacggaaacccagagggcgataagaaagccgagaagaagaccccagacgataaacataaacaacctggttttcagcagagtcattatttcgtcgccctgtatagatttaaagctctggagaaggacgacctggacttcccccctggggagaagattactgtaatcgatgactcaaatgaggagtggtggaggggtaaaataggggaaaaagttggcttctttccacctaactttatcattcgtgtccgggccggcgaacgcgttcatcgggtgactagatcttttgtgggaaacagagaaatcgggcagatcactctaaagaaggaccagatcgtagttcaaaaaggcgacgaggcaggagggtacgtgaaagtctacactggcaggaaggttggactgttcccaacggactttctcgaagagatctag

SEQ ID NO: 33426 - DNA, 507 bp, Artificial Sequence
  Description of Artificial Sequence: Synthetic coding sequence
atgaccgaaaaggaggtgctggagagccccaagccaagtttcccagccgagacgagacagagcggcctccagcggctgaagcagctccttcggaagggctctacagggacgaaagagatggagctgccccctgagccacaggctaatggcgaggccgtaggggccggtggagggccaatttattacatatacgaggaggaggaggaggaagaggaggaagaagaagagccaccccccgagccccccaagttagtgaatgataaaccacacaagtttaaggaccatttcttcaaaaagcccaaattctgcgacgtgtgtgcccgtatgattgtccttaacaataaatttggcctgaggtgtaaaaattgcaagacgaatatccacgagcattgccagtcctacgtcgaaatgcagcggtgttttggaaagatccctccaggcttccacagagcatactcatcaccgctttactccaaccagcagtacgcctgcgtaaaggatctttag

SEQ ID NO: 33427 - DNA, 978 bp, Artificial Sequence
  Description of Artificial Sequence: Synthetic coding sequence
atggagctccctcctgagccacaggccaatggtgaggccgtgggggccggcggcggaccaatctattatatatacgaggaagaagaggaggaagaagaagaagaagaggaaccaccgcctgaaccacccaagctggtgaacgataagccgcataagtttaaagatcattttttcaaaaagcctaagttctgtgacgtttgtgccaggatgatcgttctgaataataaatttgggctaaggtgcaagaattgtaaaactaatatccacgaacactgccagagttacgtggaaatgcagcgctgcttcgggaaaattcctcctggtttccatcgagcctattcttccccgctgtatagcaaccagcaatacgcttgcgtgaaggacctgtctgcagcgaataggaatgatcccgtgttcgagaccctgcggaccggagtcatcatggctaacaaggagaggaaaaaaggtcaagctgataagaagaacccagtggcagccatgatggaagaggagcccgagtcagcgcgccccgaggagggcaagccacaggatggtaatcctgagggggacaagaaagcagagaagaagacgcccgatgataagcataaacagcccggattccaacagagccactacttcgtcgctttgtatcgatttaaagctctggagaaggatgatttggactttcctcctggtgagaagattaccgtcatcgatgatagcaacgaagaatggtggagaggcaaaatcggtgaaaaggtgggtttttttcctcccaattttatcatccgggtgagagcaggcgaacgggtccatcgcgtgacgcggtcttttgtcgggaacagggaaattggacagattaccttaaagaaggaccagatcgttgtgcagaagggggacgaagccgggggctacgtcaaggtgtacacagggaggaaggttggcctgttccctactgatttcctggaggagatatag

SEQ ID NO: 33428 - DNA, 4194 bp, Artificial Sequence
  Description of Artificial Sequence: Synthetic coding sequence
atgccttccaagcctgagggggctgcaaagactataggctcttacgttcccggaccgcgctccagatcaccatcactgaacagattggggggagctggtgaggatggtaagcggcctcaacccttgtggcacgtcgggtccccatttgcgttgggagcaaataaagatagtctcagcgcctttgagtacccgggccccaagaggaagctgtattcggccgtgccaggacggttatttgtggctgtaaaaccttatcagccgcaggtggacggcgaaataccccttcaccgaggcgacagggtgaaggtgctgtcgattggagagggaggcttttgggagggatcagcaaggggacacattggctggttccccgccgagtgcgtggaggaagtccagtgtaagccgcgggattcacaggcagaaacaagagccgatagatctaaaaagctgtttcggcactacaccgtgggttcttacgactcttttgatactagctcggactgtatcattgaggagaagaccgttgtgctgcagaaaaaagacaacgaagggttcggcttcgtcctccgtggggcaaaagccgatactccaattgaggaattcacgcccaccccagcattccccgcactgcaatacctggagtccgtggatgagggaggcgtggcatggcaagccggacttcgcacgggggacttcttaattgaagtgaataacgagaacgttgtgaaggtggggcaccgtcaggttgtgaacatgataaggcagggcggaaatcacctggttctaaaggtagtgacagtgacccgcaatctcgaccctgacgacacagctagaaaaaaggcgccccctccacctaagcgggcgccaacgacagctcttaccctcagatctaaatctatgaccagtgaactggaggaactggtagataaggcgagtgtgaggaagaaaaaagacaagcccgaggagatcgtacccgctagtaaacccagcagagcagcagagaatatggccgttgagccccgcgtggccaccataaaacagcgcccaagcagccggtgctttccggccgggtctgacatgaactctgtgtatgagcgccaggggatcgccgtgatgactccaacagttcccggatctcccaaagccccctttttgggcatcccaagaggcaccatgcggcggcagaaaagcattgattctagaattttcttaagcggaataacagaggaggagaggcagtttctcgctcctcctatgctcaagtttacacgctcactttccatgccggacacttctgaagatatcccacctcccccccagtctgtaccaccgtcaccccccccacctagcccgaccacatataattgccccaagagccctaccccccgtgtgtacggtaccattaagcctgcgttcaaccagaatagcgctgccaaggtcagtcccgccactcgaagtgatacagtggcaactatgatgagggaaaaaggcatgtattttaggcgggaactagataggtacagcctggactctgaagatctgtactctcggaacgcaggcccccaggctaattttcgaaacaagcggggccagatgcctgagaatccatactctgaggtcggtaagatcgcctccaaggctgtgtatgtgcctgccaaacccgccaggaggaaaggcatgttggtgaaacagtcgaacgtagaagatagcccggagaagacatgcagtattccaataccaacaatcatcgttaaggaaccatctacttcctccagcggcaaatccagccagggcagcagtatggagatcgatcctcaggctccagaacctcctagccagctgcgccctgatgagtccctcaccgtctctagtcccttcgcggccgcaatcgcaggcgccgtccgcgatagggaaaaacgtttggaggccagaagaaattctccagcgttcctgagcactgacctcggagacgaagatgtggggctggggccacccgccccacggacccgccctagcatgttcccggaggaaggtgattttgccgatgaggatagtgccgagcagttatcctctccgatgcctagtgctacccccagggagcccgagaaccatttcgtaggtggggctgaggcaagtgcaccgggggaggccgggcgcccgcttaacagtacgagcaaagcccagggacccgagagttcacctgctgtgccatctgccagttcaggaacagccgggcccgggaattacgtgcaccctctgactgggaggttgctggacccctcgagccccctggcattagctctgtcagccagggatagagctatgaaagagagtcagcagggccctaagggagaagcgcctaaggcagaccttaacaagccattgtatatcgatactaagatgagaccttcgcttgacgccggttttcctacagttacgcggcaaaatacccgtgggccgctgcggcggcaggagacggaaaacaagtacgagaccgatctgggcagagaccgtaaaggcgatgacaaaaagaatatgctgatcgacataatggacacgtctcagcagaaatccgctggcctactcatggttcacacggtggatgccacaaaactggacaacgcattgcaggaagaggatgagaaggcggaagtggaaatgaagcccgattcaagtccaagtgaagtgccggaaggtgtctcagagacagagggggccctgcaaatttctgccgcacccgaaccaacaactgtacccggaaggactatcgtagccgtgggatccatggaggaggccgttatcctccccttccggattccgcctccccctctcgcttccgtcgatcttgacgaagatttcatcttcaccgaacccctgccacctccactggagttcgcaaattcttttgacattcccgacgaccgcgccgcttccgtgcctgcactgtccgacctggtcaagcagaaaaagtccgacactccccaatcccccagcctcaacagtagtcagccaaccaactccgcagattcaaaaaagcccgccagcctgtcaaactgcctgccagcttcattcttgccaccccctgagtctttcgacgctgtggccgatagtggaattgaggaagtagacagtaggtcttcctccgaccaccatttggaaaccacatctaccatctctaccgtgtcctcaatcagcacactgtcttctgagggtggagaaaatgtcgacacatgcactgtctacgcagacggccaagctttcatggtagataaacctcccgtcccccccaaacctaagatgaagccaattattcataagagcaacgctctgtaccaggatgctctcgtcgaggaagacgtcgacagtttcgttatccccccgcccgcaccccccccgcccccaggttccgctcaacctggaatggcaaaagttctccagccccgcacttcgaagctttggggtgatgtgactgagataaaatcgccaattctgtccggacccaaggccaatgttatcagcgagctgaatagcatccttcagcagatgaatcgggagaagctggcgaagccaggggaggggttagatagcccgatgggggccaagtctgcaagtctggctccaagaagccctgagataatgtctaccatcagtggaacacgctctactacagtgaccttcactgtacggccggggacgagccagccgatcacgctgcagtccaggcccccagactacgagtcccggacttcaggtactagacgagctccctctcctgtcgtttcccctactgaaatgaacaaagagacccttccggcccccttgtcagcagcgaccgcctcccccagcccggccttgagtgacgttttcagcctaccaagtcagcctcccagtggtgatctgttcggtttaaacccagcaggacggagtcgatctccttccccctcaatactccagcaaccgataagtaataagccttttactacgaagcctgtgcatctttggaccaaacctgacgtagcggactggcttgagtcactgaacctgggggagcataaggaggctttcatggataacgagattgacggaagccatctgccaaatcttcagaaggaggaccttatcgatctaggtgtgacccgtgtgggtcatcgaatgaacattgagcgagcgctcaagcaactgctggaccgctag

SEQ ID NO: 33429 - DNA, 4011 bp, Artificial Sequence
  Description of Artificial Sequence: Synthetic coding sequence
atggagaatctacctgctgtaactacagaggagcctactccaatgggccgaggacctgtggggccatccggtggcgggtctactcgagatcaggtgcggacagtggtgatgagaccctctgtctcgtgggagaaagcaggccccgaggaagccaaggctccggtacgaggggacgaagctcctcccgcacgtgttgcaggacccgcagcgggcactccgccctgccagatgggcgtataccccaccgatctcacactgcagctgttggctgttcggcgcaaatcccgcctgagagatcccgggctccaacagaccctcagagggcaacttcgtctactcgaaaatgacagtagggagatggctcgggtgctgggggaactgagtgctcgtttgctgagcatacactccgaccaggacaggattgttgtcacatttaagacatttgaggaaatctggaagttctctacctaccacgcccttggctttacacatcactgtctggccaatctcttgatggaccaggcattttggctacttctgccaagcgaggaagaggagacagctatccaggtgcacgtcgatgagaatgccctgagactgacccacgaatctctactgattcaagagggtccattctttgttctgtgccccgaccaccacgtccgcgtgatgactggccctagagatgccggcaacgggccccaagccctccgacaggcttcaggagcgccgcagggagaagccgcccctgaaaccgattcatccccaccctctccatccgtgagctccgaagaagtggccgttgccgctgctcccgaacccctgataccttttcaccaatgggctttaaggatcccacaggatccgattgacgatgctatgggcggccccgtgatgcccgggaaccctcttatggctgtgggactggcttccgccctcgccgactttcaggggagtggccctgaggaaatgacattccgcgggggggacttgattgagatcctcggagcacaggtacctagtttgccctggtgtgtggggcggcatgccgccagcggcagggtgggctttgtgaggagctcactgatttccatgcagggtcctgtcagcgaactcgaatctgccatttttctgaacgaagaagagaaaagcttttttagcgagggctgctttagtgaagaggatgcaaggcagctactgcgaaggatgagtggcaccgatgtgtgttctgtatattccctggattccgtcgaagaggccgagacagaacagccccaggaaaaagagataccccccccttgcctgagcctcgaacctcaggagacgctgcagaaagtaaagaatgttttggaacagtgtaagacatgccctggctgtccacaggaacccgcctcttggggtctctgtgcagcaagctctgacgtatctctgcaagaccctgaagaaccaagtttttgcctcgaagctgaagatgactgggaagacccagaagcgttgagcagtctgttactttttctcaatgctcctggatacaaagcctccttccgcggactatatgatgtggcactaccgtggttatcctcagtatttcggtccttttctgacgaggaggagctgaccgggaggctggcacaagcaagaggggccgccaaaaaagcaggtctgctgatggcgctcgctaggctgtgcttcttgttagggcgtctttgttcccgtcggctcaaactatcacaggcccgggtctacttcgaggaggccttaggagccctcgagggttcttttggagatctattcctggtagtggccgtttacgccaatctcgcatcaatttaccggaaacagaaaaacagggaaaaatgcgctcaggtcgttcctaaagccatggccctcctccttggaacccctgaccacatttgctctactgaggctgagggagaactgctgcagctcgctctgcggagagccgtgggtggccagagtctccaggccgaggctcgcgcatgttttctgctcgcaaggcaccacgtgcacctgaagcagccagaggaggcccttccattcctcgagcgcctcctcctgctgcacagggactccggagcacctgaagcggcgtggctgagcgattgttatctgttgctggccgacatatactccagaaagtgcctgcctcacctggtcttgtcttgtgtgaaggttgccagcttacgaacacggggctctttggccgggtcgctgcgctccgttaacctcgtgctacagaatgccccccagcctcactctctccctgctcagacgtcccattatctgcgtcaagcactcgcctcactgacacctgggacgggtcaggcattgcgaggcccattatatactagtttagctcagctttactcccaccacgggtgccacgggcccgccataaccttcatgacgcaagcagttgaggcgagtgctatcgcaggcgtgagggccatcgttgaccatcttgtggcccttgcttggctacacgtgcttcatggacagtcaccggtggcgctggacattctccaaagcgtccgcgacgccgtcgtagctagcgaggaccaggagggggtcattgccaatatggtggcagttgcattaaaacgaacaggccggacaagacaggctgcagagtcctactaccgggccctacgagtggcccgcgacttgggacagcagcgaaatcaggcagtgggactggccaacttcggagccttatgcctgcatgcgggggccagtagactcgcacaacattacttgttggaggccgtccgcctgttctcgcgtctgccccttggagaatgcggaagagactttacccatgtgctgctgcagttgggtcacctctgtaccaggcagggaccagcacaacaagggaaagggtactacgagtgggccctgctcgtggcagtcgagatggggcacgtggagagccagctgagagcagtacagaggctgtgccatttttactcggcagtgatgccatctgaagctcagtgcgtcatttatcacgaactccaactgagcctagcctgcaaagtggccgataaagtgctcgaggggcagctgttagagactatttcccagctttatctgtccctaggaaccgagagagcctataaatccgcgctcgattataccaagcggtctcttggcatctttatcgacctgcagaagaaagaaaaggaggctcatgcatggcttcaggctggcaagatctactatatcctgagacaaagcgagctcgtcgacctgtacattcaagtggcccagaatgtcgcactctacaccggggatcccaatttgggcttagagttgttcgaggctgctggggacattttctttgacggagcttgggaacgtgaaaaggcagtgagcttttaccgagacagggccctcccactcgcagtgaccaccggaaataggaaagctgaactcaggctctgtaacaaactggtggccctgctggcgaccctggaagaaccacaggagggcctcgagttcgcccacatggccctggccctctcgattaccttgggagaccggctaaacgagcgcgtcgcataccatcgtttggccgcacttcaacatcgcctcggccatggcgagctagctgaacatttctacctcaaagctctgagtctgtgtaattctcctctagaattcgatgaagagactctgtattacgtgaaggtttaccttgtactgggcgatattatattctatgacttaaaggaccccttcgatgcagctggctactaccagctcgcactcgccgcagccgtggaccttggcaacaagaaggcccagctcaaaatctacacaagactggctacaatctaccataattttttattggacagggaaaagagccttttcttctaccagaaagctcggacgttcgcgacagaactgaatgtgcgacgtgttaacctcccccctctcccgctgtgcggatgggctccatggctcgccccaagtcatccgaggtag

SEQ ID NO: 33430 - DNA, 2469 bp, Artificial Sequence
  Description of Artificial Sequence: Synthetic coding sequence
cctacgagggctagttcctcgaaaaagcaaagacccccaagctccggctcccgttgggctttgcgcattccgcaggatcccatcgacgacgcaatggggggccccgtgatgcctggcaaccccttgatggctgtgggtctggcaagtgccctcgccgactttcagggctcaggacctgaagagatgacatttcgcggcggcgacctcatcgagattctcggcgcccaggttcccagtctcccttggtgtgtcgggaggcatgctgcttcaggccgtgtggggttcgtcaggtccagcttgatctctatgcaaggtcccgtgtctgagctcgagtccgcgatttttttgaacgaagaagaaaagtcctttttttctgaaggctgcttttccgaggaagacgcccgccagctgctgagaagaatgtcaggaactgacgtgtgcagcgtatactctctggactccgtcgaggaggcagagacagagcagcctcaggagaaagaaatcccccccccttgccttagcttagaacctcaggagactctgcagaaggtgaaaaatgtgctggagcaatgcaaaacctgtcccggctgcccacaagagcccgcatcatgggggctctgtgccgcgagctctgacgtctctcttcaagacccagaggaacccagcttttgcttagaagctgaggacgactgggaggatcccgaagccctgtcatcgctgctcctgtttctaaacgcccccggctataaggccagcttccgaggactgtacgatgtagctcttccttggctgagctcagtgtttcggtccttctcggacgaggaggagcttaccgggaggctagcccaggctcgcggtgccgcaaagaaggcaggcctcctaatggcattggctaggctgtgttttttgctgggcagactttgcagtaggcggttgaaattatcacaggcaagagtgtacttcgaagaagctctcggggccttagaagggtcttttggtgacctctttctcgtcgttgctgtgtacgcgaatctagcaagtatatacagaaaacagaagaacagagaaaaatgcgcacaggtcgtgccaaaggccatggccctgctgctgggaacgccggatcacatatgctcaaccgaagcagagggcgaactgctgcagctggctctgagacgcgctgtgggaggccagagtctacaagccgaggcccgcgcctgtttcctcctagcccgccatcatgtccacctcaagcagcccgaagaggcgctgccatttctggagcgattgctgttactccaccgtgatagtggagctcccgaggccgcctggttgtcagactgctacctgctcctcgctgatatttatagcaggaagtgcctgccccacctggtcctgtcttgtgtcaaagtggccagcctgcgaactaggggatcactcgccggatccctgcggtctgtcaatctggtcttgcagaatgcgccccagccccactcacttccggctcagacttctcactacctgcggcaggccctggcaagcctaactccaggaacgggccaggccttaagggggcctctatatacatcgcttgctcaactgtattcacatcacggctgtcacggcccagccataacctttatgacacaggctgtcgaggcctcagctatcgccggcgtgagggcaatagtggaccatctggtggcacttgcttggctccacgtgttacatggccagtcccccgtggcattggatattctgcagagcgtccgggatgctgttgtggcatctgaggaccaggagggagtgattgcgaacatggtagctgtcgccctgaaaaggactggacggacaaggcaagccgccgaaagctattatagggccctccgggtggccagagatctggggcagcagaggaaccaggctgttggacttgcaaattttggcgctctctgcctgcacgccggggcgagcagactcgcccagcattatttattagaggctgtgcgtttattcagccgcctgccattaggagagtgtggcagggattttacacacgttctgctgcaacttggccatctgtgcacgagacagggtcccgcacaacaaggcaaggggtactacgaatgggctctgctggttgccgtcgaaatggggcacgtagaaagccagctgcgagccgtgcagcggctctgccacttttactcagccgtgatgccttcagaggctcaatgtgtcatctatcacgaactgcaacttagcctcgcctgtaaggtcgctgataaggttctcgagggccagctgctcgagacaataagtcagctctatctgtctctggggaccgaacgcagctcccagccccaacagaagcagctgcacgccttctgggctgtgctgccaacatggtggcttcttagttccgatctgtgtctccctcgggtctttactccagggctgcatttatcaccttag

SEQ ID NO: 33431 - DNA, 285 bp, Artificial Sequence
  Description of Artificial Sequence: Synthetic coding sequence
atggagaacttgcctgcagtgacaacggaagaaccaaccccaatggggcgcggacccgtggggccttctgggggtgggtctacccgcgatcaggtgagaacagttgtgatgcggccctccgtcagttgggagaaggcaggtccagaggaggccaaggcgcctgtacggggggatgaggctccgccagcccgagtagccggacccgccgccggcacccccccatgccagatgggggtctatccgaccgacctgaccctccagcttctggccgtgagacgcaaatag

SEQ ID NO: 33432 - DNA, 3195 bp, Artificial Sequence
  Description of Artificial Sequence: Synthetic coding sequence
atggatcaggctttttggcttttgctgccctccgaagaggaagaaactgccatccaggtgcacgttgatgagaacgcattaagactcacccacgagtcactactaattcaagaagggccatttttcgtgttatgccctgatcatcacgtacgcgtgatgacagggccaagggatgccgggaacggtccccaagccctgagacaggcgagtggcgccccgcaaggcgaggccgccccagagacagattcgtctccaccctccccgtcggtgtcatcagaagaggtcgccgttgccgccgcccccgagccactgatccctttccatcagtgggcattgaggatacctcaggatcccattgacgatgctatgggagggccagttatgccaggaaaccctcttatggccgtagggttagctagtgcattagctgacttccagggctctggacccgaggagatgactttcagaggaggggatttgatcgaaattctgggtgcccaggtgccctccctgccctggtgcgttggcaggcatgcagcatcaggcagggttggattcgttagaagctctttgatctctatgcagggaccagtctcagaactggagtcagcgatcttcttgaatgaagaggagaaatctttcttctctgaagggtgcttcagcgaggaagacgcaagacagttactgcgccggatgagcgggaccgacgtgtgcagtgtctactctcttgactccgtggaggaagcagagacagaacaaccacaggaaaaggagataccgcccccctgcctgtctctggagccgcaggagactttacagaaagttaaaaacgtgttggaacagtgtaaaacgtgccccggctgccctcaggaacccgctagttgggggctttgcgccgcatcatcggacgtttcgctgcaggatccagaggaaccatcattttgcctggaagccgaagacgattgggaggatccagaagctctaagctccctgctgctgttcttgaacgcccccggttataaggcatcctttcgtggactgtatgacgtggccttaccctggctctcctcagtatttcgctctttcagcgatgaggaggagctcacgggtagactggcccaggcaagaggggctgccaaaaaagccgggcttctaatggccctggcccgcctgtgctttctgttaggcaggttgtgtagcagaagactgaagctgtctcaagcccgggtgtactttgaggaggccttgggcgcactggaagggagtttcggggacctcttcctggtcgtggctgtgtatgccaacctggcctcgatttacaggaaacaaaagaatagagaaaagtgcgctcaggtggtcccaaaggcaatggcactgctgctggggaccccagatcacatctgcagcacagaggctgaaggagaattgctgcagctggccctgaggagagcagtggggggccaatcactgcaggcagaggctagggcatgtttcctcctcgccaggcaccatgtgcacctgaaacagccagaggaagctctgcccttcctcgagaggctgcttctgctgcacagagactccggtgcacctgaagcggcctggctgtctgactgttacctcctacttgccgatatttattctcgcaagtgcctgcctcatttagtactttcatgtgtaaaggtcgccagcctgcgaactagggggtccctggcaggcagcctaaggagtgtcaacctggtccttcagaacgcgcctcagccacactcccttccggcccagactagccattatcttagacaggccttggcgtccctgacccccgggacaggacaggccctaaggggccctctctatacctctttggcgcaattgtacagccatcatgggtgtcacggacccgcaatcactttcatgacccaggccgtggaagctagtgcaatcgccggagtaagggccattgtggaccacctggtcgcacttgcttggctgcacgttctacatggccaatccccagtagcgctggacattctgcagtcagtgcgggacgcagtggtggcttctgaggaccaggagggagttattgctaacatggtggccgttgccctgaagcgtaccggcaggaccaggcaagcggcagaatcatactacagggctctacgcgtagcgcgtgatctcgggcaacaaaggaaccaggcagtgggactcgctaatttcggtgcactatgcctccacgccggagccagccgcctcgcccagcattatttgctggaagctgtgcggttgttttctagactcccactgggagagtgtgggagggactttacacacgtacttctccaattgggccatctgtgtacaaggcagggtcccgcccagcagggcaagggatattacgagtgggctctgcttgtggcggtggagatgggccatgtggagagccagctccgggccgtgcagcggttatgccatttttacagcgccgtgatgccatccgaagcacagtgcgtaatctaccatgaacttcagctgtccctggcgtgcaaggtggctgataaggtgttagagggccagctgctggagaccataagtcagctttacctctcgcttgggactgaaagggcttacaaaagcgccctcgattataccaagaggtctcttggcatctttatcgatctacaaaaaaaagagaaggaagcccatgcttggttgcaagcaggcaaaatctattacatcctgagacagagtgagctggtggatctctacatccaggtggctcagaacgtggccctgtacactggcgatcccaatctcgggcttgagctgttcgaagccgcaggagacatctttttcgatggggcttgggagagggaaaaggccgtgtctttctatagggaccgggctctccccctcgcagtgacaaccggcaaccgaaaggccgagttgaggttatgcaataagttagtggccctgctcgctactcttgaagaacctcaagaaggcctcgagtttgcccacatggccctcgcactgtccattacactgggggatagactcaatgaaagggtagcctatcatcgactagccgccctacaacatcgcttaggccacggtgagttggcggaacacttctatctgaaagcactgtccctatgtaattcgccattggagttcgacgaagagacactgtacacctag

SEQ ID NO: 33433 - DNA, 3783 bp, Artificial Sequence
  Description of Artificial Sequence: Synthetic coding sequence
atgggcgtgtatcctaccgatctgaccctgcagctgctcgcagtgcggcgtaaatctcgcttgcgagaccctggccttcagcagacattaaggggtcagttgaggctgctcgaaaatgatagcagggaaatggctcgggtgctgggcgagttgtctgcgcgtttactgtctattcactccgatcaggacaggatagtcgtcactttcaagacgttcgaagagatttggaagtttagtacataccacgcccttggcttcacacaccactgcctagcaaatcttctgatggaccaggctttctggttacttcttccatcagaagaggaggagactgcaattcaggtgcacgtagacgaaaatgcactaagactgacccatgaatccctgttaatccaggagggccccttctttgtgttgtgcccagatcatcatgttcgggttatgactgggccccgagatgcaggaaatggcccccaggctctgagacaggcaagcggagctccacagggagaggccgcccctgagacagatagctccccaccctccccatcagtatcctccgaggaggtcgccgtcgcggcagcccctgagccgctgattccattccaccagtgggccttgagaatccctcaagaccctatagatgacgccatggggggcccagtgatgcccggaaaccctctgatggctgtgggcttggcaagcgctttagcggacttccaagggagtgggccagaagagatgacctttcgaggaggcgacttgattgaaattctaggggcacaagtgccttcccttccttggtgcgtcggacgacatgctgcctctggccgcgtaggttttgttcggtctagcctgatctccatgcagggccccgtatccgagctggagagcgctattttcctaaacgaagaagaaaagtcattcttctcagagggctgcttctccgaagaggatgctagacagcttttgagacgcatgagcggtaccgacgtgtgcagcgtgtactcattggattccgtggaagaagctgagacggagcaaccacaggagaaagaaattcctcctccctgtctgagtcttgagccccaggaaaccctgcagaaagtgaaaaatgttctggagcaatgtaaaacatgtcccggatgcccccaggagccagcatcttggggtctttgcgccgcctcctcagacgtcagcctgcaggatcccgaagagccctccttttgcctggaggccgaggatgactgggaagacccagaggccttgtctagtctgctgcttttcctcaacgcaccagggtacaaggcctctttccgtggactgtatgatgtggctttgccttggttgtcttctgtgttccgcagcttttctgacgaggaagaactaactggacgactggcacaggccagaggtgctgctaagaaggcaggtttgctgatggcactggccagactgtgcttcctattgggaagattatgtagccgccggctaaagctgtcacaagcccgcgtttacttcgaggaggccctgggcgcgctggagggcagcttcggagatttgtttctcgtagtcgcggtgtacgctaatctggcgtctatataccgaaagcagaaaaacagggagaagtgcgctcaggtggtacctaaggcgatggcactgctgctcgggactcccgaccacatatgctccactgaagcagaaggcgaactgttgcagctggctttgaggcgcgccgtggggggccaatcactccaagctgaagcccgcgcctgcttcctgctggctaggcaccacgtccacctgaaacaaccagaagaggccctgcctttcctggagcggttgctcctcctgcaccgcgattcaggcgcccccgaagcagcatggctttcggattgttacctgctgctggccgacatttatagccggaagtgcctcccacacctggtccttagttgcgtaaaggtggcaagcctaagaacgcgcggaagcttagctggctctctgcgaagcgtgaaccttgtcctgcagaacgcgccacagcctcacagtctgcccgcccagaccagtcattatctccggcaagctcttgcaagcctgacccctggcaccgggcaagccctgagggggcccttgtatacttccctcgcgcagctgtacagccaccatggatgccacggccccgccattactttcatgacccaggcggtggaagcttccgcgatcgcaggggtgcgggccattgtcgatcacctggtcgccctggcctggctacatgttctacatggtcagagccctgtggccttggatatcctgcagagcgtgcgggatgccgtggtagcatccgaggaccaagaaggtgtcatagcgaacatggtggccgtggcgctcaaacggacaggacggacgagacaagcagccgagtcctactacagagcactgcgtgtcgctagggatctcggtcagcaacgcaaccaggccgtgggcctggccaacttcggcgcattgtgcctgcacgcgggcgcctccagactcgcgcagcattacctgctggaagctgtacggctcttcagccgcctccctctcggtgagtgcggacgggatttcacccacgtcctgctccagttggggcatctgtgcaccaggcagggaccggcacaacaaggcaaagggtattatgaatgggcgctccttgtggcagtggaaatgggtcacgtggagagccagctgagagccgtgcagcggctttgtcatttctacagtgcagtgatgcctagcgaagcacagtgcgtaatttatcacgaactgcagctgagtctcgcctgtaaagtcgcagataaagtccttgagggccagctgcttgaaacgatttcgcaactctatctttcccttgggactgaaagggcttacaagtctgcgctcgactataccaaacgttccttaggcatcttcatcgatctccagaaaaaagagaaggaggctcatgcatggttgcaagctggtaagatatactacatactgaggcagagtgagctcgtagatctctatatccaggtagctcagaacgtcgcactgtatacaggcgaccctaatctggggttggagctattcgaggcagccggagacatcttcttcgacggtgcctgggaacgggagaaggctgtgagtttctatcgggatagggctttacctctcgccgtgacaacagggaacagaaaagccgagctccgactgtgtaacaagttagtggcactgttagcaactctcgaggagccgcaggaaggtctagagttcgcccatatggcactagcactctccattacactgggagaccgcctcaacgagagagtggcttaccacagacttgccgcactgcagcatcggttaggccatggtgagctcgctgagcatttttacctgaaggctctctctttgtgcaacagcccgcttgaatttgacgaagaaacactttactatgttaaggtgtatttggtgctcggcgatatcatcttttatgacctgaaggatccgttcgacgcggctggatattatcagcttgcactcgccgctgccgtggacctgggaaacaaaaaggcacaactcaaaatttatacgcgtttggcgaccatctaccacaactttctgctggacagggagaaaagcctcttcttttaccagaaggcacgcacctttgctaccgaattaaacgtgcgtagagtgaatctccctccgcttcccttgtgtggctgggcaccatggctggcaccgtctcaccccaggtag

SEQ ID NO: 33434 - DNA, 1209 bp, Artificial Sequence
  Description of Artificial Sequence: Synthetic coding sequence
atgcccgataaaacagcaacccccgagaggcctcccgctccagaaaatgcgccaagctctaagaaaatcccggccccagataaagtgccgagccctgagaaaaccttaaccctgggagataaggcatccatcccggggaactcgacctccggaaaaataccagctccggacaaagtgccgacacctgaaaagatggtgacccccgaagataaggcatcaatcccagaaaactctatcattcctgaggagacattgacagtcgataaacccagcacccctgagagagtcttcagcgttgaagagagtcccgctctggaggccccccccatggacaaggtgccaaaccctaagatggcaccacttggtgacgaggcaccgactctcgagaaggtcctcactcccgaactgagcgaggaagaagtgagcacgagagatgacattcagtttcaccatttcagctccgaagaggccctacaaaaagtaaagtacttcgtcgctaaggaggatcctagttcccaagaggaggcccatacacctgaagcgccaccaccgcagcccccatcatcggaaaggtgtcttggcgagatgaaatgcaccctggttcggggggactcttctccaagacaagccgagttaaagagcggaccagcctctagacctgcactagaaaaaccacacccacatgaagaggcaaccactcttcctgaagaggctccctcaaacgatgaacgcaccccggaggaggaggcgccgcctaatgagcagcgcccgctaagggaagaggtgttgcccaaagagggggtcgcgtccaaggaggaggtcacattgaaagaggagctgccaccaaaggaggaggtggcccccaaggaggaagtccctccaattgaacgtgccttcgcacagaagactaggcctattaagcccccccccgactcgcaggagactctggctctccctagtttggtgccacagaattatactgaaaacaagaatgagggcgttgacgtgacatccctgcgaggagaggtcgagagtttacgaagagctctcgaactaatggaggtacagctcgagcgcaaactgaccgatatttgggaggagcttaaatccgagaaagagcagcgacgccgtttggaggtccaggttatgcaaggcactcagaaatcccagactccgagagtgatccacacacagacgcagacctactag

SEQ ID NO: 33435 - DNA, 1923 bp, Artificial Sequence
  Description of Artificial Sequence: Synthetic coding sequence
atggtgcagagcgaactgcagctgcagcctcgggcgggcggccgggctgaagctgctagttggggagatagaggaaacgacaagggtggcctcggcaacccagacatgccatcagtgtcacccggaccacagaggcctcctaagctgtcatctctggcatacgattcccccccagattacctccagaccgtgagccatccagaggtttatcgcgttttattcgattatcagcctgaagcaccggatgagttggccctgcgccgcggagatgtggtgaaagtgttgtcaaagacgacagaagataagggatggtgggaaggggaatgtcagggccggaggggtgtgtttcccgataacttcgtcctccccccaccccctattaagaaattagtgccccgtaaagttgtgtcccgggagtccgctcccattaaggagcctaagaaattgatgcccaagacatcattacccacagtgaagaaacttgccacagccaccactgggccaagcaaggccaagacatcgcgtacgccgagcagagactcacagaagctcaccagccgggattcagggccaaacggcggctttcagtccggggggtcctatcatcctggcaggaagcggtccaaaacccagacaccccagcagagaagcgtgtcaagtcaggaggaggagcacagcagccccgttaaggcgccctccgtcaagcgaacaccaatgcccgacaagacagcaacacctgagcgcccccctgcgcctgaaaatgccccttcctctaaaaaaatcccggcaccagacaaggtcccgagcccagagaagactctcactctgggagacaaagccagcattccaggcaactccacgagtggaaagatacccgcccctgacaaagtcccgacgcccgagaagatggtcacacctgaagataaagcatccatcccagagaattctattatccccgaggagacattaacagtagataagccctcgacacctgaacgcgtgtttagtgtcgaagagtctccagctctggaggcacctcccatggacaaagttcctaatcccaaaatggcaccattgggcgacgaggccccgacactcgagaaggtgcttaccccagaattgagtgaggaggaagtttctacgcgtgacgacatacagttccaccatttttcgtccgaagaagccctgcaaaaggttaaatactttgtagctaaggaagatccctcatcgcaggaggaagcccacacccctgaagcaccacctccacaacccccctccagcgaacggtgtcttggcgaaatgaagtgtacactcgtgcgcggagattcaagccctcgacaggcagagctgaaatcgggacccgctagccgtccagcactggaaaaaccgcacccccatgaggaggctacaaccctgcccgaggaggccccgtctaatgatgaacgtactcccgaggaggaggcccctcctaatgaacagcggcctttaagagaggaagtgttgccaaaggaaggcgtagcttccaaggaggaggtgaccctaaaggaagaactccctcctaaagaagaagtcgcccctaaggaagaagtcccacccattgagagggccttcgctcagaagactagaccaatcaagccacctcctgactcccaggagacattagccctccccagcctagtccctcagaactacacagagaataagaatgagggcgttgacgtaacttctctccggggtgaggttgaatctctgcgacgcgccctggagctgatggaagttcagctcgagagaaaacttacggacatctgggaggaattaaaaagcgagaaggaacagcgtaggaggctcgaggtgcaagtgatgcaaggcactcaaaaatcacagaccccacgggttatccacacgcagacacaaacatattag

SEQ ID NO: 33436 - DNA, 2271 bp, Artificial Sequence
  Description of Artificial Sequence: Synthetic coding sequence
atggaggtattggtgttggccggctaccgcgctcagaaagaggatgagctctcgctggcacctggagatgttgtccgccaggtccggtgggtgcccgctcgaggctggcttcgtggagagtttggtggccggtatggcttgtttcccgaaagactcgtacaggagattcccgagacactgcgaggatctggtgaggcccgccggccgcggtgcgccagacgaagaggccaccccgccaaacacccccggcctcagcgttggtgcaaagtgaattttagttatagtcctgagcaggccgacgaattgaaactgcaggctggcgaaatcgtggaaatgatcaaggaaatcgaggatggatggtggctgggaaagaaaaatggacaactgggggctttcccgtctaactttgtagagctcttagattcaggacccccctcactgggaaatcctgatatgccctccgtgtcacccggaccacagagacctcctaaactgtcctcgctggcatacgattcgcctcccgactacctgcagactgtcagccaccctgaggtttatcgcgtactcttcgattatcagcctgaagcaccggatgagctggctctgcgtaggggggacgtggtcaaggtcttatcgaaaactactgaagacaaaggctggtgggagggagagtgccagggtaggcgaggcgtatttcccgacaactttgtactgccacctccaccgattaaaaaactggtgcctcgcaaggtggtatcgagagagagtgcccctatcaaagagcctaagaagctcatgcccaaaacaagcctccccaccgtgaagaagctcgctaccgccaccactggccccagtaaagcgaagacctctagaacaccttctcgggattctcagaagctgaccagtcgggattcagggccaaatggcggatttcagtccggtggatcttaccatcccggaaggaaacggagtaaaacccagactccgcagcagagatcagtatctagccaagaagaggagcattccagtcctgtaaaggctccgagcgtcaaaaggacgcccatgccagacaagacagctacacctgagcgcccgcccgctcctgaaaacgccccaagctcgaagaagattccggctccagacaaggtgccgtcccccgaaaaaactcttacgttaggagataaagcatctatacccgggaacagtaccagtgggaagattccagctccagataaagtaccaacccccgagaagatggtcacacctgaagataaggcctccattcctgaaaacagcattatacccgaggaaaccctgactgttgataaacccagcacccctgagcgcgttttcagtgtggaggagtccccagcactagaagccccacccatggacaaggttccgaaccccaaaatggccccacttggagatgaggctccaactttagagaaagttctgaccccggaacttagcgaggaggaagtttctacacgtgacgatatccaattccaccacttcagctcagaggaggcactgcagaaggtcaaatattttgtggccaaagaagatccctcatcacaggaggaagcccataccccagaagcgccacctccacagccgcctagcagcgagaggtgcctgggagaaatgaaatgtaccctggtacgcggtgatagcagcccccgccaggcggagcttaagtcagggccggctagcagaccagctttagagaagcctcacccacacgaggaggccaccacgctcccagaagaggctccttctaatgacgagcgcaccccagaagaggaagctccacccaacgaacagagacccttgcgggaagaagtcttacctaaggagggcgtcgcgagcaaagaggaggtgactcttaaagaggaactgccgcctaaggaagaggtggcacctaaagaggaggttccgccgatcgaacgcgctttcgcacaaaagaccaggccaatcaaacccccaccagatagtcaggagacactggctctcccctccctggtgcctcagaattacacagagaataaaaacgaaggggttgacgtcacgagcctgagaggagaagtcgaatctctgaggagagctctggaattaatggaagtgcagctcgaacgcaagctcacagatatttgggaggagttaaagagcgagaaagaacagcgccggagattggaggttcaggtaatgcaggggacccagaagtcacagactcctagagtgatccacactcagacacagacatattag

SEQ ID NO: 33437 - DNA, 1938 bp, Artificial Sequence
  Description of Artificial Sequence: Synthetic coding sequence
atgataaaggagatagaggacggatggtggctgggcaagaaaaatggacagctgggagccttcccctctaattttgtagagctcttggattctggaccaccatcgctagggaacccagacatgccgtctgtgagccccgggccccagcggccgcctaagttgtcatctctagcctatgattctcctcccgactacctgcagacagtgtctcaccccgaagtttacagagtgctgttcgattatcagcccgaggcaccagacgagttggcactaagaaggggcgacgtcgtaaaagttctgagtaagactacggaagacaagggctggtgggaaggcgagtgtcagggaaggcgcggagtgtttccagataacttcgtgctgccgcctcctcctattaaaaagctagtgccaagaaaagtcgtgtctcgcgaaagtgctccaatcaaggagccaaaaaagctgatgccaaagacatctctgcccacagtcaagaagctagctactgccactaccgggccgtctaaggctaaaacttccaggacaccttcaagagatagtcaaaagctgacatcaagggacagtggaccaaatggtgggtttcagtccggaggatcgtaccatcccggcagaaaaagaagcaaaacgcagactcctcagcagcgaagtgtttcatcccaggaggaggaacactccagtccagtgaaggctcccagtgtcaagcgtactcctatgccagataaaacagctacccccgagcgcccccccgctcctgagaatgccccttcaagcaagaaaatccccgcacccgacaaagtgccaagccccgagaaaacattgacactgggtgataaagcctccattcctggcaactcaacaagcgggaaaattccagcgccagataaagtgcccacacccgagaaaatggtaacacccgaagacaaggcctccattccggaaaactccattataccagaggagaccctgaccgttgataaaccatccactcccgagcgcgtcttctctgtcgaggaatccccagcgttagaggctcctcccatggacaaggtgccaaatcctaaaatggcgcctcttggggacgaggccccaactctggagaaggtgctgactcctgagctttcagaggaagaggtgtcgacccgcgatgacattcagtttcaccacttctcttccgaagaggccctacagaaggtgaagtactttgttgccaaagaagacccatcttcccaagaggaggcgcacacccctgaggcgccaccgccgcagccgccttccagcgaacggtgcctcggggaaatgaagtgcactctggtaaggggcgacagctccccacgccaggcagagcttaaatcgggcccagcctctcgccccgcattggagaaaccccatccacatgaggaagcaactacattacctgaggaagccccctccaatgatgaacgaacccctgaggaggaagctcctcccaacgaacagcggccactccgcgaggaggtcctccccaaagagggtgtggcaagcaaggaggaggtgactctgaaggaagagctgcctccaaaggaagaggtcgcacccaaggaggaagtccctcctattgaacgggcctttgctcagaaaactcgtccaatcaagcctccaccagatagccaagaaaccctggccctgccctcgttagtgccccagaattacaccgaaaacaaaaacgagggggtggatgtcacaagtcttcgcggcgaggtggagagtctgcggagagctctggaacttatggaggtgcaacttgagcgaaaactgaccgatatttgggaggagctgaaaagcgagaaggagcaaaggcgacggctggaagttcaggtgatgcagggcactcaaaaaagtcagacgccgcgagtgatccatacccagacccagacttattag

SEQ ID NO: 33438 - DNA, 2649 bp, Artificial Sequence
  Description of Artificial Sequence: Synthetic coding sequence
atgctcctgggcgccagctggctgtgcgcatccaaggcggctgcagcagctgcccagtccgagggagatgaagatcgacctggcgagcggcgacggcggagggcggccgcaacggccgccggtgctggagaggatatggacgaatcgtctctactggacttgttggagtgctccgtctgcctcgaacgcctggataccacagctaaggttctgccttgccagcatacattttgtagacggtgcttagaaagcatcgtctgctctcgccatgagttgcggtgccccgagtgcaggatattggttggatgcggggttgacgagttgcccgctaacatcctgctcgtaagattactcgacggaatccggcaaagaccccgtgctggaacttccccaggcggctcaccacccgctaggcccatccccggacagagtgcagcccccaccttggcaggcggcggaggaggcgccgcaggtagtaccccagggtctcccgtctttctcagcgctgctgctggtagtaccgctggctctttgagggagttggccacttctcggacggcacccgcggccaaaaacccgtgcttactgccgtatggaaaggccctatattcttatgagggaaaggaacccggcgatctgaagtttaataaaggtgacatcatagtgttacgaagaaaggttgatgagcaatggtatcatggcgagctgcacgggactcaggggtttttaccagcatcttatattcagtgtatccagcccctgccgcatgccccacctcagggcaaggccctttatgacttcgaaatgaaggataaggaccaagacaaagattgtttgacattcaccaaggatgaaattctaacagtgctcagaagggttgacgagaattgggccgagggaatgctcggtgacaaaatcggcatttttcctctgctgtatgtcgaattaaacgactcagccaaacagttaatcgaaatggacaagccctgtccagcagcagccagcagctgtaatgccagcctgccttcagactcaggagccgtggcaagtgtggccccttcacctaccctaagctcttccggcgcagtgagcgccttccaacgcagggtggatgggaagaaaaacaccaagaagagacactcttttacagcattgtcggtgacccacaggagttctcaggccgccagtcataggcacagtatggagatttccgcgccagtcctgatatcaagcagcgatccgagagcagctgctcgaatcggggacttagcgcatctcagctgtgctgcccctacacaggacgtgagcagctctgcgggcagcacccctaccgcagtcccccgagccgcatctgtgagcggagagcagggtacaccacccaaggtgcagcttccgctgaacgtctatttggccttgtacgcatacaaaccccagaagagtgacgaactggagctgcataaaggtgaaatgtacagagtgctagagaagtgtcaagacggttggttcaagggagcttccctgcgtacgggggtctcaggcgtgttccctggcaattacgtaactccagtttctcgagtgcccgcagggggggccgggccaccacgaaacaacgtggtcggcggaagcccactggcaaaggggatcacgactactatgcatccgggttccggttcactgtccagtttagctacggctactcggccagccctaccaataaccaccccccaggcccatgctcaacacccaacagcttctcctccgacaggttcttgtctgcggcattcagcacagcctactgcgtcacaagcccgatcaacaatctccaccgcggcccattctgctgctcaagctcaggaccgtcctaccgccaccgtgtcgcctctgaggactcagaacagccctagcaggctccctgccacatctctgcgcccacattccgtggtttcgccacagcactctcaccaaccacccgtgcagatgtgtccaagaccagcaatcccattgaccagtgcggcgtccgctatcactcctcccaacgtctctgctgccaacctcaatggcgaggctggggggggtcccataggcgtgttgtcgacaagtagtcctacgaacaccggatgcaagctagatgagaagaaatcggaaaaaaaggagaagaagagtggcctcttgaaactcctggccggagcctccacaaaaaaaaagtcaagatctcccccttctgtcagtccaacccacgacccacaagtggctgttgacgctctcctgcagggggcagtggggccagaggtctcctctctctccatacatgggcgggctggatcatgccctattgagagcgagatgcagggagctatgggcatggagcctctgcatagaaaggctggctcactggatctgaactttactagtccaagccgacaggcccctctatccatggcagccatcagacccgagcctaagttgctgcctcgtgagcggtacagagtcgttgttagctaccctcctcaatcagaagccgagattgagctgaaggaaggggatatcgtgtttgtgcacaaaaagagggaagatgggtggtacaaggggaccctgcagcgtaatggcaggacaggcttattccccggctcttttgtggagtccttctag

SEQ ID NO: 33439 - DNA, 2151 bp, Artificial Sequence
  Description of Artificial Sequence: Synthetic coding sequence
atgctcctaggggccagttggttgtgtgcgtctaaggccgctgctgctgccgcccaatcagagggagacgaggacaggcccggtgagcgacggcgtaggcgagccgcagcgacagccgctggggcaggggaagatatggatgagtccagtctgctggacctcctggaatgttccgtttgcctggagcgtctggacactacagcaaaagtgctgccatgccagcacacgttctgccgacggtgtctggaatccatagtatgtagccgtcatgagctccggtgcccagagtgccgcattctcgtgggctgtggggtcgacgaattacctgctaacatactactggtccgacttcttgacggtatccgccagcggcctcgcgccgggacctcacctggtggcagtcctccagcccggcctattcccgggcaatcagccgcacctactctggctggcgggggggggggcgcagccggaagtactcctgggagcccagtcttcctctccgctgcagccggaagtactgcgggctcccttcgggagttggcaactagtcgcacagcacctgctgctaaaaatccttgcctcctgccatatgggaaggcactatatagttacgaaggcaaagaacctggagacctcaagttcaataagggcgatattatcgttctgaggcggaaagtcgatgagcagtggtaccatggagagctgcatgggacacagggtttcttgccggcgagctacatccagtgcatacagcccttaccccatgctcctcctcagggcaaagcactgtacgatttcgaaatgaaggacaaggatcaggacaaggattgccttaccttcacaaaggatgagatcctaacggtgcttcgacgtgtggatgaaaattgggccgagggcatgttgggagacaaaatcggcatattccccctgctatacgtcgaacttaacgatagcgcgaagcaactgatcgaaatggacaagccttgtcctgctgccgccagttcttgtaacgcctcccttccgagcgacagcggagctgtagcatctgtcgctccgagtccaactttgtcttcctctggcgccgttagtgccttccagcggcgagtcgacggcaagaagaacaccaagaagaggcactcattcactgctctttctgttacccaccgctcctctcaagctgcgtctcacaggcacagcatggagatctctgcacccgtgctgataagttcgtcggacccccgggctgcggcccgaataggagacctcgctcaccttagctgcgccgcccccacccaggatgtctcgagttcagcgggaagtacgcctaccgccgtgccgcgggccgcttctgtatcaggagaacaggggacaccccctaaggtgcagctcccattaaatgtatatttagctctttatgcatacaaacctcagaaatcagatgagctggagcttcacaagggcgagatgtatcgtgtgttggaaaagtgtcaggacggatggttcaaaggcgcaagcctgcggacaggagtttcaggtgtattccctggaaactacgtcacaccggtttctagagttcccgctggaggagcaggcccgcctcggaataacgtggtgggtggttctcctctagcaaaggggatcaccaccaccatgcatccgggcagcggctctctgagttctttagccaccgcgactcggcccgccctgccaatcacgacccctcaggcccacgcacaacatcctaccgcttctcctcccactgggtcatgtctccgccattctgcccagcccacagccagccaagccagatctactatctcaactgctgcacattctgccgcccaagcacaagacaggccaaccgcaacagtttctcctctgcgcactcagaactcccccagtcgactgcctgccaccagcctgaggccccacagcgtggtatcacctcagcacagccaccagccccctgtccaaatgtgtcctcgacctgctattcccctgacctcggccgccagtgcgattacgccccctaacgtgtcggccgcaaatcttaacggtgaggcaggaggtgggccaattggcgttctaagtacaagctctcctacaaataccgggtgcaagttggacgagaaaaagagcgagaagtag

SEQ ID NO: 33440 - DNA, 171 bp, Artificial Sequence
  Description of Artificial Sequence: Synthetic coding sequence
taataccgggtggtcgtgtcatatcctccacagtccgaggcagagatagagctcaaagaaggggatatcgtgttcgttcataaaaaacgcgaagatgggtggtacaaggggacactgcagaggaacggacgcactggacttttcccgggttctttcgtggaaagcttctag

SEQ ID NO: 33441 - DNA, 1029 bp, Artificial Sequence
  Description of Artificial Sequence: Synthetic coding sequence
atgaacaatcctattccatccaatttgaaatccgaagccaagaaggccgccaagattttgcgcgagtttacagaaatcacctcacgcaacggaccagacaagattataccagcacacgttatagcaaaagccaaaggattggcgatcctgtccgtcattaaggccgggtttctcgttacggctcgcggtggctccggtattgttgtggccagactgccagatggcaaatggtccgcccccagcgcaattggcatcgccgggctgggcggaggattcgaaattgggatcgaagtttctgacctcgtcataatccttaactacgatcgcgccgtagaggctttcgccaagggggggaatctgacgttaggcgggaatctgaccgtggctgttggaccgctgggccggaatctggaggggaacgttgccctccggtcttctgccgctgtgttcacatattgcaagtcccgagggctgttcgctggtgtttctttggaaggctcgtgcctcatcgaacgcaaagagaccaatagaaagttttactgccaggacattagggcctacgatattctgtttggtgacacccctcgaccagcccaagccgaggatctgtacgagatactggactcttttaccgagaaatatgagaacgagggccaacgaatcaatgctcgcaaagccgcaagagaacagaggaaatccagtgccaaagagctgccacctaagcccttgtcccggccacaacagagctccgcccctgtgcagctcaatagtggctctcagagcaatcggaatgaatataaattgtatccaggactctcctcttatcacgagcgggtgggcaatctgaatcagcccatcgaggttaccgccctttattcctttgagggccagcagccaggggaccttaacttccaggcaggcgatagaatcactgttatttcgaaaaccgatagtcacttcgattggtgggaaggaaaactcagaggtcagaccggaatcttccccgccaactacgtgactatgaattag

SEQ ID NO: 33442 - DNA, 684 bp, Artificial Sequence
  Description of Artificial Sequence: Synthetic coding sequence
atggtgtccgacctggtgatcatccttaactacgatcgcgccgtggaagcgttcgcgaaaggaggtaacctgaccctggggggtaacctgacggtggcagtggggcctcttggacgcaacctggagggcaacgtggcgctgcggtcatctgccgcggtgttcacttactgcaagtctaggggcctgtttgccggtgtgtctttggaagggagttgcttgattgaacggaaggaaacgaaccgcaagttctactgccaggacattcgcgcctacgacatattgttcggtgataccccaagacccgctcaggccgaggatctgtacgaaatcctggactccttcaccgagaagtatgagaacgagggacagcgaattaacgctcgcaaagccgctagggagcagcggaaatcttccgcaaaggagctgccacctaaaccgctgtcgagacctcagcagtcttccgcccctgttcagctgaactccgggtctcagtccaacctcaatcagccaatagaagtgacagccctgtacagttttgaaggccagcagccaggcgacctcaactttcaggcaggagaccggattactgttataagtaagacagactcacactttgactggtgggaaggaaaactgaggggtcagaccggtatcttcccggccaattatgtcactatgaattag

SEQ ID NO: 33443 - DNA, 684 bp, Artificial Sequence
  Description of Artificial Sequence: Synthetic coding sequence
atggtctccgatctggtcatcattctgaactacgacagggccgtagaggctttcgccaaaggcggcaatttgactttaggagggaatctcaccgttgcggtcggaccactcgggagaaacctcgaaggcaatgtggcactgagaagctccgccgccgtttttacgtactgcaagagccgaggtctgttcgcaggagtcagccttgaaggctcatgtctgattgaacgcaaggaaaccaaccgcaagttttactgccaggacatcagagcctacgatattttgtttggagatactcctagacccgctcaggctgaggatctatacgagatattagattctttcacggaaaaatacgaaaatgaagggcagagaattaacgcaagaaaggcggcgagggagcaaaggaaatcatcggctaaagaattaccccccaaacctctgtctcgcccgcagcagtcctccgcccctgtgcaactgaattcaggctcccagtccaatctgaaccagcccattgaagtgactgccctgtactccttcgagggtcagcaaccaggcgacctcaactttcaggcaggtgacagaatcacagttatcagtaagactgactcgcatttcgattggtgggagggcaaactgagaggccaaacaggaatattccccgctaactacgtgacaatgaactag

SEQ ID NO: 33444 - DNA, 972 bp, Artificial Sequence
  Description of Artificial Sequence: Synthetic coding sequence
atgaataacccgatccccagtaatcttaagtctgaggcaaagaaggctgcaaagatattaagggagttcacggagatcacaagcaggaacgggccagataagattattccagctcacgtgatcgctaaggccaagggactcgccatcctgagtgtcataaaggcagggttccttgtcaccgcaaggggcggatcaggcattgtcgtggcccgcctaccagatggcaagtggtctgctccatcagccataggaattgcaggactgggaggcggcttcgagatcggcattgaggtgagcgatctggtgataatcctcaattacgaccgggcagtagaggccttcgctaaaggcgggaaccttacacttggtggcaatctcactgttgcggtgggcccgctcggccgcaatctggaagggaacgttgcactgaggagtagcgccgcagtgtttacctactgcaaatcaagaggcttgtttgcaggggtgtccctggaagggtcatgtcttatcgagaggaaagagacaaatcgcaaattctattgccaggacattcgggcgtatgacatcctgtttggagacacacctcgcccagcgcaggctgaagatctgtatgaaatactcgactcttttactgaaaagtacgaaaatgagggccagaggataaatgcgcgcaaagctgcacgcgaacagaggaaaagctctgccaaggaactccctcccaaaccgctttctcggccccagcaatcttcagctccagtgcagctgaacagtggctcacaaagcaacctgaaccagcccattgaggtgactgccctctatagcttcgagggacagcagccaggagacctgaattttcaggcaggcgatcgtataacagttataagcaagaccgacagccactttgattggtgggaaggaaagttgcgcggccaaactgggatcttcccagccaactacgtaactatgaattag

SEQ ID NO: 33445 - DNA, 1029 bp, Artificial Sequence
  Description of Artificial Sequence: Synthetic coding sequence
atgaataaccccattccctctaacctgaagtccgaagcaaagaaagctgccaagatcctgagagaattcaccgagatcacttctagaaatggacccgataagatcatacccgcacatgtgattgctaaggccaagggcttggcaatcctgtccgtcatcaaggcaggcttcttggtcacggcgcggggtggatcgggaatagttgttgctcgcctgccagacggaaaatggagcgcgcctagtgctatcgggatcgcggggttgggaggaggctttgagattggcattgaggtgtctgaccttgtcatcatactgaattatgatagagccgtcgaagcatttgcaaagggaggaaatctaacactgggcggtaacctgaccgtcgctgtcggacccttaggtcgcaacttagaagggaatgtggcccttcgcagttctgctgcggtgttcacatactgcaaatcccgtggactgtttgcaggcgtgtcgttagaaggaagttgtctgattgagcggaaggagacaaatcggaagttttattgtcaggacatccgcgcctacgatatcctcttcggcgataccccacggcctgctcaagccgaagatctgtatgagattctggattcttttacagaaaaatacgagaacgaagggcagcggattaacgcacgcaaggctgctcgcgagcaaagaaagtccagcgcaaaggaactcccgcccaaacccctgtcccgaccccagcaaagctcagcaccagtacaactgaactcgggatctcaatccaaccgcaacgaatataaactgtatcccggtctctcttcctaccatgagcgtgtaggcaatctcaaccaacccatcgaagtcaccgccctgtactccttcgaaggacagcagccaggagacctcaatttccaggctggggacaggattaccgttattagtaaaaccgattcccatttcgactggtgggaaggtaagctgaggggacagacagggatcttccccgcaaattacgtgacaatgaattag

SEQ ID NO: 33446 - DNA, 741 bp, Artificial Sequence
  Description of Artificial Sequence: Synthetic coding sequence
atggtttccgaccttgtgataatcctgaattacgatagggcagttgaggctttcgcaaaaggaggcaatctgaccctcggtgggaatctgacagtcgccgtgggcccactgggccggaatctggaaggcaacgtggcactgcgaagcagtgcagctgtgtttacctactgcaaaagccgaggtctttttgccggggtgtccctggagggatcatgtctgatcgaacgcaaagagaccaatcggaaattctattgccaggatattagggcctacgatatcctctttggcgacacgccgcgccctgcacaagctgaagacctttatgagattctcgattcttttaccgagaaatacgagaatgaggggcagcgcatcaacgcacggaaggccgctcgcgagcagaggaagagcagcgccaaggaactgcccccaaagccactctcccgccctcaacagtcctccgccccggtacagctgaatagcggatctcagagcaaccgtaatgaatataagctataccctgggttatcgtcataccatgagagagtgggtaacctcaaccaaccaattgaagtaaccgctttatatagcttcgaggggcaacagccgggtgacttgaatttccaagcaggcgacagaataaccgtcatctcaaaaactgattcccactttgactggtgggaaggcaagcttagaggtcagacaggaattttcccggccaactacgtgacaatgaactag

SEQ ID NO: 33447 - DNA, 156 bp, Artificial Sequence
  Description of Artificial Sequence: Synthetic coding sequence
atgaataatcctatcccatcaaacctgaaaagtgaggcaaagaaggccgctaagattcttcgtgaattcacggaaatcactagccgcaatgggcccgataaaattattcccgcccatgtgattgccaaggcgaaaggcctggcgattctgtcttag

SEQ ID NO: 33448 - DNA, 1047 bp, Artificial Sequence
  Description of Artificial Sequence: Synthetic coding sequence
atgccaggaaagcagagcgaagagggccctgctgaagccggcgccagtgaggattctgaagaggaaggactggggggtttgactctagaggagctccaacagggacaggaggcggcccgagcactcgaggatatgatgactttgagcgcgcagacacttgtgagggctgaagtggacgaactgtatgaagaagtgagaccacttggacagggctgctacggcagagtactgttagttacccataggcagaaagggactccattggccctgaaacagctccctaagccaaggacctcactgcggggatttctgtacgagttttgcgtcgggctttcccttggggcccacagtgcaatcgtgactgcctacggcatcggtatcgagtctgcgcacagctattccttccttactgaacctgttttgcatggcgatctcatggccttcatccagcccaaggtcgggctgcctcagcccgcagtacatagatgcgccgcgcagctagcgtctgccctcgaatacatacatgctaggggcttagtgtatcgtgatctgaagccagagaacgtcctcgtttgtgatccagcgtgtagaagattcaaactcacagatttcgggcacacaaggcccagagggacattgctcaggctcgccggaccccccattccctacaccgccccagagctgtgtgccccaccccccctcccggaggggctccccattcagccagccctggacgcgtgggcgctcggagtactgctgttctgcctcttgaccggatatttcccctgggatcggcccctggctgaagctgaccctttttatgaagattttttgatatggcaggcctccggccagccaagagatagacctcagccctggttcgggctggccgcagctgccgacgccctcttgcgcggactgctcgacccacatccccggcggaggtccgctgttatagccattagagagcacctcgggcgaccttggcggcagagagaaggggaagcggaggccgtgggcgcagtagaggaagaggccggacagtag

SEQ ID NO: 33449 - DNA, 1047 bp, Artificial Sequence
  Description of Artificial Sequence: Synthetic coding sequence
atgcccggcaaacagtcagaggaaggcccggctgaggcaggagcaagcgaggacagcgaggaagagggtctgggcgggctcactctggaagagctccaacagggccaagaggcagcaagagccctggaggatatgatgacactctctgcgcagacccttgttagagccgaagtggacgagctctacgaggaggtgagacccttaggccagggctgttatgggcgtgtcctcttagtaacacaccgacagaaagggacacctctggcactcaagcaactaccaaagcctagaaccagtctgcgcggcttcctctatgaattttgcgtgggcctgagtctgggcgcccactcggctattgttacagcctatggaatcggcatcgaaagcgcccattcttactccttcctaacagagccagtattgcatggggacttaatggcattcatacagccaaaggtgggcttacctcaacccgctgtacaccggtgcgctgctcaattggcttctgcactggagtacattcatgctagggggctggtgtacagggacttaaaacccgagaacgtattagtgtgtgaccccgcatgccgccgttttaagctcactgacttcggccatacccgcccaagggggaccctgttaagattagctggaccacctatcccctacaccgctccggaattatgcgccccacccccattgccggagggcctcccgatccagccggccctcgatgcttgggctttgggagtcctactcttctgccttctgacaggctactttccctgggataggccattagcagaggccgatcccttctatgaggatttcctcatctggcaagcctcggggcagcctagggatcggccgcagccctggttcgggctggccgcggccgcagatgcactgctccgggggttactggatccacaccctagacgtaggtcagccgtgatagctatcagagaacaccttggccgcccttggagacagagagagggggaggcagaagccgtaggggctgtggaggaggaggcaggtcagtag

SEQ ID NO: 33450 - DNA, 1182 bp, Artificial Sequence
  Description of Artificial Sequence: Synthetic coding sequence
atggccgagctccgccaggtccccgggggtcgcgagacgccccagggcgagttgagacctgaagtggtggaggatgaagtgcctcgatcccccgtggcggaagagccaggcgggggcggaagctcatctagcgaagccaagttatctccaagagaggaagaggaactggacccacgcatccaggaagagctggagcatctaaatcaggcatcagaagagatcaatcaggttgagctccagctggatgaggcgagaacgacatacaggcggatcttgcaagagagcgcccgaaagctaaacacccagggatcccacttaggttcctgcatagagaaagcacggccctattacgaggcacggcggctcgctaaggaagcccagcaggaaacacaaaaagctgccctaagatatgaacgggccgtaagtatgcacaatgctgcccgggaaatggtgttcgttgctgagcaaggtgtcatggccgataagaaccggctggaccctacttggcaagaaatgttgaatcatgcaacttgtaaagtcaatgaagctgaggaagaacgactgaggggggagagagaacaccaacgagttaccaggctttgccagcaggcggaggctcgggtgcaagcactccagaagactctgaggcgcgccatcggaaagagcagaccgtacttcgaactgaaggcacaattttcgcagattcttgaggagcacaaggcaaaggtgacagaactcgaacaacaggttgctcaggccaagacccgctactctgtggctttacggaatctggagcagatatctgaacagatccacgcccgtcggcgaggaggactgcctccacatccactgggacctcggagaagcagtccggtgggagctgaggccggtccggaggacatggaggatggtgactccggaattgagggagctgagggtgctggcctagaagagggttcaagcctggggcccggccctgcaccagataccgacaccctgagtttgctttccttgcgcaccgtagcatcagatttgcagaagtgtgacagtgtggaacatttgagggggcttagtgaccacgtaagtctggacggccaggagctcggtaccaggtcgggcgggaggcggggctcagacgggggtgcacgcggagggcggcaccagcggtccgtatctttgtag

SEQ ID NO: 33451 - DNA, 1086 bp, Artificial Sequence
  Description of Artificial Sequence: Synthetic coding sequence
atgtaccaagtgcctgatagacaagaatcattctggcagagtccatacctgcttagttttcctgaatgtttgactagctttccctgggaggaactagagcacctgaatcaagcttctgaagagatcaaccaggtagagctgcagttagacgaagccaggactacatacagacgaatcctccaagagtccgctaggaagctcaatacccagggcagccacctgggttcttgcatcgaaaaagctcgtccttattacgaggcccgtagactggctaaggaggcacagcaggaaacgcagaaagctgccctgcgctacgaaagggccgtaagcatgcataatgccgcccgcgaaatggtgtttgttgcagaacaaggtgtaatggctgacaagaacagactggatcctacttggcaggaaatgcttaatcatgcaacctgcaaagtgaacgaggccgaggaggagcgccttagaggtgaacgcgaacaccagcgtgtaactcgactttgccaacaggccgaggcacgcgtccaggctctgcagaaaaccctccggagagccattggaaaatctaggccttactttgaattgaaagcgcagttttcccagatcctagaggagcacaaagctaaagtgactgaactggaacagcaggtggctcaggctaaaacccgttactccgtagccctgcgcaatctggagcaaataagcgagcaaatccatgcccggcgcagggggggtctgccaccacaccccttgggcccgcggcggtcaagtcccgtgggagccgaggccgggccagaagacatggaagatggcgatagtgggatcgagggggcggaaggagcaggtctggaggaaggaagctctttggggcctggccctgcccccgacacagacactctgtcacttctgtcccttcgcaccgtcgcttcagatctgcaaaagtgcgactccgtagagcacctgcgaggactgtcagatcatgtttctctggacggtcaggaacttggcacgcgaagtggcggcaggcgtgggtcagacggtggcgctcgtggcggacgacaccagcggagcgtttcgttatag

SEQ ID NO: 33452 - DNA, 2169 bp, Artificial Sequence
  Description of Artificial Sequence: Synthetic coding sequence
atgagaccacaggaccccgcgctgtaccctcaagcaccgcaccctctcgccctggggcgggcatcacatccatcacagtcacggaacactcccccggggcggccaagagccgctgctcggtgcggccctcgccgcgccccaataggtcagtccggccgcggccgggaaaaatggccgacagccgctagtgctctggggctgttacggaggtggaggaggtccaaagccagcgtgcccgccgacagtttccgcaccatctcacctgatagaagaggcgaaaagtcagcatccgcagtcagtggagataccgcggccgctactaccctgaaaggaactgccattcccgtcagatccgtcgtcgcgagtccgagacctgttaaaggcaaagcgggtagggagactgcaagactacgcttgcagaggctccccgccgcccaggcggaggatacgggggaagccgccgccgccgctgccgaagagccactgctgcctgtgcccgaggacgaggaggaagcacagccgctgcccccagtctgcgtgtcacgcatgcgtggaatgtggcgggatgaaaaggtatccttgtactgtgatgaagttctgcaagactgtaaggccgaggacgctgacgaggtgatgggcaaatacttgtctgagaagcttaagctgaaagacaagtggcttggcgtttggaaaactaatcctagcgtcttctttgtgaaatatgaagaggctagcattcctttcgtaggaatcctagtcgaggtgacttgcgagccataccaagattcatctagtcgcttcaaggtgaccgtcagcgtggcggagccctttagcagcaacattgccaacattcccagggatctcgttgacgaaattctggaggaattggagcactcggtcccgttgttggaggtgtatccagtggaaggccaggataccgacatacatgtgattgcactggccttggaagtcgtgcgctttttctacgactttttgtggcgggattgggacgacgaagagagttgcgagaactacactgctctcattgaagaaaggatcaatctatggtgtgacatccaggacggcaccattcccggacccatagctcaaagattcaagaaaaccctcgagaagtacaagaataagagagtggagctcattgaatatcaatcaaacattaaggaggatccttccgcggccgaagcggtggagtgctggaaaaaatattatgaaattgttatgctgtgcggcctcctgaagatgtgggaggatcttagactgcgggtgcacggaccatttttcccacggattctgcgacgccggaagggcaaacgtgagtttggtaagacaattacacacattgtggctaaaatgatgaccacagagatgatcaaggatctatcatccgacactttgctccaacagcacggagacctggatttggcacttgacaattgctactccggggacacagtcattatattccctggagaatatcaggccgctaatctggctcttctgaccgatgatatcatcataaaaggggttgggaagagggaggagatcatgattaccagcgagccgagtagggattcttttgtggtgagtaaagctgacaacgtgaaactgatgcacctctctctgattcagcagggcacagttgacggaattgttgtggtggaatccggccacatgacccttgagaactgtatcctgaaatgcgagggcacgggggtctgcgtcctgaccggagcagcattgactataaccgatagtgagatcacaggagctcagggggcaggtgttgagttgtacccgggatccatagccatcttggagagaaatgaaatccatcactgtaacaacctgaggacaagcaactcttccaagtctacccttggaggcgtgaacatgaaggtgcttcccgcccctaagctcaaaatgaccaacaaccacatatattccaacaagggctacggagtctccatattgcaacctatggaacaatttttcattgttgccgaggaggctctgaataaacgggcctcgtccggagacaagaaagacgacaagatgctttttaaagtgatgcaaaacttgaatttagaaatgaataacaataagattgaagctaatgtcaaaggcgatattaggatcgtgacgtcatag

SEQ ID NO: 33453 - DNA, 1962 bp, Artificial Sequence
  Description of Artificial Sequence: Synthetic coding sequence
atggcgagtggaagcaaggcttctgttcccgcagactcatttcgcacaatctcccctgacaggcggggagagaaatccgccagcgctgtcagcggcgacacggccgccgccacaacactgaaggggacggccatacccgtgcggagcgtcgtcgcaagtcctagacctgtgaagggaaaggccggccgagaaactgctagattaagacttcagcggctccccgccgcccaggccgaggatactggtgaggcggcggccgccgcagctgaggaacccctattgcccgtgccagaagatgaagaagaggcgcaacccctccctcctgtgtgcgtttcccggatgagaggtatgtggcgggacgagaaggtaagcctttactgcgacgaagtgctgcaggattgtaaagccgaggatgccgacgaggtgatgggcaagtacctgtctgaaaagctaaagctgaaggataaatggctgggcgtgtggaaaacgaacccctccgtttttttcgtgaagtatgaagaagcctcaattcccttcgtagggattctggttgaggtgacgtgtgagccctaccaggacagttcatccagattcaaagttacagtcagtgttgccgagcctttcagttcaaatatagccaacatccctagggacttggtggatgaaatcctcgaagagcttgagcacagtgttcccctcctggaagtctatcccgtagaaggacaggacaccgacatccatgtaattgctctggctttagaggtggtgcgctttttttatgatttcttgtggagggattgggacgacgaagagtcttgcgaaaattataccgcactgatcgaagagagaatcaacctttggtgtgatatccaggatgggaccattcctggtcccatcgcccaaagatttaagaaaaccctcgaaaaatacaagaacaagcgcgtggagttaatcgaatatcagtctaatattaaggaggatccatccgccgctgaggccgttgagtgttggaaaaagtattacgaaattgtgatgctctgcggcttgctcaagatgtgggaggatttgcggctccgcgttcacggaccttttttccctcgaatcttgcggcggcgtaagggcaagcgggagtttggcaaaacgattacacacatcgttgccaagatgatgactacagaaatgattaaggacttaagttccgataccctgctgcagcaacatggcgaccttgatttggcgctagataattgctattctggagatacagttatcatcttccccggcgaatatcaggctgccaatctggcgctgctgacagacgatatcattattaaaggggtgggtaagcgcgaggaaattatgatcacctccgaaccatccagagattcatttgtggtcagtaaagccgacaatgtaaagctgatgcatctcagcctgatccagcaggggaccgtggacggaattgtggtggttgaaagtgggcatatgaccctagaaaactgcatcctgaagtgtgagggaacaggagtctgtgtgctgacaggtgcggctctgacaatcaccgactcagaaatcacaggggcccagggagcgggcgtggagctgtatccaggatcgatcgccatcctggagagaaacgaaattcaccattgtaataatctccgtacgtctaattcttctaaaagtacactgggcggggtcaatatgaaggtgctgccggcgccgaagctcaagatgactaataatcacatttacagtaataagggttatggagtctccatcctgcagcctatggagcagttttttattgttgcagaagaagccctcaacaagagagcgtcctccggggacaagaaggacgacaagatgttgtttaaggtgatgcaaaatctgaacctcgagatgaataataacaaaatcgaagccaacgttaaaggggacattaggatagtgacaagttag

SEQ ID NO: 33454 - DNA, 1605 bp, Artificial Sequence
  Description of Artificial Sequence: Synthetic coding sequence
atggggttcttacagctcgtccgactcgactcaaattctcggccacaggccgaggacgctgacgaggtgatggggaaatatctaagcgagaaactgaagctcaaggataagtggctcggcgtctggaagacgaatcccagcgtgttcttcgtaaaatacgaggaagccagcatacccttcgttgggattctggtggaggtgacctgcgagccgtaccaggatagcagtagcagattcaaggtgacagtgagcgttgccgagcccttcagcagcaacatcgccaacatccccagagacctggttgacgagattttggaggaactggagcatagcgtgcctctcctcgaagtgtacccagtggagggtcaagacaccgatatccacgtgatcgccctggctctcgaggttgtccggtttttttatgattttttatggagagattgggatgacgaggaaagctgcgagaactacactgctttaattgaggaaaggatcaatttgtggtgcgacatccaggacggcacgattcccggaccgattgctcagcggtttaaaaaaacattagagaaatacaaaaacaaaagagttgaactgatagaataccagtctaatatcaaggaggacccctcagcagccgaggccgtggagtgctggaagaagtattatgagatagtgatgctgtgcggcctgctaaaaatgtgggaggacctgcgcctcagagtgcatggccctttctttccccgcatccttaggaggaggaaaggcaagagagaatttgggaagaccatcacgcatattgtggccaaaatgatgacgacagaaatgatcaaggacctgtcctcagacactctgttacagcagcatggtgatttagacttggcactggacaactgttactcgggggacacggtgatcatttttcctggagaataccaggctgccaacctcgcactcctgactgacgatatcatcatcaaaggtgtcggaaaaagagaagagatcatgatcacctctgagccgtcccgggatagttttgtcgtgagtaaagcagataacgtaaagctgatgcatctgtccctgatccagcaaggaaccgtcgatggaatcgtggtggtcgagtcagggcacatgacactggaaaattgtatcttaaaatgtgaaggaactggggtgtgcgtgctcacaggggcagctctcactataaccgattctgagattactggagcccagggagcaggagttgaattgtatcccggctccatcgccatcctcgaaaggaacgagattcaccactgcaacaacttgagaacatctaattcctcaaagagtacactaggtggggtgaatatgaaggttcttccagccccaaaacttaaaatgactaataaccacatttactctaacaagggttatggggtgtccatcctccagcccatggaacagttctttattgtggccgaggaagccctgaataagcgggcctcctccggagacaaaaaagacgataaaatgctattcaaagttatgcaaaaccttaatctagagatgaataataataaaattgaggctaatgtgaaaggcgacataaggatagttactagctag

SEQ ID NO: 33455 - DNA, 1617 bp, Artificial Sequence
  Description of Artificial Sequence: Synthetic coding sequence
atgcctgccctcctgctgctggtgctgctggcttcttcagctggccaggctagggcacgcccctcaaatgccaccagcgccgagccggcggggcccctacccgctttgctagcacacctcagaaggctaactggtgccttgaccggaggaggaggggccgcaagcccgggcgctaacggaactagaaccgggcctgctgggggggccggcgctgctgctagggccccgcccccagcagaactttgccacggctactacgacgtgatgggccagtatgatgctaccttcaactgttctacaggttcttatcgtttttgttgtggcacgtgtcattaccgattctgctgcgaacacagacacatgaggttggcacaggcatcttgttcgaattatgacactcctagatgggccaccaccccgcctccactagccggcggtgccgggggggccgggggcgccggtggcggacccggccccggccaagcaggatggctggaaggggggaggaccggcggggccggcggacgcggcggtgaaggccctggggggagcacagcatacgtagtgtgtggagtgatttcatttgctcttgccgtcggggtcggagcaaaagtggcattttctaaagcaagcagggcccccagggctcacagagacattaatgttcctcgcgctctagttgatatcttacggcaccaagcaggaccaggaactcgcccagaccgagctcgttcctcttccctgacaccaggaattggagggccggacagcatgccaccgcggacccctaagaatctgtacaacacagtcaagacacctaacttggattggcgggccctccctcctccatcaccttcccttcactacagcaccctatcatgttcgcgaagctttcacaacctgtctcatctccccccaagttatgaagcggccgttaagtcagagctaaacaggtacagctctctcaaaaggttagccgagaaggatctggatgaagcatacctgaaacgtcggcccctggagttgccgaggggaaccttgcctcttcatgctcttagacggcccggcacaggaggtggctatagaatggaggcttggggcggccccgaggaacttggactggctcctgcgccaaaccctcgtcgggtgatgtcccaggagcacctactgggggacgggggaaggtccagatacgaattcacactgccacgcgctcggctggtgagccaggaacatctcctgctgagctctcctgaggccctgcgacagtcaagggagcacctgttgtctccccccagatcccccgcactcccccctgatccaacagcacgggctagtctcgccgccagccactcaaatttgctcctcgggcccggcggccctcctactccacttcgaggtctccctcccccaagctctctccatgcccaccatcatcacgccctgcatggatcgccccagcctgcctggatgtccgatgcaggcggaggtggcggcaccctcgccaggcgaccaccattccagcggcaaggaaccctagagcagttacagttcatcccagggcatcacctgccacagcatcttcggacggcgtccaagaacgaggttacggtgtag

SEQ ID NO: 33456 - DNA, 960 bp, Artificial Sequence
  Description of Artificial Sequence: Synthetic coding sequence
atgggttggcgcagaaagcgggtgcctcaacgaggcaggaaagcaccgccaccacagctgcatggtaatatcaataatctgtactttcccatccggtggagggatagattacattgggactccccaaatcccgcagccgagtgccagcgacatgaggtgaccctagtttctaggaagcctggacctggacgaattacttgggatgaactggctgctagtggtctgccttcatgcgacgcagcggttaaccttgcgggggagaacatcctcaatcccttgcgccgatggaatgaaactttccaaaaagaggtcattggcagtcggctggagaccacgcagttgcttgcaaaagctataacgaaagctccccagcccccaaaagcttgggtgctggtaaccggggtggcctattaccagccctcacttaccgcagagtacgacgaggactcgccaggcggcgatttcgacttcttcagcaatctggtgaccaaatgggaggccgctgctcggcttccgggggattccacacggcaggtagtggtccgcagcggggtcgtgctcgggcgcggcggaggcgccatgggccatatgctgctgccctttcgattgggactgggcggcccgattgggtcaggccatcagttcttcccctggattcacatcggtgatctggccggcatccttactcatgctctggaggcaaaccacgtccacggcgtacttaatggtgtcgcacctagctccgccacgaatgccgaatttgcacaaacactcggcgctgcgctgggtcgaagggccttcatcccgctgcccagcgctgtggttcaggcggtcttcggtcgtcagagagccattatgctgctcgagggtcagaaagtgatcccgcagagaacgcttgctactggataccagtattcatttccagaactgggcgcagcgttgaaagagatagtggcatag

SEQ ID NO: 33457 - DNA, 597 bp, Artificial Sequence
  Description of Artificial Sequence: Synthetic coding sequence
atggctctctcccctaatggggaaattttgcgcgcccgggaagcctactatcagccaagcctgaccgcagagtacgatgaagactccccaggtggagacttcgactttttttccaacctcgtgacgaaatgggaggccgccgcccgcctccctggcgattcgacgcggcaggtggtggtgagaagcggtgtcgtgcttggacggggtggcggggccatgggacacatgcttcttcctttccggttgggcttgggtggtccgattggttctggacatcagttttttccctggattcacatcggggatctcgcaggcatcctcactcatgcactggaggcaaaccacgtccatggggtgcttaacggggttgccccctccagtgccaccaatgctgagttcgcacagacactgggggcggcacttgggcggcgtgccttcattccattacctagtgcagttgtgcaggccgttttcggacgccaacgcgctattatgctgctcgagggacagaaggtgatcccacagagaaccctagctacaggttaccaatactcatttcccgaactgggtgcagcactcaaggaaatcgtggcctag

SEQ ID NO: 33458 - DNA, 882 bp, Artificial Sequence
  Description of Artificial Sequence: Synthetic coding sequence
atgagagtgctagtcgggggtggaacaggattcatcggaacagctttgactcagttactgaacgcccgagggcatgaagtaacgttagtctctaggaaacctggccctggcaggatcacttgggatgagctcgccgccagcgggctgccgagttgcgatgccgctgtgaatctggcaggcgagaatatcctgaatccactgaggaggtggaacgagacctttcagaaagaggttataggttcgaggttagagaccacacaactgttagccaaagccattacaaaagccccgcagcccccgaaggcgtgggttctcgtcaccggtgtggcctattaccagccctcactgaccgcggagtacgacgaggattcccctgggggcgactttgactttttttctaatttagtgaccaagtgggaagcggcagcacgcctcccgggcgattctacccggcaggtggtggtgagatcgggtgtggtcctaggcagaggcggcggtgccatgggccacatgctcctcccctttagactgggcttgggaggccccattggatcaggccaccagttttttccttggatccatattggggatctcgccggtattcttactcacgcactcgaggcaaaccatgtccacggtgtgctcaacggggttgcacctagttcagccaccaatgccgaatttgcacagaccttgggggctgcactcggtaggagagcatttattccattgccaagcgccgtggtgcaagctgtgtttgggagacaacgagcaatcatgctgctggagggtcagaaagttatcccacagagaacactagcgactgggtaccagtactcttttcccgagctgggagctgccctcaaggagatcgtcgcctag

SEQ ID NO: 33459 - DNA, 468 bp, Artificial Sequence
  Description of Artificial Sequence: Synthetic coding sequence
tttcacgttgcaagttatggcatgtccggtgcagaaaagttacagaaagaacagatcgagagcatcaacgtgggggggacgaagctcgttatcgacgtttgtgtgcgacggagagtaccccgacttatctatacttcgacagtgaacgttgcttttggggggaagcctatagaacagggggacgaggactccgtaccctatttccctttagatgagcacgtggaccattactcgagaacaaaggcgatagccgatcagctaactttaatggctaacggaatgcctctgccaggcgggggcactctgcggacttgcgtcttgaggcctcctggaatatacggtcctgaagagcagaggcacttaccacgcgtggcaggtcacataaagaaacggctttttatgttcaggttcggcgatcacaaggcccgtatgaactgggtccacgtacacaatttggtccaggcttag

SEQ ID NO: 33460 - DNA, 4482 bp, Artificial Sequence
  Description of Artificial Sequence: Synthetic coding sequence
atggagaaccgccctggctcctttcagtatgtccccgtgcagttgcagggaggggcgccatgggggtttaccctgaaaggtggtctggagcattgtgagccacttaccgttagtaagattgaggatgggggtaaggccgctcttagccagaaaatgcgtaccggggacgagttagtaaacatcaacggcactcctttgtatggtagcaggcaggaagcactgatactgatcaaggggagcttcaggatcctgaagcttattgtgcgcagaaggaatgctcctgttagtaggccacactcctggcacgtggccaagctactggaaggatgcccggaagccgcaaccaccatgcatttcccttctgaagctttttctctttcttggcactccggttgtaataccagcgacgtttgtgtgcagtggtgtcccctgagtcggcattgtagtaccgaaaagagctccagcatcggcagcatggagagcctcgagcagccaggtcaggccacatacgagagtcatcttctccctatcgatcagaatatgtaccctaatcagagggactcagcgtacagtagcttttcagcctccagcaacgcgagcgactgtgccttgtccctgcgtcctgaagagccagcctccactgattgcataatgcaagggccagggcccaccaaagcgccaagtggacgccctaatgtggccgagacgtctggaggcagccggcggaccaacggcggacacttgaccccatcatctcagatgagttcacgcccgcaggagggataccagtcaggtccagctaaagctgtgagagggcctcctcaacctcccgtccggagggattccttgcaggcttcgagagcacagctccttaacggcgaacagagaagggcttccgaacccgttgttccgctgccccagaaggagaaactgtctcttgaaccggtattgccagcccgaaatcccaacaggttctgctgtctctctggacacgatcaagtgacctctgaggggcatcagaactgcgagttttcacaaccgccggaaagttctcagcagggctctgaacacctcctgatgcaggcgagcactaaagcggttgggtcgcccaaagcctgcgatcgggctagcagcgttgacagcaaccccctcaacgaagcttccgccgagctcgctaaggcatctttcggtcgtccccctcaccttattggccctactggccatcggcacagcgccccggaacagcttttggcatctcacctgcagcacgtacacttagatactcgagggagcaagggcatggagttgccccccgtgcaggatggacaccaatggactttgtctcctctccatagcagccataaaggtaagaagtctccttgcccccctacaggtgggacacacgaccaatcatcaaaagaacgcaagactaggcaagtggacgaccgctccctagtactgggccatcagtcccagtcttcaccaccccacggcgaggccgatggccaccccagcgaaaaaggctttctggaccccaacagaactagccgcgcagcaagtgagctcgcaaaccagcaaccaagtgcttctggatctctggtacaacaggcaacagattgctcaagtacgactaaagcagcctcaggcacagaagctggagaagaaggagactccgaaccaaaagaatgttccagaatgggtgggcgccgcagcggaggtactagaggtaggtctatccaaaacagacggaaatctgaacggtttgccactaatctgcgtaacgagatccagcggcgcaaggcgcagttacagaaatctaaaggccctctgtcgcaactgtgtgacacaaaggaacccgttgaagagacgcaggaaccccccgaaagccccccccttaccgccagtaatacctcactgctgtcctcttgcaagaaaccacctagcccccgcgacaagttattcaacaaatctatgatgcttcgtgcgcgaagctctgagtgcctaagccaggcaccagaatctcacgagtcccggacaggattggaaggcagaataagccctggccagaggccagggcagtctagtctcgggctgaacacttggtggaaggcgccggatccatcttcaagtgatcccgagaaagctcacgcccactgcggtgtccgtggaggccactggagatggagccctgagcacaattcccagccgctagtggccgctgccatggagggacctagcaaccctggcgataacaaagaactgaaggcttccacggctcaggccggcgaggacgccatcttgctgcctttcgctgatcggaggaaattcttcgaggaatcaagcaaatccctttcaactagccacctgcccggcctgacaacacactcaaataagacatttacacagagacccaagccgatcgatcaaaattttcaacccatgagcagcagctgcagagagctgagaaggcatcccatggaccagtcttaccactccgctgaccagccctatcacgctacggaccagtcataccactccatgagtcctttgcagtctgagacacccacatactcagaatgctttgcaagcaaaggcctcgagaactccatgtgctgcaagccgctgcactgcggcgactttgattaccaccggacatgcagttactcctgcagcgttcagggggcactggttcacgacccctgcatctactgctccggggagatctgcccggcgctgctgaaacgcaacatgatgccgaattgctacaattgtagatgtcatcaccaccagtgcatccgctgttcagtctgttatcataatccacaacattcagccctggaggactctagtctggcgcctgggaatacttggaagccacgcaaactgactgtgcaagagttcccgggcgacaaatggaatccaattactggcaacagaaaaacatctcagtcagggagagagatggctcactccaagacctcattctcttgggccactcctttccatccatgcctggagaatcccgccctggatctcagctcttacagagctatttcctcgcttgatcttttgggcgacttcaagcacgcccttaagaagtccgaagaaacaagcgtgtatgaggagggtagcagtctggcaagcatgccacacccattgagatctcgcgcattctccgagtcccacataagcttagcgcctcagtctacacgggcatgggggcagcaccgaagagagctcttcagcaagggcgacgagactcaaagcgatttgctcggagcccggaaaaaagcatttccaccaccgcgaccaccaccacctaactgggaaaagtaccgcctgtttcgtgccgcccagcagcagaagcagcagcagcaacagcagaaacagcaggaagaggaggaggaagaggaggaggaagaggaagaagaggaagaggaggaggaggaagaggcagaggaagaagaggaggaacttcccccacaatactttagcagtgaaacatcgggatcttgtgccctcaatcctgaggaggtgctagagcaacctcagcccctctccttcgggcatcttgaaggatctcggcagggctcacagtccgtgccggccgagcaggagagtttcgcactgcattcgagcgacttcctgcctcctattcggggccacctcgggagtcagccggagcaagcacagcctccctgttactacggcatagggggtctgtggaggacaagtgggcaggaagctactgagtcagccaagcaggaattccaacatttctcacctccctcaggcgctcccgggatcccaacgagttacagcgcctattataatatatctgtagccaaggccgagctccttaacaagcttaaagatcagcctgagatggctgagattggcttgggtgaggaagaagttgatcacgagctggcccagaaaaaaatccagctcatcgagagtatttcccggaagctgtctgttctgcgcgaggctcaaagaggtctgttggaggatatcaatgcaaattcagcactgggcgaggaagtggaagcgaatttaaaagccgtgtgtaaatctaatgagtttgaaaaataccatcttttcgtcggtgacctggataaagtcgtcaacctactgctgtctctgtcaggaagactggcccgcgtcgagaacgctctcaatagcatcgattccgaagctaatcaggagaagcttgtgctgattgaaaagaagcagcagctcactggccagttagcagatgctaaagagctgaaggaacacgtggatcggagagaaaagctcgtcttcgggatggtgtctcgctacttaccccaggatcagctccaagactatcaacacttcgtgaagatgaagtccgccctgattatagaacagcgggaactagaagagaaaatcaagcttggagaggagcagctcaagtgtctccgcgagtcactgctgttgggtccaagcaatttctag

SEQ ID NO: 33461 - DNA, 1365 bp, Artificial Sequence
  Description of Artificial Sequence: Synthetic coding sequence
atggtgccaggccaggctcaaccacagtctccagagatgctgctcctgcctttattgctgccagtgctgggagcgggcagtttgaataaagatccttcttacagtttacaggttcaacgccaggtgcccgttccagaagggttatgcgtgattgtgagctgcaacctttcttacccaagggacggctgggacgagtccacagctgcatatggctactggtttaaggggtggacttcaccaaaaactggtgctcctgtagccacaaacaaccaatctagagaggtggaaatgtctaccagagaccgctttcagctgaccggcgatccaggtaagggcagttgctctttggtgattagagatgcacaacgcgaagatgaggcctggtatttttttagagtggagaggggatcccgggtgaggcactcgtttgttaacaacttattctcagtaagcgcgccggcccttacccagaaacctgacgtctatatccctgagaccctagagcccggacagcctgtcaccgtcatttgtgttttcaattgggcatttaaaaagtgccccgctccttctttctcctggaccggcgcggctctgtccccaagaagaacaagacccagcacttctcacttttctgtgctcagcttcactccttctccacaggatcatgatacagacctcacgtgtcacgtggacttttctcggaagggagtgagcgcgcaacgcacagtgagattgagagtagcgtacgcgccaaaggacctgatcatctccattagtcatgacaatacttcagctctggagttgcagggcaacgtgatttacttggaggtgcagaaagggcaattcctgcggctgctatgtgctgccgatagtcagccacctgccacattgtcatgggttctacaggatcgagtgctttcctcctcccacccgtgggggcctcggacactgggtctggagctacggggggtgcgggccggtgactccggacgctacacatgccgcgccgaaaaccggctgggttcccagcagagggccttagacctgtccgtgcagtacccccccgaaaacttacgcgtcatggtatctcaggccaataggaccgtgctcgagaatctgcggaacggtaccagccttcgggtactcgagggtcagtccctgcgcctggtttgtgtaactcattcctctcccccggctaggctgtcttggacccggtggggccaaactgttggtccctctcagccctcagaccccggtgtgctcgagctgccgcgggtccagatggaacatgagggggagtttacatgtcacgctcggcaccctcttggatcccagagagtatcactctcgttttcagtccactag

SEQ ID NO: 33462 - DNA, 1446 bp, Artificial Sequence
  Description of Artificial Sequence: Synthetic coding sequence
atgctgctgctaccactcttgttacccgtacttggcgccggtagcctgaacaaagacccctcctacagcctgcaggttcagaggcaggtaccagtcccagagggactgtgcgtcatcgtgagctgtaatctatcttatccccgagatgggtgggatgagtctacagctgcatacggatattggttcaagggctggacctcacccaaaactggcgccccggttgccactaacaatcagtccagagaagtcgagatgagcactagggatcggttccaattaactggcgatccaggcaagggctcctgtagcctcgtgatccgggacgctcagcgcgaggacgaggcatggtattttttcagagtggagagaggctctagagtcaggcatagcttcgtaaacaatctgttctcggtgagcgcacccgcccttacacagaagcccgatgtctacatcccagaaaccctcgagccaggacaacccgtgactgttatttgcgtgtttaattgggctttcaaaaagtgtcctgccccgtcgttcagttggaccggcgcagctctgtccccaagacgcacacggccttcgacaagccacttctccgtgctttcatttactccctcccctcaagatcatgatacagacttaacgtgtcatgtagacttcagtagaaagggagtgtccgcacaacggacggtccgtctcagagtggcttcattggaattgcagggaaacgtaatatacctggaggtgcagaaagggcagtttctccgcctgctttgtgcagccgacagtcagccccccgccacgttgtcctgggttctccaggatagggtcctgtcctcttcacacccttgggggcctcgcacactggggctggaactgagaggagtgcgggcgggtgactcaggccgctacacatgtcgcgccgagaacaggctcgggtctcagcagagagccttggacctcagtgtgcagtatcctcccgagaatcttcgcgtgatggtgagccaggccaacaggactgtcctcgagaacctccgtaacggtactagcctgcgcgtactggaggggcaatctcttagattggtctgcgtaactcactccagcccccccgcccgcttgagttggaccagatgggggcagaccgtcggtccgagccaacctagcgacccaggcgttctcgagctcccccgcgtgcagatggaacacgaaggagaatttacttgccatgcaagacatccactcggaagccaacgagtgagtctgagttttagtgtccactgcaagagcggccctatgacaggggtggtgcttgtggccgtgggcgaggtcgctatgaaaattctgctgttgtgcctctgcctgatactgctcagggtgcggagctgtagacgcaaagccgcgcgcgctgcactcggcatggaggccgccgacgcagtcacagattag

SEQ ID NO: 33463 - DNA, 924 bp, Artificial Sequence
  Description of Artificial Sequence: Synthetic coding sequence
atggctgctgctgtggcagcggccttggccaggcttctagccgccttcctgctcctggctgcccaagttgcttgcgagtatggtatggtgcatgtcgtgagtcaggcaggcgggccagagggcaaagattattgcattctgtacaaccctcagtgggcacatctccctcacgatttatcaaaagctagcttcctgcaactgaggaattggaccgcaagcctgctatgctccgcagccgatttgccggctagaggatttagcaaccagatacctctggtggcgcggggaaactgcactttctacgagaaggtgaggttggcacagggatcaggcgcgagggggctgctcatcgtgtcccgcgaacgtctagtgccacccggcggcaataagactcagtatgacgagattgggattcctgtggccctcctgagctacaaggacatgctggacattttcacccggttcggccggaccgtccgtgccgcgctttacgccccgaaggaacccgttctggactataacatggtgatcatctttatcatggctgtcggaaccgttgccatcggaggttactgggccgggtcccgcgatgttaagaaacgctatatgaagcataagcgggatgacggcccagaaaagcaggaggatgaagctgtcgacgtgacacctgtgatgacttgtgtattcgtggtcatgtgctgcagcatgctagtcctactgtactacttttatgacctgcttgtgtacgttgtgatcggcatcttctgtctggcatctgctactggattgtactcttgcctcgcaccctgtgtgcgccggctgccctccggaaaaaagaggcctcaggcacgcatgctgcttctcgccctgttttgcgtcgctgtgtccgtagtatggggggtattccgcaacgaggaccagtag

SEQ ID NO: 33464 - DNA, 1533 bp, Artificial Sequence
  Description of Artificial Sequence: Synthetic coding sequence
atggccgcagctgtggctgccgcccttgcacgcttactggccgcttttcttctgttggccgcccaggttgcctgcgagtatggaatggtccatgtggtgagccaagcgggcggcccggaagggaaggactactgtattctgtataatcctcagtgggcacatcttccccacgacttatcaaaagcctcttttctgcaacttagaaattggacagcctctctgttatgcagcgccgccgacttaccggcaaggggctttagtaaccagatacccctcgtcgctaggggcaattgtactttttacgaaaaggtgcgtctggctcagggttccggggctcgggggctcctgatcgtgagcagggagagactcgtgccacctggaggtaacaagacacagtacgacgagataggcattcctgtggccctcctgagttacaaagacatgcttgacatcttcacacggtttggtagaacggtgagggctgccctgtacgcaccaaaagagccagtgttggactacaatatggttataatatttatcatggcagtaggcacagtggctataggcggttattgggctggtagcagggacgttaagaagcggtacatgaaacataagcgagatgacggcccggaaaagcaggaagatgaggccgttgacgttacacctgtcatgacatgtgtcttcgtcgtcatgtgttgctccatgctcgtgctgctctactatttctacgacctcctcgtctacgttgtgatcgggattttctgccttgcatccgctactggactctatagttgcctagccccctgtgtgagaaggctgtttgggaagtgcaggattcccaataattcacttccatattttcacaaaagacctcaggccaggatgcttttgctcgccctgttttgcgtggctgtttctgtggtgtggggggtcttcagaaacgaggaccagtgggcttgggtactgcaggacgccctggggatcgccttttgtctgtatatgctcaaaaccattcgattgccaaccttcaaagcctgcactttgcttttgctagtcctatttttatacgatattttctttgtctttatcacgcctttcctgacaaaatcagggtcttcgatcatggtggaggtggcaactggtcccagtgactcagcaacgcgggagaagctacccatggtattgaaggtacctaggctgaactcatcgccgctcgcactgtgtgaccgccctttttcgctgctaggatttggggatatcttggtaccggggctactggtagcctactgccatcgctttgacatccaagtgcagtcatcccgagtgtatttcgttgcgtgcaccatagcatacggtgtaggcctcttagtaacctttgtcgctctagccctgatgcagaggggtcagcctgcgttgctgtatctcgtgccatgcaccctggttacttcatgtgccgtggcgttatggcggcgtgaactcggggtattctggaccggatccggcttcgccgtgaatacaagcctgctgtag

SEQ ID NO: 33465 - DNA, 522 bp, Artificial Sequence
  Description of Artificial Sequence: Synthetic coding sequence
atggccgctatggcctcactgggtgctctggctctactgctcctcagtagcctgagccgttgtagtgccgaggcctgccttgaaccccaaatcactccatcctactacaccacttccgatgctgtcatctccacagagaccgttttcatcgtagagatcagcctcacctgtaagaaccgagtacagaatatggccttgtacgccgatgtgggcggaaagcaatttcccgttacaagggggcaagatgtgggaaggtatcaagtgagttggtctctggatcacaaatccgcacatgccggaacctatgaggtgaggttttttgacgaggaatcttattcactcttgcgaaaagctcaaagaaacaatgaggatatcagcatcattccacctctgttcacggtctccgtagaccatcggggcacctggaacgggccgtgggtatcaactgaggttctagctgcagcaattggcctggttatttactacttagccttctccgctaagtcccatattcaggcctag

SEQ ID NO: 33466 - DNA, 522 bp, Artificial Sequence
  Description of Artificial Sequence: Synthetic coding sequence
atggccgccatggctagtttaggagctctggcattgctgcttctgagttccctgagccggtgcagtgcagaggcttgcctggagccccaaattactccttcttattatactacatcagacgcagtcatatcgaccgagacagtttttattgttgaaattagcctgacctgtaagaaccgggtgcagaacatggctctctacgcggacgtggggggtaagcagtttccggtgacacgaggacaggatgtgggccggtaccaggtatcatggtcactggaccacaagtcagcacatgcagggacttacgaggttcgattcttcgatgaagagtcctactctctgctgcggaaagcacagaggaacaatgaagatatttctattataccaccgctattcacagtcagcgtggatcaccggggcacatggaacggcccctgggtttcaaccgaagtgctggccgctgccataggcctagttatctattatttagctttttcagccaagtcccacatccaggcctag

SEQ ID NO: 33467 - DNA, 522 bp, Artificial Sequence
  Description of Artificial Sequence: Synthetic coding sequence
atggcggccatggccagcctgggagccctggctctgctcctgctgtcctctttatcacgttgtagtgcggaggcgtgcttggaacctcagatcacacctagctattacactacttctgacgccgttatcagcacagaaacagtttttattgtcgagatttcattgacatgcaagaatagggtgcagaacatggcactttatgctgacgttggtggcaagcaattccccgtcacccggggccaggacgtgggacgctatcaagtgagctggtctttagaccacaagtcagctcatgcagggacgtacgaggtccgtttttttgatgaggagagttacagccttctgaggaaagctcagagaaataatgaagatatctctataattccaccgctcttcactgtcagcgtcgaccaccggggtacatggaacggtccctgggttagcacggaggtgttagccgccgctatcggcctggttatatattatctggccttttccgctaagagtcacatccaggcttag

SEQ ID NO: 33468 - DNA, 2961 bp, Artificial Sequence
  Description of Artificial Sequence: Synthetic coding sequence
atgccccgcgccacatgggctaattcaaaggaacggtcctgggcagaatcggaaagagggccccgcgatacggggaatggtgggtctaaagcagagcgccacattcaggaaatcgagacgggtagagggggggatagagcaaaggcgcaccggcgtcagcgaatgcggctgaggggtactgaacgtgccagcctggggccgggccgaaggttgggggattcccggggcacagatatgccaggggcccgtgcccaggggctggctgccgccatgacagaagagtctgaagagaccgtgctgtatatcgagcaccgctacgtgtgttctgagtgtaatcagttgtatggaagtctagaggaggtgctgatgcaccagaacagtcacgtcccgcaacagcatttcgagctggttggcgtggccgaccccggggtcactgtggctacagatacagccagtgggaccggcctgtatcagacccttgtgcaggaaagccagtaccaatgcctggagtgtggtcagctgctgatgtctccaagccagctcctcgagcaccaagagctccacctgaaaatgatggcccctcaggaggcggtgcccgcagaaccttctccaaaggccccacccctcagcagcagcactatccattacgagtgcgtcgactgcaaagcactgtttgcaagccaggaattgtggttaaaccataggcaaacccacttgagggccaccccaactaaggctcctgcacctgtcgtgctgggtagtcccgtggtgctcggccctccagtggggcaggctcgcgttgctgttgagcactcttatcggaaagcggaagaaggcggagaaggggcgacagtccctagcgcagccgccaccacgacagaggtcgttaccgaggttgagttactgctctacaagtgtagcgagtgttcccagctctttcagttgcctgccgattttctggagcaccaggccacgcacttcccggcgccagtgccagaatctcaggaaccggcactccagcaagaagtgcaggcatccagccctgccgaggtgccagtgtcccagccagaccccttgcccgctagtgaccatagctacgaattgcgaaatggcgaagctatagggagggaccgccggggccggcgagcgaggcgtaataactctggggaagccgggggggcagcaacccaggaactattctgctcagcgtgtgatcagctgtttctctcacctcatcagctgcagcagcacttgcgcagccatcgggagggagtgttcaagtgtccactttgctctagggtgttccctagtccttcctctctggatcagcaccttggggatcacagctcagagagccatttcttgtgcgtagattgtgggctagcatttggtaccgaggccctcttgctcgcccatcgccgggcacacactccaaatcctctgcattcctgtccttgcggaaaaactttcgtcaatctgacaaagtttctgtaccataggagaacccacggagtcggcggcgttccactgccaacaacgccagtcccacctgaggagcctgtgataggattccccgaaccagctcccgccgagacgggcgaacctgaggcccctgagccacctgtgagtgaagaaacctccgctggaccagcagccccaggcacatacagatgtttactttgcagccgcgaatttggaaaagccctccagctgacacgacaccagagatttgtgcacagacttgaacgtagacacaagtgctctatttgcgggaaaatgtttaagaaaaaatcccacgtcagaaaccacttacgaacacataccggcgagcgcccattcccatgtcccgactgctctaagccattcaactcaccggcaaacttggctagacaccgcttaacacacacaggtgagaggccctatcgctgcggtgattgtggaaaagccttcacccagtcctctacgctgagacagcatagactagtgcatgcccaacatttcccataccgctgtcaagagtgtggcgtgcgctttcacaggccctacagactgctcatgcatcgttatcaccataccggcgaatacccctacaaatgccgcgaatgtcctcgctccttcctgctgcggagactgttagaagtccaccagctggtagtgcacgcagggagacagccccacaggtgtccatcctgtggagcggcctttccctcttccctcagactcagggaacatagatgcgccgccgccgcggcgcaggctcctcggcgattcgaatgtggaacttgcgggaaaaaggtcggctcagctgccagattacaggcacacgaggcagcgcatgcggccgcaggtcccggtgaagttcttgctaaggagcccccggcaccaagagcgccccgggccacccgggcacccgtggcttctcccgctgctctggggtccactgccacggcctctcctgccgcccctgcgagaagacggggactcgagtgcagcgaatgtaagaaactcttcagcacagaaaccagcctccaggtgcaccgccgcatccacaccggtgaacggccatatccatgccccgactgcggaaaggcctttcggcagtccacacatctgaaagatcaccggcgcctgcacactggggaacgcccctttgcatgtgaggtctgtgggaaggcttttgctatcagcatgaggctcgccgagcatcgccgtattcacacgggcgagagaccctactcgtgccctgattgcggcaagagctatcggtcatttagcaatctgtggaaacaccggaagacccatcaacagcagcaccaggccgctgtccggcaacagctggcagaagcagaggcagccgttggtctcgctgtgatggaaaccgccgtcgaagccttaccactggtcgaggccatcgaaatctatcctctcgcggaggcagagggtgtccaaattagcggatag

SEQ ID NO: 33469 - DNA, 447 bp, Artificial Sequence
  Description of Artificial Sequence: Synthetic coding sequence
atgtttcgtcgtcccgtgcttcaggttctgagacaatttgtgcggcacgaatccgaaacaacaacctccttggtcttggaacgcagccttaatcgggtgcatctgttggggagagtgggacaggacccagttctacgtcaggtagaaggaaaaaatcctgtcactatattctcgctggccaccaatgaaatgtggcgatccggggatagcgaagtttatcagctgggggacgtctctcagaagacaacatggcaccggatctccgtctttagacccgggcttcgggatgtggcttatcagtacgtgaagaaggggagccgaatttatctggaaggcaagatcgactacggcgagtacatggacaagaacaatgtgaggcggcaggccactactataattgccgataatattatattcctctctgaccagactaaggagaaagaatag

SEQ ID NO: 33470 - DNA, 447 bp, Artificial Sequence
  Description of Artificial Sequence: Synthetic coding sequence
atgtttaggcgcccagtcctgcaggttctcagacaattcgtgagacacgaatccgagaccaccacgagcctagtgctggaaagatccctcaacagggtccacctcctggggcgggttggccaggaccccgtcctccggcaggtcgaaggcaagaatcccgtaacaatcttctctttagccacaaatgagatgtggcgaagcggcgactctgaggtctatcagctcggggatgtgagccagaagacaacctggcacaggatatctgtgttcagaccgggcctgagagatgttgcctaccaatatgttaagaagggcagtcggatttatctggaaggaaaaatagactacggagagtatatggacaagaacaacgtgcggaggcaggccaccactatcatcgccgataatatcattttcctcagtgatcagaccaaggagaaggaatag

SEQ ID NO: 33471 - DNA, 408 bp, Artificial Sequence
  Description of Artificial Sequence: Synthetic coding sequence
atgtttcgtcgacccgtgctgcaggtgttacgccagtttgtcaggcacgagtccgagaccaccacttcgctagtgctggagcggtctttgaaccgtgtccacttattaggccgtgttggccaggaccccgtgttgagacaagtcgaaggcaagaaccccgttaccatcttcagtttagccaccaatgagatgtggagatctggggactccgaagtctaccaactgggcgatgtgagtcagaagacaacctggcatagaatttcggttttccggcctggcttaagggacgtggcttatcagtatgtcaagaaaggttcgaggatctatctggaaggaaagatagattacggggaatatatggacaagaacaatgtgagaaggcaagcaaccactatcattgccgactag

SEQ ID NO: 33472 - DNA, 447 bp, Artificial Sequence
  Description of Artificial Sequence: Synthetic coding sequence
atgtttcggcgccccgtcctgcaagtcctgagacaattcgtccgacacgagagcgagaccacaacgtcccttgttctcgagagaagtttgaatcgcgtccacctcctggggagggtgggccaggaccccgtcctacggcaggtcgaaggcaagaatccagtgactatcttttctttggctacaaatgaaatgtggcgctctggggactccgaagtgtatcaactgggggacgttagccagaagaccacgtggcatagaatcagtgtattcagaccaggacttagagatgtcgcttatcagtatgtcaaaaagggaagtcggatttatttggagggaaaaatcgattacggtgagtacatggataaaaacaatgtccgacggcaagcaaccaccataattgcagacaacataatctttttgtccgaccaaaccaaggaaaaggaatag

SEQ ID NO: 33473 - DNA, 576 bp, Artificial Sequence
  Description of Artificial Sequence: Synthetic coding sequence
atgggatataagttacaggacctcactgacgtgcaaattatggctcgtctgcaagaggaaaacaagcttaggcggtcaatgccaaacctggccagaatgccctcaaccacggctatcagttctaacattagctcccctgtgaccgtcaggaattcgcagagtttcgattcgagtctgcacggagcgggaaatggcatatctagaattcagtcttgcattccctcccccggccagttgcagcacagggtgcacagcgtgggtcactttcctgtgtcaattaggcagcctctgaaggctactgcgtatgtgtctccaacagtgcagggttcctccaacatgccgctgtctaatgggttacagctgtattcaaacacaggcatacccacccccaacaaggccgcagcctctgggatcatggggagaagcgccctgcccagaccaagcctggcaatcaatgggagcaatctgcccagaagcaaaatcgcgcaacctgttagatctttccttcagccgccgaagccactgagttcactgagcacccttagggacggaaactggagagacggttgttattag

SEQ ID NO: 33474 - DNA, 918 bp, Artificial Sequence
  Description of Artificial Sequence: Synthetic coding sequence
atgggatacaaactgcaggatctaacagatgtgcagataatggccagactacaagaggaatctctgaggcaggattatgcttcaacctcagcttctgttagcagacactcctctagcgttagcctttcttcagggaagaagggtacatgttccgaccaggagtacgaccagtatagcctggaagacgaagaagaatttgaccacctcccgccgccccaaccaagattgccccggtgctctccattccagagaggcattccacacagccagacatttagttccattagagagtgccggcggtccccctcatcgcagtatttccctagcaacaactatcaacagcagcagtattattcaccgcaggcacagacccccgatcagcagccaaacaggactaatggggacaaactgcgacggtcaatgccgaacctagctcggatgcccagtaccaccgcgatctcttcaaacattagctctcctgttacagtgagaaattctcagtcctttgactcttctctgcacggtgcaggtaatgggataagccgcatccagtcctgtatcccatctccgggacagctgcagcatagagtgcacagtgtggggcattttcccgtcagcatccggcagcctctgaaggccacagcttacgtgtccccaaccgttcagggcagctccaacatgccattgtccaatgggttacagttgtacagcaacacaggtattcccacaccgaacaaggcagccgctagtgggattatgggacggagcgcccttccccggcctagccttgccatcaacggctcaaaccttccacgaagcaaaatcgcccagcctgttagatcatttctgcagccgccaaaacctctatcttcacttagcactttaagagacggtaactggagagatggatgctactag

SEQ ID NO: 33475 - DNA, 918 bp, Artificial Sequence
  Description of Artificial Sequence: Synthetic coding sequence
atgggctataaattgcaggatttaactgacgttcagattatggcaaggcttcaggaggaatccttgagacaagactacgcttccacaagcgcctctgtatcccgtcattcatcttccgtcagtctgagctccgggaagaagggcacctgctcagaccaggagtatgaccagtattcccttgaggatgaggaggaatttgatcacctccctcctccccaacccagactcccgcgctgtagcccatttcaaagagggatcccccatagccagacgttttcctccatcagagaatgcaggaggagcccttcttctcaatattttccatctaacaactatcaacagcagcagtactactcgccacaagcccaaaccccagaccagcaaccgaacagaacgaatggcgacaaactgcgccggagtatgcccaatcttgccagaatgccctctacgactgcaatttcctcaaatatcagctcaccggtgacagtgcggaattcccaatctttcgatagcagtctgcatggggctggaaacgggatatctagaatccagagctgcatcccctccccaggtcagttacagcatagggtccattccgtgggccatttccctgtgtcaatccgccagcccctgaaggccacagcctatgtatctcccactgttcagggttcttccaatatgccgctgagcaatggactgcaactgtatagcaacacaggcattcctacacccaacaaagcagcagctagtggcattatgggacgtagcgcacttccgagaccttcccttgccatcaatgggagtaacctaccaagatccaaaatagcccaaccggtacgttcattcctgcagcctccgaaacctctctcttctctgtccacccttagagacgggaactggagagacggatgctattag

SEQ ID NO: 33476 - DNA, 255 bp, Artificial Sequence
  Description of Artificial Sequence: Synthetic coding sequence
atgtaccgctatcagagctgtcggtggaagaatactctgtttctttgcgtgtccggctacacaagtagaggctcaccgctcagtccccagtctagcattgacagcgagttgagtacctccgaactggaggacgacagcatcagcatggggtacaaactgcaggacctcactgatgtacagatcatggcacgcctgcaggaggaaagcctccggcaggactacgcttcaacatccgcaagtgtgtcccggcactag

SEQ ID NO: 33477 - DNA, 1707 bp, Artificial Sequence
  Description of Artificial Sequence: Synthetic coding sequence
atgatggctgaacaggtaaagtgtgcatccgcgggtgttagctctggagcgggcagcgggcctgtggtcaatgccgagttagaggtcaagaaattacaagagctcgtcaggaagcttgagaagcaaaatgaacagcttaggtccagagctgcctccgcagcagcggctccccacctgttgctgcttcccccacccccccctgccgccccaccaccggcgggcctccagccattggggcctcgcagcccacctgcggccaccgccactgccgccgcttccggcggtctcggtccagccttccccggtacgttttgtctgccttctccagcgccatcattgctctgcagccttgctcagccccccgaagctccattcgtgtactttaagcctgctgctggattcttcggcgccgggggcggagggccagaaccggggggcgccggaacacctcccggcgcggcggccgcacctccttctccccccccaaccttgcttgatgaggttgagcttttggatctggaaagcgtggcagcatggcgggacgaagatgactacacatggctgtatatcggttcttccaagaccttcacaagctctgagaagagcctgacacccctccagtggtgccgacatgtgcttgataatcctacacctgagatggaggctgctaggaggtcactgtgttttcgcctcgaacaaggttatacctcccgaggctctcccctttccccgcagtctagcatagatagcgagctgagtacctccgaactagaggacgacagtataagtatgggctacaaattgcaggacctcacggacgtccagataatggctcggctgcaggaggaaagtttaaggcaggattatgcttctactagtgcgagcgtctctagacacagcagtagtgtgagcctgagttcagggaaaaaaggtacatgctcggaccaggagtacgaccaatactcactggaggatgaggaagaatttgatcacctgcccccaccccagccacgtctaccacgatgttcccccttccaacgcggaattccgcactcccaaacgtttagttctattcgtgaatgcagacggagcccatcaagccagtacttccctagtaacaactatcagcaacagcagtactattccccccaggcacagactcctgatcaacagcctaaccggaccaacggggataagctcaggagatcgatgcctaatctcgccaggatgcccagcactaccgccatttcgtcaaacataagttcacctgtaaccgtccgcaattcacagtccttcgacagcagtctacacggcgctggcaatggcattagccgcattcaatcctgcataccctcccctggtcagctgcaacaccgggttcactccgtgggacacttcccagtctccatccggcaacctctgaaagcaaccgcctatgtgtcccctaccgtgcaggggtcctcaaatatgcccttgagcaatggacttcagctctactcaaacacaggaatcccaacaccaaacaaagctgcagcaagtggaattatgggaagatccgcattaccacggccctcactggcgatcaacggaagcaacctgccccgttcaaagatagcacagcctgttcggagcttcctgcaacctcctaaacccctgagcagcctctcgacattgagagacggcaactggcgggacggatgctactag

SEQ ID NO: 33478 - DNA, 1050 bp, Artificial Sequence
  Description of Artificial Sequence: Synthetic coding sequence
atggaggcagctagacgcagtctgtgcttcagattggagcagggatacacgtcccgaggctcaccgctcagtcctcagagctccatcgatagcgagctgtcgacgagcgagctcgaagatgattctattagcatgggatacaaacttcaagacctcactgacgtgcagattatggcccgattgcaggaagaatcattaaggcaggactatgcctctacttcagcaagcgtgtcacgccactcctcctccgtctctctatcttcggggaagaagggaacttgctcagaccaggagtacgaccagtactctctggaagatgaggaggaattcgaccatctgccccccccccagcctagactccccagatgctccccgtttcagagaggcatccctcattcccaaactttttcaagcattcgtgagtgccgccgctccccatcctcccaatacttccctagcaacaactatcagcagcagcagtattattctccacaggcccagacacctgatcaacagcccaatcgcaccaatggcgacaaactgcggcgctccatgcctaatctggccaggatgccttccactacggcgatatcaagtaacatcagcagcccagtaacagtacggaactctcaatcttttgactcctctttgcatggagctggcaacggcatcagtagaattcaatcatgtataccttctccgggtcagcttcaacaccgcgtacatagtgtaggacactttccggtgtcaatccgccagcctcttaaggccactgcgtacgtgtcaccgacagtgcagggttcctcaaacatgcctctctctaatggcctccagctgtacagcaacactggtattcccacaccgaacaaggctgcagcctccggcataatggggagatctgcattgccgaggccgtctctggcaatcaatggctcaaatctacctaggtccaagattgcccagccagtacgctccttcctccagcctcccaagccgctctcttctctctccacactgcgcgatgggaactggcgtgacggctgctattag

SEQ ID NO: 33479 - DNA, 723 bp, Artificial Sequence
  Description of Artificial Sequence: Synthetic coding sequence
atggggtataagctgcaggacctaactgacgttcagatcatggcacgtctccaagaggagtcattgcgacaagactatgcatctacctccgccagcgtgagccggcatagctccagtgtatcgctatcatcaggaaagaaaggcacatgctccgaccaggagtatgaccagtatagcttagaagacgaagaagagtttgatcaccttcctccacctcagccccggctgccaaggtgtagcccatttcaacggggtatcccacacagccagaccttcagctctattcgcgagtgcagaagatctccttcctcacagtacttcccatctaataactaccaacaacagcagtactactccccacaggctcagacacctgaccaacagcccaaccgtacaaatggggacaagttgcgccgcagtatgcccaatttggctagaatgccgagcactacagccatctcttctaacatcagttcgccagtgaccgtgcggaattcacagagtttcgattcctcattacatggcgccggaaatggaatatctaggattcagagctgcattcccagccctggccaactgcagcacagggttcatagcgtgggccacttccctgtctccatccggcaaccgcttaaagccaccgcatacgtgagccccaccgtgcagggctcgtcaaacatgcccctgtccaacggtttgcagctatattccaacacaggctag

SEQ ID NO: 33480 - DNA, 1707 bp, Artificial Sequence
  Description of Artificial Sequence: Synthetic coding sequence
atgatggccgagcaggttaaatgtgcaagtgcaggagtttcaagtggtgccgggagcgggcccgtggtgaatgccgagttggaggtaaagaagttgcaagaacttgtgcgcaaacttgagaagcaaaatgagcagttgaggagccgggcagcgagcgctgcggccgcaccacatctccttcttctcccccctccaccgccggcagccccaccacctgcaggacttcagcctctggggccccggtcccctcccgctgcgactgccactgcagccgcaagtggcggtctgggtcctgcctttcccggcaccttctgtttgccttcccccgcccccagtctactgtgctccctggcccagcctcctgaagccccctttgtctacttcaaacctgccgccggatttttcggcgcaggcggcggtggccctgagcctggcggagccggcactcccccaggggcagctgccgcccctcctagtccaccaccaacactgttagacgaggtagagcttttggatctggaatccgtcgcggcatggcgtgatgaggacgactatacctggttgtatatcgggtcttcaaaaacatttaccagtagtgagaaatctcttacacccctgcagtggtgtagacatgtgctggacaaccccacacccgaaatggaggccgctagacggagcctgtgttttcgactggagcaggggtacacgtcaagaggatcaccccttagcccacaaagctcgattgactcagagctgagcacctctgagctggaggacgattccatttccatgggttacaagctccaagatttgaccgatgtgcaaattatggcgcgcttgcaagaggagtctttgagacaagattacgcgtctacctctgcatccgtgagccggcatagcagcagcgtctccctttctagtggaaaaaaaggtacctgttctgaccaggagtacgatcagtacagcttagaggatgaagaagaattcgaccatcttccacccccacaaccccgtttgccaagatgttcgccttttcaacgggggatcccccatagtcaaacattctctagcatacgtgagtgccgacgatcccctagttcccagtacttcccctctaataactatcaacagcagcagtactatagcccacaggcgcagacccccgaccagcagcctaataggacaaatggggacaaactgcgtagaagcatgcctaatctggcgcgcatgccgtctaccacagccattagttctaacattagttctcctgttactgtgcgcaacagccagagctttgacagtagcctgcatggggcaggcaacggaatcagcagaattcagtcctgtattccttcgcccggtcaactccagcatagggtacacagcgtggggcacttccccgtgagtattcgtcagcccctaaaggctaccgcctacgtttcacccacagtccaggggtcttccaacatgccactgtccaatgggcttcaactttacagcaatacaggcattccaacccctaataaagcagcagcatccgggataatggggcggagcgccctgccaagaccttctctcgctattaatggatctaatctccccagatcaaaaatcgcccaacccgtgcggtctttcctgcagccaccaaaacccctgtcctcacttagcacattgagggacggcaattggcgggatggatgttattag

SEQ ID NO: 33481 - DNA, 444 bp, Artificial Sequence
  Description of Artificial Sequence: Synthetic coding sequence
atgggttacaagttacaggacctcactgacgtccagatcatggcgagactgcaagaagagtctctccggcaggactatgcaagcacttctgcctcggtgagtcgacatagttcctccgtgtcactctctagcgggaaaaagggaacttgctcagaccaggaatacgaccagtattcactggaggatgaagaggagttcgaccacctgcctcctccccagcctaggctgcccagatgcagcccatttcagcgtgggatcccacactctcagactttctcctcaatcagagagtgcagacgctctccgagtagccagtatttcccatctaataactatcagcagcagcaatattacagcccccaggctcagacaccagaccagcagcccaaccgcactaatggggacaaactgcgtcgaagcatgcctaatctcgctaggatgtag

SEQ ID NO: 33482 - DNA, 39 bp, Artificial Sequence
  Description of Artificial Sequence: Synthetic coding sequence
atgggctacaaattgcaggatctgacagatgtacagtag

SEQ ID NO: 33483 - DNA, 1281 bp, Artificial Sequence
  Description of Artificial Sequence: Synthetic coding sequence
atggtgggcgtaggcctttgtcttcgcctgctcctgttctttagatttaagcgcaccctggaccgaatctgtgttcttttcctgcttggctggcacagaaaaccacgctctgatggcagtctctttattgagcgcctgtatataggctcttctaaaacttttacatcgagcgaaaagtccctgactccactgcagtggtgtcggcacgtgctggacaatcctacaccggaaatggaggctgcgcgccggtccctgtgttttcgactggagcagggttacacatccaggggatccccactgtcaccccagtcaagcattgactcagagctctctacctccgagttggaggatgactcaatctccatgggctataagcttcaagacttgactgatgtccagattatggcacgcctgcaggaggaatctctgcggcaggactatgcctccacctccgcttccgtgagccggcactcatcaagcgttagcctatcttctggcaagaaaggcacctgctcagatcaggagtacgatcaatacagtctagaggacgaggaggagttcgaccacctacctcctccacagcctcgcctcccacgctgcagtccctttcagcgcggaattccacattcccaaaccttttctagcatccgggagtgcagacggtctcccagttcccagtacttcccatctaacaattaccagcagcagcagtattattcaccccaagcccaaacgccagaccaacagcctaacagaaccaacggcgataagcttcgtcgaagtatgcctaatctagcacggatgccaagcacaactgctatatcttccaatattagcagcccagtgaccgttcgcaattctcagagctttgattcttcgcttcatggcgccggaaatgggatctcccgaatacagtcctgtattccttcacctgggcagctgcagcatagagtacactcagtgggccactttcctgtgtccatccggcagcctctgaaggccacggcctacgtgtccccaactgtgcagggttcatctaacatgccgctgtctaacgggctgcagctttacagtaataccgggatcccgacgcccaacaaggcggcagcaagcgggatcatgggccgctccgcattgccaaggccaagtcttgctattaatggttccaatctgcctcggagcaagatcgcccagcctgtcaggtcctttctgcagcctcccaaacctttgtcatccttgtccacccttagagatggcaattggcgggatgggtgctactag

SEQ ID NO: 33484 - DNA, 408 bp, Artificial Sequence
  Description of Artificial Sequence: Synthetic coding sequence
atgggctacaaactccaggacctgactgacgtccagatcatggcccgcctgcaggaagaaagtctccggcaggattatgcgagcacatccgcgagtgttagtaggcattcctcttccgtaagcttgagttctggcaaaaaagggacttgcagcgatcaggaatacgaccagtactcacttgaggacgaggaggaatttgatcacctgccaccaccccaaccccgattgccgagatgttccccatttcaaagaggcattccgcattcacagaccttttcatcaatccgagagtgtcggaggagtccatcctctcaatacttcccatcaaataattaccagcaacaacagtattacagcccccaggcccaaactcccgaccagcagccaaacaggacaaatggagggtag

SEQ ID NO: 33485 - DNA, 2538 bp, Artificial Sequence
  Description of Artificial Sequence: Synthetic coding sequence
atgctcagcggagtgtggttcctctccgtgctgaccgtagccgggattttgcaaacggagagcagaaagaccgccaaagacatctgtaagattcgatgtctgtgtgaggaaaaagaaaatgtactgaatatcaactgtgagaacaagggctttactactgtatctctgctgcagccccctcagtaccgaatatatcagctctttctcaacggcaatctgctgacacgtctatatcccaacgagttcgtaaactactccaatgccgtgaccctacatcttgggaacaacggactccaagaaatccgcaccggggccttcagcggcctaaagactctgaaaaggctccatttgaacaacaacaaactcgagatcctaagagaggataccttcctcggcctcgaatcactggaatacttgcaagccgattacaattacatatccgccattgaggccggtgccttctcaaagcttaacaaactcaaggtgctgatcttgaacgacaatttgctcctctcactacccagcaatgtgtttagattcgtgttgctaacccacctggacctgcgggggaatcgcctgaaagtcatgccctttgccggggtgctggagcacattggtgggatcatggagatccagctcgaagagaatccgtggaattgcacctgcgacctgctccccctaaaggcgtggctggacacgatcactgtgtttgtgggtgagatcgtgtgcgagacgccatttcgcctgcacggaaaggatgtgacacagctgacccgccaagatctgtgtccaagaaagtctgctagcgactccagtcaaagagggtctcacgctgacactcatgttcaacggctatccccgacgatgaatcccgccctcaaccctacacgagcaccgaaagccagcagaccgccaaaaatgcgcaacagaccaactccccgggtgaccgtgtccaaggatcgccagtcgtttgggcccatcatggtttaccagacgaagtcccccgtgcccctgacctgtccaagctcttgtgtctgcacctcacagtcaagcgataatggactcaacgtgaattgccaggaaagaaagtttactaacatctcagaccttcagcctaaaccaacctctcctaaaaagttatatctgactgggaattaccttcagaccgtgtacaagaacgaccttctggagtatagctccctcgatctgttgcatttgggcaataatagaattgccgtgatacaagagggagcattcactaatctgacttcactgcgcaggctgtacctcaacggaaattatttagaggttctgtatccgtccatgttcgatggccttcagagcctgcaatacttgtacctggagtacaacgttatcaaagagatcaagccactgacgttcgatgcacttattaatcttcagctgctgtttcttaataacaatctcctgaggagcctgccagacaatatttttggtggcacggctcttacgcgccttaacctcaggaacaatcatttctcacacttgcccgtgaagggcgtcctggaccagttacctgccttcattcagattgatctccaggagaatccatgggattgtacctgcgatataatggggctcaaggattggacagaacacgccaattcacctgtgattatcaacgaggtcacctgtgagtcccctgccaagcatgccggcgaaatcctgaagtttctcggacgtgaggctatctgtccagactctccgaacctgtccgatgggactgttctgtccatgaatcacaacaccgatacacctcgctccctttctgtgagcccctcttcatatcccgaattacataccgaagtgccattatctgtactcattctcggactgcttgtcgttttcatcctgtctgtctgttttggggccgggctctttgtcttcgtgttaaaacgacggaaaggcgttccaagcgttccacgcaataccaataatctggacgtgagttcctttcaattgcagtatgggtcctacaacacagagactcatgataaaaccgatgggcacgtctacaactatatcccaccccctgtggggcagatgtgtcaaaatcctatatatatgcaaaaggagggagaccccgttgcctactacagaaacctccaggaattcagctacagtaacctggaagaaaagaaggaggagcccgccacccctgcttacacaatcagtgctacagaactgctcgaaaagcaggcaaccccccgggagccagagcttctatatcagaacatcgcagaaagggtgaaggaactgcccagcgccggattggtccattataatttctgcactctgccaaaaaggcagttcgctcctagctatgagagcaggcgacagaatcaggaccgcattaacaaaacagtgctgtacggcaccccccggaaatgctttgtggggcagtccaagccaaatcaccccctccttcaggcaaagccccagagcgagccagactacctggaagttcttgagaagcaaacagccatttcacagttatag

SEQ ID NO: 33486 - DNA, 2538 bp, Artificial Sequence
  Description of Artificial Sequence: Synthetic coding sequence
atgctgtcaggggtctggttcctgagcgttctcaccgtggctggaatactgcagaccgagtcacggaagaccgccaaggacatttgcaagatccgctgcctctgtgaggagaaagagaacgttttgaacattaattgcgagaacaaaggcttcacaactgtaagcctgttgcagcccccccaatatcgtatctaccagctttttcttaacggcaacctgcttacgagactctatccaaacgaatttgtcaactatagcaacgccgtcaccctccacctcggcaataatgggttgcaagagatcaggaccggcgccttcagtggcttgaagacactgaaacgattgcatctgaataacaataaactggaaattctccgcgaggacacttttttggggcttgaatctctggagtacttacaggctgattacaactacatctctgccatcgaggccggggcctttagcaagcttaataagctgaaggtcttgattctaaacgataacttgttactgagtctgccatctaatgtgttccgttttgtcttactgacccacctagacctgcgcgggaaccgtctcaaggtgatgccttttgccggcgtcttagaacacatcggaggaatcatggagattcagctcgaagaaaacccatggaattgcacctgcgacctgctgccccttaaagcatggcttgataccattactgtgtttgtgggcgagatagtttgcgaaacaccttttagactgcatggaaaagacgtgacacagttgacacgccaggacctctgtcccagaaaatcagcatcagactcttctcagaggggaagtcacgccgacactcatgtgcaacggcttagcccgactatgaatccagccctgaaccctacacgggcccccaaggcctccagaccccccaagatgaggaatagaccaactccccgcgtgaccgtgagcaaggaccgtcagagtttcggacctattatggtctatcagacgaagtcaccagttccactcacatgcccatcctcatgtgtgtgcacctctcagagcagcgataatggattgaatgtgaactgccaggaacgaaagttcacaaatatctcagatctacagccaaaacctacgagccccaaaaagctataccttacaggaaattatttgcaaaccgtatataaaaacgacctgctggagtacagctccctggacctacttcacctggggaataataggatcgcggtgatccaggagggggctttcacgaacttgacgtcactccggcggctgtatctcaacggcaactacctggaggtcttgtatccatctatgtttgacggactccagagccttcagtatctatacctggagtataatgtgataaaggaaatcaagcccttgacctttgacgctctgatcaatctgcagttgctgttccttaataacaacctccttaggtccctgccggacaacatattcgggggtaccgcacttacaaggctcaacttacgcaacaatcacttttctcacctcccggtaaaaggcgtgctggaccagcttccagcgttcatccaaatcgatctgcaggagaatccctgggactgcacctgtgacatcatgggactgaaggattggaccgagcacgccaatagtcccgtgattatcaatgaagttacctgtgagtctccagccaagcatgcaggagaaattctgaagtttctgggccgagaagcaatctgtccggatagtcctaacctcagtgacggaaccgtcctgagtatgaaccacaataccgacactcctcgctccttgtccgtctcaccctcctcctatcctgaactgcatacagaggtccctcttagcgtcttaatcttgggtttactggtggtgttcatcctgtctgtatgtttcggcgcgggtctgttcgtttttgttctgaagagaaggaaaggggtgccctccgtgcctagaaatacaaacaacttggatgtttcgtcattccaactgcaatacggtagctataatacagagacccacgacaagacggacggccatgtgtataattacattcccccacccgtgggccagatgtgccagaaccccatctacatgcagaaagagggagaccccgtcgcgtactacaggaacttgcaggaattctcctattccaacctcgaagaaaaaaaagaagagccggccaccccagcctatactatttcagccaccgagttgctagagaaacaggctacaccaagggaacccgaactcctgtatcaaaatatcgcagaaagagtgaaagaactgccctccgcgggtttagtgcactacaacttttgcacgttgcctaagcgccaatttgctccctcatatgaatcccgaaggcagaatcaggaccggattaacaagacagtgctctacgggactccaaggaaatgctttgtgggccagagcaagcctaatcatcccctcctccaggcaaaaccacagagtgaacccgattacctagaagtgctggagaagcagaccgcaatctcccagctgtag

SEQ ID NO: 33487 - DNA, 2538 bp, Artificial Sequence
  Description of Artificial Sequence: Synthetic coding sequence
atgctgtctggagtttggtttctgtcagtcctcaccgtcgcagggatactgcagaccgaaagcagaaagacagcaaaggatatatgcaagatccggtgtctctgtgaagaaaaagaaaacgtactgaatatcaattgcgagaacaaggggttcaccacagtgagtctgctccagccccctcagtaccggatttaccagttgtttctgaatggaaatctccttacccggctataccccaacgagtttgtcaactactctaacgctgtgactcttcacctgggaaacaacgggcttcaggagatcagaactggcgctttctctggactgaagaccctgaaaaggcttcatctaaataataacaagctggagatcctgcgggaggatacctttctaggtcttgaatccctcgagtacctgcaggcggactataactacatttccgctatagaagctggtgccttttcgaagcttaacaagctgaaagttctcatcctgaatgacaatctgctgttatcactaccaagcaacgtctttcgcttcgttttgcttacacatttggatctgcggggaaatcgactgaaagtgatgccgtttgcaggcgtcctggaacacattggcggcattatggaaatacagctggaagagaatccgtggaattgcacctgtgaccttcttcccctgaaagcatggttggatactatcactgtctttgttggggagatagtctgtgagacaccattccgcctgcacggcaaagatgtgacacagctgaccaggcaggatctgtgcccccgaaagagcgctagcgactcttcacagagagggtcccacgcagacacccacgtccagaggttgagcccaacaatgaatcccgctctaaatccgacaagggcccctaaggcctcccgcccaccaaaaatgcggaacagacctacccctcgcgtaaccgtctccaaggataggcagagctttgggcccattatggtgtaccagactaaaagtcctgtgcctctgacttgtccatcaagctgtgtctgcacctcacaaagtagtgacaatggtctgaacgtcaactgccaggaacgcaagttcacaaacataagtgacctccagcctaaacctaccagccctaaaaaactttatctgactggaaactacctgcagacagtgtacaaaaacgatctcctggaatatagctccctcgatctgttacacctcgggaataatagaatagctgtaatccaggaaggggccttcaccaacttaacaagcctcagaaggctgtacttaaacggtaactatctggaagtcctgtacccatccatgtttgatggcctgcagagtttgcaatatttgtacctcgagtacaatgtgatcaaggagattaaacccctcactttcgacgcactgattaatctgcaactgcttttcctaaacaataatttgctgaggtctttgcctgacaatattttcggcggcacggcacttacccgtctgaacctcagaaataaccacttctcacacctgccagtgaagggcgtcctggatcagttgccggcctttatccagatcgatctccaggaaaatccatgggactgtacatgcgatattatgggtttaaaagattggaccgaacacgccaatagcccagtaattatcaacgaggtcacttgtgaatccccggctaagcatgccggggaaattctgaaatttctgggacgggaagccatatgccccgactccccgaacctgtcagacgggaccgttctctccatgaatcacaatacggacacccctaggagtttgtccgtatccccatcaagctaccctgagctgcacacagaggtacccctgtccgtcctgatcctcggattgctggtagtgtttatcttaagtgtttgtttcggcgctggcttattcgtgttcgtacttaaacgtaggaaaggcgtaccgagtgtgccccggaacaccaacaacttggacgtctcttcctttcagctgcaatatggctcttacaatacagagacacatgataagacggacggtcatgtgtacaactatatccctccccctgtcggccagatgtgtcagaatcctatctacatgcaaaaggagggagaccccgttgcctactaccgcaacctccaggagttttcttactccaatctggaagaaaaaaaggaagaaccagctacacctgcttataccatcagcgctaccgaactacttgagaaacaagccacccctagggagcccgagttactctaccagaacattgcagagagggtgaaggaactgccctcagccggcttagtccactataacttctgcaccctgccgaagcgccaattcgctcccagctacgaatctaggagacagaatcaggatcggatcaacaagacagtgctgtatggcactccaaggaaatgcttcgtcggccagagcaagccaaatcatcccttgctccaggcaaaaccccagtccgagccggattatctagaggttctggaaaaacaaaccgctattagccagctttag

SEQ ID NO: 33488 - DNA, 333 bp, Artificial Sequence
  Description of Artificial Sequence: Synthetic coding sequence
atggctcgtggaaatcaaagagagttagcgaggcagaaaaacatgaagaaaacacaggagatcagcaagggcaaacggaaggaggattctctgacagccagccagcggaagcagtctagcggtgggcaaaaaagcgaaagcaaaatgtcggctggaccccatttgcctctgaaagctcccagagaaaacccatgtttccccctccccgccgctgggggcagccgctattacctagcctacggatctataacacctatttcagcctttgtgtttgtggtttttttttctgtgtttttcccgtcgttttacgaggatttttgctgctggatttag

SEQ ID NO: 33489 - DNA, 189 bp, Artificial Sequence
  Description of Artificial Sequence: Synthetic coding sequence
atggctcgtgggaatcagcgcgagctagccaggcagaagaacatgaaaaagacccaggagatatccaaagggaagaggaaagaagacagcttaacagcgtctcaacggaagcagcgtgattctgagattatgcaggaaaagcagaaggcggcaaacgagaagaagtctatgcagacacgcgagaaatag

SEQ ID NO: 33490 - DNA, 915 bp, Artificial Sequence
  Description of Artificial Sequence: Synthetic coding sequence
atgtccagcattaagcatctggtctacgctgttatcaggttcctgagagaacagagccagatggatacctacaccagcgatgaacaggagtctctggaggtagctatccagtgcctagaaactgtgtttaaaattagccccgaggatacccatctcgcagtttctcaaccactgactgagatgtttaccagttccttttgcaagaatgatgtattaccgctttccaattccgtcccagaagacgtcggaaaggcggatcaattgaaggacgagggcaataaccatatgaaagaagagaattacgctgccgccgtggactgttacacccaggcaatcgaacttgatccaaacaatgcagtttactattgtaatagggcggccgcacaatcaaagctgggacactataccgatgctattaaggactgtgagaaagcaattgcaatcgactccaagtactctaaggcctacgggcgcatgggtttggccctcacagctctgaataagtttgaggaagcagtgaccagctaccagaaggcactcgatctggatcccgagaatgacagctataagtctaatttaaagatcgctgagcagaaactgcgcgaggtttcttcaccgactggtactggcctatccttcgacatggctagcctaattaacaatccagcctttatttcaatggcggcttcactgatgcagaatccgcaggtgcagcaactgatgtcgggcatgatgaccaacgccataggtggccccgcggctggcgtgggggggctcacagatttgtcctctctcattcaggcagggcaacagttcgcccagcaaatccaacaacagaatcccgagctcatagaacagctgagaaaccatattcgatcaagatccttctcatcttccgctgaggagcattcctag

SEQ ID NO: 33491 - DNA, 588 bp, Artificial Sequence
  Description of Artificial Sequence: Synthetic coding sequence
atgagttcgatcaagcacctcgtttatgcagtgatccggtttctcagggagcagtctcagatggacacttatacttccgacgagcaggagtccctggaagtggcgatccagtgccttgaaaccgtgttcaagatcagccccgaggatacccacctcgccgtgtcacagccccttactgagatgttcacctcctctttttgcaagaatgacgtgctccccctctctaactctgtccccgaggacgtgggtaaggccgaccaactgaaagatgaagggaacaatcacatgaaggaggaaaattacgccgcagccgtagactgttatacacaagccatcgaactagacccaaacaatgcagtatattactgcaatagggctgccgcccagtccaagctcggccactatacagatgccattaaggactgcgaaaaagctatcgcaatcgattcaaagtactcaaaagcatatggccgcatgggcttagccttaactgctctgaacaagtttgaagaagctgtgacctcataccagaaggccctggacctggaccctgagaatgattcctacaagagcaacctcaagatttag

SEQ ID NO: 33492 - DNA, 237 bp, Artificial Sequence
  Description of Artificial Sequence: Synthetic coding sequence
atgcagcctcaggagagccatgtgcactactcaagatgggaggacgggagtagggatggagtgagtttaggtgccgtttcctctaccgaggaggccagcagatgccgtagaattagtcaaagattatgcaccgggaagctggggatcgcgatgaaggtattagggggggttgctttgttttggatcatcttcatattaggctatctgactggttactatgtccacaagtgcaagtag

SEQ ID NO: 33493 - DNA, 189 bp, Artificial Sequence
  Description of Artificial Sequence: Synthetic coding sequence
atggatcagctcgtctttaaggaaactatctggaatgacgccttttggcagaatccgtgggaccagggggggcttgccgtgatcattctattcataaccgcagtgctgctactcattctattcgctattgtattcggcctgctcacctccactgagaacacccagtgtgaggctggggaagaagaatag

SEQ ID NO: 33494 - DNA, 279 bp, Artificial Sequence
  Description of Artificial Sequence: Synthetic coding sequence
atggcttacagtggccagggccaaaaagtccagaaggttatggtacagcctatcaatctcatattcaggtacctgcagaaccgctcacagatccaggtttggctgtatgaacaggtcaacatgcaaatcgagggctgtattatcgggtttgatgagtacatgaacttagtgttggacgacgccgaggaaatccattctaaaacaaaaagccgaaaacagcttgggcgtattatgctgaaaggtgacaacataaccctcctccagagtgtgtcaaattag

SEQ ID NO: 33495 - DNA, 297 bp, Artificial Sequence
  Description of Artificial Sequence: Synthetic coding sequence
atgcaggttccacttaccccactttgggaactgggcctcgggcgagtggtggagaacgccgatgcactggctatcgcaatcgtcttaaacaaccagtggagtctggtacccaatagagggatcctgtatttcctaccagtgtcaatgaaattgggcggggacagagtgagctgtcagttcctgaccgctacttcacaccaatggttacacagcgtgagcctgactcagcacatggctcaagaatgcctgcccagcgtgagcgtgtcaacagcagccattccccgatgttggagctag

SEQ ID NO: 33496 - DNA, 423 bp, Artificial Sequence
  Description of Artificial Sequence: Synthetic coding sequence
atgcggaggtgccttcgggtgaagactcggcgcggacagcttggcttggcatccagttgttttgagcaacatagctgtttttcaccgcgcgtgaataggatactgtcagccgtgcagaataccctatgcaccggcccctcttcccaggcacctccacaaccgccacaggcatctccccccgcagctgccgatcacagtagaactccaagcctgttggcctcttcccattctgcttcaggcggcgaaagcctatttcagctgtacattgccagtctagcatggcctcaaaactgctgtgtacttgagtcttgccgcagaatcccactggggggtttgtcctccatggaaaaccgaaggcctctgctccgtaagggccgcctcttaaggggccagattcaccactcacaaactaacgagctgtag

SEQ ID NO: 33497 - DNA, 2814 bp, Artificial Sequence
  Description of Artificial Sequence: Synthetic coding sequence
atgatcagcgccccagatgtcgttgctttcacaaaagaagaggaatacgaagaggagccttacaacgaacccgctctccctgaggagtattctgtgccgctcttcccatttgctagtcaaggtgccaacccgtggagcaaactcagtggagctaagttttcgagagatttcatactgataagcgagttcagtgagcaggtcggacctcagccattgctgaccattcctaacgataccaaggtttttggcacctttgacctgaattatttctccctgagaattatgagtgtggactatcaggcctcattcgtggggcacccacctggaagtgcctaccctaaactgaacttcgtggaggacagtaaagtggttctcggtgactcgaaagaaggggcgtttgcttacgtgcatcacctcactctatatgatctagaggcccgcggctttgtacgaccattctgcatggcctatatctcagccgaccagcataagatcatgcagcagtttcaggagctgagcgccgaattctccagggcctcagagtgccttaaaactggcaatagaaaggcatttgccggggaactggagaagaaactgaaggacctcgattacaccagaactgtgctgcatacagaaactgaaattcagaagaaagctaatgacaaaggcttctactcttctcaggcaatcgaaaaggcaaatgaactcgccagcgtggagaagtctattatagaacaccaggatctacttaagcagatcagatcatacccgcatcgcaagttaaaaggacatgatctttgccccggtgagatggaacacattcaagatcaggcttcccaggcctcgacaacttccaaccctgatgagtcggctgataccgatctttatacctgtcggcccgcttatacccccaagcttatcaaggccaagtcaaccaagtgcttcgataagaaattgaagaccctagaggaattgtgtgacacggagtactttacacagaccctggcccagttgagtcacatcgaacacatgttcagaggtgacctgtgttacctgctgacgagtcagatcgatagggcccttctgaaacagcagcatataaccaatttcctgtttgaggactttgtcgaagtggatgaccgcatggtagagaaacaggagtcaatccccagtaagccaagccaagacaggccaccgagcagcagccttgaggaatgccctatcccaaaggtgctcatcagcgtcggctcctacaaatcttccgttgaaagcgtgctgattaagatggagcaggagctgggagacgaggaatacaaggaggttgaagtcaccgagttaagctcattcgatcctcaggagaacctggactacctcgacatggatatgaaaggcagcatttcttcaggtgaaagcattgaagttttggggaccgaaaagtctacgagtgttctctctaagagtgactcccaggccagcctgactgtgcctctttccccccaggtggtgaggagtaaggcggtctcacatcgaacaatttctgaagatagcattgaggtcctgtctacctgtcctagtgaagctctgatcccagatgacttcaaggcgagttatccctcagcaatcaatgaagaggaatcctatccagacgggaatgaaggtgccatccgctttcaggctagcatcagcccacctgagctaggagagaccgaggaaggctccattgaaaacacacccagccagatcgactcaagttgttgcatcggaaaggagagcgacggacagttggtgcttccttctacaccagcccacacccattcggatgaagacggagtggtctcctctcctcctcagcgccaccgccagaaggatcaggggttccgcgtcgactttagcgtcgagaatgcaaacccgagctctcgggataacagctgtgagggctttcccgcttatgagctggacccaagccatttgctggctagccgagacatatcaaaaacgagccttgacaactatagtgataccacatcctacgttagctcagtagccagcacaagcagcgaccgtattccgtccgcttatcccgcaggcctttcctccgataggcataagaagagggcagggcagaacgctctaaagtttattcgccagtatccatttgctcaccccgcaatttactctctgctgtcgggtaggaccttggtggtattgggtgaggacgaagctatcgttcggaaactggttacagccttagctatatttgttccgagctacggatgttatgcaaaaccagtaaagcactgggctagcagtcctctccacattatggatttccagaagtggaaactgatcggtctccaaagggttgcctccccagcaggggctggaacactgcatgctcttagtcggtactctagatacactagtatcctcgatttagacaacaagactttacgctgccctttgtatcgagggacattggtgccccggctagccgaccaccgaacccagatcaagcgagggtcaacgtattatctgcatgtccaatcaatgctgacacagctttgctcgaaagcctttctatacactttctgtcatcaccttcatctccctacgcacgataaggagacagaggagctggttgcctctaggcaaatgagcttcttgaaactgacactcgggctggtcaacgaagatgtaagagttgtgcagtatctcgccgagcttctaaagctgcactatatgcaggagtccccagggaccagtcatccaatgctcagatttgattacgtccctagcttcctctataagatctag

SEQ ID NO: 33498 - DNA, 954 bp, Artificial Sequence
  Description of Artificial Sequence: Synthetic coding sequence
atgcgcaagaccagtaacagctgcattatggaaaatggccaccaacctggggcaggccctggagatggccccccagagatcgcccagaacttctcagcccctgaccccccccggcccaggcctgttagcctctcactacgtcttccacatcagccagtgaccgccattacccgcgttagcgataggttctcaggcgagaccagcgccgcagctctgagtccaatgtccgctgcaacgctaggagggctgaacccatctccttccgaagttatcacaccttggactccttctcccagcgaaaaaaattcatcttttacatggtccgtgcctagcagcggatacggtgccgtgactgccagcaagcactccaattcccctcccctggtgacaccaccccaaagccctgtgtcgcctcagcctccagccataacacaggtgcatcgacagggcgagagacgtcgggagctcgtgcgttcccagacgctcccgcgcacctccgaagctcaagctcgcaaggccctctttgagaagtgggagcaggagactgctgctggcaagggcaagggagaagccagagctcggctcaagcgatctcagtctttcggtgtggcttctgccagtagtatcaagcagatcctattggaatggtgcaggtcaaaaacgctaggataccagcacgtggaccttcaaaatttcagctcgagctggagcgatgggatggccttctgtgcattggtacattccttctttccagacgcgttcgactacaacagtctctcccccactcaaaggcaaaagaactttgagctggcattcaccatggcagaaaacctcgcaaactgtgaaagactgatagaagtcgaagatatgatggtcatggggcggaagcccgaccccatgtgtgttttcacctatgtccagagcttatataaccacctgaggcgtttcgagtag

SEQ ID NO: 33499 - DNA, 1386 bp, Artificial Sequence
  Description of Artificial Sequence: Synthetic coding sequence
atggaaccagcgccagatgctcaagaggccaggaccgtccgggaggcactcggtagatacgaggctgccctcgagggggcggtgcgcgccttacacgaagacatgagggggctgcaacggggagtggagcggcgcgtggctgaagcaatgaggctggcaggacctttggcccggacagtggcggacctgcagcgcgataaccaacgtttacaagcccagctggaacgcctgacgaggcaggtcgaggctttgggcctggctagcggtatgtctcccgttccaggaactcccggtacacccagcccgcctccagcacctggcgtgccagatagggccccccggctgggctcagcccgcttcgcatcacacgccacattcagcctgtctggcagaggacagtcgcttgaccacgatgaggcctccgaatcagagatgagaaaaacaagcaatagctgtatcatggagaatgggcatcagcccggcgcaggcccaggagatggccctcccgagattgcgcagaacttctcggcccccgaccccccacgccccaggcccgttagcctgtcacttcgacttccccaccagcccgtaaccgcaataacccgtgtgtcagaccgcttctctggggaaacctcagccgccgcgcttagtccaatgagcgctgccactttaggaggcttaaatccctccccctcagaagtgatcactccctggacaccaagcccgagtgaaaagaatagctcattcacttggagcgttccctccagtggatacggggctgttaccgctagcaagcactcaaattcccctccactcgtgacacctccacagtcccccgtgtctccacaacctcccgctatcacacaggtacatagacagggagagaggagacgggaacttgtacgctctcaaacgttgccaagaacttccgaagcccaggctcggaaggccttattcgaaaagtgggagcaggagactgctgcgggcaaagggaagggcgaagcccgcgctaggctaaagcgatcccagagttttggcgtcgcaagcgctagctctattaagcagattttactggagtggtgcaggtctaagaccctgggctatcagcacgtcgacctgcagaacttcagcagtagctggtctgatggcatggctttttgcgccctggtgcacagtttttttcccgacgccttcgattataacagcctgagccccacgcagcggcagaagaatttcgaactggcttttaccatggctgagaatctagccaactgcgaacgtctgatcgaggtggaggacatgatggtcatggggcgcaaacccgatcctatgtgtgtatttacgtacgtacagtctctgtataaccatctgaggcgatttgagtag

SEQ ID NO: 33500 - DNA, 216 bp, Artificial Sequence
  Description of Artificial Sequence: Synthetic coding sequence
atggcagacgaaaagccaaaggaaggtgtcaagacagaaaataatgaccacatcaatctgaaggtggccggtcaagacggctcggtcgtgcagttcaagattaagaggcatacgcccctgagtaagcttatgaaagcatactgcgagagacaactggagatggaagacgaggacaccattgatgttttccagcagcagacaggcggggtttactag

SEQ ID NO: 33501 - DNA, 288 bp, Artificial Sequence
  Description of Artificial Sequence: Synthetic coding sequence
atggcagatgagaagcccaaggaaggtgtaaagaccgagaataatgaccacattaaccttaaggtagccggtcaagacggaagcgtcgtccagtttaagattaagaggcacacaccactctccaaattgatgaaggcctattgtgaacgacaaggtctgtccatgcgacaaatccgcttcaggttcgatggacagcccatcaacgaaactgacaccccggcacaacttgaaatggaggacgaagacactatagatgtcttccagcagcagactggcggcgtctactag

SEQ ID NO: 33502 - DNA, 1257 bp, Artificial Sequence
  Description of Artificial Sequence: Synthetic coding sequence
atggctgcaagtatgtgcgatgtgttctctttctgtgtgggggtggccggaagggcgcgggtgagtgtagaagttcgatttgtttcaagcgccaaaggcaaaggcttgtttgcaacccagctgatcagaaagggcgaaacaatttttgtggagagaccgttagtggcagcccagttcctctggaatgctctgtaccggtaccgggcctgtgaccactgtctaagggccttagaaaaggccgaagagaatgcgcagagactaaccggcaagcctggtcaggtgctgccccaccctgaactgtgcaccgtgcgtaaagacctgcatcagaattgcccccactgccaggtcatgtactgctccgctgaatgcaggctagctgctacagagcaataccatcaggttctttgtccaggtccgagccaggatgaccctttgcaccctctgaataagcttcaggaagcctggaggtcaattcattatccacccgagactgcctctatcatgctgatggctcgaatggtggctacagtgaagcaagcaaaagataaggatcgctggataagacttttctcccagttctgtaataaaactgcaaacgaggaagaagaaatcgttcacaagctgctgggagacaaatttaagggtcaattggaactgctgcgcagactgttcacggaagcactgtacgaagaggcggtcagtcaatggtttacacctgacggattcagatctctgtttgcgctggtgggcactaacggccaggggataggcacgtcgtctctgagccagtgggtacacgcctgcgacactttagagctcaaacctcaagacagagagcagctggacgccttcatcgaccagttatacaaggacattgaagcggcgactggtgagttcctgaattgcgagggctctggcttatttgttcttcaatcatgctgcaaccatagctgtgtaccaaatgccgaaacgagtttccccgaaaataattttttgctccacgttacagctctggaagatatcaagccaggggaagagatttgcatttcttatttagattgttgccagcgcgaacgcagtcgccactctagacataagatcctcagagagaactatctctttgtgtgctcctgtcctaagtgcctagccgaggccgacgagcctaatgttacctccgaggaggaggaggaagaagaagaggaagaggaaggagagcccgaagacgcagaattgggagatgagatgacggatgtgtag

SEQ ID NO: 33503 - DNA, 285 bp, Artificial Sequence
  Description of Artificial Sequence: Synthetic coding sequence
atggaacaggctcgcgatcatctccacttgaggtggactaccgaacagcacatgcctgaggtggaggtccaagtaaagtatcgcactgcggcactgtctaatcaagagtgccagttgtatctgaggcactctcagcagcagcaagtgctagtcgtggacttccaagccaaactgcgacaggtgtttatcacggagacgccaaggtgcggcaaaaagccttactggaacaatgaagaggccgaatccaagcagaatccaggctcaatttattgcctattgctctag

SEQ ID NO: 33504 - DNA, 1128 bp, Artificial Sequence
  Description of Artificial Sequence: Synthetic coding sequence
atggcagggttcaacatggggggagatctgagggagcccgcggcgtccattccacctggatccctggccgctgtgggcatatcttggttcttgtacataatcttcgtgttcctgttgggcgctatctgtacacgggaagccctccgctatgattttttgatcgcggagaaggtctcccttatgggtttcttgttcctcttaggattatatatctcttcactggctagctgtatgggcggcttgtatggagcaccccgaattctgcagtgcattgcacaggaaaaggtcattccagccctcgcgtgtcttggccaggggaaggggcctaacaaaaccccagtcgccgccatctgcctcacatcgctcgttaccatggcatttgtgttcgttggtcaggtcaacgtattggcccccatagtgacaatcaactttatgctgacgtatgtagctgtggactactcctatttctctctgtcaatgtgctcatgctccctgactcccgttccggaaccagtgttaagagaaggggctgaagggcttcactgttccgaacacctgcttctggagaaagccccaagctacgggagtgaggggcctgctcagagggtgctcgagggaaccctgctggagttcaccaaggatatggaccagcttctacaactcactcgcaagctggaatcaagccagccacggcaaggtgaggggaatcggaccccagagtcccaaaagagaaaaagtaagaaagccacaaaacagacccttcaggactcttttctgctggatctgaaaagccctccctcttttcctgtggagatctctgatagactgccagcagccagttgggagggccaggagagctgttggaataagcagacctctaaaagtgaaggaacgcagcctgagggcacatatggtgaacagcttgtgccagagctatgtaatcagtcggaatcctcaggtgagggggatcttcgcagtcctcaagagcagattatccttgccccgagcctcgctaaagtggacatggagatgacccagctgacacaggaaaacgccgactttgcaacacgagacaggtatcaccacagttccctagtgaatcgggaacaactaatgccacactattag

SEQ ID NO: 33505 - DNA, 2232 bp, Artificial Sequence
  Description of Artificial Sequence: Synthetic coding sequence
atgctgcctttagagagaactatcacgtaccgcgacatgtcgtcatttatccaggtgaaaaaccacttcaatgtggtgaacgtgacgtgcgtaagctataggtctacttgctttcgggatatgcgtcgctttatactggatgcactggcccagccccaaccttggtggaagactcaactttttatgtgggagccggtactgttcggaacctgggatggcgtttttaccagctgtatgattaacattttcggcgtggtcttgtttctgaggaccggatggctcgtcggtaacacgggcgtgctcctgggaatgttcctggtctcctttgtcattttggttgctctggtcaccgtgctcagtggcattggtgtaggagaacgctcatctatcggatccggcggagtatattcaatgatctcctctgtcctggggggccagacagggggtaccattggtcttctatacgtgttcgggcagtgtgtggcgggggccatgtatattacagggtttgccgaaagtatttctgacctcctcggactcggcaacatttgggcagtgagaggtatcagtgtggccgtgcttcttgctctgctcgggataaatctcgccggcgtgaagtggatcatcagattgcagcttctcctgctgttcttgctggccgttagcaccctcgatttcgtggtgggatcgttcacgcatctggatcctgaacacggctttattgggtattcccccgaacttcttcagaacaacacccttcctgattatagcccaggcgagtcctttttcactgtgttcggtgtgttctttcccgctgcgaccggtgtgatggctggtttcaatatggggggcgacctgcgggagccagccgcgtctattccacccgggtcacttgctgcagttggaatctcctggtttctgtatatcatcttcgtgttcctgttgggggcgatatgtacaagagaggccctccggtacgatttcctgatagcggaaaaggtgagtctgatgggctttctgttcttgctgggactgtatatcagttccttggcatcctgtatgggaggactttatggtgctccacgaatattacaatgtattgcccaagagaaggttatacccgcactcgcctgccttggccaaggcaaaggcccaaacaagactccagttgccgccatctgtctgacgtccctggtaaccatggcctttgtgtttgtgggacaggttaacgtattagctccgattgtgacaatcaacttcatgcttacctatgtggccgtagactactcttacttttctctgtctatgtgcagctgttccctgacaccggttcctgaaccggttctgcgggaaggtgccgagggactacactgctctgagcacctgctgcttgagaaagcgccttcctacggcagcgagggacccgcgcaacgcgtcctggagggcaccctcctcgagtttacaaaagatatggatcaacttttgcagctgacacgcaaactggagtcctcacagccaaggcaaggcgaaggcaacagaacacccgagagccagaaaagaaagagtaagaaagctacgaagcagacccttcaggactcctttcttctcgatctgaaaagtccgccctcattccctgtcgaaatttccgaccgcttacccgcagcctcatgggaagggcaggagtcatgttggaacaaacagacctccaagtccgagggtacccagcctgaaggaacctacggggagcagctcgtcccggaactctgtaaccagtcagaatcctccggggaggacttctttttgaagtctagactgcaagagcaagatgtgtggcgcagatctacgagcttctatactcatatgtgcaatccttgggtttccttactcggggccgtggggtccctgttgatcatgtttgtcattcagtgggtctacaccctggtcaacatgggagtggcagcgatcgtgtacttctatattggcagagcatcgcccggtcttcacttgggctcagcctccaacttttccttctttcgatggatgagaagcctgttgctccctagctgtagaagcctccgttcccctcaggagcaaattatactcgccccttctctagcaaaagtcgacatggagatgacacaattaacccaggaaaacgcggactttgccacacgcgatcgctaccatcactcctctctggtcaaccgtgaacagctcatgccgcactactag

SEQ ID NO: 33506 - DNA, 1548 bp, Artificial Sequence
  Description of Artificial Sequence: Synthetic coding sequence
atgagaagggccgccgctgggggcctggcggtgggtcagttacccggtgaaggaccagcaggcgaagagggggctgccctaggcaaggctatgcggggaggaggatgctctccgcatagccccagtggctgcctgtccggcgtgatggctggcttcaacatgggcggagacctaagggagcctgccgcctcgatcccacccgggtctttggccgctgtcggcatttcatggttcttgtatatcatctttgtctttcttctcggagccatctgtacccgtgaagcgctccgatatgatttccttatcgctgagaaggtatcccttatggggttcttgttcctgctcggcctctacatcagcagtctggcctcctgtatggggggactgtatggcgctcctcgcattctccagtgcattgcccaggagaaagtaatccccgcactggcctgcctgggtcaggggaaaggccccaacaaaacccctgtggctgctatttgtctgacgtcactggtcaccatggctttcgtctttgtagggcaggtaaacgtactggcccctattgtaacaattaacttcatgctgacatatgtagcggtggactactcttatttttcactgagcatgtgctcctgttccctgacccctgtgcctgagccagtgctgagggaaggagctgagggactgcactgttccgaacacctgttgctcgagaaggccccctcttacgggagcgagggccctgctcagagggttctcgaaggtactctgctggagtttacgaaagatatggatcaattattgcaactgactcgaaagcttgagtcttcacagccccgtcagggtgaaggtaatcgtacacctgaatcacagaagcgcaagagcaaaaaagctaccaaacagaccctccaggatagctttcttcttgacctcaaatcccctccctcttttccagtcgagatcagcgatagactccccgcagcttcttgggaaggccaagaaagttgttggaataaacagacatctaaatctgagggaacccagcctgagggtacctatggagaacaactcgtgccagaactctgtaatcagtctgagagttccggtgaggacttttttctgaagagtcgcctccaggaacaggatgtctggagacgctctaccagcttctatactcacatgtgtaacccatgggtatccttactcggcgctgtggggagtctgctaatcatgtttgtaatacagtgggtgtataccctcgtcaatatgggtgtcgccgcgattgtgtacttctacattggccgagcatcccccgggctacacctcggcagcgcttcaaacttttcattttttcgctggatgaggagtctactcctcccttcatgcagaagtctcaggtctccccaggagcagattattctggctccatccctcgcaaaggtggatatggaaatgacccaactgacccaggaaaacgcggatttcgcgacacgtgacaggtaccaccactcttccctggtgaatagagagcagctcatgcctcactactag

SEQ ID NO: 33507 - DNA, 723 bp, Artificial Sequence
  Description of Artificial Sequence: Synthetic coding sequence
atgcagactacctacgttctgcagtccttacatctccgcataccggaaatctccaatattactacaacaccacatactctcccagcagcatggttgaccatgtttgatgccgttctgatactgcttttaatcccacttaaagataagctcgttgatccaatccttagaaggcacgggctcttgcccagcagtcttaagcgcattgctgtggggatgttcttcgtgatgtgttctgcctttgcggccggaatcctcgaatcaaaaaggctcaacctagtgaaagagaagaccatcaatcagacaattggcaacgttgtgtaccacgccgctgacctcagtctgtggtggcaggtcccccaataccttctcatcggtatcagtgagattttcgcgagtatcgctggcctggagtttgcctattctgctgcccccaaaagtatgcaatccgccataatggggctgtttttctttttcagtggtgtaggtagctttgtcggatcaggcctcttggctctcgtcagcatcaaagcgataggttggatgagcagtcacacggacttcgggaatattaatggctgttatctcaattactacttcttcctcctcgctgccatccagggcgctacactgttactgtttctcataatctcggtcaaatacgaccaccacagagaccaccagcgttctcgagctaacggagtccctacctccagacgcgcctag

SEQ ID NO: 33508 - DNA, 1572 bp, Artificial Sequence
  Description of Artificial Sequence: Synthetic coding sequence
atgacccagaacaaattgaaactatgcagcaaagccaacgtgtatacagaggttcctgacggcgggtgggggtgggccgtcgccgtctctttcttcttcgtagaagtttttacgtacggcataattaagacattcggcgtgttcttcaatgatctgatggacagttttaacgagagcaatagccggatttcttggatcatatcaatttgtgtattcgtgctgacattctctgcgccgttagctaccgtgctgtctaacaggttcggacatcggttggtggtgatgctaggcggacttcttgtgtcaaccgggatggtggccgccagctttagccaagaggtgtctcacatgtatgtagcaataggtatcatttccggactgggttattgcttttcgttccttcccactgtgaccattctttcacagtatttcggcaagaggcgctcaatcgttactgcagtcgcaagcactggggagtgttttgcagtctttgcctttgcacctgccattatggccctcaaggagcggattggttggaggtatagcctcttgttcgtggggttgctgcagcttaatatcgtcatcttcggcgcacttctccgaccgatcttcattcgagggcctgcgtcccctaaaatagttatccaggaaaaccgaaaggaggctcagtacatgttagaaaatgaaaaaactagaaccagcatagacagcatagactcaggtgtagaattgacaacttcgcctaagaacgtgcctacccacaccaatctggaactcgagccaaaggctgatatgcagcaggtcctggtgaaaacaagcccccggcccagtgaaaagaaggcgcccctgctggacttctcaatcctcaaagagaagagtttcatctgttatgcgttattcggtctctttgccactctggggttctttgctccctctctttatatcatccctctgggtatttcactggggattgaccaggaccgcgccgcattcctgttgtctactatggcgatagcagaggtatttggcagaatcggagccggctttgttctaaatcgagagcctattcgaaagatttacattgagctgatctgtgtgatccttttaactgttagcctgttcgcctttactttcgccaccgagttctggggcctaatgtcttgttcaatattcttcggctttatggtggggactatcgggggcactcatatacccctactggctgaggacgacgtcgttgggatcgaaaagatgtccagcgcggccggtgtctacattttcatccaaagtatcgcgggacttgcaggccccccgctggctggactgctggtagatcaaagcaagatttatagccgcgctttttactcctgcgccgccggtatggcgcttgcggccgtctgcctcgcactggtgcgaccctgtaagatgggcctgtgtcagcaccatcattccggcgagactaaggttgtgtcccacagaggcaaaaccctgcaagacattcccgaggactttctcgagatggatttagccaaaaatgaacaccgcgtgcatgtgcaaatggaacctgtttag

SEQ ID NO: 33509 - DNA, 453 bp, Artificial Sequence
  Description of Artificial Sequence: Synthetic coding sequence
atgcggtgcgccgagggcgcatggtggttctctcccgatggaccagccgggagcgcggcctccatctggcctgctgagggagccgaaggactgcctggccagctcggaagggaccggttggaggtggtctattcagtgcctgacaacgtcccgggacaaaacgggtcacgaaggcccctcgtttgcaaaataaccgggaagtgtctgagcgtctgctctgaagagaacgccaaagctggcggttgcagcgcattcccgttgttactgagccagctgggcgcccggatgacagggagagagcacgcccacaagggcccggaacttaccaccccggacagcggactgcccaggcccccaaatcctgcccttgctggattccgagcactagcccagcacagtccaccgctggggactagcactccctcagccgtgctgctgtcagccgcaacatag

SEQ ID NO: 33510 - DNA, 453 bp, Artificial Sequence
  Description of Artificial Sequence: Synthetic coding sequence
atgcggtgtgcggagggcgcatggtggtttagtccagacggccccgctggatcagctgctagcatctggccagcggaaggcgctgaaggtctgccgggccagctggggagggatcggctcgaagtcgtatattctgttcctgataacgtacccggacaaaacggcagccgacgccccctagtctgtaaaataacaggtaagtgtctgtccgtgtgctctgaagaaaacgcaaaggcgggtggttgttctgccttcccgctattgctctcccagttaggagccagaatgaccggacgggagcacgcgcacaagggacccgagctgacgaccccagactccggcttgcctcgtccacccaatccagcgttagcaggattccgggccctggctcagcactcaccccccttgggcacctctacgccgtccgccgtactgctgagcgccgctacgtag

SEQ ID NO: 33511 - DNA, 762 bp, Artificial Sequence
  Description of Artificial Sequence: Synthetic coding sequence
atgggtgaactgcccggctccgaaggaatgtgggaaaactgcccactcggatgggtgaagaaaaaagcgagcggcactctcgcccccctggactttctgctacagagaaaaaggctgtggctgtgggcctctgaaccagtgcgaccacagccacagggcatccataggtttagggaggctcggcgacagttctgccgtatgcggggttcccgtctaactggcgggagaaagggcttcggctcctccgggctcaggtttggtaggggaggatttagtgaagaagttatgcctcagcccgtcctgaaagctatgcgttgtgcggaaggggcctggtggttcagccctgacggccctgccgggtcagccgcctccatatggcctgccgaaggcgccgaaggattgcctggccagctcgggagggacaggctcgaggtggtgtactcagtgccagacaacgtgccggggcaaaatggctcccgccgtcccctggtgtgcaagatcacaggtaagtgtcttagcgtttgcagcgaagaaaacgcgaaggcaggaggttgttccgcctttccattattgttgtcccagctaggcgctagaatgacagggagagagcacgcccacaaggggcccgaactgacaacccccgactctggcctgccccggccacccaatccggccttagcaggcttcagggcgttagcccagcactctccccctctgggaacatcaactcccagcgcagttctccttagcgctgctacctag

SEQ ID NO: 33512 - DNA, 825 bp, Artificial Sequence
  Description of Artificial Sequence: Synthetic coding sequence
atggatcgccctggcttcgtcgctgccctggtggccgggggagtggccggggtcagcgtggatcttattcttttccccttggatacaataaagacaaggctgcagtccccgcaagggttctccaaggcaggcggattccatggaatttacgcaggggtgccttcagcggcaatcggcagttttccaaatgctgctgccttcttcattacctatgaatacgtgaagtggttcctgcacgccgattcctcttcctacctgacaccaatgaagcacatgctcgccgctagtgcaggagaagttgttgcctgtctaatccgagtccctagcgaggtcgtcaaacaacgtgcccaagtgtcagcctctactaggacttttcagatcttcagcaatattctatacgaggagggtattcaaggcctgtaccgtgggtacaaatctactgtgctgcgtgagattcctttttcactggtgcagtttcccctgtgggaatcactgaaggctctgtggagctggagacaggatcatgtagttgatagttggcagtccgcagtttgcggcgcatttgccggcggattcgccgcagctgtcacaacaccacttgacgtggccaagaccaggatcaccttagcaaaagcaggatccagcaccgcagacgggaacgtcctgtcagtcctacacggtgtctggaggtctcagggtctggccgggctgttcgccggagtcttcccacgcatggccgccatcagcctcggtgggttcattttcctgggagcctatgaccgaactcacagtctcttgctggaagtcgggcggaagtccccgtag

SEQ ID NO: 33513 - DNA, 927 bp, Artificial Sequence
  Description of Artificial Sequence: Synthetic coding sequence
ttacttgttgcccttctgggtgggggcctacctgccggctttgtgggtccactgagccggatggcataccaggcctcaaacctaccctccctggagctcgttatttgcaggtgcctttttcacttgccaattgctctccttctcaagttaaggggagatcccctgctggggcctccggacatccgagggcgcacctgtttctgcgccctgttgaatgtcctgaacatcgggtgtgcctatagcgctgtgcaagtggttcctaccggcaatgctgcaacagtgcgtaaacacagctccaccgtttgttctgccatattgactctttgcctcgagtcacaagttctgtccgggtacgactggtgcggcctactcgggagtatcctggggctgattattatcgttggtccaggattgtggaccctgcaggaggggaccacgggtgtgtatacaggtctcggttatgtacaggcttttctggggggattagcactgagccttggactgttggtgtacagatcactgcactttccgtcctgcttgcccactgtggcctttcttagcggtctggtgggacttttaggctccgtacccggcctgtttgtcctgcagtctcccgtcttgccctcagatttactaagttggagctgtgtgggcgcggtgggtatactgacattggtgtcttttacatgtgtagggtatgcagttaccaaggcacatcccgctctcgtgtgcgccgtgctgcattcggaggtggtcatggctctgatcttgcagtacttcatgttgcatgagactgtggccccttccgacatcatgggcgccggagtggtcctgggttccatcgctattattaccgcgagaaacctgatttgcgaaaggactgggaaagtggaagaacagagactgaaaacaaaaaagaagaagtag

SEQ ID NO: 33514 - DNA, 1017 bp, Artificial Sequence
  Description of Artificial Sequence: Synthetic coding sequence
atggctggctcccatccatacctcaatccaccagattctactcatccatcccccccatccgcccccccgagcttgcgttggcatcagtgctgtcagccatccgacgcaactaatgggctgctggtggctttgctaggcggaggattgccagccgggttcgtgggacctcttagtcatatggcataccaagcctctaacctcccctctctcgagctactgatttgccggtgcttattccatctcccaatagccctgttacttaaactgcgtggcgacccactcttgggaccgcctgatatccgggggcgggcatacttttatgctctgctgaatgtgctctctattggctgcgcatattccgctgtgcaagttgtgcccgccggcaatgctgctacagtcaggaagggtagtagcaccgtttgctcagccgtcctgactttgtgcttggagtcacagggcctgagcgggtacgattggtgcggcttgctcggctcgatactgggcttaatcataatcgtcggaccaggcctctggaccctacaggagggcatcaccggcgtatacaccgctctaggatacgggcaagccttcgtcggcggactggctctgtccctgggtctgctggtgtatcgttccctgcacttcccatcttgtctgccaactgttgctttcctgagcgggctggtggggctgctcggttctgttcccggtctgtttgtgctacaaccccccgtgttgccgtctgatctgccttcctggtcatgcgtaggggcggtaggaattctcgccctcgtgtccttcacatgtgtctcttacgcagtgaccaaggctcatcctgcacttgtctgcgccgtgctccacagtgaagtggtcgtcgccctcattctccagtactacatgttgcatgaaacagtagccccctccgatatagttggtgccggcgttgtcctaggttccatcgcaattattactgcctggaatctttcatgtgagcgcgaagggaaagtggaggagtag

SEQ ID NO: 33515 - DNA, 1308 bp, Artificial Sequence
  Description of Artificial Sequence: Synthetic coding sequence
atggagggccagacaccagggagccgcggcctgccagagaagcctcatcccgccaccgctgccgcaaccctgagtagcatgggcgctgtgttcattctgatgaagtccgcccttggcgccggactgctgaatttcccttgggctttttctaaagcggggggtgtggtgcccgcctttctcgtggaactggtctctttagtctttttgatttccgggctagtgatcttaggatatgccgccgccgtatctgggcaggccacatatcagggggtggtgcgcggactgtgtggcccagccataggcaagctctgcgaggcatgctttttgctcaatcttctcatgatttctgtcgcttttcttcgggtgattggtgaccagctggaaaaactgtgtgacagcctgctgagcggaaccccgcccgccccacagccttggtacgcagaccagagattcaccctgcctttgctgagcgtcctggtaatcttacctctgagtgccccgcgcgagatcgcattccaaaaatacactagcattctcgggaccctcgccgcttgttacctggcgctggtgattaccgtgcaatattacctatggccacaaggcttggttcgagaaagccatccctccttaagccccgctagctggacctcagtatttagcgtgttccctacaatctgtttcggcttccaatgtcacgaggctgcagtctcgatctattgttctatgcggaaaagatccctgtctcattgggctctggtctcagttttgagcctgttagcgtgctgcttgatctactccctgaccggcgtctacggttttctcacgtttgggacggaggtgagtgcagacgtactcatgagctacccgggcaacgatatggtgatcatcgtagccagggttctatttgcagtaagtatcgtgactgtctaccccatcgtattgtttctcggacgttcagttatgcaggacttctggcggcggtcatgtctggggggctggggtccgtctgccctggcagaccctagtggattgtgggtgcggatgcctctcactattttatgggtgacagtcaccttggccatggccctctttatgcccgacttatcggagatagttagcattatcggcggcatcagcagtttcttcatttttatcttcccaggactatgcctgatttgcgccatgggcgttgaacctattggccctcgagtgaagtgctgcctggaggtgtggggagtggtgtcggtgctagtcggcacattcatcttcgggcagtcgacggccgcagccgtttgggagatgttctag

SEQ ID NO: 33516 - DNA, 2397 bp, Artificial Sequence
  Description of Artificial Sequence: Synthetic coding sequence
atgggtaaggctagccccgctagcgggctgagccgcccgaagacactagttagcccactgcggagcaatcagtggtctttgcagaagggacttcccgagcagtattattccctgacctggtttttgtccccaatcctgggccttatctttacaccactgattggatctgcatccgacaggtgcactctgagttgggggagacggcgcccatttattctggccctgtgcgtgggcgtgttatttggtgttgcccttttcctcaacggatctgcaattgggctggccctcggagacgtgcccaatagacagccaatagggatcgttctgaccgtgctgggagtggtcgtgctggacttttccgctgacgcaaccgagggcccgatacgggcttatctacttgatgtggtggatagcgaggagcaggacatggcgctcaacatccacgcttttagcgccgggttgggcggcgcaatagggtacgtcctcggaggcctcgattggactcagacattcctggggtcatggttcaggactcagaatcaggtcctattcttcttcgccgctattatctttaccgtgagcgttgcactacatttattctccatagacgaggaacagtactcaccacaacaggaaagaagcgctgaggagccaggcgctctggatggcggcgaaccccacggagtccctgcctttcctgatgaggtccagagtgagcacgaacttgccctagattaccccgatgtcgatattatgaggtctaagtccgattccgcactgcatgtgccagacactgcactggacctcgaacccgaactactgtttctgcacgacatcgagccaagtatttttcatgacgcaagttacccggcaacaccccgcagcacctcccaggagttggcgaagaccaaactgccacgcctggcaaccttcctgaaggaagcggcaaaggaggacgagactttgctcgacaatcacctgaatgaagcaaaggtgcctaatggtagcggtagcccaaccaaagatgcactcggcggctatactcgcgtagacacaaagccatccgctaccagctcctccatgcgcagacggaggcacgccttcagaaggcaggcgtcctctacctttagttattacggaaaactgggttcccattgttaccgctacagacgcgcaaatgctgtggtactgatcaaaccctctcggtccatgtcagacctgtatgatatgcaaaagaggcagcggcagcaccgccaccggaatcagtcgggagcaacaacttcttcaggcgatactgaatctgaggagggtgaaggggaaaccacagtgagactactgtggctgagtatgctgaaaatgccaagagagttgatgaggctgtgtctatgtcatctgctcacatggttcagcgtgattgccgaggctgtattctacactgattttatggggcaagtcatctttgaaggtgacccaaaggccccatcaaactccactgcctggcaggcctacaatgccggggtgaaaatgggatgctggggccttgtcatctacgcggcaaccggcgcgatttgctccgccctgctgcagaagtatctagacaactacgatctgtccgtccgcgtaatttacgtgctgggaactctggggtttagcgtcgggactgcagtgatggccatgttcccgaatgtgtatgttgccatggtaactatttctactatgggcattgtgtcgatgagtatatcatactgcccgtacgccctactcggccagtatcatgatatcaagcagtacatacaccatagccctggtaattctaagagaggatttgggatcgactgcgctatcctatcttgccaagtgtatatttcgcagatcttggtagcttcagccctggggggcgtggtagatgcggtgggtacggtacgagtgattcccatggtggcaagtgtgggatcttttctgggttttctgacagcgacattcctggtgatctatcccaacgtatctgaggaagccaaggaagaacaaaaagggcttagttcacccctcgctggagaagggcgcgctggcggtaattctgagaaacccacagtcctcaagctgacacgtaaagagggtctccagggaccagttgagacagaaaggctccaggtcctgacttctgtcaggtcccgacacatagggtggtgccgatcatgctggagggttttctttttcatgataattctagaaaagaagttttccttcccacaatgtgggagtttgcgccggatgacctatctccttttcctgtccgagctcgacaccttgtgtccaggacaaccctgcccgtgggcagccacagcccatcagagttgggaagaggctggtccggggggtctcggtagacgtcaatag

SEQ ID NO: 33517 - DNA, 2253 bp, Artificial Sequence
  Description of Artificial Sequence: Synthetic coding sequence
atgttcggcagagagttctgctatgccatggaaactgccctggtgaccccaatcctcctccaaatcggcctccccgaacagtattattccctcacctggttcctatccccaatccttggcctcatatttacccccctcatcggaagcgcctcggatcgctgcaccctgtcctggggccgacgtaggcccttcatactagccctctgcgtgggtgtgctgttcggcgttgccctctttctaaacggtagtgccatcggtctcgcactgggcgatgtgccaaaccgtcagcctattgggatagttctgactgtcctgggagttgtcgtgctggacttttccgctgacgccaccgaagggcctattcgagcctatctgctggacgtcgttgactcagaagagcaggacatggctttgaatattcacgccttttctgcgggactaggcggagccatcggctacgttttgggaggtcttgattggacgcagacctttctgggttcctggttccggacccagaatcaggtattgttttttttcgccgccattatttttactgtgagcgtcgccctgcacctcttcagcatcgacgaggaacagtactcacctcagcaggaacgcagcgccgaggaaccaggtgccctggatggcggggaaccccacggcgtccccgcatttcctgatgaagttcagagcgagcatgagctggccttggactacccagacgtcgatataatgagaagcaagtccgactccgccctccacgtgcctgacactgcgctggatctggaacccgaactcttgtttttacacgatatagaacctagtatattccacgacgccagttatccagctactccacgctccacttctcaggaactcgccaagacaaaactcccacggttggccacattccttaaggaagcagctaaagaggacgagactctgcttgacaaccaccttaatgaggcgaaagtgcctaatggctcaggcagcccaacaaaggacgccctgggtgggtatactcgcgtggacacaaagccgagcgcaacgtcctcgagcatgaggagaaggcgccacgccttccgtcgccaggcctctagcaccttctcatactatggaaagctgggctcacactgctacaggtataggcgagcgaacgccgtggtgctgatcaagccaagcaggtcaatgtccgatttgtacgatatgcagaagcgacaacgccagcacaggcaccgtaatcagagcggggccaccacctccagcggcgacaccgaatcagaggagggcgagggggaaactacagtgagactgctttggctgtcaatgcttaagatgccaagagagctgatgagactgtgtctgtgtcatcttttaacctggtttagcgtgatcgccgaggcagttttttacacggattttatgggccaggtcatctttgagggggaccccaaagccccaagcaacagtactgcctggcaagcatataatgccggcgtaaaaatggggtgttggggcctggtcatctatgcagctactggggcgatctgtagcgctctcctgcaaaaatatctcgataactacgatctctccgtgcgagttatttatgttctcggcactctcgggttctcagtcggtactgcagtgatggccatgtttccaaatgtgtacgtcgccatggttacgatttctaccatgggaatcgtgtctatgagcatcagttactgcccctatgctctgttgggccagtaccatgacatcaaacagtacattcaccacagtcccggaaactcgaaacggggctttgggattgactgcgccattctgagctgccaagtgtacatcagccaaatcctggttgcctccgccctgggaggagttgtcgacgccgtgggcacggtgagggtgattcccatggtcgcctccgtaggctcattcctgggttttctgaccgccacatttcttgtgatctacccaaatgtgtctgaggaggcgaaggaggagcaaaagggtctgtcctcccccctcgctggggagggccgagccggaggaaactctgaaaagcctacagtgttaaaactcacgcggaaggaggggttgcaaggtcccgttgagacagagtcagtcacgcccgcgggcatagacgtctgtcaaatatcgagtcactggctggtgccccaacttctggaatccatcttcttgtacgactatttcagaaagaagatcttctttagtaccatgtggttctcttag

SEQ ID NO: 33518 - DNA, 2427 bp, Artificial Sequence
  Description of Artificial Sequence: Synthetic coding sequence
atgaaaatggctcctcagaatgctgatcccgagtctatgcaggtccaggaacttagcgtcccactgccagatccccagaaagccggcggcgctgaagctgagaactgcgagacgatctctgaaggcagtatcgacaggattcccatgagactttgggtgatgcatggggccgtaatgtttggcagagagttctgttatgctatggagacagcattggtgacccccatcctgctgcagatcggcttgccagagcagtattacagcttgacatggttcctttcaccaattctggggctgatttttacccctttaatcggttctgcctctgatcgctgtacactgtcctggggacgtcggagaccctttatcctggccctgtgtgtgggagtgctcttcggtgtggccctgttcttgaacggctcagctatcggcttggcacttggggacgtgcccaatagacagcccattgggattgtgctgacggtgctcggagtcgttgttctggacttttctgccgatgcaacggaaggacccatacgggcttacttactggatgtggtggattccgaggagcaggatatggccctcaatattcatgccttctccgcgggcttgggcggggccattggctatgtcctggggggcctggactggacacagacgttcctaggtagttggttcagaacccagaatcaagtcctgtttttctttgcagctataattttcaccgtaagcgtagctttacatctattcagcattgacgaggagcagtatagtccacagcaagaacggagtgccgaggaacccggggctctggatggcggagagccccacggagtccccgcgttccccgatgaagtccagagtgagcacgaattggcattggactatcccgatgtggacatcatgcgatcgaaatcggattcggccttacatgtgcccgacaccgcacttgacttggagcctgagcttttattcttacacgatattgagccttcaatctttcacgacgccagttaccctgccaccccaagaagtacttcgcaggagttagctaaaacaaagcttcctcggctggcaacatttctgaaagaagccgccaaggaagatgagacattgctggacaatcacctgaacgaagccaaggttcctaatggctccggttcccccaccaaagatgccttgggggggtatacacgtgtagacaccaagcctagcgcgacgagctcctctatgcggcgacgtaggcacgcatttcggcgtcaggcctcaagtacattctcctactatgggaaactgggcagtcactgttatcggtaccggcgagccaacgccgtcgtcttaattaaaccaagccggtccatgtctgacctgtatgacatgcagaaaagacagagacagcataggcatcgcaaccaatcaggggcgacaacatccagcggtgataccgagtctgaggaaggggaaggagaaaccacagttaggctcctctggctgtcaatgctcaagatgccccgcgagctcatgaggctctgtctgtgtcatcttctgacatggttctccgtaatcgccgaagccgtattctataccgactttatggggcaagttatctttgaaggcgacccaaaagccccgtctaattccacagcctggcaggcgtacaacgctggcgttaagatggggtgttgggggctggtgatctacgccgccaccggcgcaatttgctcagctctcctgcagaaatatcttgataactacgacctgtctgtgcgggtcatctacgtcctgggaacactggggttttctgtcgggactgccgttatggctatgttccccaacgtctacgtcgcaatggtgactatctctaccatggggattgtgagcatgtccattagttactgtccctacgccctgctgggtcaataccacgacatcaaacaatacattcaccactcacccggtaactccaagcgcggttttgggatcgactgcgctatcctttcttgccaagtgtacatctcacagattctggtcgcttctgctctgggtggggtggtcgatgccgtcggaactgtccgcgtgattcctatggtggcttccgtgggtagctttttaggtttccttactgccacttttctggtgatatatccgaacgtcagcgaggaggccaaagaagaacagaaggggttaagctcacccttagctggcgaaggaagagctggcgggaatagtgagaaaccaacagttttaaaacttacacggaaggaggggctgcagggccccgtggagaccgagagcgtgacccccgcggggattgacgtctgccagatttcatcccactggctagttccacagctgttggaatcgatctttctctatgattactttagaaaaaagatcttcttctctaccatgtggttcagctag

SEQ ID NO: 33519 - DNA, 2154 bp, Artificial Sequence
  Description of Artificial Sequence: Synthetic coding sequence
atgggcaaggcgagtcctgcttccggcctgtcccgaccaaagacattggttagccctcttcggagcaaccagtggagtctgcagaagggtctgcctgagcagtactattccctgacatggttcctgagccccatccttggccttatcttcacccccctcatcggatccgcttccgaccggtgtaccctgtcatgggggcgtcggcgccctttcattttagcactgtgcgttggggtcctcttcggggtggccttattcttaaatgggtcagcgatcgggctagcactcggagatgtccccaatcgtcaaccaattggcatcgtgctgaccgtcttgggcgttgtcgtgctagacttcagcgccgacgccacagaggggcccataagagcctatttgctcgatgtggtggattcagaggagcaggacatggcactgaatattcacgctttttcagcgggtttgggaggagctatcggttatgtgctgggcggcctggactggacccagactttcctgggttcttggttccggacgcagaatcaggtgttgttcttctttgctgcgattatctttacagtatctgtagccctccacctgttctctatcgacgaggagcaatattccccacagcaagagcgatccgccgaagagcccggggccctcgatggtggcgaaccccacggtgtaccagcgttccccgacgaggtgcagtctgagcacgagctggcccttgattaccctgacgtggatatcatgcggtcgaagagcgatagtgccctgcacgtgccagataccgcactcgacctcgagccagagcttctcttcctccacgatattgaaccgagcattttccatgatgcttcataccccgctacccctagaagcacaagtcaagagttagccaaaacaaaactgcccagattggcaacatttcttaaagaagcagcaaaagaggacgagaccctgttggataatcacctcaacgaggccaaagtgccaaacggctctggatcaccgacaaaagatgccctgggcgggtacaccagagtcgacacaaaaccatctgccactagttccagcatgagacgtcgccggcacgccttcagacgccaggcatctagcaccttcagctattacggcaaactggggtctcactgctaccgatatagacgggccaacgcggtcgtacttatcaagcctagccggtctatgtcagatctctacgacatgcagaagcgacagcggcagcacagacacaggaatcagagtggcgcaacaacaagtagcggagacactgaatctgaggagggtgaaggagagacaactgtcagactgctgtggttatctatgctgaagatgccgcgagagctgatgcggctctgtctttgtcacctcctgacctggttctcagtaatcgcagaggccgtgttttacacagacttcatgggccaggtcatctttgagggcgacccaaaggcaccgagcaattcaactgcctggcaggcatacaacgcaggtgtaaagatggggtgctggggactcgttatctacgccgcaaccggcgctatttgtagcgctcttctgcagaagtacctggacaactatgacctcagcgttcgagtgatctacgtactgggcaccctgggtttctcagtgggcacagcagtgatggccatgtttccaaacgtgtacgtggctatggttaccatcagcacgatgggcatcgtgagtatgtctataagctattgtccctacgccctcctcggtcagtaccacgacattaagcagtacattcatcactcgcccggtaattccaagagggggttcgggatcgactgcgccattttatcttgtcaggtgtacataagccagatactggtggcaagcgcacttggcggggtggtggacgcagtgggaacagttagggtgatacccatggtggcctcagtaggatccttcctgggctttctgacagcaacattcctggtgatctatccgaatgtgagcgaggaggccaaagaggagcaaaaggggctctcctctccgctcgccggcgaaggaagggccgggggtaacagcgagaagcccactgtacttaaactgacaaggaaagaggggcttcagggcccggtcgagactgagtctgtggtatag

SEQ ID NO: 33520 - DNA, 1338 bp, Artificial Sequence
  Description of Artificial Sequence: Synthetic coding sequence
atggccgcccccactccggccaggcctgtcctaacacacctactggttgctctgtttggcatgggctcctgggctgccgtgaacggaatatgggttgagttgcccgtggttgtgaaggagctccctgaagggtggagcttgccttcatacgttagtgtcctggtggctctaggaaacctcggccttctcgtggtgaccctttggaggaggttggcaccaggcaaagacgaacaggtccctatccgcgtagtgcaagtcttggggatggttggcactgcactgttagccagcctgtggcaccatgttgccccagtggctggtcagctgcattcagtcgccttcttggcactcgcgtttgttttagcactcgcctgttgtgcttctaacgtcacttttctcccattcctgagtcacctccctccccggtttttgagatctttttttctggggcaaggtctatccgccttgctgccttgtgtgttggcacttgttcagggcgtgggtcgcctggagtgcccacctgcaccaatcaatggaaccccaggaccaccactggactttctggagaggttccccgcgagcaccttcttctgggctttaacggccctgttggtggcctcagctgccgccttccaaggcctgctcttgttgctgcctcctcccccctctgttccgacgggagaacttggtagcggtctgcaagtgggagcaccgggggcagaagaggaagttgaggagtcatcacccctgcaagagcctccaagccaagctgccgggacaacccccggacctgatccgaaggcctatcagcttctcagtgccagatctgcctgtcttctgggactgttagcagcaaccaacgccctaaccaacggtgtgctgcccgccgtgcaaagcttcagctgtcttccctacggccggctggcatatcatttagctgtggtcctcggctcagcagctaatccacttgcctgcttcctggccatgggcgtgttatgccggagcctagcagggctaggcgggctgtcactgctaggagtgttctgcggaggatatcttatggccctggccgtgctgtcgccgtgtccaccgctcgtggggacttccgcgggtgtggtgttagtagtgctgtcctgggtgttatgtttgggcgtcttttcctacgttaaggtggcagcgtcaagcttgttgcacggtgggggccggccggcacttcttgctgccggtgtcgcaatacaggtgggaagtcttctgggagccgtcgctatgtttccacccacatcgatttatcacgtgtttcatagcagaaaggactgtgctgacccctgcgactcgtag

SEQ ID NO: 33521 - DNA, 1338 bp, Artificial Sequence
  Description of Artificial Sequence: Synthetic coding sequence
atggcggcaccaacccctgccaggccagtgctgacccatctcctggtcgcactcttcgggatgggctcctgggcagccgttaacgggatctgggtggaactacctgtagtagttaaagaacttcctgagggatggtcactgcctagctatgtgtccgtattggtcgcccttggaaaccttggcctgctcgtcgtgactctgtggagaagactggcgcctgggaaggacgaacaggttcccatcagagtggtgcaggtcttaggcatggtgggtacagccctactggcttcactctggcaccacgtcgcccctgtggccggccagcttcattctgtcgccttcttggcactggcctttgtgctggccctcgcgtgctgcgctagtaatgtcaccttcttacccttccttagtcacctgcccccgaggttcttgagatcctttttcttgggccaaggactgagtgccttactgccctgtgtgctggctctggttcagggcgtggggcgcttggaatgcccacccgctcctatcaacggcacccccggaccgccgcttgacttccttgagaggtttcctgcaagtacatttttttgggccctgactgccctcctggtggcaagtgccgcagcctttcagggactcttactactgctgccgccccctcctagtgtgcctacgggtgagctcggcagtggactgcaggtgggggctccaggtgccgaagaggaggtcgaggagagttctccactgcaggagcccccctctcaggccgcaggcacgactccagggccggatccgaaagcatatcaacttctgagtgcgcggtctgcatgcttgctgggcctgttagctgccacaaacgctctgactaacggcgtcttgcccgcggtgcagtctttctcctgtctgccttacggccgcctggcttatcacctcgccgttgtgctcgggtcggcagccaatcccctggcctgttttctggcaatgggagttctgtgtagatctcttgccggcttaggcggtctctctctcctgggcgtgttctgcgggggctacctcatggcattggccgttttgagtccttgcccccccctggtcggtacctccgctggggtggtcctggtggttttgagctgggtattatgtctcggagtgttctcttatgtgaaggtggcagcatcttctctgttgcacgggggagggcgacctgccctgctggctgcaggggtggctatccaggttggctccctgttgggagctgtcgctatgttccctccaacctccatctatcatgttttccactcgcgcaaggactgcgctgatccctgtgactcttag

SEQ ID NO: 33522 - DNA, 1338 bp, Artificial Sequence
  Description of Artificial Sequence: Synthetic coding sequence
atggcggctccaaccccagccagaccggtgctgactcacctactggtggctctgttcggcatgggaagctgggccgcggtgaatgggatttgggtcgaacttcctgtggttgtgaaggaactgcccgaggggtggagtctgccatcctacgtgagcgtcctagtggctctgggtaacctggggctactcgtcgttaccctctggcggaggttggcccctggcaaagatgagcaggtccccatccgcgtggtccaggtgctaggaatggtgggaacggcccttctcgcgtctttgtggcaccacgttgcccctgttgcaggccaactacactcggtggcttttctcgccctagccttcgtgcttgccctggcctgctgtgcgagtaatgttacatttctgccctttctgtctcacctgccaccaagatttctgcggtcttttttcctcggccagggactgtcagccctgctgccttgtgtgcttgcactggttcagggcgtcggtagactcgaatgtcctcctgctcccattaacggaacacccggcccaccactggactttttggagcgtttcccagcttccacattcttctgggctctgactgctctcctggtggcatcagctgcggctttccaaggcctccttctgttattaccgcccccaccatcggtgcccacaggcgagctaggctcaggcctacaggtgggggcgcccggcgccgaggaggaggtggaggaaagttcacccctgcaggagccaccaagccaggccgccggcactaccccaggtcccgaccctaaggcctaccagctcctaagcgccagatcggcctgtttgctggggctgctggcagcaacaaatgcgctcaccaatggcgtactgccagcggtacagtctttctcttgtctgccatatgggcgattggcttatcacctggcagtcgtgctgggcagcgcagccaaccctctcgcctgcttcctcgcaatgggcgtcctgtgtcgctctctcgcaggactcggaggcctatcattgctaggcgtgttctgcgggggttacttgatggccttagccgtgctgagtccctgcccccccctcgtcggcacatcagccggcgtggtcctggtcgttctgtcgtgggttctgtgccttggcgtgttttcctatgtgaaagtggctgcaagtagcctcctgcatggtggaggccggcccgcattgctggcggccggtgtcgccattcaagttgggagcctcctcggcgctgtggccatgtttcctcccactagtatttaccacgtcttccactcccgtaaggattgtgcggacccatgcgattcttag

SEQ ID NO: 33523 - DNA, 1923 bp, Artificial Sequence
  Description of Artificial Sequence: Synthetic coding sequence
atgaagatcagtacaacccaaatcgagagaagatttgaaatcagctcatccctcgtgggattgatcgacgggtcttttgagattggcaacctgttcgtaatagtcttcgttagctacttcgggtcaaagctgcaccggcccaaactgatcgggatcggatgtttcctgatgggcactggttctatcctgatggcgctccctcacttcttcatggggtattacaggtactccaaagagacaaacatcgatccttccgagaactctacaagcaatctgcccaactgcctcatcaatcagatgctcagcctgaatcgcactccgtccgaaatcatcgagaggggttgtgtaaaggagtccggatctcacatgtggatttatgtttttatgggtaatatgcttagaggtataggagaaacacccattgtccccctgggtataagctacatcgatgactttgccaaagagggccattcaagtctatatttaggcactgtcaacgtaatgggcatgaccggccttgttttcgccttcatgttgggatccttatttgctaaaatgtatgtcgatatcggctacgtggatcttagtactattaggattactccaaaggatagtcgctgggtgggagcctggtggctgggtttcttagtgtctgggatagtcagcatcatcagctcgatccccttcttctttctgcctcttaatcctaacaagccacagaaggaacggaaagttagtttgtttttgcacgtgttaaagacgaacgacaagcgaaatcaaatagcaaatctgacaaacaggaggaagtacattacaaagaatgttaccgggttctttcagtccttgaagagcatccttaccaatcctttgtatgtgatatttgtcatcttcacactcctgcacatgagcagttatatagcctctctgacatatattatcaaaatggtggagcagcaatatggctggagcgctagcaaaaccaactttctcttaggagttctggcactcccagcggtggccatcggtatgttttccggcggttacatcatcaagaaatttaagctgtctctggttggcttagctaaactagcgttctgttccgccaccgtccatctcctttcacaggtcctctactttttcctcatttgcgagtctaaatcggtggccggattaacccttacctatgatggcaattctccggttaggtcccacgttgacgtgccactgagctattgcaactctgaatgtaactgcgacgaaagccaatgggagccagtgtgcggcaacaacgggattacatatttgtcaccgtgccttgccggatgcaagtcaagttccggcaataaagaacccattgtgttctataactgttcatgtgttgaggtgataggccttcagaacaaaaactatagcgctcatcttggagagtgcccacgcgacgatgcatgcacccgtaagtcttatgtttatttcgtcatccaagtgctggacgcgtttctatgcgccgtgggactgacttcatatagcgtgttggtgatacgtatcgtacagcccgaactgaaggctctggctattggttttcactcaatgattatgcgatctttgggggggattctagtcccaatatactttggggctctaattgacacgacatgtatgaaatggtctactaatagttgtggagcacgaggtgcttgtaggatatacaactctacatatcttggacgcgccttctttggcctgaaagtggctctgatttttcctgtgttggtattgctcaccgtattcatttttgttgtgcgcaaaaaatctcatgggaaggacactaaggtgctcgagaacgagcgtcaggttatggatgaggcaaatctagaattcttgaatgatagcgaacactttgttccttctgctgaagagcagtag

SEQ ID NO: 33524 - DNA, 2064 bp, Artificial Sequence
  Description of Artificial Sequence: Synthetic coding sequence
atggatcagcatcagcatctgaataaaactgccgaatccgcttcgtccgaaaagaagaaaacccggcggtgcaacggctttaagatgtttcttgcggcactgtccttcagttacatcgccaaagccctggggggaatcatcatgaaaataagcatcacccaaattgaacgcaggttcgacatcagtagctcattggctggtctcattgacggttcattcgaaattggcaatcttctagtcatcgtgtttgtttcttactttggcagcaagttgcatcggccaaagcttattggaatcggttgtctgctcatgggcaccggatccatcttgacatctctgccacactttttcatggggtactacagatactctaaggagacgaatatcgacccaagtgaaaactcaacgagcaacctccctaattgcctcattaaccagatgctctctctaaaccgcacacccagcgaaattatcgaacggggatgcgttaaggaatctggatcgcatatgtggatttacgtattcatgggcaatatgctgcgagggatcggtgagacacccatcgtgccactcggtatctcctacatcgatgatttcgctaaagagggtcattcctccctttatctggggacagtcaacgtgatggggatgacaggactggtctttgcttttatgttgggcagcttgttcgctaaaatgtacgtcgacatcggatacgtagacctaagcaccatccgcataacacccaaggactcacggtgggtgggtgcatggtggctcggatttctcgtttctgggattgtatccataatttcttctattcctttcttctttctcccccttaaccctaataagcctcagaaggagagaaaggtttccctcttcctgcacgtccttaaaacaaacgacaagaggaatcagatcgcaaatctgacaaacagacgaaaatacatcaccaaaaatgttacaggattcttccaaagtctcaagtccatcttgacaaatcccctttacgtgattttcgtgatttttacattactgcatatgagtagctatatcgcctcccttacgtatatcattaaaatggttgagcaacaatacggttggagcgcctctaagacgaacttcctcctgggcgtacttgcccttccagcagttgcaatcggaatgtttagtgggggttatattattaagaaattcaagctgagtctggtaggactggccaagctggcgttctgttccgccaccgtgcaccttctgagccaggtactctattttttcctgatctgtgagtccaagagtgttgctggcctgactcttacttacgatggcaacagccctgtcaggtcccatgttgacgtaccactttcctactgcaatagcgagtgcaactgtgatgagagtcagtgggagcctgtatgcggtaataatggcataacctatttgtcaccatgcctggctggctgtaaatcttcctccgggaataaagaacctatcgttttctacaattgttcatgcgtggaggtcatcggactccagaataagaattattcagcccacctaggggaatgcccccgagatgatgcctgcacacgaaaatcatacgtgtattttgtcatacaagttctcgatgccttcttgtgtgctgtgggtcttacctcttatagcgtactggtcatccgtatcgtgcagccagagttgaaggctctggctattggtttccatagtatgatcatgaggagcctggggggcattcttgtcccgatatatttcggcgctctcattgatacgacttgcatgaaatggagtactaacagctgtggggcccgaggagcctgtcgcatctataatagcacatacttaggaagggccttctttggacttaaagtagctctgatctttcctgtgctagtactgttaacagtgttcatatttgtcgtacgtaagaagtctcacggtaaggacacaaaagtcctcgagaatgagcgacaagtgatggacgaggccaacttggagttcctcaatgactcagagcactttgttccatccgccgaagagcaatag

SEQ ID NO: 33525 - DNA, 813 bp, Artificial Sequence
  Description of Artificial Sequence: Synthetic coding sequence
atgggcttctggtgccgaatgtccgaaaaccaggagcaggaagaggttatcactgtcagggttcaagaccccagggtgcagaacgagggttcatggaatagctacgtcgactataaaatcttcctgcacacaaactccaaagcattcaccgcgaagactagctgtgttcgaaggaggtatcgggagtttgtatggctgcgaaagcagcttcagaggaatgccggactggtacccgtcccagaactgcctggaaaatccactttcttcggcactagtgatgagtttatagagaagcgcaggcaagggctgcagcactttctagaaaaggtgctacagagcgttgtgctcctgagtgactcccaactgcacctctttctgcaaagccagctgagcgttcctgagattgaagcatgtgtccaggggaggagtaccatgaccgtatcagatgccatcctacgatatgccatgtccaactgtggctgggcccaggaagaaagacagtcaagtagtcaccttgctaagggggaccaacctaaatcatgttgtttcttaccgagatccgggcgccgtagttctccctcaccacccccctcggaagagaaggatcacctcgaagtatgggccccggttgtagactccgaggtccccagtctggagtcacccaccctgcctcccctttcctctcctctttgttgcgattttgggcgtccaaaggaaggcacttccactttgcagtcagttagaagagctgtcggtggtgatcatgcagtaccgctggatcctggacagctggagacagtgctcgaaaagtag

SEQ ID NO: 33526 - DNA, 813 bp, Artificial Sequence
  Description of Artificial Sequence: Synthetic coding sequence
atgggcttctggtgccggatgtccgaaaatcaggaacaagaagaggttatcaccgttcgcgtccaggacccacgagttcaaaacgagggaagctggaacagctacgtggactacaaaatctttctacatactaacagtaaagcgttcaccgctaaaacatcctgcgttcggagacgttatagggaattcgtatggctcaggaagcagttgcagaggaacgcaggtttggtacctgttcccgagttgcccggcaagtccaccttcttcggaacatcagacgagttcatcgaaaaacgcaggcaggggctccagcatttcctagaaaaagtgctgcagtccgtggtgctgctttccgattcccaactccacctctttttgcagtctcagctgagcgtgcctgaaatcgaggcgtgcgttcaggggagatctaccatgaccgtgagtgatgcaattttgcgttacgctatgtccaactgcggatgggctcaggaggaaaggcagagttcctcacacctggccaaaggcgaccagcccaagagttgctgctttctgcccagaagcggtcggcgctcctcgccaagcccacccccatccgaggaaaaggatcaccttgaggtgtgggcccccgtggtggactcagaggttccttcgctggagtcccccacgttgcctccactttctagccctctttgctgtgactttgggaggcctaaagagggcactagtactcttcagtcggtgcgtcgggccgttggcggggatcacgctgtgccattagatccagggcagttggagaccgtgctggaaaaatag

SEQ ID NO: 33527 - DNA, 630 bp, Artificial Sequence
  Description of Artificial Sequence: Synthetic coding sequence
atgagggccccggggaccctcatgtggatcatcaggtactcctcaatgcccgtgcccgagcttcccgggaagagtaccttctttggaactagcgatgagtttattgaaaaacgaagacagggcctccagcacttcctagagaaggtgctccagtctgtggtcttgctgtcggacagccagcttcacttgtttctgcagagccagctgagtgttcctgagatagaagcctgtgtgcagggccgctccaccatgactgtttctgacgcaattttgaggtatgccatgtctaattgcgggtgggcccaggaggaacggcagagctcaagtcacctagccaagggtgaccaacctaagtcgtgctgtttcttaccgcgctccgggcgcaggtcttctccctctccaccccctagcgaggagaaggatcatctcgaagtctgggcacccgtagtggacagtgaggtaccaagcctggagtcacccactctgccaccactttcctcccccctgtgctgtgatttcggacggcctaaggagggaaccagtactctccagtccgtaaggcgggctgtcgggggcgatcacgccgtccctctggatcccggacagctcgagaccgtgctggaaaaatag

SEQ ID NO: 33528 - DNA, 381 bp, Artificial Sequence
  Description of Artificial Sequence: Synthetic coding sequence
atgacagtctctgacgctatcctacgttatgcgatgtctaactgtgggtgggcgcaggaagagaggcagagtagctctcatctggctaaaggggaccagcccaagagctgctgtttcctccctagatctggacgtaggtcttcgccaagtcccccaccttctgaagagaaggaccacctcgaagtgtgggccccagtcgtggactcagaggttccatcacttgagtcacctaccctgccccctctctccagtccactttgctgtgacttcgggcggcctaaggaaggaactagcacgctccagagtgtcaggagagccgtggggggggatcatgctgtgccactggatccaggacagctggaaacagtgctggaaaagtag

SEQ ID NO: 33529 - DNA, 477 bp, Artificial Sequence
  Description of Artificial Sequence: Synthetic coding sequence
atgagcgatacagccgttgccgacacccggcgattgaatagtaagcctcaggatttgacagacgcatacggccctccttccaatttcttagaaatagacatatttaatccccagacagtgggtgtcgggagggcacggttcaccacctatgaaacgaatctgcctattttcaagctcaaggagtcctgcgtccggcgtcggtacagcgattttgagtggcttaagaacgagttagaacgagatagtaagatagtggtgcccccgttaccaggcaaggcattgaaacgccagctcccctttagaggcgatgaggggatttttgaagagagtttcatcgaggaacggcgacagggcctcgaacagtttattaataagatcgcagggcatccattagcgcagaatgaacgttgcttgcacatgttcctgcaggaagaggcaattgatcgaaattacgttccagggaaagtgcgccaatag

SEQ ID NO: 33530 - DNA, 489 bp, Artificial Sequence
  Description of Artificial Sequence: Synthetic coding sequence
atgtctgacaccgcagtggccgatacacggaggttaaatagtaagccgcaggatctaacagacgcatatggccctccttccaactttctggaaattgacattttcaatccacaaaccgtgggagtcgggcgagcccgttttactacatatgaagtgcggatgagaacaaacttaccaatctttaagctgaaggaatcatgtgtcaggcgtcgatattctgacttcgagtggctgaaaaacgaattggaaagggatagtaagatcgtggtaccccccttgcccggtaaggccctgaaacggcagctgcccttcagaggcgacgagggaatctttgaagagtccttcatagaggagaggcgacaggggcttgagcagtttatcaacaaaatcgcagggcaccctcttgcccagaacgaacgatgtctgcatatgtttctccaggaagaggctattgacagaaactatgtcccaggaaaagtcaggcagtag

SEQ ID NO: 33531 - DNA, 3327 bp, Artificial Sequence
  Description of Artificial Sequence: Synthetic coding sequence
atgtcttccgtgaaaagacccagagggcgtcccccctccagcaaaaagagcgacgggtcaggcacatacacaaaactgcaaaacacacaagtacgcgtgatgagcgaaaaaaagcagagaaagaaagtggagagtgagtccaagcaggaaaaggccaaccgtatcatttcagaggccattgcgaaggcaaaggagcggggagaacggaacatcccccgagtcatgtctccagaaaacttccctacagcctccgtcgagggtaaagaggaaaaaaagggacgacggatgaagtccaaaccgaaggacaaggacagtaaaaagaccaagacatgtagcaagctgaaggagaaaaccaagattggcaagctaatcattaccctgggcaagaagcagaaacgtaagaacgagtcttcggacgagatcagtgacgctgagcagatgccccaacacacgttaaaagatcaggattcccagaagaggcggagcaatcgacaaatcaaaagaaagaaatacgcagaagatattgagggcaagcaaagtgaagaggaggtcaagggtagcatgaaaatcaagaaaaacagcgcaccactgccgggggagcagccgctacaactattcgtggagaacccgagcgaggaggatgccgccatagtggacaagatcctgagctctcggacagtgaagaaggaaatctcaccaggagtcatgattgacaccgaagaattcttcgtcaaatacaagaattacagctatctgcattgcgaatgggctacagaggagcagctgttaaaagataagcgcatccagcaaaagattaagcggttcaaactcaggcaagcccagagagctcacttcttcgccgatatggaagaggaaccattcaacccagactacgtggaggttgacagggtcctagaagtgtcgttctgcgaggataaggacactggagaaccagtgatttactatttagtgaagtggtgttcactgccgtatgaggactctacttgggaactgaaggaggatgttgacctggcaaagattgaagaattcgaacagctgcaggcttctaggcccgatacgcgtagactagatcgaccgccctccaacatatggaaaaagatcgaccagagcagggactataagaacgggaaccaactgcgcgagtaccaactggaggggctgaactggctgctgtttaattggtacaatcgaagaaactgtattttggccgacgagatgggtctggggaagactattcagtcaatcaccttcctgtatgaaatcctgctgacagggatacggggaccttttctgattattgctcctctcagtaccatcgccaactgggagcgcgagttcagaacttggacagacatcaacgtcgtcgtgtatcacggttccctcattagtcggcagatgatacagcagtacgaaatgtattttagggatagccaaggccggatcattcgtggtgcatacaggttccaagctataataacaactttcgaaatgattttagggggatgtggggaactgaatgcaattgagtggagatgcgtaatcatcgatgaggcccatcgtctgaagaataaaaactgcaagctgctagagggtctgaagctgatgaatttggagcacaaagtgctgctcactgggacaccactccagaacaccgtcgaggaactgttttcccttctccacttcttggaaccgctgcggtttccctccgaatctaccttcatgcaagagtttggcgacctaaagaccgaggagcaggtgcagaaactgcaggccattttgaaaccaatgatgctacgccgtctaaaagaagacgtagagaaaaagttggctcccaaggaagagacgatcattgaagtcgaactgacgaacatccagaaaaaatactaccgtgcaatactggaaaagaacttttcttttttgagcaagggcgcaggtcaaactaatgtgcccaaccttgttaatacaatgatggagcttagaaagtgttgcaatcatccttatctaattaaaggggctgaggagaaaatcctgggtgagttccgagacacgtataaccccgccgcctccgactttcatctgcaggcaatgatccagtccgctggcaaactggtcctaatcgacaagctgctcccaaagatgaaagcgggtgggcacaaggtactgatattcagccaaatggttcgttgcctggacatcctggaggattatcttatccacaagagatacttgtacgagaggattgatgggcgagtgcgtggaaatctgagacaggccgctatcgacagattttctaagcccgactcagacagattcgtcttcctcttgtgtaccagggctggtggcctgggtataaatctcaccgctgcagatacatgcataatttttgactccgactggaacccacagaacgatcttcaggcccaggcacggtgtcaccggataggccaaaataaggccgtgaaggtgtaccggctcgtcacccggaactcctacgaacgggaaatgtttgaccgcgcgtcactgaaattgggactggacaaagcggtgctgcagtccatgagtgggcgggaaagtaacgtggggggcatacagcagctctccaaaaaagagatagaggacttgttgaggcgcggcgcatatggcgcaataatggaggaggaagatgaagggagtaagttttgtgaggaagatattgatcaaattctgctccgaagaaccaaaacaatcaccatcgaatcagagggccggggcagcacttttgccaaagccagctttgtagcctccgggaatcgcactgatatctcccttgatgatcccaacttttggcaaaagtgggctaaaaaagcagagatcgatatcgaagcgatcagcggcaggaatagtcttgtcatcgacacccctaggattagaaaacagacacgacctttttctgcgactaaggacgagctcgccgagctgtcagaagctgagtctgagggagacgagaagccgaaactgcgccggccttgtgaccgaagcaacggttacggtcgtactgaatgtttcagagttgagaaaaatctgcttgtttacgggtggggaaggtggcgcgagattctctcccacggccggtttaagcgtcagctgaacgaacatgacgtcgaaattatttgccgggccctcctcgcgtattgtctagtgcattataggggagacgagaaaattaagggctttatttgggacctgatcacccccacagaagatggacagactagagagctgcaaaaccacctcggcctgtccgcgcccgtgcccagaggcagatag

SEQ ID NO: 33532 - DNA, 1128 bp, Artificial Sequence
  Description of Artificial Sequence: Synthetic coding sequence
atgtctggaagccagaataacgacaaaagacagttcctgctggagcgactcctggatgcagttaagcagtgccagattcgatttggcggtagaaaagagatcgcatcagatagtgacagtcgtgtaacatgtctgtgcgctcagttcgaggcggtactgcagcacggcctcaagcggtcccgcggattggcgctcactgcagctgcgataaaacaggctgcagggtttgcctccaagactgaaacagagccagtgttttggtactacgtcaaagaagtgctgaataaacacgaactgcagcgattttattccctgcgacatatagcctctgacgtggggcgaggacgggcttggctccgctgcgctctaaacgagcattcccttgagcgttatctgcacatgttgttggcagaccgctgccgtttgtctaccttttacgaggattggagcttcgtcatggatgaagagcggagctcgatgttacctacaatggctgccggcctgaacagcatcttgttcgccatcaacattgacaataaagatctgaacgggcagagtaagttcgccccgacggtgagtgaccttcttaaggaaagtactcagaatgtaacctcactgcttaaggaaagcacacaaggcgtgtcttccctgtttagagagatcacagctagcagcgctgtgagcatattgattaaaccagaacaggagaccgaccctttacctgtcgtcagcaggaatgtttctgctgacgctaaatgcaagaaggaaaggaaaaaaaaaaagaaggtcaccaatatcattagtttcgacgatgaagaggatgaacaaaattctggcgacgttttcaaaaaaaccccaggcgccggggagtcgtctgaagataactccgaccgctcttccgttaatattatgtccgcatttgagtctcccttcggaccaaattcaaatggttcacagtcaagtaattcttggaaaattgattctttgagcctgaacggagagtttggctaccagaagcttgacgtcaaaagcattgatgacgaggacgtggacgagaacgaagacgacgtttacggtaactcatccggacgaaaacaccgcgggcattcagagtccccagaaaagtag

SEQ ID NO: 33533 - DNA, 1287 bp, Artificial Sequence
  Description of Artificial Sequence: Synthetic coding sequence
atgcactcttgggcccccttgaaggtcctgcacaatgacagcgacatcctattccccgtgtccggggtggggtcatatagccctgccgatgctcctctgggttccctcgagaatggcactgggcccgaagaccacgtcttgcccgacccgggcctgagatactctgtggaagcatcttcgcccggccacgggagtcccctcagttcactgctgcccagtgcctctgtccctgaaagtatgactattagcgaattaaggcaggccaccgtggccatgatgaatcgtaaagacgaattggaagaggagaatcgatcactgcgtaacttgctggacggggagatggagcattcagctgcattgaggcaggaggtggacaccctgaagaggaaggtcgctgaacaggaggagcggcagggcatgaaagtacaggccctagccagggagaatgaagtgctcaaggtccagctgaagaagtacgttggcgccgtgcaaatgctgaagagggagggacagaccgctgaggttccaaacttgtggtcagtcgacggggaggtgacagtggcggaacagaagcccggagaaattgctgaggagctggcctcttcttacgagagaaagctcatcgaggtagccgagatgcatggcgaactgatcgagttcaatgagagattgcaccgcgccctggtggcaaaggaagctctggtgtctcagatgcggcaggaacttattgacttaagggggcctgtgccaggtgatctgtctcaaactagcgaagaccagagtctgtccgattttgagatcagtaaccgggcactcataaatgtgtggattcccagtgttttcctgagaggcaaggcagcaaacgcatttcacgtttaccaagtttatattcggatcaaggatgacgaatggaatatatatcgcagatatacagaattccgctctctgcatcacaaattgcagaacaagtatccccaggtacgcgcatacaattttcctccaaagaaagcgattgggaataaggatgcaaagtttgttgaggaacggaggaagcaactgcagaattacctcaggagcgtcatgaacaaagttattcagatggtccccgagttcgccgcttctcctaagaaggaaacactgattcagttgatgcccttcttcgtggatataactcccccgggcgaaccggtgaattccagaccaaaggcagccagcaggttcccaaagctaagtagaggacagccgcgcgagacaagaaacgtggaacctcaatcaggtgacctgtag

SEQ ID NO: 33534 - DNA, 1227 bp, Artificial Sequence
  Description of Artificial Sequence: Synthetic coding sequence
atgcacagctgggcccccctgaaagtgctccacaacgatagtgatatcctgttccccgtctccggggtcggctcatattcaccagcagatgcaccactgggaagtctagagaatggtactggccctgaggatcacgtcctgcctgatcctggcctccgatacagtgtcgaagcttcaagccccggccatggaagccctttgagttcactcctccctagcgcttcagtacccgagtccatgactattagtgagcttagacaggcaactgttgcaatgatgaataggaaggatgaattagaggaagagaacaggtctctgcgaaacttgttggacggagaaatggaacactcagcagctctccggcaagaggttgataccctcaagcgcaaagtcgctgaacaggaagaacggcaaggtatgaaggttcaagctctcgctagggagaatgaggtcctcaaggttcagctcaaaaagtacgttggtgccgtgcagatgttgaaacgcgagggccagactgctgaagtgcccaacttatggtcagtcgacggggaggtaaccgttgctgaacagaaaccaggtgaaatcgccgaagaattagccagttcttacgaaaggaagcttatcgaggtggcagaaatgcacggcgagcttattgagtttaacgaacgactgcatcgagctctagttgccaaagaagctctggtgtcgcaaatgcgccaggagctaatagacctgagaggacctgtacctggagatctgagccagacatccgaagaccagagtctgtctgacttcgagatcagcaatcgcgcattaataaatgtttggatcccttccgtcttcctaagggggaaagccgctaatgctttccatgtttatcaggtgtatatcaggatcaaggacgacgagtggaatatttatcgcaggtacacagagtttcggagtttgcaccataagcttcagaacaaatacccgcaagttagagcttacaatttccctcccaagaaggccatcggaaacaaagacgccaagtttgtcgaggagagaagaaaacagctacagaactacctgaggagtgtgatgaataaagtaatacagatggtgcccgaattcgctgcaagtccgaagaaagagaccctgatccaactcatgcccttttttgtcgattggatctctctattcggtaatggcagggatagctcacgcgaggagtttagctcttcttag

SEQ ID NO: 33535 - DNA, 750 bp, Artificial Sequence
  Description of Artificial Sequence: Synthetic coding sequence
atggacgaggagagatcctcgatgctcccgactatggccgcgggtcccaatagcatcctgtttgcaattaatatcgataataaggacctgaacgggcagagcaaattcgccccgacagtgtcagacctgctgaaagagtccacacaaaacgtgacactgctgaaagaatcaacgcagggcgtgagcagtgtttttagagaaatcaccgctagctctgcaattagcatactgattaagcccgaacaggagaccgatccgttaccagtcgtttcccggaacgttagcgccgacgcaaagtgtaagaaggagcgcaagaagaagaaacaggtcacgaacatcatcagctttgatgacgaagaagatgagcagaatagcggtgacatgttcaagaaaaccccgggtgctggagagtctagtgaggataattccgaccactcaagcgtgaacatcatgtccgcctttgaaagcccctttggccccaattctaatggatcccagtcttcaaactcgtggaaaatcgattcccttagtcttaaccgtgaatttggctaccagaaattggatgtgaagtccatagatgacgaagatgttgacgaaaatgaggacgacgtgtatggaaattcgagcggcagaaaacaccgtggacactcagaaagtccagaaaagaacggtgctcacagcgtcacccaggccggtgtccaatggcacgatctctcaagcctccagccgctgccacccgggttcaagtag

SEQ ID NO: 33536 - DNA, 750 bp, Artificial Sequence
  Description of Artificial Sequence: Synthetic coding sequence
atggatgaagagcggtcctcaatgttacctacgatggccgctggcccaaacagcattctattcgcgatcaacattgacaataaagatctcaatggccaatctaagttcgctcccaccgtctccgacctactaaaagaaagcacgcagaacgtgaccctcttgaaggaaagcacccagggagtttccagtgttttcagagagataacagcttcttcggctattagcatcctcatcaaacccgagcaagagaccgaccccctacccgttgtttccaggaatgtctccgccgatgccaaatgcaagaaggagcgcaagaaaaagaagcaggtgaccaatattatctcttttgatgatgaagaggatgagcagaactccggagatatgttcaagaaaacccctggagccggagaatcctctgaggacaacagtgaccatagttcggttaacatcatgtccgctttcgaatccccattcggacctaattccaatggtagtcagtcttccaacagctggaagatcgacagcctcagtctcaacagagagttcggttatcagaagcttgacgtgaaatcgatcgacgacgaggatgtagacgagaatgaagacgacgtgtacggcaacagtagcgggagaaaacatcgtggacattcagagagccccgagaaaaacggggctcactcagtcactcaagccggcgtgcaatggcacgacctgagcagcctccagccacttccacccggcttcaagtag

SEQ ID NO: 33537 - DNA, 807 bp, Artificial Sequence
  Description of Artificial Sequence: Synthetic coding sequence
atgctcttagccgatcgctgcaggctaagcacattctacgaggactggtcctttgtgatggatgaagagcgcagctccatgctcccaaccatggctgcaggacctaattctatcctgttcgccattaatattgataacaaggacctcaacggacagagcaagttcgcaccaaccgtctctgacttgcttaaggaatctacacaaaacgtaacgttgctaaaggaatccacccaaggggtttcatccgttttccgcgaaatcaccgctagttcagcaatatcaattttgattaaacccgagcaggagacagatccccttcctgtggtcagcagaaacgtatcggctgacgcaaaatgcaagaaagagcgtaagaaaaagaagcaagtgaccaacataatatctttcgacgacgaggaggatgaacagaattctggggacatgttcaaaaagaccccaggagcgggcgagagctccgaagataattctgatcacagctccgtgaacattatgtcagcatttgagtcaccattcggaccaaatagtaatgggtcacagtcgagcaattcctggaagatcgattccttgagcttgaatcgcgagttcgggtatcagaaactcgatgtgaaatccatagatgatgaggacgttgacgagaatgaggacgatgtttacgggaactcctccggtagaaagcatcgcgggcattcagagtctcccgaaaaaaatggcgcccacagcgtcacacaagccggggtgcaatggcatgacttatcaagccttcaaccgctgccgcccggcttcaaatag

SEQ ID NO: 33538 - DNA, 351 bp, Artificial Sequence
  Description of Artificial Sequence: Synthetic coding sequence
atgctgctcgccgaccggtgtcgactgtcgaccttctatgaggattggagttttgtaatggacgaggaaagaagctcaatgctacccacaatggcagcggggcccaattccatcctgtttgccatcaatattgacaataaggaccttaatggacagtcgaaattcgccccaaccgtgagtgatttgttgaaggagtcaacacaaaacgtcaccctgctgaaggagtccacccaaggagtgtctagcgtgtttagagaaattacagcttctagcgccatctctattttaatcaagccagaacaggagaccgatccccttcctgtcgtaagtcgcaatgtgtccgctggatag

SEQ ID NO: 33539 - DNA, 1323 bp, Artificial Sequence
  Description of Artificial Sequence: Synthetic coding sequence
atgaagatgcatttttgtatcccagtgtcccagcagcgtagtgacgccctaggcggaaggtatgtgctctacagtgtccaccttgacggattcctgttctgccgggttagatattctcagctacacggctggaatgagcagttgcgcagggtgtttggcaactgcttgcccccctttccccccaaatactacctggccatgaccacagctatggccgatgagagacgagaccagctggaacagtatctgcagaatgtaactatggatcccaatgttctgcggagcgatgttttcgtcgaattcctcaagttggcccagctcaatacctttgacatcgctactaaaaaagcctacttggacatttttctgccaaatgaacagtctatccgaatcgagatcattacctccgataccgccgagagggtgctggaagtggtgtcccataagattggcctctgccgcgagttgctcggatatttcggtctgttcttaattcgctttggaaaagaggggaagttatccgtagtcaagaaactggccgatttcgagttgccatacgttagcttaggttcttcggaagtggagaattgcaaggtggggctgagaaagtggtacatggctccgtctctggactccgtgttgatggactgcagggtcgctgtcgacctactgtacatgcaggccatccaagacatagagaagggctgggccaagccaacccaggcccagaggcagaaattagaagccttccagaaggaggactctcagaccaagtttctagagctggccagggaggtccggcactacggatacctgcagcttgacccatgtacgtgcgattacccagagagtggctcaggggcagtcctgtcggtcggcaacaacgagatttcttgctgtatcaccctcccagattcccagacacaagatattgtgtttcagatgagtcgtgtaaagtgctggcaggtgaccttcctgggcacgctcctcgacactgatgggcctcagcgtactttgaatcagaatctggagttgagattccagtactctgaggattcttgttggcagtggtttgtgatctacactaagcaggcattcctgttgagctcttgtttgaagaagatgattagcgaaaagatggtgaagctagcggctgagaataccgaaatgcagatcgaagtacccgaacagtctaaatcgaagaaataccacattcagcagagccagcagaaagattattcatccttcctctctcgtaagtcaaaaatcaaaattgcgaaagacgattgcgtgtttggaaacatcaaagaggaggacctttag

SEQ ID NO: 33540 - DNA, 1026 bp, Artificial Sequence
  Description of Artificial Sequence: Synthetic coding sequence
atgctcgggaacaccgagaactggaacacttttgatatcgccaccaagaaggcctacctggatatttttctgccaaacgagcagtctattcggatagaaatcatcacatctgatactgctgagcgcgtgcttgaagtggtgagtcacaaaatcgggctctgccgtgaactgctgggctatttcgggctctttctgatacgattcggtaaggaaggtaagctaagcgtggtgaaaaaactggccgactttgagcttccatacgtgtccttaggctcctcagaggttgagaattgtaaagtgggcttgcggaaatggtacatggccccttcactcgactccgtgttgatggactgtcgcgtcgcagttgatctgctgtatatgcaggcgattcaagacatcgagaaaggatgggcaaagcccacacaggcacagagacaaaagttggaagccttccaaaaggaagactcacagaccaagttcctggagcttgccagagaagtgagacattatgggtacctgcagttggacccttgtacatgtgactaccctgagagcggttctggggcagtgctgtctgtcggcaacaacgaaatctcttgctgcattaccctgcctgacagtcagacccaggatatcgtgtttcagatgtccagagtaaagtgctggcaggttacattcttggggaccttgctggacactgacgggccccagagaaccctgaatcaaaatcttgagttaaggttccagtatagcgaggattcttgctggcagtggtttgtgatctatacaaaacaagcttttctcctaagttcatgcctcaagaagatgatctcggaaaagatggtcaagctagccgccgaaaatactgaaatgcagatcgaagtacctgagcaaagtaaatcaaagaagtatcacatccagcagtcccaacagaaagattacagcagcttcctgagtcgcaaaagtaaaataaagatagcaaaggatgactgcgtgttcggcaatattaaagaagaagatctgtag

SEQ ID NO: 33541 - DNA, 1212 bp, Artificial Sequence
  Description of Artificial Sequence: Synthetic coding sequence
atggaaacttacgcggaggtgggcaaggaaggcaagccgtcttgcgcctctgtagatcttcagggtgactcttcccttcaggtagaaataagtgatgccgtgagcgagagggataaagtgaaattcaccgtacagaccaaatcctgtctgcctcattttgctcaaaccgaattctccgtggtgcgacagcatgaggagtttatttggttacacgacgcctacgtcgaaaatgaggagtacgctggacttatcatccctcctgccccacccaggcccgattttgaggcctcacgcgagaaactgcagaaactgggggaaggcgattcttctgtaacgcgggaggagtttgccaagatgaaacaggagctagaggcagaatacctggctatctttaaaaaaactgttgccatgcacgaagtcttccttcagagacttgctgcgcacccaacattgcgccgtgaccataacttcttcgtttttctggagtatggtcaggatctctctgtacgaggtaaaaatcgtaaggaactcttaggcggcttcctgagaaacatcgtgaagtccgccgacgaggcacttatcactggcatgtcggggttaaaggaagtggatgatttctttgaacacgaaagaaccttccttttggaataccatacccggattcgggacgcttgcctgcgggctgatcgcgtcatgagagcccacaagtgcctcgcagacgattatatcccgatttctgcagccctctcttcactcggaacccaggaggtgaaccagcttagaacctcctttctgaagctggccgaattgtttgaacggttgagaaagctagaaggacgggtggcttctgatgaggacttgaagctgtctgatatgcttagatactacatgagagactcccaagccgccaaggatctgctgtaccgcaggctgagagctctggccgattatgaaaacgccaataaagccctcgataaagcccggactcgcaatcgggaggttaggcctgccgagtcacaccagcagctatgctgtcagcggttcgagagactgtccgattctgctaaacaggaactgatggactttaaatccaggagagtgagctcctttagaaaaaacttaatcgagctcgcagagctggagctcaagcatgccaaagcgagtactctgattcttagaaacaccctggtggctctgaaaggggagccctag

SEQ ID NO: 33542 - DNA, 384 bp, Artificial Sequence
  Description of Artificial Sequence: Synthetic coding sequence
atggagacgtacgctgaagtgggtaaggaaggcaagccttcttgtgcttcggtagacctacagggcgactccagcttgcaggtggagatttccgacgccgtctctgagcgtgacaaagtaaagtttacggtgcagactaagagttgtctgccacacttcgcccagaccgaattcagcgttgtgcgccagcatgaggaattcatttggctacacgatgcgtatgtggaaggaaaggccaccgagatcggccgggggggacaactttgccatagcggccgagtctgccaggatgaggcgggtgccggttctgtcagtgcaccatccttcccatgtcacccgcagtcccccgacgtttttccgtcatacttgcccatgaacgtctag

SEQ ID NO: 33543 - DNA, 1725 bp, Artificial Sequence
  Description of Artificial Sequence: Synthetic coding sequence
atggctctgaaaggtcgcgccctgtacgattttcacagtgagaacaaggaggagatttcaatccagcaagacgaggatcttgtgatatttagcgagacaagcctggatgggtggctccaaggtcagaattcacggggagagaccggcttattccctgccagttatgttgaaattgtacggtccgggatctctaccaatcacgccgactactcatccagccctgccggtagcccgggggcccaggtgtcattgtataactcaccaagtgtggctagccctgcacggagcggcggcggcagcggcttcctgagtaatcaggggtcctttgaggaagacgacgatgatgactgggacgactgggatgatggttgtaccgttgttgaggagccacgcgctggcgggctaggaactaatggacatccgccactgaacttgtcatacccaggtgcctatcccagtcagcacatggcctttaggccaaaaccacccttggagcggcaggactccctcgcatctgcaaaacgcggttctgtggtgggtcgtaaccttaaccggttcagttgttttgttagatcaggagtggaagctttcattttgggcgacgtgccaatgatggcaaaaatagccgaaacctattctatcgagatgggcccaagggggccccagtggaaggccaacccccatcctttcgcttgttccgtggaggacccaaccaaacagactaaattcaaagggattaagagttacatttcgtacaagctgacccctacacatgctgccagcccagtataccgcaggtacaaacacttcgactggctgtataatcgcctgctccataaattcactgtgatatctgtgcctcatttgcctgaaaagcaggccaccggtagattcgaggaggacttcatcgagaaaaggaagcgtcgactgattctgtggatggatcatatgacttcccaccccgtgctcagccagtatgaaggcttccagcacttcttgtcgtgcttagacgataaacagtggaagatgggtaaacggcgggctgagaaggacgaaatggtgggcgcaagttttctgcttacattccagatacctaccgaacaccaggacctgcaggacgtcgaagatagagttgacacttttaaagcctttagcaaaaagatggatgactcggtgctccagctaagcaccgtcgctagtgagctggtaagaaagcatgtgggcggtttcagaaaggaattccagaaactggggtcagcattccaggcaatcagccatagtttccaaatggaccctcccttctgtagtgaagcacttaactccgcgatttcccacacgggacgtacctacgaggcaatcggagagatgtttgcagaacagcctaagaatgacctctttcagatgctcgatactctctcactgtaccaggggttactgtctaatttccccgacatcatccatcttcagaaaggggccttcgctaaggtcaaagagagtcagaggatgagcgacgaagggcgaatggtgcaggacgaagcagacggaattcggagacggtgtcgagtggtcggtttcgctctccaggccgagatgaaccatttccatcagcgtagggagctggattttaaacacatgatgcaaaactatttgaggcagcagatcctgttttaccagagagtgggtcagcagctggaaaagactttgcggatgtatgacaacctgtag

SEQ ID NO: 33544 - DNA, 312 bp, Artificial Sequence
  Description of Artificial Sequence: Synthetic coding sequence
atgggacagcagtcctctgtccggcggctcaagcggtccgtgccatgcgagtcaaacgaagccaacgaggctaacgaagccaacaaaacgatgccggaaacgcctacaggtgacagtgacccccagcctgccccaaagaagatgaagacctccgaatcatcaactatcctggtcgtgcggtatagacgcaacgtgaaacgcacgtcacctgaggagttactgaatgatcatgctcgagaaaatcgcatcaatcccgaccaaatggaggaggaggaattcattgagatcacaactgaacggcccaagaaatag

SEQ ID NO: 33545 - DNA, 294 bp, Artificial Sequence
  Description of Artificial Sequence: Synthetic coding sequence
atggacaagcagagtagtgcaggtggcgtaaagcgcagtgtcccttgtgactccaacgaagctaacgagatgatgcctgaaacaagttccggatactcagaccctcagcccgccccgaagaaattaaagacctcagagtcctcgacaatcctggtggtaaggtatcgaaggaattttaagcggacctctccagaagaattggtcaacgatcatgctcggaagaacagaattaaccccctgcagatggaggaagaggaattcatggagattatggttgaaatacccgcaaagtag

SEQ ID NO: 33546 - DNA, 219 bp, Artificial Sequence
  Description of Artificial Sequence: Synthetic coding sequence
atggagcagccaacgagctctatcaatggggagaagcgaaaatccccatgcgagagcaataacgaaaatgacgagatgcaggaaaccccaaacagagacctcgcccctgaaccatcattaaagaagatgaagacctccgagtattcaacagttctggcattttgctatagaaaagcaaagaagattcattctaaccagcttgagaacgaccagtcatag

SEQ ID NO: 33547 - DNA, 543 bp, Artificial Sequence
  Description of Artificial Sequence: Synthetic coding sequence
atggagcaaccaacctcttcaacaaacggtgaaaagagaaagagcccctgtgaaagcaataataaaaagaatgatgaaatgcaggaggctcccaaccgggtacttgccccgaagcagagcctacagaagaccaaaactattgaatatctgacgattatagtgtattattaccgcaaacatactaagattaatagcaatcagctggagaaggaccagagtagagagaacagtataaacccagtgcaggaggaggaagacgaaggcttggattcggcagagggtagttcccaagaggatgaggatttagattcttcagaagggtcctcgcaggaggatgaggatctagactcttcagagggatcttcacaggaagatgaagacctggattcttctgagggatcatctcaggaagatgaagacctagactcctcagaagggtcttcccaggaagatgaggacctcgatccaccagaggggtctagccaggaagacgaagatctcgactcttctgaaggctcgagccaagaaggcggcgaagactag

SEQ ID NO: 33548 - DNA, 426 bp, Artificial Sequence
  Description of Artificial Sequence: Synthetic coding sequence
atggagcagcctaccagcagcactaatggagagaaaaccaaaagcccatgcgaatccaataacaagaaaaacgatgaaatgcaagaagtgccaaatcgggtcctcgccccggaacagtctctcaaaaagactaagacaagtgagtacccaatcatatttgtctattacctacggaagggcaaaaagattaatagcaatcaactggagaatgagcagtcccaggaaaacagcattaaccccatccagaaagaagaagatgaaggggttgatttatccgagggctcatctaacgaagacgaggatttgggtccatgcgaaggcccttcgaaagaagacaaagacctggacagctccgagggatcctcacaagaagacgaggaccttgggttatcggaaggatcaagccaggactctggcgaggactag

SEQ ID NO: 33549 - DNA, 300 bp, Artificial Sequence
  Description of Artificial Sequence: Synthetic coding sequence
atggaagagcctacctcctcaacgaatgaaaacaaaatgaaatccccttgtgagagtaataagagaaaggtcgacaagaagaagaagaacctgcacagagccagcgcccccgaacaaagcttaaaagagactgaaaaggcaaagtacccaaccctcgtattctattgtagaaaaaacaaaaagaggaacagcaatcagctggagaacaaccagcccacggagtcatcgactgaccctatcaaagaaaagggcgacttagacatatccgcaggctccccacaggatggaggccaaaactag

SEQ ID NO: 33550 - DNA, 219 bp, Artificial Sequence
  Description of Artificial Sequence: Synthetic coding sequence
atggaaaaaccaacctccagtacaaatggggaaaagcgaaaaagcccttgcgactccaacagcaaaaacgatgaaatgcaagagactcctaatagagatctggtgctcgaaccttcactcaaaaagatgaagacgagcgaatattccaccgtgctggtcctgtgttacagaaagacaaagaaaatccatagcaatcagcttgagaatgaccagtcatag

SEQ ID NO: 33551 - DNA, 1011 bp, Artificial Sequence
  Description of Artificial Sequence: Synthetic coding sequence
atgcaaaaacattacacagtggcctggttcttatacagcgcccccggagttgatccctcaccgccatgtagaagtcttggttggaaaaggaagcgggagtggtcagatgaatctgaggaggaaccagagaaggaacttgcacctgaacctgaagaaacctgggtcgtcgaaactctctgcggtctgaaaatgaaattgaaacagcagcgtgtgtctccaatacttctggaacaccataaggatttcaatagccagcttgcccccggagtggacccctctccgccgcataggtccttctgttggaagcggaaaatggagtggtgggataaatccgaagaaagtgaagaggagccaagaaaggtgctcgcaccagagcccgaagagatttgggtggctgaaatgctttgcggactgaaaatgaagctgaaacgtcgtcgagtgtctctagtgctgccagaacaccatgaagcctttaaccgcctactggaagaccccgtgataaagaggttcctcgcttgggacaaggacctgcgcgtatccgacaaataccttctggcgatggtgatcgcttattttagtagggcggggttccccagctggcagtatcagcgcctgcacttcttcctggctttatacctcgcaaacgatatggaggaggacgacgaagatagcaaacagaacatcttccatttcttgtacggaaagaatagaagcaggatccccctgttgcgaaaacggaggtttcagctctataggtcaatgaatccaagggctaggaaaaataggtctcatattcccctggtaagaaaacggagatttcagctgcgcagatgtatgaatccaagagccagaaagaacaggtcacagattgtcctgtttcagaagcggcgctttcactttttctgtagtatgagttgcagagcatgggtgtcccccgaggagttagaggagatccaggcttacgatccagagcattgggtctgggcccgcgatcgggcacgcctgtcttag

SEQ ID NO: 33552 - DNA, 777 bp, Artificial Sequence
  Description of Artificial Sequence: Synthetic coding sequence
atggagtggtgggatgagtctgaggaatccctggaagaggagccccgaaaggttctggccccggagcccgaggagatttgggtggctgaaatgctgtgtggcctgaaaatgaagctaaaaagacgcagagtgtctcttgtcttaccagagcatcacgaggcattcaatagattgctcgaggatccagtgatcaagaggtttctcgcgtgggacaaggacctgcgcgtgtcagacaaatacctgctggccatggtcattgcctacttttcaagggctggattcccctcttggcagtatcagagaatccacttcttcctcgctctgtatctggctaatgacatggaagaggacgacgaggacagcaaacagaacattttccatttcctgtatcggaagaaccggagtaggattcccttactcaggaagccttggttccagctgggccatagcatgaacccgcgcgcacgcaaaaaccgctcccgcatacccctcctgaggaaacgcaggttccagctctaccgctccacaaatccccgggcccggaagaaccgcagcaggattcccctccttaggaagcggaggttccagttgtatcgcagtatgaattcccgggcccgaaaaaacaggagccagatcgttctgtttcaaaaaaggagattccatttcttctgttctatgagttgtagggcatgggtgagcccagaggaactcgaagagatacaggcttatgaccccgagcactgggtatgggctagagatcgagcccacctgtcctag

SEQ ID NO: 33553 - DNA, 777 bp, Artificial Sequence
  Description of Artificial Sequence: Synthetic coding sequence
atggagtggtgggacgaatcagaggaaagcctcgaagaggagccaaggaaagttctggccccagaaccagaagagatctgggtggcagaaatgctatgcgggttaaaaatgaagctgaaacgacggagagtcagcttggtgctgccagagcaccacgaagcatttaacagacttctagaggatccggtcatcaaaaggtttctcgcttgggacaaggatctgagagtgagtgacaaatatctactggctatggtaattgcctacttctcacgggcgggctttccaagctggcagtatcagcgcatccatttttttctcgccctctacttggccaatgacatggaagaagacgacgaggatagtaaacaaaacatattccattttctctaccgcaagaaccgctcacggatccccctcttgcgtaaaccctggttccaattggggcattcaatgaatcccagggcccgtaagaaccggtcgagaatccctctcctccgcaagaggaggttccaactgtacagaagcaccaatcctcgcgcccggaagaataggtctagaattccactcctgagaaagcgtaggtttcagctttataggagcatgaacagccgcgccaggaaaaatcggtcccagatcgtcctgttccaaaagagaaggtttcattttttctgctctatgtcctgcagggcatgggtgtcaccggaggagctggaagaaattcaggcgtacgatcccgagcattgggtctgggctcgagaccgcgcccatctcagctag

SEQ ID NO: 33554 - DNA, 1209 bp, Artificial Sequence
  Description of Artificial Sequence: Synthetic coding sequence
atggatcgaacagagaccaggttcagaaaacgcggccaaatcaccgggaagataaccacgtcccggcagcctcatccacagaatgagcaatccccccagcgatcaacctctggttatcctctgcaggaagtggtggatgatgaaatgctcggtccttctgcgcccggcgtcgacccttctcccccctgtcgtagcctcggttggaagaggaagagagaatggtccgacgagtcagaggaggaacctgagaaagagttagcccccgagcccgaggaaacctgggtcgtcgaaatgctgtgtggactgaaaatgaaactcaagcagcagcgtgtgtcaccaattcttcctgagcaccacaaggatttcaacagccagctggcacccggggtggacccatcacctcctcatagaagtttctgctggaagcgcaagatggaatggtgggatgagtccgaagaatccctggaagaagaacccaggaaagtcttggctccagaacccgaagaaatctgggtggctgagatgctttgcggcctcaagatgaagcttaagaggagacgggtgtcactcgtgcttcccgagcatcatgaggcttttaaccggctactggaggatccagtcatcaagcggtttctggcgtgggataaagatcttcgcgtctcagataagtacctgttagccatggttatcgcctatttctctagagctgggttcccctcatggcagtatcagcggattcacttttttttggccctgtatttggccaacgatatggaagaagatgatgaggatagcaagcagaacatcttccatttcttatacagaaagaatcgatcgagaatcccattgctcagaaaaccttggttccagctgggccatagcatgaacccgagggcgaggaagaacagatctcgtatccccctgctgcgaaagcggcggttccagctgtatcggtccactaacccccgtgcgagaaagaatcgcagtagaatcccgctgctgagaaagaggcggttccagttgtacagaagtatgaactctagggctaggaaaaataggagccagatagtgctgttccagaaaaggcggttccacttcttttgctcaatgagctgccgggcttgggtctcccccgaggaactagaggagatccaagcctacgacccagagcattgggtgtgggcccgtgaccgtgcccatctcagctag

SEQ ID NO: 33555 - DNA, 1650 bp, Artificial Sequence
  Description of Artificial Sequence: Synthetic coding sequence
atgacgtcacatcagccccagccacaagaggaacaaagtccccagaggtctacctccggttatccactgcaagaggttgttgatgatgaggtgtctggcccctctgcccctggtgtagacccctccccccctagacgtagcctgggctgcaaaaggaagagagagtgcttggacgagagtgatgacgagccagagaaagagctcgcccctgaaccggaggagacttgggtggccgaaaccctgtgtggcctaaagatgaaagctaaaagacgacgagtgtccctggtgctaccggagtactacgaggccttcaaccgactactagcgcccggcgttgatccatctcctccacgtcgcagcctgggctgtaagaggaaaagagagtgcttggatgagagcgacgacgagcccgaaaaggaactggcgcccgaaccagaagagacctgggtggcggaaactctttgcggactgaagatgaaagctaagcgacgacgcgtgtcgctcgtgctacccgaatattatgaagcgtttaacagactgttagcccccggcgttgacccatccccaccgagaagatcacttggctgcaaacgaaaacgtgagtgtttggatgaatccgacgatgagcctgagaaggagctcgccccagagcccgaggagacttgggttgccgagaccctgtgtggcctgaaaatgaaggccaagcgccgtcgcgtgagcctggttcttcctgaatattacgaagctttcaataggctgctggctccaggggtcgacccttcccctccacgtcgcagcctcggctgtaagcgcaaaagagaatgcctggatgagtcagatgatgagcccgagaaagagttagccccagagccggaggagacttgggtggccgagacactgtgtggcctcaagatgaaagccaagaggaggcgggtgtctttggtactgcccgaatattatgaagccttcaatcggctacttgcccccggagtggaccctagtccaccccggcggtcacttggctgcaagcggaagagagaatgcctggacgaatcagacgatgagcccgaaaaggagcttgctccagagccagaagaaacttgggtggcggagacgctctgtggcctcaagatgaaggcaaaacgacgtagagtctcactcgtcctccctgagtattatgaggcctttaataggctactggaagaccctgtcatcaagcgctttcttgcgtgggacaaggatcttcgggtcagtgacaaatacctcttggccatggttatcgcttacttcagccgagctggcctgccctcctggcagtatcagaggatccattttttcctggctctctacctggccaacgacatggaggaggatgatgaggccccgaaacagaaaatcttttattttctttacgggaagacgcacagccatataccgttaagaccgaaacactggttccaactgtgcaggcctatgaacccccgggcgcgaaaaaactgtagccagattgccttatttcagaaacgtaggtttcagtttttttgtagcatgagatgcagagcttgggtgtcacccgaagagctagaagagattcaggcatacgatcctgagcactgggtctgggctcgggatcgggcgcacttgtcctag

SEQ ID NO: 33556 - DNA, 519 bp, Artificial Sequence
  Description of Artificial Sequence: Synthetic coding sequence
atgaaagctaagagaaggcgtgtttcgctcgtactgccagaatactacgaagcgttcaatagactcttagaggaccctgtaataaagagatttctcgcctgggacaaggacctccgggtcagtgacaaataccttttggctatggtgatcgcctacttttcccgagctggactcccatcttggcaataccagcggatccacttcttcctcgcgctctacttggcaaatgatatggaagaggacgacgaggcccctaaacagaagattttctattttctatatggcaaaacccactctcatataccactgcgccctaaacactggttccagctatgccgaccgatgaaccccagagctcgaaaaaattgcagtcagattgcactgtttcaaaagaggcgtttccagttcttttgcagtatgcggtgtcgggcgtgggtttctcccgaggagctggaagagatccaggcctatgatcctgagcactgggtgtgggctagagacagggctcatttatcatag

SEQ ID NO: 33557 - DNA, 714 bp, Artificial Sequence
  Description of Artificial Sequence: Synthetic coding sequence
atggcatcggggcaggctagacctccgttcgaggaagaatctccacagccatccaccacagtccgatctccagaggtggtcgttgacgatgaagtgccaggccccagcgctccctggatagacccatctcctcaaccacagagcctggggctgaagagaaagtcggagtggagcgatgagtccgaagaggagcttgaggaagaactggaattggaaagagcacccgaacctgaagacacatgggttgtcgagaccctctgcggcctgaaaatgaaactgaagaggaaacgcgctagctccgtgctgcccgaacaccacgaggccttcaacaggctgttaggagacccggttgtccagaaattcctggcttgggacaaggatctaagggtgtcagataagtacctgctggctatggtaattgcatacttcagccgtgccggactgttctcatggcagtatcaacgaatccatttctttctggccctgtacttggcttcagacatggaggaagacaatcaggcaccgaagcaggacatctttagcttcctctatgggaagaattacagccaacgaccactcttccacaaactgcgctatcaacttttatgttccatgagatggaggacttgggtgtctcccgaagaaatggaggaaatccaggcctacgaccccgagcactgggtgtgggcacgggatcggaccctcatctcatag

SEQ ID NO: 33558 - DNA, 1209 bp, Artificial Sequence
  Description of Artificial Sequence: Synthetic coding sequence
atggacaggactgaaacacggtttcgcaagcgaggacagataaccggaaagataactacctctaggcaaccacatccacagaacgaacaaagcccacagaggagtaccagcggctatccactgcaagaagtggtggatgatgaaatgctgggcccatcagccccgggtgttgatccaagtccaccttgccggagcttagggtggaagcgcaaacgcgaatggagtgatgagtctgaagaagaacccgaaaaagagttggctcccgagccagaggagacttgggtggttgagatgctttgcggcctcaaaatgaaactgaaacaacaaagagtgtcaagcattctgcctgagcaccacaaagattttaattcccagcttgcacctggagtcgatccctctcctcctcataggtcattctgctggaagaggaaaatggaatggtgggatgagtctgaagagagccttgaggaggaaccacgcaaagtgctggctcccgagccagaggaaatctgggttgcagagatgctgtgcgggctcaagatgaaacttaagcggagaagggtttccctggtcctgcctgagcaccacgaggccttcaatcgtctgctggaggatcccgtaattaagcggttcctggcctgggacaaggatctcagggtgagtgacaagtatctgttagctatggtgattgcctacttcagtcgcgccggattccccagctggcagtatcagaggatccacttctttctggccctgtacctcgccaacgatatggaagaagacgacgaagatagcaagcagaatatctttcattttctttatcgtaagaatcgatcaagaataccactactgagaaagccgtggtttcagctcggacactccatgaaccccagggctaggaagaaccggagccgtatccctttgctccggaagcgaagatttcagctgtaccggagcacaaaccctagagctcgcaaaaaccggtctaggattcctctcttaagaaagaggagattccaactttaccgcagtatgaattcccgtgctaggaaaaaccgctcacagattgtcctctttcaaaaaaggcgatttcactttttctgctctatgagctgccgtgcttgggtgtccccagaagaacttgaggaaatccaggcctacgaccctgagcactgggtgtgggctcgcgacagggcccacctgtcttag

SEQ ID NO: 33559 - DNA, 777 bp, Artificial Sequence
  Description of Artificial Sequence: Synthetic coding sequence
atggagtggtgggacgagagcgaggagagtctggaagaagagccgcgcaaagtacttgcccctgaaccagaggaaatttgggtggctgagatgctgtgtggtttgaagatgaagctgaaacggcgcagagtgtcactggttctacctgagcaccacgaggcttttaatcgtttgttagaggaccccgtaatcaagcggttcctggcatgggataaagatctgcgtgtcagcgacaagtatctgctagctatggtaattgcgtacttctctcgagcagggttcccatcctggcaataccagaggatccacttttttctggctctgtatctggccaacgatatggaggaagatgacgaggattcaaaacagaatattttccactttctgtatcgtaaaaataggagcagaattccgcttttacgcaaaccctggttccaactcggacacagtatgaaccccagagccagaaaaaatagatcacggattccactcctgaggaaacgaagatttcaactgtataggagcacaaatccacgggctaggaagaatagatcgcggattcccctattacgcaaaaggcggttccagctgtaccgatcgatgaattcccgagctcgaaagaacaggtctcagattgtgctgttccagaaacgtcgattccactttttttgctcgatgtcgtgcagggcctgggtttcacctgaggaactggaagaaatccaggcctatgatcccgaacactgggtgtgggcgagagacagagcccacctctcctag

SEQ ID NO: 33560 - DNA, 1209 bp, Artificial Sequence
  Description of Artificial Sequence: Synthetic coding sequence
atggaccgcactgaaacccgtttcaggaaacgcggtcagataacaggaaaaatcacaacatccaggcagccacatccccagaacgaacaaagcccccagaggtcaacctctggataccccttgcaggaggtagttgacgatgaaatgctaggtccttcagcaccgggcgttgatccttcccctccttgtaggtctctgggttggaagcgcaaacgcgaatggtctgacgaatcggaggaggagcccgagaaagaactggcacccgagccagaggagacctgggttgtggaaatgctgtgcggcttaaagatgaagctcaaacagcagcgcgtgtcaagcatcctaccagagcaccataaggactttaactcacagctggcgccgggcgtggatccttcgcctccacatcgatccttttgttggaagcgaaagatggagtggtgggatgaaagcgaagagtctttagaggaagagccacggaaggttctcgccccggagccggaggaaatctgggtggcagaaatgctctgtgggcttaaaatgaagctgaagcggcgtcgggtgagcttagttttaccagagcatcacgaagctttcaacaggctgctggaagaccctgtgattaaaagattcctggcctgggacaaggacctccgcgtgtccgacaagtatctgctggcaatggtgatagcctatttctccagagcaggattcccaagctggcagtatcaacgaatccatttttttctggccctgtacctggccaatgatatggaggaagatgatgaggactcaaaacagaacatcttccatttcttgtacaggaagaaccgctctagaattcctctcctgagaaagccctggttccagctcgggcattccatgaaccccagggctcggaaaaacagaagtcgcatccccctcttacggaagcgaaggttccagctgtaccgctccaccaatccgagagcccgcaaaaacaggtcacgcatcccactgctgaggaaacggaggtttcagctgtacaggtctatgaatagtcgggcccggaagaaccgctctcaaatcgtgctcttccagaagaggcgcttccatttcttttgttcgatgagctgtcgagcatgggtgtcccctgaggaactcgaggagatacaggcctacgaccctgagcattgggtgtgggctcgagatcgcgcacatctctcttag

SEQ ID NO: 33561 - DNA, 1545 bp, Artificial Sequence
  Description of Artificial Sequence: Synthetic coding sequence
atgagtgagattctgtgccagtggcttaacaaggaactgaaagtaagtaggacagtcagtccaaaatcattcgcgaaggcattttccagcggctatcttctgggagaagtgcttcacaaattcgagctgcaagacgacttctcggagttcctggatagcagagtttcctcagcaaaacttaacaacttctctcggctcgagccaactctgaacctcctgggagtgcagtttgatcagaacgtggcccacggcattataaccgaaaagcccggcgtggccaccaagctcctgtatcaactgtacattgcgctgcagaagaagaagaaaagcggcttgaccggggtcgaaatgcagaccatgcaaaggctgaccaaccttaggctgcagaacatgaagagcgacaccttccaagagagactcagacacatgatccctcggcagacagatttcaacctgatgcgcattacataccgctttcaggaaaaatacaagcacgttaaggaggatctcgcacatttgcactttgaaaagttagaacgctttcagaagctgaaggaagaacaaaggtgtttcgacattgaaaaacagtacttgaatcgccggagacagaacgaaatcatggccaagatccaggcagctattatccagattcctaagccggcttctaaccgcacacttaaggccctagaggctcaaaaaatgatgaagaaaaaaaaagaagccgaggacgtcgccgacgaaattaaaaagttcgaggccctgattaagaaggatctccaggccaaagaatccgctagcaaaactagcctggacacagccggccagactactaccgaccttctgaacacttatagtgacgacgaatatattaaaaagatccagaaacgtctcgaggaggatgccttcgcccgggagcagagggaaaaaaggagacgtaagcttcttatggatcaattgattgcccacgaagctcaggaagaagcctaccgagaagagcagctcattaatcgactgatgagacagtctcagcaggagaggaggatagccgtgcagctgatgcacgtccggcatgagaaggaggtcctgtggcaaaatagaatcttccgggagaaacagcacgaagaacggaggctgaaggattttcaggatgcattagaccgagaagctgctttggcgaaacaagccaagattgatttcgaagaacagtttttaaaagaaaaaagatttcatgatcagatcgccgtggagcgagcccaggcaaggtacgagaagcactattccgtatgtgcggaaattttagatcagattgtggatttgagtacaaaggtagcagattatcggatgctcacaaataacttgatcccatacaagctgatgcacgattggaaagagctgtttttcaatgccaaacctatttacgagcaggcatctgtgaaaacgctcccggcaaatcctagcagagagcaacttactgagctcgagaaaagagatctcttggacacaaacgattacgaggagtacaaagtgcctaccgatatgaagtag

SEQ ID NO: 33562 - DNA, 1860 bp, Artificial Sequence
  Description of Artificial Sequence: Synthetic coding sequence
atgccatcgcaaatcggagatcgtaaatggctgcatggactgcaggctgctcttcagaacttccttaagggttatccagccattgtccgtcagctgcatagcgctggccgcggaaaatctgatacatcacagaagaaacccaaggaactgctagagtccctgttgcaggccgacatcgtgaagtttgcacatttccttctggacgttatgaacgtattgtctattctcagttgtgtcaataaaaaccgaaactcaagcatagccgacatcttcgctaccctcgagtccatgttagagatgctccagatgtaccagacccgcttgggtcctaaggaacgaatggtggacagtgccacgcacttccacggcaactgccttagagggaaggagaatatttcagccgtgaggaatattgttcttacacacctcatcaaaagactgcagggctgcttccgggatgcctcccaaaacgtggtccgggcaacagtcatcgggtccttcaaactgtggcctacgaagatcaaccaggaatttggtgagaaggaggtgtctatattaacagctcattacgaaccagtgctagaggccgccaacgtaaagttaagcgaggtcgatacggaatggagtatgctgaaactggaaatctatgcgcggtttcagaacattaggaagctgacctgggactttgtgaatagcatttatcttcataaatatcctaacatattaaccttggtcgatctagttctaacactgcctgcatcttctgccgaggctgagcacggttttagtcagatgaaatggactaaaagccacatgcatgctaaaataaaagctgaaagcattataggtaataaggcattcaccgacattctcattgatttggtcacgctgaatcttgggacgaacaatttcccgagtaattggatgcacctgactcagcctgagctccaggagctgacatcattgttgacagttaacagcgagtttgttgactggagaaagtttctgctcgtaacttctatgccctggccgatccccctcgaggaagagctgttggaaacactgcaaaagtttaaggccgttgacaaagagcagcttggcaccatcacttttgaacagtatatgcaagcaggtctctggtttacaggtgacgaggacattaagatccccgagaaccccctcgagccactcccgttcaatagacaggagcatctgatcgagttcttcttcaggttatttgcagattacgagaaggatcctccccagttggactatacccagatgctcctatacttcgcctgtcatccagatactgtggagggagtttatcgtgcactgagcgtggccgtgggaacccacgtgtttcaacaggtaaaggcatccattccatccgccgaaaagacctcctcaaccgatgccggccccgccgaggaattccctgagccggaagagaacgcagctcgggaggaacgcaaactcaaggatgacacagaaaaacgggagcagaaggacgaggagatacccgagaacgccaataatgaaaaaatgagcatggaaacgcttctaaaggtgtttaaaggcggttccgaggctcaggatagcaacaggttcgccagccaccttaaaatagagaacatatatgcagagggcttcatcaagacatttcaggacttgggggccaaaaatctggaacctatcgaggtggccgttttgctcaagcaccctttcattcaggatctgattagcaattatagcgattacaagttcccagatattaagattatactacagcggtctgaacacgtgcagggctctgacggcgagcgctccccgtcgaggcataccgaggagaagaagtag

SEQ ID NO: 33563 - DNA, 5469 bp, Artificial Sequence
  Description of Artificial Sequence: Synthetic coding sequence
atgtccgagattctgtgtcagtggctcaataaagagctgaaggtctcgcggacagtctccccaaaaagcttcgctaaggctttctcctctggttacctgctcggcgaagtgttgcacaaattcgagctgcaggacgattttagtgagttcctggattcacgagtctcaagtgccaaactgaacaactttagtcgcctcgagcctacgctcaacttattaggtgtccagttcgatcaaaatgttgctcatgggatcattaccgagaagcccggtgtcgctaccaagttgctgtaccagttgtacatcgccctgcaaaagaaaaagaaatctggacttaccggtgttgagatgcagacaatgcagaggctgactaatctgagactacagaacatgaaatcagacacatttcaagagcgactgcggcacatgataccaaggcaaaccgacttcaaccttatgagaatcacctacaggttccaagaaaagtacaagcacgttaaagaagatcttgctcacctgcactttgaaaaattagagcgattccagaaactgaaagaagaacaacgctgtttcgatattgagaagcagtacttgaatcggagacggcaaaacgagataatggcgaagatccaggccgcaataattcaaattcctaaacctgcctccaataggaccctgaaagctctggaggcacagaaaatgatgaagaaaaaaaaagaggctgaagatgtcgcagatgaaatcaagaaattcgaagccctaataaaaaaagacttacaggcaaaagagtcggcatctaaaactagccttgacaccgccggccagactactacggatctcctgaacacgtatagcgacgacgagtacatcaagaaaatccagaagcgcctggaggaagatgcattcgccagagagcagcgagagaagcggaggcgaaagctgttaatggaccaattgattgcccacgaagcccaggaggaagcctaccgggaagaacaactgatcaatcgcctgatgcgtcagtctcagcaggagcgtcgcatagccgtacaactgatgcatgtgagacatgagaaagaggtgctgtggcagaatagaatttttcgagagaagcagcatgaagaacggagactcaaagacttccaggatgctttggacagagaggccgcgctggccaaacaagcaaaaattgacttcgaagagcagtttcttaaggagaaacgcttccacgatcagatagctgtcgagagagcccaggcacggtacgaaaaacactactctgtgtgcgccgagattctggatcagatcgtcgacctgagcactaaagtggccgactacaggatgttgaccaacaacctgattccatataaattaatgcatgactggaaggaactattcttcaacgcgaagcccatctatgagcaagcaagcgtcaagacgctccctgcaaatcccagtagagaacagttaacagaactggagaaacgcgatctactagatacaaacgattacgaggagtataagaatatggtcggcgaatgggcgctgcccgaggagatggtggataacctacccccgtcaaataattgtattctcgggcacatcctccacagactggccgagaaatctctgccacccagggcagagtcaacgacgccggagctaccttcctttgctgtaaagggctgccttctgggcaagaccctgtcaggcaagacaacaatactcagatccctccaaaaggacttccctattcagatcttatcgatcgacacactggtccaggaagcaatccaggcgtttcacgacaacgaaaaagtgagcgaggtcttgcccatccaaaaaaatgatgaggaggacgccctgccagtgctgcaggaggagattaaggaaagtcaagacccccagcatgtctttagcgctggcccagtctcagacgaagtgttgcctgagacagagggagagacgatgctctcagccaatgcagataagactcctaaagcagaagaggtgaaaagctcggattcctttctgaagctgacgacgagggcgcagttgggcgccaaaagtgagcagttactaaagaaaggaaaatctatcccagatgtcctgctcgtggatattatagtcaacgcgattaatgaaattccagtgaaccaagattgcatcctggacgggtttcctatgacactcaaccaggctcagctgctggaagaggccctgacgggctgtaatagaaacttgaccgaggtggagcgcaagaaggcccaaaaatccacactggcaatcgaccccgcaacgtctaaggagatcccactgccaagccctgcctttgatttcgtgattcttctggacgtctcagatacgagttctatgtctcggatgaacgatatcattgccgaggaattaagttataagactgctcacgaggacattagtcaacgtgtagctgctgagaaccaagataaggacggagatcagaacctgcgcgatcaaattcagcatcggatcatcggatttctcgataactggcccctcctcgaacaatggtttagcgaaccggaaaatatactgatcaagatcaacgccgagatagataaagagagcctttgcgagaaggtgaaggagatcctgaccacagagattgcaaagaagaagaacaaggtggagaagaagctggaggagaaggaggccgaaaaaaaggcggctgcttctctggctgagctccctttacctactccgccacctgctcctcctcccgagccagagaaagagaaagagattcatcagtcacatgtagcctccaagacgcccactgcaaagggaaagccacagagcgaagccccccatggcaagcaggagagcctgcaggagggcaaagggaaaaaaggggagaccgctctaaagcgaaaggggagccccaaagggaaaagctctggcggaaaggtccccgtcaagaaatctccggctgattccacagacaccagccctgttgccatcgttccacagcctcctaaacccggtagcgaggagtgggtatatgtgaatgaaccagttccagaggaaatgcctctgtttctcgtcccatactgggaactgattgagaatagttatatcaacaccatcaagactgttctgcgccacttgagggaggaccaacacacggtgctagcctacctgtacgagatcagaactagcttccaggagttccttaagaggcctgaccacaaacaggacttcgtcgcacagtggcaggccgattttaactctctgccagacgatctctgggatgacgaagagaccaaagcagagttgcatcagcgtgttaacgacctgcgagatcgcctttgggacatttgtgacgcgcggaaggaagaagctgaacaagaaaggttggatataattaacgaatcctggctccaggatacgctaggtatgacaatgaatcacttcttcagcctgatgcaagctgagctgaacagattccaggatacaaagaggctgcttcaggattattattgggggatggaatcaaagatccctgtggaggacaataaaaggtttaccaggattccattagtgcagctggactccaaagataacagtgagtcacagctcagaattccgttagtgcccaggatctcaatttccttagagaccgtaacccctaagcctaagacaaaatccgtcctgaagggtaaaatggacaattccctcgaaaatgtggaatccaatttcgaggccgacgagaaactggtgatggacacctggcagcaggcttcacttgcagtttctcacatggtcgccgctgaaatccaccaacgactcatggaagaagaaaaggagaaccaaccagccgaccccaaagagaaatccccccaaatgggtgccaacaaaaaagtcaagaaggagcctccgaaaaagaagcaagaggacaagaagcctaagggcaaatcaccccccatggccgaagcaactccagttattgtaactacagaagagatagccgaaatcaaacggaaaaacgagctgcgagtgaagatcaaggaagaacatctagcagcgctgcagtttgaagagatcgcaacccagttccgtttggaactcatcaaaaccaaggcccttgcattgctagaggacttagtgaccaaagtggtggatgtttacaaactgatggagaagtggttgggagaaaggtacctgaacgagatggcgtctactgaaaagctcactgacgtggcccgatatcacatagagacaagcaccaaaatccagaatgagctgtacttatctcaagaggacttttttattaacggcaacattaaggtgtttcctgatcctccccccagcatacggcctcccccggtcgaaaaggaggaagacggtaccctgaccattgagcagctggactctttacgagatcagttcctcgatatggcccctaaaggaattattggtaacaaagccttcacagacatccttatcgacttggttactctgaatcttggtaccaacaattttcctagcaattggatgcatcttacacaacccgaattacaagaacttacatcgctcctcacagtcaattctgagtttgttgattggcgtaaattccttctggtgacgtccatgccttggccaattccactcgaggaagagcttctcgagaccctccagaagttcaaagccgtggataaggagcaactgggcaccatcacgtttgaacagtatatgcaggcgggcctttggtttactggggatgaagacattaaaatcccggagaaccctttggagcccttgcctttcaacagacaagagcacctcatagaattcttcttcaggcttttcgcagattacgaaaaagatccgccccagctggactatacccagatgctcctgtatttcgcctgccaccctgacacagttgaaggcgtctatcgcgcactttccgtcgccgtgggtacacatgtgttccaacaggtcaaggccagtattccctcagctgaaaagacaagcagtacagacgccggccctgcagaggagtttcctgagccagaggaaaacgcggcacgggaggaaaggaaacttaaagacgataccgaaaagcgggaacagaaggacgaggagattcccgaaaacgccaataacgaaaagatgagcatggagacgttactgaaggtgttcaagggcggatcagaagcacaggactctaacagattcgctagccatctcaagattgagaacatttacgctgaaggctttattaaaacctttcaggacctgggcgccaaaaatctggagccaatcgaagtcgctgtattactcaaacacccttttatccaggatctgatctcgaactacagcgactataagtttcccgacatcaagatcatcctgcagcggagtgagcatgttcagggctcggacggggagagaagcccttctcggcataccgaagagaagaaatag

SEQ ID NO: 33564 - DNA, 1410 bp, Artificial Sequence
  Description of Artificial Sequence: Synthetic coding sequence
atggacaatcggaatacccaaatgtacacagaagaggagaagacagttaacccctttttaccgtcaactccaggccccaaaaaagctaagggggggggtgaagctgtcgagacacaccccgcccccggtccactcccacctcccgaggtgagggacattggcgagaggcgcgagcccgatcgcgcccagcagcagccacaaaaacccgccgtcgccgcaggcacccagagtctaggtaattttcggcaggggttcatgaagtgcctcctggaggtggaaaaaatggaagcctcccacaggcgagcaagcaaggccaggagccagactgcgcagaaaagcccacggactctgacacccgtgcctacttccgccccctctctgccacagaccccagcaagtgtcccggcaagtggcccaagctgggctcgtctgcctgctccaggccccgaacctgcgccgatgggggccccggtgcctacaagcatgccgtgccctgtcttgctgggcccggcgctggatcttggatggcggagaatggagctactgcaccagtcctctgaacggactctgtcttacgctaaggccagacaggaacctgaggagcaatccctgcaaaaactctaccagaaccgggagaaatcagaggaacaactaaccctgaaacaggaagaggctttccgcagttattttgagatctttaatgggcccggggaggtggatgctcagtcgctgaagaacattctgctgttgatgggattttcagtcactctggcacaagtggaggatgcactgatgtccgctgacgtcaacggtgacggacgcgttgacttcaaggacttcttagccgtcatgaccgatacaagacggttcttctgtagtgtagagcaaaatgcactttcagatatggccccccacaatcctcatacgttattgtttgagattctgagccttttagtcgagatgctggccctccctgaagccgtattggaggaaattactaattattaccagaagaagctcaaagaggggacttgtaaggcccaggagatggaggccgccgtcggccgccttcgcctccaaaagctaccctataatccacagcaggaggaatcttctgaggtgcctgagaggaaggtgctgtcaatcttgagccgcctgaagcagcagaattatgcgccgaacctacagagcccatacgcccaggttccgtgcatccttttgtgtccacagctggacaaaaagatggttcgccgccaacctagcaatcattacgccctggatcagtgtactcccccgggcttagacccggatatccggtccccattttttcagtccggatctcaggggaaccgggagcacaactccgatagccggaagtggctctcatcagtgcccgcacgaactcattag

SEQ ID NO: 33565 - DNA, 603 bp, Artificial Sequence
  Description of Artificial Sequence: Synthetic coding sequence
atggataatagaaacacccagatgtacacggaaggcaggacaaaagctccgggaactcagccttcacctgggctacgtataaccattaaaagagctggcgtagagccaatcattcctggagtcagcaaggttatgtttcctgatgcgtcagaggtgggatccaagaagcatctctcctcagcctccagggggcccgaaaaaggcccacggcttcgcgacgcctttgagaaggggccctccgagctgcgtatccaagagcagggacccccagctagaccagggaagaagcaacctagctgggtgccccaggaaggctcacaggaacttcaagcaggccaggatcagtcagagctgggactgctgccatcatgggtgcctgaagtccctgagggcttgcagcagctagggtccgggaaagagataaaggggcagcagggtagacagcgaaaccgtggcatcggcgaggatcagccgcccgaaagctgtcaggctggccacggcgggagtagactgttgattcctgcgcttctggaagccgagggcggtcgctcacccgaagtaaagacctccctggcaaacatggtcaagccatgcctatactag

SEQ ID NO: 33566 - DNA, 1341 bp, Artificial Sequence
  Description of Artificial Sequence: Synthetic coding sequence
atggctcaacccggtgctgtagaacacgcctgtcacccatccactttgggtgggcaaggcggcggatctctagaggaagttcgcgacataggcgagcggagagagcctgacagagcgcaacagcagccgcagaagccggcggtcgccgccgggacccagtccctgggaaacttccggcagggctttatgaaatgtctccttgaggtagagaagatggaggcctctcacaggcgtgccagcaaggctaggagtcaaaccgcccagaagagcccgcgcactctaacgccagttccgaccagcgctcccagcctgcctcaaaccccagcttcagtacctgccagcggcccatcatgggcaaggctgccagcacccggcccagagcctgccccaatgggtgcacctgtgccaacaagtatgccatgccccgtgcttcttgggcctgctctggacctgggatggagaagaatggagctcctccaccagtcatccgagcggacactgagctatgcaaaggcccgtcaggagcctgaagagcagagcctccagaagctgtatcagaatcgggagaagtctgaggagcagctgactctgaaacaggaagaggcttttagatcatatttcgaaatcttcaacggcccaggagaagtagacgcgcagagcttaaagaatatcctactgctcatgggttttagtgtgaccctcgctcaggtggaagacgctctgatgagcgctgacgtcaatggcgatggtagagtcgacttcaaggacttcctggccgtgatgaccgatactagaaggtttttttgctcagtggaacagaacgcgttgtcagatatggctccgcataacccacacacacttctgttcgagattctctcccttctagtcgagatgttggccttgcctgaagctgtactagaggaaatcaccaattactatcaaaaaaagctgaaagagggaacatgcaaagcccaggaaatggaagccgcagttggcagactccgcctccagaaactgccgtataatccccagcaggaagaatccagtgaggtccctgagagaaaagtgctatccatcctaagtcgtctgaagcagcaaaactatgctcccaatcttcaaagcccttacgctcaggttccatgcatattactctgcccacagctggataagaaaatggtgcgcagacaaccttccaatcactacgccctcgaccaatgtacacccccaggtcttgatcctgatattcggtcccctttctttcagtccgggtcccaaggcaaccgtgagcacaactcggacagtaggaagtggctctcttctgtaccagcacgcacacactag

SEQ ID NO: 33567 - DNA, 810 bp, Artificial Sequence
  Description of Artificial Sequence: Synthetic coding sequence
atgaagcgctctctgaatgagaactctgcccgatcaaccgcgggatgcctgcctgttccactgttcaaccagaaaaaaagaaataggcaaccgcttacctccaatcccctgaaagatgatagtggaattagtaccccatccgacaattacgatttccctcctttgccaaccgattgggcttgggaagctgtaaatcccgaactggcccccgttatgaagactgtagatacaggacagattcctcattcggtgtcaagaccattgcggtcccaagacagtgtttttaattccatacagagtaatactgggaggtcccaaggcgggtggagctaccgtgatggtaacaagaacaccagccttaagacctggaacaaaaatgacttcaagccacagtgtaaacgtactaacctagttgctaatgatggcaagaactcgtgtcctgtgtcctccggcgcacagcaacagaagcagctgcgaatcccggagcctcccaacctgagtaggaataaagagacagagctgcttcgccagacccacagctctaaaatcagtggctgcaccatgcgcggcctagataagaactctgccctacagactctcaaacccaacttccagcaaaaccagtataaaaaacagatgctcgacgacattccggaagacaacacgctcaaagagacctctttgtatcagctgcagtttaaagaaaaagccagcagtctgcgcatcataagtgctgtgatcgagagtatgaagtactggcgcgagcacgctcagaagacagtactccttttcgaggtgctgggatcttag

SEQ ID NO: 33568 - DNA, 963 bp, Artificial Sequence
  Description of Artificial Sequence: Synthetic coding sequence
atgaagcgttccctaaatgagaactctgccagaagcaccgccgactgggcatgggaggcagtgaaccctgagcttgccccagtcatgaaaaccgttgatactggccaaataccccacagcgtttccaggcctctccgaagccaagacagcgtattcaactccattcaatcaaacactggtcgatcccagggagggtggtcctaccgggacggaaataaaaacactagcttgaaaacctggaataagaacgacttcaaacctcagtgtaaacgcacgaatctggtcgcaaatgatggtaagaactcgtgccccgttagtagcggagctcagcaacagaagcaactcaggatcccagaacctccgaatctgtctcggaataaagagacagagcttttacgtcagacacattcgtcaaagatatccgggtgtacaatgaggggtctagacaagaacagtgcccttcagactttgaagcctaactttcagcagaatcagtataaaaaacagatgctggatgacattccagaggacaatacgctgaaagaaacgtccctctaccagctgcagttcaaggaaaaggctagctccttacgtatcatctcagcagtgattgagtccatgaagtactggagagaacacgctcagaaaacggtactcctgttcgaagttctcgcagtgctggattcggcagttactcccgggccgtattattctaagacctttttgatgagagacggaaaaaatacgttgccctgcgttttttacgaaatcgatcgagaactcccaagacttatacgcggtcgagtgcaccgctgcgtgggtaactacgatcagaaaaagaacatatttcagtgtgtgtctgtccgtcctgccagcgtttccgagcagaaaaccttccaagctttcgtcaaaatcgccgatgtggagatgcagtattatatcaatgtcatgaatgaaacttag

SEQ ID NO: 33569 - DNA, 1092 bp, Artificial Sequence
  Description of Artificial Sequence: Synthetic coding sequence
atgaagcggtctcttaacgagaactctgccagaagtacggcaggatgtttgcccgttcccttatttaatcagaagaagagaaaccggcaaccattgaccagcaaccccctcaaagatgactctggaatctccacaccatctgataattatgactttccccctttacctactgactgggcgtgggaggctgtgaatccagagcttgctcctgtcatgaagacggtagacacaggacagattccccactcagtgtcccggccactgaggtctcaggattctgtcttcaattccattcagagcaatactggtcgctcccaaggcggctggtcctatcgggacggaaacaaaaacacatctttgaagacttggaataaaaatgatttcaaaccccagtgtaagaggacaaatctggtcgcaaacgacgggaagaactcctgccctgtctcatcaggagcccagcagcagaaacagctgcgtattcctgaaccgccaaacctgtccagaaataaggagaccgaattactcaggcaaacccatagttctaagatctcgggatgtaccatgagaggtcttgataagaacagcgctctgcagacgctaaagcctaattttcagcagaaccagtataagaagcagatgctcgacgacattccggaggataacacactcaaggaaacatccctctaccaactgcagtttaaagaaaaagccagtagcttaagaataattagtgccgtgatcgaatccatgaagtattggcgggaacacgcgcagaagacggtcttactgttcgaagtcctggctgtgctcgacagcgcagtgacacctgggccatactatagtaaaacgttcctgatgagagacgggaagaatactctgccttgtgttttctatgagatagaccgcgagttgccccggctgatcagaggccgtgtgcacaggtgcgtcgggaactacgaccagaagaagaacatctttcagtgcgtctctgtcagaccagcaagcgtctcagagcagaagacattccaagcatttgtcaagattgcagacgtagagatgcagtactacatcaacgtgatgaatgagacatag

SEQ ID NO: 33570 - DNA, 1044 bp, Artificial Sequence
  Description of Artificial Sequence: Synthetic coding sequence
atgaaaaggagcctgaatgaaaattccgcccggtccaccgccggctgtctgcctgtgcccctgttcaatcagaagaagcggaaccggcagccactgacatctaaccctctgaaggacgactcggattgggcttgggaggcagtcaaccccgaacttgcccctgttatgaaaaccgtggataccgggcagatcccccactccgtgtcaagaccactgcggagccaggactctgtgttcaattcaatacaaagcaacactgggaggagccaaggaggatggagctacagagatgggaacaaaaatacttcactgaagacctggaacaaaaacgacttcaagccccagtgtaagaggactaacctggtcgccaatgacggtaagaattcatgtcccgtctcatccggagctcaacagcaaaaacagctgcggattccagagcctcctaatctctcccggaacaaagagaccgagctccttaggcaaactcacagttccaaaataagtggttgcacgatgagaggcctggacaaaaattccgctctccagacactgaagccaaatttccagcagaaccagtataaaaagcagatgctcgatgacatcccggaggataacactcttaaagaaacctctctataccagctgcagttcaaagagaaggccagttcgctcagaataatctctgcggtaatcgagagcatgaagtattggcgggagcacgcacagaaaaccgtgctgctgttcgaagttctggcggtcctagatagtgccgtcacacccggcccttattattcaaaaacctttctcatgcgggatgggaagaatacactgccctgcgtcttttatgaaatcgatagagagctgccccggcttatccggggccgggttcaccgctgtgtaggtaactacgatcaaaagaagaatattttccaatgcgtgtctgttcgccccgcctctgtgtcagagcagaaaaccttccaagcctttgtgaagatagccgatgtagaaatgcagtattacatcaacgttatgaatgagacgtag

SEQ ID NO: 33571 - DNA, 1092 bp, Artificial Sequence
  Description of Artificial Sequence: Synthetic coding sequence
atgaaacggtctttaaatgagaacagcgccagatccaccgcaggttgcctccccgtccctctcttcaatcaaaaaaaaagaaaccgtcaaccgttaacaagcaacccgttgaaggacgactcaggcatctcaaccccgtctgacaattacgatttccctcctcttccgactgactgggcttgggaagctgtcaaccctgagctggcccccgtgatgaaaaccgtggataccggccaaattccccatagcgtgagccggcccctgcgctctcaggactccgtcttcaactccatccaatctaatacagggaggtcacaagggggctggtcatatcgggacgggaacaaaaacacttccctaaaaacctggaacaaaaatgatttcaagccacaatgcaagcggacaaatcttgttgctaatgacggaaaaaacagctgcccggtaagcagcggagcccaacagcaaaaacagctgaggattccagagccaccaaatttgtctagaaacaaagaaactgagcttctgagacagacacattcgagcaagatctccgggtgtacaatgagagggctggacaagaattccgctttgcagacactaaaacctaatttccagcagaaccagtataagaagcagatgcttgacgatatccccgaggataatacactgaaagagaccagtctttaccaattgcagttcaaagagaaggcgtcaagcctgcgcattatatcggctgtaatcgaatctatgaagtattggagagagcacgcccagaagacagtcctcttgtttgaggtgttagctgtgctggattctgcagttacacctggcccatattacagcaagacatttctgatgcgcgatggaaagaacaccttaccctgcgttttttatgaaattgaccgcgagctcccgaggcttatcagaggccgcgttcatagatgtgtcgggaactacgatcaaaaaaaaaacatctttcagtgtgtgtcggttcggcccgcatcggtttctgaacagaagacgtttcaagccttcgtcaaaatagccgacgtggaaatgcagtactatatcaatgtgatgaacgagacatag

SEQ ID NO: 33572 - DNA, 1092 bp, Artificial Sequence
  Description of Artificial Sequence: Synthetic coding sequence
atgaaacggtctcttaacgagaacagcgccaggtccaccgctgggtgcctgccggtccctctgtttaatcagaagaagcgaaacagacagccactcacttccaacccccttaaggacgactctggcattagcaccccatctgataactacgacttcccccctctcccgactgactgggcctgggaagctgtgaacccggagttggcccccgtcatgaagaccgtggataccggacagattccccattccgtctctcgtcctcttcgttcacaagattctgtattcaactctattcagtctaataccggacgcagccaagggggttggtcttaccgagacggtaacaaaaacacaagtctcaaaacatggaataaaaatgattttaagccccagtgcaagagaaccaatctcgtagctaacgacggaaagaattcgtgcccagtttcaagtggggcccagcagcagaaacagttgcgcattcctgaaccgcctaatctctcaaggaacaaagagaccgagctgctgcgccagactcacagcagcaagatttctgggtgtaccatgaggggacttgataaaaatagtgctctccagacactgaagcccaactttcaacagaaccagtacaaaaaacagatgctggacgacatcccagaggacaacacgttaaaggagacatctctgtaccagctccagttcaaagaaaaggcttccagtctgaggattattagcgcagtaatagagagcatgaaatactggcgagaacatgcccaaaaaaccgttttactgttcgaggtgcttgcagtcttggattcagcagtcactcctggtccatattactcaaagactttcttaatgcgggacggaaagaacaccctcccttgcgtcttttacgagatagatcgagaactgcccaggctcataaggggccgagtgcatcgttgcgtgggcaattacgaccagaagaagaatatcttccaatgcgtgtctgtgcgccccgcaagcgtttctgagcaaaagacattccaagcattcgttaagatagccgacgttgaaatgcagtactacattaacgtgatgaacgagacctag

SEQ ID NO: 33573 - DNA, 1275 bp, Artificial Sequence
  Description of Artificial Sequence: Synthetic coding sequence
atggggtcttccagtctatctgaagattataggcagtgccttgagcgggaactgaggcgtggccgcgctggcgtctgcggcgacccatctctgagagctgttctctggcaaatcttggttgaggactttgacctgcacggtgccctgcaggacgacgccctggcattactcaccgacgggctttgggggcgcgcagatctggcaccagcgctaagaggcctggcgagagccttcgaacttctcgagctggccgctgtgcacctgtatttactaccatggaggaaggagttcactaccatcaaaactttctccggggggtatgttcacgtgctgaagggagtgttgtccgacgatctgctgctaaagtcatttcaaaaaatggggtatgtgcgacgcgatagccatcgtctcatggtaaccgctttgcccccggcttgtcagctcgtgcaggtggcccttggttgcttcgcactcagactcgagtgcgagatacttggggaagtactggcacagctgggaacgtccgttctacccgcagaagaactgctgcaggctcgcagagcctctggggacgtcgcctcatgtgtggcgtggttacagcagagactggcccaggatgaagagccaccccctctgcctcctcgtggctcccctgcagcgtaccgcgccccgttggacctgtaccgtgatctgcaggaggatgagggctctgaggatgcgagcctatacggggaaccatcgcccgggcccgacagtcccccggcagaactcgcttatagaccgcccctctgggagcaatcagctaagctgtggggcacagggggacgcgcatgggaacctccagcggaagagctgccccaagcctcttcccctccttacggggccctggaggagggcctcgagcccgaaccctccgctttctccttcctgagcctgcgaagagagctgtcaaggcctggagacctggcgacccctgaatcgagcgcagcagcctctccacggaggatacgtgctgagggagtgcccgcatctgcctatcggtccgtgagtgaaccacccggttatcaggcacactcctgtctttcccccggcgctttacccactctgtgctgtgacacatgtcgacagctgcatgcggctcactgcgccgcgctgcctgcgtgtcggccaggccactcccttcgcgtgttactcggtgatgcccagcgacgcttgtggttgcaacgcgcacagatggacaccctcttatataatagtccgggcgctagaccgtag

SEQ ID NO: 33574 - DNA, 459 bp, Artificial Sequence
  Description of Artificial Sequence: Synthetic coding sequence
atgggatcctcctcactgagcgaggactaccggcagtgcctcgagcgggagctgcgtcgcggaagagctggtgtctgcggcgaccctagtttgagggccgttctgtggcagattttggtggaggactttgatcttcatggtgctctgcaagacgacgccttggctctgctgacggacggactgtgggggagagctgacctggcccccgccctgagggggctggcccgggctttcgaattgttagagctggctgccgtccatctgtatctgctcccatggagaaaagagtttactaccatcaaaactttcagtggtggttacgtacacgtgctgaaaggggtgttgtctgacgacctcctcctcaagtcatttcaaaagatgggatatgtaagacgcgacagccacaggttaatgctgtgctggagccaaagcgcaggcctctgcagggtccatggctag

SEQ ID NO: 33575 - DNA, 552 bp, Artificial Sequence
  Description of Artificial Sequence: Synthetic coding sequence
atgaaaaaggtcaagaaaaagagaagtgaggctcgacggcatcgcgactccacttcccagcacgcttcttccaactccaccagccaacagccatcacctgagtccaccccccagcaaccctccccagagtccaccccccagcattccagcctggagaccacgtcgaggcagcctgcattccaggctctccctgcacctgagatcaggagaagttcatgctgcttgcttagccccgacgccaatgtgaaggccgctccacagtcacggaaggctggacctttaattagagctgggccgcatagctgctcctgcgccacatgcccatgcagttctgcctgctggcggcggcttggtctgtgtcacagccggatcttcgatgttttgttaccacgtgattggcagatggcccctggccgcggccttcctaatttgcttactttctatcggaagtcctccaggaagcccagctcccacaggaatgcctgcccaccctcaccacgcaattgtggatgcggatcaggcggctccagaagctgtctgttgcatcactag

SEQ ID NO: 33576 - DNA, 579 bp, Artificial Sequence
  Description of Artificial Sequence: Synthetic coding sequence
atgaagaaggttaaaaaaaaaaggtcagaggcccgaagacacagggattccacctcacagcatgcgagctcaaactctacctcccagcaaccttcacccgaatccactccccagcagccatctccggaatccacacctcagcaaccgagtccggaatctacgcctcaacattcgagtctcgaaacaacttcacggcaacctgcattccaggctctccccgcacccgagattcgacggtcatcttgctgtctgctgagtccagacgcgaacgtgaaggccgcgccccagagccggaaagctgggccactgattcgcgctggaccccactcctgttcctgtgccacttgtccttgttcttccgcgtgctggcgccggttaggattatgccactcacggatctttgacgtacttttgccacgggactggcaaatggctcccgggcgaggactgcccaacttacttacgttctacaggaagtcgtctcgtaaaccatcaagccatagaaatgcttgccctccatcccctcggaattgtgggtgtgggagtggagggagccggagctgtctgctacatcactag

SEQ ID NO: 33577 - DNA, 579 bp, Artificial Sequence
  Description of Artificial Sequence: Synthetic coding sequence
atgaaaaaagtgaagaaaaaacgatccgaggctcgtcggcaccgggactcaacttcgcagcatgcatcttccaattccaccagccaacagccaagcccggagagcaccccccagcagccctcacctgaatcaactccacagcaacctagcccggagtcgaccccccagcattcttcactggaaacaacaagcagacagccagcttttcaggcacttcctgcccccgagatccgccgctcctcttgctgcctcttatcaccagacgccaacgttaaggctgccccacagagtcggaaggcaggccctctaatccgcgcgggtccacatagctgctcctgtgccacatgtccctgcagcagtgcatgttggcgccggctgggcctttgccactcaaggatcttcgacgtgctgctaccacgcgactggcagatggctcccgggcgcggacttcccaatctgttaaccttctaccggaagtcttccaggaaaccttctagtcatcgtaatgcctgtccaccatcacccagaaattgtggttgcggtagcgggggctctcgatcgtgcctccttcatcattag

SEQ ID NO: 33578 - DNA, 579 bp, Artificial Sequence
  Description of Artificial Sequence: Synthetic coding sequence
atgaaaaaggtgaaaaaaaaacgatccgaagcccggcgtcaccgtgattcaacttcgcagcatgcttcgagtaactctacaagccagcagccatcccccgaatccacaccacagcagccatccccggaatccacacctcagcagccaagcccagagagcacgccacagcactcaagcttggagacgacgagtcgacagcctgcatttcaggccctgcccgccccggagattcgccgatccagctgttgtctgctgagcccagatgcaaatgttaaagccgccccacagagccggaaggcgggtccgttaattcgcgctggccctcactcgtgttcctgcgctacctgcccttgttcctccgcctgttggaggagattgggcttgtgccacagcagaatattcgacgtacttcttcctagggattggcagatggctccaggcagggggctgcctaacctcttaaccttctaccgcaagtcctcccggaagcctagctcacatagaaatgcctgccctcctagtccgcggaattgcgggtgcggaagcggtgggtctcggtcttgcctcctgcaccactag

SEQ ID NO: 33579 - DNA, 579 bp, Artificial Sequence
  Description of Artificial Sequence: Synthetic coding sequence
atgaagaaggtcaagaagaagagatcagaggcccgccgtcatcgagattcaacctcgcaacacgcgagctcaaattcgacatcgcagcagcccagccccgaatctacacctcagcagccctcccccgaaagtacacctcagcaaccgtcccccgagtcgacaccccagcattcgtcgttggaaactaccagccggcagcctgctttccaggcattgcccgcacctgagatcaggcgatcaagctgttgcctactttcccccgatgcaaatgtgaaggctgcacctcagtcccgaaaggcgggccctctcatccgcgctggacctcatagctgcagctgcgctacctgtccgtgctcatcagcatgttggaggcggctcgggttgtgtcactccaggatattcgacgtgctgcttccacgcgactggcagatggcccctggcaggggcttgcctaacctactgacattctatcgaaagtcctcccggaagccatcatcccatcgaaatgcatgccccccaagcccacggaattgtggctgtgggtctgggggaagccggtcttgtttgctgcaccactag

SEQ ID NO: 33580 - DNA, 21 bp, Artificial Sequence
  Description of Artificial Sequence: Synthetic coding sequence
tagtgtctgctacatcactag

SEQ ID NO: 33581 - DNA, 1005 bp, Artificial Sequence
  Description of Artificial Sequence: Synthetic coding sequence
atgcctctggaagttgtagtcgaactccagattagggccatctcatgtcccggtgtctttttgcctggcaagcaggacgtctacctgggggtttatctgatgaatcagtatctggaaaccaatagctttccctccgcctttcccattatgattcaagagtctatgcggtttgagaaaggcattgccccaaaaattgagttctcaacccgcaccgccataagggaatgtgtgttccttcaccgcaatcggtttctggaggaaaggcacgagtctcggcgccccctgagtacttctcacgaacctatctttccactcaataccattaagatgaagctgaaggagaataacctgaacagattgcccaagggaatgcaggctcgagctccaagtcagtacagtacaaggcacttctttcaggaccagcccgctcagttaaatctggggaacaactttaagataagcggcgggagcaagccaccatttgttgtccggcacgttgattcggctaagccctttggagagaacatttcagagcaccacttgcggcgctcccgtcgaaagagtaaattctccgacttcccgtttccaactagaagggccagttcactcgattctctcgcagccaacgtaaaagttattaaggaacctgacgagagaattgttctccggtcggattcctcgagctgtctggattctagtcagttcggaaaaagttcaagctctaaacaaggggatgcggatttccacgggaaggcttcctttgctacgtatcaacacagcacttctcccgggcctcttgaccaacctctacttagagagaggtttcatccagggtcacagtcgacctggaaaaacatccatgaaagagtgtgctccctcctcacctcgcacagagcccagctccaccagaataaggaagactctacaagcgaggtgaattatataatcgaaaggccgagctacccgctaaagaaatatagcctgcacgagcaacggtacttctag

SEQ ID NO: 33582 - DNA, 903 bp, Artificial Sequence
  Description of Artificial Sequence: Synthetic coding sequence
atgagccctagtatgttgacgggcaattctccccggggctgtaggttgccctctatctccagcacaacctgtgggagacagttagagaaagtgcccgaaaagagagatagtggcatgaccgaggtcgagagaacatatagcgccaactgtagtgattttctggagtccaagggctgttttgcaaacaccactccgagtggcaaaagcgtttcctcaagttcttccgtagagaccggtccctctgtgagtgagcctccaggcttgccacgggtctccgcatacgtggacaccaccgccgatcttgacaggaaactgtctttttctcatagcgaccatagctcagagatgtctctccccgaggtgcagaaggacaaatacccagaggaattctcactactcaaactgcagactaaggatggacaccggccggagtggactttctacccccgtttcagtagcaatattcatacgtaccacgtagggaaacaatgctttttcaacggcgttttcctgggaaataagagatcacttagtgaaagaaccgtggataagtgctttggaagaaagaaatacgatattgatccccggaacggaatcccaaaactgacccctggcgacaatccttacatgtaccccgagcagtcaaaaggcttccataaggctggcagcatgctgccccctgtgaatttctctatagtgccttacgaaaagaaattcgacactttcataccactggagccattgcctcagattccaaacttgcctttttgggtgaaagagaaagccaattccctgaaaaacgaaatccaggaggtcgaagagttagataactggcagcctgctgtgcccctcatgcacatgctgcacctttccggcgccctggactttccacggcagtcttag

SEQ ID NO: 33583 - DNA, 903 bp, Artificial Sequence
  Description of Artificial Sequence: Synthetic coding sequence
atgagcccgtccatgctgaccggcaattctccgaggggatgtcggctcccctcaattagctccacaacatgtggacgacagctggagaaggtgccagaaaagcgagattcaggcatgacagaggttgagcggacatattctgccaactgttcagacttcttggagtccaaaggttgcttcgcaaacacaacgcctagcggcaagtctgtcagctcttcaagttcggtggaaacgggtcccagcgtgtccgagcctcctgggttaccaagggtaagcgcatacgtagacaccaccgcggatctggataggaaactatcctttagccatagcgatcactcatcagagatgtcccttcctgaggtgcaaaaagataagtatcctgaggaattttcactgctgaagctgcagacaaaagatggacacagaccagagtggacattttacccacgctttagtagtaacattcatacgtatcacgtaggcaagcagtgtttcttcaacggggtattcctagggaataagcgtagtctttccgagagaacggtggacaaatgtttcggccggaaaaaatacgatatcgacccccggaatggcattccaaagttgacgcctggcgataatccttatatgtatccagaacaatccaaggggttccataaggccgggagcatgctgcctcctgttaacttctccatcgtcccgtacgagaagaagtttgacacctttattcctctggaacctctcccccagattcctaacctgccgttctgggtgaaggagaaggctaacagcctgaaaaatgagatacaagaagttgaagaactggataactggcagccagccgtgcccttgatgcatatgctccacctgagcggagccctggacttccctaggcagagttag

SEQ ID NO: 33584 - DNA, 1338 bp, Artificial Sequence
  Description of Artificial Sequence: Synthetic coding sequence
atgtccccacctgggatgtggcaacccggcgtgcagcagcccggcatatctcagcaagtcccaagtcatcctgatatgtcccaaccaggcatgtctcaacaggtccccagccagcccgggattagacagcctgataccagtcagtcatgtaagaaccagacagatatgtcccagcccgacgctaaccagtcttcactatctgactctaatcaaactgggattatacagcccagcccctcactgttgggtatgaatcaaatggatatgaaccagtggtccgcttccctttatgaaatgaaccaggtggacatgaaacaaccctccatgagccaggcaggtatgagacaatccggaacaaatctgccggatatcaaccagcctggaatgaaacagcctggaacatggcagctaggaaggtcacagccaggcatgtggccacagtccctttctgagctggtactgagtgaggcttcaatttcgcagcccggaccaccccagagagcaccttctcagtccgggcctaggcagtcctcaaccagccaggctgggacaaaccagtccggcattagtcagccagtcatgtggcagttagatatgcggcaaagtggtggcagccaaccatccatgcgtcaagtaggcaccagccagtcaggtactagtcaaataggcatgtcacagccaggtacatggcagactggcctatcccagccagtccctcgccaacccaacaagtctcctccaggcatgtggcagcgggggatgtggcagcctggaatgtcccagcaggtacctagccaactggggatgcgccagcctggcacctctcagtccagcaaaaaccagacgggaatgtctcatccgggcagagggcagcccggcatttgggagccaggaccgtctcagcccggtctctcacagcaggacctaaatcaacttgtcctgtcacagcctggactgtcacaacccggccgctcccagcctagcgtgtcacagatgggaatgcggcaaacgtctatggactattttcagatccgtcatgctgaggcaggagactgtcctgagattcttagactgatcaaggaactagctgcatgtgagaacatgctggacgcgatggagctcaccgcggccgatttgctgcgagacggtttcggagataatccactgttctattgtctgatcgcggaggtgaacgatcagcaaaagccgtccggtaaactgactgtgggctttgctatgtactattttacctacgacagttggacggggaaggtgctgtatctggaagacttctacgtaacacaggcctatcaggatagtcaccataacagtatgtag

SEQ ID NO: 33585 - DNA, 1527 bp, Artificial Sequence
  Description of Artificial Sequence: Synthetic coding sequence
atgagcccccccgggatgtggcagccaggcgtgcagcaacccggcatttctcagcaggtaccatctcatcccgatatgtcccagcctggcatgagccagcaagtcccaagtcagcctggcataagacaaccggacacgtcccagtcctgtaagaaccagacagacatgagccagccagacgctaatcagtcatcactatctgattccaatcagactggcatcattcaaccctctccatcactgctgggaatgaaccaaatggacatgaaccaatggagcgccagcctgtatgagatgaaccaggtcgacatgaaacagcctagcatgagtcaggccggtatgagacaaagcggaacgaacctgcccgatatcaatcaacctggcatgaagcagcctggcacatggcagcttgggcggtcccagccaggaatgtggccccagagcctatccgagctagtgctcagcgaggcctccatctcccaaccaggtccgcctcagagggcccccagtcagtccggaccgagacaaagctctactagccaggccggcaccaatcagtccggtatctcccagcccgtcatgtggcagctagatatgcgtcagtcaggtggaagccagccctcaatgagacaggttgggacctcccagagcggcacttcccaaatcggtatgagccagcctgggacttggcagaccggactctcacaacctgtcccgagacagcctaataagagcccccctggcatgtggcagagagggatgtggcagcctggaatgagtcagcaggttccgagtcaattgggtatgaggcagcccggaaccagtcagagcagcaagaatcagacaggcatgagtcatccgggaaggggccagccgggtatctgggagcctggtcccagtcagcccgggctgagccaacaagacctcaatcagctggtgctgagccagcccgggctgagtcagccagggagaagtcagccatcagtgagtcagatggggatgagacagaccagcatggattactttcagatcaggcacgcagaagcaggcgattgcccggagatactgaggctaatcaaagaactggctgcttgcgagaatatgctggacgcgatggagctgacggctgccgacttactcagagacggtttcggagacaacccccttttctactgcttgatagcagaagtaaatgatcagcagaaaccctcggggaagctgaccgtgggattcgcgatgtactatttcacgtacgacagctggactgggaaagtactatatcttgaggatttctacgttacgcaggcttatcagggactcggcatcggggcagagatgcttaagcgtctgtctcagatagcaattacgacccagtgtaactgcatgcactttcttgttgtcatttggaatcaggcatctataaattattataccagccgaggggcattggacctcagtagcgaagagggatggcatctcttcagattcaatcgggaggagttacttgacatggcctgggaagagtag

SEQ ID NO: 33586 - DNA, 1899 bp, Artificial Sequence
  Description of Artificial Sequence: Synthetic coding sequence
atgaaccagtcgggtaccaatcagtcctctctgtctgacagtaatcaggccgggatcaaccaaccaagtactaacagcctgggcatgaatcaaatggatatgaatcaggggagtgcgtctttgtatgagatgaaccaggtagacatgaagcagccaagcatgagccaagctggcatgagacagagcggaacaaacttgccagacatcaaccagccggacatgaagcagcccgacacgtggcaactcggacgaagtcagccaggcatgctgcaacaggaactctctcaattggtgctcagcaaggctggcatttctcaaccagacccttctcagcccggacctagccaatctggccccagccagagcagaatgcggcagattggaaccaaccagtctggcatgtcacagcccgtgatgcaacagctggattcacagagcggcggcagccaaccaagtatgaggcaggtcggaacatcccagctcggtacaagtcagatcggcatgtctcagcctggaacttggcagacaggtttgagtcagcccgttctgagacagcccaacatgtctccccctggaatgtggcagcccggggtgcagcagccaggcatctcacagcaagtcccatcccacccagatatgagccagccagggatgtcacagcaggtgccatcacagcccggcattcggcagcccgatacgagccaatcatgcaaaaatcagactgacatgtctcagcccgacgccaatcagtcctccctgtctgattccaaccagaccggcatcattcagcccagtccttctctgctgggcatgaatcagatggacatgaatcagtggagcgcatctctgtatgaaatgaaccaggtagacatgaagcagcctagtatgagccaggcagggatgcggcagtctggcaccaatctacccgacatcaatcagccagggatgaaacagccaggaacttggcaactgggtaggtctcagcccggcatgtggccgcagtcacttagcgagcttgttctaagcgaggccagtatctctcaaccgggaccaccccagcgtgctccttctcaaagtggaccccgccagagctccaccagtcaggcagggaccaatcagtcgggtatttctcagcccgtgatgtggcagctcgacatgaggcaatctggcgggtctcagccaagtatgaggcaagtcggcacctctcagagtggcacctcgcagatcggtatgagccagcccggtacctggcagaccggcctgagccagcccgtccctcgtcagcccaacaagtctccacccggaatgtggcaacgagggatgtggcaacccgggatgagtcagcaggtccctagtcagctaggaatgcgtcagccaggtacctctcagtccagtaaaaatcaaaccggtatgtctcatcccgggcgagggcaacctggtatctgggagcccggtccgtcccagcccggtctgagccagcaggacctcaaccaactggtcttatcacagcctggcttatcccagccgggaaggagccagccctcagtcagtcagatgggcatgaggcagacttccatggattatttccagattcggcacgcagaagccggtgactgtcctgaaattttgaggttgatcaaagagcttgcagcttgtgagaacatgctcgatgccatggaactgacggccgccgatcttttgcgcgatggtttcggggataaccctcttttctattgcttaatcgcggaagtgaatgaccagcagaaacctagtggaaagctgactgtggggttcgccatgtattactttacctatgatagctggactggcaaggtactgtatttggaggatttctacgtgactcaggcatatcaagactcacatcataatagtatgtag

SEQ ID NO: 33587 - DNA, 192 bp, Artificial Sequence
  Description of Artificial Sequence: Synthetic coding sequence
atgactcgaattaagatatcggtgtgtatctgtttcaggtacttcgagttctgcttcttttacgcactgaacattttgtttcagaaagtgtccgaggccaatagtcagacagaacttctgcttcgcccacactgcaaaaatatccttttcaacgttagttttatgattgacttgcaggccgcccacttttag

SEQ ID NO: 33588 - DNA, 1062 bp, Artificial Sequence
  Description of Artificial Sequence: Synthetic coding sequence
atggggagcctgtattcagagtacttgaaccccaacaaggtccaggagcattacaactacactaaggagaccctggaaactcaggaaacaactagccgccaggtcgcctcagcgtttatcgtaatcttgtgttgtgctatcgtagtggagaatctgcttgtgcttattgctgtggcccggaattccaagttccactctgcaatgtacttgttccttggcaacttggcagcatctgacctgctggccggagtagccttcgtggccaacacactgctgagtggttcagttaccctccggctgactccagtccagtggtttgcgcgtgagggatctgcctttattaccctctcagcttctgtatttagtctcctggcaattgcaatagaacggcacgttgcaatcgccaaagtcaagctgtatgggagtgacaaatcttgcaggatgctactgctgataggtgcctcatggcttatttcactagtcctgggcggattgcctatcctggggtggaactgtctgggccatctggaagcatgctctactgtcctgcccctctatgcaaaacactatgtgctctgcgtcgtcaccatattctcaattatcctcctggctatcgtcgcgctgtatgtgcgaatctattgcgtcgtgaggtcgagccacgccgatatggcggctccacagactttggccctcctgaagacggtcaccattgtcctaggagtgtttatcgtttgctggttgcccgcttttagtatacttctgctcgactatgcctgtcctgtgcacagctgtcccatcctatacaaggcccattactttttcgctgtcagcaccctaaactctttattaaaccctgtaatttatacatggcggtcgagggaccttcgccgcgaggtcctcaggcccctccagtgttggaggcctggggtaggagtccaggggaggaggcggggcggcacaccaggccaccacttactccctctgcgaagctctagttccctggagcggggtatgcacatgccaacaagcccaacatttctagagggaaacacagtggtttag

SEQ ID NO: 33589 - DNA, 789 bp, Artificial Sequence
  Description of Artificial Sequence: Synthetic coding sequence
atgctagcgctggaagccgctcaactcgatggcccccacttctcctgcctctaccccgacggagttttttacgacctggattcttgcaagcacagtagttatccggatagcgagggtgctcctgattccctatgggattggaccgtggcacctcctgtccctgccactccctatgaggccttcgatccagccgcagccgcgttctcacacccacaggcagctcagttatgttatgaacctcccacctattcccccgcaggaaatcttgagctggcccccagtcttgaggcaccaggccccggactgcccgcttaccccactgaaaactttgcctctcagactcttgtgcccccagcatatgctccctacccatcccctgttctctccgaggaggaagatctaccactggacagcccagcactggaggtgtccgactctgaatcagacgaggccctcgtcgcaggaccagaagggaagggttccgaggcaggaacacggaagaaattacggctatatcagtttctcttgggtctcctgacgcgcggcgatatgcgggaatgtgtgtggtgggttgaacctggcgccggggtgttccagtttagctcaaagcacaaggaactgctggcccgccgctggggccagcaaaagggcaatcggaagaggatgacatatcagaagctcgcacgagctctgcgtaattatgccaaaaccggcgagatccgtaaagttaagagaaaacttacctatcagttcgacagcgcactgctgcccgctgtgagacgcgcctag

SEQ ID NO: 33590 - DNA, 768 bp, Artificial Sequence
  Description of Artificial Sequence: Synthetic coding sequence
atggcttcatcagatctggaacagctgtgtagccatgtgaacgaaaagattggaaatatcaaaaagacgctcagcctccggaattgcgggcaagaaccaacgctgaaaaccgtcctgaataagatcggggacgagatcattgttatcaatgagctgctgaacaagcttgagttggagattcagtatcaagaacagaccaacaacagcctgaaggagctttgcgaaagccttgaagaagactataaggacatcgagcacctcaaggagaatgtgccttcccacctaccccaggtgactgtgacccagtcttgcgtaaaggggagcgatcttgacccagaagagccaatcaaagtggaggagcccgagcctgtcaagaaacctcccaaggagcagaggagcattaaagaaatgccattcatcacgtgtgacgagtttaacggtgttccatcctatatgaagtccaggcttacctacaaccaaattaatgacgtcatcaaagagatcaacaaggccgtgatttccaagtacaagatcctccaccaacccaaaaagtccatgaattcagtgactagaaatctgtaccatcgatttattgatgaagaaaccaaggataccaagggacggtactttatcgtagaagccgacatcaaagaattcaccacgctgaaagccgataaaaaattccatgtgctgttgaacatcctgagacattgcaggaggctgtccgaagtcaggggggggggcctaaccagatatgtcatcacatag

SEQ ID NO: 33591 - DNA, 381 bp, Artificial Sequence
  Description of Artificial Sequence: Synthetic coding sequence
atgtctacaatcaatatggaggcagaggtagataagctcgagctgatgttccaaaaggctgagagtgatttggactacatccagtaccgtctggagtacgagatcaagacaaaccacccggatagtgctagcgagaagaatcccgtgacccttctcaaggagttgtccgtcattaagtcacaataccaaacactgtatgccaggttcaaacccgtggccgttgaacaaaaagagaccaagagtcggatttgcgcaggaatgaccaaaaccatgaacgttatccagaagctccagaaacagaccgacttggacttgagtccactgaccaaggaagagaaaacggctgctgaacagtttaagtcacacgtgcctgacctttag

SEQ ID NO: 33592 - DNA, 777 bp, Artificial Sequence
  Description of Artificial Sequence: Synthetic coding sequence
atgaaaacacccaacgcgcaggaggctgaggggcaacagacacgcgcagcagccggaagggccacaggctctgccaacatgacgaagaagaaggtatcacaaaagaagcagagaggacggcctagctcacagcccagacgaaacattgtggggtgccgaatcagccatggctggaaagagggcgatgagcccatcacccaatggaaaggcactgtgctggatcaagtgcctataaacccctccctgtatctcgtcaagtacgatgggatagactgcgtctacgggttagagctgcaccgagatgagcgagtgctcagtctaaagatcctgtccgaccgcgtcgcgtcttctcatataagtgacgccaacctcgcaaataccattatcggcaaggccgtggaacacatgtttgagggggagcatgggtctaaggacgaatggcggggtatggtacttgctcaggcccccatcatgaaagcatggttctacataacctacgagaaggacccggtgttgtacatgtaccaactgctcgacgattacaaggagggggatctccgcattatgccggaaagcagcgagtcacctcccaccgagcgcgaaccagggggcgtggtggacggccttatcggcaaacacgtcgagtacacaaaggaggatggttccaagcgaattggcatggtcatccaccaggtggaaaccaagcctagcgtttattttatcaagttcgacgacgactttcacatctacgtgtatgaccttgtgaaaaagagttag

SEQ ID NO: 33593 - DNA, 777 bp, Artificial Sequence
  Description of Artificial Sequence: Synthetic coding sequence
atgaaaacgcccaacgcacaggaagctgaaggccagcagactcgcgctgccgctgggcgtgctacaggttccgctaatatgacaaaaaagaaggtcagccagaagaagcagcgcggtcgcccatcctcacagccacggcgtaatatcgtagggtgtcggatttcccatggctggaaagagggtgatgagccaattacacagtggaaggggaccgtcttagaccaagtaccgattaatccttcactatacctcgtcaaatacgatggcattgattgtgtttacggtctggagctgcatagggacgagagagtgctgtctctgaagatcttgagcgacagagtagcatcctcccatattagcgacgctaacctggctaataccattataggaaaagccgtcgagcacatgttcgagggcgagcatgggagtaaagacgagtggagaggaatggttctggcacaagcacctattatgaaggcctggttttacataacctatgagaaggaccccgtactctacatgtatcagctgctggatgactacaaagaaggcgatttgcgcatcatgccagaatcttctgagagtcccccgactgagagagagccaggtggagtcgtggacggacttattggcaagcatgtcgagtacacaaaagaggacgggtccaagcggattgggatggtaattcatcaggtggaaacaaagccctctgtctatttcatcaagtttgatgatgatttccacatctatgtctatgatttagtcaaaaaatcctag

SEQ ID NO: 33594 - DNA, 234 bp, Artificial Sequence
  Description of Artificial Sequence: Synthetic coding sequence
atgaagacaccctttgggaaagcggctgcagggcagcgatcccgaacaggggcgggccatggatctgtgtctgtgaccatgatcaagcgaaaagccgctcataagaaacacaggagtcggccaacgagtcagcctagaggcaacatcgtgggatgcaggattcagcacggttggaaggacggggacgaacccctgacccaatggaagggtacggttctagaccagctactgtag

SEQ ID NO: 33595 - DNA, 777 bp, Artificial Sequence
  Description of Artificial Sequence: Synthetic coding sequence
atgaagacgccctttgggaaggccgccgctggccaaagatcgaggactggggcgggccatggcagcgttagcgtaaccatgattaaacggaaagcagcccacaagaaacatcggtctcggcccactagccaaccgaggggtaacatcgttgggtgcaggatccagcacggctggaaggatggcgacgaaccattgactcaatggaagggaactgtgctggaccaggtgcctgtgaatccctctctgtacctgattaagtacgatggcttcgactgcgtatacggactcgaactgcacagagacgaaagagtctcttctctcgaagtgctcccgaatagagtggccagcagtaggatcagtgacacccacctcgcggagataatggtcggtaaggccgtcgagcacattttcgagacggaagaaggtagcaagaatgagtggcgcgggatggtgctagcgcaggctcccgtgatgaatacttggttctatatcacctacgaaaaagaccccgtgctctatatgtatcagctcctcgatgactataaggacggtgacctgaggattttgcaggacagcaacgacagccctcttgccgagagagaaccaggcgaggttattgacagcctggtcggcaaacaggtagagtatgccaaggatgatggctccaagaggacagggatggtgattcatcaggttgaagccaagccctccgtgtacttcatcaaatttgatgatgactttcatatatacgtgtacgaccttgtcaaaacatcatag

SEQ ID NO: 33596 - DNA, 750 bp, Artificial Sequence
  Description of Artificial Sequence: Synthetic coding sequence
atgagtccaccaacggtccctccaatgggggtggacggtgtatctgcatacttgatgaagaagcggcacacacaccgcaaacagcgccgcaagcctacatttctaacacgacgcaacatcgttggctgcaggatccagcacggctggaaagagggcaacgaacccgtagagcagtggaaaggcaccgtgctggagcaggtctctgttaaacctacgctttatattatcaaatacgacgggaaagatagcgtgtacggactggaactgcacagggacaagcgggtgctggcgcttgagattcttcccgaacgtgtaccgacgcctcggatcgatagccgactcgccgacagcctcataggtaaggccgtcgagcacgtttttgagggagagcacgggacgaaggatgagtggaaaggaatggtgcttgcacgagcccctgttatggatacttggttctacatcacttatgagaaagaccccgttctctatatgtatacattgctcgacgattacaaagatggagatctgcgtatcatccctgattctaactactattttcccaccgccgagcaggagcccggggaagtggtcgatagcctcgttggaaaacaggtggagcatgccaaggatgatggctctaagagaaccgggatcttcatccatcaggtggtcgcaaaacccagcgtgtacttcataaagtttgatgacgatatacacatttacgtgtacggacttgtgaagaccccctag

SEQ ID NO: 33597 - DNA, 696 bp, Artificial Sequence
  Description of Artificial Sequence: Synthetic coding sequence
atgaagaaaaggcacacacatagaaaacagagacggaagccaacatttctgaccaggaggaatatagtgggctgccgcatacagcatggctggaaggagggaaatgaaccagtggagcagtggaagggcactgtccttgaacaggtttcagtgaaacctaccctgtatattatcaaatacgatggcaaagactctgtttatggcctggagttgcatcgggacaaacgcgtgttagccctcgagatcctccctgagcgcgttccaactcctcgaattgattcccgactcgccgacagcttgattggtaaggctgtggaacacgtcttcgagggggagcacggcacaaaggatgaatggaaggggatggtcctggcacgcgcgcccgtgatggacacctggttctatatcacttatgaaaaagaccctgtcttgtacatgtacaccttattggacgactataaggacggggacctgaggataatcccagattccaattattattttcccacggctgaacaggagccaggggaggtggtagattccctggtcggcaagcaggttgagcacgctaaagacgacggctccaagcgcacaggtatatttatccaccaggtggtcgccaaaccatcagtgtacttcataaaatttgatgacgacattcacatttacgtatacggcctggttaaaacgccttag

SEQ ID NO: 33598 - DNA, 792 bp, Artificial Sequence
  Description of Artificial Sequence: Synthetic coding sequence
atgggccagactgctcttgccggcggctcgtcctctacccctacccctcaggccctgtatccagacctgtcttgtccggagggacttgaagaactcctcagtgctccacctcctgatctcggggcacaacggaggcacggctggaacccaaaggattgtagcgaaaatatcgaagtgaaggagggcggcctgtatttcgagcggcggcctgtcgcccagtccacagacggggctaggggtaaaaggggctactctaggggcctacatgcatgggaaatttcctggcccctggagcagcggggaacccatgcggtggtcggtgtcgcgacagccctggcgccattacagactgaccactatgcagcactgctgggttccaattccgaatcctggggctgggacatcggtcgaggtaaactataccaccagtcgaaaggacccggtgctcctcagtacccagccggaactcagggagagcaacttgaggtgcctgagcgcctccttgtcgtcctggacatggaggagggcactcttggctacgctatcggaggcacgtacttaggaccagcgtttcgggggctgaaagggcgcacactttatccagccgtgtcagctgtgtggggacaatgccaggtccggatccggtacctcggagagcgaagggctgagccacattctttgttacacctatcccggctttgtgtgcgacacaatctcggcgatactagacttggacaggtgagcgccctgcccctccccccggccatgaagagatatctcctgtatcagtag

SEQ ID NO: 33599 - DNA, 792 bp, Artificial Sequence
  Description of Artificial Sequence: Synthetic coding sequence
atggggcagacagcattggctggcgggtctagctcgactccaaccccacaggccctgtaccctgacttaagctgtccagaaggtctggaagagctgctgtcagcacccccgcccgacctcggcgctcagaggaggcatggttggaatcccaaggattgctcagagaatatagaggttaaggaaggcgggctgtacttcgaaagaaggccagtggctcaaagtacagacggtgcgcgcggcaaacggggttatagtcgggggttgcacgcttgggaaatctcatggcctctggagcagagaggtacgcacgcggtggtgggtgttgcaacagccctggctccactccaaacggaccactatgcagccttgcttggaagtaactcagaatcctgggggtgggatattggccgcggaaaactttatcaccagagcaaagggccgggcgccccacaataccccgcggggactcagggtgagcagttggaggttccagaaagactgctcgtggtcctggacatggaggagggaactcttgggtatgctatcggaggaacttacctggggcctgcctttcggggacttaagggtcgcaccctgtacccggccgtgtctgcggtgtggggccagtgtcaggtgcggattaggtacctcggcgagagacgggcggagccacactctctgctgcatctgtcaagattgtgcgtgagacacaacctcggggatacccgcctgggccaggtatctgccctacctctgcccccagccatgaagcgatacctgctctaccagtag

SEQ ID NO: 33600 - DNA, 2424 bp, Artificial Sequence
  Description of Artificial Sequence: Synthetic coding sequence
atgcggctgtctccagcacccttgaaattatctagaacgcccgcactgctggccctggccctgcctctagctgcagcactggcgttttcagatgagactctggataaggtgcccaagtctgagggatattgtagtcgaatactacgagctcaaggtaccaggagagagggatacactgagttcagtctgcgcgtcgaaggggacccagacttttataagccaggcacctcataccgagtcaccctgtctgcggcaccacctagttactttaggggattcaccttaatcgccctgagagaaaatagggaaggggacaaagaagaggaccatgcaggcaccttccagattatcgatgaggaggaaacgcaattcatgagtaactgccctgtcgctgtgactgaatctactcctcgccgcagaacgcgaatccaggtgttctggatcgctcctccagccggaactggctgcgtgatactcaaggccagtattgtgcagaaacgaatcatctacttccaagacgagggcagcctaaccaagaaactgtgtgaacaggattccacctttgatggcgttactgacaaacccatcctcgactgctgcgcatgcggcactgccaaatatcgcctcactttttacgggaattggtcggaaaagacgcatcccaaagactatccccgtcgcgctaatcactggtcagcaataatcggggggtctcactctaaaaactacgtcctgtgggagtacggagggtacgcgagcgagggggtcaagcaggtagccgaactcggaagcccagtgaagatggaggaggagattaggcaacagtccgatgaagtgctcaccgtaatcaaagctaaggcccaatggcccgcatggcagcctttgaacgtgagagctgccccgagcgccgagttcagcgtcgatcgcaccagacatctgatgagcttcctgactatgatgggcccttctccggactggaatgtcgggctctccgcagaggacctctgcaccaaggaatgtggctgggtgcaaaaggtcgtgcaggacttaatcccttgggacgctggtactgatagcggtgtgacttacgaatctcccaacaaaccaacaattcctcaagaaaaaattagacctctaacttcgttggatcacccacagagtcccttctatgacccagaggggggatcaataactcaagtggcgagagtggtcatcgagaggatagctagaaaaggggagcagtgcaatatcgttccggataacgtggacgatatcgtcgctgatttagcacctgaggagaaggatgaggacgatactccagagacctgcatctactcaaattggtccccgtggagcgcctgctcgtccagcacctgcgataaaggcaaacggatgcgccaaagaatgctgaaagcacagctggacttgtcagtgccatgccccgatacgcaggactttcaaccatgcatgggacccggatgctcagatgaagatggctctacgtgcaccatgtcggagtggatcacgtggagcccctgctccatctcctgtggaatgggcatgcgctctagggagcgttatgtcaagcaattccccgaggatggcagcgtgtgcaccctgccaacggaagaaacagaaaaatgtacagtgaacgaggagtgtagtccatcctcctgtttaatgaccgaatggggcgagtgggatgaatgctctgccacatgtggcatgggcatgaaaaagaggcacagaatgataaaaatgaacccagcggacgggtccatgtgcaaagctgagacctctcaggccgaaaagtgcatgatgccagaatgtcacacgatcccatgcttgctcagtccgtggtcagaatggtctgattgttctgttacctgtggaaaagggatgagaaccagacagcgtatgttgaaatccctggctgaattgggggactgcaacgaggacttagagcaggttgagaagtgtatgctgccagagtgccccatcgattgcgagcttacggaatggtcacagtggtctgagtgtaacaagtcgtgtggaaagggccacgtgataaggactaggatgattcagatggagcctcagtttgggggagcaccgtgtccggagacagtccagaggaaaaagtgtagaatccgaaagtgtcttagaaaccccagcatccagaagctgaggtggcgagaagcgcgagaatcccggcgcagtgagcagctgaaagaggagtccgagggagagcagtttcccgggtgtcgcatgcgaccttggactgcctggagcgagtgtactaagctgtgcggaggcgggatccaggaaagatacatgacggtgaaaaagcgcttcaagtcaagtcaattcacttcttgtaaggacaaaaaggagattcgggcctgcaacgtacatccctgctag

SEQ ID NO: 33601 - DNA, 1329 bp, Artificial Sequence
  Description of Artificial Sequence: Synthetic coding sequence
atgaggcgtacgagaagaccaaggttcgtgctgatgaataagatggatgatctcaacctccactaccggttcctcaactggaggcgcaggatacgggagattagggaggtacgggcttttcggtaccaggagcgcttcaaacacatcttagtcgatggcgacacactcagctaccatgggaactccggcgaggtgggctgctacgtagcttcccgccctctcaccaaggactcaaactatttcgaagtctctattgtggacagcggtgtgcgaggcacaatagctgtggggctggtaccacagtactacagcctggatcaccagcccggctggttgccagactctgtagcttaccacgccgatgacgggaagctgtataacggaagagccaaaggcaggcagttcggcagtaagtgcaacagtggggatcggataggttgtggcatcgaacctgtttcatttgacgtccaaacggcgcagattttttttactaagaatggcaagcgggtcggaagcaccattatgcccatgagccctgatggattgttccccgctgttggcatgcactctttgggagaggaagttagactccacctgaacgccgaactcggcagggaggacgatagcgtgatgatggtggatagctacgaagatgaatggggccggttgcatgacgtccgggtctgtggtactctcctggagtacttgggaaagggaaaatctatcgttgacgtgggactggctcaggccagacatccccttagcaccaggtcacactatttcgaggttgagatcgttgatcctggcgagaagtgttacatcgccttaggtctggctcgcaaggattaccctaaaaaccggcaccctgggtggtcaagaggttccgtcgcctatcacgctgacgacgggaagatctttcatgggtccggcgtcggagaccccttcggacctcgttgctataagggggatatcatgggatgtggcatcatgttcccccgagactatatcctcgattctgaaggggattctgatgacagttgtgacacagtgatcctttctcctactgctagggcagttcgaaatgttcggaacgtcatgtacctgcatcaggagggcgaggaggaagaggaagaggaggaggaagaggaggacggagaagaaatcgagccagaacatgaggggaggaaagtagtggtcttcttcacccgtaatgggaagattattggaaagaaagatgccgtggtccctagtggcggctttttccccactatcggtatgctcagctgcggagaaaaggtgaaagtggacctccatcctctcagtggttag

SEQ ID NO: 33602 - DNA, 1359 bp, Artificial Sequence
  Description of Artificial Sequence: Synthetic coding sequence
atgaattcagggatcctccaggtcttccagagggccctgacctgtcccatttgcatgaactactttctggaccctgtgaccattgattgtgggcatagcttctgtagaccgtgtctttatctgaactggcaagatactgccgtactcgcccaatgctccgaatgtaagaagacgacaagacagcggaacctgaataccgacatctgtctgaaaaacatggcctttatcgcacggaaagctagcctccggcaattcctgagcagtgaggaacagatctgcgggatgcaccgtgagacaaagaaaatgttttgtgaagtcgataaaagcctcctgtgtttgccctgctctaactctcaagaacaccgtaaccatatccactgtcccatagaatgggcagccgaagaacggagggaagaactgctgaagaaaatgcagagcttgtgggagaaagcatgtgaaaatctgagaaacttaaatatggagactactcgcaccagatgctggaaagactatgtgtcccttcggatcgaagccatcagagcggaataccaaaaaatgcccgctttccttcacgaagaggagcagcaccacctggagaggctacgaaaggaaggtgaagatatttttcagcagctgaacgagtctaaagccagaatggaacactccagggaactgctgcgcggaatgtacgaggatctgaagcagatgtgtcataaggccgatgttgaactccttcaggctttcggcgacatcctccatagatacgagtctttgcttctgcaggtgagcgaaccggtcaatcctgaactgtctgcagggcctatcaccggactgttagacagcctcagtggttttcgcgtggactttacccttcaaccagagagagccaactcccacattttcttgtgtggagatctgcggagcatgaatgtcggctgcgatccacaagatgaccctgacatcactggcaaatccgaatgttttttagtctggggagcgcaggcatttacgagcggaaaatactactgggaggtgcacatgggcgacagttggaactgggccttcggtgtttgcaacaactattggaaggaaaagagacagaatgataagatcgatggcgaggaagggctgttcctgctggggtgcgtgaaggaggatacccactgttcgctcttcactacttcccccctcgtggtgcagtacgtgccacggcccacatctaccgtgggcctcttcttggactgcgaaggtagaaccgtgtcattcgttgatgtcgatcagtccagcctgatctacactattccaaattgttctttttctccccctctgcgccccatcttctgctgtagccacttctag

SEQ ID NO: 33603 - DNA, 591 bp, Artificial Sequence
  Description of Artificial Sequence: Synthetic coding sequence
atggccacttctgtgctgtgttgcttgaggtgttgtcgagacgggggaacaggccacattcctttgaaagagatgcccgcagtgcagttagacacacaacacatgggcactgacgtggtaatcgtgaaaaacgggcggcgtatctgcggaaccgggggttgtttggcaagcgcccccctccaccagaacaaatcttattttgaattcaaaatccaatctactggtatctggggaataggggtggccacgcagaaggtgaatctgaatcagatacccctgggccgggacatgcattcactggtgatgcggaacgatggtgccttgtaccacaataacgaagagaaaaacaggctgcccgcaaattcactgccccaggaaggagacgtggtgggtattacatacgaccatgtcgagttaaatgtctacctgaatggaaagaacatgcactgtcccgcctccggcatccgaggaaccgtctacccggtcgtgtacgtggatgactctgcaattttggattgccagttctctgagttttatcacacaccaccaccgggatttgagaagattctctttgagcagcaaattttctag

SEQ ID NO: 33604 - DNA, 474 bp, Artificial Sequence
  Description of Artificial Sequence: Synthetic coding sequence
atggccaccagtgtgctctgctgtctgaggtgttgtagagacggtggcaccggacatattcccctgaaggagatgccggcagtgcagctcgacactcagcacatggggatatggggtattggagttgccacacagaaggtcaatctcaatcagatccctttgggccgcgatatgcactccttggtcatgagaaatgatggcgccttgtaccacaataacgaggaaaaaaatcggctacctgcgaactcgctgcctcaagagggcgacgtggtggggattacctatgaccacgtggagttgaacgtttacctgaacggtaagaacatgcactgcccagcttccggcatacgcggcactgtgtaccctgtggtttatgtcgacgacagtgcaatcctagattgccagttctcagagttttaccacactccccctcctggcttcgagaaaatcctgttcgagcagcagattttctag

SEQ ID NO: 33605 - DNA, 1059 bp, Artificial Sequence
  Description of Artificial Sequence: Synthetic coding sequence
atggacttcagggagattcttatgattgcgagcaagggccaaggcgtgaacaacgtacctaagcgttactctctggccgtgggaccacctaagaaggatcccaaagtgaagggagtccagagcgcggccgtgcaggccttcttgaagcgcaaagaagaggaactgaggcggaaagccctcgaagaaaaaagacgcaaggaggaacttgtcaagaaacgcattgagctgaagcatgataagaaggccagggccatggccaaacgtaccaaggacaacttccacggatacaacgggattcctatagaggagaaatcaaagaagcgccaggcgaccgaaagccacacctcccaaggaactgaccgcgagtacgagatggaggaagagaatgaatttcttgaatacaatcacgcagagtcggagcaagagtacgaggaggagcaggagccgcctaaggtggaaagcaagccaaaggtgcctttaaaaagcgcccccccccctatgaactttacagacctgttgaggctggctgagaagaagcaattcgaaccggtggagattaaagtggttaaaaagtctgaggagaggcctatgacagcagaggagctgagagagagggagtttctggaaaggaagcataggaggaagaaactagaaacagacggaaagcttccaccaacggtgtctaaaaaggccccatcacagaaagaatccgtagggaccaagctaagcaaaggaagcggcgataggcacccttctagtaaggggatgcccctgccgcatgccgagaagaaatcgagaccctcaatggcaaatgagaaacacctcgcccttagtagctccaaatctatgcccggcgagagaattaaggccggctctgggaactcatctcagccctcactcagagaggggcacgacaaaccagtgttcaatggtgcgggcaagcctcatagtagtacatctagcccaaagcatgtctggaaggaaaacaaatatatgaaaagggactggctcttttattttcagtgcattgagtatattagactgctattcatcttttag

SEQ ID NO: 33606 - DNA, 2058 bp, Artificial Sequence
  Description of Artificial Sequence: Synthetic coding sequence
atggattttagggagattctaatgatagcttcaaaaggccagggggtaaataatgttccaaaaaggtatagcctcgccgttggtccccctaagaaagacccaaaagtgaaaggcgtgcagtcggccgccgtgcaggcgtttctaaagcggaaagaggaggaattgagacgtaaggcgttggaagagaagcgccgaaaggaggaactcgtgaaaaaacggatagagctgaagcatgacaaaaaagcacgggcaatggcaaaacgcaccaaggataatttccatggatacaatggcataccgattgaagagaaatctaagaaacgccaggctaccgaaagccacacgtctcagggaactgaccgcgaatacgaaatggaggaagagaacgaatttttggagtataaccatgcagaatccgagcaggagtacgaggaagaacaggaacctcccaaggtcgaatcaaagccaaaggtgcccctgaaaagcgcgcccccacccatgaacttcacagacctgctgaggctggccgaaaaaaaacagtttgaaccggtcgaaataaaagtggttaagaagtccgaagaacgcccaatgaccgctgaagagctacgggagcgggagtttttggagcgtaagcaccggcgcaagaagctcgaaactgacgggaagttacctcccacagtgtccaagaaagcaccttcccagaaggagagtgtgggtactaaactttcaaaaggatctggcgacagacatcctagtagtaaaggtatgccactgccacacgctgagaaaaaatctcggccttctatggccaacgagaaacacctggccttgagtagctcgaagtccatgcccggagaacgcatcaaggctggatctggaaactcatcccagccctccctgagggaggggcacgacaaacctgtgtttaacggtgccggaaaacctcactcaagcactagtagcccctctgtgccgaagaccagcgcaagtcgtacccagaagtctgctgtagaacacaaggcgaagaaatcactgtctcacccctcacactctcgtccaggtcctatggtaactccccataacaaggctaaaagtcctggcgtccgacagccaggatcatcgtcctcgagcgccccagggcagccatccacgggtgtagctcggcctacagtaagctcaggacccgtcccgaggaggcagaacgggtcctcctcatctgggccggaaagatctatttcggggtctaagaaacccaccaatgatagcaaccccagtcggagaaccgtttctggaacctgcgggccaggacagcctgccagcagtagcggagggccggggagaccgatttcaggatcagtgtcgtcggctagaccactggggtccagccgagggccagggcggcccgtgtctagcccccacgagctgcggcgccctgtcagcggcctaggcccgcccggacgcagtgtcagtggaccaggcaggagcatttctgggtctatccccgcaggccgaacagtctctaactcagtacctggtcgacctgtttccagtcttggaccagggcagactgttagttcatccggaccgacaattaaacccaagtgcaccgttgtgtctgaaaccatcagttccaagaatatcatctcgcgttcaagcaatggacagatgaacggcatgaaaccaccactgagcggctatagagccgcacaggggccacagaggttgccatttcctactggatacaaaaggcaacgagaatacgaagaagaggacgacgacgatgacgagtatgactccgagatggaggacttcatcgaagacgagggcgaaccccaagaggaaatctcaaaacacatcagagaaatttttggctatgatagaaaaaaatacaaggatgaaagcgattacgctctccggtacatggaatcctcttggaaggagcaacaaaaggaggaggctaagtccctgcgtctgggcatgcaggaggatctagaagaaatgcgccgcgaggaggaagaaatgcagcggcgccgggcaaagaaactgaagcgaagatag

SEQ ID NO: 33607 - DNA, 1488 bp, Artificial Sequence
  Description of Artificial Sequence: Synthetic coding sequence
atgcagtggtcgcccaccccgggcgcgagcgcctgcttgggatgggcctcctccttagcttgcagcacagctcctaccctgctgggcagagcgggacgcggccccctcatggcagccaagtggtttaaagagtttccactgaatctgaagactgttagtgagagagctaagccgggcggtggcggaggaaaattacgcaagaattccgaagcaggcggggcgggacctggacccggtaagggacggaagaatagcgctgccgaattagggtccggccgagcgggagtcggtcctaaagatagcaggttatctcgggactccctacaaggactaatccaagccgcagccggaaaggggcggaaaaattccagagccactgaagaagaaccacatcgcggcgctacgaaatcgtccgggtgctcaacctacataaaccggttgataaaagtcgacacccaagagaaaaacggcaaatcaaattacccttcatctagctcttcctcatcatcttcttcctcgtccgcttcgtcaagcccgtcctccctggggcctgaactagataaggggaagatcataaaacagcaggagactgttattatcctcgaggactacgccgacccttatgatgctaagaggaccaaaggacagcgtgacgccgagagggtgggcgaaaatgacggctacatggagccttacgatgcccagcagatgattaccgagatccgtcggaggggatcaaaagaccccttagtgaaagccctccaattgctggattctccctgtgagcctgccgatggcgggctgaagtctgaaaccctggcaaaacgccgcagcagtaaagacctgctcggtaagccccctcagctctacgataccccgtacgaaccggcggagggcggaccgagggctgagggcaaggcccgtcctcctgactccaggcttcctgaaaacgatgaaagacccgcagcggaatacgaacaaccctgggagtggaaaaaggaacaaatcgtccgggcattatccgtgcagttcgaaggagccgaaagaccgtcgttccgggaggagaccgtaaggcagcaccatcgtcaaaagagttggactcagaaaatccttaaacccgctctgtcggaccactctgagggcgaaaaagtagacccaggattgcccttggagaaacagccctggtaccacggggcgatctctagagcagaggctgagagccgcctgcagccatgcaaagaagcgggttatctggtccgcaattccgagagcggtaacagccgatactcaatcgcccttaaaacctcccaaggatgtgtacacatcatcgttgcccagacaaaggataacaaatacaccctgaatcaaacatctgcagtctttgacagcattcccgaagttgtccattactactccaacgaaaagctaccatttaagggagccgaacatatgaccctattatacccagtccatagcaagctacattag

SEQ ID NO: 33608 - DNA, 1272 bp, Artificial Sequence
  Description of Artificial Sequence: Synthetic coding sequence
atgcagcaggagggtggacctgttcgctcggcgccatgccgaaccggcacactcgaaggcagccgccaagggagcccaggacataggaagcgtgcttctcctaaaggatcactctcaagtgcgcagccacatagctggatgcttaccccatcacctctgaacagccattgcgctcacagagagccaatctcaagttcacctcaacccgttgccaatgggcctaagcagaagaagaagtctaactggcgaagcacaacccgccttcgaattatccgcctgcgggaccgcttggagcctcggcccctcgccatactcgaggattacgccgatccgtttgatgttcaggagactggagaaggatcagcgggtgctagcggagctcccgaaaaggtccctgagaacgacggatacatggagccatacgaggctcagaagatgatggccgagatcagaggcagtaaggagaccgcaacgcagccacttccactgtatgacacaccctatgagcctgaggaagacggagctactgctgagggagaaggggcgccatggcctagggaatcacgcctcccggaggatgatgagcggcccccagaagaatatgaccagccatgggagtggaaaaaagaacgtattagtaaagcatttgcggtggatataaaggtgatcaaggatcttccttggccgccaccagtcggacagctagacagcagcccttcactgcctgatggtgacagagatatctcaggcccagcctctcctctgccagaaccaagtctagaggatagctccgcacaattcgagggccccgagaagagctgcctgtctcctgggcgggaagaaaagggcaggctgccccccagactttctgccgggaacccaaagtccgctaagccgctgtctatggaacccagctccccgttaggcgagtggacagatccggcactcccactggagaaccaggtctggtaccacggggctatctccaggaccgatgccgagaacttgctgcggctgtgcaaagaagcatcatacctcgtgcggaatagcgaaacatctaagaacgatttcagcctgtccctaaagagctcccaggggttcatgcatatgaagctctctcgtactaaagaacataagtatgtgctgggccagaattcccccccattcagcagcgtccctgaaatcgttcaccattatgcaagtcgcaaactgcctattaaaggcgcagaacatatgagccttttgtaccctgtcgccatccgaaccctgtag

SEQ ID NO: 33609 - DNA, 1302 bp, Artificial Sequence
  Description of Artificial Sequence: Synthetic coding sequence
atggtggcccagtccctgtctgacgctcaccacgctttaactatcatgctctcggagcgactttggctcgggctggagctgctaaattttaccagacgtaaaatctcttcggaccctccaccttataatttcctggaggctagagaggccgccctcggtcatcggtggagaatgcagcaagaaggcggcccagtgaggtcagctccgtgtagaacgggcacgctggagggttcaagacaaggatctccgggacataggaagcgggcttcccccaagggctcccttagcagtgcacaaccccatagctggatgcttaccccctctccattaaacagtcactgtgcccatcgcgagcccataagttcttccccacagcccgtcgctaacggccctaagcagaaaaagaagtccaactggagatccacaaccagacttcggataatccgcttgcgcgatcggctggagccaagaccactcgccatattggaggattacgcggatccgttcgacgtgcaggagactggcgagggaagtgcgggtgcaagcggtgcacctgaaaaggttcccgagaacgatgggtacatggaaccttacgaggcacagaagatgatggccgaaattcgcggcagcaaggagactgccacccagcctctacccttgtacgacaccccgtacgagcccgaggaagacggagcgacagcggagggcgagggggccccttggccaagggagagcaggctgcccgaggatgatgaaaggccacctgaggaatacgatcagccttgggagtggaaaaaggaacggatctctaaggcttttgcagcacagttcgaaggacccgaaaagtcttgcctgtcgcctgggagggaagaaaaggggaggttgccaccaaggctgtctgccggtaaccctaaatccgctaaacccctctctatggagccgagctcgccgctgggagagtggaccgatcccgccctgcctctggaaaaccaggtctggtaccatggtgctatttctagaacagatgccgaaaatttattgaggctgtgtaaggaagcctcttatttggtacggaactccgaaacttccaaaaacgatttctcactgagcctaaagagttcccaaggctttatgcatatgaagttgtcacggacaaaggagcacaagtacgtgcttggccagaacagtcctccattttcctccgtgcctgagattgttcaccattatgcaagtagaaagttgcccattaaaggtgctgaacacatgtctttgctttatccggtagccatccggacactttag

SEQ ID NO: 33610 - DNA, 1110 bp, Artificial Sequence
  Description of Artificial Sequence: Synthetic coding sequence
atgcagcaggaagggggccccgtgagatccgcaccgtgtagaacagggacactggagggctcacgccagggctctcctgggcaccgcaagcgggcgagccctaaaggcagtctatcctctgcccagccacattcgtggatgttgaccccctccccattaaactcccactgtgctcaccgagaacctatttccagcagccctcagccggttgcgaatggtccgaaacaaaagaagaagtccaactggcgtagtacaaccaggttgagaataatcagacttcgggatcgcctagaaccaaggcctctggctatcctggaggactatgccgacccatttgatgtccaggagaccggagagggttcagcaggggcatctggggccccagagaaggtgcccgagaatgatggatacatggagccgtacgaggcccagaagatgatggcagaaattcgaggctcaaaggagactgccacgcaacctctacccctgtatgacacgccttatgaacctgaagaggacggcgcaactgctgaaggggagggcgcgccatggccacgtgaatcacggctgcccgaggatgatgagcggccacccgaggagtacgaccagccctgggaatggaagaaagagcgcatcagcaaggcgtttgctgttgacattaaagtgattaaggatctgccatggcctccacctgtgggccagttggattcctcaccgtctctccccgatggtgaccgtgacatctctggaccagccagcccactgcctgaaccaagtctggaggatagctctgctcagttcgagggcccagaaaaatcatgtctgtctcccggaagagaagagaaaggccggttgccaccgaggctgtctgctggtaacccaaagagcgcaaagcccttgagtatggaaccctcctcccccctcggcgagtggacagatccggcactgccattggagaatcaggtttggtaccatggagcgatctcacgaacagatgcggagaacctaagcgggtgcgctaaaagacctgcaacttggtgtgctactgtgcggccggccaggatgacctccccttcaccgagtagggccgctcgggactcctgcacatag

SEQ ID NO: 33611 - DNA, 1101 bp, Artificial Sequence
  Description of Artificial Sequence: Synthetic coding sequence
atgttgctgtccggcgccccaccagccgcacctcctgctcctccgccagacatcctggctgcctataggcttcaaagggaaagggacttcgaggacccatacagcggaggctccagcggcagtgcagctctcgctactcccgtcgcacctggacctacaccaccccccaggcacggaagcccaccccaccgcctgatcagagtcgaaacacccgggccccccgcacccccagcggacgagaggatctccggcccccctgcatccagtgacaggctggccatcctcgaagattacgcggacccctttgatgtgcaggagaccggggagggaagtgcaggggccagcggggccccggagaaggtccctgaaaacgacgggtatatggagccatatgaggcgcagaaaatgatggcagagatcagaggatccaaggaaactgcaacacagcccctccctctgtacgatactccatacgaacccgaggaagacggcgccacggccgaaggagaaggcgctccctggccaagggagtccagattgccagaagatgacgagcgcccccccgaggaatacgatcaaccttgggaatggaagaaggagcggatcagcaaggcttttgccgcacagttcgagggtcctgagaagagctgtctatccccgggaagagaggagaaaggccgcttgccaccaaggctgtccgcaggaaacccgaaatctgcaaagcccttgtctatggagccctcttctcccctgggggagtggacagatcctgcactgccactggagaaccaggtgtggtaccatggtgcgatctcaaggaccgacgctgaaaacttactgcggttatgcaaagaggcttcatacctggtccgcaactctgagaccagtaagaatgacttctccctatcgctgaagagctcacaggggttcatgcatatgaagctcagcagaacaaaggaacacaagtatgttctgggccaaaacagccctccattctccagcgtgcccgaaatagtgcatcattacgccagcaggaaactgcccataaaaggcgcagagcatatgtctcttctgtacccagtggccattcgaacactatag

SEQ ID NO: 33612 - DNA, 690 bp, Artificial Sequence
  Description of Artificial Sequence: Synthetic coding sequence
atgacccctcaactcctactggctttagtgctgtgggccagctgcccgccatgctccgggaggaaagggcctccagccgctctaacattgcctagagtccagtgtcgggcgtcacgctatccaatcgctgtcgattgctcgtggaccttaccaccagcccccaacagtaccagcccagtctccttcatagccacttaccggctggggatggctgctcgcggccactcatggccctgcctccagcagaccccaaccagtactagctgtaccataactgacgtccaactctttagtatggctccctatgtgctgaatgtaactgccgtgcatccttgggggagctcgtcatctttcgtgcccttcattactgagcacataatcaagccagacccacctgagggcgtgcggttaagtccactggctgagcgccagctccaggtgcaatgggagccccctggttcgtggccatttcccgaaatctttagtctcaagtactggattagatacaagagacagggcgccgcacggttccacagagtcggacccattgaggcaacaagcttcatccttcgtgctgtacgcccccgggcaaggtactacgttcaggtcgccgcccaggatctcaccgattatggggaactttctgactggagcctgccagccactgctacaatgagcttaggaaagtag

SEQ ID NO: 33613 - DNA, 1023 bp, Artificial Sequence
  Description of Artificial Sequence: Synthetic coding sequence
atggccaagtggctgagagattacctcagtttcggtgggcggcggcctcccccacaacccccaacacccgattatacagaatcagatattcttagagcctatagagcccaaaaaaacttggacttcgaagacccttatgaggatgcagagtcccgcctagaaccggacccagccgggccaggtgattcaaagaacccaggagacgctaagtatggatcccctaagcataggttgattaaagtcgaagcagccgacatggccagagccaaagccctcctggggggccctggagaggaactcgaggcggacactgaatacttggacccatttgatgctcaacctcacccagccccgcctgatgacggctacatggaaccttacgatgcacagtgggtgatgtccgagcttccaggaagaggggtgcagctttatgataccccatacgaggagcaggatcccgagaccgctgacggccctcctagtgggcaaaagcctcggcaatctcgtatgccccaggaagatgaacggccagctgatgaatatgatcagccctgggaatggaagaaagatcacatcagtcgtgccttcgcagtgcagttcgactctcccgagtgggaacggacccctggctctgctaaggagctgaggagacctcctccacgcagccctcagccagcggagagagtagatcccgcgctgccactcgaaaaacaaccatggttccatggacctctcaatagagctgatgcggagagtctgttgtccctttgcaaggagggctcgtatttagtgagactgtccgagaccaatccccaagattgtagcctgtcattgagatccagccaggggtttctgcatttgaaatttgcgcgtactcgggaaaatcaggtggtcttaggtcagcactctggtccattcccctcagttcccgaactggtgctccactactcttcccggccgctacccgtccagggcgccgaacacctggccttactgtacccggtcgtcacccaaaccccatag

SEQ ID NO: 33614 - DNA, 3552 bp, Artificial Sequence
  Description of Artificial Sequence: Synthetic coding sequence
atgggaaacgccccatcgcaggaccccgagaggtccagtccacctatgctctccgctgatgatgcagagtaccctcgtgagtataggactctgggcggtggcggaggaggaggttctggcgggaggcggttctctaatgtgggtctcgtgcacacttctgagagacggcatacggtgatagctgcccagtcgctggaggccctgagcggcctgcaaaaagccgacgctgataggaagcgcgacgcgttcatggaccatttgaaatcgaagtatccacagcacgccctcgccttgcggggccagcaggaccgaatgcgggaacagcccaactattggtcctttaaaactcggagctcccggcacactcagggcgctcagccaggactggccgaccaggctgctaaactgagttacgcctctgccgagagtctggaaaccatgtcagaagcagaactaccactcggctttagtcgtatgaaccggtttagacagagtcttcccctcagcaggagcgcaagccaaaccaagttacgcagtccaggcgttctgtttctgcagtttggcgaggaaacccggcgtgtacacattacccatgaagtttcttcactagacactctgcacgcgcttattgcccacatgtttccacagaagttaacaatgggtatgcttaagagccccaacactgctatactgattaaagacgaagcccgcaatgtcttttacgagctggaagatgtgcgcgatattcaggaccggtcaattataaaaatctatcgtaaagagcctctgtacgctgccttccccggtagccatctcaccaatggggatcttcggcgagagatggtgtatgccagccgcgagtcgtcacccacccgcagactcaacaatctgagtccggcacctcaccttgcgtcaggatctcctccccccgggctgccaagtggcttgccaagtggcttacaatcaggctcaccgtctcgttcacggttaagctacgccggcgggaggccgccatcttatgccgggtcacctgtccaccacgcagccgaacgcctgggtggggcccccgccgcgcagggtgtgtcaccctccccaagcgctattcttgagaggagagatgtgaagccagacgaggatcttgctagcaaggctggggggatggtgctggtgaaaggcgaagggctgtacgcggatccgtatgggctcctgcacgagggaagactgagtctggcggcagctgccggcgatcccttcgcttaccccggcgcaggtgggctgtataaacgtgggtcagtaagaagtctctctacatattctgcagccgctctgcagagcgacctggaggatagcctatacaaggctgccggcggcggaggcccactctacggtgacgggtacggatttcggttaccacccagctccccccaaaaactggcagatgtagccgcacctcccggcggccccccccctccccacagcccctattccggccccccctcacgcggcagccccgtgcgtcagtcgttccgtaaagattccggatcaagctccgtgttcgcggaatctcctggtgggaagacaaggtccgccggaagcgccagcaccgcaggtgctcctccctccgagctctttcctggaccgggagaacgctctctagttgggtttggccccccggtacccgccaaagatacggagacgcgagaacgaatggaagcaatggaaaagcagattgcttccctgaccggtctggtgcagtccgctttgctccgcggctctgaaccagagactccaagcgagaagatcgagggctccaatggcgccgcgacccctagcgcgccatgtggatctggggggaggagtagcggcgcgaccccagttagcgggccgccccccccttctgctagtagtacaccagcgggccaacctactgccgtgtcccggctccaaatgcagctccacttgcggggtctgcagaattctgccagtgacctccgaggccagcttcagcagctgcggaagttacagctacagaaccaggagagtgttcgcgcactcctgaagagaaccgaggccgagctttctatgcgagtcagcgaggcggccaggcggcaagaggatcccctgcagcggcagaggaccttggttgaggaagaacggctgaggtatttgaatgatgaggagcttattacccaacaactcaatgacctcgagaagtcggttgagaaaatccagcgtgatgtctctcataatcatagacttgtccctggcccggagctagaagagaaggcactggtgttgaagcaattgggcgaaaccttgacagaactgaaggctcattttccagggctgcagtccaagatgcgtgtcgtgctccgggtcgaggtggaagccgtgaagttcttaaaggaagagccacagaggttagacggcttactgaaacgctgtcgaggggtgacggataccctcgcacagattagaagacaggtcgacgagggcgtctggcctccgcctaataacttactgtcccagtctcccaaaaaagttaccgcggagaccgacttcaacaaatccgtcgacttcgaaatgccaccccccagccctccactgaatctgcatgagttgagcgggccagctgaaggcgcgtccttaaccccaaagggaggcaatccaaccaaggggcttgacacccccgggaaacggagcgtcgacaaggctgtatcagtcgaggcagccgaaagagactgggaagagaaaagggccgctttgacccagtactcagcaaaagacataaatcgcctgcttgaagaaacccaggccgagctacttaaggctattcccgacttggactgcgcttccaaagcgcacccagggcctgcgcccacgccggatcacaagcctccaaaggcaccccatggccagaaagcggccccacgtaccgaaccatcgggccggcgcgggtctgatgaactcaccgtgcctagataccggactgagaaaccatcaaaatcaccacctccacccccccccagaagaagctttccctcctcccacggtctgaccactactagaacaggagaggtggtcgtcacctccaagaaagattcggctttcatcaagaaagctgaatcagaggagctggaagttcagaagccccaggtcaaactgcgccgtgccgtgtctgaagtcgcgagacccgcatccacccctcccatcatggccagtgccatcaaagacgaggacgatgaagaccggattattgcagagctcgagagtggaggtggcagtgtgccccctatgaaagtggtgacccctggtgccagcaggctcaaagccgcccaagggcaggctggcagtcctgataagtccaagcacggaaagcagcgagctgaatacatgcgtatccaggcccaacagcaggcaaccaaacccagcaaagaaatgtccggctctaatgaaaccagctccccagtgagcgagaagccaagtgcaagccgcacttctatacccgtgttaacctccttcggagcacggaatagttcaatctccttctag

SEQ ID NO: 33615 - DNA, 3108 bp, Artificial Sequence
  Description of Artificial Sequence: Synthetic coding sequence
atgtcagaagcggaattgcccttaggatttagccgcatgaataggttccggcagagtctgcccctgtcacggagtgcaagccaaaccaagctcaggtcccccggcgtactctttctccagtttggagaggagacacgcagggtgcacatcacacatgaagtgagcagcttggatactctccacgccctcatagcccatatgtttccccagaaacttacaatgggcatgttgaagagtcccaacactgccattttgatcaaagatgaggccaggaatgtcttctacgaattggaagatgtgagggacattcaggataggagcatcatcaagatttacagaaaggagccgttatacgctgccttccctggctcccatctgactaacggcgacctgcgccgggagatggtctatgcaagtcgcgagtcctcaccaacgaggcggctgaataacctgtcccccgcaccacatttggcttccggctcccctccaccaggtctcccctcaggactgccatctggtttgcaatcaggatcaccaagccgttcaagactttcatatgcaggcgggaggcccccgagctatgccggctcccctgtccaccatgccgcagagcgattgggcggggctccagccgctcagggggtgtccccctcaccgagtgcgatcctcgaacggcgagacgtgaagcccgacgaagatctggccagcaaggccgggggaatggttcttgtgaaaggggaggggctctatgctgatccctatggtttgttgcatgagggtcggctctcgttggccgccgcagctggcgatccattcgcctatcccggagccggaggcctctacaagagagggagcgttcgaagcctgagcacatactctgcggctgcccttcagagtgacctggaggacagcctgtacaaggccgctggtggtggggggcctctgtatggtgacggctatgggtttaggctccctccctcaagcccccagaagcttgctgacgtggctgccccccctggcggcccacctcctccccatagcccttactccggcccaccgtctcgggggtctcctgtgcgccaatcatttaggaaggacagcggcagcagcagcgtgtttgctgagtccccaggggggaagactagatctgccggctcagccagcacagccggggcaccgccctcagagctgttccctggcccaggcgagaggtctttggttggcttcggccctccagtgccagcaaaagatactgagacacgcgaaagaatggaggcaatggaaaagcagatagcgtctctgactggcttggtccagtcggccttgctgcggggcagcgagccagaaacaccctcagagaaaatcgaggggagcaatggagctgccactccaagcgccccctgtgggtctggagggagatccagtggcgcgaccccagttagcgggcctccaccgccatcggcctcttcgacgcctgctgggcagccaacagccgttagtcggctgcagatgcaattgcacttgagaggcctccagaactcagcctccgatctccggggacagctccagcaactgcggaagttacagctgcaaaaccaggagtccgtgcgcgcactcctcaagcgtactgaagcagagctgtcaatgcgcgtgagtgaagcagctcggaggcaagaggatccactgcaaaggcagcgcacactggtggaagaagaacgactgaggtatctaaacgacgaagagttaattactcagcagttgaacgacctggaaaaatctgtggagaaaattcaaagggatgtgtcccataatcacagactggtccctggcccggaactggaggagaaagccctggtacttaaacagctaggcgaaacgctgaccgagcttaaagcccattttcctggccttcagtccaaaatgagagtcgtcctgagagtagaagtagaggccgtgaagtttctgaaggaagaaccacaacgattagacggcctgctgaaacgatgtaggggagtgacggacacgttggcccagatccgccggcaggtcgatgagggcgtgtggcccccccctaacaaccttcttagtcagagccccaagaaggttacagctgagacggacttcaacaagagtgttgacttcgaaatgcccccaccctctcctccactgaacctccacgagctgagtggcccggctgagggcgcttcactgactcctaagggcggcaatcctacaaaggggttagacacccctggaaagaggtctgttgataaggcagtctctgtcgaggccgctgagcgggattgggaagaaaagcgtgccgctcttactcaatatagcgccaaggatataaacagattgctcgaagagacacaggcagagttattgaaagcgattcctgatctggattgcgccagcaaagcccacccagggcccgccccgactccagaccacaagccaccaaaggctccacatggtcagaaagctgctccaaggacggaaccttccggaagacgcggcagcgacgagctcacggttccccgttatagaaccgaaaaaccttcaaaatcgcctccaccgccgccgcccagaagatcctttcctagttctcacggcctgaccactacgcgcacaggtgaagtagtggtgacatccaagaaagactctgcttttatcaagaaagccgagtcggaggagctagaggtgcagaagccacaggtaaagctgagaagggccgtctctgaagtggcccgtccggcctctacaccccctatcatggcctctgccatcaaagatgaggatgacgaggatcgcatcatcgcggagctggaggtctttgagagatcttcagtaagctctcttccccccactccacgacgtcaattgatccctactttgttgagtccacaggatctgggcccaccagggggctccgcgccaggtccaactagaaaatcaggcggtggtagcgttccacccatgaaggtcgttacgcctggggcctcccgcttgaaagcggcacagggccaggcaggcagtcccgacaagtccaagcacggcaagcaacgagcagagtacatgcgcattcaggcccaacagcaggtatag

SEQ ID NO: 33616 - DNA, 2766 bp, Artificial Sequence
  Description of Artificial Sequence: Synthetic coding sequence
atgggaatgttgaaatctccaaatactgccattctgataaaagacgaggcaagaaatgtgttttatgaacttgaggacgtgcgggatatccaggaccgctctatcataaagatataccggaaggagcccctgtatgcagctttcccgggatctcatcttacaaacggagatctcaggcgagagatggtttatgctagccgagaaagttctcctaccaggaggttgaataatctctctcctgctccgcacctcgctagcgggagcccccctcctggcctaccatcgggtctgccctctggcttacagtcaggctccccgagcagaagccgcctgagctatgccggaggtagaccacctagttatgctgggagtcccgtgcaccatgcagcggagagactgggcggagcccccgcagcccagggcgtgtcaccatcccctagcgccatactggaacgcagggacgtgaaacctgacgaagacctggcaagcaaggctggaggaatggttttagtgaagggagaggggctgtacgctgacccttatggactcttgcacgaagggagactgagtcttgctgccgccgcaggcgaccctttcgcataccccggggctggggggctgtacaagagaggaagtgtgaggagcctctctacctattctgctgcagcgttgcagtctgacctggaggattcactatacaaagccgcgggtggtggaggaccactttacggagacggttacggtttccgtctacctccatctagccctcaaaagctcgcggatgttgcagcccctccaggaggcccgcccccgccgcatagtccttacagtggcccaccatcgcgggggagcccagtccggcagagctttcgtaaggatagtggctcgagttctgtgtttgccgaatctcctggcggaaagaccaggtcggcgggcagcgcctcgactgctggggcgccgccgagcgaactttttccaggacccggcgagcgcagcttggtgggctttgggccgccggtgccagctaaggacaccgagacgagggagagaatggaggcgatggagaaacagattgcttctctgactggattggtgcaatcagccctgctgcgggggagtgaacccgaaacaccaagcgaaaagattgaaggtagcaatggcgctgccacaccttcagccccatgtggtagcggcggtcgatctagtggtgctacgcctgtttctggacctccgccaccatcagcatcaagtactcctgctgggcagcccactgccgtctctcgactgcagatgcagctgcacctcaggggtcttcagaacagtgcgagcgatttaaggggacagcttcagcagctgcgcaaactccagttgcagaaccaagaatcggttcgggccctcctgaagcggactgaagcagaactctccatgcgggtcagcgaagctgcaagacgccaagaagatccgctgcagaggcaacgcacgcttgttgaggaagagcgcctccgttacctgaatgacgaggaactcatcactcagcagctgaatgacctggagaaaagcgtggaaaagatacaacgcgatgtttcccacaatcaccggctcgttccaggtccggagctagaggagaaggctctagtcctaaaacagttaggtgaaaccctgaccgagctgaaagctcacttcccagggctgcagtccaaaatgcgtgtcgttctgagagtggaggtcgaagctgtcaagttccttaaagaggagccacagaggctggacgggcttctgaagcggtgccggggagtcacagacaccctggcacagatcaggcgccaagtggacgaaggagtgtggccaccccctaataacctgttatcccagagcccaaaaaaggtcaccgcagaaactgactttaacaagtccgtggatttcgaaatgcccccacccagtccgccacttaacctccacgagttgtccggcccagccgaaggtgcttcgctgacgccaaagggcggcaaccccactaaaggtctggacactccaggcaagcgaagcgtggataaggccgtctcagttgaagccgccgagcgagattgggaagagaagagagccgcgctgacacaatacagcgctaaggatatcaaccgcctattggaggagacacaggcagagcttctgaaggctatccctgatctcgactgcgcctccaaggcccatcctgggcccgctccgacacccgatcacaagccaccaaaggctccacatggacaaaaagccgccccgagaacagaaccaagtggcaggcgcggttcagatgaattaacggtcccccgctaccgaaccgaaaaaccctctaagtcccctcccccaccgccaccccgtcgtagctttcccagttcccatggcctgacaacaaccaggacaggagaggtggtggtcactagcaagaaggacagtgcctttatcaagaaggcagaaagtgaggagctggaggtacagaaaccacaggtgaagctgcggcgggcagtgtctgaagtcgcacggccggcttccacgccccccattatggcctccgctataaaagacgaggacgatgaagacaggattatagccgaactggaatccggcggcggcagtgtgcccccaatgaaggttgttacacccggagcatctagattgaaggccgcccaaggtcaggccggcagtcctgataagtccaagcacgggaagcagcgggcagagtacatgagaattcaagcacagcagcaagtatag

SEQ ID NO: 33617 - DNA, 1356 bp, Artificial Sequence
  Description of Artificial Sequence: Synthetic coding sequence
atggtgagcagagaccaggcccatctgggccctaaatacgttggactttgggattttaagtcacgtacagatgaagagctttcattccgagcgggggatgtattccacgtggcccgcaaggaggaacagtggtggtgggcaactctcctagatgaagcggggggagctgtcgcacagggctacgtcccgcacaattacctggccgagagagagaccgtggagagcgaaccgtggttttttggatgcatcagtaggagtgaagctgtaagacggctccaggccgaggggaacgctaccggggccttcctgatcagggtaagcgaaaaaccctcagcagactatgtactttcagttcgcgatactcaagccgtgcggcactacaaaatttggaggagggccggcggcagacttcatctgaatgaggctgttagctttctatcacttcctgagctggtaaattatcaccgcgcccagtctctgagccacgggcttcgcctggccgctccgtgcagaaaacatgaaccagaaccgctcccccactgggacgattgggaacgtccaagggaagaattcaccctgtgtcgaaaactgggaagtgggtattttggagaggtgtttgaaggtctctggaaagatcgcgtccaggtagccattaaagtgatctcccgagataatttgctgcatcagcagatgctgcagtccgagatccaggcaatgaagaagctgagacataaacatatactagccctgtatgcagttgtgagtgttggggatcctgtatatatcatcaccgagttgatggccaaggggtcactgttggaactcttaagggattctgacgagaaggtcctcccagtgagtgagctgctggatatcgcatggcaggtggcagaaggcatgtgctatctagagtcacagaactacattcaccgcgacctggcagctcggaatatactcgtgggtgagaacacgctctgcaaggtcggggatttcggactggcccggttgatcaaggaagatgtgtatttgagccatgatcacaacattccctataagtggaccgccccggaggctctgtccaggggccactattccacgaagagtgacgtatggtcgtttgggatcctgctgcatgagatgttttctcgcggtcaggtcccttacccagggatgagtaatcatgaagcatttctgcgcgtggacgccggctacaggatgccctgtcccctggaatgtcccccctccgttcacaagctgatgctaacctgttggtgccgcgatccagaacagcgaccctgttttaaggctttacgggaaagattatcttcatttacgagctacgagaaccctacttag

SEQ ID NO: 33618 - DNA, 468 bp, Artificial Sequence
  Description of Artificial Sequence: Synthetic coding sequence
atggcagtgcctgggtgtaacaaggattccgttcgcgccggctgcaagaagtgcggctacccaggccacctgacattcgaatgtaggaacttcttgcgagtggatccaaagcgcgatattgttctggacgttagcagtacgtcaagcgaagattctgacgaagaaaacgaggaactgaacaagctgcaggcactgcaggaaaagcgaatcaacgaggaggaggagaagaaaaaggaaaagtcaaaagaaaaaataaaactgaagaagaaacgcaagagaagctactcctcaagtagtacagaggaagacactagtaagcaaaaaaaacaaaagtaccagaaaaaagagaagaagaaggagaagaagagcaagtccaagaagggcaagcaccacaaaaaggagaaaaaaaaaagaaaaaaagagaaacatagctctacccccaacagctcagaattcagccggaagtag

SEQ ID NO: 33619 - DNA, 1704 bp, Artificial Sequence
  Description of Artificial Sequence: Synthetic coding sequence
atgtccgccagtaccggcggcggaggcgactctggggggagcggaggatcatcctccagctctcaggcctcatgcggccccgagagtagtggcagcgagttggctctggctactcctgttcctcagatgttgcaggggctcctggggtccgatgatgaggagcaggaggatccaaaagactactgcaaagggggctaccaccccgtgaaaataggtgacgtttttaatgggcgctaccatgttgtgcgaaagctgggctgggggcacttttctaccgtttggttgtgctgggatatccagcgtaaaagatttgtggctctcaaggtagtgaaaagtgcaggacactataccgagaccgcagttgatgagatcaaactgcttaagtgcgtccgggactctgatccaagcgacccaaagcgggaaaccatcgtacaactcatcgacgatttcaggatctccggtgtgaatggggttcacgtgtgcatggtcctcgaggttctcggtcatcagctattgaagtggattattaagtcgaattaccagggtctgccagtcccctgcgtcaagtctatcgtaaggcaggtgctgcatggtctcgactatctacataccaaatgtaagataatccacaccgacattaagcccgagaatattctgctgtgcgttggagatgcatacattcgaaggctcgcggctgaagccacggagtggcagcaagccggggcacctcctcccagcagatccatagtaagcactgctccccaagaggtgctgcaaacgggtaaactgtcaaagaataagagaaagaaaatgagaagaaagcgaaagcaacagaaacgcctgctggaggagcggttgagagacctgcagcgcttggaagctatggaagccgccacccaggctgaagactccggactgagactggacggaggtagtggcagcacctcttcatccgggtgtcatcctggaggagcgagagcgggaccttcgcccgctagttcatcaccagcacctggtggcggaaggtccctgagcgctggaagtcaaacaagcgggtttagtggcagcctgtttagcccagcgagctgctcaattctctccggttcttccaatcaacgcgagaccggcggactgctgtccccctcgaccccatttggagcctcaaatcttcttgtcaaccctttggagcctcagaacgcggataaaatcaaaatcaagatcgccgacctgggaaatgcctgctgggttcacaagcactttactgaggacatccaaacccgtcaatatagggccgtggaagtgctcataggtgctgaatacgggcctccggctgacatctggtccaccgcttgcatggcttttgaactggccacgggcgactacctcttcgaaccacactccggcgaggattattctagggatgaggaccacattgctcatatagtagagctcctgggggacattcctccagcctttgcactgtccggccggtacagtagagaattcttcaatagacggggcgagttgagacacattcacaatctgaaacactggggcctgtacgaggttcttatggaaaaatacgaatggccattggaacaggcaactcagttctccgcgttcctgttaccaatgatggagtatattcccgagaagagggcctccgcggccgactgcttgcagcatccttggctgaatccttag

SEQ ID NO: 33620 - DNA, 1602 bp, Artificial Sequence
  Description of Artificial Sequence: Synthetic coding sequence
atgtctgcctcaaccggaggaggcggcgacagtgggggaagcggaggaagctctagcagttctcaggcatcttgcggaccggagagttccgggtctgagctcgccttggccaccccagttccccagatgctccaaggactccttggtagcgacgatgaagagcaggaggatcctaaggactactgcaaggggggctatcaccctgttaagatcggcgacgttttcaacggaagataccatgtggtgcgtaaacttgggtggggtcacttcagtaccgtctggctttgttgggacattcagcgcaaaagatttgtggcccttaaagtggttaagagcgccggccactacaccgagactgcagtcgacgaaataaaattgttgaagtgtgtgagggactctgaccccagcgatcccaagagagagaccattgttcagcttatcgatgacttccggatcagcggagtaaatggcgtgcatgtgtgtatggttctagaagtgctggggcaccagctgctgaagtggattattaaatctaattatcagggcctaccagtgccctgtgtgaagtccatcgttagacaggtcctccacggcctggattatctacacaccaagtgtaaaatcattcacacagatatcaagccggagaatatccttctgtgcgtgggggacgcttacataagacggctggctgctgaggccacggaatggcagcaagccggagcacctcccccctcacggtcaatcgtgagcacggccccacaggaagtactgaccggaaaattgagcaagaataagcgtaagaagatgcgcaggaaaaggaagcagcagaagcggctgcttgaagaaagattaagagatctccagcgactggaggccatggaagcagctacccaagctgaagacagcgggttaagattggacggcggttctgggagcacgtcctcttctggtttcagcgggtcactgttctcaccagcttcttgtagtattctgagcggctcatcaaatcagagagaaactgggggcctactgtcaccatccacaccttttggcgcctcaaacctgctcgtcaaccctcttgagccgcagaatgccgataagatcaaaatcaaaatcgcagacttgggaaatgcctgttgggtccacaagcatttcaccgaggatattcagacccgccagtatcgtgcagtggaggtcctgatcggggcggaatacggcccgcctgcggacatttggagtacagcttgcatggcgttcgaactggccaccggggactatctctttgagccgcactcaggagaggattacagcagggatgaggaccatatcgctcacatcgtcgaattgctgggggatatccctcctgcattcgccttgtcaggccgatactctcgcgagttcttcaataggagaggggagctgcggcatatccataacctgaagcactggggtttgtacgaggtccttatggagaagtacgaatggccgctggaacaggccacacagttctctgcctttttgttgcctatgatggaatacataccagagaagcgtgcctcagccgccgactgtctgcagcatccctggcttaatccatag

SEQ ID NO: 33621 - DNA, 120 bp, Artificial Sequence
  Description of Artificial Sequence: Synthetic coding sequence
atgactggcttcttcaagggcgcggaagacagatactcttctcatttatggcgaccacaaggagggccacgctccaaaggcccggggcctcggtcgtggaacaccgaaagcctacggtag

SEQ ID NO: 33622 - DNA, 1023 bp, Artificial Sequence
  Description of Artificial Sequence: Synthetic coding sequence
atggtcacacttagaaaaaggaccctgaaggtgctcacttttctggtgctgttcatcttcctgacctcattctttctcaactactcccacaccatggtggccaccacctggtttcctaagcaaatggtgcttgaactttctgagaacctgaagagattgatcaaacataggccgtgtacctgtacgcattgtattggacagaggaaattgtcagcctggtttgacgaaaggtttaatcagactatgcagccgcttctgaccgcgcagaacgctttgcttgaggatgacacttataggtggtggctcaggcttcagagagagaaaaagccaaacaacctgaacgatacgattaaggaattgttcagggtggtgccaggtaacgtagaccccatgctcgagaaacgttccgtgggctgtaggagatgtgctgtagtaggaaattctggcaacctgcgcgagagtagctacggccccgaaatcgattcccacgacttcgtgctgaggatgaataaggcccccaccgctggtttcgaggctgacgtgggtaccaagaccactcatcatctggtgtacccagagagcttcagggaactgggcgacaatgtctccatgatactggtgccgtttaaaacaattgacctcgagtgggtggtatccgccattacaacagggactatctcacatacgtacatccccgtgccggcgaaaataagagtaaagcaagacaaaattttaatctaccatcccgcttttattaagtacgtcttcgacaattggctccaggggcatggacgctacccctcgaccgggatcctgagtgttatatttagcatgcacgtgtgcgatgaggttgacctctacggcttcggcgccgactcaaagggcaactggcaccattactgggaaaataacccatccgcaggagcattccgaaagactggtgtgcacgacgctgattttgaaagtaatgtcactgcaacgcttgctagcatcaacaagatacgcatcttcaaagggcgctag

SEQ ID NO: 33623 - DNA, 1023 bp, Artificial Sequence
  Description of Artificial Sequence: Synthetic coding sequence
atggtgaccctcaggaagcgtacactgaaggttctcacatttctagtgctatttatcttcttgacttccttttttctgaattactcgcacactatggtggctacaacatggttcccaaaacagatggtcctcgagttatccgaaaatcttaaacgattgatcaagcatagaccatgcacatgcacccactgcatcggccaacgcaaactctccgcgtggttcgacgagagattcaatcagactatgcagccactgctgaccgcccagaacgctctgctggaggatgatacatatcgctggtggctcagactgcagagagaaaaaaagcccaacaatctgaatgacactataaaggaactcttcagagtggtgccagggaacgtcgatccaatgttagaaaagcgtagcgtcggttgcagacggtgcgcggtggtggggaatagtgggaacctgcgggaaagcagctatgggcccgagatcgattcacatgattttgttctgagaatgaataaagcccccaccgcgggtttcgaagcagacgtgggtaccaaaacaacacatcacttggtctatcccgagtcgtttagggaactgggcgacaacgtcagtatgattctcgtgccatttaaaacgatcgacttggagtgggtggttagcgccatcaccacaggtactatctcacacacgtatatcccagtgccagcaaagatccgggtgaagcaggataaaatcctgatctaccaccctgccttcattaagtacgtgtttgataattggctccaggggcacggtcggtacccttctacgggcattctaagcgtgatcttcagcatgcatgtctgcgacgaagtggacttatatggtttcggcgccgatagcaagggcaactggcaccactactgggagaacaacccaagcgctggggccttcagaaaaacaggagtacacgacgccgatttcgagtctaatgtgactgcaacgctcgcttccatcaacaaaatccgtattttcaaggggaggtag

SEQ ID NO: 33624 - DNA, 150 bp, Artificial Sequence
  Description of Artificial Sequence: Synthetic coding sequence
atggtaacactgcgcaagcgcaccctgaaagttctgacctttcttgtcttgttcatattcctgacgtcatttttcctgaactattctcacacgatggtggccacgacctggtttcctaagcagatggtgctcgagctctcagaaaactag

SEQ ID NO: 33625 - DNA, 1023 bp, Artificial Sequence
  Description of Artificial Sequence: Synthetic coding sequence
atggtcacccttcgcaagcgaaccctcaaggtactcaccttcctggtgctgttcatttttctgacaagcttctttctcaattattcacacaccatggtcgcaaccacatggttccctaaacagatggtgctcgaactctccgaaaatctgaaaaggctaattaagcaccggccttgcacatgcacccactgcatcggccaaagaaaattgagcgcctggtttgatgagcggttcaatcagaccatgcagcccctgctgaccgcccagaatgcgctcttagaagacgacacatatcggtggtggctgaggctccagcgggaaaagaagccaaacaatttaaacgacacaataaaggagctttttagagttgtccccgggaacgtggacccaatgttggagaagcggagtgtcggctgccgccggtgcgcagtcgtcgggaactcagggaatctgcgggagagctcctacggacctgagattgacagtcatgatttcgtgctgaggatgaataaagctcccactgcaggattcgaagcggatgtgggcacaaaaactacacatcatcttgtttatcccgaaagcttccgcgaactcggggataacgtctcgatgattttggtcccatttaagactatcgaccttgaatgggttgtgtccgccataactaccggtactatttctcacacctacataccagtacccgccaaaataagagtcaaacaagacaagatcctcatttaccaccctgcctttattaagtatgtgttcgataactggctccaagggcacggtcggtatccatccacgggcattctaagcgtgatttttagcatgcatgtgtgcgacgaagtagacctgtacgggttcggggccgatagcaaaggtaactggcatcattattgggagaacaatccatcggccggtgcctttagaaagacgggggtgcatgacgcagattttgagtctaacgttactgccacattggcatccatcaacaagatccgaatcttcaagggccgttag

SEQ ID NO: 33626 - DNA, 1023 bp, Artificial Sequence
  Description of Artificial Sequence: Synthetic coding sequence
atggttacgctgagaaagcggacgctcaaagtacttacgttcctcgtcttgtttatttttctcacgagtttttttcttaactacagccacacaatggttgctaccacctggttcccaaaacagatggttctagagttatctgagaacttgaaaaggctcatcaagcacagaccatgtacctgtacacactgtataggccagagaaagctctccgcatggttcgacgagcgtttcaatcagaccatgcaacctctcctgacagcccaaaatgccctcctcgaggacgacacttatcgttggtggctgaggttgcaacgggagaaaaagccaaataatctgaatgacacaattaaggagttattcagagtggtacctggaaatgtagatccaatgcttgagaagcgttctgttgggtgcagaaggtgcgccgtcgtcgggaattctggaaatctccgagagtccagctatgggccggagattgactcccacgacttcgttctgaggatgaacaaggccccaaccgccggctttgaagctgatgttgggaccaagaccactcatcacctggtttaccctgaatcatttcgcgaactgggagataatgtatctatgattttagtaccatttaagacaatcgacctcgagtgggtcgtgagcgctattaccaccggcactatcagtcacacttacattcccgtgcccgcaaagatcagagtaaaacaagacaagattctgatctaccatccagcgttcataaagtatgttttcgataactggttgcagggacacgggaggtacccctcaaccggtatcctgagtgtgattttcagcatgcacgtctgcgacgaggtcgacctctacggattcggagctgacagcaaggggaactggcaccactattgggagaacaatccatccgctggagcgtttcggaagaccggcgtccatgatgcagactttgaatccaacgtgaccgctaccctggcctccattaacaaaatcagaatttttaaaggcagatag

SEQ ID NO: 33627 - DNA, 219 bp, Artificial Sequence
  Description of Artificial Sequence: Synthetic coding sequence
atggtcacactgaggaaaaggacgctaaaggtcctgacatttctggtgctcttcatcttcctaacatcatttttcctcaattactcccacaccatggtggcgactacatggttcccaaagcagatggtgctggagctgtccgagaacctcaaaagactcatcaaacataggccatgcacttgcactcactgtattgggcaacgcaaactgtccgcctag

SEQ ID NO: 33628 - DNA, 144 bp, Artificial Sequence
  Description of Artificial Sequence: Synthetic coding sequence
atggtgacgctgcgtaagcgaaccttgaaggtcttgaccttcctagttttatttatttttttaacatctttttttctgaattactctcacaccatggtggctaccacctggttccctaagcagatggtgttggaactatcatag

SEQ ID NO: 33629 - DNA, 1221 bp, Artificial Sequence
  Description of Artificial Sequence: Synthetic coding sequence
atgatacacacaaaccttaaaaagaaattttcttgctgcgtgctcgtgttcctgctttttgctgtgatctgcgtgtggaaagaaaagaaaaagggaagttactatgacagcttcaaattacagaccaaggagtttcaggtgttaaaatcattaggaaaactggcaatgggatctgattcacagtccgtgtcctcgtcatccacccaggatcctcaccgcggccgtcaaacgctcgggtccttgcgcggactggcgaaagcaaaaccagaggcctcctttcaggtttggaataaagatagctccagtaaaaatctaattcctcgcctccaaaagatctggaaaaactacttgagcatgaataagtacaaagtatcatacaaaggccctggtcccggcattaaattctccgccgaggctttacggtgtcacctgagggatcacgtgaatgtatctatggtggaggtcaccgattttccctttaatacatctgagtgggagggttacttgcctaaagaaagcattcggacgaaagcagggccatggggccggtgcgccgttgtgtcttctgccggctctttaaagtccagccagttggggcgagagattgacgaccatgacgccgtcctgagattcaacggcgcccctactgctaactttcagcaggacgttggcaccaagactacaattcgattaatgaattctcaacttgtgacaaccgagaaaagattcctgaaggactccctgtacaacgagggtatactcattgtctgggatccgtctgtgtaccatagcgacattccaaaatggtaccagaacccagattataatttctttaataattataaaacttatcgtaagctccaccccaaccagcctttttatattctgaaaccacagatgccctgggagctctgggatatcctacaggaaatttccccagaagagatccagcccaaccccccatcaagtggcatgctgggtatcataattatgatgaccttatgtgatcaggtggatatttatgagtttctgccaagcaaaaggaaaaccgatgtgtgctactattaccaaaagtttttcgattctgcctgcacaatgggagcctatcatcctttactgtacgagaagaatctggtaaaacacctgaatcaaggcaccgatgaggatatttatctgctcggaaaggctaccctgcccgggtttcgaactattcattgctag

SEQ ID NO: 33630 - DNA, 228 bp, Artificial Sequence
  Description of Artificial Sequence: Synthetic coding sequence
atgattcacaccaatttaaagaagaaattctcctgttgcgtgctagttttcctactgtttgccgttatttgtgtctggaaagaaaagaaaaaaggtagttactatgactcgtttaaactccagacaaaggaatttcaggtgcttaaatctctgggaaaactggctatgggatcagactcccaaagtgtttccagctcttctacacaggatccacaccgaggacggtag

SEQ ID NO: 33631 - DNA, 342 bp, Artificial Sequence
  Description of Artificial Sequence: Synthetic coding sequence
atgattcacactaatctaaagaaaaagtttagctgctgtgtgctcgtctttctgctcttcgcagtaatctgcgtgtggaaggaaaagaaaaaagggtcatactatgatagtttcaaacttcaaacaaaagagttccaggttctgaaatcccttgggaagttagcgatgggctctgactctcagagcgtaagttccagctcaactcaggacccacacagggggagacagaccctgggcagtctgcggggcctcgccaaggccaagccagaggcaagcttccaggtttggaacaaagattccagttcaaaaaatctcatacccaggctgcagaagatatggtag

SEQ ID NO: 33632 - DNA, 384 bp, Artificial Sequence
  Description of Artificial Sequence: Synthetic coding sequence
atgatccacacaaacctaaagaaaaaattttcctgctgtgtgctcgtttttctgttgtttgcggtgatatgcgtgtggaaagagaagaagaagggcagctactacgacagctttaagctccaaaccaaggagttccaggtactgaaaagtctgggaaagctagccatgggctcagactcccagtctgtgtcgtcctcttccactcaggaccctcacaggggccgccaaactttgggatcactgcgaggactggctaaggcaaagcccgaagccagtttccaagtatggaacaaggatagtagctccaaaaatttgatcccacggctgcaaaagatatggaaaaactacctgagtatgaacaagtataaggttagctacaaatag

SEQ ID NO: 33633 - DNA, 129 bp, Artificial Sequence
  Description of Artificial Sequence: Synthetic coding sequence
atgattcacactaatttaaagaagaagttttcatgctgtgtcttggttttcctgctattcgccgtcatctgtgtgtggaaggaaaagaaaaaggggtcttactacgactcattcaaactgcagacgtag

SEQ ID NO: 33634 - DNA, 294 bp, Artificial Sequence
  Description of Artificial Sequence: Synthetic coding sequence
atgatccacactaatctgaaaaagaagtttagctgctgcgtgctcgtgtttctactttttgccgtgatctgtgtttggaaagagaagaagaaaggaagttactatgacagtttcaagctgcagaccaaagagtttcaggtgctgaaatcattgggcaagctggccatgggctccgattctcaatctgtcagttcctctagcacccaggacccccatagaggacgacagacattgggtagcctgaggggcttagctaaggctaagccagaggcttcgttccaggtgtggaactag

SEQ ID NO: 33635 - DNA, 138 bp, Artificial Sequence
  Description of Artificial Sequence: Synthetic coding sequence
atgattcacacgaacttaaagaaaaagttttcctgctgcgttctcgtcttcctgctgtttgcagtgatatgcgtctggaaggagaagaaaaaaggctcctattatgatagcttcaaactgcaaaccaaggagttttag

SEQ ID NO: 33636 - DNA, 276 bp, Artificial Sequence
  Description of Artificial Sequence: Synthetic coding sequence
atgatacatactaaccttaaaaagaagttctcctgttgcgtcctagtgttcctgctctttgcagtaatttgtgtctggaaggagaaaaagaaaggttcctattacgacagcttcaagctccagacgaaggagtttcaggttttgaagagcttagggaaattagcaatggggagcgatagccaatctgtctctagttcctccactcaagatcctcacagaggcagacagactctcggttccctccgcgggctagccaaagccaagccagaagcctag

SEQ ID NO: 33637 - DNA, 1221 bp, Artificial Sequence
  Description of Artificial Sequence: Synthetic coding sequence
atgatacacactaatctgaagaagaaattttcgtgttgcgtgcttgtctttctgttgtttgctgtgatatgcgtctggaaagagaaaaagaagggttcttactacgattcgtttaaactccaaacaaaggaattccaggtgctaaagtctcttggcaaactagctatggggagcgacagccaatcagtgagctcctcctcaacacaagatcctcaccggggacgccaaacgttaggtagcctccgcgggctggccaaagctaaacctgaagcctctttccaggtctggaacaaggacagctcctcaaaaaaccttataccccgtctgcagaaaatctggaaaaactacctttccatgaacaaatacaaggtttcttataaagggccgggaccaggaataaagttttcggccgaggcccttcggtgtcacttaagagaccacgtcaatgtgtcaatggtggaggtgaccgacttcccgttcaacacaagtgaatgggagggctatctacctaaagagtcaataagaactaaggctggcccttgggggcggtgcgccgtcgtgtcatctgccggaagcctcaaatcatctcaactggggagggaaatagatgaccatgacgccgtgctccgcttcaacggcgctccaaccgcaaacttccagcaggacgtgggaaccaagactaccattagacttatgaattcccagttagttacaacagagaaaagattccttaaggatagtttatataacgagggcatcctaatcgtttgggatccgagcgtttaccactccgacattcccaaatggtatcaaaatcccgactacaatttctttaataactataagacttaccggaagctacaccccaatcagcccttttacattctgaaaccccaaatgccctgggaactgtgggatatcctgcaggaaatttcacctgaggaaattcagccgaacccaccatcatccgggatgctcggtattatcattatgatgaccctgtgtgatcaggtggacatttacgaattcttaccctccaagcggaagaccgacgtttgctactattaccagaaatttttcgactccgcatgcactatgggagcataccatccattgctgtacgagaagaatctagtaaaacatcttaatcagggaaccgatgaagatatttacctgctaggcaaggctacgctcccaggtttccgcacgattcactgttag

SEQ ID NO: 33638 - DNA, 297 bp, Artificial Sequence
  Description of Artificial Sequence: Synthetic coding sequence
atgatccatactaacctgaagaagaagttctcctgctgtgtgctggtctttctcttgttcgcagtgatctgtgtatggaaggaaaaaaagaaaggatcttactacgattcctttaagcttcagaccaaagaatttcaagtcctgaaatctctcggaaaactcgcgatgggatccgatagtcagagcgtgtcatcatccagcactcaggacccacaccgcgggcgccaaaccctcggcagcctgcgtggccttgccaaagccaaacctgaggcgtctttccaggtttggaataaatag

SEQ ID NO: 33639 - DNA, 528 bp, Artificial Sequence
  Description of Artificial Sequence: Synthetic coding sequence
atgaattctcaacttgttactaccgaaaaacgctttctgaaggattctctctataatgaaggcatcctgattgtgtgggatcccagcgtctaccactccgatatacccaagtggtaccagaaccccgactacaatttttttaacaattacaagacctaccgaaaactgcacccaaatcagcccttctacatcctcaagccccaaatgccctgggaactttgggatatcctacaggagatctcccctgaggaaattcagccgaaccctccgagtagtggcatgctgggcattataatcatgatgacactgtgtgatcaagttgatatctacgagttcctgccttcaaagagaaaaactgacgtgtgctactattaccaaaagtttttcgattcagcctgcaccatgggggcataccaccccttgctgtacgagaagaatctggtcaagcatctgaatcagggcactgatgaggacatttaccttcttggcaaggccactcttcccggcttccgcaccatccattgctag

SEQ ID NO: 33640 - DNA, 78 bp, Artificial Sequence
  Description of Artificial Sequence: Synthetic coding sequence
atgattcatacaaacttgaaaaaaaagtttagttgctgcgtgcttgtgttcctcctcttcgccgtgatctgcgtctag

SEQ ID NO: 33641 - DNA, 876 bp, Artificial Sequence
  Description of Artificial Sequence: Synthetic coding sequence
atggaaaagctggcagccagtactgagccccagggccctagacctgtgctcggccgggagtcagtccaggttcccgacgatcaggacttcaggtcttttcggtcagagtgtgaagctgaagtgggatggaacctgacctatagccgcgcaggcgtgtcagtgtgggtccaggccgtggagatggatcgcacgttgcacaaaataaagtgtaggatggagtgttgtgacgtgcctgcagaaacactgtacgacgtacttcacgacatagagtaccgcaaaaagtgggattcgaacgttattgagaccttcgatatagccagacttactgtgaatgctgatgtgggatactactcctggagatgtcccaaacctctgaagaaccgggacgttatcactttgcgctcttggctgccaatgggcgcagattacattatcatgaattactccgttaagcatcccaagtacccccccagaaaggatctcgtgagggctgtttccatccagacaggatatctgattcagtctacaggccctaaaagttgtgtgattacttatctggctcaggtcgaccccaaaggatccctccccaaatgggtggtgaacaagtcttctcaattcttggcccctaaggcgatgaagaaaatgtataaggcatgcctgaaatatccggagtggaaacagaaacacctgccccacttcaagccatggctgcatcctgaacagagcccattgccatccctcgctctctctgaactcagcgttcagcacgcggacagcttagagaacatcgacgagtctgctgtagcagagtcacgagaggagcggatgggtggggccggaggtgagggaagtgatgacgatacttctctgacatag

SEQ ID NO: 33642 - DNA, 270 bp, Artificial Sequence
  Description of Artificial Sequence: Synthetic coding sequence
atggagaaacttgcagcctcgacagaaccccaaggcccacgcccggttctgggcagggagtccgtgcaggtgcctgatgatcaggacttccgctccttcagatccgagtgtgaagctgaagttggctggaacctgacttattctcgggctggcgtcagcgtctgggtgcaagcggtagagatggataggacactgcataaaataaagtgcagaatggaatgctgcgacgttcctgctgaaacattatatgatgtcctgcatgacatttag

SEQ ID NO: 33643 - DNA, 759 bp, Artificial Sequence
  Description of Artificial Sequence: Synthetic coding sequence
atggagaagctggctgcatcaactgagccacaaggtccacggcctgtgctaggaagggaatcagttcaggtgcccgacgaccaagatttccgatccttcaggtcagagtgtgaggctgaggtgggttggaacctgacctattccagagctggagtgagcgtgtgggtccaggccgtagagatggatagaactctgcataaaatcaaatgcagaatggagtgctgcgacgtacctgccgaaactctgtatgatgtgctgcatgatatagagtacaggaagaaatgggacagtaacgtgattgaaaccttcgacattgccagactgactgtcaatgccgacgtgggctattatagctggcggtgcccaaagcctttaaagaatcgtgacgtgattacacttaggtcttggctacccatgggggccgactatatcattatgaactactcagtgaaacacccaaagtaccccccccggaaggatcttgtgagggccgtgagtattcagacagggtatcttatacagtctaccggacccaagtcctgtgtgattacctatctggcacaggtagatcccaaaggttccctcccgaaatgggtggtgaacaaatcttctcaatttctcgcccctaaagcaatgaaaaagatgtacaaagcatgtctgaagtaccctgagtggaagcagaaacacctgcctcactttaaaccttggctgcatcccgaacaatcgcccctccccagcctggccctgtccgagctgtag

SEQ ID NO: 33644 - DNA, 39 bp, Artificial Sequence
  Description of Artificial Sequence: Synthetic coding sequence
atggaaaagctggccgctagcacagaacctcagggctag

SEQ ID NO: 33645 - DNA, 576 bp, Artificial Sequence
  Description of Artificial Sequence: Synthetic coding sequence
atggagaaactcgccgccagcactgagccacagggaccccgcccggtgctgggcagagaaagcgtgcaggtccccgacgatcaggattttcgctcttttcggtctgagtgcgaggcggaagttggctggaacctgacatactcacgtgccggggtcagcgtctgggtgcaggccgtggagatggacaggactctccataagattaaatgtcgtatggagtgttgtgacgtgcccgccgaaaccctgtacgatgtgctgcacgacatcgagtatcgaaagaagtgggactcgaacgtgatcgaaacattcgacattgctagactgactgttaatgcagatgtcgggtattactcctggagatgccccaaaccactgaaaaaccgagatgtgattaccctgcgctcctggctccctatgggcgccgattatatcataatgaactactcggtcaagcatccaaaatatccaccaagaaaggatttagttagggccgtgtcaattcagactggttacctaatccagtctacaggccctaaaagctgtgttatcacatatctggcccaggtggatccttag

SEQ ID NO: 33646 - DNA, 876 bp, Artificial Sequence
  Description of Artificial Sequence: Synthetic coding sequence
atggagaaactggccgccagcacagagccgcaaggtcctagacctgttctaggtagggagtccgtgcaggtgccggacgatcaggactttaggtcatttcggagcgaatgcgaggctgaagtggggtggaatctgacctacagtcgcgcaggcgtttcagtgtgggtgcaggctgtggagatggatcgcacattgcacaaaataaagtgtaggatggagtgctgcgacgtgccggctgagacgttgtatgatgtgcttcatgatattgaatacagaaagaagtgggattccaacgtaatcgaaacattcgacatagcgaggctcaccgttaacgccgacgtgggttactactcctggcggtgccctaagccactgaaaaatagagacgtgatcactctgagatcctggctgcccatgggagccgactacatcattatgaattatagtgtcaagcatcccaagtatccccccaggaaggacctggtgcgggctgtgagcatccagaccggctacctaatccagagtactggccctaaaagctgtgtgatcacatacctggctcaggtggatcctaagggctccctgcccaaatgggtggtcaacaaatcatctcagtttcttgctcctaaagctatgaaaaaaatgtataaagcatgcctcaagtacccagagtggaagcaaaaacaccttccacactttaagccctggctccaccctgagcaatcaccccttccctctctcgccctgtcagagctctcggtgcaacatgccgatagcctggaaaacatcgacgagagcgccgtggctgaaagcagagaagagcgcatggggggcgcagggggcgaaggctccgacgacgacacttctctgacctag

SEQ ID NO: 33647 - DNA, 417 bp, Artificial Sequence
  Description of Artificial Sequence: Synthetic coding sequence
atggaaaaactggctgctagcactgaaccacagggcccccgtcctgtactgggcagagaatcagtccaggtaccagatgaccaggacttccgctcgtttagatctgagtgtgaggccgaagttggatggaacctgacctattccagagccggggtgagtgtatgggtgcaggcggtcgagatggatcgaacgctgcacaagataaagtgccggatggaatgttgcgacgtgccagctgagaccctgtatgatgtacttcacgacatcgagtaccgtaagaagtgggattctaatgtcatcgaaaccttcgatatcgctagattgaccgtcaacgcagacgtagggtattacagttggaggtgcccaaaacccttgaagaaccgggatgtgataactcttaggtcgtggctgccttag

SEQ ID NO: 33648 - DNA, 14103 bp, Artificial Sequence
  Description of Artificial Sequence: Synthetic coding sequence
atggccaatgtgcaggtggcagttcgtgtgaggcctttgagcaagagggaaacgaaggaggggggtcggatcatcgtcgaagtggacgggaaggttgctaaaattaggaatctaaaggttgacaaccggcctgacgggttcggggatagccgcgagaaggtcatggcctttgggttcgactactgttactggtctgtgaatcccgaagatccacagtatgcctcccaggatgttgtgttccaggaccttggaatggaagtactgtcaggggttgccaagggctacaacatctgcttgttcgcatacgggcagactggttcaggcaaaacttataccatgctgggaaccccggcctctgtcgggctgactccgagaatatgtgagggattgtttgtgagggagaaggattgcgccagcctaccaagctcctgcaggattaaagtatctttcttggaaatttacaacgaaagagtccgggatctgctcaagcaatccggacaaaagaagtcctacacactgcgcgtccgcgagcaccccgaaatggggccgtacgtgcagggattgagccagcacgttgtgaccaactacaagcaggtgatccagttgctggaggaagggatcgccaataggatcacggctgcaactcacgtgcacgaggccagctcgcgctcacacgcgattttcaccatacactacactcaggctattctggaaaacaacttacccagcgagatggcctctaagattaacctggtcgacctggctggctccgagagggccgatccatcgtattgcaaagaccgaatcgcagagggcgccaacataaacaagtcactcgtgactctcggtatcgtcatcagcaccctggcccagaactcacaagtgttcagtagctgtcagagtctcaattcctcagtttcgaatggcggcgattcagggattttgtcaagcccatctggtacaagctctggcggcgcaccgtctcggcgccagtcctatattccgtaccgcgattctgtactgacttggcttctcaaagactctttgggtggcaatagcaaaacaatcatggtcgccaccgtcagtccggctcacactagctacagtgagaccatgagcacgttgcgctacgctagcagtgccaagaacatcattaataagcctcgtgtgaatgaagacgccaatctcaagctcattagggaactgcgggaagagatagagcgcctaaaggccctgctgctgagttttgagctgcggaatttctcttcactctccgatgaaaaccttaaagaactggtattgcagaacgaattgaagatcgaccaattaaccaaggactggacacagaaatggaacgactggcaagctttgatggaacattattccgtggacattaacaggcgccgggcaggtgtggtgatagactcatccttgcctcacctcatggcactggaagacgatgtcttatccaccggcgtggttctgtaccaccttaaagagggcaccactaaaataggccggattgacagcgatcaggagcaggatattgtgctacaaggccaatggattgaaagggaccattgtacaattacctccgcatgtggagtggttgtcctaagacccgcccgcggtgcacggtgtacagtgaacggcagagaggtgacagcatcctgtcgactgacacagggggccgtgattaccctcggtaaagcgcagaagtttaggtttaaccacccagcagaggcagctgttttacggcagagacgacaggtcggggaagccgctgcagggcgcggatccctagagtggctggatctggacggtgatcttgcagcctcccggcttggattgtctcctcttttatggaaggagcgtcgtgcactggaggaacagtgcgatgaggaccatcagacacctcgagacggagagacgagccatagagcccagatacagcaacagcaaagttacgtggaagatctgcgccaccagatactggctgaagaaataagggctgccaaggaattggaattcgatcaggcttggatttcgcaacagataaaagaaaaccagcaatgcctactgcgggaggagacctggttggcctccctgcagcagcagcaacaggaggatcaggtggcggagaaggagctcgaggcatcagtagcgctggacgcctggttgcaaaccgaccctgagatccagccctctcctttcgtgcagagtcagaagagggttgtacatctccagctcctgcggcgtcacactctgcgcgcagctgaacggaacgtacggcgtaaaaaggtgtcctttcagcttgagcgcattatcaagaagcagcgactccttgaggcccagaaacgactggaaaagttaaccacactgtgctggctccaggacgactccactcaagagcccccataccaggtcctttctcccgatgcaaccgtgccaaggcccccatgtcggtccaagttaaccagttgctcttcactcagcccccagcgtttgtgtagtaaacatatgccgcagttgcattcaatcttcctgagctgggacccctccactacccttccgccgagacctgatccaacccaccaaacctccgagaagacaagttctgaagagcacctcccccaggctgccagctatcccgcacgcaccgggtgcttgagaaaaaacggtctgcactccagcgggcatggccagccttgcactgcaagggccgcactggcaaggaagggcgcctctgctcccgatgcctgcttaaccatgtccccgaatagcgtgggcatccaggagatggagatgggggtgaaacagcctcatcagatggtcagccagggactggcatccctgcggaaatcggctaacaaactcaaacccaggcacgaacctaaaatcttcacatcaaccactcagaccaggggagccaagggccttgccgatcctagccacacgcaggcaggttggcgaaaagaaggcaatctgggcacgcataaggcagctaaaggcgcctcttgtaattccttgtatccacacggcccccggcagactgcagggcacggcaaagccgtgaaaaccttctggacagagtataagcctccctcgccatctagggcttctaaaaggcatcagcgcgtgttggctacccgtgtcagaaacatcacaaaaaagtcttcgcacctgcccctcggatctcccctgaagcgacagcaaaatactcgcgatccagacacaatggtgccactcacagatttttcaccagtcatggatcattctagggagaaggataacgatctgtccgacaccgactccaattacagcctggacagcctgtcttgcgtgtacgcaaaagccctgatcgaacccctgaagcctgaggaacggaagtgggattttcctgagccggagaactccgaaagcgacgactcacagctgagtgaagactcgctagcagagaaaagatatcagtctcccaaaaaccggctggggggaaataggccaactaataatagagggcagccccggaccaggacgagagcatcggtaaggggattcactgcagccagcgattcagacttactcgctcagacccacagatccttcagcctggatagccttatagacgctgaagaagagcttggcgaagaccagcaagaggaacctttccctgggtcggctgatgagatcccaacggagactttctggcacttagaggatagtagtctgcccgtgatggatcaagaggcaatttgcaggcttgggccgataaattaccggacagctgcgcgtctggacgccgttctgccgatgagtagcagcttctaccttgacccccagtttcagcctcactgcgaattacagccccactgtgagctgcaaccacattgcgagctccaacctcactgtgagcaggcggaaagtcaggtcgagcctagttacagtgagcaggctgactcccttcagggaatgcaactcagtagagagtccccgctaatgtcgatggattcgtggttcagttgcgattccaaaataaatccaagcagtccacccggcattgtgggttctctgtgtccctccccggatatgcaggagtttcacagctgcaagggagaacgaccaggctactggcccaatactgaggagcttaagccaagcgatgccgaaaccgtgcttccatatagctccaaactgcaccagggttctacagagttactgtgttcagcgcgggacgaacacacagcgtccgccgcggatacctccagattatcactgtggggcattcagcgcctgatccagccaggtgctgatggcacctttcagggcaggtgcattcctgatatgactcaacaaggaagcagtgaggcatcccataatagttcagtctctaacgtgctggcagcaagtgccacgaccctgactcacgtgggtagcactcacgagagagattggtctgctctccaacagaaatacctccttgagctgtcctgtcctgtgctggaggccatcggggcgccgaaacctgcatacccctatctcgaagaggattccggctctcttgctcaggccagctccaaaggaggcgataccctcctgcctgtcggaccaagagtctcctctaatctgaacctcaacaacttccctgtgcatctgtctcggattaggcgactgcgggctgagaaagagcaggacagcctgaatgccaagctggaaggcgtgagtgacttcttctctactagtgagaaggaggccagctatgacgagacttacagcgctgatctcgaaagcctgtccgcgtcacgctcaaccaacgcccaggtcttcgccacagaaaacgctatccctgattctatgactgaggcatgcgaggtcaaacagaacaatctcgaggagtgcctgcagagctgccgcaaacctggactgatgacatcttcagacgaggatttttttcaaaagaatgcgtgccattcgaacgttaccaccgctactaaggcggatcattggtcacagggatgggcgcccctgagaaaaaatagtgcagtgcagcctgggcagttatcccctgacagccactatcctctggaggaagaaaaaaccgactgccaggagtcaagtaaagaagccgtgcgtagacatattaacgtatcctttgcattaccttcaggccccgaactctacctccatagcgcaccgtggaaccccctctcctccagcttacagccacccctgctcgagacgttctacgtcacgaagagtcgggatgctctcacagaaactgccctggagatccccgcctgccgagaagttcgggtacctagccctcccccacgggaggcctggggcttcggacacaaccatcaagctctgcaaggtgcctacttgaaaaataaccttcctgtgcttctgcagaaccagaattccaaaatagcgtctagccaacaggtaactgcagagatcccagtcgatttgaacacccgggaggtaattagagaaagcgggaagtgccctggaaacataacagaggagtcgcacgacagtgtgtactcatcagtgacccagaataggcacttcctgccatccactagcaccaaggtctgtgaatttgagaaccaggtggtgatattaaacaaaaaacactcctttcccgccctcgagggtggcgaggtgacagcacagagctgctgcggcgcatcttcagacagcacagagagcgggaaaagcctattgttccgggaatctgaggctagagaggaagaagagctggatcagaacacagtgctgaggcagacaattaatgtttcgttggagaaggatatgcctggcgagtcagcagtatcgctgaagagtcggagcgttgataggcgggtctcatccccagtgatggtggctcagggaggcggaccaacccccaaatgggaaggaaaaaatgaaaccggccttctagagaagggactgcgccccaaggattccagcgaagaatttaaactccccggtacgaagcccgcttacgagcgctttcaactggtcgcatgcccacaggaacggaatcccagtgagtgcaaatcccaggaaatgttgaaccctaaccgggagccctcaggaaaaaagcagaataagcgagtgaacaacactgacgaaatggcccggctgatccgcagtgtgatgcaactggagaatggtatactggaaatcgaaagtaaacagaataagcaagtgcacgcgtcccacacccctggtactgataaggagctcgtctttcaagatcagaaggagcaggagaaaacagatcacgcttttcgacctgattcttctggaaacccccttcccagcaaggaccagccctccagccctcggcagacagatgacacagtgttccgcgatagcgaggccggggctatggaggtgaatagcataggaaatcatcctcaggtacagaaaatcactcctaaccccttccggtcacgggaaggcgtccgagagagcgaacctgtgcgggaacatacacaccccgccggaagcgatagaccagctcgagacatttgcgactctttggggaaacacactacctgcagggaatttacaaacacgtcgctgcatccccagcgtatgaaggccctcgcgcgggctcttccacttcagccgaggctcgaacgctcctccaagaacaatggtcagtttgtgaaggcaagcgcctctctaaaaggacagccttggggcctggggagtctggaggaattggaaacagtgaaagggtttcaagagagccaagtcgcggagcatgtctcctcttccaatcaggaggaaccgaaagcccaggggaaggtcgaggaaatgccaatgcagcgcggagggagcctgcaagaagagaataaagttacccagaagttcccaagtctaagtcagctctgcagagacacatttttcaggcaagaaactgtatcgcccctcctgtcaagaacagaattttgtaccgccccattgcaccaggatctgtctaataccttgcccttaaacagtcctagatggccacgcagatgcctgcacgtgccagtggctctaggcatttcctctctagattgcgtgctcgatctcaccatgctgaaaatccacaatagccctttagttacaggagtggaacaccaggatcagtctacagagactcgaagtcacagccctgaagggaacgtccgtggacggtcatcagaagcccacactgcctggtgcggaagtgtgcgtagtatggccatgggctcacacagccagtccggagtgccagagtcaatcccgctgggcaccgaggaccgcattagcgccagcacttcaccccaggaccacggtaaggacctcaggattacgttattgggattcagtacctcagaagacttcgcctctgaggcagaggtggccgtgcagaaagagattcgcgtgtcatcactcaataaagtgtctagtcagccagagaaacgagtgtccttcagtctcgaggaagattctgatcaggcctcgaaaccccggcagaaagcggagaaggaaacagaggacgtagggctgacctccggcgtgagtttagccccggtcagtctgcctagagtgccttcccccgagcctcgcctgttggaaccttccgatcatgcttcaatgtgcttggctatcctcgaggaaattcggcaggcgaaggcgcagaggaaacagttgcacgacttcgttgcacgggggactgtgctttcatactgcgagacactgctggaaccagagtgtagttcaagggtggcaggacggccacagtgcaagcaaatagaccagtcatcttcagaccaaacacggaacgagggggaggccccaggcttccatgtagcctctctttcagcagaagctggccagatcgacctgcttcccgacgagaggaaggtgcaggccacgtccctgagcgcagacagttttgaatccctacccaacacagagaccgacagagagccctgggacccagttcaagccttctctcatgccgcaccggcccaggaccgcaagcggcgcacaggcgaactgagacagttcgcaggagcatcagagccctttatatgccactcctcttcttccgagataattgagaaaaagaaggacgcaacacgcaccccaagttccgccgaccccctggcccccgacagcccccggtcatcggcgccagtggaagaggtgcgacgcgtggtctcaaaaaaggtggtagctgcgctaccttcccaggcaccctatgatgatcctcgtgtgacccttcacgagctgtctcagtccgtgcctcaagaaactgcagagggcatcccccctggttcgcaggacagtagccctgagcaccaggaaccccgcaccctggacactacatacggagaggtctctgacaacctcctggtcacagctcagggggaaaagaccgctcactttgagagccagtccgtgacttgcgacgtccaaaatagtacttccgcatccggccccaaacaggatcacgtacaatgccccgaggccagcaccggctttgaggagggtcgagcctcacctaagcaggacaccatccttcccggggcacttacgcgcgtcgcgttggaagcccccacccaacaatgcgtgcaatgcaaggaatctgtcggctcaggccttactgaggtatgtcgagcaggctccaaacactctagacctatccctctgcccgatcagagaccctcggccaaccccggcggaataggggaggaagcgccctgccgtcacccacgcgaggcgttggacggaccggtgttcagtaggaaccccgaggggtctcgcaccttaagtccctcgcgaggaaaggagtcccggacacttccctgccgtcagccatgcagctcccagccggtggccacccacgcttactcctctcattcttctaccctactctgttttcgcgatggagatctgggtaaagagccgttcaaagcagccccacacaccattcaccctccgtgcgtcgtcccatcgcgggcttatgaaatggacgaaaccggcgagattagtaggggtcctgatgtgcatttaacacatggtcttgagccaaaagacgttaatagggagttccgactgaccgaatcttctacttgtgagccctccacagtggctgctgtgttgagcagagcccaggggtgtcgatccccaagtgccccagacgtgaggactgggtcattctctcactccgccaccgatggttctgttggattaattggagtgcccgagaaaaaggttgccgaaaagcaggcatcgaccgagttagaggcagcctccttccctgcaggcatgtactcagagcccttaagacagttcagagacagctccgtaggagatcagaatgcacaggtgtgtcagaccaatccagagccgccggccactactcaggggccccacaccttagacctgagcgagggaagtgcagaatctaagctggtggtcgagccgcagcatgagtgcctggaaaacaccactcgctgctttctcgagaagccccaattttccacagagctgcgcgaccataatcgcttagacagccaggccaagtttgtggcgagactgaagcacacatgctccccacaggaagactctccctggcaggaggaggagcagcatagggaccaggccagtggtggtggcgaaggctttgcccagggcgttaaccccctgcccgatgaggatggtctcgacgggtgccagatcttggatgcgggccgcgaagaggtcgccgtcgccaagcctccagtgtctaaaattctgtcgcagggcttcaaggatcccgctaccgtttcattgagacagaatgagaccccgcagcctgcagcccagaggagcggtcacctgtatacaggtcgagaacagccagcccccaaccaccgtgggtctctgccagtgaccacgattttctctggcccgaaacattctaggtcctccccaactccgcagttcagcgtcgtcggaagctccaggagtctccaagagttaaacctgagcgtcgagcctccctctcctactgacgaggacacccagggcccaaatcgcctgtggaatcctcatctgcgggggtactcaagtgggaaaagtgtggcaagaacctccttacaggcggaagactccaaccagaaagctagttccagactcgacgacggaaccactgaccaccgccatcttaaaccagccacaccaccatatccgatgccaagcacactcagtcatatgcccactcccgacttcaccacaagctggatgagtggtacactagagcaagcccagcagggcaagagggagaaattaggagttcaggtgcgccccgagaactggtgcagccagatggataaaggcatgctgcatttcgggagtagcgatatttctccttatgccctgccctggcggcctgaggaacctgccaggatatcctggaaacagtacatgagcggcagcgccgttgacgtgtcttgttctcagaagccacaggggctgactctctcaaacgtggccaggtgtagctccatggataacggattggaggaccagaattccccgtttcatagccatctgagtacctatgccaatatctgtgacctgtccactactcattcctccacagagaatgcccagggatctaacgaggcatgggaggtgtttagaggcagtagcagtattgccttgggcgacccccacatacctacgtcacctgagggagtggcacccaccagtggacacgatcgtcgcccccagttccgaggccctagcggagaagcagactgtttgaggtcaaagcctccgttagccaaaggctcagctgctggacccgttgacgagatcatgctcctgtaccccagcgaggccggatgccctgttggacaaactcgcacaaatacattcgaacagggcacccagacgctcggatctcgtcggcactggtccagcacggatattagctttgcccagcccgaagcctcagctgtcagcgccttcgacctggcttcttggacttccatgcacaacctttcacttcatttgtcccagctgctccactcgacaagcgagctgctgggatcattgtcacagcctgacgttgcacggagggagcagaacacaaagagggacatacccgacaaggccccccaggcccttatgatggacggatcaacacagaccactgtggatgagggaagccagacggacctgacgcttccgactctatgcttacagacctcggaagccgaacctcagggtgccaatgttattctggagggccttgggtccgacaccagcactgtgagccaggaggaaggggatgtcccaggcgttccccaaaaacgagaagccgaagaaacggcccagaaaatggcacagctgttgtatctgcaggaggaatctacaccctataaaccccagagcccttccatccccagctcccatctgagatttcagaaggctccagtgggacaacatctgccttcagtaagcccatctgtctccgacgccttcctgccaccgtctagccagccagaggaatcgtactgtctagtagtttctagcccatccccaagttccccacacagcccaggtctgttccctagcacctctgaatacccaggcgattcacgggtgcagaaaaagctgggaccaacatctgccctttttgtggacagggccagctccccgattctcacacttagcgccagtacgcaagaacctgggctgagtccagggtccctcactcttagtgctccttcaactcaccccgtggagggccatcaaaagctggactccagtcctgacccggtggacgctccccgcacaccaatggataattactcacaaaccacagacgaactaggcggaagccaacggggtcggagttctcttcagcgctccaatggccggagcttccttgagctgcacagtcctcactcccctcagcagtcacccaaactgcaattctcgttcctgggacaacacccacagcaacttcaacctcgtaccacaatcggggtacagtccaggttactgccgcctcctctaagacatcgttcgcagagattaggcaacagcttcgttcctgaaaaggttgcatcccctgaacactgtccactgtctggcagagagcctagtcagtggcaatctcgaacggagaacggtggcgaaagctccgcctcaccaggtgagcctcagcggacactggatagaccatcctcttggggcggccttcagcatctttcaccctgccccgtgagtgagctgactgataccgcaggcctgagagggagcgctctgggtttacctcaggcctgccagcctgaagagttgctgtgcttttcctgtcagatgtgcatggctccagaacatcagcaccatagcttgagggacctgcccgttcacaataagttcagcaactggtgcggcgtccagaaaggtagtcccggcgggttggatatgacggaagaggagctgggagcctccggagacctgtcttcagagaagcaggaacagagcccaccacagccgccgaacgaccactcccaggactcagagtggtcaaagcgagagcagattcctctgcaggtgggggcccagaatctctccctctctgtcgagcttacagaagccaagctccaccatgggtttggggaggcggacgctttgctgcaggtcctccaatccgggacaggagaggccctggccgccgacgaaccggtcactagtacctggaaggaactctacgcacgccagaagaaggccatcgagaccctgaggagggagcgggcagagagactcggtaatttctgtcggactcggtctctctccccacagaaacagctgtccctccttcctaataaagacctgtttatctgggacctggacctgccttctagaagaagagagtatctacagcagctcaggaaagacgtcgttgagacaacacgcagtcctgagagcgtgagccggagtgcgcacaccccatcagacatcgaattgatgctgcaggactatcaacaggcccacgaagaggccaaagtcgagattgcaagagctcgtgaccaactgagggaacgaacggaacaggagaaattaagaattcatcagaaaataatctcgcagctcttgaaggaagaagacaagctccacaccctcgccaactcctcaagcctgtgtacatccagcaacggttccctgtcgtccggcatgacttccggctacaattccagtcccgcccttagtgggcagctgcaattcccagaaaacatgggtcataccaacttacctgactcaagagacgtgtggattggtgatgaaagaggaggacactcagccgtgcggaaaaacagtgcatacagtcacagagcctccctggggtcctgttgctgttctccatcctcattgtcaagcctcgggacatgcttctcctcctcctaccaagacctggcgaagcatgtcgtggatacttcaatggccgacgtgatggcagcctgctccgacaacctgcataatctgttttcatgccaggccacagctggctggaattatcagggggaggagcaggccgtgcaactgtactacaaggtgttcagtccaacccgccacggctttctcggcgccggggtggtttcgcagcccctgtctagagtctgggctgcagtctcagatcccaccgtatggcccttatactacaagcctattcagactgcgaggcttcatcagagagtaaccaactcaatttcactcgtatacctagtgtgcaacaccactctctgtgcactgaaacagccaagagatttctgttgtgtctgtgtggaggccaaggaaggccatttgtccgtcatggctgcccaatccgtgtatgatacttccatgccccgcccctctcggaaaatggtcagaggtgagattctgcctagcgcttggatcctgcagcccattaccgttgaaggcaaggaggtgacacgagtcatctacctggcacaggttgagctgggagcacctgggtttccaccacaactgttgtctagcttcataaagaggcagcctttggtaatagctcgtttggcctcctttttgggccgttag

SEQ ID NO: 33649 - DNA, 570 bp, Artificial Sequence
  Description of Artificial Sequence: Synthetic coding sequence
atgacccttgcagcctacaaagaaaagatgaaggaacttcccctagtctccctcttctgttcttgcttcctcgctgatcctctaaacaaatccagctacaagtacgaagccgacaccgtagacctgaactggtgcgtgatctccgatatggaggttatcgaactcaacaaatgtacttctggccagagttttgaagtaatacttaagcccccctcattcgacggagtgcccgagttcaacgcatccctacctcgccgccgcgacccatctctggaggagattcaaaaaaagctggaggcagccgaggagagaagaaagtaccaggaagctgaactgctcaaacatctggccgagaaaagagagcacgagagggaggtgattcagaaggcaatcgaagaaaataacaacttcataaaaatggctaaggaaaagctggcacaaaagatggagtcgaacaaggaaaacagagaggctcacctggctgctatgctggagcgactgcaggagaaagacaagcatgccgaagaggtaaggaagaataaggaattaaaggaggaggcatctaggtag

SEQ ID NO: 33650 - DNA, 651 bp, Artificial Sequence
  Description of Artificial Sequence: Synthetic coding sequence
atgacactcgcagcttacaaggagaagatgaaggagttacctctcgtaagtctgttttgtagttgcttcctcgcagacccacttaacaagagctcgtacaagtacgaaggctggtgcgggcgccagtgtaggcgaaaagacgaatcccagcggaaggatagcgcggactggcgggagcgaagggctcaggctgacacagtggatctcaactggtgcgtcattagcgatatggaagttattgagttaaacaagtgcacctctgggcaatcatttgaggtgatcctgaagcctccatccttcgatggggtcccagaatttaatgcctccctgccgaggcgcagggacccatctttagaggagatccagaagaagctggaagctgccgaggagcggcgtaaataccaagaggctgaactgctgaaacatctggccgagaaacgcgagcacgaacgcgaggtgatacagaaggctattgaggagaataacaattttataaaaatggccaaggagaagctggcccagaagatggagtcaaataaggaaaatcgagaagcgcatctcgcagcaatgctggaacgactgcaggagaaggacaagcatgccgaggaggtaagaaagaataaagaactcaaagaggaagcttcccggtag

SEQ ID NO: 33651 - DNA, 945 bp, Artificial Sequence
  Description of Artificial Sequence: Synthetic coding sequence
atgtctttcttggtatctaagcctgaacgcataagaaccaatgatgcctcatctgaatctatcgccagcttcagtaagcaagaggttatgagcagcttccttccagaaggagggtgctatgaactgcttaccgtcattggtaaggggttcgaggatcttatgacagtgaacttggcacggtataagccgactggcgaatacgtcacagtgcgacgcatcaatctcgaggcctgctccaatgagatggttacctttctacagggcgaactccatgtctctaagttgttcaatcaccccaacatcgtgccatatagggccactttcatcgcagacaatgaattatgggttgttacgtcatttatggcttacggttccgcaaaggacttgatctgcacacattttatggacgggatgaatgagttggctatcgcgtatatacttcaaggtgttctgaaagcgctcgattatattcatcacatgggttatgttcaccggtccgtgaaggcttctcatatcctgatttcggtcgatgggaaggtgtacctctcaggccttcgctccaacctgagcatgatcagccacggccagcgacaacgtgtggtgcacgatttcccaaaatattccgttaaagtgctaccttggctgtcccccgaggtgctccagcagaatctccagggatacgacgccaagtccgacatttatagcgtaggaatcactgcatgtgagctggccaatgggcacgtaccgtttaaggacatgcccgccacgcagatgctacttgaaaagctgaatggaaccgtgccttgcctcctcgacactagcacgattccggccgaggagctcacaatgagtccatctcgttcagtagcaaactccggactgagcgactctcttaccacttcaacccctagaccctcgaacggacccgtgcccgcccccagctag

SEQ ID NO: 33652 - DNA, 2073 bp, Artificial Sequence
  Description of Artificial Sequence: Synthetic coding sequence
atgggggctgttgcgcgcgcccatgggggtctcagggttgccagagcacgcgagagcgtggctggaggccgtcataggggagcgggccgcccaggagcccgcgccgccggtgcagcagcgggcctcgttagggccgaggccgggggccgccgagcagggagagggcgccgccccggtagaggacttccaacaggtggaggaggcctagccgctgctgccgtgggacgcgaggtggcccaggggctgtgcgatgccatcaggctggatggaggtctggatctgttgctccggctccttcaggcccctgaattggagacacgagtgcaagctgcacggcttctggaacagatcctcgtggcagaaaacagggaccgcgtggccagaattggcctcggtgtgattcttaacctggctaaggagcgcgaacctgtggagctggctcggagtggctccggcatcctggagcatatgtttaagcactccgaagaaacgtgccagaggctcgtggcggccggcggtctagacgcggtgctgtactggtgcagaaggactgatcctgctcttttgcggcattgtgcccttgctctcggaaattgtgccctccatggcgggcaggccgtccaaagaaggatggtggaaaagcgggctgctgagtggttattcccactggctttctccaaggaagatgaactgctgagtctgcatgcgtgtttggccgtggcagtgctggctacgaataaagaagtggaacgcgaagttgaacgcagtggtacattggcactggtcgagccactcgttgccagcctcgatcctggacgcttcgcccggtgtctggtggacgcgtcagacactagtcagggccgggggcctgatgacctgcagcgtctcgtccctttgcttgactctaaccgcctggaggcacagtgcattggggccttttatctctgtgcagaagcagctatcaaatcccttcaggggaagacgaaggttttttccgatattggtgctatccaatcacttaagcggttggtatcttacagtaccaacggaaccaagtctgcactggcgaaaagagctttgagactactcggcgaagaggttccccgaccaattctgcctagtgtgcctagttggaaagaagcagaggtgcagacttggctccagcagataggattctctaaatattgtgaaagtttccgcgagcaacaggtcgacggcgacctgcttctcagactgaccgaggaggaactccagaccgacctggggatgaaatccggcattacaaggaaacggttcttccgagaactgacagaattgaaaactttcgccaactactctacctgtgacaggtctaatctcgcagattggctcggatctctggatccacgcttccggcaatatacctatgggcttgtctcatgcgggctggacaggagcctgctacacagagttagcgaacagcagctgcttgaagattgtgggatccatttgggggttcatagagcacggattctgacagctgcccgggagatgctccactcaccattgccctgtaccggggggaagccaagtggcgatacgccagacgtgtttatcagctaccgacgaaacagtggttcacagctcgcctctctgttaaaggtgcacttgcagttacatggattttcagtgtttatcgacgtggaaaaactcgaggccggtaagttcgaggataaactgatccagtcggtgatgggtgctcgcaatttcgtgctggttttgtctccaggtgccctggacaagtgcatgcaggatcacgactgcaaggactgggtacataaagagatagttacagcacttagttgtgggaagaacatcgtgccgatcatagacgggttcgaatggccggaaccacaggttttgccagaggatatgcaagcagttcttaccttcaacggaataaaatggtcccatgaatatcaagaggcgaccattgagaagatcatcaggttcctccagggcagaagcagccgcgattcctctgcggggtctgatacctctctggaaggtgctgcgcccatgggtcctacctag

SEQ ID NO: 33653 - DNA, 2169 bp, Artificial Sequence
  Description of Artificial Sequence: Synthetic coding sequence
atggtgctgaccctgctgctgtcagcctataagctttgtaggttcttcgccatgtcaggtcctcgtcggggcgctgagcggttggccgttcccggcccagacggagggggaggaactgggccctggtgggccgcaggagggccaggaccccgggtcagccccggagccgggacagaggtacaagatgcgctagagcgcgcactgccagaactccagcaagcgttatcagcactgaagcaggcagggggcgcccgggccgtgggagccggactggcagaggtgtttcagctggtcgaagaggcctggttactggccgtgggacgggaggtggctcaggggctgtgtgacgcaattcgtctggatggtggcttagatttactcctgcgcctgctgcaggcacctgaactggaaacgcgcgttcaggcggcaaggctcttagagcagattctcgtcgccgagaatcgggatagagtcgcaagaattgggctgggagtgattcttaatttggccaaagagcgcgaacctgttgagcttgcacgtagcgggagtgggatcttggaacacatgtttaaacattccgaggaaacatgtcaaagactggtcgctgctggcggcctggatgcggtcctgtattggtgccggcgtacggatcctgccctgttgcgacactgtgctctcgctcttggcaactgcgcactccacgggggacaggcagtccaacgtcgaatggtcgaaaaacgggccgccgaatggctttttcccctcgcgttttccaaggaggacgagttactttcactacacgcctgcctcgcagtggccgtgttggccactaacaaagaagtggagcgcgaggttgagcgcagtggcaccttggccctggtggagcctctggtggcaagcctggacccaggtcggtttgctagatgtctagtggacgcaagtgacacctcgcagggacggggaccagatgatttgcaacggttagtccccttgctggattcgaaccgcttggaagcccagtgcatcggcgcattctacctctgtgcggaggccgccatcaagagtctgcagggaaagacaaaagtgttttctgacatcggagctatccaaagtctcaagcggctggtctcttacagcaccaatggtaccaagtctgcactcgccaaacgcgccctcaggctgctgggcgaggaggtgcctcggccgatactcccatccgttccctcctggaaagaagctgaggtccaaacttggctgcagcaaattggctttagtaaatactgcgagtctttcagggaacagcaggttgacggggatctcctgctgcggctgaccgaggaggaattacaaacggacttaggcatgaaatcaggaatcacgcgaaagaggttttttagagagctcacagaactgaaaacctttgccaactactccacatgcgacaggagcaatttagcagattggctgggatctcttgatcctcggtttcgccagtatacgtacggcctcgtttcctgcgggctggaccgctccctattgcatagagtgtccgagcagcaactgctcgaagactgcggcattcacttaggcgtgcatagggccagaatccttacggctgcaagagagatgctccacagcccgctgccctgcacaggaggcaagcctagtggagacactccagatgtcttcatcagttaccggcgcaactccggatctcagctcgcttccctcctaaaggttcatttgcaactgcatgggttctccgtgtttatcgacgtcgagaagttggaggccggaaaattcgaagacaagctgattcagagcgttatgggtgcacgcaactttgtgctggtcttatctcccggtgccctcgacaagtgcatgcaggaccacgactgcaaggattgggttcataaagaaatcgtaacagctctgtcctgtgggaagaatattgtacctattatcgacgggttcgaatggcccgagccacaggtcctcccagaggatatgcaggccgtcttaacttttaatggcattaagtggtctcatgagtatcaggaagctacaatcgagaagatcatcagatttctgcaaggccggagctctagggacagtagcgccggcagcgacacatcactggagggggccgcaccaatgggtcctacatag

SEQ ID NO: 33654 - DNA, 1254 bp, Artificial Sequence
  Description of Artificial Sequence: Synthetic coding sequence
atggcttcaagcaagctgcgcgagccagtcgatgaggtgtttgatctcgacctcgccgttccagaaactgccaggttagattcttcattgcataaggcccgtgctcagctgcttgcgaaaggccgtcgacacagaccaagtaggagtaggttaagggatagcgcctcttcagccgaggatggcgaggggagtgacggacctggaggcaaagttaccgatggctgtggaagtcccctgcaccggttgcgctccccacttcacagtgggccaggtagtcctgctggaggatctttttgcctggaccctcccggcttgaggcgcagtctcgacgaagatgagcctccccccagtcctttgactcgttaccgaccgctgcacaatgcagccagtcacgaagggctggccgccgcaagctgctctccgccccggagcgccccaagcagtgatagcagccccagttttgtacgccgccatccacgggcagaaccccacagcgaggatgactctcgtgacgcctccccacctgagccagcaagtcccacgattggactagacaaaaaaacccgcaggaaatttctagacctgggcgttacattacgccgcgcctcaaccggcaaaagcaggaaagaaaagggctctaatagactctccatgggcagtcgagagtcggtagagggctcaggtaggtccggaggatcgccatttttaccgttctcctggttcaccgactccggcaagggtagtgcttcctccggttctacgacatctcctacctgtagccccaaacacgaggggttttccccaaaaaaatccgctagccaagagagtacgttatccgacgatagtactccccccagctccagccccaagatcccctcgggcccgtggcaggaggcaaaatgtagctacccgtatcacacactgtctcagtcctcagatgaattcctggatgagcctttgcctcccgttcatcattggacatcccagcaggtggggcagtggctgcagagcctcaacctcgagcagtatgccgccgaattcgccgccagacaggtcgatgggccccagctgctgcagcttgatgggtccaagttgaagtccctgggactgagtaacagccacgacagggccctggtaaagcggaagctgaaggagatggctgctgcagctgaaaaagagcgcaaagcccaggagaaagctgcccggcagcgagaaaagctgagacgccgtgagcaagaggccaagaaatcatag

SEQ ID NO: 33655 - DNA, 1338 bp, Artificial Sequence
  Description of Artificial Sequence: Synthetic coding sequence
atggctagctccaaactccgggagccggttgatgaagtattcgacctggatctggccgtgccagagactgcccggcttgacagcagcctccacaaagccagagcacaactgctagctaaggggaggcgccaccggcctagccgatcacggctgagagactcggcttcttccgccgaagacggagaaggtagtgatggcccagggggtaaggtcactgatggctgtggttcccccctccaccgacttagaagccccctgcatagtggtcccgggtcacccgccggaggctctttctgcctggatccccctggcctgcgtcgtagtttagatgaggatgagcctcccccatcgcccttgaccaggtacagaccgctccacaacgccgctagccacgaagggctggctgcagctagttgctcgccaccaaggtcagctccatcctcagatagctcaccaagcttcgtcagaaggcacccacgagctgaaccgcacagtgaggacgatagccgcgatgcttcccctcccgaacctgccagtccaacaatcggtcttgataaaaaaacacggcgcaagttcctcgatctcggcgtaaccctacgcagggcatccacaggcaaaagcagaaaagagaagggaagcaatcgtctgtccatgggaagcagggagtctgtggaaggatccggaaggtccggggggagtccttttctgcccttttcttggttcacagattctggcaaggggagcgcctcctctggcagcacgaccagtccgacgtgtagtccaaagcatgaaggattcagccccaagaaaagtgccagccaagcccagctgctggcacacgcccaagaagcactgtctaactcttggtgcctggtgcaggacttcgggtcaacgcagattggtatggaatccacactgagcgacgattctacccctccttcatcctctccaaaaatcccttcaggaccctggcaagaggccaaatgctcctacccataccatactctgtctcagtcatccgacgagttcttagacgagccattgccaccagtgcaccattggacctctcagcaggtgggtcagtggctccagtccctgaacctcgaacagtatgccgcggagtttgcagccagacaggtggacggcccccagctactgcagttggatgggagtaaactgaaaagcctcgggctttcgaatagccatgatcgcgccctcgtaaaacgtaaattgaaagagatggccgccgccgcagaaaaggagcggaaggcccaggaaaaggctgcccgccagagagagaagctgagaagacgcgaacaggaagcgaaaaagagctag

SEQ ID NO: 33656 - DNA, 42 bp, Artificial Sequence
  Description of Artificial Sequence: Synthetic coding sequence
atggcttcctcaaagctaagagagcccgtggatgaagtctag

SEQ ID NO: 33657 - DNA, 978 bp, Artificial Sequence
  Description of Artificial Sequence: Synthetic coding sequence
atgagtgacctgcaggctgccgagggcccaggctcttggagtcctaccgctaggccagggtcggccggtggagtgggcgactgtcagggagtagaagggtctcaggcagcagccagcgaaaatgaggacctagaaaataaggacacctcattgctggcttccgccacagatcccgagccttgttcctcaccccacaggccacagatggtctcccctgtgagtaaggatgccactgaagatctaaggaaggccactgggcccttagaagcccaggctttggttaaacaggacttgctgcctgctgatcaggcccaagttttgaatgaaatggccaaataccaggttccgcagagatcaggtgatatcgtcatgatccagtctgagcacaccggcgccattgatgtacttagcgccgacttggaatcagccgatcttcttggcgaccatagaaaggtttccccaccactgatggctcctccctgcatatggacttttgccaaagtaaaggaatttaagagcaaacttggtaaagagaaaaacagcaggctggtggtgaagaggggtgaagtggtgactatccgggttccaacccaccctgaagggaaaagggtgtgctgggaattcgccactgatgactacgacatcggcttcggtgtctactttgactggacccccgtcacttcgaccgacatcacagtacaggtgtctgattccagtgatgatgaagacgaggaggaggaggaagaagaggaaattgaagagcctgtccccgcaggggacgtcgagcgcggatccaggagtagtctacgcggaagatacggagaggtcatgccagtgtaccggcgggatagtcatagagacgtccaggctggctcacacgactatcccggcgaggggatttacctgcttaaattcgataactcgtatagccttctgaggaacaaaacactgtacttccacatatactacacgagctag

SEQ ID NO: 33658 - DNA, 666 bp, Artificial Sequence
  Description of Artificial Sequence: Synthetic coding sequence
atggaaacctggtccgtggaacaggtgtgtagctggttggttgagaagaacttaggcgagctggtgcatcgctttcaggaggaagaggtcagcggcgccgccctattggcacttaacgatagaatggtgcagcagctcgtgaaaaagatcggacatcaggccgtgttaatggatctaatcaaaaaatacaagcagaatactcaaggcctaaagagccctgagaatccaaaaaaggctgcgctggtaatgcagaccgaggctgctcgggattaccgcgacgaagaatccagcagtcctgccagacacggcgaacagatgccaagcttctatcctgcagaaaatttagataacggccttatcgatcagcgagttctgaaacagagaagaaacgtgaagcaaattcttgcacgctcaaaggctctccagtggactaaaagttacgtgctcccagagtttccctacgatgtgaagtgcatgttggcagaacagaagtgtcccgaccattccatgcgaatacggatcattgagtttctgcaggccgatatgaccaagtaccttgaaggtagcctgtacccttcaactcaacagtacaatgacgtcgtcaatgcgctgcttcaggcccatccttttctcgatgaagatggctgcggattcgctggtgtgtag

SEQ ID NO: 33659 - DNA, 1563 bp, Artificial Sequence
  Description of Artificial Sequence: Synthetic coding sequence
atggagacctggtccgtcgagcaagtgtgctcctggcttgtagaaaagaatctcggggaactggtgcaccggtttcaggaggaggaggttagcggggctgctcttcttgcgcttaacgaccgcatggtccaacagctcgttaagaagattggccaccaagccgtgctgatggatctcatcaagaaatataaacagaatacccaaggcctcaagtctccagagaatcccaaaaaggctgcgctggtgatgcagacggaggctgcaagggactatcgcgacgaggagtcttccagcccagcacgccatggagagcagatgcccagcttttatcctgcggaaaatttggacaatggactcatagaccagagggtgttgaagcagaggaggaatgtgaaacagattctggccaggtccaaagctttgcaatggactaaatcctacgtccttcctgagtttccatacgatgtcaagtgcatgcttgccgagcagaaatgccctgaccactctatgaggatccgtattattgaattcttgcaggcagatatgacgaaatacctcgaaggatcactctacccatcgacacaacagtacaacgacgtggtgaatgccctgctccaggctcacccattcctggatgaagatggatgcggcttctttttatggaaaagagctctgaaggaccgcttcaaatacgttcgccgaccaattgaggacgacgagcaagttatccgtaacaagtgtaaattcggccaccggcgaggccagacccggaagagccttgccgatatacggtttgacgaaatcaagctagtgcagatcaaagaagaagccgtgtgctttgactcagaactggacgagcacatcaaatggtttcaacaggagtatgtcaaaactgagaaggattggagggaaatcgacaaacgcatgtcacagacattagagatacgccgcaagatgatcggttcgagaactcctctcaaggacattctgaagctcttcccctttttaaagtgcccatatcaaatgtttagggaatttcagctgctgacccgcactgatatctataaaaagactaggcatatcctcgaaagctattccgagaacattttaacttccttctccgtcgtagacaacccaatcaatatcgtgttgcaggaaaagatgaagcactataccgacgaagatatgctaaagtatatgaaaatgactgctacctgtctcttattaccggatgtgtttggggatgatccctccctgttcgttataatgaacgagcaggtgcaggtgtccactcccgttctggaagtcaagaatcctttcaacatggaggtgtgtgaatttagcttgtacttggaaagagagagactcactaaggtcgacgactgtgtgactgctttggcagctttggttgctgccttccacgtctttagaattgagtgtcctagacgcctgagccagactttcaactttctggagaccctcatcttcgatatgcacagtccatattttccgagcctgaaggaaaaagagaatgaggttggctttcagcaccccctgacatag

SEQ ID NO: 33660 - DNA, 1563 bp, Artificial Sequence
  Description of Artificial Sequence: Synthetic coding sequence
atggagacctggtccgtcgagcaggtctgcagttggctagtggaaaaaaatctgggcgagctggtgcataggttccaggaagaagaagtctcgggggcagccttattggcactgaacgatcgtatggttcaacagctcgttaagaaaatcgggcaccaggctgtgcttatggacctgataaagaaatataagcagaatacccaaggacttaagagccccgaaaatcccaaaaaagcggccttggtgatgcagacggaagccgcaagagactacagagacgaagagtcaagctctcctgccagacatggcgaacagatgccatcattttatcctgctgagaacttggataacggactcatcgaccagcgcgtgttgaagcagcgaagaaatgtgaagcagatccttgcccggagcaaagccctccagtggacaaagtcatacgtgttacctgaattcccatacgacgttaaatgtatgctggctgaacaaaaatgccctgaccatagtatgagaattcgcataatcgagttcctgcaggccgacatgactaagtatctggaaggtagcctgtaccctagcacccagcagtacaacgacgtggtgaatgccctgctgcaggcacacccattcctagacgaggacggctgcgggtttttcctttggaagcgggctctgaaagacagatttaagtacgtgcggcggccgattgaggacgatgaacaagtgatccgaaataaatgcaagtttggccataggcggggccagacaaggaaaagcctggctgacattagattcgacgagattaagctcgtgcagataaaggaagaagctgtttgtttcgatagcgaactagatgagcacatcaagtggtttcagcaagagtatgtgaagacggaaaaagattggcgcgaaatagacaaacggatgtcacaaaccttggaaattcggcgtaaaatgattggtagtcggaccccattgaaggatattcttaagctttttccttttctgaaatgtccctatcagatgttccgggagtttcaactgttaactcggacagatatttataagaagaccaggcacatcctcgaaagctactcagagaacatcctcacttctttctctgtcgtagataaccccattaacatcgtgctgcaggagaagatgaagcactacactgacgaagatatgttaaaatatatgaaaatgactgccacttgcctactcttaccagacgtgttcggcgacgatccctcgctcttcgtgatcatgaatgagcaggtgcaagtgagtactcccgttttagaggtaaagaatccgttcaacatggaggtctgcgaattctccctgtacctggaacgcgagcggctcaccaaagtggacgattgcgttacggctctggcagcactcgtagccgcattccacgtctttcgtatcgaatgcccccgacgcctgagccagactttcaactttcttgaaacgctcatttttgatatgcactccccttacttcccttcactaaaggaaaaggagaatgaggtaggttttcagcacccccttacatag

SEQ ID NO: 33661 - DNA, 1563 bp, Artificial Sequence
  Description of Artificial Sequence: Synthetic coding sequence
atggaaacatggagcgtggagcaggtttgttcttggttggttgaaaaaaatttaggagagctggtccatcgttttcaagaagaagaggtctcaggggccgcgcttttggcccttaacgatagaatggtgcagcagcttgtaaagaagattggtcatcaggcagtactcatggatttaataaagaagtataaacagaatactcagggcctcaagtccccagaaaaccccaagaaggctgcattggtgatgcagaccgaagccgcaagggactatcgtgatgaggagtccagctcccctgcgaggcacggagaacagatgcctagtttttaccccgctgagaatctcgacaacggcctgattgaccagagggtgcttaaacagcgccggaacgtgaagcagatcctggccagaagtaaagctctacagtggacaaagtcatatgtcctgcctgaatttccgtatgacgtgaagtgtatgctagccgagcagaagtgtcccgaccacagtatgaggattcgtatcattgagttccttcaagccgacatgactaagtacttggaaggatctttgtatccatctacgcagcagtacaatgatgtggtcaacgcactgctgcaggcacatccttttctggatgaggatggctgcggtttcttcctctggaagagagccctcaaggatcgctttaagtacgtgcgccgccccattgaagatgacgagcaggtcatcaggaacaaatgtaaatttgggcacaggcggggccagactcgcaaatcgctggccgatatcagatttgacgagataaagttggtgcagattaaagaggaggctgtgtgttttgacagcgagttggatgagcacatcaaatggttccagcaagaatacgttaaaaccgaaaaagactggcgagagatcgacaagaggatgagtcaaactctcgagatacgaaggaagatgatagggtctagaactcccctgaaagacattctgaaactgtttccattcctgaaatgcccatatcaaatgtttcgcgagttccaactgctgacccggacagacatctataaaaaaacccggcatattttagagagttactcagagaatatccttaccagtttcagcgtggtggacaaccctattaacatcgttctgcaggagaaaatgaagcactataccgatgaagacatgctaaaatatatgaaaatgactgccacctgcctgctgctgccagacgtgtttggcgatgacccatcccttttcgttatcatgaacgagcaggtgcaggtgtcaacacccgttctcgaggtgaagaaccctttcaacatggaggtatgtgagttcagtctgtatctcgagcgtgagcgcctgaccaaggtggatgactgcgtaactgcgctggccgctctggtcgctgccttccacgtgttccgcattgagtgccccaggagattaagtcagacttttaatttcttagagacgctgatcttcgatatgcactccccttatttcccctccctaaaggaaaaagaaaacgaggttggattccagcacccactgacatag

SEQ ID NO: 33662 - DNA, 522 bp, Artificial Sequence
  Description of Artificial Sequence: Synthetic coding sequence
atggaaacatggtcagtggaacaggtttgctcttggctcgttgagaagaacctgggtgaactggtgcatagatttcaggaggaagaagtatcaggggctgcccttctggcactgaatgatagaatggtccagcagcttgtgaagaagatcggacatcaggctgtcctgatggacttgattaagaagtacaagcaaaacacccagggcctgaagtccccagagaatccaaagaaggcagccctggtaatgcagaccgaagctgcgcgggactatcgggacgaagagagctcctccccggctagacatggagaacaaatgcccagtttttacccagccgaaaacctggataatggcctcattgatcaaagagttcttaagcagcgtagaaacgtgaagcagatcctcgctcgtagtaaagcactccaatggactaagtcttatgtactaccagagttcccttacgatgtaaagtgcatgttggccgagcagaagtgcccggaccactctatgcggatcagatag

SEQ ID NO: 33663 - DNA, 2085 bp, Artificial Sequence
  Description of Artificial Sequence: Synthetic coding sequence
atgatgttccgggatcaggtcgggatcctcgccggatggtttaaagggtggaacgagtgtgagcagacagtcgccctgttatctctgttgaaacgggtgacgaggacccaagctcgtttcctgcagttgtgtctcgagcactccctggccgactgcaacgacatacacctgttagaatctgaggccaactccgccgcgatagtcagtcaatggcagcaggaaagcaaggagaaggtggtgtccctgctgttatcacacctgccgctgttacagcccggaaacaccgaggctaaatcggagtacatgcgtctcctccagaaagtgcttgcttacagtattgaatccaatgcattcatagaggagagccgtcagctgctgagttacgccctgattcacccagcgaccacgctcgaggaccgtaatgctctggccctctggctcagccacctcgaggagcgattagcctcaggttttaggagcaggccagagcccagttaccatagcaggcaaggaagcgacgagtggggaggaccagctgagcttggccctggggaagctggacccggttggcaagataagcctcctagggagaacggacacgtacccttccacccatcatcttcggtgcctcccgccatcaatagtattgggtcaaacgctaacaccggacttccgtgccagattcatccgagtccactgaagcgcagcatgtcactgatcccaaccagtccacaggtgccaggtgaatggccttccccggaagagcttggcgctagagctgcattcaccactcctgaccatgcccctctgtccccacagtctagcgtggcctccagtggatccgagcagacggaagagcaaggctcgagccggaacacttttcaggaggacggttctgggatgaaggacgtgcccagctggttaaaatctctccggcttcacaagtacgcggcgctattttcgcagatgagctacgaggagatgatgactctaaccgaacagcacctggagtcccaaaacgtgacaaaaggggccaggcataagatagccctctctatccagaaacttcgcgaaagacagagcgtgctgaagtccctcgagaaggacgtcctcgagggtggcaatctgcggaacgccctgcaggaactacagcagataataattactccaattaaggcctactcagtgctccaggccaccgtggctgcggcaaccacgacacctaccgcgaaggacggcgctcccggggagccgccactgccaggagctgagccacccctagctcatccaggtactgacaagggcaccgaggccaaagatccgcctgccgtggaaaattatccacctccgcctgcaccggcccctaccgacggaagtgaaccggctccggctccagttgcggacggcgacattccttcacagttcactagggtaatgggtaaagtctgcactcagcttctcgtgtccaggcccgacgaggaaaatatcaccagctatcttcagctaatcgagaaatgcctgactcatgaggctttcacagaaacccagaagaagagactgttgagctggaagcaacaggtcttaaaactgctaagaactttccccaggaaggctgccctcgaaatgcaaaattaccgacaacagaaaggttgggcgttcgggagcaacagcctgccaattgcagggagcgtaggtatgggagtggctagaaggactcagaggcagtttccgatgccccctagagcgctaccgccagggcgtatgggactgctgtcaccctctggtattgggggggtatctcctaggcacgccctgacaagcccttctctgggtggccaggggaggcaaaatctctggttcgcgaatccaggagggtcaaattcgatgcctagtcaatcccgctcatccgtgcagcgtacacattccctcccagtacatagcagccctcaagccatcctgatgttcccccctgattgccccgtacctgggcctgatctcgagataaaccccacactggaaagcctgtgtctaagcatgaccgagcacgcgcttggagacggaacagacaaaacctctaccatctag

SEQ ID NO: 33664 - DNA, 1992 bp, Artificial Sequence
  Description of Artificial Sequence: Synthetic coding sequence
atgatgttcagggatcaggtggggattcttgcagggtggtttaaaggctggaatgaatgcgagcagacagtggccctactgtcccttctgaagagagtcacacgcacgcaagctaggtttttacagttatgcctggaacattcactcgctgactgtaacgatatacatttgctggagtcagaagctaacagcgccgcaatcgtcagccaatggcagcaggagtcgaaagagaaggtggtctctttattactctcccatctgcctctgctgcaaccgggcaatactgaagccaaatccgagtatatgcgcctgcttcagaaggtgcttgcctactccattgaaagcaacgcttttatagaggagtcacgccagcttctgagttacgcgctgattcacccggctacaactttagaggaccggaacgcattggcactctggctgagtcatcttgaagaaaggctggccagcggatttcggtcacggcctgaaccttcttaccactccaggcagggttccgacgaatggggggggcctgccgaactgggtcctggagaagccggaccaggttggcaggataaacctccacgggaaaacggccacgtcccattccacccctcttcatccgtcccacctgccattaacagtatcggctccaacgctaacactggattgccatgccaaatacacccttccccactcaagcgatctatgagtctcatccctaccagccctcaggttccaggcgaatggccatctccagaagaactgggagcccgagccgcctttacaaccccagaccacgccccactctctccacagagctccgtcgcttctagcggaagcgaacagactgaggagcagggctcgtctcgaaacacattccaggaggatggtagcggtatgaaagatgtgccctcttggcttaaaagcctgcgcttacacaaatacgctgcactcttttcccagatgtcttacgaagagatgatgacgctgacagagcagcacttggagtcacaaaatgtaactaagggcgctcgccataagatcgccctgtcaattcaaaagcttcgagagcgacaatcagtgctgaaatccctcgagaaggacgtcctggagggcggcaatcttcgtaatgctcttcaggaactgcagcagattatcattacacccatcaaagcctacagtgtcctacaggccacagtggcggcggccacaactacccctacggccaaggacggagccccgggcgagccccctctgcccggagctgagccaccactcgcgcatccaggcactgataaaggcacagaggctaaagatccaccggcagtcgagaattatccaccgccacctgcacccgccccaactgacgggtccgagcctgccccggctccagtagccgacggcgatattcccagtcagtttacccgagtgatggggaaagtgtgcacccaactcctagtgtccagacctgacgaggaaaatatcacttcttatctgcagcttattgagaagtgcctgacgcacgaggctttcactgaaacccagaaaaagagactcttgtcgtggaaacagcaggtcctgaaactactgcggacatttccccgtaaggcggcactggaaatgcagaattacagacagcaaaagggatgggccttcgggtctaattcactgccaatagcgggcagcgtgggaatgggagtagctcgtcgaacgcaaaggcagttcccaatgccacctcgcgcgttgccacctgggagaatggggctgctttctccctcgggaattggtggggtgtctcctaggcatgccttaacccctcagccctggcgtcccggccctactgagcccgtggtgtgtcagccatggaggcagcaacagcacgcgcagagcgaacctcagttatgtgccgcccacccattagcgccagggccactggtgaccccagggcacagccacgtcccttctagactgcctggctcatgggcttag

SEQ ID NO: 33665 - DNA, 522 bp, Artificial Sequence
  Description of Artificial Sequence: Synthetic coding sequence
atgtgcaccaacatcgtgtacgaatggctgaaggccctgcagcttccgcagtatgccgagagctttgttgataatggctacgatgatctcgaggtctgcaaacagattggtgatcctgatctggatgccatcggcgtgctcgcacccgctcacaggaggcgcatactggaggctgtacgacggctgcgtgagcaggacgctaacgctgctggtctctacttcacattagaacctcaacccgcgccacccggcccacctgccgacgcagttcccaccgggcgaagaggggaaccatgcggggggccggcacaaggcacccgaggggatagtagaggtcacaccaccgcacctcgaagtagggagctagttagttacccaaagctgaaactcaagattatgatacgcgacaagttggtgagagatggcatccaccttagcaagcccccctacagcagaaaagtgcctatggcgggcattctcgagtatctaatgaattggcccaaatcctctcagagccgttag

SEQ ID NO: 33666 - DNA, 1341 bp, Artificial Sequence
  Description of Artificial Sequence: Synthetic coding sequence
atggcagtcaatcccctccttaccccgactgggcagcagactatcccgctgatcccatcacctttcggcccccccaccgttgaccgcgacgttcttccaagtaccgtggctcctactgaccctcgtcagttctgtgtaccaagccagtttggcagcagcgtgctgccgaacaccaatatggccaacgtactgagttcaagaatttatccgggctggggcatcctgcctcctgagagtataaaagctgtggctcggcgcaatgagatgattcagcgacatcatactgcgcgcaccgagatggagatgtacgccatttatcagcagaggcggatggagaaaatcaaccccaaagggctagccggactcggtattccattcctttacgggtctagcgtgccagcagctccagcagcttatcatggtcggtccatgctccccgcgggagatctccatttccaccgctcgaccctgagaaaccttcagggaaacccaatgctagccgcgacagctcctcacttcgaggagtcatgggggcagaggtgtcgtcgcttacggaagaatacaggcaaccagaaggcccttgatagtgacgccgaaagttccaaatctcaggctgaggaaaagatcctcggacagacacatgctgttccctacgaggaggaccactatgcgaaagatccagacatcgaagcacccagtaatcagaaatctagcgagaccaatgaaaaacctaccacagccctggcaaacacctgtggcgaactcgagcccacccaccgtaaaccttggggcagtcataccacaacactgaaggctaaggcttgggacgatgggaaggaagaagctagcgaacagattttcgcaacttgtgatgagaagaatggggtctgcccgccagtcccgaggccctcgctgcctggaacacacgccctcgtaactattgggggaaacttgtccctggatgaagacatccagaaatggaccgtggacgacgtgcactcattcatacgctccttacctggatgttctgattatgcccaggtcttcaaggaccatgctattgacggggagactctgccactgctgacagaagaacacctaaggggcacaatggggctcaaactcggacctgcactgaagatccagtctcaggtaagccagcatgttggcagcatgttctacaaaaagacgctatcctttcctatcagacaggcctttgaccagcctgcagacactagccccctcctagatcctaacagctggtccgacaccatgaatatcttttgcccccaggacaccattatccctaagggcatagagcgcggctctatgaggaactag

SEQ ID NO: 33667 - DNA, 1341 bp, Artificial Sequence
  Description of Artificial Sequence: Synthetic coding sequence
atggcagtgaatcccctgcttacaccaacaggacaacagactatccccctgatcccctctccattcgggcccccgacagtggatcgtgacgtgctaccgagcactgtggctccaaccgacccaaggcagttctgtgtgccatctcagttcggttcaagtgtgctccccaatactaacatggccaatgtgctttcatcaagaatctatccgggttggggaattcttccccctgaaagcattaaagccgtcgcacggcgaaatgaaatgattcagcgccaccacacagcgcgcacagagatggaaatgtacgccatataccagcaaaggcgcatggagaagattaaccccaaggggttggccggcctggggattccatttctgtatggatccagcgtgcccgccgccccggcagcctaccacggccggagtatgttgccagcaggagaccttcatttccacagatcaactctgcgaaacctccaaggcaatcccatgctggctgcaaccgcgccacacttcgaggagagctgggggcaaagatgcagacggctgagaaaaaacaccggcaatcagaaagccctcgattcagatgctgagtctagcaaatcgcaggcagaagagaaaatcctgggtcaaacacacgctgtaccctacgaagaagaccactatgctaaggatcccgacatcgaggccccctccaatcagaagagctcagagacaaatgagaagccgaccactgctctcgctaatacgtgcggcgagcttgagccaacgcacagaaagccgtggggctcacatactaccacacttaaggcaaaagcttgggatgacggtaaggaggaagcatctgagcagatcttcgcgacttgcgacgagaagaacggtgtatgcccccctgtaccacggccgtccctgcctgggacacacgccctagtaaccattggaggtaacttaagtctggatgaggatatccagaagtggactgtcgacgacgttcattctttcatcagatcgctgcccggttgctccgactacgcgcaggtgttcaaagaccacgcaatagacggagagacgctccccctcttaactgaagagcacttaaggggcaccatgggattgaagttgggacccgcattgaaaatacagagtcaggtgagccagcacgtagggtctatgttctacaaaaagacgttaagctttcccattcgtcaggccttcgaccagcccgccgacacctcacctttgctagatccaaacagttggagcgacacaatgaatattttttgccctcaggacactattatcccaaaaggaatagagagaggctccatgagaaattag

SEQ ID NO: 33668 - DNA, 2781 bp, Artificial Sequence
  Description of Artificial Sequence: Synthetic coding sequence
atgaaaaaaacacgcagtaccaccttaagacgagcctggccatcttcagacttcagcgaccgggcatctgaccgtatgaggtcacggagcgagaaggattaccgcctccacaagaggttcccagccgccttcgctccccaagccagtaggggctacatgacgtctggtgacgtctcccccattagcatgagccccatctcccagagccagttcatacccctgggcgagattttgtgccttgcgatcagcgccatgaatagcgcaaggaagcctgttacacaggaagccctcatggagcacctgacaacttgcttccctggcgtgcccacaccctcccaggaaattctcagacacacactgaacactctcgtcagggagagaaagatttacccaacccccgatggctatttcattgtgactccccagacgtacttcatcacaccttctctgatacggaccaattcaaagtggtatcacttggacgaaagaatccccgatcggagtcagtgtacctccccgcagccggggaccattaccccatccgctagcggttgtgtgcgtgagaggaccctgccgcgaaatcactgtgactcctgccattgttgtagggaagatgtacattccacacacgccccgactctgcagagaaagtcggccaaagactgtaaagatccgtattgccctccttctctgtgtcaggttccaccaaccgagaagtctaagtccacggtcaacttctcatacaaaaccgagactttgagtaaacctaaggattcagaaaagcagagcaagaaatttgggctgaagctctttcgactctctttcaaaaaggacaagaccaaacaactggctaacttttccgcacagttccctcctgaggagtggccattgagggatgaagacacacctgctactataccccgcgaagtcgagatggagattataaggaggatcaatccggaccttaccgtggaaaacgtgatgaggcacaccgctctcatgaagaagttggaggaggagaaggcccagcgttccaaggcagggtccagcgcacatcattcggggcgtagtaaaaaatcccggactcaccgtaaaagtcacgggaagtcccggtcccactccaaaactagagtttcaaaaggcgatccttccgatggtagccatctcgacattcccgccgagcgcgagtatgatttttgtgaccctttgacacgagtcccccgtgagggttgtttcattatcgagcataagggggataactttattatgcacagtaacacgaacgttctcgagtcacactttcccatgactcctgaatgggacgtctctggagagctggcaaagagacgcacagagatgccgttcccagagccctcccgcggttccagtcactccaaagtgcataggagtcatagtcacactcaggacagaagaagcaggaacgagcgctctaacaaggcaaaagaacggagtcgctccatggataattcaaaaggccctctgggggccagctcgctcggaacccccgaggatctagcagaagggtgctcccaggatgatcaaacacctagtcagagctacattgatgatagcacactgagacccgcccagactgtgtcactgcagcgggcacacattagtagcacaagctataaagaagtgtgtatccctgagatcgtttcgggtagcaaagaacccagctcagcatgttctcttctcgaaccagggaagccccctgaatccctaccgagctacggtgaattaaactcctgtcctacgaagacagccactgacgattatttccagtgcaacacctcttcggagacagtgcttactgcacccagccctctgggcaagaataaagaggaccatgacacgctgactcttgccgaaggagtcaaaaagttaagcccaagtgaccgccaggtgccacactcttctcgagagcctgtgggacacaaggaagaatctcctaagggccccggcggcgggccagcagctagtggcggcgtggcagagggcatagcaaacgggcgcctcgtgcaacatcacggcgcagagccctccagtttggataagagaaaggagatctttagcaaggacacactgtttaagcccttgcacagtaccctcagtgtaaacagctatcacaagtcaagtctctcactcctcaaatcgcatcccaagacaccggcagataccctgcccgggagatgcgaaaagttagagccgtccctgggaacctctgccgcccaggccatgccagcaagtcaaaggcagcaagagtctggcggtaaccaggaagcttccttcgactattacaacgtctccgacgatgatgacagtgaagaaggcgccaacaaaaacaccgaggaggaaaagaatcgagaagatgtgggaaccatgcagtggctgttggaaagggagaaagagcgcgatctgcagcgaaagttcgagaagaatctgactctgttggcaccgaaggagaccgactccagttcgaaccaacgggccactcatagcgctagacttgatagcatggacagctcaagcataacagtcgattcaggcttcaacagtcctcggacgcgcgagagcttagcttctaatacaagttctattgtggaaagcaacagacgccaaaatccagctttgtcaccagcccatgggggagccgggcctgcattcaacttccgcgcatccgctgagcctcccactaatgaggcagagaaactgcagaagccctctaattgcctgcaggcatccgtgacgtctgtctag

SEQ ID NO: 33669 - DNA, 2592 bp, Artificial Sequence
  Description of Artificial Sequence: Synthetic coding sequence
atgaagaaaacacggagcactacgcttcgtagagcctggcctagttctgacttttcagaccgagcatccgataggatgagatccagaagtgaaaaggattatcgtctgcacaaaagattccccgctgcctttgctcctcaggcctctaggggatacatgacatccggcgatgtctcacctatctccatgagtccaatcagccagtcacagttcattcctctgggtgagatcctgtgcctagcgatttctgctatgaacagtgcaagaaagccggtgacacaggaagctctcatggagcatttgaccacttgctttcctggtgtcccgaccccatctcaagaaatactgaggcacacattgaacactctagtcagagagcgcaagatatatccgaccccagatgggtatttcattgtcacaccacaaacctacttcataactccatctctgatcaggacgaactctaagtggtaccacttggatgaacgcatccctgacaggtcacagtgcacatccccccagccgggaaccataacgccttcggcgagcggatgtgtaagagaaagaacactgccgagaaatcattgtgactcatgtcattgctgtagagaagacgtgcatagcacacatgcccctacactgcaaagaaagagtgctaaggactgtaaagacccatactgccctcctagtctttgtcaggtcccacctaccgaaaagtctaaatctaccgtcaactttagttataaaaccgagaccttaagcaagccaaaggattcagaaaagcagagcaaaaagtttgggttgaagttatttcggcttagctttaagaaagacaagaccaagcagttggctaattttagcgcgcagttcccaccagaggaatggccactgcgggacgaggacaccccagctaccatcccaagggaagttgagatggagattatccgacggataaaccccgatctcacagtggaaaacgtgatgcggcacactgccctgatgaagaagctggaggaggagaaagcccagcgaagtaaggctggttctagtgcacaccactccgggcgatcaaaaaagtctcgaactcaccggaagtcccacggaaagtctaggagccattctaagacccgtgtatccaaaggtgacccctctgatggttctcacttagacatccctgccgaacgggaatacgacttctgcgatccactgacgcgggttcctcgagagggctgcttcataatcgagcataaaggcgataatttcataatgcacagcaacactaatgtgctggagtcacacttccccatgacaccagagtgggatgtctcgggagaactagcaaagcgcagaacagagatgcccttccctgagccctcccgaggatcttcccactccaaagtgcacagaagccactcacacacacaggatcgccggtcaagaaacgagcggtctaacaaagctaaagagagatcccgctccatggacaattccaaagggccgttgggcgctagctctctgggcacacccgaagacctcgccgaaggctgttctcaggatgatcaaaccccctcacagagttacatcgatgattccaccctacgccctgctcagactgtttcgttgcaaagagcccacatctcctctaccagttataaagaagtctgtatacctgagatcgtgtctgggagcaaggaaccatccagcgcgtgctctcttcttgagcccggtaagccgccagagagtctgccatcatatggggagctcaatagctgccctacaaagacagccacagatgattactttcagtgcaatacgtcatctgagaccgtcctaacagcaccctccccgttggggaaaaacaaggaggatcatgacacactgactttggcggagggcgtcaaaaagctcagcccatcagatcgtcaggtccctcactcttcacgtgagcctgtcggacataaagaggaaagtcctaaagggcctgggggcggccccgctgcatccgggggggtggcagagggtatcgcaaatgggaggctggtgcaacaccacggcgctgagccctccagccttgataaaagaaaggagatctttagcaaggacacactctttaagcctttgcattctactctgtccgtgaattcgtaccataaaagtagcctgagtctgctgaagagtcaccctaagactcctgccgacacactgcccggccggtgcgaaaagctggagccaagtctcggaactagcgccgcacaggccatgccggcatcacagaggcaacaggaaagcggtgggaaccaagaggcaagttttgactattacaacgtgagtgacgacgacgattccgaagagggcgcaaataaaaatactgaagaagaaaagaatagagaagacgtcggcactatgcaatggctgctcgaacgagagaaggaaagggatcttcagcgcaagttcgaaaaaaacctcactctgctcgcccctaaggaaacggactctagttccaaccagcgagcgacacattcagctagactggattcaatggactcaagtagcattacagtggactccggctttaatagtccacgtaattag

SEQ ID NO: 33670 - DNA, 4155 bp, Artificial Sequence
  Description of Artificial Sequence: Synthetic coding sequence
atgtcacaactccagctctggctgcagttcgaagcattaaacaagggcatggcccctggatccccccagacacgcgccgctcagagttcatgtagtatcgctgctctccaggtcttgcaaaagagcgacgctgtcctgcgtggtcctgaggactcatcttactttgaggatttttcaaacataagcatcttttcaagttcagtggatagcctgtcagacattgtagacacccccgatttcttgcctgcagactctctcaaccaggtttccacaatttgggacgataatcctgctccatctacccatgacaaagtgtccgctccaggagctccaagccagcctaggcccactagcgtggctagccctgcaagagatcctcatggccccgttagactccggggccccacatcctgtgacctgagcagacttgcacgcgctgacatcctccttcctttccagctctttcagctatctcgcccatttgccggttttgaggacttcttgccctctcacagcacccctctgctggtcagctaccaagagcaaagcgtgcagagccaaccggaggaggaggacgaggctgaagaggaagaggctgaggaactgggacacaccgaaacgtacgctgattacgtgccatccaagtcgaagatcgggaaacagcaccccgacagggtggttgagacatccacgctgtcttctgtccccccaccagatatcacctatactctcgcgttgccctcagattcaggcgcactatccgccttgcagctcgaagcaattacatatgcatgtcagcagcatgaagtcttgctgccctccgggcagagagcagggtttcttatcggcgacggcgccggcgtggggaaaggtcggaccgtggccggtgtgatcctggaaaatcacctgcgaggcaggaagaaggcactgtggtttagcgtttcgaacgacctcaagtacgacgcagagcgcgatctgagggacatcgaagctaccggaattgcagtccatgccttgagtaaggtcggcgctgtcctgggtaaagtgggtggcaaagtgggtactgtgccatgtaagataaagtacggcgatacaacaacgagtgagggggtgctgtttgctacatacagtgccctgatcggcgagagtcaagcaggagggcagcacaggacacgactgcgtcagattttggactggtgtggggaggccttcgagggagtgattgtctttgatgagtgccacaaggcaaagaacgccgggtccaccaagatgggtaaggcagtcctggatctacaaaacaagctgcccctggccagggtggtctatgcctctgcaaccggggcctctgaaccccgaaacatgatctatatgtctagactgggtatatggggagaggggacccccttcagaaatttcgaggaattcttgcacgcaatagagaagaggggcgttggcgcgatggagattgttgccatggacatgaaggtcagcgggatgtacatcgctcgccaactgagtttcagtggcgtcacgtttcgcatcgaagaaataccattggccccagccttcgaatgtgtttataatagagcagcgttgctttgggcagaagccttgaatgtgtttcaacaggccgccgactggattggcctggagagtcggaaaagcctatggggccagttttggtccgcacatcagcggtttttcaaatatctctgcatcgccgcgaaagtgagaaggctggtcgaactcgctcgtgaggagctggcacgggacaaatgtgttgttatcgggctgcagtccaccggtgaggcacgcacgcgggaggtgctgggcgagaatgacggacacctcaactgtttcgtctcagctgcggagggagtgtttttatctctgatacagaaacacttcccgagcaccaaacggaagcgtgacagaggagcgggatctaagcggaagcctggcgtgattcgaatttctgacgactcaagtacggaatctgatcccggactagattccgactttaactcaagccctgaatcgctcgtagatgacgacgtggtgatcgtggatgccgttggactacctagcgacgaccggggccccctctgtctgcttcagagggaccctcacgggcccggagttctcgaacgggttgagagactcaagcaagatctgctggataaggtccgaaggctggggagggaactgcccgttaataccctggacgagctgattgatcagttgggaggaccccagagggtcgctgagatgacaggccggaagggccgagtggtcagcaggccggatggaacggttgcattcgaaagcagagccgagcaagggctcagcatcgatcacgtgaacctgcgggagaaacagcggttcatgagcggagaaaaattggtcgctatcatctccgaagcaagctccagtggggtctctctgcaggccgatcgccgagtccaaaaccagcgcaggagggttcatatgacattggagctgccatggagcgctgacagggctatacagcagtttggcaggacccataggtccaatcaggtctccgcccctgagtacgtatttctgatctcggagttagccggagagcgcaggttcgcctccattgtggccaagcggctcgagagcctgggagccctcactcacggcgaccgcagggcgacagagagccgggatctgagtaaatataacttcgagaataaatacggcacccgtgccctgcactgtgtgctgacaactatcctctcacaaactgagaacaaggtgcccgtgccacagggatatcccgggggagtgcccaccttctttcgcgacatgaagcagggcttgctgtccgtcggtattggcggaagggaatcccgcaatgggtgtctcgatgttgagaaggattgcagcattactaagttcctgaaccggattttggggctcgaagtccacaagcagaacgcgctgttccagtatttctccgataccttcgatcacctgattgagatggacaagagagagggcaaatacgacatgggaattctcggggaacatcgttgccggggcgtggtctgggttgacctcgcccctggaatcgaggaaatttacgaggagtcgcaacaggtgttcctagcacccggacatccccaggacggtcaggtggtcttttataagatcagtgtggatagaggcctgaaatgggaggacgcatttgcaaaatcactggcgctcactggcccatacgacgggttttacctctcttacaaagtgcggggaaataaacccagttgtctacttgccgaacagaaccgcgggcagtttttcaccgtctacaagccgaacatcggtcggcagtcccagttggaggccctagactccctgaggaggaaatttcaccgtgtcactgccgaggaagccaaagagccctgggagagtggatatgcactgtcactgacccactgctctcacagcgcctggaacagacactgccgtttggcacaggaaggaaaggattgcctgcagggcttaaggttgcgccaccactacatgctctgcggtgcactcctgcgtgtgtggggcagaatcgcagctgtaatggccgacgtaagttccagctcctacctccagatcgtgaggctgaaaaccaaagacagaaagaagcaggtcggaattaagatacctgagggttgcgtacgccgcgtgctccaggaattacggttgatggacgcagacgtaaagcggaggcaggcccccgccctcgggtgtcccgctccaccagccccccgtcctttggcactgccgtgtggcccaggggaggtgttagacctgacttactcccccccggcagaggccttcccaccgcctccccatttctcctttcccgcccccttgtcgctggatgccgggccaggcgttgtccctctgggtacccctgatgcacaagcagatcccgccgcgctggcgcaccagggatgcgacatcaatttcaaggaggtgctcgaggatatgctccgctccctgcacgcaggcccaccgagcgagggtgcactgggggagggggctggggctggcggcgcagcaggggggggcccagaacgacagagcgtaattcagttcagtccacccttccccggtgctcaagctcctctgtag

SEQ ID NO: 33671 - DNA, 4101 bp, Artificial Sequence
  Description of Artificial Sequence: Synthetic coding sequence
atgctggctgttgggccggccatggaccgggactacccacagcatgagcccccacctgccggatcactgttgtactccccaccacctctgcagtccgcaatgttgcactgtccctactggaacacgttcagcctacctccttatccagctttttcctcggattccaggccctttatgagctcagcatccttcttgggcagccagccttgcccagatacctcctacgcccctgtggcaactgcatcaagtctcccccccaagacatgcgatttcgcccaggattcttcctactttgaggacttcagtaacattagcatctttagctcttccgtggactcactttcggatattgtcgacacacctgatttcttgccagctgattcccttaatcaggtttctacaatttgggacgataaccctgctccatctacgcacgacaagctgttccagctgtccaggccctttgccggcttcgaggacttcttgccatctcactcaacaccactcttagtgagttatcaggaacagtcggtgcaatcccagcccgaggaagaggacgaagcggaagaggaagaagctgaggaattgggccataccgagacctatgcagactatgttccaagcaaatccaagatcggcaaacagcaccccgatcgagtggtagaaacatctaccttgtcttcagtcccgccacccgacatcacttatacactggcgctgccttccgacagtggtgcgctaagtgcactccagctcgaggccataacctacgcctgtcagcagcatgaggtactcctgccatcaggccaacgcgctggatttctcattggcgatggcgctggtgtgggtaaaggaagaactgtggcaggggtcattttggaaaaccacctccgcggcaggaaaaaagctctgtggtttagcgtgtcaaacgatctgaagtacgacgccgagagggacctgcgagatatcgaggccactgggattgcagttcatgcattatctaaaatcaagtacggggacaccacaacttctgaaggggtcctattcgctacatatagtgcactaataggcgaatcccaggctgggggccaacatcgcactagactgaggcaaatcctcgactggtgcggcgaagcttttgaaggtgtcatcgtttttgacgaatgtcacaaggcaaagaacgctggatccaccaagatgggcaaagcggttctggacctacagaacaagcttcctctggcgcgggtcgtctatgcatctgcgacgggagccagcgaaccgaggaatatgatctatatgagccggctcggcatttggggggaaggaacaccatttcgtaatttcgaggaatttctccacgccatagagaagcgcggcgtcggcgccatggagatcgtggccatggacatgaaagtgtcaggcatgtatatcgccagacaactcagcttttcgggcgtaaccttccggatagaggaaatcccactggccccagcattcgagtgcgtgtacaaccgggcagccctcttgtgggcggaggccttgaatgtgtttcagcaagccgcagactggatcggcctggagtcccgaaaaagtctgtggggccagttctggagcgctcaccagaggttctttaagtatctgtgtatagctgccaaggtgcgcagactcgtggagcttgcccgagaggagttggccagagacaaatgcgtggttatcggactgcaatctacaggggaggcccgcactagggaagtccttggagaaaatgatggtcacctaaattgttttgtgtccgctgctgaaggagtcttccttagtctcatccagaagcatttcccatctactaagcgcaagagggatcggggcgccggtagtaagaggaagcggagacctcgggggcgaggggccaaggccccccgactggcatgcgaaaccgccggtgtaatccggatcagtgatgacagcagcacagagagtgatcccgggcttgactcagactttaactccagcccagagtcactggtggacgacgatgtcgtgattgtcgatgcagtcgggctccccagtgatgacagaggtcctctttgcttgttgcagagggatccccacggcccaggcgtccttgaaagagtggaacggctgaagcaggacctgctcgataaggtcagacggctggggcgcgagctgcccgtaaatacactagacgaactgatcgatcaactggggggccctcagcgggtcgccgaaatgacaggacggaaaggaagagtcgtttcccgccctgatgggactgtggctttcgaatccagggcggaacagggactgtccatagatcatgtgaacctgcgcgaaaagcagcgttttatgtctggggagaagctcgtggccattatcagcgaggcatccagctccggcgtgagcctccaggctgatcgccgagtgcagaaccagaggcgtagggtacacatgacactggagctcccctggagtgcggaccgtgcgattcaacagtttggtcgaacccacaggtctaaccaggtctctgccccagagtacgtcttccttattagcgagttggctggcgaaagaagattcgcttctatagtagcaaaaaggttggaaagcttaggagcccttacccatggtgatcgcagggcaactgaatctagggacctgtctaagtataattttgagaataaatatggcactcgcgcactccattgcgttttgacaactatcttgtcacagaccgagaacaaagtgcctgtgccacaaggttaccccggcggtgtgcctacgttctttagggatatgaagcagggtctgcttagcgttggtatcgggggtagggagagcaggaacggatgcttggacgtggagaaggattgtagtatcacaaaatttctgaatcgaattctggggcttgaggtgcacaagcagaacgcactgttccagtacttctcagatactttcgaccatctgatcgagatggacaagcgggaaggaaagtacgacatgggtatcctcgacctcgcccccggcatcgaggaaatttacgaagagtcacagcaggtttttctcgcccctggccatccacaggacggccaagtggtgttctataaaataagcgttgatcggggactcaaatgggaagacgcttttgctaaatcactagcattaaccggtccatacgatggattttacctgagctataaagtgagggggaacaagccttcttgtttactcgccgagcaaaacagaggacagttctttactgtgtacaagcccaacattggtcggcaatcacagctggaagctctggattccttgaggcgtaagtttcatcgcgtgacggccgaagaggcgaaggaaccctgggagtccgggtacgcactgtccctgacacactgtagtcattctgcctggaatagacactgcagactggcccaggagggcaaggattgcctgcagggtctaaggttgcgccatcactatatgctgtgtggggccttgctgcgcgtctggggaagaatcgccgccgttatggccgatgtctcttcgtctagctatctgcagatcgtgaggctgaaaaccaaggatcgcaagaagcaggtcggcatcaagatccccgagggctgcgtgagaagggtgctgcaggagttaaggcttatggacgccgatgttaagcggcgccaagcccctgccctgggctgccccgcacctccagcgcctcgacccttggccctcccctgcggacccggggaggtcctcgacctgacttactcgccacctgcagaggcttttcctcctcctccccacttttcgttccccgcgccactgtcacttgacgctggtccaggcgtcgtgcccctcgggacaccagacgcccaggctgatcctgcagcactggcccaccaaggctgtgatatcaattttaaggaggtgcttgaggacatgctccgttccctacatgctggccctccatctgagggggcgcttggagagggcgctggggctggcggcgccgcagggggcgggcccgagcggcagagcgtcatccagttcagtccccctttccccggtgctcaagctccgctgtag

SEQ ID NO: 33672 - DNA, 3930 bp, Artificial Sequence
  Description of Artificial Sequence: Synthetic coding sequence
atgagagagccactccccgggtcagcgagttgggggactccaggcccaccaagtgccggcaccatgagccagcttcagttgtggctacagttcgaagctctgaataaagacagtagttacttcgaggacttcagtaatatatccattttttcatcctccgtggactccctgagcgatattgtcgacacgcctgatttcttacctgccgattctttgaatcaagtgtcgacgatttgggacgacaatccagccccctcaactcatgataaattgtttcagctgagccggccatttgcaggcttcgaagatttcctcccgtcacactcaacaccgctgctcgtgtcttaccaggagcagtcagtgcagtcccagcccgaggaggaagatgaagcagaggaggaggaggccgaggagctgggtcacacagagacttacgctgactatgtgccttctaaatccaagattggcaaacagcaccctgaccgagtcgtcgaaacttctactctctcctcagtacccccccctgacatcacgtataccctcgccctgccctctgattctggagccttaagcgctttgcagctggaagccatcacctacgcctgtcagcagcacgaggttctgctaccctctggacagagagctggcttcttgatcggcgatggcgctggcgtcggaaaaggcaggactgtcgctggcgtgatcttagaaaaccaccttcggggccgtaagaaagccctgtggttcagtgttagcaacgaccttaaatacgatgcggagcgggatctccgtgacattgaggccactggtattgctgtgcatgctcttagtaaaataaagtatggtgatacaactacatccgagggcgtgctgtttgcaacctatagtgccctgattggggaaagtcaggccggaggacaacaccgcacgcgactgagacagatcctggattggtgtggtgaggctttcgagggagtgattgtgtttgacgagtgtcataaggccaagaatgcagggtctactaaaatgggcaaggctgtgctggatctgcagaataaactacccttagcacgtgttgtgtacgcctcagccacaggggcctccgagccccgcaatatgatctatatgtcaaggctgggcatctggggggagggcactcccttccgaaattttgaggaattcctgcatgccatcgaaaagcggggggtgggtgccatggagatcgttgccatggacatgaaagtatcgggcatgtatatagcacgacagctgagcttttccggggtaacgtttcgaattgaagagatacctcttgcccccgcattcgagtgcgtgtacaacagagccgcgctgttgtgggccgaggccctcaatgtgtttcagcaagccgcggattggattgggctcgaatctcggaagtctttatgggggcagttctggagcgctcaccaacgattcttcaaatacctttgcatcgccgccaaggtgcggcgtttagttgagctggcgagggaagagctggctagggacaagtgcgttgtgattggactgcagtccaccggggaagcacggacccgggaagtgttgggtgagaacgatggccatttgaactgctttgtctcagcggcagagggagtttttctaagcctaatccagaaacattttccctctacaaaaagaaaaagagataggggggcaggctccaagagaaagcggcgcccgcgcggacggggcgccaaggctccccgcctggcatgcgagaccgctggcgtgatacggatctctgatgattcaagtacagagagcgaccccggcctcgatagcgatttcaactccagccccgagtcactggttgacgatgacgttgtgattgtcgatgccgtgggcctacccagcgacgaccggggtcctctgtgtcttcttcagcgggatccgcacggaccaggtgttctggagagggtggagaggcttaagcaagatctcctggacaaagttcgaaggttaggtcgggaacttccagtgaacacgcttgacgagcttatcgatcagctgggcggtccccagagagtggctgaaatgacgggccggaagggtcgcgtcgtctcccgacctgatgggacagtcgcttttgagagccgcgctgaacagggtctatctatcgatcacgtcaatctcagagaaaaacagagattcatgagcggtgagaagctggtggccatcatctctgaagcatcctcctctggtgtgagtctgcaagccgatcggcgggtgcagaaccagaggcgccgcgtgcacatgactctcgagttaccctggtccgctgatagggctatccagcagtttgggcgcacccacaggtccaaccaagtttcagcacccgagtacgtcttcctgatctcagagcttgcgggggagagacgtttcgcctcaatcgtggccaagcgtcttgaatctctcggggctctcacacacggtgaccgccgggctacagagagtcgagatctcagcaagtacaattttgagaataaatatggaacacgtgcactgcactgtgttctcacgaccatcctctcacaaaccgagaacaaggtgccagttccccaaggttatccagggggggtccctacttttttccgcgatatgaaacagggactgctgagcgtgggcatcggcggtcgtgagtcccggaacgggtgtctggatgtcgaaaaagattgttctataacaaagtttctaaatcggattctcggccttgaagtacacaaacagaatgctctgttccaatacttcagtgatacattcgaccatctaatagagatggacaaaagggagggcaagtacgacatgggaatcctggacttggccccaggaatcgaggaaatctatgaagagagtcaacaagtgtttttggcgcccggacatccccaggacggccaggtggtcttttacaaaatctctgtagatagagggctcaagtgggaagatgctttcgctaagagcctggcgttaacgggcccctacgacggcttttatctttcgtataaggtccgcggaaacaaaccatcttgtctattagcagaacaaaacaggggccagtttttcactgtctataagcccaacatagggcgccaaagccagctggaagcactggacagcctgagaagaaagtttcatcgcgtgaccgctgaggaggccaaggaaccctgggagagcggctatgctctgtcgctgacgcactgttcgcattctgcctggaatcggcactgccgacttgcccaggaggggaaagactgtttgcaggggttacgattgcggcatcactacatgctgtgtggggccctgttgcgagtgtggggccggatcgctgccgtaatggccgatgtcagtagctcttcctatctgcagattgtgagattaaaaacaaaggaccgcaaaaagcaggttggaataaagattccagagggatgcgtaaggagggtgctccaggaactaagattaatggacgccgacgtcaaaaggcgtcaggcacctgctctcggctgtcccgcccctccggcccccagacctctggcactaccctgcgggcccggcgaagtcctcgatttgacttactcacctccagcagaggccttccccccgccaccgcatttcagttttccagctccgctctctctggatgccgggccaggtgtggtgcctcttgggactcctgatgctcaggctgatcccgcagcgttagctcaccaggggtgtgacattaattttaaggaggtgctagaggatatgctacggtctctgcacgctggtccaccctccgaaggcgccctaggcgaaggagctggtgccggcggagccgcagggggcgggcccgaaaggcagtcagtgattcaattctccccacccttccccggggcacaggctccactgtag

SEQ ID NO: 33673 - DNA, 453 bp, Artificial Sequence
  Description of Artificial Sequence: Synthetic coding sequence
atgtccggttggatcgctacttcaaaaactaggatgcaagacttctggtctctgttaaccttctcctccgatcttgttgacgttaaggactctggcgactacccgcttactgcccccgggctgtcgtggaagaagttccaggggtctttctgcgagtttgtcggaaccctcgtgtgtcggtgtcagtatattctgctgcacgacgacttcccaatggacaaccttatctcccttttgactggcttctccgacagccaggtatgcgctttttgtcatacttctactctggcagccatgaagctaatgacatcgctagtcagggtcgctcttcaactgtccctgcatgaagacatcaatcagcgacagtatgaagccgaacgcaacaaggggccagggcaacgagcgccggaacgcttagagtccttgctggaaaagcacaaggagctgcattag

SEQ ID NO: 33674 - DNA, 453 bp, Artificial Sequence
  Description of Artificial Sequence: Synthetic coding sequence
atgtctgggtggatcgcaacatcaaagactcgcatgcaggatttctggtctctgcttactttcagtagcgatcttgtcgacgtcaaggattcaggagactaccccctgaccgctcccgggctgtcctggaagaaattccagggatcattctgcgagttcgtaggcacgctggtttgtcgctgccaatatatactgttgcacgacgactttcctatggacaacttgataagcctgctcacagggttctcagacagccaggtttgcgcgttctgtcacacaagtaccctcgccgctatgaagctcatgaccagtctggtccgagtggccctgcagctcagtctgcacgaggacatcaaccagcgacagtatgaggcagagagaaacaagggacccggccagagggcacccgagaggctggagagcctgctcgaaaaacacaaggagctgcattag

SEQ ID NO: 33675 - DNA, 891 bp, Artificial Sequence
  Description of Artificial Sequence: Synthetic coding sequence
atgctttccccaaaagacatcctgcggaaggacctgaagctggtccacgggtaccctatgacttgtgcctttgcaagcaattgggaaaagatcgagcaattccacagcaggcctgacgatattgtgatcgccacatatcctaagagcggcaccacctgggtttctgagatcatcgatatgatcctaaacgatggggatatcgaaaagtgcaagcgcggctttatcaccgagaaagtccccatgctcgagatgactttgccggggctcaggaccagtgggattgaacagctcgagaaaaaccccagtccgcgcatagtgaaaacacacctgcccacagatcttttacccaaatccttctgggaaaacaactgtaaaatgatatatttggcacgcaatgcaaaggacgtgtcagtgtcatactatcattttgatctgatgaacaacttgcagccattcccagggacctgggaagaatatttggagaaattcctgacaggcaaggtagcatatggatcttggttcacccatgtaaagaattggtggaaaaagaaggaagaacatcccatcttgtttctgtattacgaagatatgaaggaaaaccccaaagaagaaatcaagaaaatcatccgattccttgagaagaacctgaatgacgagatcctggacagaattatccaccatacatctttcgaagtcatgaaggacaaccctttagtgaattatacccacctgcctaccacagtaatggatcatagtaaatctccttttatgaggaaaggcacagccggcgattggaaaaattacttcacggtggctcagaacgaaaaatttgatgctatatatgaaacagaaatgtctaaaaccgccttgcaattcaggacagaaatttag

SEQ ID NO: 33676 - DNA, 468 bp, Artificial Sequence
  Description of Artificial Sequence: Synthetic coding sequence
atgctctcccccaaggacatcctccggaaagatctgaaacttgtgcatgggtaccccatgacctgtgctttcgcgagcaactgggagaagatcgaacagttccactccagacctgacgatatcgtgattgccacctaccccaaaagtggcacaacctgggtgtcagagattattgacatgatactgaatgatggcgacattgaaaaatgtaaacgcggattcattacagagaaagtgcccatgctggagatgaccctgcccggacttaggacctccgggattgaacagctggagaagaaccctagcccccggatagtcaaaacccacctgccgacagaccttctgccaaagtcattttgggagaataattgcaagatgatctacttagccaggaatgccaaagacgtgagcgtgagttattaccacttcgacctcatgaacaacctgcaacccttccctggcacgtag

SEQ ID NO: 33677 - DNA, 639 bp, Artificial Sequence
  Description of Artificial Sequence: Synthetic coding sequence
atggatccagtggtgctgtcctacatggatagtttgttaagacagtctgacgtgagcctgctcgacccaccatcttggttgaacgaccacataataggttttgcgtttgagtacttcgcaaacagccagtttcacgattgcagtgaccacgtgagctttataagccctgaggtcacacagttcatcaagtgcacaagtaatcccgccgagatcgccatgtttctggaaccattagatctgccaaacaaaagagtcgtgtttctcgcaatcaacgacaattctaaccaagccgctggaggcacacactggtctctcctggtttatctgcaggataagaacagtttcttccattacgacagccacagcaggagcaactcagtacacgcaaagcaagtggccgaaaaactggaggcctttctcggtagaaagggcgacaagctggcctttgtcgaggaaaaggcgcctgcacaacaaaacagctacgactgcgggatgtatgtgatctgtaacaccgaagcgttgtgccaaaattttttcagacagcagacagagtcgctactgcagcttcttacacctgcctatatcacaaagaagcggggggagtggaaggatcttatcactacgttggccaaaaaatag

SEQ ID NO: 33678 - DNA, 639 bp, Artificial Sequence
  Description of Artificial Sequence: Synthetic coding sequence
atggaccccgtggtactcagttacatggattccttgttacggcaatcagacgtctccttgctggatccgccaagttggctcaacgatcatattattggcttcgcctttgagtatttcgcgaatagtcaatttcatgactgcagtgatcacgtgagttttattagccctgaagtgacacagttcatcaagtgcaccagcaatccagcggagatagcaatgtttctggagccacttgacttgcccaacaagcgcgttgtgtttctagctatcaatgacaacagcaaccaggctgcggggggcacccattggtcgctattagtataccttcaagacaaaaattcttttttccactatgatagccatagccggtctaactcagtacatgccaaacaggtagctgagaaactggaggcctttctcgggcgcaaaggcgataagcttgcgtttgtcgaagaaaaggctccagcccagcagaacagctatgattgtggcatgtacgtgatttgcaatactgaggctctatgtcagaatttttttagacagcaaacagagtcgctgctccagttacttaccccggcatacattaccaaaaaacggggcgagtggaaggatctgatcaccactctggccaagaaatag

SEQ ID NO: 33679 - DNA, 639 bp, Artificial Sequence
  Description of Artificial Sequence: Synthetic coding sequence
atggaccccgtcgtcttgtcctacatggattcactgctgagacagagcgacgtgtcactgctagatccgccttcttggttgaacgatcatatcatcgggttcgcgttcgagtacttcgccaatagccaatttcacgactgctctgaccacgtatcttttataagcccggaagtgacccagtttatcaagtgtacctccaaccctgcggaaatcgctatgtttctggaacctctggatctccctaataaacgcgtcgtgtttcttgcgattaacgacaactcgaaccaggccgcaggtgggacccactggtccttgcttgtgtacctgcaagacaaaaattcattcttccattacgattctcacagtaggtctaatagtgttcatgccaagcaggttgccgagaagctggaggcttttcttggcagaaagggtgataagctcgccttcgtggaagaaaaggcccctgcccaacagaatagctatgactgcggcatgtacgtgatatgcaatactgaggcgctctgtcaaaatttctttcgccagcagacagaatccctgctgcaactgcttacacccgcttacatcacgaaaaagcgcggcgagtggaaggacctcataaccacactggccaaaaagtag

SEQ ID NO: 33680 - DNA, 639 bp, Artificial Sequence
  Description of Artificial Sequence: Synthetic coding sequence
atggaccctgtggttttgtcttatatggacagtctcctaaggcagagcgacgtgagcctgcttgacccaccttcttggttgaatgaccacatcataggctttgcctttgagtactttgctaattcacagtttcacgattgcagcgatcatgtgtctttcatcagcccagaggtcacccagtttattaagtgtactagcaacccagccgagatcgcgatgtttctcgagcctctcgatctgcccaacaagagagttgttttcttggcgatcaacgataattctaaccaggccgcgggcggtactcattggtccctcctcgtgtacctccaggataagaactcctttttccattacgattcccattctagatccaatagtgtgcatgccaaacaggtagccgagaaactggaagccttcctgggcaggaagggtgacaaactggcctttgtggaggaaaaagccccggctcagcagaactcatatgactgcggcatgtacgtgatttgtaatactgaggcactgtgccaaaatttttttaggcagcagacagagtccctcttacagctgcttactccggcctatatcactaaaaaacgaggcgagtggaaggatctgattaccaccttagccaagaagtag

SEQ ID NO: 33681 - DNA, 1668 bp, Artificial Sequence
  Description of Artificial Sequence: Synthetic coding sequence
atggcggatcggggaggggtgggcgaggctgccgcagtcggggccagtccagctagtgtgcccggcctgaaccccactctcggatggcgcgagcggctgagggccggcctggcaggaacaggagcttctctgtggttcgtcgcgggcttgggtctgctctatgcactgcgaattccgcttcggctctgtgaaaacctcgcagccgtgacagtattcctcaactccctgactcctaaattctatgtggcactgacagggacctcgtcacttatttctggcctgatcttcattttcgaatggtggtactttcacaagcatggcacctcctttattgagcaggtcagcgtctcacaccttcagccacttatggggggaacagaatcgtcgatttctgaaccaggctctccaagtaggaacagagagaacgaaactagcaggcagaacttatccgaatgtaaggtgtggaggaaccccctgaacctgtttcgtggcgcggagtacaggagatatacatgggtgactggcaaagagccccttacctattatgatatgaacctgagcgcccaggatcatcaaacctttttcacatgcgacacagattttctccgacctagtgacaccgttatgcagaaggcctggagggagaggaaccctcccgctcgcattaaagcagcctatcaggcactggaactcaataacgattgcgctactgcctatgtgcttctagcggaggaggaggctacaacaattgtggacgccgagcggctgttcaagcaggctcttaaggctggggagaccatctatcgtcagtctcagcagtgccaacatcagtccccccagcatgaagcccagttgcgacgggacaccaatgttctggtctatataaagcgtcggctcgctatgtgcgcaagaaaactcgggaggatcagagaggcggtaaaaatcatgcgggacctgatgaaagagtttccacctctgaccatgctgaatattcacgaaaacttgctggaaagcttgttggagctccaggcctaccctgacgtccaggccgtgctggccaagtacgacgacattagtctgccaaaatcagctgcaatatgctatactgccgctttgctgaagactagaacagttagcgagaagttcagccccgagaccgcgtctagaaggggcctaagcaccgcagagattaacgcagtggaagcaatccacagggccgtggagttcaatccacatgtcccaaaatacttactcgaaatgaagtcattgattttgcctccagaacatatcctgaaacgcggggattctgaggccatcgcttacgcttttttccaccttcaacactggaaaagaatcgagggggcactaaatctcctccaatgtacttgggaaggtacattccgaatgattccttacccactcgaaaaggggcacttgttctacccttacccttcctgcaccgaaacagctgatcgagaactgctccccactttccaccacgtctccgtctacccaaagaaggagctcccactgttcatacactttactgccggattttgtagttccaccgctatgatagctatactgacgcaccagttccctgagattatgggcatttttgccaaggctgtgagcatgatctctcgtacatgcgtggattatttgtag

SEQ ID NO: 33682 - DNA, 1728 bp, Artificial Sequence
  Description of Artificial Sequence: Synthetic coding sequence
atggctgacaggggcggtgtcggcgaggctgctgctgtgggagcgtcccctgcctctgtgcctggactcaatcccacattgggctggagagaaaggctcagagcgggcctggctgggactggagccagcctgtggttcgtggcaggcttgggtctgctgtatgccctgaggattcccttaagattgtgcgagaatctggccgccgtgacagtgttccttaactccttgacacccaagttctacgtggccctgacagggacatcctccctcatttccggcttgattttcatctttgaatggtggtatttccacaaacacggcaccagcttcattgaacaggtctcagtgtcccaccttcaacccttaatgggcggcacagaaagtagtatatcggagccaggttcaccgtctaggaatagagagaacgaaacgtcaaggcaaaacctgtcagaatgtaaagtttggaggaaccccctgaaccttttcagaggggcagagtatcgacgatacacctgggtaacaggaaaagagccactgacttactacgacatgaatctctccgctcaggaccatcagaccttctttacttgcgatactgacttcctgcggccatccgacactgtaatgcaaaaggcctggagagagcgtaatccccctgcccgtattaaggccgcctaccaggctctggagctaaacaacgactgcgccacggcatatgtcctcctggccgaggaagaagccaccactatcgtcgacgccgagaggctgtttaaacaagccctgaaggctggagaaacaatctacagacagagtcagcagtgccagcaccagagtccccagcacgaagcacagctccggagagacacaaatgtcttggtctacatcaaacgacgactagccatgtgtgctcggaagctcggacgtattcgggaggcagtgaagatcatgcgtgatttaatgaaagaatttccgccactcacaatgttaaatatccatgagaatcttcttgagtccctcttagagcttcaggcctacccagatgtgcaggcggtattggccaagtacgatgatattagtcttcccaaatcagccgctatttgctatactgccgctctgctcaaaacccggaccgtttcagagaagttctcacccgagactgcctcgagaaggggactgtctaccgccgagatcaatgcggtggaggccatccaccgagccgtggagtttaatccccatgtgccaaaatatcttcttgagatgaagtccctgatcctaccgccagagcatatccttaagcgcggtgattcggaggccatcgcctatgctttctttcatttgcaacactggaaacggatcgaaggagccctgaacttactgcagtgtacctgggagggaacgtttcgaatgatcccctaccccctcgaaaaaggccacctgttttatccatatcctagctgtactgagacggcagatcgggagttgctgccaacctttcaccatgtgagcgtctatcccaagaaagaactgcctctgttcatacatttcacggctggattttgctcctccacagccatgatagctattcttacgcaccaattcccagaaatcatgggcatcttcgccaaagcggtgctggggctgtggtgcccacagccctgggcttctagcggcttcgaggagaacactcaggatctgaaaagtgaagatttggggctaagctctggctag

SEQ ID NO: 33683 - DNA, 1635 bp, Artificial Sequence
  Description of Artificial Sequence: Synthetic coding sequence
atggccgatcgcggcggcgtaggggaagcagcagcagtaggcgcttcccccgccagcgtaccgggactgaatccaaccttgggctggcgcgagcgcctgcgggccggcttagctggcacgggggctagtctgtggttcgtcgcagggctaggcctcctgtacgccttgcgcattccactgcgactatgtgagaacttagcggcggttacggtgtttttgaactcacttacccctaaattttatgtagccctcactggcacctcatcccttatttccggcctgatatttatatttgaatggtggtatttccacaagcacgggactagtttcatcgaacaggtatccgtgtcgcacctgcagcccttgatgggcggcaccgagtcgtccatttctgagccaggaagtccatcgagaaatcgggagaacgaaacttctcgacagaacctgagtgaatgtaaggtgtggcgcaaccctttgaacctgttccgtggagccgagtataggcgctatacgtgggttacaggaaaggagcccctgacctactacgatatgaatctgtcagcccaggaccaccagactttcttcacatgcgatacggactttctccgtccttccgacaccgtgatgcagaaagcctggagggaacggaatcctccagctagaattaaagccgcctatcaggcactggagctcaataacgactgtgctaccgcttacgtgctgctggccgaagaggaagcaactactattgtcgatgctgaaaggctctttaaacaagccttaaaagcgggcgaaacgatctatcggcagagtcagcaatgccagcatcaatctccccagcacgaggcccagttgagaagggacacgaatgttcttgtgtatattaaaagacgtcttgcgatgtgtgctaggaaactgggtcgcatccgcgaagcggttaaaataatgagagatttgatgaaggagttccccccactgaccatgttgaacatccatgagaacctgctagaatcactcctcgaattgcaggcgtacccggacgtccaagccgtgctcgctaagtatgatgatatttccctgcctaagagcgccgcgatctgctacacagccgcattactcaagactcgcaccgtctcagaaaagttttcaccggaaactgccagtaggaggggactctccaccgccgaaatcaatgctgtggaggctattcatcgcgccgtagaatttaaccctcacgtgccaaagtacctccttgagatgaaaagcctcatcttgcccccggagcatattctcaagcggggtgacagcgaggcaatcgcctacgcttttttccatctgcagcactggaaaagaattgaaggtgcattgaacctccttcaatgcacctgggaaggcacgtttcaccacgttagtgtgtatcccaagaaagagcttcctctgtttatccatttcactgccggcttctgctcatccacagcgatgatcgcaatcttgacgcaccagttccctgaaattatgggcatctttgctaaagccgtgttggggttgtggtgcccccagccttgggcgtctagcgggtttgaagagaatacccaggatctgaaatccgaggatctgggtctcagcagcgggtag

SEQ ID NO: 33684 - DNA, 690 bp, Artificial Sequence
  Description of Artificial Sequence: Synthetic coding sequence
atgtccccatttctcttcagagatgatatgaaggacctcacagtgtttcttaattccctgacacctaagttttacgttgctctgaccgggacaagttccttaatttcaggcctaatcttcatttttgaatggtggtattttcacaaacacggcacgtcctttattgagcaggttagcgtctcccacttgcaacctctaatgggggggacagagtcctccatatcagaacccggctcgcctagcagaaatcgcgagaacgagacctctaggcagaacctctcggagtgtaaagtgtggcggaatcccctcaacttgttccgaggtgccgaataccgacgttacacctgggtgactggcaaggaacctttaacttactatgatatgaatctctcagctcaggatcaccagacattcttcacatgcgataccgacttcttgcgccccagtgatacagttatgcagaaagcttggagagagcgcaaccctcctgcccgcataaaggcagcctatcaggcacttgagcttaacaatgactgcgccactgcttatgtcctcctggccgaggaagaggcaaccacaatcgtcgatgctgaaagactgtttaagcaggctctcaaagctggcgaaacaatttacagacaatcccagcaatgtcagcaccagtcccctcaacatgaggcccagctgtag

SEQ ID NO: 33685 - DNA, 966 bp, Artificial Sequence
  Description of Artificial Sequence: Synthetic coding sequence
atggggggcacagaaagcagcatctccgaacctggcagtcccagtcggaaccgcgagaatgaaaccagtcgtcaaaacctgtctgagtgtaaagtttggcgcaatcccctcaatctgtttaggggagctgagtacagacggtacacatgggtgactggcaaagaacccctaacatactacgacatgaatctgtcggcgcaagaccatcagacattctttacgtgcgacaccgactttctgcggccctctgacaccgtcatgcagaaggcctggcgagaacgaaaccctcccgctcggatcaaggctgcataccaggcactggaattgaacaatgattgtgctaccgcttacgttctcttggcagaggaggaggcgacaacgatcgtggacgccgagcggctcttcaagcaggccctgaaggccggcgaaacaatctatcggcagtctcaacagtgccaacatcaaagcccacagcacgaagctcagctgaggcgggacacaaacgttctcgtgtatattaagcgccgcctggcaatgtgtgcgcggaaacttggtaggattcgggaggccgtgaagataatgagagacttgatgaaggagtttccacccctgaccatgctgaacattcatgaaaacctgttagaatcactgctagaactccaggcataccccgacgttcaggcggtcctcgctaaatacgacgacatctccctgccgaagtccgctgctatctgctacaccgcagcattgcttaaaacccgcacagtgtctgaaaagttcagccccgagaccgcatcccggcgtggccttagtacagccgagataaatgctgtcgaagcaatccaccgagccgtggaatttaaccctcatgtgcccaaggtggaaatttacccgttctcaccacagcttaacatcaaagctgttgacaactcagctatcagtaagtatccagcaaacatgtactag

SEQ ID NO: 33686 - DNA, 1617 bp, Artificial Sequence
  Description of Artificial Sequence: Synthetic coding sequence
atggcagatcgcggtggtgtcggagaggccgccgcagtgggggcatcaccagcaagcgtgcctggcctgaatcctacattgggatggagggaaaggctgcgggctgggcttgctgggactggagcctctctttggtttgttgccggcctggggttgctgtatgcactgcggatacccttgcgactttgcgagaacctggctgcaggtactagttccctgatctccggcctcattttcatcttcgaatggtggtactttcacaagcacggtacctcctttatcgaacaggtttcagtgtcacatctgcagcccttgatgggtggaactgaatccagcatttcagagcccgggagcccatcccggaacagggaaaatgagacttcaagacagaacctgtccgaatgcaaagtgtggcgtaatccattgaatctgtttcgcggggccgaataccgccggtacacatgggtcacaggcaaagagcccttaacatattatgacatgaatctgagtgcccaggaccaccagacgttcttcacttgtgacacagacttcctgcgccctagtgacacggtaatgcagaaggcctggcgggagaggaatcccccagctagaatcaaggcggcttaccaggcccttgaactcaacaatgactgcgcaactgcctacgtgttgctggccgaggaggaagctactacgatcgtggatgcagagagactattcaaacaagcccttaaggcaggagaaactatttacagacagagccagcagtgtcagcatcaaagcccacagcatgaagctcagttacgtagagacacaaatgtgctggtgtacataaagagacggctggctatgtgtgctaggaagctgggtagaataagagaggccgtgaagattatgagagacttaatgaaggagtttcctccattgactatgttaaatatccatgagaacctgctcgagagtctgctggagctgcaggcctaccccgacgtacaagccgtactggccaagtacgacgacatcagcctgcctaaaagcgccgcaatctgctacacggctgccttgttgaagacccgaactgtgagtgagaagtttagtcctgagaccgccagtcggcgcggcttgtccactgccgagattaatgccgtcgaggcaattcatcgcgccgtagaatttaaccctcatgtccctaagtacctgttggaaatgaaatccctgatactccctccggaacacatcctcaaaagaggggactccgaggccattgcctatgcatttttccacctgcagcattggaagcgcattgaaggggccctgaacctgctgcaatgcacctgggaggggacctttagaatgattccatatccacttgaaaaaggccacttattttatccctacccctcctgcactgagactgctgaccgagaactcctacccaccttccatcacgtgtccgtgtacccgaagaaggagctgccacttttcatccactttacagctgggttctgctcctctacggcgatgatagctatactgacccaccagtttcccgaaatcatggggatttttgccaaggctgtgagtatgatcagtcgaacctgtgtagattacctgtag

SEQ ID NO: 33687 - DNA, 1668 bp, Artificial Sequence
  Description of Artificial Sequence: Synthetic coding sequence
atggccgaccgcggtggagtgggtgaagctgcagctgtcggagcgtctccagccagtgtgcccggccttaatcctaccttgggctggcgtgaacgactgcgcgcagggctggctggcacgggggcctccttgtggtttgtggcaggcctcggcctgctgtatgctctgagaattcctctccgcctctgcgagaatctggcagctgtgacagtatttctaaatagtctgacacccaaattttacgtggcgctgaccgggacatcctccctgatatccgggctgatcttcattttcgaatggtggtacttccataaacacgggacatcattcatcgagcaggtgagtgtgtcccacctccagccacttatggggggaacggagtcttcgatctctgaaccaggctcccccagtcgaaatcgcgagaacgagacatcgcgccaaaacctgtccgagtgcaaagtgtggcgcaatccattgaaccttttccggggggccgagtatcgcaggtatacctgggttacgggcaaggagcccctgacttactacgatatgaatctttccgcgcaggaccatcaaacattttttacctgtgataccgattttttacgaccaagtgacaccgtcatgcagaaggcctggagggaacggaacccccccgccaggatcaaagcggcctaccaggcgctcgagctgaataacgattgcgctactgcttacgtcctattggcagaggaggaggctacaaccatcgtggatgcagagcggttattcaagcaggcactgaaggctggcgagaccatctatcggcagtcacagcagtgccagcaccagtccccacagcacgaagcccagcttagacgcgacacaaatgtgctagtgtacatcaagagacgacttgccatgtgtgcacggaagctgggcagaattcgcgaggcggtgaagatcatgagggacttgatgaaggaatttccaccccttaccatgctcaacatacacgaaaacttgctagaaagcctgctcgagctgcaagcctaccctgacgtgcaagcggtgctggcaaagtatgacgacatctctttacccaagagtgccgcaatctgctacacggcggcacttttgaaaaccagaacagtgagtgagaaattctcgcccgagactgcctcccggagaggtctcagcaccgctgagatcaatgctgtggaagccatacaccgagctgtggagttcaacccacacgttcccaaatacctgctggaaatgaaatccctgatcctgccccctgaacacatcctgaaacggggtgattcagaggccattgcctatgcgttttttcatcttcagcactggaaacggattgaaggcgcacttaacctcctccaatgtacctgggaggggactttccgcatgatcccgtaccctttggagaagggccacctcttctatccatacccctcttgtaccgaaacagccgaccgtgaactcctgcctacattccatcacgtgtctgtgtacccgaagaaagaactgcctttatttatccactttacggctggattttgttcatccaccgcaatgatagcgattctgacccatcagttcccggaaatcatgggtatttttgcaaaagcagtggtgggtgtgaagacccagaaggagaacgctgactag

SEQ ID NO: 33688 - DNA, 1179 bp, Artificial Sequence
  Description of Artificial Sequence: Synthetic coding sequence
atgaatctgtctgcgcaggaccatcaaacattttttacatgtgatacagacttccttcggccatcagataccgttatgcagaaggcatggcgtgaaaggaatccccccgctcgcatcaaagccgcctaccaggccctagagctgaataatgactgtgctactgcttatgtgttactggccgaagaggaagcaacaactattgtggatgccgaacgcctgttcaagcaggcgttgaaggctggcgaaacaatctacaggcagtcccagcagtgtcaacatcagtccccacagcatgaggcccagctgagacgtgacactaatgtcctagtttacatcaagcgaaggctggcaatgtgtgcccgaaagctagggaggattagggaggcagttaagattatgagagacctgatgaaggagtttcctccgcttaccatgctgaatatccacgagaacctactggaatccctcttggagttgcaggcgtaccctgacgtgcaggctgtccttgccaagtatgatgacattagtctgccgaagagtgcggccatttgctacaccgcggccttgctaaagacccggaccgtcagcgaaaaattttccccagaaactgcttcacggaggggtctgagcaccgcagaaatcaacgccgtggaggcgattcaccgagccgtggagtttaatccccatgtccctaaatacctgctggagatgaagtctctgatcctccctccggaacacatcttaaaacgtggtgattctgaggccatcgcttacgccttctttcatttgcagcattggaaaagaattgagggtgccttgaacctacttcaatgcacgtgggaaggcacattccggatgatcccataccctctcgagaaaggccacctgttctatccatatcccagctgtaccgagacggcagaccgggaactgctaccaaccttccaccacgtgtctgtttatccaaaaaaagaactccctctgttcatccacttcaccgccggtttctgttcctccactgcgatgattgccatcctgacccatcagtttcccgagataatgggaatcttcgccaaagccgttctcggcctgtggtgtccccagccctgggcctctagcggcttcgaagagaacacacaggatctcaagagcgaagacctgggactctcttcaggatag

SEQ ID NO: 33689 - DNA, 978 bp, Artificial Sequence
  Description of Artificial Sequence: Synthetic coding sequence
atgggcggcaccgagtcatccatttcggagcccggtagccctagccgaaacagagaaaacgagacctctagacagaacctgtctgaatgtaaggtttggcggaatccactgaatctgttcagaggcgccgaatatcgccgttacacctgggtgacgggcaaagagcccttgacatactatgatatgaatctcagcgcacaggaccatcagacatttttcacttgtgacaccgatttcttgagaccatcggacacggtcatgcagaaagcttggcgagaaagaaatccccctgctaggatcaaggctgcttaccaggctctcgagctaaacaatgactgcgccacagcctacgttcttctggccgaggaagaggcgactactatagtcgatgctgagaggctgtttaagcaggcacttaaagcaggcgagactatttacagacaaagccagcagtgccagcaccagagtcctcagcacgaggctcagctccgcagagatacaaatgtcttagtctatattaaaagacggttggcgatgtgtgcacgtaaactgggtaggattagggaggcagtcaaaatcatgcgcgattacctgttggaaatgaagtctctgattctccctcccgagcacatcttaaagaggggagactcggaagcgattgcttatgcgttcttccacctgcaacactggaagagaattgaaggtgccctcaacctgttacagtgcacatgggagggcacgtttcatcacgtctccgtgtatcctaaaaaagagttgcccttgttcatccactttactgctggattctgttcatctacagctatgatcgcaattctaacgcatcagtttcctgagatcatgggcatcttcgctaaagccgtgctgggcctgtggtgtccacagccgtgggcctcatccggattcgaagaaaatacacaagacttaaaatccgaggacctgggcctgagctcaggctag

SEQ ID NO: 33690 - DNA, 864 bp, Artificial Sequence
  Description of Artificial Sequence: Synthetic coding sequence
tgaattagcgagccaggttcgccatcccggaatcgcgaaaatgaaacttcccggcagaatctttccgagtgtaaagtgtggcgaaatcccttaaacctattcaggggggcagagtaccgccggtatacctgggtaacagggaaagagccgctgacttactatgacatgaatctctccgcccaggaccatcagacgttttttacctgtgacacggactttctgcgaccctcagacacagtgatgcaaaaggcatggagggaacggaacccacctgcccggataaaagccgcttatcaggcactggagctaaacaatgattgcgcgactgcatacgtgctgctggcggaggaggaggcgacgaccatcgtggacgcagagcggcttttcaaacaggctctaaaagccggagagacaatttatcggcaatctcagcagtgtcagcatcagtccccacagcatgaggctcagctgcgtcgagacacgaacgtgttagtgtacatcaagagacgattggccatgtgtgctagaaaactcgggcgaatccgtgaagccgtcaagatcatgcgagattacctacttgaaatgaaaagtctcatcttgcctccagagcatatcctgaagcgcggggattcagaggctatagcatatgctttttttcatctccaacactggaagagaattgagggcgctctgaatctgctgcaatgcacatgggaagggacgtttcatcacgtttcagtttaccccaagaaggagctgcccctgtttatccatttcactgccggtttttgctcgtctacagccatgattgcaatactaacacatcaattccccgaaattatggggatctttgccaaggcctag

SEQ ID NO: 33691 - DNA, 1677 bp, Artificial Sequence
  Description of Artificial Sequence: Synthetic coding sequence
atggccgacaggggaggcgtgggcgaggccgcagccgttggtgcttctcccgcctccgtgcctggcctgaatcccactctcggatggcgcgagcgactccgtgctgggttagcgggcaccggggccagcctgtggtttgtcgctggattaggtctcctctacgcacttcgtatcccactgagactgtgcgagaacttggctgctggtacgtcaagccttattagtggtctaattttcatttttgaatggtggtacttccacaaacacggcacctcttttattgaacaggtgtctgttagccatctccaacccctgatgggtgggactgagagcagcattagcgaacccggctctccttctagaaatagagagaacgagacgtcgcgccagaatcttagcgagtgcaaagtttggcgtaacccactgaacctgtttaggggtgcagaatatcgaagatacacatgggtgacaggcaaggaacccttaacatactatgacatgaatcttagcgcccaagatcaccaaacattctttacttgcgataccgacttcttgcggccctctgataccgtgatgcagaaggcctggagagagagaaacccaccagctagaatcaaagcggcatatcaggccctggagctcaacaatgactgcgctaccgcttatgtactccttgcggaggaagaggccaccacaatcgtggatgcagagagattgttcaaacaggcacttaaggccggggagaccatttataggcagtcccagcaatgccaacaccaatctccacagcatgaagcccaacttcggagggacactaacgtcctagtatacattaagcgtcggctggccatgtgtgcaaggaagttgggtcggattagggaggcagtgaaaatcatgcgtgacttgatgaaagagtttcctccccttacgatgcttaatatccacgaaaaccttcttgagtctttactggaactgcaggcttaccctgatgtgcaggccgtactcgcgaagtatgacgatatatcccttcctaaaagcgcagccatctgttataccgcagccttgcttaaaacccgtactgtgtctgagaaattctcacctgaaacagcatcaaggcgcggcctctcaaccgctgagattaatgcagtggaagcgattcaccgagccgtagagttcaaccctcacgttcccaagtatctcctggaaatgaagagtttgatcctcccacccgaacacatactcaaacgaggagattcagaagccatagcttacgctttttttcacctccagcactggaagcggattgaaggggccctgaacctcctgcagtgcacttgggaaggaacatttcggatgatcccgtatcccttagagaagggccatttattttacccttatccctcatgtacagagacggccgacagggagctgcttcctacgttccatcacgtgagtgtctacccgaaaaaggagcttccactcttcattcactttaccgcaggattctgcagctcgaccgcaatgattgcaattctcacccaccagttccccgaaataatgggcatattcgcaaaggccgtgctcggactctggtgcccacagccctgggcctcaagcggcttcgaggagaacactcaggacctgaaaagcgaggacctcgggctgtcttctgggtag

SEQ ID NO: 33692 - DNA, 1500 bp, Artificial Sequence
  Description of Artificial Sequence: Synthetic coding sequence
atgtcgccatttctgtttcgtgacgatatgaaggaccttactgtttttctgaacagcctgacacccaagttttatgtggctctgacaggcacctccagcttgattagtgggctcatttttatctttgagtggtggtacttccataaacatgggacgagcttcatcgagcaggtgagcgtttcacaccttcagccccttatggggggcacagagagctcaatttctgaacccgggtccccttctaggaaccgggagaatgaaacctctcggcagaatctgtccgagtgtaaggtctggagaaatccgctaaatcttttccgcggcgctgaatatcgacgatacacatgggtgacgggaaaggaacccctgacttactacgatatgaatcttagcgctcaggaccatcagacattttttacctgcgacaccgatttcttgcggcccagtgacaccgtgatgcagaaagcgtggcgagagaggaaccccccggcccgcataaaagccgcataccaggctctggagctcaataatgattgtgccacagcttatgtcctgctcgctgaggaagaggccactaccatcgttgacgccgagcggctgtttaaacaggccctgaaggctggagaaaccatctaccgccaatcccaacagtgtcagcaccagtccccacagcatgaggcccagctgaggcgcgatactaatgttctcgtgtatattaaacggagactcgccatgtgcgcaagaaaactcgggagaatcagggaggccgtgaagatcatgcgagatcttatgaaagaattccccccattgacaatgttgaacatccatgaaaatctgctggagtccttgctggagttgcaagcataccctgatgtgcaggccgttttggccaaatatgatgacattagtctgccaaaaagcgcagcaatctgctatacagctgctctgctgaaaacaagaaccgtgtccgagaagttttctccagagaccgcaagtagacgggggctatccaccgctgaaatcaatgccgtcgaggcaatccatcgggccgtggagtttaatccccatgtcccaaagtaccttcttgaaatgaaatcactgatcctgccacccgagcatatactgaagcggggcgactctgaagccattgcctacgccttcttccacctgcaacactggaaaaggatcgaaggagcattaaacctccttcagtgcacctgggagggtaccttccgcatgattccttacccgctggagaagggccacctattctacccatatccctcttgtacggagactgctgatagggagctgcttcccacctttcatcatgtgagcgtgtaccccaaaaaagagcttccactatttattcactttaccgccgggttttgctcaagcacagctatgatcgctattctcactcaccaattcccagaaataatggggatcttcgctaaagcagtctcaatgattagtcgcacctgcgtggactacctttag

SEQ ID NO: 33693 - DNA, 1206 bp, Artificial Sequence
  Description of Artificial Sequence: Synthetic coding sequence
atggccgaccgcgggggtgtcggggaggcagcagctgtgggcgcgagtccagccagcgtccctggtcttaaccccactttgggttggagggaacgactgcgggccgggctggctgggactggcgcctctctctggtttgtggccggactggggctactctatgccctgcgtatcccccttcgtctctgtgagaacttagctgcaggcacctctagcctgatttcaggcctgatctttatctttgagtggtggtattttcataaacatggcacttctttcatcgaacaggtaagtgtgagtcaccttcagcctctcatgggtgggacagagagctctatcagcgagcctggttccccgtcacgaaaccgtgaaaatgagacttctaggcaaaatctcagcgaatgcaaggtgtggcgcaatccattgaatttattcagaggagcagagtaccgccggtacacatgggttaccgggaaagaacccctcacatactatgatatgaacctgtccgcccaggatcatcagaccttttttacatgtgacacggatttcctgcgtccttccgacacggttatgcagaaggcgtggagagagagaaatcctcccgctcgaatcaaagccgcttatcaggctctcgaactcaacaatgactgcgccactgcctacgtgctgttggctgaggaggaagctactactatcgtggatgccgaacggctgttcaagcaagccttgaaggccggagagactatataccgccagtcccagcagtgccagcaccaatcgcctcagcatgaggctcagctgagacgggatactaatgtgttggtatatatcaaacgccggctggcaatgtgcgcaagaaagctggggagaatccgagaggcggtgaaaattatgagagacttgatgaaggagttcccccctctcacaatgttgaacattcatgagaatctgctcgagagtcttctggagctacaggcctatcctgatgtgcaagctgtccttgctaagtacgatgacatttccctacctaagagtgcagccatctgttacaccgcagctttactcaaaaccaggacagtgtcggaaaaattcagccctgaaacagctagtcgacgcggcttgtcaacagccgagataaacgcagtggaagcaattcacagggcggtagagtttaacccacacgtgcccaagctactggagtag

SEQ ID NO: 33694 - DNA, 1533 bp, Artificial Sequence
  Description of Artificial Sequence: Synthetic coding sequence
atggccgataggggcggcgttggcgaggctgccgcagttggagcctcacctgcatctgttccgggattgaatccaactctgggatggagagagagactacgtgctggccttgcggggacgggggcctcgttatggtttgtcgcaggtctgggactgctgtacgctctgcgaatccctttgcgactgtgtgaaaacctggccgccgtaacagttttcctcaattcactgacgccaaagttctacgtggcccttaccggcacctcgagcctcatctcaggacttattttcatattcgaatggtggtatttccacaagcatggaaccagctttatagagcaggtgtctgtgtcacacttgcaacctctaatgggagggaccgagtcctcaattagtgagcctgggtcgccaagccgcaaccgcgagaatgagacatctcgccagaacctgtccgaatgcaaggtctggcggaaccccctgaatctgtttaggggtgcagaataccgatcctgtgcaacagcttacgtcctcctggccgaagaagaagctactactattgtggacgccgagcggctgttcaagcaagcacttaaggctggggagaccatttaccgccagtctcagcagtgtcaacaccaatctccacagcacgaggcccaactgcgaagggacactaatgtgctcgtctatatcaagcgacggcttgctatgtgtgcacgcaagttaggccgcatccgagaggcggttaaaattatgcgggatttgatgaaggagttccccccactgacgatgctaaacatccatgagaatctgctggagtcactgttagagcttcaagcctaccccgacgttcaggccgtgttggccaaatacgacgatatttccttaccgaaaagtgccgcaatttgctacactgccgcattgctgaaaacccggacggtctctgaaaagttctcaccagaaactgcatcccgccgcggcctttccacagccgaaatcaatgcagtcgaggccatacatagggcagtggaattcaacccacatgtccccaaatatctgctggagatgaagagtctgatccttccacccgaacatattctcaagcggggcgacagcgaggcgatagcttatgcttttttccacctccagcactggaagcgaatcgaaggcgctttgaacctcctgcagtgtacttgggaggggacttttaggatgattccctatcctcttgaaaaggggcacctgttctacccttacccctcctgcacagagactgccgatcgggagctcttgcctacatttcaccatgttagtgtgtatccaaaaaaggaactgcctttgtttatccatttcacagccggcttttgtagttcaaccgcaatgatcgccatcctgacccaccagttcccagagatcatgggaatctttgccaaggctgtactgggtttgtggtgccctcagccttgggctagttcaggcttcgaggaaaatactcaggacctcaagtctgaagatctggggctctcgagcggctag

SEQ ID NO: 33695 - DNA, 444 bp, Artificial Sequence
  Description of Artificial Sequence: Synthetic coding sequence
atggggagccagggctcagggggagtccccctggtccaggcaccttataccgtgctgctgttacccctgggaacgagccgccaggaccctggtgctcagtctttcttcttgtggctgcgccgtatgcaggctctggagagggaacaagacgctctgtggcagggtctcgagctcttgcagcacgggcaagcctggtttgaagaccacctgagagaggcgcagcgccagcagctgcatctgggagccttaggtgagaacttccttaccgatctacactctgagcccggcagaccacccctggcccagatccagaaggtcaacatttgtttacagaacctcatacacgaaaaactgtcacgacaacagaagggagtgacgcagcccaaggaggaaatggcacaacggggctgcaccaaaggccctcgaggacccactagggtgtag

SEQ ID NO: 33696 - DNA, 537 bp, Artificial Sequence
  Description of Artificial Sequence: Synthetic coding sequence
atgggcagccaggggtctggaggcgtccccttggtgcaggccccatacacagtgctacttctgcctcttggcacaagccgccaagatcccggtgcgcagagcttctttttatggctgaggaggatgcaagcactggagagagagcaggatgccctatggcaaggactggaacttcttcagcacgggcaggcatggtttgaggatcacctgcgcgaagcccagaggcagcagctgcacctgggggccttaggcgagaactttctgactgatctccacagcgagcccggacggccccccttagcgcagatacaaaaggtgaacatatgtctgcaaaacctcatccacgaaaagttttccccttcccctttgaacaaggcttcaagctgtactacccaggactctaaagagcggaggcgcgaacaaaatctgtggcagcaacaggaactgtctcgacagcaaaaaggcgttacccagccaaaggaagagatggcccagcggggctgcactaaaggccctagaggcccaactagagtgtag

SEQ ID NO: 33697 - DNA, 444 bp, Artificial Sequence
  Description of Artificial Sequence: Synthetic coding sequence
atggggtcccaggggagcggcggtgtgcccctggttcaagccccatatacagttctgttgctgcctctgggcacaagcagacaggaccctggcgcacaatctttctttctctggctaagaaggatgcaggcgctggagagagagcaggacgcactttggcagggcctcgagcttctgcagcacggccaagcctggtttgaagatcacctccgcgaggcacagcgccagcagctgcatttgggcgctctgggggagaacttcttgacggacctgcacagcgagcccggcaggcctcctctggcccagatccagaaagtgaatatatgcctgcaaaacttgatacacgaaaagctgagccgccagcagaagggtgtcacacagcccaaagaagagatggctcagcggggctgcacgaaaggccctagaggcccaactcgcgtttag

SEQ ID NO: 33698 - DNA, 447 bp, Artificial Sequence
  Description of Artificial Sequence: Synthetic coding sequence
atgggatctcagggctcaggaggagtgccacttgtgcaagcgccgtacaccgtgctactcctcccgctgggaacaagtcgccaggacccaggagcacagtccttcttcttatggctcaggcggatgcaagctttagaacgagagcaagatgccctatggcaagggttagagctcctgcagcacgggcaggcttggttcgaggatcatctgcgcgaagcgcagagacagcaactgcacctcggagccctgggagaaaacttcctcactgacctgcactccgagcccggaaggcctccactggcacaaattcaaaaggtcaacatttgtctgcaaaatctgatccatgagaaggagctgagtagacagcagaagggcgtgacccaaccgaaagaagagatggcccagagaggatgcaccaaagggcctcgggggcctactcgtgtgtag

SEQ ID NO: 33699 - DNA, 444 bp, Artificial Sequence
  Description of Artificial Sequence: Synthetic coding sequence
atgggctcccaggggtcaggcggcgtgcctctggtgcaggccccttacacggttttactgctcccgctgggtacgagcagacaggaccctggggcgcagtccttcttcctgtggctccgccggatgcaagcattagagagagagcaggatgcactctggcaggggcttgagctcctccaacacggccaggcctggtttgaggatcatctgagagaggcacaaagacaacaacttcatttgggagcactgggcgaaaatttccttacggacctccatagcgaaccaggtcgcccacccctggcacagattcagaaggtgaatatttgcttgcagaacctgatccatgagaagctctccagacagcaaaaaggagtcactcaacccaaagaggagatggcgcagcgcggctgtactaaggggcctaggggaccgactcgcgtctag

SEQ ID NO: 33700 - DNA, 444 bp, Artificial Sequence
  Description of Artificial Sequence: Synthetic coding sequence
atgggaagtcaggggagcgggggagtaccattagtgcaggcgccttatactgtactgctcttacccttgggcaccagccggcaggacccgggcgctcagagcttttttctgtggctgcgccgcatgcaggcgctggagcgtgaacaagacgctttgtggcagggcctcgaattgctgcagcacggccaggcttggtttgaagatcacctccgagaggctcagaggcaacagttgcacttaggggccctcggtgagaatttcttgaccgaccttcatagcgagcctggcagacctcccctggcacagattcagaaagtgaatatttgccttcagaatctgatccatgaaaaacttagtcggcaacaaaagggcgtgacgcaacccaaggaggaaatggcccaacgcgggtgtacaaaagggcccaggggccctaccagggtctag

SEQ ID NO: 33701 - DNA, 444 bp, Artificial Sequence
  Description of Artificial Sequence: Synthetic coding sequence
atgggaagccagggctcgggaggggtgcccctagtgcaagcaccctacaccgttctcttgctgcctttggggaccagtcgacaagatcctggggcacagagcttttttctatggctccgccgcatgcaggcgctcgagagggagcaggacgccctgtggcagggcctggagctgctccagcatggccaggcttggttcgaagaccacttaagggaagcacagcgccagcaactccacctgggggccctcggtgaaaactttcttaccgacctgcatagcgagccaggccgacctcccctcgcgcagatccagaaagtgaatatctgcctgcaaaatctgatccacgagaagctgtccagacagcagaaaggagtgacccagcctaaggaggaaatggcgcagcggggttgcactaaaggaccacgaggccccactcgcgtctag

SEQ ID NO: 33702 - DNA, 537 bp, Artificial Sequence
  Description of Artificial Sequence: Synthetic coding sequence
atgggaagccagggcagcgggggcgtgcccctcgtccaggctccttatactgtgctcttactccctctcggaacttccaggcaagatccaggggcacagtccttctttctgtggcttaggagaatgcaggccctggagcgtgagcaggatgcgctgtggcaaggcctggaattgctgcaacatggacaagcttggttcgaagatcaccttagggaagctcagcggcaacagcttcatcttggcgcgttgggcgaaaattttttgactgacctccacagcgaaccagggcggcctccactcgcccagatacaaaaggtgaatatctgcctacaaaatctaattcatgaaaaattttcgccctctccactcaacaaagcttctagttgcaccactcaggactccaaggaacgccgccgggagcagaatctgtggcagcagcaggaactgagtcgtcagcagaagggggtgacacagccaaaagaggagatggcacagagaggatgtacgaagggaccccggggcccaacaagggtctag

SEQ ID NO: 33703 - DNA, 537 bp, Artificial Sequence
  Description of Artificial Sequence: Synthetic coding sequence
atgggttcccagggctcaggaggcgttcctctggtgcaggccccttacactgtgctgctgctcccactgggaactagccgccaggaccccggagcacagtctttctttctgtggctacgcagaatgcaggctctcgaacgggaacaggatgcactctggcagggcctggagctccttcagcacgggcaggcgtggttcgaagaccatctgcgggaggcccagaggcagcagcttcacctaggcgcccttggcgagaactttctgaccgatctccactcagagccagggcgcccacctcttgcccagatccagaaagttaacatttgcctccagaatcttatccacgagaaattttcgccctccccactgaacaaagcttcgtcttgtaccacacaagactctaaggaaagacgccgcgaacagaacctatggcagcagcaggaactgtcaagacagcagaaaggcgttacccaaccgaaggaggagatggcccaacgtgggtgtactaaaggacccagagggcccactagagtatag

SEQ ID NO: 33704 - DNA, 537 bp, Artificial Sequence
  Description of Artificial Sequence: Synthetic coding sequence
atgggatcccaaggatctggtggtgtccctcttgtacaagccccatacactgttctgctactgccactggggacatctcgtcaagaccctggagcacagagttttttcctctggctacgccggatgcaggctctggagagagaacaggatgcgttgtggcagggcctggagctgctgcagcatgggcaagcctggtttgaggatcatctccgggaggcccaaagacaacagctgcacctcggtgctttgggtgaaaacttccttacagatctccattctgaacccggacgtcctccgctggcccaaatacagaaagtgaatatatgtctgcagaacttaattcatgaaaaattctctccttcccccttgaataaggcatcatcctgtacgactcaggacagtaaagagcggcgccgggaacagaatttatggcagcagcaggaacttagccggcagcagaaaggcgtaacccagcctaaggaagaaatggctcagcgtggatgtaccaaaggcccacggggcccaacacgagtttag

SEQ ID NO: 33705 - DNA, 444 bp, Artificial Sequence
  Description of Artificial Sequence: Synthetic coding sequence
atggggtcacaggggtcagggggcgtaccactggtgcaggcgccgtacactgtgctgctactgcctttggggacatcccgtcaagacccaggcgcccaatctttctttctctggctgcggcggatgcaggcactagaaagagaacaagacgccctttggcaggggctcgagctgcttcagcatggtcaagcctggttcgaggaccatttgcgggaagcccaacggcagcagctacatctgggggctctcggcgagaacttcttgacagacctccattccgaacccggcagaccgcctctggcacagatccagaaagttaatatctgtttgcagaacctgatccatgagaagctgtcacgtcagcagaagggcgtaacacagcccaaggaagagatggcgcaacgcggatgcaccaagggcccccgaggacctactagggtgtag

SEQ ID NO: 33706 - DNA, 537 bp, Artificial Sequence
  Description of Artificial Sequence: Synthetic coding sequence
atggggtctcaggggtcaggaggcgtgccacttgtgcaggctccctatactgtcctgctgctgccgttaggcacgagtaggcaggacccaggggcacaaagcttctttctctggcttcggcgaatgcaggcactggagcgagagcaagacgcgctttggcagggcttggagctgctacaacacggccaggcctggttcgaggaccatctcagagaagcacagagacaacagctacatctgggcgcgctcggcgagaatttcctgacggatctccactccgagcccggaagaccacctctggcccagatccagaaggtgaatatttgtcttcagaacttgattcacgagaaattctcgccctcgccactgaataaggccagctcgtgtactacacaggactcgaaggagcgacgccgggagcagaatttgtggcagcagcaggagttgagtaggcagcaaaagggggtaactcagcccaaggaagagatggcccagcgcggttgtactaaggggccacggggtcctactcgcgtctag

SEQ ID NO: 33707 - DNA, 447 bp, Artificial Sequence
  Description of Artificial Sequence: Synthetic coding sequence
atgggctcacagggatctggtggcgtgcctctggttcaggctccatatactgtcctcttactgccgctggggactagccgacaagaccccggcgcgcagtcatttttcctctggctcagaagaatgcaagcactggaacgagagcaagatgcactctggcaaggattggagttgctacaacacgggcaagcatggttcgaagatcatttgagagaggcgcaacgccagcagcttcacctgggggcgctaggagagaactttttgactgacttacacagcgagccaggtagacctcctctcgctcaaattcagaaagtgaatatttgcctgcagaacttgattcacgaaaaggagctctctaggcagcaaaagggtgtcacccaacctaaagaggagatggctcagagagggtgcaccaaagggccccgtggccctactcgggtgtag

SEQ ID NO: 33708 - DNA, 447 bp, Artificial Sequence
  Description of Artificial Sequence: Synthetic coding sequence
atgggctcccagggaagcggcggggtgcccctagtccaagctccttatactgttctgctgctcccattgggaaccagccggcaggatcccggagctcaatccttctttctctggctccggcggatgcaggccctggagcgggagcaggatgctttgtggcagggtctcgagctcctccagcatgggcaagcatggttcgaagaccacctgcgcgaggcacaacgtcagcagctgcacttaggcgctctcggcgaaaattttttgaccgacttacacagcgagccaggcagaccgccactcgcacaaattcagaaggtcaatatatgcctgcagaatctcatacacgaaaaggagctgagcagacagcaaaaaggggtgacccaacccaaggaggagatggcccagagaggatgcacaaagggcccaaggggccccactagagtgtag

SEQ ID NO: 33709 - DNA, 447 bp, Artificial Sequence
  Description of Artificial Sequence: Synthetic coding sequence
atgggcagccaaggttctggaggggtgcctctggtacaggcaccctacactgtcctgcttcttccgcttggtacttcccgacaggatcccggggcccagtcttttttcctgtggcttagacgaatgcaagcactggagagagaacaggacgcactttggcagggactcgagctacttcagcatgggcaggcatggttcgaggatcatctcagggaagctcagcgacagcagctgcatctgggagctctaggggagaattttctcaccgatcttcacagtgaaccgggtaggcccccattagcacaaattcagaaggtcaacatctgtctccagaaccttatacatgagaaagaactcagccgtcaacagaaaggcgtgacacagcccaaggaggaaatggcacaaagaggatgcactaagggtcctcgcggaccaacccgcgtgtag

SEQ ID NO: 33710 - DNA, 447 bp, Artificial Sequence
  Description of Artificial Sequence: Synthetic coding sequence
atggggtcccaggggtcagggggtgtgccgctcgtccaagccccctataccgtgctgctgctgcccttgggcaccagccgacaggatcctggagcccaatcatttttcctgtggcttaggagaatgcaggcgctggagagggaacaagatgccctctggcagggcttagagttgttgcagcacggacaggcttggttcgaggatcacctgagagaggctcaaagacaacaactacatctgggcgcactaggcgaaaatttcctgacagatctgcatagcgagcctggacggccacctcttgcccagatacagaaggtaaacatatgcctacaaaacctaattcacgaaaaagaactgagccgacagcagaagggcgtcacacagcccaaggaggagatggctcagagggggtgcacaaagggcccacgggggccaacacgcgtgtag

SEQ ID NO: 33711 - DNA, 447 bp, Artificial Sequence
  Description of Artificial Sequence: Synthetic coding sequence
atggggagccagggaagcgggggggtgcccctagtacaggcaccttacactgttctgcttctgcctctcgggacctcacgacaggatcccggtgctcagtctttttttctttggctaaggcgcatgcaggcgttggagcgagagcaagatgccctatggcagggtcttgagctgcttcagcacggacaagcctggtttgaggaccaccttagagaggctcagcggcagcaactccaccttggagccctgggcgagaactttttaacagatttacacagcgaaccgggaaggcccccattggcacaaatacagaaggtcaatatttgtttgcagaatctgattcatgaaaaagagctgagccgacagcagaaaggtgttactcagccaaaggaggaaatggcccagcgaggatgcacaaagggcccccgggggcctacacgtgtgtag

SEQ ID NO: 33712 - DNA, 99 bp, Artificial Sequence
  Description of Artificial Sequence: Synthetic coding sequence
atggccgctgccgctgcagggcctgctgcatcccagcggttttttcagagtttttccgacgccttgattgaccaggatccacaggccgccctggaatag

SEQ ID NO: 33713 - DNA, 99 bp, Artificial Sequence
  Description of Artificial Sequence: Synthetic coding sequence
atggctgccgccgcagccggccccgctgccagtcaacgatttttccaatcattcagtgacgcactgatagaccaggacccacaggcagcgctggagtag

SEQ ID NO: 33714 - DNA, 4986 bp, Artificial Sequence
  Description of Artificial Sequence: Synthetic coding sequence
atggaagctcctgctgcggaacctccggtgcgaggttgtggtccacagccagcccccgctcccgcacccgcgccagaacgcaagaagagtcatcgggcccccagtcctgcgcggcctaaagatgtggccggttggtccttagcgaagggaagaagagggcctggccctggttccgcagtcgcttgctctgctgcctttagcagtagaccagataagaaagggcgggcagtggctcctggggcgcggggcgcaggtgtccgagtggcaggcgtccggacaggtgtgagagcaaaagggaggccaagaagtggggccggcccccgaccccctcctccacctccatccttaactgattcctcctccgaagtcagcgattgtgcttctgaagaggctagactactcggcttagagttggcgttaagttcagacgccgaaagtgctgccgggggacctgccggtgtaagaaccggacagcctgctcaacctgctccttccgcccagcaacctccacggccgccagcatctcctgatgaaccttccgttgcagccagttcagttggttcgtcacgcctcccactgagcgccagcttagccttcagcgacttgacagaggagatgttagactgcggtccctctggcttggtgcgcgagctggaagaactcaggtctgaaaacgactacctaaaggacgaaatcgaggagctgcgggcagaaatgctcgaaatgcgggatgtatatatggaagaagacgtgtaccaactgcaggagcttcggcaacagctggatcaggcttccaagacttgtagaattctccagtacagattgcgcaaggcagaaaggcgctctctgagagcagcccagacaggccaggtggatggcgagctaattagaggcttggagcaggacgtgaaggtctcgaaggacattagtatgcgcttacacaaagagctagaagtggtggagaagaaacgtgccagactggaggaagaaaatgaggagctgcgccaaagacttatcgagacggagctcgcgaaacaagtgctacagaccgagctggaaaggcctcgggagcactcattaaagaaacgggggacaagaagcctgggcaaggccgacaagaaaacgttggtgcaggaagactccgccgatctgaagtgtcagctacatttcgccaaagaggaatccgctttgatgtgtaagaagctgactaagctcgcgaaagaaaacgatagcatgaaggaggagctattaaaatacagatcattgtatggagaccttgactccgccctcagtgccgaggagctagcagacgctcctcattcccgggaaaccgagttgaaggtgcatctcaagctggttgaggaggaggctaacctgcttagtagacgaattgttgaacttgaggtcgaaaaccgtgggctgagggccgaaatggacgatatgaaggaccatggaggcggttgtggaggacctgaggcccgcctggcttttagtgccttaggcggaggcgaatgtggcgaaagcttggcagagctacgtcggcatcttcagtttgtcgaagaggaagcagaactgcttcgcaggagttccgctgaactagaggatcagaacaaacttctgctcaatgagttggctaaatttcgtagcgaacatgaattagacgtggccctgtcagaagatagttgctcagtgttgtctgaaccctcccaagaagagttggcagcagccaaacttcagataggcgaactcagcggcaaggtcaaaaaacttcagtatgaaaaccgggtcttgttatcaaacttgcagcgctgcgatttggccagctgccagagcacacgcccaatgcttgaaactgatgccgaagcaggcgatagcgcccagtgcgtacccgctccactgggcgagacacacgaatcacatgccgtgcgactgtgtcgtgctcgagaggccgaagtcctcccaggcctccgagagcaagcagctttggtcagtaaggccattgacgtcctcgtggctgacgctaacggctttaccgctgggttacgtctgtgtctcgacaatgaatgcgccgactttcggctccatgaggcccccgacaactctgaaggccctcgggataccaagctcatacatgccatcctggtgcgactatcagtgttgcagcaggagctgaacgccttcaccagaaaggccgatgctgttttaggttgttccgttaaagaacagcaggaatccttctccagccttccaccgctgggcagccagggactcagcaaagagatcttgctcgcgaaagatctcggaagcgattttcaaccccccgacttccgtgatctgcccgagtgggagccgaggatccgggaggcttttcggacaggcgacctggacagcaagcctgacccgtcacgctccttccggccctatcgggcagaggacaacgacagttacgcctccgagatcaaagagctccagctggtgcttgccgaggcccatgatagcctgcgggggctgcaggaacagttgtcgcaggaacgccagctgcgaaaggaagaggccgataactttaaccagaagatggtgcaattgaaagaagatcagcagagggctttgctccgtcgggagttcgagttacagtctctgtctctgcagaggagattggagcagaagttttggtcccaagagaaaaatatgctggtacaggaaagccagcaattcaagcacaatttcctactccttttcatgaaactgcggtggttcttaaagaggtggaggcaagggaaggtcctcccttcagaaggagatgatttcttggaggtgaattctatgaaggagctgtatctcctcatggaggaggaagaaattaatgcacaacattcagacaataaggcctgcacaggcgattcatggacacagaatactcccaatgagtacatcaagactctcgcagacatgaaagtcacactgaaagaactctgttggttgctacgggatgaaaggcgaggactaaccgagctgcagcaacagttcgctaaagccaaagcaacttgggaaaccgagcgggccgaactgaaggggcatactagccaaatggagttgaagaccggtaaaggggctggggagagagctggtcccgactggaaggccgcactgcagcgagagcgagaggaacagcagcacctcctagctgagtcctactccgctgtgatggaactgacacgtcagctccagatctctgagagaaattggtcacaggaaaaactgcagcttgtagaaagactccaaggcgagaagcaacaggtcgagcagcaggtgaaagagttacaaaatcgtctaagtcagctgcagaaggcagccgacccatgggtactgaaacactcagagcttgagaaacaggataatagttggaaggagactagatctgagaagatccacgataaggaggccgtgtctgaggtcgagctcggcggcaacggattgaagaggaccaaatccgtgtctagtatgtccgagttcgagagtctgttagattgctcaccttacctcgctgggggcgacgccaggggaaagaaattaccaaacaaccctgcttttggcttcgtgtccagcgagcccggcgatccagagaaggatactaaggagaaacctggcctgtcgtcccgggattgtaatcacttaggcgcgctggcatgtcaggacccgcccggaaggcagatgcagcggagctatacagcccccgacaagacgggaattcgggtgtactactccccgcctgttgccagacgactgggagtccccgtggtgcacgataaggaaggaaaaattatcattgagcccggattcctgttcacaaccgctaagcctaaggaatcagccgaggctgacggactggctgagagttcttacggtcggtggctgtgtaacttctccaggcagcggcttgacggaggtagtgcaggaagtccatctgcagcgggtcccggtttccccgcagccttacacgacttcgaaatgagcggcaatatgagtgacgacatgaaagagattacaaactgtgtgagacaggccatgcggagcggcagtctggagcgcaaggtgaaatccacatccagtcagacggttgggctggccagcgtgggcacacaaacaatccgcaccgtcagcgtgggcctccagacagaccctccccggtcatctctgcacggtaaggcatggagcccgcgcagttcaagccttgtgtcagtgagaagcaaacagataagctcttccctcgacaaggtgcactcaaggatcgaacggccatgctgctcaccaaagtacggaagtcctaaacttcaacgtagatcggtaagcaagctcgactcctcaaaagatcgctccctgtggaacctgcaccagggaaagcagaatggatcagcatgggcacggagtaccacaaccagagattcaccagtattgcgaaatattaacgatgggctctcctctttattttcggttgttgagcacagcgggagcaccgagtccgtatggaaactcggaatgagcgagacccgcgccaagcctgaaccccctaagtatgggatagttcaggagttctttcggaatgtctgtgggagggccccttcccctacatcctctgcaggggaggaaggaacgaagaaacctgagcccctatcccccgcgtcctatcatcagcctgagggggtcgcaagaatactgaacaagaaagccgcaaaactgggcagttctgaagaggtgaggctcaccatgttgccacaggtgggcaaagacggggtgctgagagatggcgacggagctgtcgtcttgccaaacgaggacgctgtatgtgattgcagtacccaaagcttgacgtcatgcttcgccagatcctctcggtcggccatcagacacagtccctcaaaatgccgtctgcaccccagtgagagctcttggggtggggaggaaagagccctgccccccagcgagtag

SEQ ID NO: 33715 - DNA, 3051 bp, Artificial Sequence
  Description of Artificial Sequence: Synthetic coding sequence
atgttagagatgagagacgtgtatatggaggaggatgtgtaccagctgcaggagctcagacagcagctcgaccaagcatctaaaacctgccggatccttcagtacaggctcagaaaggctgagagaaggagtctcagagccgcgcagacaggccaagtggatggtgagctgatccggggcctggagcaggatgtcaaagttagcaaggatattagcatgcggctccacaaggagctcgaagttgtggaaaaaaagcgcgcgcgcctggaagaggagaatgaggaactgagacaacgcctgatagagaccgagctcgctaagcaggtgctgcagacagagttagaaaggccaagggaacattctttgaagaaaagggggactagatcattaggcaaggccgacaagaagaccttggtgcaggaggactctgccgacttaaagtgtcagttgcacttcgccaaagaagagagcgcccttatgtgcaagaaactgacgaaactggccaaggaaaacgatagcatgaaggaagagctgctgaaatatcggtctctttacggagacctggattccgccttgtctgctgaggaactcgcggacgctccccatagcagggagacagagctgaaggtgcatcttaagctggttgaggaggaggctaacctgctcagcagacgaatcgtggaactagaggtggagaacaggggcttgcgggcggagatggatgatatgaaggatcatggtggcggctgtggggggccagaggctcggttagccttctctgcgttaggaggaggcgaatgcggcgagtcgctggcggagctgcgcaggcatttgcagttcgttgaggaggaagctgagcttctgaggagaagttccgcggagctcgaggaccagaacaagctcctgctgaacgagctggccaaatttcggtccgaacatgagctcgatgttgctttaagcgaggacagctgctcagtgttgtccgagccttctcaggaggagttggcggctgctaagctccaaataggggagctgtctggcaaagtcaagaaactccagtatgaaaaccgagtactcctgagcaacctccagaggtgtgacctggcaagctgccagtccacaagacccatgttggaaaccgatgccgaggctggtgatagcgcccagtgtgtacccgcccctctcggtgaaacccacgaaagccacgctgtcagactgtgccgagcgagggaggcagaggtgttaccaggactgagagagcaggccgccctggtgagtaaagccatcgatgtgctggttgccgatgctaatggctttacagctgggctccgactctgtctggacaacgaatgcgcagatttccgacttcatgaggcacctgacaacagtgaaggtcccagggacacgaaactgatacacgccatccttgtaaggctgtcagtgctccagcaagagttaaacgcattcacccgtaaggctgacgccgtcctaggctgcagcgttaaggagcagcaggagtcatttagcagtttacctcctctcgggagtcagggcttaagcaaggagattttactggcaaaggacctcggatcagattttcagcctccagacttccgcgacttacccgagtgggagccacggatcagggaagctttccggactggcgacctggatagcaaacccgatcccagcaggtccttccgaccttaccgggccgaggacaatgactcctacgcgtctgagatcaaggaactgcagctcgtactggccgaagcacacgattcgctgcgcggtcttcaggaacagctcagtcaggagcgccagctgcgcaaggaggaagctgacaattttaatcagaaaatggtccagctgaaggaagaccagcaaagagctctgctccgtagagaatttgagctgcaatcgctgagtctgcagcggcgcttggagcagaaattttggtcccaagagaagaatatgttggtacaagagtcacagcagtttaagcacaatttcttactgctgtttatgaaactcaggtggttcctcaaaaggtggcgacagggcaaagttctgcctagtgaaggagacgactttctcgaggtgaactccatgaaagagttgtaccttctgatggaagaggaagaaattaacgcacaacatagtgataacaaggcttgcaccggcgacagctggactcagaacacccccaacgagtatatcaagaccttagctgacatgaaagtgacgctgaaggaactctgctggttactcagggacgaacgcagagggttaacggagcttcagcagcagtttgccaaggccaaggctacctgggagaccgagcgggccgaactgaagggacacacctcacaaatggaacttaagaccggcaaaggagctggagagagggctggcccggattggaaagccgcactgcaacgcgagcgagaggaacaacagcacctgttagctgaatcttacagcgcggtgatggagctcacacgacagctccagatctccgaacggaattggtcacaggaaaagttgcaactggtggaacgtttacaaggcgagaagcagcaggtggaacagcaggtgaaggagctccagaatcggctgtctcaactgcagaaagcagcagatccatgggtactaaagcattctgaactggaaaaacaggacaattcctggaaggagacaagaagcgagaagatccacgacaaagaggctgtatctgaagtggagctcggggggaatggcctcaaacggaccaagtcagtgagctcaatgtcggagttcgaatccctgctcgattgttcaccgtacctggccgggggggacgctagaggaaaaaaacttcccaacaaccccgcctttgggttcgtgtctagcgaacctggggatcccgagaaggacactaaggagaaaccaggcttgtcttcgcgggactgcaaccacttgggggccctcgcgtgtcaagaccccccagggagccagaaactgccctttcttcttattttggcaccaccacaaccgcccccgatcctctag

SEQ ID NO: 33716 - DNA, 4272 bp, Artificial Sequence
  Description of Artificial Sequence: Synthetic coding sequence
atgctggagatgagagatgtatatatggaggaagacgtgtaccagctccaagaactgagacagcagttagaccaggcctcgaagacttgcagaatactacagtaccgcctgagaaaggccgagcggaggagcctgagggctgcgcagacagggcaggtggatggagaactcattcgagggcttgagcaggacgttaaagtttcaaaggatatctccatgcggcttcacaaagagctcgaagttgttgagaagaaaagggcccgactggaggaagaaaacgaggaacttcgccagcgcctgatagagacggagctggccaagcaagtgctgcagacggaactggagagacccagggagcactctctcaagaagagaggcactcggagccttggcaaagccgacaaaaagacccttgtgcaggaggacagcgcagacctgaagtgtcagctgcacttcgccaaagaagaatctgctctgatgtgcaagaaacttaccaaattggctaaggagaatgattccatgaaggaagagttgcttaaataccgcagcctgtacggagatcttgacagtgccctgagcgccgaagagctggcagatgctcctcacagccgcgaaactgaactcaaagtccatctgaagctggttgaagaagaggctaacctcctgagtaggcgcatcgtggagctggaggtcgagaatagaggactaagggcagagatggatgacatgaaggatcatgggggtggttgcggaggcccggaagcccgactcgcattctcggccttgggcgggggcgagtgtggagagagcctggctgaattacgacggcatttgcagtttgtggaagaggaagctgaactgctgaggcgatcctcagctgaattagaagaccagaataaactgttgcttaacgagcttgccaaattccgttctgaacatgagctggatgtggccctttccgaggactcttgttccgttctcagcgagccctcacaggaagagctggcggcagcgaagctgcaaataggagaattatccggcaaggtgaagaagctgcaatatgagaaccgggtcctgctgtcaaaccttcagagatgtgacctggcttcttgccagtcaactcgaccaatgctggagaccgacgccgaagctggtgactctgctcagtgcgtaccagcacccctcggtgaaacccacgaaagccacgctgtccggctctgtcgggccagagaggcagaagtgctgcctgggctcagggagcaggccgctctagtcagcaaggctatcgacgtgctcgtggccgacgctaacggctttactgccggacttagactatgtttagacaacgaatgcgcagattttcgtctgcacgaggcccccgacaactctgagggcccacgagacaccaaacttatccacgctatactggtaaggctttccgtgctccaacaggagttgaatgcttttactagaaaggcagacgccgtgttgggatgcagcgtgaaggagcagcaggagagttttagtagccttcctccgctgggtagccagggtctgtctaaagagattttgctcgcaaaggacttgggcagcgattttcaaccaccagacttcagagacctgccagagtgggagcctaggatccgcgaagcctttcgcactggagatctggacagtaaaccggatcccagcaggtcttttagaccctatcgtgctgaagataacgatagctacgcctccgaaattaaggagctgcagctcgttttggccgaggcacatgacagcctgagggggctgcaagaacagctgtcccaggagcgccagctgagaaaagaggaagccgacaattttaaccaaaaaatggtacagttgaaggaggaccagcagcgagctctgttgagaagagagttcgagctccagtctctctcactgcagaggcggctagagcagaaattttggtcccaagagaaaaatatgctggttcaggaatcccaacagttcaagcacaatttccttctgttatttatgaagctgcgctggttcctcaagagatggcggcaagggaaagtgctgccatccgagggagacgatttcctggaggttaatagtatgaaggaactgtatctcttgatggaagaggaggaaatcaacgctcagcattcagacaataaggcgtgtacaggcgattcctggactcagaacacacctaatgaatacatcaagacactcgccgacatgaaggtgacgttaaaagagctgtgctggctcctcagggacgaaaggaggggacttactgaattgcaacaacagtttgccaaagccaaggcaacatgggagaccgaacgcgctgaactgaaaggccacacttctcagatggaactcaaaacaggtaaaggagccggggaacgagccgggcccgactggaaggcagctcttcagcgagaacgcgaagagcagcaacacttactggccgaaagctactccgccgtgatggagctcacacgacagctgcagataagcgagcgcaactggagtcaggaaaagctgcagctggtggaacgccttcagggtgaaaagcagcaggtcgagcaacaggttaaggagctccaaaatcgcctgagccagctccagaaagccgcggacccatgggtgctgaagcactccgaactggagaagcaggataactcttggaaagagacacgcagtgaaaagatccatgacaaggaggccgtgagcgaggtggagctgggggggaacggattgaagcggacgaagtcggtgtccagcatgtcagagtttgagagcctactagattgtagcccgtatcttgcaggaggagacgccaggggaaaaaagctacctaacaacccggccttcggcttcgttagcagcgagccgggcgaccctgagaaggacactaaggaaaaaccaggactctctagcagggactgcaaccatttaggcgcgttagcctgccaggatccacccggtcggcaaatgcagaggtcatacactgcccctgacaagacgggaattagggtgtattatagcccccctgttgccagaagactaggcgttcccgtcgttcacgataaggagggaaagatcatcattgaaccaggcttcctcttcactaccgctaaacctaaggagtccgccgaagccgatgggcttgcagaaagctcctacgggaggtggctgtgcaatttctctaggcaacggcttgacggcggctccgccgggtccccttcagcggccggccccgggtttccggccgctctgcacgacttcgagatgtctggtaatatgagtgatgacatgaaggaaataacaaactgtgtcagacaggctatgagaagtggctccctggagcgcaaggtgaagagtacttcttcccagacggtgggactggcaagcgtgggcacacagacgatacgtaccgtgtctgtcggactccagaccgaccctccacggtcctctctgcatggcaaagcctggagcccgagaagcagctcccttgtgtcggttcgcagcaaacaaatcagcagctccttggacaaagttcatagtcggattgagcgcccatgctgctccccgaagtatggatcgcccaaacttcaacgacggtctgtctctaagctggattctagcaaagacagatccctctggaacttacaccaagggaaacagaacggaagcgcttgggccaggagcaccacaacccgtgactcacctgtgcttagaaacataaacgatgggttgtcatcgctttttagtgtagttgaacactctgggagtacagagtcagtgtggaaactaggaatgtccgagactcgggcgaagcccgagccaccaaaatacggtatcgtgcaggagttcttcagaaacgtttgtggccgcgcacctagcccaaccagcagtgccggagaagagggaactaaaaaacccgagccactttctcccgcaagctaccatcagccagagggtgtcgccaggattctgaataagaaggccgccaaactgggttcctcagaagaggtgcgattgactatgcttccccaggtcggcaaggacggagtgctgagagacggagacggcgccgtggtactcccgaatgaggacgctgtatgcgattgctctacgcagtctttgacatcatgttttgcccgctcatctcggtccgcgatcaggcactccccatctaagtgccgcttgcaccctagcgaatcgtcatggggtggtgaagaaagggccctacctccctctgagtag

SEQ ID NO: 33717 - DNA, 3795 bp, Artificial Sequence
  Description of Artificial Sequence: Synthetic coding sequence
atgtgcaaaaaactcacgaagctggcaaaagagaacgattccatgaaagaggaattactgaaatatagatccctttacggcgacctggactccgccttgtccgcggaggagttggccgatgctccacactccagagagacagagttgaaggttcatctgaaactggttgaagaagaggctaacctccttagcaggcgcatcgtagaacttgaagtggaaaaccgggggctgagggcagaaatggacgacatgaaagatcacgggggcggatgcgggggccccgaggcacggctcgccttctccgcgctgggcggaggggaatgtggcgagtcactggccgaactccgcagacacttgcagttcgttgaagaggaggcggagctgctgcggcgttcatctgcagagttggaagatcagaacaagctccttttaaatgaactggcaaagtttcgttccgagcatgaactggacgtggccctttctgaagacagctgtagtgtcctaagcgagcctagtcaggaagagctcgccgcagctaagctgcagatcggagagctcagcgggaaggtaaagaaactgcagtacgagaatcgtgtattgctctccaatcttcaaaggtgcgacctggcttcctgccaatcaactagacccatgctagagaccgacgccgaagcaggagatagcgcacagtgcgttccagcgccactcggagaaacccacgaatcgcatgctgtgcgactctgcagagcgcgggaggctgaagtacttcctggcctgcgggaacaggctgccctggtgtccaaagccattgacgtgctcgtcgcagacgcgaacgggtttaccgccggcctgagactctgtctggataatgaatgtgcagatttcagactacacgaagctccagataattcagagggtccacgagacaccaagttgatccatgcaatcttagtgagactgtccgtactgcagcaggaattaaacgcctttacgcgcaaagccgacgccgttctcggatgctctgtgaaagagcaacaggaaagcttcagctcgctgccgcccctgggatcccagggcctatctaaggaaatccttctcgcaaaggatttagggtctgactttcaacctcctgactttcgggacctcccggagtgggagcccagaattagggaggcatttcgcaccggggacctcgatagcaagcctgatcctagtagatcctttcggccatacagagcagaggacaacgattcctatgcgtctgagataaaggaactgcaactggtcctcgccgaggcccatgactcactgcgcggcctccaggagcagctgtctcaggaacgccagttgcgaaaggaggaagccgacaatttcaaccagaagatggtccaactcaaagaagaccagcagcgtgccctgctgcggcgagagttcgaactccagagtctgtcgctgcagaggcgactggaacagaagttttggtcacaagaaaagaatatgctcgtgcaggagtctcagcaatttaagcataatttcttgctgttgttcatgaagttgcggtggttccttaagcggtggcgccaaggcaaagttctcccttccgagggggacgacttcttagaggtgaatagcatgaaagagctgtatcttctgatggaggaagaagaaattaatgcacagcacagcgacaacaaggcctgcaccggtgactcctggacacagaacaccccaaacgagtatatcaaaacgctggccgatatgaaggttaccctgaaagaactgtgctggttgctccgcgacgaaagacgtggactgacggagctgcagcagcaatttgctaaggctaaagccacttgggaaaccgaacgcgcggagttaaagggccacacttctcaaatggaactgaagacggggaagggagcgggagaaagggcaggccccgactggaaggcagctctgcagagagagcgcgaagaacagcagcatttgttagctgagtcttactccgcggtaatggagttaacccgacaactccagatcagtgaacgcaattggagccaggagaaattgcagctagtggaacgcctgcagggcgagaagcagcaggtggagcagcaggtcaaagagctgcagaaccgtctgagtcaacttcagaaggccgctgatccatgggtactgaagcacagcgagctggaaaaacaagataattcatggaaagagacacggagcgagaaaattcacgataaggaagccgtatctgaggtggaactgggtggaaatggcctgaagaggacaaagtcagttagctcaatgtctgaatttgagtcgctcctggactgcagcccatatctcgctggcggcgatgcgaggggaaaaaaactgccaaacaaccctgcctttggattcgtatcctcagaacccggggatccagaaaaggacaccaaggagaagcccggcctttccagccgggattgtaaccatctgggggccctggcttgtcaggacccaccaggaagacagatgcaacgatcctatactgccccagataaaaccggcatccgagtctattattcccctcccgttgctcggagactcggtgtcccagtcgtgcatgataaggagggcaaaataatcatagagccaggcttcctctttaccaccgccaaacccaaggaatctgccgaggccgacggcctcgctgagtcaagctacgggcgctggctttgtaatttctccagacagcgcttggatgggggctcggctggctcaccttcagcagccggccctgggttcccagcagccctgcacgactttgaaatgtctgggaacatgtctgacgacatgaaagaaatcactaactgtgtgcgacaagctatgcgtagcggttccttagaacgaaaggtcaagagcacttcatcccagaccgtaggcttggccagtgtaggcacacagacaatacgcacagttagcgtgggcctgcaaactgacccaccccgaagctccttacacgggaaggcttggtctccgcgtagcagtagtttagtttccgtgcgctccaaacagatctccagctctctggacaaagttcactccaggattgagagaccttgttgcagtcccaaatacgggtcacccaaactgcagagacgctccgtgtctaaactggactcttcaaaggaccggagcctgtggaacctgcatcaagggaaacaaaacgggtcagcctgggcaaggtctaccactacaagggattcgcctgtgttaagaaatattaacgatggactttcgagcttgttctcggtggtagaacactccggctctacagaaagcgtgtggaaactggggatgagtgaaactagagccaaacccgaaccacccaaatacggcattgtgcaggagtttttccgaaacgtgtgcgggagggccccctctcctacatccagcgccggcgaagagggtaccaaaaagcccgaacccctgtccccagcctcatatcatcagccggaaggggttgctaggatcctcaataagaaggccgctaaactcgggtcttctgaagaagtaagacttaccatgctaccacaagtggggaaggacggcgtgttgagggatggtgacggtgccgtcgtgttgcccaatgaggatgcggtgtgtgactgtagtacccaaagcctgacctcctgtttcgcaagatcctccaggtccgccatccgacactctcctagcaagtgtcgcttacaccccagcgagtcctcctggggcggcgaagaacgagcgcttccaccatcggagtag

SEQ ID NO: 33718 - DNA, 237 bp, Artificial Sequence
  Description of Artificial Sequence: Synthetic coding sequence
atgggcagcggcctgccactagtattgctgctgactctcctcggtagctcccacggcactggccctggaatgacactgcagctcaagctgaaggagtcgttcctgacaagcagcagctatgagtccagcttccttgaactccttgagaaactgtgtctattactgcatctcccatcgggcaccagcgttactctgcatcatgctaggtctcagcaccatgtggtgtgcaatacgtag

SEQ ID NO: 33719 - DNA, 690 bp, Artificial Sequence
  Description of Artificial Sequence: Synthetic coding sequence
atgcccgcagcaggccccccgcttttactgctcggtacacctggatcaggcaagaccgcgctgttatttgccgcagccctcgaggctgcaggagaggggcaggggccagttctttttctgacaagacgtcccctccagtccatgccaaggggtacaggtacaacgctcgacccgatgcggctgcagaagattcggtttcagtaccccccttccacccgagaattgttccgtctcctgtgttcagcccatgaggccccaggcccagcccccagtctcttgctgctcgacggtctcgaggaatacttggccgaggacccagagccccaggaagccgcttacttgatcgccctcctgctagatactgcagctcatttcagtcaccgcctgggtcctggcagagactgtggacttatggtggcactgcagactcaggaggaggccggatctggcgacgtcctccaccttgcccttctgcaaagatacttcccggcccagtgctggctgcaacctgatgcccctggcccaggtgagcacggtctgagagcttgcctcgaacccggcggactgggccccagaacagagtggtgggtgacctttagaagtgatggtgagatgatgattgccccttggcctacccaggcaggagatccgtcttctggtaaaggctctagctccggcgggcaaccatag

SEQ ID NO: 33720 - DNA, 2703 bp, Artificial Sequence
  Description of Artificial Sequence: Synthetic coding sequence
atgtcttccaaagagagctgcggtaagaaggagacaagccagcgcaaagatacaacaacttcttctccgaactttggggaaaaggacaagaaggaaaggaaaacccctgcatccagtacctcttcctcatccattcggtcggtttcatcagaaaaacgaaaactaaagtctgaccacactgacgtgctttattacaatatcaaacgccggcagggcctcaagcgcctttccgttgagatcgataccctgcgtcgccgccccaagattggaagtagcagccagagaccgataaaactgaaagaggcgtcctatagtaacgacaaccagatcatactccagagtcccagttccaatggaaccaagaaggacatccacaaatgcgttgactttaaacccaaggatatcaagttgaccaacgcaggttctaagctggaccacggtattaaatccttgagttcccctaaaattgcatccgacgtgaagcctaaagctgaaggtcaggcctcagagaataagtggagccaccttttggtgcagcgggagaaaatgaaagaacttaaaaagggccggaactctaaattccgggacaatagtgagaaatgtgtgcttgagaagtggaaacgcaaccagttttctcaggattataactcaaacaagataatcaaggaaccactgggttctcgcagacagaaaatttccttcaaaatccccattaagagcagggacaccctgcagaaactggtggaggaaaacgtctttaatattgacagtaataactccaagacaaaacaagaagaacgcgaataccttgagagctctcaagtgagcctgaatgtgacgagacagaaaaccgaacatctgctgtctgactttacctacaaacgcaccgtgcacgagtggaaaagaaagcaccactatgatcatcaagagtctaacgatagtcattcccgtgagaacctgactcaaagttttgaggcaccatgttgcagcgtttcctcagagtccatacaggacgctgatcaggagatgcagatcgtggaggaactgcatgctgccagggttggtaagtctgtggacctcccgggtgagctcatgtctatggaaattgatctcgaggatgatgtccactccagttccgctaacaacaccagtgatagaaagctccttatcgtcattgataccaatattctcatgaatcatctaaagttcgttcgaatcctgaagactacagaggtgcctggctttgacaagctggttctaattattccttgggtggtcatgcaagaattggacaggatgaaagaaggtaagctgctaaagagagcacagcacaaagcgatcccggccgtgcattttattaatgactcacttaaaaaccaagatcggaaactgtgggggcagtccattcagctggcaagtcagaagcactacggcctctccgatgagaataatgacgaccgagtgctgaagtgttgcctgcagcaccaggaattgttcccctgcagctttgtcattctgtgtacagacgacagaaacctgcggaacaagggattgatctctggggttaagtccttgagcaaggaggagcttagcgccgaactacttcatctgagtctcaatacagacgtctgtcaccagccatgcattcccaagcagcagctcaaggccgagacaacccccctgaaagagtcctacaaagaagaatccaccaatagcggcctgtcgatcctccttgagtccatcgtgtctgacctcgaaaagagcctcggcactggcctgtctagcatcctagagaccgagatgaaaatagcttttggcaatttgtggatggaaattctgtatctgaagcccccttggactctcctgcacctgcttcaatgcttcaaaaaacattggctagcggtcttcggtcttgtgatggagaagaatctgctactgacaatcgaatcattatacaagaacctgagaaaagccaacaaggctgtggacttcactaccgttaagttcctgttgcaggattcccggtcgctgctacacgcatttagcacaagatcaaactatgacggtatactgccacagaccttcgcacaggtcaataacctgctgcagacctttgctgaagtgaagaccaaacttaagcctaacagctctgaaaacacagtcaccaagaagcaggaaggaacttccctgaagaacagccacaaccaggagattacagtgttctcctccagccacctgccacaaccatctaggcaccaggagatttggtcaatcctggagtctgtgtggatcacgatttaccagaactcaaccgatgtgtttcaacgccttggctccaattcggcactgacaacatctaacatcgcctcgttcgaggaggcgttcatctgtcttcagaagctgatggccgccgtcagagacatcctggagggcatacagaggatcctggctccgaattcaaattaccaggacgttgaaactctgtataacttcctgattaaatacgaggttaataagaatgtgaagtttactgctcaggagatttacgattgcgtgtctcagactgaatatagagaaaagttaaccattggctgtcgccagctggttgaaatggaatatacaatgcagcagtgcaatgcctccgtatatatggaagccaaaaatcggggatggtgtgaagacatgttgaattatcggatatag

SEQ ID NO: 33721 - DNA, 2703 bp, Artificial Sequence
  Description of Artificial Sequence: Synthetic coding sequence
atgagttctaaagagagctgcggaaaaaaagaaacatcccagcggaaagacactacaactagctccccgaactttggcgaaaaggacaagaaagagagaaagactcccgcatccagcacaagctcctcctccatcaggagcgtcagttcagagaaacgtaagttgaagtcagaccacaccgacgtactttactacaatatcaaaagaaggcaggggttaaaacggctgtctgtggagattgataccctacgacggcgtccaaagatcggatcatcgtctcaacggccaattaagctcaaagaagctagttactcaaacgacaatcagatcattctgcaatcacccagctcaaacggaacaaagaaagacattcataagtgtgttgattttaagccgaaggatattaagctgactaacgcggggagcaaactggatcacggcattaaaagtctgagctcaccgaagattgccagcgacgtaaaaccaaaagccgaaggacaggctagtgagaataagtggtcacacctgctcgtccaaagggagaagatgaaagaactgaaaaagggaaggaactctaagtttagggataacagtgagaagtgcgttctcgagaaatggaaaagaaatcagttttcccaggattacaattcaaacaagatcattaaggaacccttgggcagccgcagacagaagattagtttcaagattccaatcaaatcccgcgacacgcttcagaagctggtggaggaaaacgttttcaatattgatagtaacaattctaagacgaaacaggaggagagagagtatttagagagctcccaggtgagtcttaacgtcaccaggcagaaaactgagcacctgctttcggacttcacctataagagaacagtccatgaatggaaacgaaagcaccattacgatcatcaggagtctaacgacagccacagtcgagaaaaccttacccagtcttttgaagcgccatgctgcagtgtatcatcagaatcaattcaggatgcggaccaggagatgcagattgttgaggagctacatgccgccagagtaggaaaaagcgtggatttacccggcgaactgatgagcatggagatcgacctggaagacgacgtccacagttcttccgccaataatacctccgatagaaagctgttgattgtgatcgatacgaacatcctgatgaatcacctgaagttcgttcgaattctgaaaaccacggaagtgcccgggtttgataagctggtgctgatcataccctgggtggttatgcaggagttagacagaatgaaagagggaaagttgttgaagcgagctcaacataaggcaatccccgctgtccactttattaatgatagtttaaagaatcaagatagaaaattgtgggggcagagcatccaactcgcttcccagaagcattatggtctgtctgatgagaacaatgacgacagagtcctcaagtgctgcctgcaacaccaggagttgtttccctgttccttcgtgatactttgtactgatgataggaacctgagaaacaagggcctgattagtggagtgaagtctctgtccaaggaggaactcagcgcggagctgctccacctgtccctgaatacggatgtctgccatcagccctgtattcccaaacagcagctgaaagcggaaaccacccctctgaaggaaagttacaaggaagagagtaccaattccggcctgtctattttgttagaatctattgtgtcagatctggaaaagagcctcggcactgggctgagtagtattctcgagaccgaaatgaagatagccttcgggaacttgtggatggagattctctacctcaagccaccatggacccttcttcatctcctgcaatgctttaaaaagcactggctggccgtttttggtctcgttatggaaaagaatctcctgctgaccattgagtcactgtacaagaatctgaggaaggccaacaaagccgtcgatttcaccacagtgaaatttctgctgcaggacagtcgatcactactgcacgccttcagtactagaagcaactacgacggcattctgccccagacctttgcccaggttaataacttgctccagacgtttgccgaggttaagaccaaactgaagcctaattcaagcgagaacaccgtgactaagaagcaggagggaacctctctgaaaaacagtcacaaccaggagataaccgttttctcctcttcgcacttgccgcagccttcccggcaccaggagatttggagcatccttgaaagtgtctggatcacgatctatcagaactcaacggacgtgttccagcgactgggcagcaatagtgccctcactacttctaatatcgctagcttcgaggaggcttttatttgccttcaaaagcttatggctgcggtacgggacatcctggagggcatccagaggattctggcacctaatagcaactaccaggatgtggagactctgtacaacttcctgatcaagtatgaagtgaacaagaatgtaaaattcactgcccaggaaatttacgactgcgtgtcacaaactgagtacagggagaagctgactatcggatgtcgccagttggtcgaaatggaatataccatgcagcaatgtaatgctagtgtctatatggaagcgaaaaacagaggatggtgcgaggacatgctgaattaccgtatttag

SEQ ID NO: 33722 - DNA, 483 bp, Artificial Sequence
  Description of Artificial Sequence: Synthetic coding sequence
atgtccagcaaggaatcttgcgggaaaaaggaaacatcccagagaaaggacaccacaacatcctcccctaacttcggggagaaagacaagaaggagagaaaaacacctgccagttctacttcaagcagctccatacgttccgtcagctccgaaaaaaggaaattaaagagcgaccataccgatgtgctgtactacaacatcaagaggcgccaaggtctcaaacggctgtccgtggaaatagacaccctccggcgccggccaaaaatcggtagttcatcgcagcggcctattaagctgaaggaggcctcatacagtaacgacaaccagatcattctgcagtcaccatcgagtaatggcactaagaaagatatccacaaatgtgtggatttcaaacccaaggacataaagcttacaaacgctggctccaagttggaccacggtatcaagtcgctctcttcccctaaaattgcaagcgatgtttag

SEQ ID NO: 33723 - DNA, 1545 bp, Artificial Sequence
  Description of Artificial Sequence: Synthetic coding sequence
atgatgaactttttgcgccgccggctttccgattccagcctgtttagcagcctctctcaggccgtaaagcagaccgccgcctccgcgggcctcgtggacgctccaggcgctgccccggctgctgccaggaaggccaaggtcttactcgtggtggacgagcctcacgcggactgggcgaagtgcttccgcggaaagaaagtactgggcgactatgacataaaggtggaacaggcagagttttctgaactcaaccttgtggcccacgccgatggcacgtatgctgtggacatgcaggtgctcaggaacggcacaaaggtggttcgttcgtttcggcctgacttcgtactgatccgacaacacgcttttggcatggccgaaaacgaagacttcaggcatttgatcattggaatgcagtacgccggcttgccctccataaattcactggagtccatctataatttctgtgacaaaccgtgggtgttcgcacagctcgtggcgatttataagaccctgggcggggaaaagtttcccctgatagagcagacctactaccctaaccataaggagatgctgaccctgccaaccttcccggtagtcgtcaaaattgggcacgcacattcaggaatgggcaaagtgaaggtcgaaaatcattacgactttcaggacatcgcaagtgtggtggcactaacgcagacttacgcaacagccgagccctttatagattctaaatatgatattagggtccagaaaatcggtaataattacaaggcttacatgcgaacatcaatttctggcaattggaagacaaataccggatctgcaatgctagaacaaatagcgatgtccgataggtacaaattgtgggtggacacctgcagcgaaatgttcgggggtctcgacatctgtgccgtaaaggccgtccacgggaaagatggtaaggattatatcttcgaggtaatggactgttctatgccactcattggggagcatcaggtggaagaccgccaattgattacagaacttgtgatatctaaaatgaatcaactgctgagccggaccccagcgctgtccccccaaagaccgttgacgactcaacaaccacaaagcggcaccttgaaggatcctgattctagcaaaacgcccccccaacggccaccacctcagggtggaccaggtcagccgcaggggatgcaaccacccgggaaggtgttgccacctagacgtcttccccccgggccaagcctgccaccttcctcttcttcgtccagcagtagctcatccagcgcccctcagcgccccggaggacccactactcatggcgatgcaccaagcagctcttcttccctcgcagaggcgcagccaccgctggccgcgcccccccaaaagccacaaccccatccgcaactgaataagtctcagtctctgaccaacgccttttcctttagcgagtccagcttcttccggagctccgctaatgaggacgaagctaaagctgagacaatccggtccttgaggaaaagtttcgcatcgctgtttagcgattag

SEQ ID NO: 33724 - DNA, 729 bp, Artificial Sequence
  Description of Artificial Sequence: Synthetic coding sequence
atggccggaaagcttaagcccctgaacgtagaagcccccgaagcaacagaggaggcagaaggccaggcgaagtctttgaagactgaggacctgctggccatggtcattaaactgcagaaagaggggagcttagagccccaaattgaagacctgattagtcgaattaatgacctgcagcaggcaaaaaagaaatcttctgaagagcttcgcgaaactcacagtctgtgggaggccctgcatcgggaattggatagcctgaacggtgagaaagtgcacctagaggaggtactgggaaagaagcaagaagcccttagaatattgcagatgcattgccaagaaaaagaatccgaggcccagagactggacgtgcggggacagttagaggatctgatggggcaacataaggacctttgggaatttcatatgcttgagcagagattggccagggagatcagagctctggagaggtcgaaagagcaactgttatctgagagaaggcttgtacgcgcaaagctgagagaagtagagcggagactccactcgccacccgaggtggaaggcgctatggccgtaaacgacggcttgaaagccgagttagaaattttcggggagcaagtgaggagcgcacccgaggtcggggccggcgagggagaggccgggcccgagctgccacgggccagagatgaggaagaccccgagccgcccgtggcggccccagacgcattgtag

SEQ ID NO: 33725 - DNA, 267 bp, Artificial Sequence
  Description of Artificial Sequence: Synthetic coding sequence
atggatgacgccgacccagaggagcggaactacgataacatgcttaagatgctgagtgatctgaacaaagatcttgaaaagctgctggaagagatggaaaaaattagtgttcaggcaacatggatggcctacgacatggttgttatgcgaactaaccccactctggccgagagcatgaggagactggaggacgcattcgtgaattgcaaggaggagatggagaaaaactggcaagagttgctccatgagacaaaacagaggttgtag

SEQ ID NO: 33726 - DNA, 942 bp, Artificial Sequence
  Description of Artificial Sequence: Synthetic coding sequence
atgttactgcttgccgatatggacgttgtcaaccagctggtcgcggggggtcagtttagggtggtgaaggaacccctggggtttgtgaaagtgcttcagtgggtgttcgcgatctttgccttcgctacatgcggatcctacagcggggaattacagttaagtgtagactgtgccaacaagactgagagcgacttgagtattgaggtggagtttgagtacccattccgtctgcatcaggtttactttgacgcccccacgtgtcggggggggacaacaaaagttttcttagttggcgactacagcagtagcgccgaattcttcgttacagtcgctgttttcgctttcctttatagcatgggggcactcgcaacatacatcttccttcagaacaagtatagggaaaataacaagggacctatgctggatttcctggcaacagcggtgttcgccttcatgtggctggtctcatctagcgcctgggccaagggactgtccgacgttaagatggccactgatcctgagaacatcattaaagagatgcccgtatgccggcagacagggaacacttgcaaggagctgagggaccccgttacctccgggttgaatacctctgtggtgttcggattcctgaacttggtactttgggtgggcaacctttggtttgtgtttaaggagacgggctgggcagccccttttctgagggcccctcccggcgcgcccgaaaagcagcccgctccgggagatgcctacggagacgcagggtatggtcagggccccgggggctacggcccacaggactcttatgggccccagggggggtaccaacctgactacggacagccggcagggtctggaggctctggatacggcccccagggcgactatggacagcagggatatggcccgcagggcgccccaacaagtttctctaaccagatgtag

SEQ ID NO: 33727 - DNA, 1173 bp, Artificial Sequence
  Description of Artificial Sequence: Synthetic coding sequence
atggcagagcagttggctcttgtgattggaggcacaattggaggtctccttcttctgctgcttatcggcgctagttgctgcttatggcggaggttctgcgcaacattgacctacgaagagctccctggcaccccagctatggcgactacagccgcatcctccggtcagcgcgacaggccttgccagcctcacgccagaacccagctcagcaggcctcccgcagtcccttttgtcgtgcccccaactttacagggtcgagactgggtgccattgcattccggtgaatgggccgacgcaccttgggacccgtgtcctgctagcgaactgctgccccacacatcatcaggaggcttaggcgatgcatgtatggtgggcgccatcaacccggagctgtacaagtttccagaggacaagtccgagacagacttccctgatggttgcctgggcaggctgtggttttccgtcgaatacgaacaggaagccgagagattgcttgtgggcctcatcaaggcgcaacacttgcaggctcctagcgaaacctgttcacccctggtgaagctgtacctgctgcctgacgaaaggcgattcctgcaaagtaagaccaaacgaaagacatctaaccctcagttcgatgagcactttatcttccaggtatcatcaaaaaccataacacaacgggtgcttaaatttagcgtgtaccatgtagacaggcagaggaagcaccagctcctgggccaagtcctgtttccactcaagaatgagaccctggtgggcgactgccgtagagtaatctggcgagacctcgaggctgagagcctggagcccccctctgagttcggagacctccagttctgtttgagctacaacgactacctctcaaggcttaccgtggtggtattaagggcaaagggactccgtttgcaggaggatagagggatcgtttctgtcttcgtgaaggtatccctcatgaaccacaacaagtttgtgaaatgtaaaaagacaagcgcagttttggggagtattaaccccgtctacaacgaaacatttagttttaaggcagatgctacagagctggacacagcatccctcagtttgaccgtggtacaaaacatggaaggcgacaaacaggcaactaccgtggagctgtttctcttccatcttacgtccgggtag

SEQ ID NO: 33728 - DNA, 1833 bp, Artificial Sequence
  Description of Artificial Sequence: Synthetic coding sequence
atggcccaggagatagatcttagtgctctgaaggaattggaacgtgaagctatacttcaggttctttacagggatcaggctgtgcaaaacaccgaggaggagcgtacccgcaagctgaaaactcatttgcaacatcttcggtggaaaggggctaagaataccgactgggagcacaaagagaaatgctgtgctcgttgccaacaggttttgggatttctgttacacaggggcgctgtctgtagaggatgcagccaccgggtctgcgcccagtgcagagtcttcctgagaggaactcacgcctggaaatgtacggtgtgctttgaggatcggaatgtgaagatcaagaccggcgagtggttctatgaagagcgggccaaaaaattccctactggcgggaaacatgagactgtgggcggacagctcctgcaaagctaccaaaagctctccaagatcagtgtggtacccccaactccccccccagtctctgaatctcagtgttcccggtctcccggacggttacaagaatttggccagttccgggggtttaataaatcagtggagaacttgttcctatctctagctacacatgtgaaaaaactttccaaatctcagaatgacatgacctctgaaaagcacctgctggcaactggaccaagacagtgtgtgggccagaccgagcgcaggtctcaaagtgacaccgcggtgaacgtcacaactcgaaaggtgtccgcgcctgatatactcaaacccctcaaccaggaagacccgaaatgcagcacaaaccctatcctgaaacagcagaatctgccctcttcgccagcccccagcacgatttttagcggaggattccgacacggatcccttatttccattgactctacctgcacagaaatgggaaacttcgataatgcaaatgtgacgggagagatcgagttcgcaatacattactgttttaagacacactcccttgagatctgtataaaggcctgtaaaaacttagcctacggtgaagagaagaagaagaagtgtaatccctacgttaagacgtacctcctcccggacagatcctcccagggcaagcggaaaaccggtgtacagcggaacaccgtagatcctacttttcaggagacgttgaaataccaggtcgctcctgctcagctggtgacaagacagttgcaggtctccgtgtggcacttgggaaccttggcccgccgggtgttccttggagaggttattataccactggccacttgggactttgaggactcgacaacccagtctttccgatggcatcctttaagggctaaggctgaaaagtatgaagactccgtcccacagtccaatggcgagctgacagtgcgcgcgaagctagttctgcctagccgcccacgcaagctccaagaggcacaagaggggacagaccagccctcactgcatggccagctctgcctcgtggtgctgggggccaagaacctgcctgtaagaccggatggcacattaaactcttttgtgaaaggttgtcttaccttgcccgatcagcagaagctgcgactaaagtccccagtgctgcgaaagcaggcctgtccccaatggaaacatagctttgtgttttccggcgttaccccggcccagctacgacagtcgtcattagagctcaccgtgtgggatcaggcactcttcgggatgaacgatcgtctcttaggtgggacgcgcttggggtcgaagggggacactgctgttggcggtgacgcctgctccctgtccaagctgcaatggcagaaagttcttagcagccccaatttatggaccgatatgaccctagtcctgcactag

SEQ ID NO: 33729 - DNA, 1629 bp, Artificial Sequence
  Description of Artificial Sequence: Synthetic coding sequence
atggcccaggagatcgacctgtctgctctgaaggaattggagcgcgaagctattctgcaagtactgtatcgcgaccaagcagtgcaaaacacggaggaggaacgtacaaggaagcttaagacacatcttcagcacctgcgttggaagggtgcaaaaaacaccgattgggagcataaagagaaatgctgcgccaggtgtcaacaagtgcttggatttctcctccataggggggccgtatgccgtggttgttcccatagggtctgcgcccagtgccgtgtatttcttcgcgggactcatgcatggaaatgcactgtctgctttgaggaccgaaacgtgaaaataaagacgggcgagtggttctatgaggagcgggctaaaaagttccccacaggagggaagcatgagaccgtaggtggacagctgctccagtcgtatcagaagctgtctaagatcagtgtcgtccctcctacacccccccctgtgtctgagtcacagtgttctcgcagcccaggccgcaaggtcagcgccccagatatcctgaagcccctcaatcaggaggacccaaagtgcagcacgaaccccattttgaagcagcagaacctgccctcatccccagcaccctcaaccattttctctggcggcttcaggcacgggagccttatctctattgatagcacctgcaccgagatggggaatttcgacaatgccaatgtgacaggcgaaatcgagtttgcaattcattattgctttaaaacgcacagtctggaaatttgcattaaggcctgcaagaacttggcctatggtgaagagaagaagaagaaatgcaacccctacgtaaaaacgtacctgctgccagacagatcttcacagggcaaacggaagactggcgtgcaacgcaacactgtggatcccacgtttcaagagacgctaaaataccaggtggcccccgcgcaactggttacgagacagctgcaggtcagcgtgtggcatctgggtaccctagcgcgaagggtgttcctaggagaggtgatcattcccctggctacctgggatttcgaagattcgaccactcagtcctttcggtggcaccctcttcgcgctaaggccgagaagtacgaagactcggtccctcagtcaaacggcgaattaactgtccgagctaagctggtgctaccatctcgtcctcggaaactacaagaggctcaagagggcacagatcagcctagcttgcatgggcaactctgccttgtcgtgttaggcgccaagaaccttccagtgcggccagacgggactcttaatagttttgtcaagggctgtcttacactcccagaccaacagaaactgcggctgaagtcccctgtgcttcgcaaacaggcctgccctcagtggaagcattctttcgtattctctggcgtcacaccggcccagctgcggcaaagttcccttgaacttactgtgtgggatcaagccctgttcggcatgaacgaccggctgctgggtgggacgcgactgggctctaaaggggataccgcagtgggcggagatgcctgctccttatctaaacttcaatggcaaaaggtgttgtcttcccctaacttatggacggatatgaccctggtgcttcactag

SEQ ID NO: 33730 - DNA, 1011 bp, Artificial Sequence
  Description of Artificial Sequence: Synthetic coding sequence
atgagaaacgagccacggaatttccaattagaaggctccttaattagcatagattcaacatgcaccgagatgggcaatttcgacaatgcaaacgtaactggcgaaattgagttcgccatccattactgcttcaagacccactctttagagatctgcattaaagcctgtaagaaccttgcgtacggcgaagaaaagaagaagaagtgtaatccctacgtcaagacatatctgctgcctgatcgaagctcacaggggaaacgaaagacaggagtccagagaaacactgtggatcccacattccaggaaacccttaagtaccaggtggcccctgcgcagctggttacacgacagctccaagtctctgtgtggcaccttggcactctcgcccgtcgcgtttttttgggtgaggtgattattcccttggccacatgggacttcgaagactctacaacccaatctttccggtggcatccgcttcgagctaaagccgagaaatacgaggacagcgttccacaatccaacggagagctcacagtgcgtgctaaactagtgcttcccagccggccgcgaaaactgcaggaggcccaggaggggaccgaccagcctagcttacatggccaactgtgtctcgttgtgttaggtgctaaaaatctgcctgtgagacctgatggcacactgaactccttcgtgaagggttgcctgactttgcctgaccaacagaagttgaggctgaagtcaccagtgctccgcaagcaagcatgcccacagtggaaacactcatttgttttcagtggcgtgacacctgcccaactgaggcagtctagcctcgaacttacggtatgggatcaggctttgtttggcatgaacgaccgcttactagggggcacaaggctgggctccaagggagatacagccgttggtggagacgcctgttctttatctaagctacagtggcagaaggtactctcttccccaaacttgtggacggatatgaccctggttctgcactag

SEQ ID NO: 33731 - DNA, 1704 bp, Artificial Sequence
  Description of Artificial Sequence: Synthetic coding sequence
atggcacaagagattgatttgtccgctcttaaggaattagagcgcgaggctatcctacaggtgttgtaccgtgatcaggccgtacagaatacggaggaagagcgcacgcgcaaattaaagactcacctccaacatttgcgctggaaaggcgctaaaaatactgattgggagcacaaagagaaatgctgcgcgcggtgtcagcaggtgctcggctttctgctccatcggggagctgtttgtaggggctgctctcaccgcgtttgcgcccagtgtagagtctttcttcgtggaactcacgcttggaaatgtaccgtgtgctttgaggacaggaatgtcaagatcaaaacaggggaatggttctacgaagagcgtgccaagaagttccccactggcggaaagcacgagaccgttggagggcaactgctgcagtcctaccaaaaactctccaaaatctccgtcgtcccccccacacctccccctgtaagcgaatctcaatgttcccggagccctggacgcctccaagagttcggccaattcagaggatttaacaaatctgtagaaaaccttttcctgtccttggccactcacgtaaaaaagctgtccaagagccagaacgacatgaccagcgagaagcacttgctcgccactggtcctcgacaatgcgtggggcagactgagcggagaagccagagtgacaccgccgtgaacgtcacaactagaaaagttagcgcgccagacatcctcaaaccactaaaccaggaagatcccaaatgctccactaatccgattttgaaacagcagaatttgccctcttctcccgccccctctacaatattctcgggcgggttccgccacggaagcctcatatccattgattctacttgcaccgagatgggtaatttcgataacgctaatgttactggcgaaattgaatttgccatacactactgcttcaaaacccactcactggagatttgtattaaggcttgcaagaacctcgcttatggagaggagaaaaagaaaaagtgtaacccctacgtaaagacgtacctgttgccggatcggagctcccagggcaagcgtaaaaccggcgtgcagagaaataccgtcgatcctacgttccaggaaacacttaagtatcaggtggcacccgctcagctggtgacccgtcagctgcaagtatctgtgtggcatttagggaccctggccagacgcgtttttctgggggaggtcatcattcccctggcaacttgggatttcgaggacagcactacacagtcattccgctggcacccattgcgggccaaagctgaaaagtacgaggattcagtgccgcagagcaacggagagctgactgtgagagcaaagctagttcttccaagccgcccccgaaaacttcaggaagcgcaggagggaacggatcagcccagcttgcatggtcagttgtgcctggtagtattaggcgcgaagaacctccccgtcagaccagacggaactctgaatagcttcgtgaaaggatgcctcaccctgcccgatcagcagaagctcagactgaaatcacccgtcctgcggaagcaagcttgcccgcagtggcgccactcctgctggagggggtgcatgctgaccatcgaggcccccgtggcagagtctcccttccaaccccagtctatggaccgtcatgatagttgccctgctctgacatag

SEQ ID NO: 33732 - DNA, 2193 bp, Artificial Sequence
  Description of Artificial Sequence: Synthetic coding sequence
atgagcaaaaattccgaatttatcaacctctctttcctcctagaccacgagaaagagatgatactcggtgtgttgaaacgcgacgagtatttgaaaaaggtagaagataaaagaatacgaaagctgaagaacgagctgttagaggccaaacggaggtctgggaaaacccagcaggaggcttccagagtgtgtgtccactgccaccgcaaccttgggctgatattcgatagaggagatccatgtcaggcttgttcacttagggtgtgtagggaatgccgagttgcagggccaaacggaagctggaaatgtaccgtctgtgacaagattgcacagctgcgcattatcactggagagtggttctttgaggaaaaggctaagcggttcaagcaagtgaatgtcctggggaccgatgtggttcgacagtcaatcctgcggcggagtcccggggctgaggaagtacagtcccaagagcaaacgagacaagacgctgagaaatctgacaccagccctgtagcggggaaaaaagcgagccacgatggtcctaagcgaaaagggttccttctgagcaaattccgctccgcgactagaggcgagattattactcccaagacagatactggccgaagttattcgctggacttggacggccagcatttcaggtctttgaagagtcctccaggatcggatcggggttcaacaggatccagtgacttgaacgaccaggaacccgggccgagaacccctaaatcttccaggagtaacggtgtgacacccggcacacaatcctctccagctccaagtaccaggaccgtgacctcagtgatctctcgagaatatggattcgaaaattccatggacctggccgctatcgaggggacttctcaggaactgaccaagtcgcataggagaaatacatctggcactccaagcatagctgtgtcgggtacaagcctcagcagcgatcagtctcgaagtgagctggatctgagcgagagtttcactgaagacagtgaggacactgtgtcaattcgaagtaagagcgtgccaggagctttagataaggattcccttgaggaaacggaggagtccattgacgccctggtgagtagtcagttaagtactaacacacaccgcctcgcttccggtctgtccactacgagcctgaactcaatgatgtctgtatacagcgaaaccggtgactatggaaatgtgaaggtgtccggcgagatcctgctccatatatcatattgttacaagaccggggggctgtacatcttcgtcaagaactgtagaaatttagcgataggagacgaaaaaaaacagaggactgacgcatacgtaaaaagctatctgcttcctgacaagtctcgaaacaataagaggaagactaagattcgcacaggaacgaaccctgagtttaacgagaccctgaagtacacaatttcccacacccagctggagaccaggaccctccagctctccgtctggcattacgacaggtttgggcgaaatagctttctgggtgaggtggagatcccgtttgactcctggaactttgaaaatcctaccgatgagtggtttgttcttcagcccaaagtggagttcgcccctgatatcggcctgcagtataagggcgaattgactgtcgttctgagatatattcctcctgaggagaacctcatgctgcctccggagcagctgcaaggcaacaaaacgtttaaaaaaggcaagaaaaaggaaagccctgtcatcagtggaggtatcctcgaagttttcatcaaagaggcaaagaacctaaccgctgtgaagtccggaggcactagcgatagctttgtgaaaggctatttactccccgatgatagcaaggccaccaagcacaagaccctcgtgatcaaaaaatcagtgaatcctcagtggaatcatacattcatgttttccggaatccaccctcaggacatcaaaaacgtgtgcctggagttgacgatttgggacaaggaagctttctcatccaatatcttcttgggcggagttcggctgaactctggctccggggtgtcacacggcaagaatgtggactggatggacagtcaaggggaagaacagcgactgtggcaaaagatggctaacaatcctggtacccccttcgaaggcgtgttgatgctgaggtcgagcatgggcaagtgcaggctttag

SEQ ID NO: 33733 - DNA, 2193 bp, Artificial Sequence
  Description of Artificial Sequence: Synthetic coding sequence
atgagcaagaattccgagttcattaatttgtctttcctgcttgatcatgaaaaggagatgattctaggtgtcttaaaacgggacgagtacttaaagaaagttgaagacaagcggatcagaaagcttaaaaacgaattgctagaggcaaaaaggcgcagcgggaaaacccagcaagaagcctcacgagtgtgcgtgcactgccatcgcaacctgggtctgatcttcgatcgcggcgacccctgccaggcatgctctctcagggtttgccgcgaatgcagagtggccgggcccaatggttcatggaagtgcaccgtgtgtgacaagatcgcgcagctcaggattataacgggtgagtggttcttcgaggagaaggctaagcggtttaaacaggttaacgttctgggcactgatgttgtccggcagagcatcctccgtaggtctcctggggctgaggaggtccagtcacaggagcaaacccgccaagacgccgagaaaagcgacaccagtcccgttgccggcaaaaaggcctcccatgacggccctaagaggaaaggttttctgttatcaaagttccggagtgcaacgcgaggtgagataattacccccaaaaccgacaccggtagatcctactcactcgatttggatggccagcactttagaagcctaaagagtcctccagggagtgatagaggcagtacagggtcctctgatctgaatgaccaagaaccgggcccgcggacccccaaatcaagtcggtccaatggagtaacgcccggaacccagtcttcgccagcacccagcacaagaaccgtaacatccgttatttcccgagaatatggctttgagaacagtatggatctggccgctatagagggaacctctcaagagctaaccaaatctcaccgtaggaacacttccggcaccccatctatcgctgtgagtgggacctccctctctagtgaccagagccgttctgagttggatctgagcgagagctttacagaagacagtgaagacacggtgtccatccgatctaagagcgtgcccggcgcattagataaagacagtctcgaagagacggaagaatcgatcgatgcactggttagcagtcaacttagtaccaatacgcatcgcctagcgagtgggctctccactacctccctgaattcaatgatgtccgtttactctgaaaccggggattatggaaacgttaaagtttcaggcgaaatcctgttgcacattagctactgctacaaaaccggcgggttgtatatctttgtcaaaaactgtcgtaacctggcaattggagacgagaagaagcagagaactgatgcatacgtgaagtcttacctgctacccgataaatcccgaaataataagagaaagactaagatccgcaccggtactaaccctgagtttaacgagacccttaaatacacaatatctcatacacagctggaaacacggacgctccagttgtccgtgtggcattacgaccgtttcggcagaaactcattcctgggtgaggtggaaattcctttcgatagctggaatttcgagaaccccacggacgagtggtttgttcttcaacctaaggtggagttcgcccctgacattggcctgcagtataagggggaattgactgttgtgctcagatacattccgccagaggagaacctcatgttaccccctgaacagttgcaggggaacaaaacgttcaagaaagggaagaaaaaggagagtcccgtgatttccggaggcatcctggaagttttcattaaagaagcaaagaacctcacagccgttaaatccggtgggaccagcgattcctttgtgaagggctatcttctgcctgatgattccaaggccacaaaacacaagaccctcgtgataaagaaaagcgtgaacccccagtggaaccacactttcatgttctctgggatccatccccaggacattaaaaacgtttgtctggagttgaccatatgggacaaggaagccttcagttccaatatttttctgggcggagtccggttgaactccgggagtggcgttagccacgggaagaatgtagattggatggacagccaaggggaggagcagcgcttgtggcagaagatggcaaacaaccctggaacaccttttgaaggcgtcttgatgctgaggtccagcatgggaaaatgtcgtttatag

SEQ ID NO: 33734 - DNA, 2259 bp, Artificial Sequence
  Description of Artificial Sequence: Synthetic coding sequence
atgtctaagaacagtgagttcattaacctgagcttcctcctggatcacgagaaagaaatgattcttggcgtgctgaagagggacgaataccttaaaaaggtcgaggataagcggatcagaaaactcaagaatgaactgttggaggctaagaggcgcagcggaaagacgcagcaggaagccagtcgggtgtgtgttcattgtcatagaaatttgggcctgatctttgacaggggggacccatgccaagcttgcagtctccgggtctgtcgggagtgtcgcgtggcggggcctaatggatcctggaagtgcaccgtctgtgacaaaatagcccagctgagaattatcacaggcgagtggttctttgaggagaaggccaagaggttcaagcaggtgaacgttttgggcaccgacgtggtgaggcagagcatcctccggaggtcccctggggccgaggaggttcagagtcaggagcagacacgccaagatgcggagaagtccgataccagccctgtggccgggaagaaagcttcacatgatggccccaaaagaaaggggttcttgctgagtaaatttaggtcagctacccggggagagataattacaccaaagactgacactggaagaagctatagccttgaccttgatggccagcacttcaggtcacttaagtcccccccgggcagtgatcggggttctaccggatcaagcgatctcaacgaccaggagccgggacctagaacgcccaagagcagtcgctctaatggtgttacacctggtacacagtctagccccgccccctctacacgtactgtcacgtctgttatctcgcgagagtatggatttgaaaactctatggacctggccgccattgaaggtacatctcaagaactgacgaaaagccatcgccggaacacatctggcacaccttcaatcgccgtttccggaacaagcctttcgtccgatcaatcacggtctgagctggacctgagcgagtcctttaccgaggactccgaggatacagtttctatccgaagcaaaagtgtgcctggtgccttggataaagattccctcgaagagaccgaggaaagtatcgacgccctggtgtcctctcaactcagtacaaacactcacagattagcctcaggactaagcacctctagccaggctgggagcgataggaagtggacatatcttaatgtgcccgatgccgattcagataccaccagcctcaattccatgatgagcgtatacagtgagacgggcgactacggaaatgttaaggtcagtggagagatcctgttacacatttcctactgttacaaaactggtggcctctatatatttgtcaaaaattgtaggaatctggcgatcggtgacgagaagaagcagagaacggacgcatatgtcaagtcctacctgctaccagataagtcaaggaacaacaaaaggaagacaaagatcaggacagggacaaatcccgaatttaacgaaactctgaagtatacaatctcacatacccagctggagacgaggaccctgcaactctccgtgtggcactacgataggtttggcagaaattcatttctgggcgaggtggaaatccccttcgatagctggaactttgaaaacccaactgatgaatggtttgtgctgcagccaaaggtagagtttgcgccggacatcgggttgcaatataaaggagaactgactgtggtgcttcgatatatcccacctgaagagaatctgatgctcccaccagagcagctgcagggcaataagacgttcaagaagggcaaaaagaaagagtcccctgttattagcggtgggattctcgaagtcttcataaaggaggccaaaaacttgactgccgtgaagagcggggggaccagcgacagcttcgttaagggatatctcctgcctgatgattcaaaggccactaaacacaaaaccttagtcatcaaaaagagtgtgaatccgcagtggaaccacacattcatgttttccggcattcacccccaggacatcaaaaacgtctgccttgagctcactatctgggacaaggaagccttcagtagtaacattttccttggcggggttaggcttaatagtggctccggagtgtcacacggaaagaacgtggattggatggattctcagggggaggagcaacgtctgtggcaaaagatggcgaataatcctggcacaccattcgaaggcgtcttaatgctgcgcagttctatggggaaatgccgactgtag

SEQ ID NO: 33735 - DNA, 3762 bp, Artificial Sequence
  Description of Artificial Sequence: Synthetic coding sequence
atgctctcttggagactgcagaccggtccggagaaagctgagctacaggaactaaatgcccgactatacgactacgtgtgtcgcgtgcgcgagttggagcgggagaacctcctgttagaagaagagttacgcggacgtcgaggtcgggaagggctgtgggccgaggggcaggcaaggtgtgctgaggaagcccgatcgctgaggcagcagttagatgagctgagttgggcaaccgctctagccgaaggcgagcgcgacgcgctcaggcgggagcttcgggaactccagagactggacgccgaggagagggccgccagggggcgcctggacgccgagctcggcgcgcaacagcgtgagctgcaggaagccctgggggctcgggccgcactggaagccttacttggtcggcttcaggctgagcgtagagggctcgatgcagcccatgagcgtgatgtgagggaacttcgagccagagctgcctctttaacaatgcattttcgcgcccgggccactgggccagccgcacctccaccgaggctgagggaggtacacgattcatatgctctcctggtggcagagagctggagagagaccgtgcagctgtacgaggacgaagtcagggaactggaggaagcactacgcaggggacaggagtcgcgcttgcaggccgaggaagagacccgcctctgtgcccaggaggccgaagcactgcgtagggaggccttgggtctcgagcagctccgagccagactcgaagacgccctgctgaggatgcgggaggaatacggaatccaagccgaggagcgccagcgagtgattgactgcctggaggatgagaaagctaccttgacgctcgccatggctgactggctgagggactaccaggatctgctccaggtaaaaacaggcctgtcacttgaagtggccacataccgggcacttctggaaggcgaatctaaccccgaaatcgtgatatgggctgagcatgtggagaacatgcctagtgaattcaggaataaaagctaccattacacagacagtcttcttcagagggaaaatgagaggaatctgtttagcagacagaaggcgcctctggcgtccttcaaccactcctcagccctgtatagtaatctgagcggccaccgcggctcccagacaggaacttcgattgggggcgacgcacgacggggatttctgggttctggctattccagcagcgccaccacccagcaagagaacagctacgggaaagccgtgtcctcccagacaaatgtgaggacgttctcgccgacctacggcctcctgcggaacactgaagcacaggtgaaaaccttcccagacagacctaaggcaggggatactcgggaggtcccagtctatatcggagaagatagtactattgcgagggaaagctacagagacaggagggataaggtggccgcaggagcctcagagtccacacgtagcaacgaacgtaccgttatcctggggaagaagaccgaggttaaagccacaagggaacaggagagaaataggcccgagacgatcagaactaagcccgaggagaaaatgtttgattcaaaggagaaggcctcagaagaaaggaacttacggtgggaagagctcaccaaattagacaaggaagcacgccaacgggaatcccagcagatgaaggagaaagccaaggaaaaggattctccaaaggagaaaagcgtccgagaacgcgaggtacccatttccctggaagtgagccaggatcgtagggctgaggtcagccccaaagggttacagaccccagtgaaggacgctggaggagggaccggtagggaggccgaagctagggaactgcggttccggctgggcaccagcgatgcaacagggtcactgcaaggcgattctatgaccgagaccgtagcagagaatatcgtgacctcgattctcaagcagttcacccagagtcccgagactgaagcctccgcagactcctttccagacacaaaggtaacatatgtagacaggaaagagctacctggcgagaggaagaccaagacggagatcgtcgtagagtccaaactgacggaggacgtagatgtgagcgatgaggccgggttggattacctgctgagcaaggacattaaagaagtaggtctgaaagggaagtccgcagagcagatgattggggacataatcaacctgggcctcaaaggaagagaagggagggcgaaggtggtcaacgttgaaatcgtggaagaacctgtcagctatgtttccggagagaagccagaggagttttccgtgcctttcaaggtggaggaggttgaggacgtaagccccggtccatggggtcttgttaaagaagaggagggatacggtgaatccgacgtgaccttctcagttaaccagcaccgccgtacgaaacagccccaggaaaatactacgcatgtggaagaggtgaccgaagccggcgatagcgagggcgaacaatcctatttcgttagtacacctgacgagcaccccggcgggcacgacagggacgatggttccgtgtatggtcagattcacatcgaggaggagagtacaatcaggtactcgtggcaggatgaaattgtgcaggggacccgaagacgaactcagaaagacggcgccgtgggcgaaaaggttgttaagccgttagacgtgccagcgccgtccctggagggagacctagggagcacacactggaaggagcaggcccgctcaggagagtttcacgcggagcccaccgtgattgagaaggaaattaaaatcccccatgagttccatacgtctatgaaggggatctcttccaaggaaccaaggcagcagctcgtggaggttatcggccagctggaggaaactctcccagagagaatgcgtgaggagttaagcgccttgacacgggaagggcagggcggacccggttcagtgtcggtggatgtgaagaaagtgcaaggtgcaggagggtcctccgtgactctggtcgcagaggtaaatgtttctcagactgtggatgctgatcgactggaccttgaagaactctctaaagacgaagcgtctgagatggaaaaggccgtcgagtctgtggtacgcgagtcactttctcgccaacgatctccagcccctggttcacctgacgaggaagggggagcagaggctcccgcagctggaatcaggttccgacggtgggcgacccgcgaactatacattcccagtggcgagtctgaggtcgccggcggcgcatcacattcgagtggccagcggactcctcagggtccggtaagcgcgaccgtggaagtgtccagtcccaccgggttcgcccagtctcaggtcctagaggatgtgtcgcaagcagccaggcacataaaattaggtccgtccgaggtgtggagaactgagaggatgtcatatgagggaccaacagcagaagtggtggaaatggacgttagcaacgtcgaagcgatccgttcaagaacacaggaggccggtgccctaggggtttctgatcgggggtcttggcgggacgccgattcaaggaatgatcaggcagtgggtgtctctttcaaggcaagcgcaggagagggcgaccaagcgcaccgagagcaagggaaggagcaggctatgtttgataagaaggtacagctacaaagaatggtagaccagaggtctgtgatttccgacgagaaaaaggtcgccctcctgtacctggacaacgaggaagaggagaatgatggccattggttttag

SEQ ID NO: 33736 - DNA, 3759 bp, Artificial Sequence
  Description of Artificial Sequence: Synthetic coding sequence
atgctgtcatggcgactgcaaacaggacctgagaaggccgaactgcaagagctcaacgcacggctttatgactacgtgtgccgtgtgagggagctcgagagagaaaatttgctgttagaagaagagctgagagggcgccgcggcagagagggcctgtgggctgagggccaagcgcgctgcgcggaggaggcaaggagcttgcgccagcagttggatgagctctcctgggccactgctctggccgagggagagcgcgatgccctgcgccgggagctgagggagctccagcgactcgacgccgaggaaagagctgcccgtgggaggctggatgcggagctcggagcccagcaacgagagttgcaggaggctcttggagcacgcgcagcccttgaggccctgttaggtcgattgcaagccgaacgtcgaggattggatgcagcccatgagcgcgatgtgcgcgaacttcgggccagagcagcatctctcacaatgcatttccgcgccagggcaacaggcccagcagcgccccccccgaggctgcgtgaagtgcatgactcatacgctctgctggtcgccgaatcctggcgtgaaactgtccagctctacgaggatgaagtccgcgaactcgaggaagcactcaggcgcggtcaggaaagtcgcctgcaggccgaggaagagactcgactgtgcgcccaggaggccgcattgcgccgggaggcactgggactagagcagctgcgtgcgaggcttgaggacgccctcttgcgcatgcgggaagagtacggcattcaagcggaggagcggcagagggtgatcgattgccttgaggacgaaaaagctacattaacgctggccatggcggattggctcagggattaccaggacctgttgcaggtcaagacaggactaagtctggaggtagccacataccgtgcactcctagagggggagagcaacccggaaattgtgatttgggcagagcacgtagaaaacatgccctcagaatttcgcaataagtcttatcactataccgactccctcttgcagagggagaacgaacgcaatttattttccagacagaaggcccctctagctagcttcaatcacagtagtgccctctactcaaatctctccggccaccggggctctcagactggtacctcaataggtggcgacgcccggcgaggatttctagggagcggatacagcagctccgctacaacccagcaggagaattcgtacggcaaggccgtgagctctcagaccaacgtgagaacattctcgcctacatacgggctcctgcgtaatacggaagctcaggtcaagacctttccagaccgacctaaggcaggcgacacacgggaggtgcctgtttatatcggcgaggatagcaccatcgctcgcgaatcgtatcgtgataggcgcgacaaagtagccgcaggtgcctctgaatccaccaggtccaatgagcggaccgtgatattaggaaagaagacagaggtgaaagccactagggagcaagagcgtaaccgcccagagaccatacggactaagcccgaggagaaaatgtttgacagcaaggaaaaggcatccgaagaacggaacctgcgctgggaggagttaaccaagctggataaggaggcgaggcagcgggagagtcaacagatgaaggaaaaggcaaaagaaaaggattctcccaaggagaagagcgtgagggagagggaggtgccgatctcactagaagtgagccaagatagaagagcggaagtctctccaaagggcctccagacccctgtgaaggatgccggtggtggcaccggccgagaagcagaggcccgagagctccgattcagactgggcacttcagacgctaccggctccctgcaaggagactcgatgacagagaccgtcgctgaaaacatagtcaccagtatcttgaaacaattcactcagagccctgagactgaggccagcgctgacagcttcccagacactaaggtgacttatgtggatcgcaaggagctgccaggcgagcgcaaaaccaagactgaaatcgtggtggaaagcaaactgaccgaagatgttgacgtgagtgacgaagccggcctggactacctgctgtccaaagatattaaagaggtaggcctgaaagggaagtcggccgaacagatgatcggcgatattattaatctaggtctaaaaggtcgcgagggacgagcaaaagtggtgaacgtagagattgtagaggaaccagtgagctacgtcagcggtgagaaacccgaggaattcagcgttcccttcaaggtcgaagaggtggaggacgtatcacccggtccctggggactggtgaaagaagaggagggatatggcgaaagcgacgttacttttagcgtcaatcagcaccggcggactaagcaaccccaggaaaacactacacacgtcgaggaagtcactgaggcaggtgattccgagggggagcaaagctactttgtttctacacctgatgagcaccctggcggtcacgacagggacgatggatccgtctatggccagatacacatagaggaagagagcactatcaggtattcctggcaggatgagattgtgcagggaacaagacgccgcacgcagaaggatggggcagtaggagagaaagtagtaaagcccttggacgtgcctgcccccagcttagagggcgacctcggcagcactcattggaaagaacaggccagatcaggcgagtttcatgccgagcccaccgtgatcgaaaaagagattaagatcccccacgaattccacacctcgatgaaaggtatttcttccaaggaaccgcgccagcaattggtggaagtgatcggccagctggaggagacgctccctgagcggatgcgcgaagagctgtccgccctgacacgagagggccaagggggacccggaagtgtgtctgtagatgtgaaaaaggtgcagggtgccggtggatccagcgtgacccttgtcgcagaagtcaatgtgagccagactgtggacgctgaccggttagaccttgaggagctgtccaaagatgaggcctcagagatggaaaaggctgtagaatcggtcgttagggaatctctctcgcggcagcggtcacccgcacctgggtcccctgacgaagagggcggagcagaggcacctgcagccggaatcaggttccgccgctgggccacgagggagctctacattccatcaggggaatccgaggtggctggaggtgcgtctcacagctcaggacagcgtacaccgcagggcccagtgtctgcgacagtggaagtgtcctctccaactgggtttgcccagagccaggtattggaggatgtgtcacaggctgcaaggcatattaaactggggccctcagaggtttggaggaccgagaggatgtcctatgaaggtcccaccgccgaggtggtggagatggacgttagtaacgtggaggcgattcgctcgaggactcaggaggctggagccttaggggtctcggacagaggctcatggcgtgatgcagacagtagaaacgatcaagctgtgggggtcagcttcaaggcttctgccggagagggggaccaggcccacagggagcaaggaaaggaacaggcgatgttcgataagaaagtccagctccagcgtatggtcgatcagcgctccgtgatctccgatgaaaaaaaggtggctttgctgtatttggacaatgaggaagaagagaacgatgggcattggttctag

SEQ ID NO: 33737 - DNA, 4695 bp, Artificial Sequence
  Description of Artificial Sequence: Synthetic coding sequence
atgttaagctggcgtctgcagacgggacctgaaaaggctgagctccaggagctcaacgcccgcctctacgactacgtctgtcgcgtccgggaacttgaaagagagaaccttctgctggaagaggaactgcggggcaggagaggacgagaaggcctttgggccgaaggacaagctagatgtgccgaggaggcaagatcactgagacagcagctggacgagctatcctgggcaaccgctctggccgagggggagcgagacgcgctgagacgggagctgagagaattgcaacgcctggatgccgaggagcgcgcagcacgaggaaggcttgatgccgagcttggagcacagcagcgggagttacaagaagctctcggggctagagccgctctcgaggccttactgggccgtctacaggccgaacggaggggactcgatgctgcccatgagagagatgtaagagaattgcgggctcgtgcggcgtctcttaccatgcacttcagagcccgcgctacaggtcctgcagctccaccaccgaggctgagagaagtgcacgactcttacgcactgctggtagcggagagctggagggagactgtccagctctatgaggacgaagtgcgtgagctggaggaggcgctgaggcgtgggcaggagagccgcttgcaagctgaggaagagacccgcctgtgtgcacaggaggccgcccttcggcgggaagcccttggcctggagcagcttagagccaggctagaggatgctctgctgcggatgagagaagagtatggcatccaagctgaagagcgtcagcgcgtgattgactgcctcgaggatgagaaagctacactgactctagcaatggccgattggctgcgcgactatcaggaccttcttcaggtaaagactggtctctctcttgaagtggcgacatacagggcgctcctggagggtgaatccaatcctgagattgtgatatgggcagaacacgtggagaatatgccttcagagttcaggaacaagtcgtaccattataccgactccctcctccagagagagaatgaaagaaacttgttcagtagacagaaagcccctctcgcgtcctttaatcacagttcggccctttactcaaatctgagcgggcatcgaggaagccagactggaaccagcatagggggcgatgctcgtcggggttttctgggcagcggctacagcagcagtgccactacacagcaagagaactcgtacggaaaggcagtgagttctcagacaaatgtgcgcactttttccccaacatacggtctactcaggaacaccgaagcccaggtgaagacattccccgaccgccccaaggcaggtgacacacgggaagtcccggtgtacatcggagaggatagtacaatcgcacgcgaatcctacagagatagacgagacaaggtggccgcaggcgcctccgagagcacacggtccaacgagcgcacagtcatcctgggcaaaaagacagaggtgaaagcgaccagggaacaggaacgcaatagacccgagacaataaggaccaaaccagaggagaagatgttcgattctaaggagaaggcgtcagaggaacgcaacctcagatgggaggagttaacaaagctcgataaggaggcaaggcagcgcgaatctcagcaaatgaaagaaaaagctaaggaaaaagacagccccaaggaaaaatccgtgcgcgaacgtgaggtgcccatcagtctggaggtttctcaggaccgtcgggcggaagtaagccccaagggactgcagacccctgtgaaagatgccggtggaggcacgggcagggaagccgaagcaagagagctcagattccgtctgggtactagcgacgctacaggaagcctgcaaggcgattccatgaccgagacggttgccgagaacatagttacttctatcctgaagcagtttacccagtcgcccgagaccgaagctagcgcagactcctttccagacaccaaggtgacctacgtggacagaaaggagctccccggcgaaagaaagacgaagaccgaaattgttgtcgagtctaagctaacagaagacgtagacgtcagtgacgaggccggtctggattacctgctgagtaaagatattaaggaggtgggcctgaagggcaagagcgcagaacagatgatcggcgacattatcaacctgggactgaaagggagagaagggcgcgctaaagttgtgaacgtagagatcgtcgaagagccagtgtcgtatgtaagcggcgaaaagcccgaagagttttcagtcccctttaaggtagaagaagttgaggacgtgagtcccggcccatggggtttggttaaggaggaagagggctatggtgaaagcgacgtgaccttttccgtgaatcagcaccggagaaccaagcaaccccaagaaaatactacccacgtagaggaggtgaccgaggccggggattccgaaggtgagcagtcatacttcgtttccactcctgacgaacaccccggcggccacgatagggatgatggttctgtatacggtcagattcatatcgaggaggaatctacgatcaggtatagttggcaggacgaaatagtgcaggggacccgccggagaacacaaaaagatggggcagttggagagaaggtagttaaaccactggacgttccagcacctagcctggagggcgacctgggatccacacactggaaggagcaagctcggagtggtgaattccatgcggaacctactgtgattgaaaaagaaatcaagattccacacgagtttcacactagcatgaaaggcatcagctctaaggaaccacggcagcagttagtcgaggttatcggccagcttgaggaaaccctgcccgaacggatgcgcgaggagctgagcgctcttaccagggagggccagggtggtcctggtagtgtttcagtggatgtgaaaaaggtgcagggcgcaggcggatcgtctgttaccctcgttgccgaagttaatgtgagccagacagtggatgccgatcggctggacctcgaagaactgagtaaagatgaggcctccgaaatggaaaaagccgtggagtccgttgtccgggagtccctgtcaagacagcggagccctgctccaggaagtccggacgaggaaggaggggccgaagctccggctgcaggaattaggttccggagatgggctacccgcgagctgtatatccctagcggtgaatccgaagtcgcagggggcgcttcccacagcagcggacagagaactccgcaggggcccgttagcgcgacggtggaagtgtcctccccaacgggattcgctcaatctcaggtgctggaggacgtaagtcaggcggcacgacacataaagttgggccctagcgaggtttggcgaacggaaaggatgagttatgaaggcccaactgccgaggtagttgaggtgtccgcaggcggcgacctctctcaggctgcttcacccacaggggctagcaggtcagtgagacacgtcaccctcggacccggccagagccccctgtcccgagaggtgatatttctgggtccagcgccagcatgccccgaggcatgggggagtccagagccaggaccagctgaaagctcggctgatatggatgggagtgggcggcacagtacattcggctgtcgccagtttcacgcagagaaggagattatctttcagggacctatctctgccgcaggaaaggtgggtgactatttcgcgaccgaagaatccgtggggacccagacatctgttagacagctccaactcggaccaaaggaaggcttcagcggccagatccaattcactgcgcctttgagcgataaggttgagctgggagttatcggcgattctgttcacatggaggggctgcccggcagcagcaccagtattcggcatatttctattggcccacagagacatcagacgacccagcagattgtgtaccatgggctggtgccccagcttggggagtccggggactctgagtctaccgtgcacggcgagggcagtgccgacgtccaccaagcaacacattcacatactagcggtcgtcagaccgtgatgacagagaagagcaccttccagtccgtggtgagcgaatcaccccaggaagacagcgcggaggatacttctggagccgagatgaccagcggggtgagccgtagctttaggcacattaggctgggtcctaccgaaacagaaacttcagagcatatcgccattcgcggccccgtgagtcggacatttgttctcgcagggtccgcagactcgccggagctgggtaagctggcagattccagtcggacgctccgtcatattgcccctggccctaaagaaacgtcattcaccttccagatggacgtctccaacgttgaggcaataaggagtagaacccaggaggcaggcgcactcggggtttccgaccgcggatcatggcgggacgccgactcccggaatgatcaggctgtcggagtttcatttaaggcgtcggctggggagggcgatcaagcccacagggagcaaggtaaggaacaggctatgtttgacaaaaaggtgcagctgcagagaatggtggatcagagatctgttatttcagacgaaaagaaagtggccctgctttacctggataatgaggaagaggaaaacgatgggcactggttctag

SEQ ID NO: 33738 - DNA, 567 bp, Artificial Sequence
  Description of Artificial Sequence: Synthetic coding sequence
atgaatggtgatgacgcattcgtccgccgcccccgggtggggtcccagatccctgaaaagatgcagaaggcgttcgatgatatcgccaaatacttctccgagaaagaatgggagaaaatgaaggctagcgagaagatcatctatgtttacatgaagaggaaatacgaggccatgactaaactgggattcaaagccacactaccaccattcatgcggaacaaacgggtcgcagacttccaaggcaatgatttcgataacgatcccaaccgaggtaaccaggttgagcacccacagatgacattcggtaggcttcagggtattttccccaagatcacaccagagaagcccgccgaagaagggaacgactctaagggggtgccggaggccagtggtcctcagaataatggcaaacagctcaggccatctggcaaacttaatacttccgagaaggtgaataaaacctccggtcccaaacgggggaagcacgcgtggacacatcgcgtgagggaacggaaacagctcgtcatctatgaagagataagtgatcctcaagaggacgatgaatag

SEQ ID NO: 33739 - DNA, 885 bp, Artificial Sequence
  Description of Artificial Sequence: Synthetic coding sequence
atgaaggataggctgcaggaactgaagcagaggacaaaggagattgaactgagtcgcgacagtcacgtatctaccaccgaaaccgaagagcagggggtcttcctacaacaagccgtgatttacgagcgtgagcctgtggctgaaaggcacttacacgaaatacagaaacttcaggaatctattaataatctggccgataacgtgcagaaatttggtcagcagcaaaagagcctagtggccagcatgcgacggttttctttgttaaagagggaatcaaccattacaaaggagattaagatccaggccgaatacatcaaccggagcctgaatgacctcgtgaaagaagtgaaaaagtccgaggtcgaaaacggtccatcttccgtggttactagaatccttaaatcccaacacgcggccatgtttcgccactttcagcaaatcatgtttatatacaacgatactatagcggcaaaacaggagaagtgcaaaacctttattctgcgacagttagaagtcgctggcaaagagatgagcgaggaggatgtgaacgacatgctgcatcaagggaagtgggaggtgttcaatgaaagtcttttaacagaaataaatataactaaagctcagttgtccgaaatcgaacaaaggcataaagagctggttaatctggagaaccagattaaggacttacgggacctcttcatacaaatctctctcctggtcgaggaacagggcgagagtatcaacaatattgaaatgactgtaaatagcacgaaggaatatgtgaataatactaaagaaaaattcggactcgccgtgaaatacaagaagcgcaacccttgtagagtgctgtgttgttggtgttgtccttgctgcagtagcaagtag

SEQ ID NO: 33740 - DNA, 393 bp, Artificial Sequence
  Description of Artificial Sequence: Synthetic coding sequence
atggaaactgtggttaccacacttccaagggagggcggagtcgggcctagtcgcaagatgctcctcctgttattgctgctggggccgggatcaggcctgtcagctgtggtcagccagcatccaagtagggtgatctgtaagtctggcacaagtgtaaacatcgagtgtcgatcacttgattttcaggctacaaccatgttctggtataggcagcttcgtaaacagtctctgatgctgatggccaccagtaatgaaggaagcgaggttacttacgagcagggagtcaaaaaagacaagtttcccatcaatcaccctaatttaacattttctgccttgaccgttacttccgcgcaccccgaggattcaagcttttatatatgttccgctcggtag

SEQ ID NO: 33741 - DNA, 345 bp, Artificial Sequence
  Description of Artificial Sequence: Synthetic coding sequence
acgggcacacggttgctcgggtgggtagctctgtgcctccttgccgcaggctgctttcacgctaaagttacccaaacaccaggatacctggtgaagggcaagggaagaaagactaagatgtactgtacccccaagaatggccatacttttgtgtgctggtatcagcagaatcagaataaagagtttatgttcctcatcagtttccagaacgagcaggttctacaggaaatggaaatgcacaagaagcgcttcagttctcagtgcccaaagaacccgccttgttccctggccatattgagctctgagcccggcgacaccgcactgtacctgtgtgcaacgtcatag

SEQ ID NO: 33742 - DNA, 339 bp, Artificial Sequence
  Description of Artificial Sequence: Synthetic coding sequence
atgacaatccgatttttacgccaggtggcattctatttcctcgaagcaggtctcaaggaagccgagatctaccagaccccccgccatagagttatcggggcagggaagaaaattacactggagtgcagtcagacaatgggacatgataaaatgtattggtctaggtcaagaaacggaatcacaccgcaccccccttttctgtgggtaaacagcaccgaaaaaggagatttgtgcagcgaatctacagtttcaaggatccgcatagaaagattcccgctcactctggagtcggcaagtccttcccacacaagccagtatctatgcgccagctccgaatag

SEQ ID NO: 33743 - DNA, 525 bp, Artificial Sequence
  Description of Artificial Sequence: Synthetic coding sequence
atggcggatgctgccgcaacagcgggcgcgggcgggtccggaactcgctcaggaagcaaacagtccacaaaccccgcagataactatcacctcgccagacgaagaaccttgcaggtcgtggtcagctcactcctgaccgaggccgggttcgagagcgctgagaaggcatcagtcgagactttaaccgaaatgctccagagttatataagtgagattgggcgcagtgcaaagtcatattgcgaacacacagcccgaacacagcccaccttgagtgacattgtggtgacactcgtggagatgggttttaacgtggacacactacccgcctatgccaaaagaagccagcggatggttatcaccgctcccccggttaccaatcagccggtgactcccaaagctctgactgctggacaaaaccggcctcatccaccacacatccccagccactttccggaattcccggatcctcacacttacatcaaaactcctgtctctgacgaggcccttggactgagagttgtttag

SEQ ID NO: 33744 - DNA, 1017 bp, Artificial Sequence
  Description of Artificial Sequence: Synthetic coding sequence
atggccgatgccgccgcaacggctggcgccggcgggtcaggtactcggtctggatcaaaacagagtaccaaccccgcggacaactatcacctggcgcggagacggaccctccaggttgtggtgtcctctctgctcaccgaagcaggattcgagagcgccgagaaagcgagcgtagagactctgactgagatgttgcagagctatatttcggagataggtagatccgccaagtcatattgcgaacatacagcccgaacccagcctaccctctctgatattgtggtaacactggtggaaatgggatttaacgtggacacgctgccagcctacgccaaaagatctcagcggatggtgattactgctcccccggtcacaaaccaaccagtgacgcccaaggcacttaccgcgggccaaaacaggccccatcctccgcacatccccagtcattttcccgaattcccagatccccatacatatataaaaacgcctacctacagagaaccggtatcagattatcaggtcctccgggaaaaagccgctagtcaacgacgcgacgttgaacgcgcactcacgcgttttatggccaaaaccggtgagacacaaagtctgtttaaggacgacgtgtccacctttccactgattgcagcgcgtccctttaccatcccctacttgacagccctcttgccaagcgaactggaaatgcaacagatggaggagaccgatagtagcgaacaagatgaacagacggatactgagaatctggccctgcatatctccatgatcgaatctcggagtgttacgcaagccggggttcagtggcaggatctgggcagcctgcaaccgccaccccccggattcaagaggttctctagtctgagtctgttgagcagctggaactaccgtagaatccttgagccccgcaggcgcactccgctgtcctgtagtaggactccgccctgtcgtgtcgcggggatgggcagacgtacatctagcataacattgatctgcggaagatag

SEQ ID NO: 33745 - DNA, 936 bp, Artificial Sequence
  Description of Artificial Sequence: Synthetic coding sequence
atggccgacgcagccgcaacagcaggagccggagggagcgggactagaagcgggtcgaagcagagtaccaacccagcggacaattaccacctagctagacgcagaacacttcaggtggtggtaagtagcctgctcacagaggcgggctttgagtcggcggagaaggcgagtgtagaaaccttgaccgagatgctgcagtcctacatcagcgagattggccggtccgcaaaaagttattgtgagcacactgcacgtactcaacccacactatcagatatagttgtaaccctcgtcgagatgggctttaatgttgacacccttcctgcgtatgccaaacgctcccagagaatggtaatcacagccccacccgttactaaccagccagtgacaccgaaagccctgacagcagggcagaacagaccacaccctccccatatcccgtctcacttccccgaattccccgatccccacacctacatcaagacacccacctaccgggaaccagttagtgactatcaggtcctgcgggagaaagccgcaagccaaaggagggacgttgaaagagcactgacgcgctttatggcaaaaaccggagaaacccagtcgttgttcaaagatgatgtgtctactttcccactgattgccgctcgccctttcactatcccctacttaacagcactcctaccgagcgagttggagatgcagcagatggaggagaccgacagttcagaacaagatgaacagacagacacagaaaatttggccctccacatttccatggaggattcgggagctgagaaggagaatacaagcgtgctacagcaaaatccctccctgagtgggagtaggaatggggaggagaacataatagacaatccctatctgcgccctgtgaagaaacctaagatacgtaggaagaagccagacacattctag

SEQ ID NO: 33746 - DNA, 1017 bp, Artificial Sequence
  Description of Artificial Sequence: Synthetic coding sequence
atggccgacgccgcagccaccgctggcgccggtgggtcaggcacacgctcagggagtaagcaaagcacaaaccctgccgacaactatcacctcgcccgcaggagaacgctgcaggtcgttgtcagctcactgttgactgaggctggatttgagtcagcggaaaaagcatctgtggagactctaaccgagatgctgcagtcgtatattagcgagatcggcagatccgcaaagtcctattgcgaacacactgctcggacacagccaactctcagcgacatcgtggtaaccctcgtagagatgggattcaacgtcgacacgctccctgcctacgcaaagaggagtcaacggatggtaatcaccgcaccccctgtgactaatcagcctgttacacctaaggcgttgacagcagggcaaaacagacctcatcctccacatatcccaagtcacttccctgaatttcctgatccccacacctacattaagacacctacttaccgggagcccgtgtcagactatcaggtcctgcgagagaaagccgccagtcagcgtagggacgtggaaagagctctgactcggtttatggccaaaacaggcgagactcagtcccttttcaaagacgacgtgagtacttttcctctgattgcagctcgcccatttaccattccctatctgactgctcttttacctagtgagctagaaatgcaacaaatggaggaaactgattccagtgaacaggatgaacaaactgatacagagaacctggcactgcatataagcatgattgagtcaagaagcgtgacccaggctggagtacagtggcaagatcttgggtctctccaacctccaccacccggtttcaaaaggttcagctctctgtctctgctgtccagctggaactatcgccgcatcctggagccaaggcggcggactcccctgtcgtgctctcgcactccaccctgtcgcgtagctggaatgggccgtagaactagtagcattaccctgatttgtggtagatag

SEQ ID NO: 33747 - DNA, 795 bp, Artificial Sequence
  Description of Artificial Sequence: Synthetic coding sequence
atggaatctgggaaaaccgcttctccaaagagtatgcctaaggatgcccagatgatggcccagatcctcaaggatatggggatcacggagtacgagccccgggtgatcaaccaaatgttggagttcgcgttccggtacgtcacaaccattctggatgacgctaaaatctacagctcccatgcaaagaaggcgactgttgacgctgatgacgtgcgcctagcaatccaatgtcgagcggaccaaagtttcacaagccctccaccgcgggattttctgctagacatcgctcgtcagaggaaccaaacccccttgcctcttatcaagccctactccggccccagactacctcctgaccgttactgcctgaccgcacccaactaccggctgaagtctttgcagaagaaagcaagtacgagcgccgggagaatcaccgtaccaagattgtccgttggatccgtcactagtcgcccttcaacgccgacccttggaacccctactcctcagaccatgtctgtcagcactaaagttggaacacctatgtccctgaccggtcaaagattcacagtacagatgcccacctcacagagccctgctgttaaggctagtatcccagcaacgtcagcggtgcagaacgtgctcatcaaccctagcctcatcggctctaaaaacatcctgatcaccaccaatatgatgtcatcacagaacactgcaaatgaatcctctaacgctctgaaaaggaaacgggaggacgacgacgacgatgatgacgacgatgatgactatgacaatctgtag

SEQ ID NO: 33748 - DNA, 1374 bp, Artificial Sequence
  Description of Artificial Sequence: Synthetic coding sequence
atggaattcctcctgggcaatcccttctctactcctgtgggccagtgcttagaaaaggctacggatggatccctgcaatctgaagattggaccttgaacatggaaatttgtgacattattaacgagactgaggagggcccaaaggacgcaattcgtgcactaaaaaagcggctgaacggaaacaggaattacagggaggttatgttggcgttgacagcctgggccgacgccttcagatcttcgccagacttaacaggagtggtacacatatatgaggaattaaagcggaagggggtggaattccctatggctgacctggacgcactcagtccaatccacaccccacagagatccgtgccagaggtggatccagccgccaccatgccgagatcccagtcgcagcaaaggacgagcgccggcagctattccagcccaccacccgcaccatactcggccccccaggcccctgcactttctgtgaccggtccaattactgctaatagcgagcagatagctcggctgcgctctgaactggacgtcgtaagaggcaatacaaaagtgatgagcgagatgctcactgagatggtccctggccaggaggatagcagcgatctggagctcctgcaagagctgaatagaacctgtcgcgccatgcaacagcgaatcgtggagctgataagcagggtgtcaaacgaggaggtgacagaagagctgctgcatgtgaacgacgatcttaataacgtgtttcttagatatgaaaggttcgaacggtaccgaagcggacgaagtgtccagaatgcctccaatggggtactgaacgaagtgacagaggataatctgatcgacctcgggcctggctcgcctgcggtggttagtcctatggtgggaaatacagcgcctcctagctctctgtctagccagctagcaggcttggatttaggcaccgagtctgtctcaggaacccttagttccctgcaacagtgtaaccctcgcgatggcttcgatatgtttgctcagaccaggggtaattctctggccgaacagaggaagaccgtgacgtacgaagacccacaggctgtgggggggctggcttctgccttggataacaggaagcagagttctgaagggatccccgtcgcccagccaagcgtgatggacgatatagaagtgtggctgaggacggatctgaagggcgacgacctggaggagggggttacatctgaagagtttgacaaattcctggaggaacgagccaaagccgccgagatggtgccagacctccctagcccgcccatggaggcacctgcgcctgccagcaatcctagtggcagaaaaaaacctgaacgcagcgaggacgccctgttcgctctgtag

SEQ ID NO: 33749 - DNA, 1524 bp, Artificial Sequence
  Description of Artificial Sequence: Synthetic coding sequence
atggaatttctcctgggaaacccattctctactcctgtagggcagtgcctcgagaaagcgacggatggaagcttgcagtcggaggattggacactgaacatggaaatttgtgacataatcaacgaaacagaagagggccccaaagacgccatccgggcgctgaagaaaaggctaaacggaaataggaactatcgggaagtaatgttggctctgacagtactcgaaacatgcgtgaaaaattgcggccataggtttcacatcttggtggctaaccgagacttcatcgactctgtgctcgtgaagatcatcagtcccaagaacaaccctcctaccattgtgcaggacaaagtgctggctctcatccaggcatgggccgatgcttttcgctcatcccctgacctcaccggggtggtacacatttatgaggaactgaagcgcaagggcgtggagtttcctatggccgacttagacgccctgagcccaatccacaccccacagcgttctgtaccggaggttgatccagctgcaacgatgccccggtcgcaatcccagcaacgtacgtcagccggctcctattcttcacccccacccgcaccctacagtgctcctcaggcaccagctctgtccgttacggggcccatcaccgcgaattcagagcagatcgcccgccttagatcggagctagatgtagtgagaggcaacacgaaagttatgagtgagatgctcaccgagatggtacctggccaggaggattccagtgatctggagctcctccaggagctcaaccggacctgcagagctatgcagcagcggatcgtggaacttatctcccgagtgtccaatgaggaggtgacagaagaactgttgcatgtgaacgacgacctcaataatgttttcctcagatatgagcgatttgagcgatacaggtcagggaggtccgtacagaatgcttccaacggagtactgaatgaggtgacagaagataacctgattgatctcgggccaggctcacccgctgttgtctctccaatggtgggaaacacagcgccccctagcagtctttcttcacagctggccgggctcgaccttggcacagagagcgtcagcggcaccttatcctccctgcagcagtgcaacccgagggacggattcgatatgttcgcacagacgagagggaattctctagctgagcagcgcaagacagtcacctatgaagatccacaggccgtgggcggcctggcatcggccctcgataatagaaaacagtcctcagaagggatacccgtcgctcagccttctgttatggatgatatagaggtgtggctgcgtacggacctgaaaggcgatgatttagaagaaggtgtgacatccgaggaattcgacaagttcctggaggaacgggcgaaagcggcggagatggtgccggacctgccttcacctccaatggaagccccagcacccgcctcgaaccccagcggcaggaagaaacctgaaaggagcgaggatgctctgtttgcattgtag

SEQ ID NO: 33750 - DNA, 1389 bp, Artificial Sequence
  Description of Artificial Sequence: Synthetic coding sequence
atggagtttctgctgggcaaccctttctcgacccctgtgggacaatgcctcgagaaagccacagatggttctcttcagtccgaggattggacgctgaatatggagatctgcgatataatcaatgagacagaggaaggtcccaaggacgccatcagagccctgaagaaaagattaaacggcaaccgaaactatcgggaggtgatgctggctctgacggtgcttgaaacatgcgtaaagaactgcggtcaccgttttcacatcctggttgccaatcgagattttatcgactcagtcctggttaaaataatcagcccgaaaaataacccccccaccatagtgcaggataaagttctggcactgatccaatctgtgccagaggttgatcctgccgcaaccatgcctcgctcccagtctcagcagcgaacgtccgccggttcctactcttctccacctcctgccccttactcagctccacaggctcctgctctatcggtaacaggcccgattactgccaactccgaacagatcgcgcgactgagatccgagctcgatgtggttcggggcaacaccaaagttatgagtgaaatgcttacagagatggttcctgggcaggaggactcaagtgacctggaactgctgcaggagctcaacaggacatgcagagccatgcagcaacggatcgtggaattgatcagtagagtgtccaacgaagaggtgaccgaggagctccttcacgtgaacgatgatctgaataatgtgttcctccggtacgaacggttcgaaaggtatcgttctggcagatctgtccagaatgcctctaacggagttcttaatgaagtgaccgaggacaatctaatcgacctaggcccaggctctccagcagtggtgtctcctatggtgggcaacaccgccccccccagcagcctgagttctcagctggctggtttggatctggggaccgagagcgtttctggcactttgtcaagtctgcagcagtgcaatcctcgggacggcttcgatatgtttgctcagaccagaggaaatagcttagcggagcaacgcaaaactgtgacatacgaggatccacaggcagtcggcggactggcatccgcactggataaccgtaaacaaagttctgaaggaatccctgtggctcaacctagcgtgatggatgacatcgaagtctggttaagaactgatctgaagggggacgacttggaggagggggtgacatcagaggagttcgataagttcctcgaagagagggccaaagccgccgaaatggtgccggaccttccatcccctcccatggaagcacccgcccccgccagcaatccctcaggacggaagaagcctgagcggtcagaggatgcgctgttcgcactttag

SEQ ID NO: 33751 - DNA, 1452 bp, Artificial Sequence
  Description of Artificial Sequence: Synthetic coding sequence
atggaatttctgctgggaaaccccttttctaccccggtcggacagtgtcttgagaaagccaccgatggctctttgcagagcgaggactggacgttgaatatggagatttgcgacattatcaacgagaccgaggaggggcctaaagatgcaatcagggccttgaagaagcggctgaacggcaatagaaattacagagaagtgatgctggctctgaccgtgctggaaacctgcgtgaagaactgcggccatcgcttccacatccttgtcgcgaatcgcgattttatcgactctgtactggtgaaaatcatcagccctaagaacaatccacccactattgtacaggataaggtgttggctttaatccaggcgtgggccgacgctttcagaagcagtccggatctaaccggggtcgtccacatttatgaggagctgaagcgaaaaggagttgagttcccaatggcggacctggacgcactgtctcctatccataccccgcagagaattgcgagacttaggtccgagctggacgtcgtgagaggaaacacaaaggtgatgagtgagatgctcaccgagatggtcccaggccaggaggactcaagtgatctggagcttttacaagaactcaacaggacatgccgcgccatgcagcagcgcatcgtggagctgataagtcgagtgagtaacgaagaagtgaccgaggaattgttacacgtgaatgatgatcttaataacgtatttctgcggtacgaacgctttgagcgatacaggtcaggtcgaagtgtacaaaatgcctccaacggagtgctgaacgaggttaccgaagataatctgattgatctcggtcctggctctcccgccgtagtgagccccatggttggaaataccgcacccccctccagtctcagctctcaactagcgggtctcgacctgggaacagagtctgttagcgggacactgtccagtttgcaacagtgcaatcccagagacggtttcgatatgttcgctcagacccgcgggaactccctggccgagcaacggaagactgtgacttatgaggacccccaagcagttggagggttggctagtgcattggataatcgaaagcagtcatctgaagggacctttctatcctctgctcagaagcgtggcaggggcggagaaagcgatctcgaaccaatcgattcttggctcattacccagggcatgattcctgtagcacagccatccgtcatggacgacatcgaagtgtggctgcgtaccgacctgaaaggagatgatttagaagagggggtcaccagcgaagaatttgataagttcctggaggagcgggcaaaggcagctgagatggtgcctgacttacccagcccaccgatggaagcacctgcacctgcctctaatccatcaggccggaaaaaacctgaacggagtgaggacgcattgttcgcactgtag

SEQ ID NO: 33752 - DNA, 834 bp, Artificial Sequence
  Description of Artificial Sequence: Synthetic coding sequence
atggagtttctgctgggcaacccttttagcacacccgtcggacagtgtctcgaaaaggctaccgacgggtccctccagagcgaggattggacactgaacatggagatctgcgatatcatcaatgagaccgaggaagggccaaaagatgccattagagctttgaagaaacggctgaatggcaatagaaactatcgtgaggtgatgctggcgctgaccgcatgggccgatgcttttcgctcttcccctgatttgactggggtagtgcacatatatgaggagcttaagcgcaagggcgtcgaatttcctatggcagatttggatgcgttatctcctatacacactcctcagcggtctgttccggaggtagaccctgccgccaccatgccccggagtcagagccaacagcgcacttcagccggttcttattcttcacctccgcctgcaccatattctgctccacaggcaccagccttgtccgtaacagggcccatcactgcgaactccgaacagatcgctagattgcgaagcgagttagatgttgtgaggggcaacaccaaggtcatgtctgaaatgttaacagaaatggtgcccggccaggaggattccagtgacctcgaattgttgcaggagctgaaccggacttgccgggccatgcagcagcgtattgtggaacttatcagcagagtttccaatgaggaagtcacagaggagttgctgcacgttaacgacgacctgaacaacgtgttccttaggtacgaaaggtgggagcccgactttttctttttcttctttctggagaagattgttgctattactgaggggttcctgtcctag

SEQ ID NO: 33753 - DNA, 1170 bp, Artificial Sequence
  Description of Artificial Sequence: Synthetic coding sequence
atggaattcttgctggggaatccttttagtacccctgtaggacagtgcctggaaaaggccacagatgggtccctccagagcgaggactggaccctcaacatggaaatttgtgatatcattaatgagaccgaagaaggccctaaagacgctattagggcccttaaaaaacggctcaatggcaaccgcaattacagagaggttatgctcgcacttaccgtgcttgaaacctgtgtaaagaactgtggccacagatttcacattctggttgcaaatagggactttatagactcagtgctggtcaagattatctctcccaaaaataacccccctaccatcgttcaagataaagtgctcgcacttatccaaatcgcgaggctgcggtctgaattggacgtggtgcgcggaaacaccaaggtcatgtccgagatgctgaccgaaatggtcccaggccaggaagattcgtccgatcttgagcttttgcaggagctcaacagaacctgtcgcgccatgcaacagcgaatcgtagagctgatttcacgggtgagcaacgaggaagtcactgaggagctgctgcacgtgaacgatgatcttaacaatgtgtttttacggtacgaacgcttcgagcgctaccgatccggtcgttctgtgcagaacgccagcaatggggtgctgaacgaagttacggaggacaacctcattgatctgggcccaggctcccctgccgtcgtgtcaccaatggtgggaaatactgccccaccctcctcgctttcctcccagctcgcaggcttggacctgggaaccgagagcgtttctggaactctttcttccctccaacagtgcaacccaagggatggcttcgacatgttcgctcaaactcgagggaacagtctcgccgagcagcggaaaactgtgacctatgaggacccacaagccgtaggcggactggcctccgcgctggacaatagaaaacagtcctccgagggaaagggcgacgatttggaggagggagtcacctccgaagaatttgataaattcttagaagagagagccaaggcagctgaaatggtccctgatctgccctccccccccatggaggcacccgcgcctgcgagtaatccgtcaggacggaagaagcccgagcgcagcgaagacgccttgttcgctctctag

SEQ ID NO: 33754 - DNA, 1167 bp, Artificial Sequence
  Description of Artificial Sequence: Synthetic coding sequence
atggagtttttgctgggaaatccttttagcacaccagtgggccagtgcctggagaaagccacggacggtagcctgcaaagtgaagattggactctcaacatggaaatctgtgatatcataaatgaaactgaagaaggccccaaagatgcaatccgggccctgaagaaacgactcaatggtaatagaaactatagggaggtgatgctagccctgaccatcgccaggttaagatcagagctggatgtggtcagggggaacacaaaggttatgtccgagatgctcacagagatggtcccaggtcaggaggattcctcggatttggagcttcttcaggagctaaataggacatgtcgggcaatgcagcagagaatagtggaactgatttcacgagtgagtaacgaagaggtgaccgaagagttactccacgtgaacgacgatctgaataatgtgttcctgaggtatgaacggttcgagaggtatcgatctggtcgctctgtccagaacgcctcaaacggcgtgcttaacgaggtgacagaggataacctgatcgatttggggccaggaagtccagcagtggtgtcacccatggttggaaataccgccccgccgtcctccctatcctcccagctggcagggttggaccttgggactgagagcgtttccggcactctctcaagcctgcagcaatgtaaccctagagatggttttgacatgttcgctcagacacggggcaattcgctcgccgaacagcgtaagacagtgacatatgaggacccccaggccgtgggaggattagcaagcgcactggacaacaggaaacaatcttcggagggcactttcctgtcttccgctcagaagcggggacgcggcggcgaaagcgatctcgagccaattgactcctggctgattacccaagggatgatcccagtggcccagccaagcgttatggatgacatcgaggtgtggcttcgtaccgacctaaaaggtgatgatctggaagagggcgttacttccgaagaatttgacaagtttctggaggagcgtgccaaggccgcggagatggttccagaccttcctagcccacccatggaagccccagctcctgcatctaatccttcgggacgtaagaagccggaacgtagtgaagatgccctcttcgctctatag

SEQ ID NO: 33755 - DNA, 1374 bp, Artificial Sequence
  Description of Artificial Sequence: Synthetic coding sequence
atggagtttttactgggaaaccctttcagtacacccgtggggcaatgcctggagaaggccactgatgggtcactccagagcgaggactggacattgaacatggagatatgtgacattattaacgagaccgaagaggggccaaaggacgcgatacgagccctgaagaaaagactcaacggaaaccgtaactatcgagaggtgatgcttgccttgacagcatgggcagatgcctttaggagctctccagacctgacaggcgtagtgcacatctacgaagaattaaagcggaaaggggtggagtttccaatggccgacctcgatgccctgtctcccattcacacacctcagcgctcagtaccagaagtcgaccccgccgccacgatgccaagaagccaatcacaacagcgcaccagcgccgggagctactcctcccctccccctgccccgtatagcgctccccaggcccccgccctgagcgtgaccggaccaataaccgctaactcagaacagattgcgcggctccgctccgagctagacgtggtaagaggtaatactaaagttatgtctgagatgttgactgagatggtgcccgggcaggaggactccagtgacctcgagctgttacaagaactgaataggacatgcagagccatgcagcaaaggatcgtagagctgatctcccgagtctctaacgaggaggtgacagaagagcttctccatgtaaacgacgatcttaacaacgtgtttttgcggtatgaaaggtttgagaggtaccgtagtggacggtctgtccagaatgcatcaaacggggttttgaatgaggtgactgaggacaatctgattgatctgggaccgggatccccagcagtcgtgtcaccaatggttggaaacactgccccaccctcttccctgtcaagccagctggccggactggatcttgggacggaaagtgttagcggaaccctgagttcactgcagcagtgcaacccgcgggatggattcgacatgtttgcacagacccggggtaatagcctggctgaacagcggaaaacggtaacatacgaggacccacaggccgtcgggggtctggccagcgccctggacaatcgtaagcagtcttccgagggcattcctgttgcccaaccctcagttatggacgacattgaggtgtggcttcgaaccgacttgaagggggatgaccttgaagagggtgtaacatctgaagaattcgacaaatttctggaggaacgggccaaggctgctgaaatggtgcccgatttaccctctcctcctatggaagcccccgcgcccgcgtcaaatcccagtggtcgaaagaaacccgaacggtcagaagatgctcttttcgccctctag

SEQ ID NO: 33756 - DNA, 2571 bp, Artificial Sequence
  Description of Artificial Sequence: Synthetic coding sequence
tagtgcacgaatgaagctttggtcgacgaaattatgatgaccctgaagcaggccttcacagtggcggcagtgcagcaaactgcgaaagcacccgcccaactctgtgagggctgtcccttacagtccttgcacaagctttgcgagaggattgaaggtatgaactccagcaaaaccaagctggaactgcagaagcatctcaccaccctgacaaaccaggagcaggccacaatttttgaagaagtccagaaactgcggccaagaaacgagcagcgcgaaaacgagcttatcatcagcttcttgaggtgtctatatgaggagaaacagaaagagcacatacatattggcgagatgaagcaaacatcccagatggcggctgagaatattggatccgaactacccccttccgctacgagattcaggctggacatgctaaaaaataaagctaagaggagcctgactgaatctctggagtccatcctgtctaggggaaataaagccagaggacttcaagagcatagcattagcgtcgaccttgactctagtctttcgtcaaccctgtccaacacaagcaaagaaccaagtgtatgcgagaaggaagccttgcctatctccgaatcatcgtttaagctcctgggcagcagtgaagacttgagctctgactctgaatcccaccttcccgaagagcctgcacccctgtccccacagcaggccttccgtcggagggcgaacacactatctcactttccaatagagtgccaggaaccgccccagcctgccaggggatccccaggcgtgtcccaaagaaaattgatgaggtatcactcagtgtctacagaaacaccccacgaacgaaatataagctacaggaacgctctcaggaaaaaactccattcttcaagctctgttcctaacttcctgaagtttttggcccccgtcgacgagaacaacactagcgacttcatgaatactaagcgcgattttgagagcaaagcgaatcacttaggagactctggcggaaccccagtcaaaacacgaagacactcctggcgccaacagattttcctgagggtagccactcctcagaaggcctgtgactcctccagtaggtatgaagattacagcgagctcggcgaactgccaccgcggagtccgctggagccagtctgcgaagacggcccgtttgggccccctcccgaagaaaagaaaagaacatctagagaactgcgagagttatggcagaaggccattctgcaacagattctactattaagaatggagaaggagaatcaaaagctacaggccagcgagaatgatctcctgaataaaagactgaaactggattacgaggaaatcaccccttgcctgaaagaggtcactactgtctgggagaagatgctgagcacgcccggaagaagcaagattaaattcgatatggaaaagatgcactcagccgtggggcagggggtgcctagacatcatcgcggcgagatctggaagttccttgctgagcagttccacctcaagcatcagttcccctccaagcagcagcctaaggatgtgccgtataaggaactcctgaaacaactcacctcacagcagcatgccattcttattgatctgggtcgaacatttcctacacatccttacttctcagcacaactaggcgctggacagctatcgctgtacaacattcttaaggcatactccttgctggaccaagaggtgggctattgtcagggtcttagcttcgtggcgggcattctcctgctgcatatgtccgaggaagaggcatttaagatgttgaagttcctaatgttcgacatggggcttaggaagcagtaccgtccagacatgatcatactccaaatccagatgtatcagttgtctcggctgctccatgactaccatcgggatctgtataatcacttggaagaacatgagatcggaccgtctctatacgccgccccatggtttctcacgatgtttgcctcacagttcccgctcgggtttgtggctcgggtgttcgacatgatttttctgcagggtaccgaagttatcttcaaggtggccctctcacttttaggcagccacaagccccttattctgcagcatgagaatttagagacaattgtggacttcattaaaagcacgctcccgaacttggggctagttcagatggagaagacaatcaatcaagtctttgaaatggatatcgccaaacagctccaagcttacgaagtcgagtaccacgtcctgcaagaagagttgatagacagtagccccctgtccgataaccaacgtatggataagctggaaaagactaactcctcacttcgcaagcagaacctcgatctgctggagcagctacaggtggccaacggccgcatccagtcgttggaagctacgatcgaaaagctgctcagcagcgagtcaaaactcaaacaggcaatgctaacgttagaactggaaaggtctgcccttctgcaaaccgtggaggaactacgcagaagatccgcagaacccagcgacagagaacccgagtgtacacagccggaaccaacgggcgactag

SEQ ID NO: 33757 - DNA, 2682 bp, Artificial Sequence
  Description of Artificial Sequence: Synthetic coding sequence
atgttcccactgaaggacgccgagatgggcgcctttaccttttttgcctctgctctcccccatgacgtgtgtgggtcaaatggcttaccactcacacccaacagcattaagattctcggtcggtttcagattctgaagactattactcatccgcggctctgtcaatatgtggatatttcaaggggcaagcatgaacggctggtggtggtggcagaacactgtgaacggagtttagaggatctgttgcgggagcgaaagccagtgagctgttccacagtgctgtgcatagcgttcgaggtccttcagggcttgcagtacatgaacaaacatggcatcgtccacagggccctcagtcctcataatatcctcctggataggaagggccacataaaactagcaaaatttggtctctatcatatgactgcgcacggcgacgatgttgattttccaataggctacccttcataccttgcgcccgaggtaatcgcacaggggatctttaagaccactgatcacatgccttccaagaaacccctgccaagtggacctaagtctgacgtatggagcctaggcatcattttgtttgagctttgtgtgggcagaaagctgtttcagtcattagacatatccgagagactcaagttcctcctcactttagactgtgtggatgacaccttgattgtactagcggaggagcatgggtgtctggacattatcaaggagctgccagagactgtaatcgatctgttaaacaagtgtttgacctttcacccgagtaagagaccaaccccggaccaactcatgaaggataaagtgttctccgaagtgagtccactatatacgccctttacgaagcccgcatccctgttttcctcaagtctgcgctgtgctgacctgaccctccccgaggatatcagccagctgtgtaaggacataaataatgactacctagcagaaaggtctatcgaagaagtctattatctgtggtgcttggcggggggtgatctcgaaaaagaactggtcaataaggaaataatacgttccaagcctccgatctgcactcttcctaacttcctgttcgaagatggcgagagctttggtcaagggcgggatcggtcgagcttgctggacgacactaccgtgacattaagcctgtgtcagctgcggaaccgtctgaaggatgtgggaggggaggcattctaccccttactggaggatgatcagagtaatctcccacacagcaattccaataacgagctgtccgccgccgccacactgcccctgatcatccgggagaaggacaccgagtatcagttgaatcggattattctgtttgaccgcctcttgaaagcatacccatataagaaaaaccagatttggaaggaggcaagagtcgacattcctccgctaatgcgagggctgacctgggcagcgctcttgggagtcgaaggagctattcacgctaaatatgacgccattgacaaggacactccaattccaaccgacagacagattgaggtcgatatcccacgctgccatcaatacgatgagctcctgagcagtcctgagggacatgccaagttccgtagggtgctgaaggcctgggttgtttctcaccctgacttggtgtactggcaaggccttgattccctctgtgctccttttttgtaccttaatttcaacaacgaagctctggcctatgcatgtatgagtgcattcattccaaaatacttgtacaattttttcctaaaagataattcccatgttatccaagagtacttgactgtattcagtcagatgatcgcgtttcatgatccggaattgagcaaccacctgaatgagattgggtttataccagacctgtatgcaatcccttggtttcttacaatgttcactcatgtgtttcccctacacaagattttccatctttgggacacccttttactaggtaattcatccttcccattctgcattggtgtggccatccttcaacagctccgagacagacttctggctaacggctttaacgagtgtatcttgcttttttcagatctccctgaaattgatatcgagaggtgtgtgcgagaatcaatcaacctgttctgttggactccgaaatccgctacatatcggcagcacgcccagcctcctaagccatcatctgattcatctggaggaaggtctagcgcgccatacttttctgccgaatgtccggaccctcctaagactgatctgtctagagaaagcatccctttgaacgacttgaaatccgaagtttcccctcggatttccgccgaggatttaatcgatctctgcgagctgactgtgactggacactttaagacgccaagtaaaaagactaaaagcagcaaacctaaactgttggtggtggatatcagaaactcagaggattttattcgcgggcacattagcggatcaattaatattccctttagcgctgcctttactgcggagggggagcttacccagggcccttatacggccatgctgcaaaactttaaaggaaaggtgatcgtgatcgtgggtcacgtggcaaagcacacagcggagttcgctgcacaccttgtcaaaatgaaataccctcggatttgtatcttggacggcggcattaataagataaagcctactggactactgaccattccgtctccacagatctag

SEQ ID NO: 33758 - DNA, 2493 bp, Artificial Sequence
  Description of Artificial Sequence: Synthetic coding sequence
atgtttccactgaaagacgccgaaatgggagcattcactttcttcgctagtgcactgccccatgacgtgtgcggatccaacggtcttcccttgacacctaattccattaaaatattaggcagatttcaaattcttaaaaccataactcacccacggctgtgccagtatgtagatatttccaggggcaagcacgaacggcttgttgtggtcgccgagcattgtgagagaagcttagaagatttgctgcgggaacggaagccagtccggtacccatcatatctggcgcccgaggtgatcgctcaaggtatcttcaagacaaccgaccatatgccctccaagaagcctctcccatcaggtcccaagtctgatgtgtggagtttgggcataatactgtttgagctctgcgttgggcgtaaactgtttcaatctctcgatatcagcgagaggctcaaattcctgctcaccctcgattgtgtggacgataccctaattgtgctcgcagaagagcacggatgcctggatattattaaggagctccctgaaaccgttatcgatctgctgaacaaatgcctaacattccacccatctaagaggcccacacctgatcaattaatgaaagataaggtgttctccgaggtgtccccactctatactccctttacaaaaccagcatctttgttctcaagttccctcagatgtgctgatctgacgctgccagaggacatctcacagctgtgcaaagacataaataatgactatctggccgagaggagtattgaagaggtgtactacctgtggtgtctggcagggggcgacctggaaaaagagctcgtcaacaaggagatcatccgtagcaaaccccccatctgtactctgcccaactttttattcgaagatggcgagagctttggccaagggcgagacaggagctctctgttagacgacactacagtcaccctgagcttatgtcagctgcgtaaccgcttaaaagacgtcggaggcgaggctttttaccctctgcttgaagatgatcaatctaatctgccgcattccaactcgaacaacgagttgagtgcggctgccactcttccgttgatcatccgggagaaggatacagagtaccaacttaacaggatcatcctcttcgatcgtctgctgaaggcatacccatataaaaagaatcaaatatggaaggaagctcgggttgacattccacccctcatgcgtggtcttacatgggctgcactgctgggcgttgagggggccatccatgctaagtatgatgccattgataaggatactcccattcctactgatcgccagattgaggtcgatattccgagatgccaccagtatgatgagctgctcagctccccggagggacacgcaaaatttcggagggtgcttaaggcctgggtggtgagtcatcccgaccttgtatattggcaggggttagatagcctctgcgcgcccttcctgtatctgaacttcaacaacgaggccctggcctacgcctgcatgtcagccttcatcccaaaatacctctacaacttctttctgaaagacaacagtcacgtgatccaggagtatctgaccgtgttctctcaaatgatcgccttccatgatcctgagctaagcaaccacttgaacgaaattggattcatccccgatctttacgccattccttggtttctaacaatgttcacacacgtgtttcccctccacaagatcttccacctctgggacactttactgttaggtaattcgtcctttcctttctgtatcggcgtagccattctgcaacaactcagagatcgtctactcgctaatggatttaacgagtgcattcttctgttttcagacctgccagaaatcgacattgagagatgtgtgcgagagagcatcaatctattctgttggacgccaaaatccgcgacttataggcagcacgcacagccaccaaagccgtctagcgatagctcaggtgggaggtcttctgccccttatttctctgcagaatgcccagacccaccaaagactgatctgtctcgcgaatctattcctctcaacgacctcaagagcgaggtgtccccgcgaatctcggccgaggacttgattgacctatgcgagctgactgtaactgggcacttcaaaacacctagtaagaagactaaatctagcaaaccgaagctgttggtcgtagacatccgcaattcagaggacttcatacgcggccacatttccgggtcaattaacatcccatttagtgcagctttcacagctgagggcgaattaactcagggcccttacaccgccatgttacagaattttaaaggaaaagtgatcgtgatcgtgggccatgtcgccaagcacactgccgaattcgctgcacacttggtgaaaatgaagtaccccaggatctgcattctggacgggggaatcaataagatcaagccaaccggccttttaaccataccctcccctcaaatttag

SEQ ID NO: 33759 - DNA, 2565 bp, Artificial Sequence
  Description of Artificial Sequence: Synthetic coding sequence
atgttccctcttaaggatgccgagatgggagcctttaccttctttgcaagtgcgctgcctcacgatgtgtgcgggtcaaatggactgccccttactccaaattctattaaaatccttggccgtttccaaatcctgaagacaatcactcacccaaggctgtgccaatacgtggatattagtagaggaaaacatgaacgtctggtggtggttgccgagcactgcgaacggagtcttgaagacttgcttcgcgaaagaaaacccgtgtcctgttcgacagttttgtgcattgcctttgaggtcctgcagggcctgcagtacatgaataaacacggcattgtgcaccgagcactgtcacctcacaatattctgttggatcgcaaaggtcatatcaagttagccaagttcggactgtaccatatgactgcgcacggagacgacgttgactttcctatcggttatcccagttatcttgccccggaaggacggaagctgtttcagagcttagatataagcgaacgcctcaagttccttctcaccctagattgcgtggatgacacgttaatcgttttggctgaggaacacgggtgcctcgacattatcaaagaactgccagagaccgttatcgatctgctcaacaaatgtctgacatttcatcctagcaagcgccctactccagaccagctgatgaaggacaaagtattctctgaggtgtccccactctacactccattcactaagcccgcctctcttttcagtagcagcctgaggtgcgcagatttgacactacccgaggacattagccagctctgtaaagatattaataacgactatttggctgagagaagcatcgaggaggtgtactatttgtggtgtctggctggcggcgatctagagaaggagcttgttaacaaggaaatcattagatccaagccaccgatttgcaccttgcccaacttccttttcgaggacggtgagagcttcggtcaaggcagggatagatcgtcactgcttgatgatactacggtcaccctttccctgtgccaactgcggaatcggttgaaagatgtcggcggagaggctttctacccgctcctcgaggacgatcagtctaaccttccccattctaactcgaacaatgagctgtctgccgcggcaactctgccactcataatccgagaaaaggacacagagtatcagttgaaccggattatcttgtttgatcgcctattgaaggcatatccatataaaaaaaaccaaatttggaaggaggcgcgtgtagatatcccgccactcatgcggggcctcacatgggctgcacttttgggagttgagggggccatacatgcgaaatacgatgccatcgataaggacactccgattcctaccgacaggcaaatcgaagtcgacatccctaggtgccaccagtacgacgaattgttgagtagtcctgaggggcacgctaagtttagacgtgtgcttaaagcttgggttgtttctcaccccgacctggtgtactggcaagggctggatagcctctgcgcgcctttcctgtatctgaactttaataacgaggcgttagcctatgcatgcatgtctgcttttatcccaaaatacctgtataacttcttcctaaaggacaacagccacgtcatccaggaatacctgactgttttttcgcagatgattgcatttcacgatccagaactctccaaccacttgaatgagattggcttcatacctgatttatacgccataccgtggtttctgactatgtttacccatgtgtttcctctgcacaagatcttccacctgtgggataccctcctgttaggaaacagctccttccccttctgcatcggagttgcaattcttcagcaactccgagatcgcctcctggccaatggcttcaacgaatgcattctgctattctccgatctgccagagatagacatcgagaggtgtgtgcgtgagtccattaatctgttttgttggactccaaaatcagccacctaccgacagcatgcccagcccccgaaacctagctctgacagtagtggaggaaggtcctcagcaccgtacttctcagctgagtgccccgatccacccaaaacagacctaagcagggaatctattcccctgaacgatttgaaaagcgaagtaagcccaagaatttccgccgaggacttaatcgacctctgtgagctcaccgtcaccggtcacttcaagacaccctccaagaagaccaagtcctctaaacccaaactgctcgtcgtcgacattagaaattccgaagatttcatccgaggccacatctcaggctccatcaatatcccatttagcgctgctttcacagccgaaggagagcttacccaggggccttatactgccatgctgcagaacttcaagggtaaagtgatcgtgattgttgggcatgtcgcaaagcacactgcagagttcgccgcccaccttgtaaaaatgaaataccctaggatttgtattctagatggaggcattaacaaaataaaacccaccggtctgttaacaattcccagcccacaaatatag

SEQ ID NO: 33760 - DNA, 2682 bp, Artificial Sequence
  Description of Artificial Sequence: Synthetic coding sequence
atgttccctcttaaggacgcagaaatgggagccttcactttttttgcctctgctctgccacatgacgtttgtggatccaacggcctgccactaacaccaaattctatcaagattctgggcagattccagatcctgaaaaccattacccatccgagactgtgccagtacgtcgatatctctcgcgggaagcacgagcgcctagtagtcgtggctgaacactgtgaaaggtcgcttgaagatttgctgcgagaacggaaacccgttagctgttcaacagtgctgtgtatcgctttcgaggtcttgcaaggactccagtatatgaacaagcacggcatcgtgcaccgggccctgtccccccacaatatcctcctggaccgtaaaggccatatcaagctggccaagttcgggctctaccatatgaccgcccacggggacgatgtagacttccccatcgggtacccctcctatttggcccctgaggtgatagcacaaggtatatttaaaacaactgaccacatgccatctaaaaagccactgccctctgggcccaagagcgatgtgtggagccttggcatcatactgtttgagctttgtgttgggagaaagctgtttcaaagcttggacattagcgagcgcctgaagtttctccttactttggattgcgtagatgatactctaatcgtcttggctgaagagcacggttgcctggatataatcaaggagctccccgagacggttattgaccttttaaataagtgcctcacttttcatccaagtaaacggcccacaccagatcaacttatgaaagacaaggtgttcagcgaggtgtcccccctgtacactccgttcactaaaccagcgtcgctcttttcctcctccttgcggtgcgccgatctaactctccctgaggacatttcgcagttatgtaaggatatcaacaacgactatttggctgagcgatctatcgaagaagtttattatctgtggtgcctggcgggaggtgatttagaaaaggaactggtaaacaaagaaatcatacgcagtaagcccccaatctgcaccctgcctaactttttgttcgaagatggagagtcatttggtcagggacgagaccggagtagtctgctggatgatacaaccgtgacactttcactgtgccaactacgcaatagattaaaggacgttgggggagaggcattctacccactgctggaagatgaccaaagcaatctgccccactccaacagtaacaatgaactctccgctgcagccactcttccccttatcatcagagagaaggacacagagtatcagttaaataggatcatcctgttcgatcgcctgctgaaagcgtacccttataagaaaaaccagatttggaaggaagcacgtgtggatattcccccacttatgagagggttgacatgggccgcactgctgggcgtggaaggagctatacacgcaaagtatgatgccatagacaaagacacgccaatccctaccgatagacagatcgaagttgacataccaaggtgtcaccagtacgatgaactgttaagctcaccagagggacacgccaaattccgcagagtgctcaaggcatgggtggtttcacatcctgatttggtgtattggcaaggcctcgacagcctatgtgccccctttctgtaccttaattttaacaatgaagcccttgcttatgcttgtatgtcagcctttatcccaaagtacctgtacaactttttcctgaaggataactctcacgtcattcaggagtacctcacagttttctcacagatgatagcttttcacgaccccgaactgagtaaccatctgaacgaaatcggattcatccccgatctgtacgccattccttggtttttgacaatgtttacccacgtgttccctctgcataaaatctttcatttgtgggatacactgctgctgggtaactcttcatttcccttttgtattggggtcgccattctccagcaattgcgcgatagactgctggctaacggattcaacgagtgcattcttcttttttcggatctgcctgagatcgatatagaaagatgcgttagggagtctattaatctgttctgctggacgcccaaaagcgcgacatacagacaacacgctcaacctcctaaaccttctagcgatagttcgggcggccgatcctcagctccatatttctccgccgagtgccctgatcctcccaagactgacctttcccgggaaagtataccacttaatgatcttaagtctgaagtctcacccagaattagtgccgaggacctgattgatctctgcgaactgaccgtgacaggacattttaaaacacctagcaagaagactaagtccagtaagcccaaactgctcgtggttgacatccgcaacagcgaagactttatcagaggacatatcagcgggagtataaacattcccttttctgcagcattcactgctgaaggcgagctgacccaggggccctacacagctatgctgcagaatttcaaagggaaggtcatcgtgatagttgggcacgtggctaagcacaccgcagagtttgctgcacacctagttaagatgaagtatccgcggatttgtatcctagatggcgggatcaacaaaatcaagccaaccgggctgcttaccatcccttccccacagatttag

SEQ ID NO: 33761 - DNA, 2682 bp, Artificial Sequence
  Description of Artificial Sequence: Synthetic coding sequence
atgttccccctgaaggacgcggaaatgggtgcattcacattctttgcaagtgctctgccccacgacgtgtgcggctctaatggcctaccactcactcccaactctataaagatattaggacggtttcagatcctcaagacaattacccacccacggctgtgtcagtatgtcgatatctcacgcggtaagcacgagcgcctagtggtggtggctgaacactgtgagcgctcattggaggatttgctgagggagcggaagcccgtctcctgttcgactgttctgtgcattgcttttgaggtactgcaaggactccagtacatgaataagcacgggatcgtccacagagcactgtcaccgcacaatatcctgctggaccgtaaaggccatatcaaactggccaagttcggcctttatcatatgacagcgcacggtgacgatgttgatttccccatcggttacccctcatacctggcaccagaggtcatagcacagggcatatttaagaccactgaccacatgccctccaaaaaacctttgccctctggccccaagtcagatgtgtggtcgttaggaatcatcctcttcgaactgtgcgtgggtcgcaagttatttcagagccttgacatttccgaacgactgaagttcttgctgaccctggactgcgtcgatgacacattgattgttctggccgaggaacatggttgcctagatatcattaaagaactccccgaaacagtcattgatttgctgaataaatgcctgacctttcacccaagcaagcgaccaacgccagaccagcttatgaaggataaggtgttctcggaggtgtcacctctctacacacccttcacaaagcccgcaagtctcttttcttcaagcttgagatgcgccgatctgacactacctgaggacattagtcagctgtgtaaagatattaataatgactacctggctgaacgaagcatcgaagaagtctactatctgtggtgcctagcagggggcgatctggagaaggagctggtgaataaggaaattatccgaagtaaaccccctatctgcactctcccaaacttcttgttcgaggatggtgagagctttggccagggacgcgacaggagctccctcctcgacgacaccaccgtgactctctcgctctgtcaactcagaaacaggctcaaggatgtgggaggtgaggcattttatcctctgttggaggacgaccaatccaatctaccgcatagcaactctaacaacgagctttcggccgcggccacgctgccactaattatccgagagaaggataccgagtatcaactgaatagaattatcctgttcgaccgcctcttgaaggcatacccttacaaaaaaaaccagatttggaaggaggctagagtagacataccgcctctcatgcggggattgacgtgggctgccctcttaggggtggaaggggcgattcacgctaagtacgatgcgattgataaggatacccctatccctacggacagacagatagaagtcgatatcccacggtgccatcagtatgacgagctgctcagctccccagaagggcatgccaaatttaggagggttctcaaagcgtgggtggtgtcacaccccgatctggtttactggcaggggcttgattctttgtgtgccccatttctgtacttgaactttaacaacgaggctctggcttatgcttgtatgtctgccttcatcccgaagtacctttacaactttttcctgaaggataactcccacgtgatccaggagtacctgactgtgttctcccagatgatcgcgtttcatgatcccgaattgagcaatcacctgaatgagatcgggtttatacccgacctctatgccattccttggttcctcacaatgtttactcatgtctttcccttgcataagattttccacctgtgggacaccttgcttctgggcaattcctcatttccattctgtattggagtggccattttacagcaactcagagatcgccttttggctaatgggttcaacgagtgcattctcctgttttccgatctgcctgagatagacatcgagcggtgtgtcagggagtcaattaatttgttctgctggaccccgaagtccgccacctatcgtcagcatgcccagccccccaaaccttctagcgatagctccggagggcgcagctccgctccttacttctctgccgaatgcccagacccacccaaaacagatctctcacgcgaatcaattcccctcaatgacctgaagtcagaggtgagccctagaatatctgctgaggacttaattgacctgtgcgagctgactgttacagggcacttcaagactccaagcaaaaaaaccaagagtagcaaaccaaagcttctggtggtggacattagaaacagtgaggatttcattaggggccacatatcagggtcaattaatatcccattctccgccgccttcaccgcggaaggggagttaacacaggggccctacacagctatgcttcaaaatttcaaggggaaggttatcgttattgttgggcatgtcgccaaacacaccgccgaattcgccgcgcatctggttaaaatgaaatatcccaggatctgcatcttagacggcggaatcaataaaatcaaacccacagggcttctgacaataccttcccctcagatatag

SEQ ID NO: 33762 - DNA, 207 bp, Artificial Sequence
  Description of Artificial Sequence: Synthetic coding sequence
atgtttccgttgaaggatgcagaaatgggtgcattcaccttctttgcatcggctctcccccacgatgtgtgcggaagcaatggattacccctcactcccaattccattaaaattctcgggcgcttccagattctcaaaaccattacccatccgagactgtgccagtacgtggacattagccgagggaagcatgaacggttggtatag

SEQ ID NO: 33763 - DNA, 480 bp, Artificial Sequence
  Description of Artificial Sequence: Synthetic coding sequence
atgtttccactcaaggacgcagagatgggagcgttcaccttcttcgcctctgcactgccccacgacgtttgcggcagcaacgggcttccactgacccccaactcaatcaagatcctaggcagatttcagatcttaaagacgattacgcatccaagactttgtcagtatgtggacatttcaagaggtaaacacgaacgattagtggtggttgcagagcactgtgaaagatcacttgaagaccttctgcgcgagcgaaagcctgtgtcgtgcagcacagtgctatgtatcgccttcgaggtcctccaggggctgcagtacatgaataaacacggaatagtgcatcgggcattatctccacataatattctgctcgatagaaaaggtcacatcaaactggccaaatttggactgtaccatatgacagcacacggagacgatgtggacttccccatcggttacccttcctacctggcaccctag

SEQ ID NO: 33764 - DNA, 318 bp, Artificial Sequence
  Description of Artificial Sequence: Synthetic coding sequence
atgtttcctctgaaagacgcagagatgggcgccttcaccttcttcgcatcggccctgccacatgacgtttgtggatctaatgggctccccctaacaccaaatagcatcaagatcctcggccggtttcagatcctgaaaactatcacccaccccagactctgtcagtacgtagacatctcacgcggtaagcatgagaggctggtggttgttgccgaacattgtgagagaagcttggaggatctgctgagggaacggaagcctgtgtcttgctctacggtcttatgcatcgcatttgaggttctgcagggcttgcagtag

SEQ ID NO: 33765 - DNA, 753 bp, Artificial Sequence
  Description of Artificial Sequence: Synthetic coding sequence
atggagatggacggggacccctacaacctccctgcgcagggccaagggaacatcatcataacaaagtatgaacagggacaccgggcgggcgcggctgtggatttaggtcatgaacaggtggacgttcggaagtataccaataatctgggaatcgttcatgagatggagcttcctcacgtgtctgctctcgaggtcaagcaaaggcgaaaggagtctaaaagaacgaataaatggcagaaaatgctggccgactggaccaaatacaggtcaacaaagaagctatctcagcgggtctacaaggtgattccgttagcggtacgaggccgggcctggtcccttctcctggatatcgatcggataaagagccaaaatcccgggaaatataaggttatgaaagagaaaggcaagagatctagccgcataatccactgcatccagttagatgtaagtcatactctccagaaacatatgatgtttatccagaggttcggggtcaagcagcaagagctgtgtgatatcctggtggcttattcggcctataatcccgaggtcggctaccatcgggacctgagcaggatcacagccatcctccttctgtgtctacccgaagaggatgctttctgggcactgacccagctgttagccggagaaagacacagtctgtggtacagtactgctcagattctgccgggttctagaggaagctatcgcactcgctctcggtgttgcacttccccgagtcagcggtcttag

SEQ ID NO: 33766 - DNA, 453 bp, Artificial Sequence
  Description of Artificial Sequence: Synthetic coding sequence
atgggacatctcgacaaagagggactgtgcacccagggctcctcattctcctggcttctcagagtgctcaatgacggaatctctctgggactcacaccttgtttatgggacatgtatctgctggaaggagagcaaatgttgatgctaatcacatccattgccttcaaggtgcagagaagcctctatgaagagacaaacaaggaaacttggggccccgctacaccaagagccttgaagggcaccggtcgcgcccgaccaatatgtgagtctttacacagctctttgcaagctctcacagctagtgagtctagtcgggggccttccttactgcagacacccccaagggtgcctggacagcaggccctgagccgcggagacaagggaatatccgtgtcacttagcttgccaagcctcccctctcgccgagggcggtgtggcaggattatcgggtag

SEQ ID NO: 33767 - DNA, 2286 bp, Artificial Sequence
  Description of Artificial Sequence: Synthetic coding sequence
atgcggcaggacaagctaacaggcagtttgcgacgcggaggcaggtgcctcaaaagacaaggaggcggcgttggaacgatcttgtccaacgtgttgaagaagagatcatgtatcagccgcacggcgcccaggttgctgtgtacactcgaaccaggcgtggatacaaagctgaagttcacgctcgagcctagcctggggcaaaacgggttccagcaatggtatgatgctctgaaggcagtggcccgacttagcactggtattccgaaagaatggaggaggaaagtgtggctcacattggctgaccactatttgcattctatcgctatcgattgggataaaaccatgaggttcacatttaatgagcgctccaacccagacgacgacagcatgggtatacagatcgtcaaagatctgcatagaactggctgttcaagctactgcggacaagaggccgagcaggaccgggtcgtgttgaagcgtgtcctccttgcctatgcacgctggaacaaaactgtaggctattgccagggatttaatattctggcagcactgatcctggaggtgatggagggaaacgaaggcgacgcacttaaaattatgatttatcttattgataaagtcttgcccgagtcgtactttgtaaacaatctgagggcccttagcgtcgacatggctgtgtttcgcgacttgctgaggatgaagctgcccgagctgtctcagcacctggacaccttacagcgtactgccaacaaagagtcaggcggcggatacgaaccacctctgacaaacgttttcactatgcaatggtttctgacactgtttgcaacctgtctccctaaccagaccgttctgaagatctgggactcagtcttctttgagggctcagagatcatcctgcgggtttccctggcaatttgggccaaactgggcgagcagatcgagtgctgcgaaacagcggacgagttctactccacaatggggcgacttactcaggagatgctcgagaacgaccttctccaaagccacgagttgatgcaaaccgtctactccatggcaccgtttcctttcccacagctcgccgagcttagagagaaatatacctataatatcacgccttttcccgccactgtaaagccaactagcgtgtcaggaagacacagcaaggctcgggattccgatgaagagaatgacccagatgatgaagacgccgttgtcaatgcagtgggatgcctcggccccttttctggatttctagcacctgaactccagaaatatcaaaagcaaatcaaggagccaaatgaagaacagtctctgagaagcaacaatattgccgagctgagcccaggagccattaactcttgcaggagtgagtatcacgctgcttttaactccatgatgatggaacggatgactactgacatcaatgcgctcaagaggcaatacagccgtattaagaagaaacagcaacagcaggttcaccaggtgtacatccgcgccgacaagggaccagtgaccagcatcctcccttcccaagtaaattcctcccctgtaatcaaccaccttttacttggcaagaaaatgaagatgactaacagggctgcaaagaacgccgtcattcacatccctggtcacactggggggaagatttctccggtgccttatgaggatcttaaaacaaaattaaacagcccgtggcgcacacatattagagttcataagaaaaacatgccgcgaacaaagagccaccccggctgtggagacacagtgggtcttatcgacgaacagaacgaggcgagcaaaaccaacggccttggtgccgcggaggcctttcccagcggctgtacagccaccgcggggagggaggggagtagcccagaagggtccactcggcgcacaattgaaggccagtccccagaacccgtattcggggacgcagacgttgacgtgtctgctgtgcaggccaaactgggcgcattggaactgaaccagcgcgacgctgcggctgaaaccgaactgcgggtgcatccaccctgccaacgtcattgtcctgaaccacccagtgcacccgaggagaataaagccactagtaaggccccccaggggagcaattctaaaacgcccatcttttcccccttcccttctgtgaagcctcttcgtaaatccgccaccgcacggaacctgggactgtatggtccaactgagcgcacgcctacggtccatttccctcaaatgtctcggagtttttctaagcctgggggcggtaactcaggtactaaaaagcgctag

SEQ ID NO: 33768 - DNA, 2454 bp, Artificial Sequence
  Description of Artificial Sequence: Synthetic coding sequence
atgtaccactctctgagcgaaacccgacatcccctgcagccagaggaacaggaggtggggattgatccactttcatcttattctaacaagtccggcggtgacagtaacaaaaatggtcggaggacttcgtccaccctggactccgaggggaccttcaattcctatagaaaggaatgggaagaattatttgtcaataataactacctggcgacgattcgccagaaaggaatcaacggccagctgagatctagtaggttcagatctatttgctggaaactgtttctctgcgtgctgcctcaggataaatctcaatggatttctagaattgaggagctcagggcctggtacagtaacatcaaggagatccatatcaccaatccaagaaaggtagtgggtcagcaggacctcatgattaataatcccctgtcacaggacgaaggatctctctggaacaagttttttcaggataaagaactgcgctctatgatcgagcaagatgttaaacgcacttttcccgagatgcagttttttcagcaggagaacgtccgtaaaattctgactgatgttttgttctgttacgcacgcgaaaacgaacagctactgtataagcaggggatgcacgagctgctggccccaatcgttttcgtgcttcattgcgatcatcaggccttccttcatgctagcgaaagcgcccagcccagtgaggagatgaaaacggtcctcaaccctgagtacctggagcacgacgcctatgcggtgttttcacaattgatggagaccgccgaaccttggttctctacctttgagcacgatggtcagaagggcaaggagacccttatgacacctattcccttcgcgaggccacaggacctgggcccaactatcgcgatagtgacgaaggtcaaccaaattcaggaccacctgctgaagaagcacgatattgaactgtatatgcacctgaacagactggagatcgccccccagatctacggtctgcggtgggtccgccttctgtttgggagagaattcccgttacaggacttgctggtcgtctgggacgcccttttcgctgatggactgtcattagggttagttgactacatattcgtggctatgctgctgtacattcgggacgccctcatcagctcaaattaccagacgtgccttggactgctgatgcattacccttttattggcgatgtgcactcactgattctgaaagctctctttctccgagatccaaaacggaatccaagaccagtgacctatcaattccatcccaatctcgattattataaggctagaggggcggacctgatgaacaaatcacgcaccaatgccaaaggcgcccccctgaatatcaataaggttagcaatagccttataaacttcggtcgaaagctcatatcacccgccatggcccccggtagcgcagggggccctgtgcctggaggcaacagctcaagcagttccagtgtggtgattcctaccagaacatcagctgaagcccctagccatcatctgcagcaacagcagcaacagcagagattgatgaaaagcgaaagcatgcctgtgcagctcaacaagggcgacgtagttactggcagcgacgcccaggtttcggttccagtgcaaaccttaaccgatctgcaaggcctctccagtaaaaacatctcgagcagtcctagcgttgagagtctcccaggcggtagagagttcaccggcagccctccctcaagcgccacaaagaaggacagtttttttagcaatatcagccgcagccggagtcactcaaagaccatgggtcgaaaggagagcgaagaggagcttgaggcccagatttcattccttcagggccagttaaatgacctggacgctatgtgtaaatattgcgccaaagtgatggacacacacctggtaaatattcaggatgtgattctgcaggaaaacctagagaaggaagatcagatcttggtttctttggccggcctgaagcaaattaaagacattctgaaagggtccctccggttcaaccaatcacagcttgaggccgaggaaaacgaacagattacaatcgccgataaccactattgctcgtcaggtcagggccagggacgtggccaggggcaatctgtgcaaatgtcaggagctatcaaacaagcatcgagtgaaacccccggatgtactgatagaggaaactctgacgatttcattctgatttcaaaagatgatgacgggtcgtcagccaggggttcatttagcggacaggcccagccgctgaggacactgcgcagcacgtcagggaaatcccaggcccccgtctgtagtccattagtgttttctgatcccctaatgggccctgctagtgctagctccagcaatccaagttcttctccagacgacgattcttctaaagactccggttttaccattgtttctcccttggacatctag

SEQ ID NO: 33769 - DNA, 624 bp, Artificial Sequence
  Description of Artificial Sequence: Synthetic coding sequence
atgttggcccttcggtgtggttcacgctggttgggactgctctctgttcccaggagcgtgcccctgagactccccgccgcaagagcttgtagcaagggcagtggtgacccaagcagtagctccagcagtgggaacccacttgtttatttggatgtagatgctaacggaaaaccactcggtagagtagtccttgagttaaaggctgacgtggttccaaagaccgctgaaaactttagagctctgtgcacaggggagaaagggtttggctacaagggcagtacgtttcatagagtcatcccctcgttcatgtgccaagccggagacttcactaatcataacggaacaggaggaaagagtatttatggatcacgttttccagacgagaatttcactctgaagcacgtcgggcccggagtgctgtccatggccaatgcgggccctaatacaaatggaagtcagtttttcatttgcaccataaaaactgattggctcgacggtaaacacgttgtctttggacacgttaaggagggcatggatgttgtaaaaaagatcgagtcctttggatccaagagtggcagaacctctaaaaagatcgttattaccgactgtggtcaattatcatag

SEQ ID NO: 33770 - DNA, 444 bp, Artificial Sequence
  Description of Artificial Sequence: Synthetic coding sequence
atggggttcatctttagtaagtcgatgaatgagtccatgaagaaccagaaggaatttatgctgatgaacgcaaggctgcaattggagcgccagctgatcatgcagtctgaaatgagggagcggcagatggccatgcagatagcctggtctagagagttcctgaaatacttcggaacgttcttcggcctggctgctatctcgctgacagcaggtgcaatcaaaaaaaaaaagcccgccttcttggtgccgatcgtcccacttagcttcattctcacatatcagtatgatctgggctatggaacgcttctcgagcgtatgaagggggaagcagaggatattctggagacagagaagagcaagctgcaattacctcgtggaatgatcacatttgagagtatagaaaaagcaaggaaggagcagagtcgctttttcatagataaatag

SEQ ID NO: 33771 - DNA, 1203 bp, Artificial Sequence
  Description of Artificial Sequence: Synthetic coding sequence
atgtccagcctacacaagtcccgcatcgctgatttccaggacgtgctgaaagaacccagtatagcactggagaagctgcgagagctgagtttcagtgggatcccatgtgaaggagggctgagatgcctctgttggaaaattttgctgaactatctcccccttgagagagcatcctggacctcaatccttgccaaacagagagaactctacgcccagtttctgagagaaatgattatacagcccggcatcgcaaaggcaaatatgggggtgagcagagaggacgttacatttgaagatcatcctctgaaccccaaccccgactcccggtggaacacatatttcaaggataacgaggtgctgctgcagatcgataaggatgtccgacggctctgccctgacatcagcttctttcagcgagcgactgactacccttgcttactcatactggatccccagaacgaattcgagacactgagaaaaagggtcgagcagactacgcttaaaagtcagactgtggcacggaatcgatccggggtgacaaatatgtcttccccgcataagaattctgtgccatctagcctgaatgagtacgaggtactacctaatgggtgcgaggcccactgggaggtcgtcgaacgaatcctctttatatatgccaaactcaaccctggcatcgcctacgtccagggtatgaacgagatagtaggtccgctctactatacattcgcaaccgatcccaattcagagtggaaggagcacgcagaggcagatacctttttctgttttaccaacctgatggccgagattagagataattttatcaagtccctggatgattctcagtgtggcatcacttacaagatggaaaaagtctacagtaccttgaaagacaaggacgtagagctgtacctcaaactgcaggaacagaatatcaagcctcagttcttcgcttttagatggcttacgctgctgctttcgcaggagtttctgctgccagacgtcattaggatatgggattccctgttcgcggacgataacaggtttgactttctgttgctggtatgttgtgccatgctcatgctgatcagagaacagctgctggaaggagatttcactgttaacatgagactccttcaggattacccaatcactgatgtgtgtcagatcctgcagaaggccaaggaactacaggacagcaaatag

SEQ ID NO: 33772 - DNA, 660 bp, Artificial Sequence
  Description of Artificial Sequence: Synthetic coding sequence
atgtcaagcccccacaagaattctgttccgtccagtttgaatgagtatgaagtgctgcccaatggctgtgaggcgcactgggaggttgtggaaaggattttattcatctacgccaagcttaacccaggaatcgcttacgtccagggcatgaatgagattgtcggccctctgtactacacatttgcgacggatccgaacagcgagtggaaggagcacgccgaggcagacaccttcttctgcttcactaacctgatggctgagatccgcgacaatttcattaaatccttggacgattctcaatgcggtatcacctacaagatggaaaaggtgtactcaaccttgaaggacaaagatgtcgaactctaccttaaacttcaggagcaaaatatcaagccccagttcttcgcgttcaggtggcttaccttgctgctttcacaggagtttttactgccagacgttatacggatctgggattctctgttcgccgatgacaaccggttcgacttccttttgctggtgtgctgtgcaatgctgatgttgataagggagcagctgttagagggagactttactgtgaatatgagattactgcaggattatccgattactgatgtttgtcagattctgcaaaaggcaaaagagctgcaagactcgaagtag

SEQ ID NO: 33773 - DNA, 2082 bp, Artificial Sequence
  Description of Artificial Sequence: Synthetic coding sequence
atgaccgacgggaaacttagcacctctacaaatggggtagcctttatggggattctggacggcaggccaggcaaccctcttcagaacttacagcacgttaacctgaaggcccctaggctcctgagtgctcctgagtatggcccaaagctgaagctgagggcgttggaagacaggcacagtctgcaatcggttgactccggcatcccaaccctggagattggaaatcccgaacccgttccatgctccgcagtccatgtgcggcgtaagcaatctgatagtgacctaatccccgagcgcgcattccaatctgcctgtgctttgcctagctgcgccccgcctgcccccagttctacagagcgcgagcaaagcgtgcgtaaatcatccacctttccgcgcacaggttatgattccgtcaagctgtattcccccactagtaaagccctcacccggagcgatgacgtttctgtctgctccgtgagttccctgggcaccgagctgtccacaaccctgtccgtcagtaatgaagacattctggatctggtggttacatcttcgtcctcagcaattgtcaccttagagaatgatgacgatccccagttcaccaatgtgacactgtcctctatcaaggagacacgcgggctacaccaacaagactgtgtgcatgaagcagaagaggggtctaagttaaaaattctgggccccttcagtaacttcttcgccaggaatctattggctaggaagcaaagcgcccgactcgataaacacaacgatctggggtggaaactgttcggcaaggctccattacgcgaaaacgcacagaaagactcgaagcgcatccagaaggagtatgaagataaagccgggcgaccatccaagccacccagccccaagcagaacgtgaggaaaaacctggactttgagccactctcaaccactgctctgatactcgaggacaggccggctaacctgccggccaagcccgccgaggaagcccaaaaacaccgccagcagtacgaagagatggtggtccaagctaagaaaagggaactgaaagaggctcagcgtcgcaaaaaacagctggaagagagatgcagagtcgaggagagtattggaaacgctgtcttgacctggaataacgagattctacctaactgggaaactatgtggtgtagtcggaaagtgcgtgatctgtggtggcagggcatccccccttctgtcaggggtaaagtatggtctctcgctatcggcaacgagttgaatatcacgcacgaactgttcgacatctgcttggcccgggccaaagagcgatggaggagcctgagcacaggcggttccgaggtggagaatgaggacgcgggcttctcggcagctgacagagaagcctctctggagctgattaagctggacatttccaggactttcccaaacctgtgcatttttcagcagggcggaccataccatgacatgctgcactccattctaggcgcctacacttgttatagacccgacgtgggatacgtgcagggaatgtcgtttatcgcagctgtactcattctcaacttagacactgctgacgcattcattgcattctcaaacctgctgaataaaccctgccaaatggccttttttcgggtggaccatgggctgatgcttacctatttcgctgcctttgaggtgttctttgaagagaaccttcccaaactcttcgcacattttaagaagaacaatctgacccccgacatctacttgattgattggatatttaccttgtactctaagtctcttcctctggaccttgcttgccgtatttgggacgtcttctgtagagatggagaggagttccttttcaggacggcactagggatactaaaactttttgaggatatcctcaccaagatggacttcattcacatggctcagttcctaaccaggcttcctgaagacttacccgcagaagaactatttgcttccattgccaccatacagatgcaatcccggaacaagaagtgggcgcaggttctaaccgccttgcagaaggatagccgcgagatggagaagggttcacctagcctgcggcactag

SEQ ID NO: 33774 - DNA, 171 bp, Artificial Sequence
  Description of Artificial Sequence: Synthetic coding sequence
atgacggatggcaaactctccaccagtaccaacggggtcgcgtttatgggcattttagatggaagaccaggcaacccactccagaatctccaacacgtgaatcttaaggctccaaggctgctctccgccccggagtatggaccaaaactgaagcttcgggcactcgagtag

SEQ ID NO: 33775 - DNA, 384 bp, Artificial Sequence
  Description of Artificial Sequence: Synthetic coding sequence
atgaccgatggtaagctctctaccagcacaaatggagtcgcctttatgggtatacttgatgggcggcccggaaaccctttacagaacctccagcacgttaacctcaaagcgccgaggttgctgtccgccccagaatacggccccaagctaaagctgagggcccttgaagaccgtcacagcctgcagtccgtagatagcggaattcctaccctggaaatagggaatccagagcctgtaccctgctctgccgttcatgtccgccggaagcaaagtgactcagatctcatccctgagcgggccttccagtccgcctgcgctcttccatcctgcgcgcccccagccccttcttccacagagcgcgagcagagcgtgagaaagagctag

SEQ ID NO: 33776 - DNA, 1023 bp, Artificial Sequence
  Description of Artificial Sequence: Synthetic coding sequence
atgtggtgtagtcgcaaggttagggatctgtggtggcagggtataccccccagcgtaagagggaaggtatggtctttggctataggaaatgagcttaacatcacccatgaattattcgacatttgtctggcacgagcaaaggagcggtggagatctctttccactggcggcagcgaggtggaaaatgaagacgctggcttcagtgcagctgacagagaagcgtccctggaattgataaagctggatatttccagaacttttcctaatttatgcatcttccagcaggttttgatctttgtggacttcagagtgggtttacagaaatcatttcagaagcggaaagagagagagagcactaaattgcagcagctctggagttggtgtctcggtggaccctaccatgacatgctgcactctattctgggtgcgtacacctgctatagacccgacgtggggtacgtacagggaatgtcctttatcgccgcagtcctgatactgaacctggatacagccgatgccttcatcgccttcagcaatctccttaataagccttgccaaatggccttctttagggtcgaccatggattgatgctgacgtactttgcggcttttgaggtcttttttgaggagaatctccctaaactctttgcccactttaaaaagaataatcttacgcccgacatatacctcattgattggatcttcacactctattctaaaagtctcccgctagacttggcatgtcggatctgggacgttttttgcagagacggggaggagttcttgtttaggactgctctgggcatcttgaagctttttgaggatattcttacgaagatggattttattcacatggcccagtttctgactcggctccccgaggatctccctgccgaggagctgtttgccagcatcgcaactattcagatgcagagccggaacaaaaagtgggcccaagtgttaactgccctgcaaaaggactcacgggagatggaaaagggaagtccctctttacgccattag

SEQ ID NO: 33777 - DNA, 2082 bp, Artificial Sequence
  Description of Artificial Sequence: Synthetic coding sequence
atgaccgatggcaagctgagtaccagtacaaacggcgtggcctttatgggaattttagatggcaggccaggaaatccgttgcagaatctgcagcatgtgaacctcaaggcgcccaggcttctgagtgcaccagaatatgggcctaagttaaagctgcgtgctttagaagatcggcatagtctgcagagtgtggacagcggtatacccacgctcgagattggaaaccctgagcccgttccatgttcagctgtgcacgtgcgtcgcaaacagtccgattctgatcttatcccagaacgcgctttccagagtgcctgcgccctaccatcttgcgcaccccccgccccgagctctaccgaaagggagcagtctgttaggaaatcctctacattcccaaggactggctacgatagtgtgaaactgtacagcccgacttctaaagcacttacccgtagtgacgatgtcagtgtctgttctgttagcagcctgggaactgaactttcgaccacgctgtctgtcagcaatgaggacatcttggacctggtggtgacctcttccagctcggccatagttaccctggagaatgacgatgatccccaattcaccaacgttacactgtcgtcaatcaaggaaacccggggactacaccagcaggactgtgtccacgaggccgaagaaggaagcaagctaaaaattctcggccctttctcaaacttctttgcccgtaatctcctagctcggaaacaatccgccaggctggataagcataatgatctgggctggaaactatttggcaaagcgcccctgagagagaatgctcagaaagactctaagcggatccagaaggaatacgaagacaaggcgggccggccaagcaagcccccctctcccaagcagaacgtaagaaagaatctggacttcgaacctctgagtaccactgccctcatcctggaggatcgccctgcaaacctcccagcgaaaccagcagaggaagcacagaaacacagacagcaatacgaagagatggttgtgcaggccaaaaaacgggagctaaaagaggcccagagaaggaaaaaacagttggaggaacggtgtagagtggaggaatcaatcggaaatgcagtgctgacctggaataatgaaattttgccaaactgggagacaatgtggtgctcacgcaaagttagagacttgtggtggcagggaatcccacctagtgtaagagggaaggtgtggtctctggcaataggtaatgaactcaatattacacatgagttattcgatatttgcctggctcgcgcaaaagagcggtggcgtagcctgtccacaggggggtccgaagtggagaatgaagacgccggattttctgctgctgacagagaggcctccctcgagctgattaagctggacatcagccgaactttcccaaatctctgcatttttcaacagggaggtccatatcatgatatgctgcacagtattctcggagcttatacttgctaccgtcctgacgtcgggtacgtgcaaggaatgagtttcattgcagccgtactgatactcaacctagacactgcagacgctttcatcgcgtttagcaacctgctgaacaagccatgtcagatggcgttctttcgagtggaccatggacttatgctaacatatttcgcagcatttgaagttttcttcgaagaaaacttaccaaaattgttcgcccactttaaaaaaaacaatctcacccccgatatctatctcatcgactggatcttcacactgtatagtaaatcactccccctggatcttgcctgtcggatctgggacgtcttttgtcgggatggtgaagaatttttgttccggacagcgttaggaattctgaaactgtttgaagacatcttaacaaaaatggactttatccatatggcccagtttctgacgcggttacccgaggacctgccagcagaagaattgttcgcctccatcgccaccattcaaatgcagagccggaataagaagtgggcccaggtgctgacagcactccagaaggattctcgtgagatggaaaagggctccccaagtctgcggcattag

SEQ ID NO: 33778 - DNA, 1242 bp, Artificial Sequence
  Description of Artificial Sequence: Synthetic coding sequence
atggagtatgaagataaggctgggagaccgagcaaaccaccatcacccaagcaaaatgtcagaaaaaatctggactttgagccgttgtcaacaaccgcgctcattttagaggacagacccgccaatctgcccgctaaacccgccgaggaagcccagaagcaccggcagcagtacgaggaaatggtcgtgcaggccaagaagagggagttgaaggaagctcagcgacgaaaaaaacaactggaagagaggtgcagagtcgaggagtctataggtaatgcagttttaacctggaataatgagattcttcccaattgggaaaccatgtggtgcagtaggaaggtgcgggacctctggtggcagggtatccctccaagcgtccgaggaaaagtatggagcttagccattggaaatgaacttaacattacacacgagctgtttgacatctgcctggcgagggccaaggagaggtggcgttccctctccacaggaggctccgaagtggagaatgaggatgccgggttttccgcggctgatcgggaagctagcctggaacttatcaagctggacattagcaggactttccctaatctctgtattttccagcagggtggcccctatcacgacatgcttcattctattttaggagcctatacttgctataggccggacgttggctacgtccagggcatgagctttatcgcggccgttctgatattgaacctggacaccgccgatgcctttatcgcctttagtaatcttctgaataaaccttgccagatggctttcttccgggtggaccacggactcatgctgacctacttcgctgccttcgaagtgttcttcgaggagaaccttcctaagctcttcgcccatttcaagaagaataaccttacaccggacatttatctgatagactggatctttacactgtacagcaagtcactgcctctcgaccttgcgtgtcggatctgggatgtcttctgtcgcgatggagaggaatttttgtttcgcacggcacttggaattcttaaactattcgaggacatcctgacgaaaatggacttcatccatatggcacagtttttgaccaggctgccagaggacctccccgcggaggagctgtttgcaagtatagccactattcagatgcagtcccgtaataagaagtgggctcaggtgcttactgcgctccagaaagattcccgcgagatggaaaagggcagtccatccctcaggcactag

SEQ ID NO: 33779 - DNA, 2304 bp, Artificial Sequence
  Description of Artificial Sequence: Synthetic coding sequence
atgagcttgggtcgattattgagacgagcaagttctaaggcttcagatctcctgacgctaactcccggtgggtctgggagcggttctcctagcgtgctggacggcgaaatcatttactccaaaaacaacgtctgtgtgcacccacctgaaggtcttcaagggctcggggagcaccatcccggatatctgtgcctctatatggaaaaggacgaaatgcttggggctacactaatcctcgcatgggttcctaacagtcggatccagagacaagacgaggaagccctgaggtatatcactcccgagtcgtcaccggtacgtaaggcgccacgccctaggggacgccggaccagatctagtggagcctcccaccagcccagtccaacggagctgcgccctacgctcactcctaaagacgaggatatcttagtggtggcccagtcagtgccagatcgaatgctcgccagccctgcacccgaggatgaagagaagctcgctcaggggctgggagtagatggagcgcagcccgcctcgcagcctgcttgtagtccgtccggaattctgtccacggtgagtcctcaagatgtgactgaggaaggtcgagagccaaggcccgaagcaggggaggaagacggctccttggaactgtcagcagagggcgtgtcccgcgattcctcatttgactctgattccgatacattctcctctcctttttgcctcagcccaatctctgccgcgctcgcggagagcagaggcagtgtgtttctggaatccgattcttcgcctccctcttccagtgacgcgggattgagattccctgattcgaatggactgctacaaactcctagatgggatgagccgcaaagagtatgcgcgcttgaacaaatttgcggggtctttcgggtggacctgggccacatgagaagcttgcggctctttttcagcgacgaagcatgcacatctggacagctcgtcgtcgcttctcgagagagccagtataaagtgttccatttccatcacggtggccttgacaagctgtcggacgtgttccagcagtggaaatactgtacggaaatgcaactcaaggaccagcaggtcgcaccagataaaacctgcatgcagttcagtatacggagacctaaactaccttcctctgaaactcatcctgaggagtcaatgtacaaaagacttggcgtgtctgcctggttaaatcatttaaatgagctcgggcaggtggaggaggagtacaagctgaggaaagccattttttttggcggaatcgacgtttccattcggggagaggtgtggcccttccttctgcgctattacagccatgagagtacaagtgaggagagggaggcgctgaggctgcagaagaggaaggagtacagcgagattcagcaaaaaagactgtctatgacaccagaagagcacagggcattctggcggaacgtgcagttcaccgtcgacaaagacgtagtgagaactgaccgaaataaccagttttttcgcggggaagataacccaaacgtggagtcaatgcgaagaattctgctcaattacgcagtctacaatcctgcagtgggctattcccagggcatgagtgacctggtggcccccatccttgctgaggttctggacgagagcgacacgttttggtgctttgtgggactcatgcaaaacactattttcgtatccagcccacgcgatgaagacatggaaaagcagctgctgtacttgagggagctgctgcggttaacccatgtacgattctaccagcacctggtctccctgggcgaggatggcctccagatgctcttttgccaccgctggttactcctttgtttcaaacgcgaattcccagaggccgaggcccttcgcatttgggaagcgtgctgggcccattaccaaacggattactttcatttgtttatctgcgtggccattgtggccatttatggagacgatgtgatagagcagcagctcgccacagaccaaatgctgcttcacttcggaaatctcgcaatgcacatgaatggtgagctggtgttgcgtaaggctagaagccttctctaccaattcaggcttctgccaagaattccatgtagcctgcacgacctctgcaaactgtgcggcagcgggatgtgggatagcggtagcatgccagcagtagaatgtaccggtcaccacccgggttcagaaagttgcccatatggtggcacggttgaaatgccaagtccgaagtcccttcgagaaggaaaaaaaggccccaaaaccccacaggacggtttcggcttccggcggtag

SEQ ID NO: 33780 - DNA, 1218 bp, Artificial Sequence
  Description of Artificial Sequence: Synthetic coding sequence
atgaaggtggccccggataaaacttgcatgcagttctccatcagacggccaaaactgccaagttccgaaacccatccggaggagtcgatgtacaaacggctgggggtgagcgcatggttgaatcacttgaacgagctggggcaggtggaggaagagtacaaacttcgcaaagcaattttctttgggggaatcgatgtatccatccgcggggaagtgtggccgttcctgctacgatattatagccacgagtctacttcagaagaacgagaggcgctgaggctgcagaaacgcaaggaatatagtgagattcagcaaaaaagactgtctatgaccccagaagagcatagagcattttggaggaacgtgcagttcacagtcgacaaagatgtcgtgagaacagatagaaataatcagttttttcgaggggaggacaaccccaatgtggagagcatgagacgaatcctgttaaactacgctgtgtataacccagccgtgggctactcccagggaatgtccgatctggtggctccaattctggcagaggtactggacgaatcggacacattctggtgtttcgttggactgatgcagaataccatcttcgtgagttccccacgagacgaggatatggaaaagcagctgctctacttgcgggaactcctgcggctcactcatgtcaggttctaccagcaccttgttagtctcggagaggacggcttacagatgctgttttgtcacagatggcttctgctttgctttaagcgggagtttcccgaggccgaagctcttaggatctgggaggcatgttgggcccattatcagactgattacttccacctctttatttgtgtcgcaattgtggcaatctacggggacgacgtgatagagcagcaattagcgacggatcagatgctgttacattttggcaacttagccatgcatatgaacggagagctggtccttcggaaggccagatctcttctgtaccaatttcggctcctaccccgtattccatgctctctgcacgacctgtgcaaattgtgcggctctggaatgtgggactctggatccatgccagccgtcgagtgcaccggccaccatccaggttccgagagctgtccatatgggggcactgtcgagatgccttccccaaaaagcttaagagaaggaaagaaagggcccaagacacctcaggatggattcggattcagacgctag

SEQ ID NO: 33781 - DNA, 2154 bp, Artificial Sequence
  Description of Artificial Sequence: Synthetic coding sequence
atgggcgatcttcctccatatcccgagaggccagcgcagcagccccccggtagacggacctctcaagcaagtcagagacggcactcacgcgatcaagctcaggcactcgctgccgaccccgaggaacgtcagcagattccacccgacgcacagaggaacgcgcctggatggagtcagcgggggagcttatcccaacaggagaatttgctgatgccccaagtgttccaagcggaggaggcgagattaggtggcatggaatatccgtcggtaaataccggcttccctagcgagtttcaacctcaaccatactccgacgagtcaagaatgcaagttgcggagctgaccacaagcctgatgctccagcgtctccagcagggtcaatctagcctgtttcagcagctcgatccaacctttcaggaaccccctgtgaaccctctcggacagtttaacctgtatcagaccgaccaattttcggaaggagcacagcacggtccgtatatccgcgatgaccccgcattgcaattcctgccaagcgaactgggttttccccattacagtgcacaggtccctgagcctgagccactggagttagctgttcaaaatgctaaagcatatcttttgcagactagtataaactgcgatctttctctgtacgagcacttggtgaatctcctcacgaagatcctcaatcaacgcccagaggacccactgagtgtgcttgaatctttgaataggaccacccaatgggagtggttccatcccaagctggataccttgcgggatgacccagagatgcaacctacctacaaaatggcggaaaagcagaaggccttgtttacgagatctgggggcggaacagagggcgagcaggagatggaagaagaagtgggggaaaccccagtcccaaatataatggagacggccttctactttgagcaagctggggtgggactgtcttccgacgaaagcttccgcattttcctggccatgaagcaactcgtggagcagcagccaatccacacctgcagattctggggcaaaatccttgggattaaaagaagctatttggtggctgaggtagagttcagggaaggcgaggaggaggcagaagaggaggaagtggaagagatgacagaggggggagaagtcatggaggcacatggggaagaggaaggcgaagaggatgaggagaaggctgtggatattgtaccaaagtccgtgtggaaacccccacctgtaataccaaaggaggaatctcgtagcggagccaacaagtacctctatttcgtgtgcaatgagcctggcctcccatggacgcggttacctcacgttaccccagctcagatcgtgaatgcccggaagattaagaagttctttacgggttaccttgatacaccggtagtgtcatatccaccttttcctgggaacgaagctaactacctgcgagcacagatagcccggatctctgccgctacacaggtctcacccctcggattctaccagttcagcgaggaggaaggagacgaagaggaagaggggggcgccggtagagattcctacgaagagaatccagattttgagggaattcctgtcctggaactcgtagattctatggccaattgggtccatcacacacaacatattctgccccagggtcggtgtacctgggtgaacccgttacagaaaactgaggaagaggaggatctaggggaggaagaagagaaagcagacgagggcccagaggaggtggaacaagaggttggcccaccattgttaacacctctctccgaggatgcagaaatcatgcatttggcaccttggacgacccgcctttcatgtagtctgtgcccccagtacagtgtggctgttgtgcgctcaaatctgtggcctggtgcttatgcgtatgccagtggaaaaaagtttgaaaatatctacatcggttgggggcacaagtactccccggaaagcttcaatcctgcactgccagcccctattcagcaggagtacccgtccggacctgaaattatggaaatgagcgatcccaccgtcgaggaggaacaggcccttaaggctgcccaggaacaggctctgggggctacggaagaggaggaggaaggggaagaggaggaagaaggcgaggagacagatgattag

SEQ ID NO: 33782 - DNA, 1848 bp, Artificial Sequence
  Description of Artificial Sequence: Synthetic coding sequence
atggagggggccggatatagagataatgacgtgttgttgcactgggctcccgtggaagaggctggggatagtacacagatcctgttttctaagaaagattcttcagggggtgactcctgcgcatcagaggaagagccgaccttcgacccagattatgagcctgactgggcagtgatctcgacagtaagaccacagctttgccattctgaaccaactcggggcgcagagccaagctgcccccagggaagctgggcattctccgtctccttgggcgaactgaagtccattcggcgatccaagcctggcctgtcatgggcctatctggtgctcgtgactcaggcaggcggctccctccctgcattgcactttcatcgcggcgggacccgggcgctgctcagggttctgtcccggtacttgctgctggctagcagccctcaggattctaggttgtatctcgtgtttccacacgatagttcagcactgagcaattctttccaccacctccagctctttgatcaagatagctctaacgtcgtgtctcggttcctacaggacccctattccacaacattttctagcttcagcagggtgactaatttttttcgcggcgccctgcagccccagccggagggtgcagcgagcgaccttccgcctccacccgatgacgagcctgaaccaggcttcgaagtgatatcgtgcgttgagctcggaccccgcccaacagtggagcggggtcccccagtcacagaggaagaatgggcccgccatgttggcccagaagggcgactacagcaagtccctgaattaaagaacagaatttttagtggcgggcttagcccgtcactccgtcgggaggcttggaagtttctgctgggctatctgtcatgggagggcacagccgaagagcataaagcgcacatcagaaagaagacagatgagtactttaggatgaagttgcagtggaagtccgtgtccccagaacaggaacgcagaaactctctgctccacggttataggtctctgatcgaacgtgatgtcagcagaaccgatcgaaccaataagttttacgaaggccccgagaaccctggtctgggtctgctgaacgatatcctgctaacttattgtatgtatcactttgatcttggctatgtgcaggggatgtctgatctccttagcccgattctttatgtcatccagaatgaagtagatgccttctggtgcttctgcggatttatggagcttgtgcaaggcaatttcgaagaatcacaggagaccatgaagcgtcagttaggcagactgctgcttctgctgagagtcctggaccccctgctctgtgactttctggatagccaagattctgggagcctttgcttttgcttccgttggttactcatctggttcaagagggagtttccgtttccagatgtgttgcgcttatgggaggttctctggaccggcctgcccggacccaacctccacttgctggtggcttgtgccatcctggacatggaaagagataccctgatgctgagcggcttcggctctaatgagattctgaagcacatcaatgaactcaccatgaagctgagtgtggaagacgtgctcacacgggccgaggctctccaccgccagctcactgcatgtcccgaacttccccataacgtacaggaaatactgggtctggctccaccagccgaaccgcatagcccatcccccactgcgtcaccacttcctctgagcccaactcgagccccacccaccccgccgccaagtaccgacactgcgcctcagcccgacagttccctcgagattctgcccgaggaagaggacgagggagcagacagctag

SEQ ID NO: 33783 - DNA, 1581 bp, Artificial Sequence
  Description of Artificial Sequence: Synthetic coding sequence
atgctgcaggaagagagtgacctctcgctgatcattgcgcagatcgtacaaaaattgaaggggagcaatttgtactctcagttggagcgccaggcctgggcctcactgcaaaggcccgagatcaaactggaaagtcttaaggaggacatcaaggaatttttcaagatttctggatgggagaagaagctgcagaacgcagtctactctgagttaagtgtgttccccttaccatcccaccctgcagcccctccagaacacctgaaagagccattggtgtatatgagaaaggctcaggggtcatgggagaagaggattctgaaatcactcaattcaatgtgtacagagctatccatccctttggccagaaaacggcccgtcggcgagcagaaagagctgctcaataaatggaatgaaatgggaacagacgagcccgacctgtccttatttaggccggtgtatgcccctaaggactttctggaagtccttattaacctgcggaatccaaattacgagaacggggatagtctaagttttaggacccacttggggcttatccaggtgcctttgaaagtgaaggatatcccagagctcaaagaatgctttgtagagctggggctcaacataggtcagctgggtattgacgactccacacaggtgccgccagagctttttgagaacgaacacgtacggatcgggcagaaagtcttggcggagcaggactctgctgcagcccagcagtatattaggcaggggtcccccacagcattaagagccgaactctgggcactaattctcaatattagttctcaacctgaggacgttctctattacgagcagttaaagaccaatgtaattcaacatgacctactcgtggactccttgatctataaggatgtaaagttgaccgcctctaacgatgattactacttcgtgtttgaggattatttatatcaggtcctgctgtgcttttcccgagatacaagcgtgcttagtcatttcgcattcaattccgcctcacctcctaagtcgtacatcagagggaaactcggtctggaggagtatgcagtgttttatccccccaacggagttatccccttccacggcttctctatgtatgtggctcccctgtgctttttgtaccatgagccctcaaagttataccagattttcagagagatgtacgttcggttcttctttagattgcattcaatctcctcccacccttcaggaatagtgagcctctgcctgttgttcgagaccctgttacagacgtacctacctcaacttttttaccaccttagggagattggtgcccaaccactgcgtattagcttcaaatggatggtaagagcatttagcggctatcttgctaccgaccagctgctgctgctgtgggatcggattttgggatacaactccctcgaaatcctggctgtgctcgccgccgcagtgttcgcgtttagggcagttaatctgatggaagtgacctccctggccgcagcagaggccgtcttagccgatctctcaaccttgaaagttatgccactcttacaaatattcttattcgcaacagtgacatag

SEQ ID NO: 33784 - DNA, 1386 bp, Artificial Sequence
  Description of Artificial Sequence: Synthetic coding sequence
atgcttcaggaggaatcagatctcagtctcatcatcgcccagatcgtgcaaaaattaaagggatccaatttgtattctcagttggagagacaggcctggggatcttgggaaaagaggatcctcaagtcgctaaatagcatgtgcacagagctcagtatccccctggctagaaaaaggcctgtgggcgagcagaaggaattgctaaacaagtggaacgagatgggaactgatgagcctgatttgtccctcttccgtcccgtgtacgcacctaaggattttctggaggtgctcatcaacctgagaaatcccaattatgagaacggcgatagcttgtctttcagaacccacctgggcctgattcaggtgccactgaaagtcaaagatattcctgagctgaaagagtgcttcgtcgagctggggctgaacattgggcagctgggcattgatgatagtacgcaggtccctcctgagctgtttgaaaatgagcacgtgcgcattggacagaaggttctggccgaacaggacagtgctgccgctcagcagtacattcgccagggctccccgaccgcattaagagcagagctatgggccctcatattgaatataagctcccagcccgaagacgtcttatactacgaacagctgaagactaacgtgattcaacacgacctgcttgtcgactctcttatttataaagatgtgaagctaactgcaagtaacgacgactactatttcgttttcgaggactacctgtatcaggtgcttctctgttttagtcgggacacttctgttctctctcactttgcgtttaactcggcctcaccaccgaaaagctacatcagaggtaagcttggtctcgaagagtatgccgtgttctacccaccaaacggggtcattcctttccatggcttctccatgtacgtcgcacccctgtgttttttatatcatgagcccagtaagctataccagatttttagggagatgtacgtgagattcttttttcgactgcattccatctcatcacacccatctgggatcgtttccctttgtctgctgtttgagaccctgctgcaaacttatctgcctcagttgttttatcacctaagagaaatcggtgcacaaccgctgcgaatctcatttaagtggatggtgagagctttctctggatatctcgccacagaccagctactgctcctatgggataggattctgggctacaactcgctcgagattcttgccgtgctggctgctgccgtattcgcttttcgtgctgtgaatctgatggaggtgacgtctttggctgcggctgaggctgttttggccgatttatctacactgaaggtgatgcctctcctccaaatctttctctttgcaactgtcacctag

SEQ ID NO: 33785 - DNA, 1011 bp, Artificial Sequence
  Description of Artificial Sequence: Synthetic coding sequence
atgactacactgtcccctgaaaatagcctgagcgccagacagtctgccagctttatactcgtgaagcgcaagccccccatcgataagactgagtgggattccttctttgatgagtcaggccatttagctaaatcgagggattttatttgtgttaacattctggaacgggggctgcatcctttcgtgaggactgaggcttggaaatttttgactggctacttcagctggcagagctctcaagacgaacggttgacggtggacagtatgcggagaaagaattataaggcactgtgtcagatgtacgagaagatccagccactgctggaaaatctccaccgaaattttacggagacaaggaataacatcgcacgtgacatacagaagatttatgacaaagaccctttggggaatgtgctgatcgataagaagcgtcttgagaagattttgttactctcatatgtttgtaacacccaagcagaataccagcagggcttccacgagatgatgatgctgtttcagctcatggttgagcatgaccacgaaacgttttggctctttcagttttttcttcagaaaaccgagcactcctgcgtaattaacattggagtggccaaaaatctggacatgctgagtactctgattactttcctggatcccgtgttcgccgaacacttaaagggaaaaggagctggggcggtccaatccctctttccatggttttgtttctgtttccaacgagcgttcaaaagctttgatgacgtttggcgcctgtgggaggtccttctgactggcaagccatgcagaaattttcaagtgctggtggcctattccatgcttcagatggtaagagagcaagttctgcaggagtccatggggggagacgacattcttctggcttgcaataatctgatagacctggatgccgatgagttgataagtgctgcctgtgtagtgtatgctgaactgatccagaaggacgtgccccaaaccctcaaggatttttttttgtag

SEQ ID NO: 33786 - DNA, 903 bp, Artificial Sequence
  Description of Artificial Sequence: Synthetic coding sequence
atgactacgctgtcaccagaaaattccctcagtgcccggcagtctgcatcatttatccttggtctccatcctttcgtgaggaccgaggcatggaaattcctcaccggttatttttcatggcagagctcccaggacgagagactgaccgttgattcaatgcggcgaaagaactataaagccttgtgccaaatgtatgagaagattcagcctctgctggaaaatctacacaggaattttacagaaaccagaaacaatatagcccgagacatccagaaaatttacgataaggaccccctgggaaacgttctgatcgataaaaaacgattggagaaaatcctgctgttgtcctacgtgtgtaatactcaggcagagtatcaacaggggtttcacgagatgatgatgcttttccagttgatggttgagcacgaccatgagacattctggctgtttcagttcttccttcagaagacagaacacagttgcgtgattaatattggagtggccaagaatcttgacatgttgtcaacattgattacttttctggaccctgtatttgcggagcacctcaaaggcaaaggtgcaggcgccgttcaaagtctcttcccctggttctgtttttgcttccaaagggccttcaagtctttcgatgatgtttggcggttgtgggaggtattactaactggtaagccctgtcggaactttcaggtgctggtcgcctactctatgcttcagatggtgcgcgaacaggttctccaagaaagtatgggaggcgatgacattctactcgcatgcaataaccttatcgatctggacgccgacgagcttatatcagctgcttgcgtcgtgtacgcagaacttattcagaaagacgtcccccagactttaaaggatttctttctctag

SEQ ID NO: 33787 - DNA, 1554 bp, Artificial Sequence
  Description of Artificial Sequence: Synthetic coding sequence
atggccagtgacggcgctcggaaacagttctggaagcgatcaaatagcaagctgcctggaagcatccagcacgtgtatggcgctcaacacccccccttcgatcccctcctgcatggaactttgctgcggagtactgccaaaatgcccacaacaccagtcaaagctaagagggtatctactttccaggaattcgagagtaacacaagcgacgcatgggacgctggagaggatgacgatgagctgctagccatggccgccgaaagtcttaattcggaggtcgtgatggaaaccgccaatcgcgtgctacggaaccattctcaacgacaaggaagaccaaccctgcaggagggtccaggcctgcagcagaagcccagacccgaggccgaacctccctctccccctagtggggatttgaggttggtgaagtcagtgtctgagagccataccagttgtcctgccgaatcggctagtgatgccgcccctctacaaagatcccagtctttgcctcactccgcaacggttacgctgggcgggacttccgacccctctactttgagtagtagtgccctatccgagagggaagcttctcgccttgacaagttcaaacagctgctggcgggccctaacaccgatctcgaagagctccggaggctgtcctggtccggcatccccaagccagtgcggccaatgacatggaaactgctcagtggatacctccctgctaatgtcgacaggagacccgcaaccttacagcgtaaacagaaggaatacttcgcattcatagaacactactacgactcaagaaacgatgaggtccatcaggatacttaccgacagattcacatagacatccctcgaatgagtcccgaagcacttatacttcagccaaaagtaacagaaatttttgagcgaattctctttatttgggctattcggcacccagcatctggctatgtgcagggcataaacgatctggtgacgccatttttcgtagtgtttatttgcgagtacattgaggcagaggaagtcgacaccgtcgatgtcagtggggttccagcagaagtgctgtgtaatattgaagcagacacatactggtgcatgtctaaattgctggatggaattcaggacaactacacgtttgcccagcctgggatacagatgaaggtgaaaatgttggaggaactcgtcagtcggatcgatgaacaggtccacagacacctagatcagcatgaagtaaggtatctgcagttcgcctttaggtggatgaacaaccttctgatgcgtgaggtcccgctgagatgtacaattcggctgtgggacacctaccagagcgagcccgacggcttctcgcactttcacctctacgtgtgcgcagccttcttagttaggtggcgcaaggaaatcctcgaagaaaaggacttccaagagttgttactcttccttcagaatctgcccaccgctcattgggacgatgaggatattagtctgctcttagccgaggcatatcgactaaaatttgcttttgcagatgcgccgaaccactacaaaaaatag

SEQ ID NO: 33788 - DNA, 1320 bp, Artificial Sequence
  Description of Artificial Sequence: Synthetic coding sequence
atggcaagtgatggcgccaggaagcagttctggaaaaggtctaactcaaaactgccagggagtctactccgttctactgcgaaaatgcccaccaccccggttaaggcaaagagagtctctaccttccaagaatttgaatccaatactagcgacgcctgggacgcaggcgaggacgatgatgaattactggctatggccgcagaaagcctcaattcggaggtcgttatggagactgccaatcgcgttctgaggaatcactcacagcgtcagggtcggcctaccctacaggaagggcccggactgcaacagaagccgcggcctgaagccgagcccccctcacctccctcaggcgacctgaggctcgtgaaatctgtgtccgagagtcatactagctgtcccgccgaggaactgagacgcttatcctggtcaggtataccaaaacccgtacgccctatgacctggaaactactctccggctatctccctgcgaacgtcgatcgaaggccggccaccttacagcggaaacagaaggagtactttgcgttcatcgagcactactatgattcccgcaacgatgaagtccatcaagacacttataggcagattcacatcgacatccccagaatgagccccgaggctctgatattgcagcctaaggtgactgaaatttttgagcgaatcctgtttatttgggccatccgccaccccgctagtggttatgtgcagggcattaacgatctggtgactccttttttcgttgtgttcatctgtgagtacatagaagccgaggaagtggacactgtggatgtctctggggtacccgccgaggtcctctgtaatattgaagccgacacctattggtgcatgagtaagttgctcgacggaatccaggacaattatacgtttgcacagcctggtattcagatgaaggtcaagatgctagaggagctggtctcacgcattgacgaacaggttcacaggcacctcgatcagcatgaggtacggtacctgcagttcgcgttccgttggatgaacaacctgctgatgcgagaggtacccctgcgctgtaccattcgcttgtgggacacataccagagcgagccagacggctttagccacttccatctgtatgtgtgcgctgctttcctggtgcgctggcgtaaggagattttggaagaaaaagacttccaagaactgcttctctttctgcagaatctgcctacagcccattgggatgatgaggatatatcgctcctgttggcggaggcttaccgcctcaagtttgcgttcgctgatgctccgaatcactacaagaagtag

SEQ ID NO: 33789 - DNA, 975 bp, Artificial Sequence
  Description of Artificial Sequence: Synthetic coding sequence
atgccgacgacacccgtgaaggcaaagagagtttctacgtttcaggagtttgaaagtaacaccagcgacgcctgggacgccggagaagacgatgatgaactactggcgatggctgcagaatcactcaactccgaggtggttatggagacagccaaccgagttctgcgaaaccatagccaacggcaagggagacccacactacaggagggcccaggtctgcagcagaagccacgccctgaggcagaacctccttctcctccatcaggcgatctacggctcgtgaagtccgtgagtgagtctcacaccagctgcccggccgagtcggcgtccgacgctgcaccactccagagaagtcaaagccttcctcactccgccacagtcaccctgggaggcacctctgatccttccaccctgtccagttctgccctgagcgaaagagaagcatcgcgactggataagttcaagcagctactggcaggacctaacactgatctcgaggagctgaggcggctgtcctggtcaggcattccaaagcctgtgagaccaatgacttggaagctgttgtccggttatctgcccgccaatgtggatcgcaggcctgctactctacagagaaaacaaaaggagtacttcgccttcatcgaacactattacgactctcgcaacgatgaagtccaccaggacacctataggcagattcatattgacattcctaggatgtctcccgaggccttgatcctacagcccaaggtgacggaaatttttgagagaattcttttcatttgggccatcagacatcccgcgtctggttacgttcaagggatcaatgaccttgtcacccctttctttgtcgtctttatatgtgagtatattgcttttcctgggtgcggcaggccacagatcccaatcctggctgtcatttggcgagacgaaccatatcccaggactgacgaacaaatcattctccggcggtag

SEQ ID NO: 33790 - DNA, 1413 bp, Artificial Sequence
  Description of Artificial Sequence: Synthetic coding sequence
atgcctactaccccagtcaaggctaaacgtgtgagtacctttcaggaatttgaatctaacacgtccgatgcgtgggatgctggagaagatgatgatgaactcctcgccatggctgccgagtcccttaactccgaagtggtcatggagaccgccaatagggtcttacgaaaccacagccaacgccaaggcagacctacactacaggaaggccccggcttacagcagaagcctcgcccagaggcagaacctccttctccccctagtggcgatctccgcctcgtgaagagtgtttctgagtcacacacttcctgccccgccgagtcagccagtgatgccgcaccccttcaacgatcccaaagtttgccccattccgccactgttactctggggggcacttcagacccctcaacactctcctcaagcgcgttgtccgaacgggaagcttctcggctggataagttcaaacagctgctggctggccctaatacggatttggaagaactgcggcggctgtcttggtctggaattcctaagcccgtgcgcccaatgacttggaagttgctttctggctacctccctgccaacgtggatcgacgcccagccactctgcagcgcaagcagaaggaatattttgcatttattgagcactattacgacagccgcaatgatgaagtacatcaagatacctaccgccagatccacatcgatatccccagaatgtctccggaggctctgattctgcagccaaaggtcactgagatattcgagcgaatcttgttcatatgggccattcgtcatccagcatctggatacgtccagggcattaacgacttggttactcctttctttgttgtgttcatttgcgagtacatcgaagctgaagaggttgacactgtcgacgtcagcggagtgccggccgaggttctgtgtaacatcgaagcagacacctactggtgcatgtcaaagctgctggacggcattcaggacaattatacttttgcacaacccggcatacagatgaaagtaaaaatgctagaggaactggtttcgaggatcgacgagcaggttcaccgacatttggatcagcacgaggttaggtatttacagttcgcctttcgctggatgaataaccttctcatgagagaagtgcctctgagatgtaccataagactctgggacacataccagtccgagcctgacgggtttagtcactttcatttatatgtttgcgcagcttttttagtgagatggcggaaagaaattctcgaagagaaagattttcaggaactgcttctgttcctgcaaaacctccctaccgctcactgggatgacgaagatatttctcttctgcttgccgaagcctaccgcctcaaatttgccttcgcagacgctccaaaccattacaagaaatag

SEQ ID NO: 33791 - DNA, 1377 bp, Artificial Sequence
  Description of Artificial Sequence: Synthetic coding sequence
atggcatccgacggggcacggaagcagttctggaagaggagtaacagcaaactgcctggctctatccagcacgtgtatggagcccagcacccgcctttcgatcccctgctgcacggcacactactacgaagcacggccaagatgcctactactccagttaaggccaagcgggtgagcacctttcaggaatttgagtccaatacatcggatgcatgggatgctggggaagacgacgatgaattgctcgcaatggcggccgaaagcctgaattccgaggtggtgatggaaaccgctaatcgcgtgttgcgcaaccactcccagcgccagggtcgaccgacattacaggaagggcccggcctgcaacagaagccaaggcctgaggccgagccaccatccccgcctagcggagatcttagactggtaaaaagcgtttctgagagtcatacgtcctgtcccgccgaggaattgcggcggctttcctggagcggaattcctaagcccgtccggcctatgacctggaaactactttccggctatctacccgccaacgtggacagacgccccgctacgctgcaacgaaagcaaaaggagtacttcgctttcatcgagcattactacgactccaggaatgatgaagtgcaccaggatacttacagacaaatccacattgatattccgagaatgtctccagaagcactcattctacagcccaaagtaaccgaaattttcgagcgcatcctgtttatttgggccattcgtcatccagcctcaggttacgtgcaaggtattaacgaccttgtcacccctttctttgtggtatttatatgtgagtatattgaagcggaggaggttgatactgtcgacgtgagcggggtccctgcagaggtattatgtaacatagaagcagatacctactggtgcatgagtaaactcctcgacgggatccaggacaactatacgttcgctcagcctgggatccagatgaaggtgaagatgctggaagagctggtgtcacgaatcgacgagcaggtgcacaggcacctggaccagcacgaggtgagatacctgcagttcgcatttagatggatgaacaacctgctgatgcgcgaggttccgctgaggtgtactataagactgtgggatacgtaccaatcggagcccgatggctttagtcattttcatttgtacgtgtgtgccgcatttctcgttcgatggcgaaaggagattctggaagaaaaagacttccaggagcttctgctcttccttcagaacctccctactgcccactgggacgatgaggacatcagccttttgctggccgaagcctatcgcctgaaatttgcctttgctgacgcgccaaatcactacaaaaagtag

SEQ ID NO: 33792 - DNA, 1518 bp, Artificial Sequence
  Description of Artificial Sequence: Synthetic coding sequence
atggccgccgagaattccaagcaattttggaaacgaagcgccaagttgccaggctccatacaaccagtgtatggcgcccagcatccgccacttgacccccgactgactaagaatttcattaaggagaggagcaaggtgaacacagtacccctcaagaataagaaggcgtcgtcatttcacgagtttgcaagaaatacgagcgatgcatgggacataggagacgacgaagaggaggactttagctctccttcatttcagacactaaacagcaaggttgccctggctacagccgcgcaggtgctggagaaccactcaaagctgcgggtaaaacccgagaggagccagagtacgaccagtgatgttccagccaattataaagtcattaagagcagtagcgacgcacagctttcgagaaacagttccgacacttgcctgagaaacccactacacaagcagcaatccctgcctcttcgacctattattccactggtcgccagaatctccgatcaaaacgcaagcggagctccgccaatgacagtgcgagaaaagaccagactggaaaagttccgccaactgctgtccagtcagaatacagaccttgacgagctccgtaaatgctcttggcctggagtgcctagagaagtgaggcccattacctggaggctgctgagcggctacctgccagcgaacaccgagcgccgtaaattaacgctccagaggaagagagaagagtactttgggtttatcgaacaatattacgacagccgcaacgaggagcatcaccaagacacatacagacaaatccacatagatattccacgcactaatcctttaattccactcttccagcaacccctcgttcaagagattttcgaacggatcctcttcatctgggccatccggcacccagcctccggatacgtgcagggaatcaatgatctggtaactccattcttcgtagtgttcctgtctgaatatgtggaggaggatgtcgagaactttgatgtcacaaatctctcccaggatatgctgagaagcatcgaggcagacagcttttggtgtatgagcaagctcttggatggtatacaagataattataccttcgcacaacccggcatacagaagaaggtgaaagccctggaggagttggtatcacgaatcgatgagcaggttcacaaccactttaggaggtacgaagtggagtaccttcaatttgcgtttcggtggatgaataatctgctgatgcgcgaattgcccctgcgctgtaccatccggttgtgggacacctatcagtctgagcccgagggcttctctcattttcacctgtacgtgtgcgctgcatttctcattaagtggagaaaggagatccttgatgaggaagatttccagggactgctgatgcttcttcagaatctgcctacaattcactggggaaatgaggagatcgggttacttctcgccgaggcctacagattgaagtatatgtttgccgatgctccgaatcactatcgtaggtag

SEQ ID NO: 33793 - DNA, 2055 bp, Artificial Sequence
  Description of Artificial Sequence: Synthetic coding sequence
atggcagaaggcgaagacgttcctcccctgccaaccagcagtggtgacggctgggagaaggaccttgaggaagccttggaagctggcggatgtgatctcgagacattgaggaacatcatccaggggagacccttgcccgcagatctgagggcaaaagtatggaaaatcgcgctgaacgtagctggaaaaggcgattctctcgcctcatgggacgggatcttagacctgccagagcagaacacaattcacaaggactgcctgcagtttatcgaccagttgtcagtaccagaggaaaaggccgccgagcttctgttagacattgagagcgtgataactttctactgcaagtctcgaaatattaaatattccaccagccttagctggatccatctcctcaagccattggtccatttgcagttacctcgtagtgatctgtacaattgcttctacgctatcatgaacaagtacatccctcgggattgcagccagaagggcaggccttttcacttgtttagactgttgatccagtaccacgaacccgagctgtgttcgtatctggacaccaagaagatcactccagacagttacgccctgaactggttgggctccctgtttgcctgttattgttccacggaagtgacgcaggctatctgggatggctatctgcagcaggccgatcctttctttatctatttcttaatgctcattattctggtgaacgctaaggaggtgatcctgacccaggagtcagacagtaaagaagaggttatcaagttcctagagaacactccctccagcttaaatattgaggatattgaggacttgtttagcctggcgcagtattactgttctaaaacccctgcgtcattccggaaggacaaccaccaccttttcgggtccacattgttgggcatcaaggacgacgacgccgatctgagccaggcgctttgtctggccatctcagttagtgagatcctgcaggcaaaccaactgcaaggagaaggggttaggttcttcgttgtggactgtcggccggcggaacagtacaacgctgggcacctatccactgccttccacctcgacagcgacctcatgcttcaaaacccgagcgaatttgctcagagtgtaaaaagtctgctggaggcacagaagcagagcatcgaatcaggttccatagcgggtggcgaacatctgtgcttcatgggatccggcagggaagaggaagatatgtatatgaatatggtacttgcacacttcctgcagaagaacaaggaatatgtctccattgctagtggcggattcatggccctgcagcagcacctagcagacatcaacgtagacggtcccgaaaatgggtatggccactggatcgcctcaacctcagggtcacggtccagtataaattctgtagacggtgagagccctaatggtagttctgaccgaggcatgaagagtctggtaaataaaatgaccgtcgcccttaagaccaagagcgtgaatgtgagagagaaagtgatcagcttcatcgaaaacactagtactccggtcgaccgccatgtgtccagcagtgatcgcgttggaaagccgtatcgcggggtcaagcctgtgttctccatcggagacgaagaggagtatgacaccgatgagattgactccagtagtatgtccgatgacgacagaaaggaggtggttaacatccagacttggatcaataaaccggacgtgaaacatcacttcccgtgtaaggaggttaaagaatctggccacatgtttccctctcatctcctggtgactgcaactcacatgtattgcctgagggaaattgtgtcccggaagggacttgcctatatccagtcgcgccaagccctgaattcagtggtaaagatcacatccaagaaaaagcaccccgagctgatcacgtttaaatacggtaacagcagcgcctctgggattgagatcctggctatcgaacgctatttaatccccaacgccggggatgccactaaggctattaaacaacaaatcatgaaagtgctcgatgccctggagagctag

SEQ ID NO: 33794 - DNA, 2100 bp, Artificial Sequence
  Description of Artificial Sequence: Synthetic coding sequence
atggcggagggtgaggatgttccacccttgcccacctccagtggggacggatgggagaaagacctggaagaagctctagaggcagggggttgcgacctggaaacactgagaaacattatccagggtcgccccctgcccgctgatctcagagccaaggtctggaagattgccctcaacgttgctggcaagggtgacagtctggctagctgggacggaattctggatctgcctgagcagaatacgattcacaaagactgtctgcagtttattgaccaactgagtgtgcccgaagaaaaggcggctgagctcctgctcgatatagagtcagtcataactttctattgcaagtcccggaacattaagtactcaaccagtctgtcctggattcatcttctcaagcccctggttcacctccagttacctagaagcgacctgtacaactgcttctacgcaataatgaacaagtatatccctagggactgctcgcagaaaggcaggccatttcatttgtttcgactgttaattcaataccacgaacccgagctctgctcttatctggataccaaaaaaataactccagactcttacgcccttaactggttgggttcactctttgcctgctattgcagtaccgaggttacccaagccatatgggacggctatctgcagcaggccgatccctttttcatttactttttgatgcttattatattggttaacgctaaggaagtgattctcacacaggagagcgactccaaagaggaggtgataaagttcctagagaatactccttccagtctcaatatcgaagacatcgaggacctgttctcactagcccaatattattgcagtaagacgccagcatctttcagaaaagataaccaccatctgtttggctccaccctactgggtattaaggatgatgatgctgacctgtcacaagccctatgcctagccattagcgtcagtgagattctccaggctaatcaactgcaaggtgaaggagtcagattctttgtggtcgactgccggccggcagaacaatacaatgcaggccatttgtcaaccgcatttcacttagactctgacctgatgctccagaatccttctgagtttgcacaatccgtgaagtcgctcttggaagcacagaagcagtccatagaaagcgggagtatcgccggcggcgaacatctgtgtttcatgggttcaggacgcgaggaggaagatatgtatatgaacatggtgttggcccactttttgcagaagaacaaagaatacgtttctatcgcgtcaggagggttcatggctcttcagcaacatctagcggatatcaatgttgatgggcccgaaaacggctatggccattggatcgcatcaaccagcgggtctaggtcgagcatcaactcagtggacggtgagtcgcccaacggctcgtctgatagaggtatgaaaagcctggtaaataagatgacagtggcactgaaaaccaaaagtgttaacgttagggagaaagtgatctccttcatcgagaatacatccactccagttgatcgaatgtcattcaacctcccatggccggacagaagctgcaccgagcggcacgtctcctcctctgatagagttgggaagccgtatcgcggtgtgaagcccgtctttagcattggcgacgaagaagagtacgacactgacgagatcgatagtagttccatgtcagatgatgacagaaaggaggtggtcaacatccaaacgtggatcaacaagccagatgtgaaacaccatttcccttgcaaggaggtgaaggagagtggacacatgtttccgagccacctactagtgaccgccactcatatgtactgcctgagagagattgtgtcccggaagggattggcatatatccagtcccgacaagctctgaattctgtggttaaaatcacatctaagaaaaaacacccggagctcatcacatttaaatacggcaacagcagcgcgtccggaattgaaattctggccatcgagcgttaccttatcccaaacgcaggcgacgcaacaaaggccatcaaacagcagatcatgaaggtactggatgcactggagagctag

SEQ ID NO: 33795 - DNA, 1689 bp, Artificial Sequence
  Description of Artificial Sequence: Synthetic coding sequence
atgggttggtactttcgcctagcaagaaccgaacattattcccagcggctccccgcggtgtattgggactgcagtcagaaaggaaggccattccacctgtttaggcttttaattcaataccacgagcctgagctgtgttcctaccttgacaccaagaaaattacccctgacagttacgccctgaattggctgggctctctgttcgcttgctactgctctacagaggtgacccaagccatatgggacgggtacctgcagcaagccgaccccttttttatctactttctaatgttgatcatcctcgtaaacgccaaggaggtgatcctaacacaggagagcgatagcaaggaagaagtgataaaatttctggagaacactcctagctcacttaatattgaagatattgaggacttgttcagcctcgcccaatattattgctccaaaacaccagccagctttaggaaggataaccaccatctgtttggaagtaccctgctgggcatcaaagacgacgatgccgacctgagccaggccctctgtttggcgatctcagtgagtgagattttacaagcaaaccaactgcagggggaaggggttcggtttttcgtggttgattgtaggccagccgagcaatataacgctgggcacctgtcgaccgctttccacctggattccgatctgatgctgcaaaatccatcagaatttgcccagtcagtcaaaagccttctcgaagcccagaagcaatctatagaaagtggcagcatagccgggggcgagcacctgtgtttcatgggatccggacgtgaggaagaggatatgtacatgaatatggtattagctcacttcctccagaaaaacaaggaatatgtgtccatcgcttccgggggatttatggccctccagcagcacctagcagatatcaatgtggacggaccagagaatggttacgggcactggattgcctccacttctggtagtcggagtagtataaacagcgttgatggcgagtcaccaaatggctccagtgaccgggggatgaagtcattggtcaataagatgacagtggcacttaagactaagtccgtgaacgttagagagaaggtcattagtttcattgaaaacacaagtacccctgtggatcgtatgagtttcaatctcccctggccagatcggtcatgtacagagcgccatgtgagcagtagtgatcgggtaggcaagccatatagaggggttaaaccagtcttctccattggagatgaagaggagtacgacacagatgagattgacagttccagtatgtccgacgacgaccgcaaagaggtcgtaaacatccagacctggatcaataaaccggacgtgaaacatcacttcccctgtaaggaagtaaaggaatcaggtcacatgttcccctctcacctccttgtgaccgcaacccatatgtattgcttgcgggaaattgtgagcagaaaaggactggcgtacatccaatcgaggcaagcactgaatagtgtagtgaagataacctctaaaaagaagcaccccgagttaatcacctttaagtacggtaattcatcagccagcggaatcgaaatcctggctattgaacgatatctcatccccaacgcaggggatgccacaaaagctatcaagcagcaaatcatgaaggtcttggacgctctggaatcttag

SEQ ID NO: 33796 - DNA, 753 bp, Artificial Sequence
  Description of Artificial Sequence: Synthetic coding sequence
atggagatggacggcgatccctacaatctgccggctcaagggcagggcaacattattatcacgaaatacgagcagggacatagggcaggtgccgccgtcgacctgggacacgagcaggtggatgtgcggaaatataccaataatctgggcatagtacacgaaatggagctgccccacgtctcagcgctggaagtgaagcagcggcggaaagagagcaagagaactaataagtggcaaaaaatgctggcggactggacaaaataccgctccaccaagaaactgtcccagagggtctataaggtgattcccctggcagttaggggacgagcttggtctctgttgcttgatatagataggattaagtcccaaaacccaggcaagtataaggtcatgaaagagaaaggaaagaggagcagtcggatcattcactgtatacaactggacgtttcacatacattacagaagcatatgatgttcatccagcggttcggcgtcaaacagcaggagctctgtgacatactggtggcctacagtgcctataaccctgaagtagggtatcaccgagatttgtcgcgcattactgccattcttctgttgtgtctgcccgaggaggatgcgttctgggccttgactcaactgctagctggagagcgccactccctgtggtattcaactgcgcagatcctgccaggcagccgtggctcctaccgcacgcgcagccggtgctgcacaagcccgtcccagagatcctag

SEQ ID NO: 33797 - DNA, 633 bp, Artificial Sequence
  Description of Artificial Sequence: Synthetic coding sequence
atggagatggatgaggaccccgataacctgccagcccagggccagggcaatataattatcaccaagtatgaacaggggcacagagctggtgctgctgtggacctcggtcatgaacaggtcgacgttagaaaatacaccaacaatctcggcattgtgcacgagatggagctgcctagagtatccgctctggaggtgaagcagagaagaaaagaaagcaagcggacaaataagtggcaaaaaatgctggcagattggacaaagtaccgctctactaaaaagctgagtcagagagtttgcaaggtgattccattggcagtgcgggggagggctctttctctgctgctcgatattgacaaaatcaaatcccagaaccccggcaaatacaaggtgatgaaagagaaaggaaagcgctcctcacgcatcattcattgtatacagttggacgtgagccacacccttcaaaaacacatgatgttcattcaacgctttggcgtgaagcagcaggaactgtgcgatatacttgtcgcttacagcgcatacaaccctgtttcaatcccaggtcagcgatatagctggtacctctgtccttatagtcaggcctgggtaagcctgggcggcgtggcaactagttag

SEQ ID NO: 33798 - DNA, 633 bp, Artificial Sequence
  Description of Artificial Sequence: Synthetic coding sequence
atggaaatggatgaggaccccgataatctgcctgctcagggccagggtaatataataattacaaaatacgaacagggccatagagccggtgcagctgttgacctgggtcacgagcaggtcgacgtcaggaagtatacaaacaacctgggcattgtacacgagatggagctgccccgcgtgagcgctctggaggtgaaacagcggcggaaggaaagtaaacgtactaacaagtggcagaaaatgctcgccgattggacgaagtaccggagtacaaaaaagctttcccagcgcgtgtgcaaggtcattcccctggctgtgagggggcgcgctctctctctacttctcgatatagacaagataaagagccaaaaccccggcaagtacaaagtgatgaaggaaaagggaaagagatctagcagaattattcattgtatccagctggacgtatcccatactctgcagaaacacatgatgtttattcagagatttggagtaaaacagcaggaactgtgtgacatactggtggcatattccgcctataatcctgtgtctatccctggacaacgttactcttggtatctgtgcccgtatagtcaggcttgggtctccctcggaggcgttgctacttcatag

SEQ ID NO: 33799 - DNA, 453 bp, Artificial Sequence
  Description of Artificial Sequence: Synthetic coding sequence
atgggccacctggataaggagggactgtgcacccagggttcatctttctcctggctcctcagagtgcttaatgacggaatttcacttggactcacaccctgcttatgggacatgtatttgctagagggagaacagatgcttatgctgatcacttcaattgccttcaaagttcaacgctctctctatgaagaaacaaacaaagagacttggggaccagccacccctagggcactcaaagggaccggaagagccagacccatttgtgaatcactgcatagctcactacaggctctcaccgcctccgaatcctctagagggccttccttgctccagacaccacctcgggtgcctggtcagcaggctttgtcaagaggagacaaaggcatttcggtgtcactctcacttccttcgctccccagtagacggggaagatgcgggcggatcattggatag

SEQ ID NO: 33800 - DNA, 246 bp, Artificial Sequence
  Description of Artificial Sequence: Synthetic coding sequence
atgggccatctggacaaagaagggttatgcacacagggaagttcattttcttggttgctccgcgtgcttaacgacggaatctcactgggtctgaccccctgcttgtgggatatgtacctgctcgagggtgagcagatgctcatgcttatcactagcattgcatttaaggtccagaggcggccatcaagagccctggaggaaccggaccctttcgtgcgagcgtccacccccccctgcaagagatag

SEQ ID NO: 33801 - DNA, 2892 bp, Artificial Sequence
  Description of Artificial Sequence: Synthetic coding sequence
atgcccggtgctggagcgcgtgccgaggagggaggggggggaggagagggggccgcccaaggagccgccgcggaaccgggagccggccccgcaagagagcccgccaggctctgtgggtatctgcagaagctatcgggcaagggcccactacgcggatataggtcccgatggttcgtattcgatgcgcggaggtgctatctctattactttaaaagcccacaggatgccctccccctgggtcatctggatattgctgatgcctgcttctcttaccagggccctgatgaagcagctgaacctggtacagagccaccagcacacttccaagtgcactctgctggcgccgttacagtcctgaaagcccctaacaggcaacttatgacatactggctgcaggaactgcagcagaaacggtgggagtactgtaatagtctggacatggtgaagtgggattctcgcacctcacccaccccaggcgacttcccaaaaggcctcgtggctcgagacaacacagatctcatttaccctcatccaaacgctagtgcagaaaaagcacggaacgtgctcgcagtggaaactgtcccaggcgagcttgttggggagcaggccgcaaaccaaccagcgccgggacatcccaatagcatcaatttctactcccttaaacaatggggtaacgaacttaagaacagcatgagctcttttcgacctggacggggtcacaacgattcgcggcgcacagtgttttataccaatgaggaatgggaactgcttgacccgacaccaaaggatctggaagaatccattgttcaagaggaaaagaagaaattgacccctgagggaaacaaaggagtaaccggaagcggattcccttttgacttcggccgtaacccgtacaagggcaagcgtccgttgaaggatatcatcggatcctacaaaaatagacatagcagcggagaccctagcagcgaaggcacatccggtagcggcagtgtctcgatccgcaaacctgcctctgagatgcagctgcaggttcagtcgcagcaggaagaactggaacagctaaaaaaggatctcagttctcagaaagagcttgttcgcctgttacagcagaccgtccgaagttcacagtacgacaaatactttacaagcagccgtctttgcgagggagtccccaaggataccctagaactccttcaccagaaagatgatcagattcttggattaacgagccagctggagcggtttagcctcgagaaggagtcattgcaacaggaagtacggactctaaaaagcaaggtgggagaattgaacgaacagttgggtatgctgatggagacaatccaggcaaaagatgaagttatcataaagttgtccgagggagagggtaacggcccccctcccactgtggcaccttcttcgccgtccgtggtgcccgtggctcgtgaccagctagagctggacagattgaaagacaacctacaggggtacaagactcagaacaagttcctcaataaggaaattttagagctgtccgccctgcggagaaacgcagaacgtagagagagggatctcatggccaagtattcctcactggaagccaagttgtgtcagattgagtctaagtaccttatcctgctgcaggagatgaagacccctgtgtgctcagaagatcagggtcctacaagagaagtgatcgcccagttgttagaagacgcccttcaggtggaatcacaggaacagcctgaacaggcgttcgtcaaaccacacctcgtgagcgaatatgatatatacggttttcggacagtccctgaggatgatgaggaggagaaactggtggcgaaggtgcgggcgctcgatctaaagaccttgtatctgaccgaaaatcaggaagtgagcacgggggtcaagtgggagaactactttgcctctaccgtgaacagagaaatgatgtgctccccagaactgaagaatttaatcagagctgggataccacacgaacacaggtcgaaggtgtggaagtggtgcgtcgacagacatacacgaaagttcaaagataatacagagcccgggcatttccagaccctattgcaaaaggccctggagaagcagaatccggcgtccaaacaaatagaacttgacctgctgagaaccctgcctaataacaagcattactcttgccctacctcagaggggatccagaaactccgtaacgttctgctcgccttcagctggcgaaaccccgacattggctactgccagggacttaatcggcttgtcgccgtggctctgctatatttggagcaggaggacgcattttggtgtttggtgactattgtggaagtgttcatgcctagggactactacaccaagactctacttggcagccaggtcgatcagagggtgtttcgcgatctaatgtccgaaaaactccccaggttgcatgggcacttcgagcagtacaaagtcgactataccctaatcactttcaactggtttttggtggtgttcgttgactccgtggtctcagacatcctgttcaagatatgggattccttcctgtatgagggacctaaggtcattttcagatttgctttagcactctttaagtataaagaagaggagattctgaaactccaggattcaatgtccatctttaaatacctcagatactttactcgcaccatactggacgctagaaagcttatcagcatctcctttggcgatctgaaccccttccccctcaggcaaataagaaatcggcgagcttaccatctggaaaaagtaagactggaactcaccgagctggaagcgatccgcgaggactttttacgggagcgggatactagtcccgacaaaggggaactagtcagcgacgaggaggaagatacttag

SEQ ID NO: 33802 - DNA, 2745 bp, Artificial Sequence
  Description of Artificial Sequence: Synthetic coding sequence
atgcctggagcaggcgcacgcgccgaagagggtgggggcggaggcgaaggcgccgcacagggagcagctgcggaacctggcgctggtcccgcccgagaaccggcaagattgtgtggttatcttcagaagctgagcgggaagggcccgctgaggggatacaggtccaggtggttcgtgttcgacgcacgaagatgttacctgtactactttaaatctccacaagacgccctgcccttagggcatttggacatcgctgacgcttgctttagttaccagggtccagatgaagctgctgagcctggcacggagccccctgctcatttccaagttcactctgccggggcggtgacggtgttgaaggctccaaacaggcagttaatgacgtattggttgcaggaactccaacagaagcggtgggaatattgcaactcactagatatggtgaaatgggactctcgaacgagccctacgccgggtgatttccctaaagggttggtggctcgagacaacacggatctgatttacccacaccccaatgcctcggctgaaaaagcccgaaacgtgctagcggtcgaaaccgtgccaggcgagttagtcggggaacaagcagcaaaccagccagcccccggccatcccaacagtataaacttttattccctcaaacaatggggtaatgagctcaagaactcaatgtccagttttagacctgggcgcggtcacaacgactcgcgtaggacagtgttctacaccaacgaggaatgggagttattggatcccacaccaaaagatctcgaggagtcgattgtacaggaggagaagaagaagttgacgcctgaaggcaataagggcgttactggttcaggatttccctttgattttggcaggaacccctataaaggcaagaggccactaaaagatataatcggctcatacaaaaataggcactccagcggggacccgagtagtgaaggtacatcgggtagcggtagcgtgtctatcaggaagccggctagtgagatgcagctgcaggttcagagccaacaagaagagctcgaacagcttaagaaagatctgagcagccagaaggagctggtgcggctgctgcagcagacagttcggtcttcacagtatgataagtattttacatcctctagactatgtgagggagtgcccaaggatacactcgagctgttgcaccagaaagatgaccaaatcctgggcctcacgtcccaactggaacgcttctctcttgaaaaagagtcactgcaacaggaagtgcgtacacttaagtccaaggtgggcgaactgaacgagcagcttggtatgctgatggaaaccattcaggctaaggacgaagttataatcaaactgagtgaaggcgagggtaatgggcctccccccaccgtagccccttcttcgccttctgtggtcccagtagcacgagaccagttagaactggatcgcctgaaggacaaccttcaggggtataagacccaaaacaaattcctcaataaggagatactagaacttagcgcactcaggagaaatgccgaacggagagagagagacctcatggctaaatactcaagcctagaggccaaactttgccaaatagagtccaagtacttgatcctcctgcaggagatgaaaaccccagtctgtagcgaggaccaggggccaacacgtgaggttatcgcccagctgctggaggatgctctgcaggtcgaatctcaagaacagcctgagcaagcgttcgtaaagcctcacctggtttcagagtacgacatttacggtttccggaccgtgcccgaagatgacgaagaggaaaagctggtggcgaaggtccgggcattagatctcaagaccttatatcttacggagaatcaagaagtatcaaccggcgtcaaatgggaaaactacttcgcctctaccgtgaatagagaaatgatgtgctccccagaactcaagaatctgatcagagcaggaatcccccacgaacacaggtccaaagtctggaagtggtgtgtggaccgacatacacgcaaatttaaagacaacactgagcctgggcacttccagacacttctccaaaaggcattggagaagcaaaacccagcgtccaagcaaatcgaactggatctgctgcgcactctgcccaacaacaaacattatagctgtccaaccagtgagggaattcagaagctgcgcaacgtactccttgcttttagttggcgaaatcctgacatcggatactgtcagggcctaaacagactcgtagctgtggctctgctgtacctcgaacaggaggacgctttctggtgcctcgtgaccatagtggaagtgttcatgcctagggactactataccaagacactcctgggctcccaggtcgaccagagagttttccgcgacttgatgtccgagaagctgccaaggttgcacggacattttgagcagtataaagtggattacacgctgatcaccttcaactggtttttagttgtgtttgtggattccgttgtgtccgatatcctgttcaagatctgggattcctttctgtacgagggaccaaaggtcatcttccgctttgcccttgcactatttaaatataaggaagaagagatcctaaagctccaagattcaatgtcgatcttcaagtaccttcggtacttcacccgcactatcttggacgctcgatctggtacagacgcgcctactacatggagaaaatctggatggtcatag

SEQ ID NO: 33803 - DNA, 768 bp, Artificial Sequence
  Description of Artificial Sequence: Synthetic coding sequence
atggtgctcgaactgaacgcttctgatgaccggggcatcgatatcattcggggccctatactcagtttcgcatccacccgcactatctttaaaaagggcttcaagctggtaatattggacgaagctgatgctatgacacaggatgctcagaatgccttacgccgagtcattgaaaaattcacggaaaacacccgattttgtctgatctgcaattatctcagcaagatcatcccagccctacaatcacgttgcacccggttccgcttcggccctttgacccccgagctcatggtgccccgcctggaacacgtagtcgaagaggagaaagtggatatttcggaggacggcatgaaggctctggttacactgtcatccggcgatatgaggcgtgccctgaatatattgcaatccaccaatatggccttcgggaaagtgactgaagaaaccgtgtatacttgtactgggcaccccctgaaaagcgatatcgcaaatatcctcgattggatgctgaatcaggatttcactacggcttataggaacatcactgaattaaagacactcaagggcttggccctacacgatattcttaccgagatccatttgttcgtacatcgcgttgattttccatcttctgtacgaatccatctgttgaccaagatggcagatatcgaataccgcctcagcgttggaaccaacgaaaagatccagctcagttcccttatagcagctttccaggtcacgagggacctgatagtggccgaggcgtag

SEQ ID NO: 33804 - DNA, 1734 bp, Artificial Sequence
  Description of Artificial Sequence: Synthetic coding sequence
atgcggcaggacaaactcacaggctctctgcggagaggtggccgttgtctaaaacggcagggcgggggcgtagggaccatcctgtccaatgtactgaagaagcggagctgtataagtcgaacggcccctcgccttctgtgcacactggagccaggcgtcgacactaaactgaaatttacgctggaaccctctttggggcagaacggttttcagcagtggtatgatgcactgaaagctgtcgctagacttagtacaggaattccgaaggaatggcgacgcaaggatctgcatcgcaccgggtgctcttcttactgtggacaggaggccgagcaagatagggtcgtccttaaaagagtgctgttggcctatgctcgctggaacaaaaccgttggctactgccagggcttcaatattctcgctgctctaatcctcgaagtgatggagggcaatgagggagacgccctcaaaattatgatctatctaatcgacaaggttctgcccgagtcctattttgtgaacaaccttcgtgctctgtctgtggatatggctgtgtttagggacttgctccggatgaaattacccgaactttcccagcacttggacaccttgcagcgcaccgctaacaaggagtccggaggtggctacgagcctccacttacaaacgtgtttacaatgcagtggttcctaacgttgtttgcaacttgccttcccaaccagacagttctcaagatctgggattcagtgttttttgagggctctgagatcatcctgcgcgtttcactggcgatctgggcaaaacttggcgaacaaattgagtgttgtgagacagctgatgagttctactccacaatgggcaggctcacgcaggagatgttggaaaatgacctgctgcagagccatgagcttatgcaaaccgtttattcaatggcaccattcccttttccccagctggccgaattgagggagaagtacacttataatattactcccttccccgccaccgttaaacctacctccgtgtctgggaggcactctaaggctcgtgactcagatgaggaaaatgatcctgatgacgaggacgctgtggtgaatgccgtcgggtgccttggcccgttctcgggatttttggcccccgaactgcaaaagtaccagaaacagattaaggagcccaacgaggaacagtcgcttcggtccaacaatatcgcggagctatcaccaggggcaatcaacagttgtcgaagcgagtatcatgcagcattcaattccatgatgatggagaggatgaccacagacattaacgccctaaagaggcagtactcacgaattaaaaagaaacaacagcagcaggtccaccaggtttacataagggctgataagggcccagttacctcaatacttcctagccaggtaaacagttcacctgtgatcaatcacttgttactgggaaaaaaaatgaagatgaccaatagggcagctaagaatgctgtgatacacattcctggccatactggagggaagattagtcctgtgccttatgaagatctgaaaacaaagctgaatagcccttggcggacccacatcagagttcataaaaagaacatgcccagaactaaatcccatcctggctgcggggataccgtaggtctgattgatgagcagaacgaagccagcaagaccaatggattaggcgccgccgaggcattcccttccgggtgtactgcaggtcagggctag

SEQ ID NO: 33805 - DNA, 1914 bp, Artificial Sequence
  Description of Artificial Sequence: Synthetic coding sequence
atgagacaggataagttaacgggctcattaaggaggggaggtcggtgtctgaaaaggcagggaggaggcgtggggacaatcctatcgaacgtgcttaaaaagcgtagctgtatctcccggacggcgccaagacttctgtgtactctggagcctggcgttgacaccaagctgaaattcaccctagaaccaagcctcgggcagaacggattccaacagtggtatgacgccctgaaagcagtggcgaggctgagcaccggcataccaaaagagtggagacgcaaggtgtggctgacactggccgaccattacctgcacagtattgccattgactgggacaagacaatgagattcacattcaatgagaggtccaatcccgacgatgattctatgggaatccagatcgtgaaggatctgcatcggactggctgttcatcctattgcgggcaggaagccgagcaggacagagtggtcttaaaacgcgtactgctcgcctacgccagatggaacaagaccgtcgggtactgtcagggatttaatatcctggctgcgctcattctggaagtgatggaagggaatgagggggacgcgctgaaaattatgatctacctgatcgacaaagtgcttcctgaatcctatttcgtcaataacctccgcgcactgtccgtggacatggccgtgtttcgcgacctgctgaggatgaaattgccagaactctcacagcacctggacactctgcagcgcactgcaaataaggaaagtggggggggttatgagcctccccttacaaacgtttttaccatgcagtggttccttaccctttttgctacctgcctacctaaccaaactgtgctgaagatttgggacagcgtgtttttcgagggttctgagataatcctgagagtgagtctggctatatgggccaaacttggcgaacagattgaatgctgcgaaactgccgacgaattctattccaccatgggacgcctaactcaggagatgcttgaaaatgacctgctacagtcccacgaactgatgcagacagtctactcaatggctccgttcccctttcctcaactggcagaactgcgagaaaagtacacctataatatcaccccatttccagctacagtgaaacccaccagcgtgtccggccgccactctaaagcacgagactccgacgaggagaacgaccctgacgacgaagacgcagttgtgaatgccgttggatgtctgggccccttttccggcttcctagcccctgagcttcaaaaataccaaaagcagatcaaggaaccaaacgaggagcaatccttgcgaagcaacaacattgcagaactcagcccaggtgccatcaacagctgccgctcagagtatcacgccgctttcaattctatgatgatggaacggatgaccaccgatatcaatgctttaaagaggcagtattcgcgaattaagaagaaacagcaacagcaggtacatcaggtttacattcgggcagataaaggccccgttaccagcatccttccttcccaggtaaattctagtcccgtgattaaccacctgttgctgggaaaaaagatgaagatgaccaatagggccgccaagaatgccgtgattcacattcccgggcacaccggaggcaaaataagccctgtaccatacgaagatctgaaaaccaagttgaactctccctggcgtacccacatcagagtccacaaaaaaaatatgcctcgcactaaatcccatccaggctgcggcgatacagtgggtctcattgatgaacaaaatgaggccagcaaaaccaatgggctcggggccgctgaggctttcccgtccggctgtacagccaccgccggaagagaaggctcatcgcccgagggatcatcaagttacaaaagcttgcagatgatctag

SEQ ID NO: 33806 - DNA, 2388 bp, Artificial Sequence
  Description of Artificial Sequence: Synthetic coding sequence
atgtaccactctctgtccgagacaagacatcccctgcagccagaagagcaggaagtgggcatcgaccccttgagttcctactctaacaaatccggaggagactcaaataaaaacggacggaggacaagcagcaccttggactccgagggaaccttcaattcgtatcgaaaggagtgggaagaactgttcgttaataacaactatctcgccaccatcaggcaaaagggcatcaacggacagctgcggagttctcggtttcgttccatttgctggaagttgttcctgtgcgttctgccgcaggacaagtctcagtggatcagccgcatcgaggagctgcgggcttggtactctaacattaaggagatccacatcactaatcccaggaaagtagtcgggcaacaagacctcatgatcaataatccattatcccaggacgagggatcactttggaacaagtttttccaggacaaggagttacggagcatgatagaacaggacgtgaagaggacattcccagagatgcagttttttcagcaagagaacgtgaggaagattttgactgacgtccttttttgttacgccagggagaatgaacagctattatacaagcagggtatgcacgagctgctcgcccccattgtcttcgtgcttcattgtgatcaccaggcttttttgcacgcttctgaatctgctcagccatccgaagaaatgaagacagtactgaaccctgagtatctggaacacgacgcctacgcagtgttttcacagctgatggagacagctgagccctggttcagtacctttgaacacgatggacagaagggaaaagaaacactgatgacgcctattccctttgcaagaccccaagacctcggtcccaccattgcgatcgtgacgaaggtaaatcagattcaggatcacctgctcaaaaagcacgacatcgagctctatatgcatctcaacagactggaaatagcaccacaaatctacggcttgagatgggtaaggttgctgttcgggagggagtttcccctgcaggatctgttggtggtgtgggatgctctgttcgctgacggcttgtccctagggctcgtagactacattttcgtcgctatgcttttgtatatcagggacgcactaatatcgtccaattaccagacctgcttgggcctgcttatgcattacccttttataggcgatgtgcacagcctaatcctgaaagcattgttccttcgagaccccaaacgaaatccccgaccagtgacttaccagttccaccccaacctggactactataaagcccgaggggccgatttaatgaataaatccaggactaacgctaaaggagcgccactgaacatcaacaaagtgtccaattcactgattaacttcggccgtaagttaattagtccggccatggctcccggtagcgctggcgggcccgtgcccggaggaaacagtagcagcagtagtagcgtggtaattccaacaagaactagtgcagaagcgccctctcatcatctgcagcagcaacagcaacagcaacgcctgatgaaaagtgagagcatgcccgtgcagttaaataagggactgagctccaagaacatatcctcttcgccttccgttgagtctctgcccggcgggcgcgagttcaccggcagccctcccagctctgcaaccaaaaaggattcctttttcagcaatataagcaggagccggtcccactctaaaacaatgggtaggaaggaatctgaggaagagttggaggcccagatctccttcctgcagggccagcttaacgacttagacgctatgtgcaaatattgtgctaaagtgatggacacacatctagtgaacattcaggatgtgatactgcaggagaatctcgaaaaagaagaccaaattttagtctctttagccggtcttaagcagattaaggatatactcaaggggtccttgcggttcaatcagtcacagctggaggctgaagaaaacgagcagatcaccattgcagataatcattactgctcttccggccaaggacaaggcaggggacaggggcagtctgttcagatgtccggagctattaagcaggcaagttccgaaacacctggttgcacagaccggggaaacagcgacgattttatcctgatttcaaaggacgatgatgggtcttctgcaagagggagctttagcggccaagctcagcctctccggaccttgcggtccaccagcgggaagagccaggcccccgtttgctctcccctcgtcttcagcgacccattgatgggccccgcaagcgccagctcaagtaacccctcaagttcaccagacgacgactctagcaaagacagcggattcaccattgtgtcacccttggatatttag

SEQ ID NO: 33807 - DNA, 552 bp, Artificial Sequence
  Description of Artificial Sequence: Synthetic coding sequence
atgtatcactctctgtccgaaactaggcaccctctccagccggaagaacaggaagttggaatcgacccattgtcttcctacagcaataagtcaggcggggatagcaataagaatgggagaagaacctcatcaactctcgacagcgagggcacttttaacagctaccgcaaagagtgggaggagctgtttgtgaacaacaactacttggcaacaattcgtcaaaagggcatcaatggacagttgaggagcagtcggtttcggagtatttgctggaagttattcctctgtgtactacctcaagacaagagtcagtggatcagccggattgaagaactgagggcttggtactccaacatcaaagaaattcacatcacaaatcctaggaaagtggttgggcagcaggatctcatgatcaataatccattgtcccaggatgagggtagcctatggaacaagttcttccaggataaggagttacgcagtatgatcgagcaagatgtgaagaggacttttcctgagatgcagtttttccaacaggagaatgtgcgatag

SEQ ID NO: 33808 - DNA, 2388 bp, Artificial Sequence
  Description of Artificial Sequence: Synthetic coding sequence
atgtatcactcattgtcagaaactcggcaccccctgcagccagaggagcaggaggtcggtatcgatcctctttcctcatattcaaataaaagcgggggggactcaaacaaaaacggcaggagaacgtctagcaccctggattccgaggggacctttaattcatatcggaaggaatgggaagagctgtttgtaaataacaattacctagccactatccgccagaaaggtataaacggacagcttaggtcaagcaggttccgtagtatttgctggaaactgttcctgtgcgtgctgccccaggacaaatcacagtggattagtcgtatagaagaattgcgtgcctggtactctaatattaaagaaatccatatcaccaacccacggaaagtcgttgggcaacaggacctcatgatcaacaaccctttgagtcaggatgaggggagcctgtggaacaaatttttccaagacaaagaacttaggtctatgattgagcaggatgtgaaacgcacctttcctgagatgcagtttttccagcaggagaatgtccggaagattttgacagacgtattgttttgttacgcccgcgagaatgagcagcttctttacaaacagggcatgcacgagttgctggcccccatcgtgttcgttctgcactgtgaccaccaggcattcctgcatgcctctgaatctgcacaaccatccgaagagatgaagaccgtcctgaatcccgagtacctcgaacatgatgcctatgcagttttctcacagcttatggagaccgcagaaccatggttcagcaccttcgagcatgatggccaaaagggtaaggaaaccctgatgaccccaatcccctttgcccgtccacaagatcttgggcccacaatagccatcgtgacaaaagtgaaccagatccaagaccacctccttaaaaagcacgatatcgaattgtatatgcacttgaaccggttggaaatcgccccacaaatctatggattgcgctgggtcagacttctgttcgggcgtgagttccctttgcaggacttactggtggtttgggacgcactgtttgcagacggcttgtctttgggacttgtcgattacatcttcgtagccatgctactgtacattcgcgacgcactgatctcctccaactaccaaacatgtttaggactgctgatgcattaccccttcatcggcgatgtgcacagcctgatcctcaaggcactgtttctaagggaccctaaacgcaatcctagaccagttacctaccaatttcacccaaacttggattactataaggctcggggcgccgacctcatgaacaagagtcgaactaatgcaaaaggcgcaccccttaatataaataaggtctcaaattctctgataaactttggtaggaagctcatatcgccagccatggcaccgggatctgccggagggcctgtcccaggtgggaattcaagctcctccagctctgtggtgatccctacacgaacttctgcggaggcaccttcacatcacctgcagcaacagcagcaacagcagaggttgatgaaaagtgaatccatgccggtgcagctgaacaagggactctcgtctaaaaatatcagcagcagcccatccgtggagagcttgcctggcgggagagaatttactggatctcccccgagtagcgccaccaagaaagacagtttcttcagtaacattagtcggtcccggagccatagcaagacaatggggcgcaaagaaagcgaggaggagttggaagcccagatttctttcctacaaggccagctcaatgacctggacgcaatgtgcaaatattgtgcaaaggtgatggacacacatttagtcaacatacaggatgtaatcttacaagagaacctggaaaaagaggatcaaatcctggtctccctagccggactgaagcagatcaaggatatactgaaaggatctctgagatttaaccagtcgcagctggaggccgaagagaatgagcaaatcaccatagcggataaccactattgcagttctgggcaagggcagggacgcggtcagggacagagtgtgcagatgagcggcgcaattaaacaggcctctagtgaaactcctggctgcacggataggggcaacagcgacgatttcattctaatttcaaaggatgatgacgggagttctgccaggggatccttttccggacaagcccagcctctgaggacccttcgtagcaccagtggcaagtcacaggcgcctgtgtgttccccactcgtgttctccgacccactgatggggccagcatctgcctcaagttccaatccatcaagctctcccgacgatgatagcagcaaggatagtggattcactatcgtttctccgctcgacatttag

SEQ ID NO: 33809 - DNA, 267 bp, Artificial Sequence
  Description of Artificial Sequence: Synthetic coding sequence
atgtaccattctctctcagaaacacgccaccccctccagcccgaggagcaggaagtgggaattgacccattgtcctcatattccaataaatccggaggagactcgaataaaaatggtagaaggacttctagcacactcgattcagaggggaccttcaattcatataggaaggaatgggaggaactgtttgtcaataacaactatctggcaacgatccggcagaaaggtataaacggccagcttagaagtagcagatttagaagctag

SEQ ID NO: 33810 - DNA, 3423 bp, Artificial Sequence
  Description of Artificial Sequence: Synthetic coding sequence
atgtggctgaagcctgaagaggtactgctgaagaatgccttgaaactgtgggttacacagaaatcatcctgttacttcatcctccagcgccgaagagggcacggcgagggcggcggacgcctgacaggtagacttgttggcgccttggacgccgtgctggacagcaatgctagagtcgctcccttccggatactcctgcaagtaccgggctctcaggtgtactccccaatcgcctgcggcgccacactggaggaaataaatcagcattgggactggctcgaacagaatttgttacatacactttccgtattcgacaacaaggatgatattgcttccttcgtcaaagggaaggtcaaagcactgattgctgaggagactagcagtcggctggctgagcaggaagaagaaccagagaagtttcgggaggccctggtcaaatttgaagcccgcttcaactttcccgaggccgagaagctggtcacttactacagttgctgttgctggaagggccgcgtcccccgacaaggctggctttatctctcaattaaccacttgtgcttttactcctttttcttgggcaaagagttgaagctggtggtgccatgggtggatatccagaaactcgagcgaacatccaacgtctttttgaccgacactattaggataaccacccagaacaaggagagggacttttccatgtttttaaatctagacgaggtatttaaggtaatggaacagctcgcggacgtcaccttgcgacgcctgctcgacaacgaggtgtttgacctggatccagatctgcaggagccttctcagatcaccaagcgagatcttgaagctcgggctcagaacgaattttttcgggctttcttcagactgcccagaaaggaaaaattgcacgccgtggtcgactgctctttgtggactccgttctccagatgccacactactggacgcatgttcgcctctgattcctacatttgctttgcttcgagagaggacgggtgctgtaagatcatcctgcctctcagggaagtcgtgagcattgagaagatggaggatacaagcctcctgccccaccccatcattgttagcattcggtccaaggtagcgtttcagtttatagagctgagagatagggacagcttagtcgaggcattgttggcccgtctcaaacaggttcatgccaatcatccagtgcattacgacacaagcgctgacgacgacatggcatctctcgtgtttcatagcacttccatgtgttccgaccatcggttcggagatctggaaatgatgtcgagccaaaattcagaagaatctgagaaagagaagtcccccctgatgcaccccgatgctttggtcactgcctttcaacaaagcggatcacagtcacctgattcccgcatgagtcgagagcagattaagattagcctctggaacgatcactttgtcgaatatggcaggaccgtgtgtatgttcagaaccgagaagattaggaagctggtcgcaatggggatcccagagtccttgcgggggcggctctggctgctgtttagtgatgctgtcactgatcttgccagccatccaggttactacgggaacttagtggaggaatccctgggaaagtgttgcctggtgactgaagaaatcgagcgggatctgcacagatctctgcctgaacaccctgcctttcagaacgaaacgggtatagccgctctgcgtcgagtgttgacagcctacgcacatcggaaccccaaaatcgggtattgccagagtatgaacatactcacaagtgtgttactgctgtatacaaaggaagaggaggcgttttggctgctggttgccgtctgcgagcggatgctgcctgactatttcaaccacagagtgattggcgcacaggtggaccagagcgtttttgaggagctcattaagggccatctcccagagttggctgagcatatgaatgatctgtctgccctggcgtctgtgagcttgtcctggttcctcaccctgtttctgagcatcatgccactcgaatctgcggtcaacgtggtcgactgcttcttttatgatggcattaaagcaatttttcaactgggactcgccgttctagaggctaatgccgaggacttatgttcaagcaaagatgatggacaggcccttatgatcttgtccaggttcctggatcatatcaagaacgaggattcaccaggacctcctgttggctctcaccatgccttcttctcggatgaccaggagccatatccagtaactgacatttccgacctcatcagagacagctacgagaaattcggggaccaatccgtcgagcagatcgaacatctccgctataaacatcgaatacgcgtactgcagggacacgaagacaccactaagcagaacgtgttgagagtggtgatcccagaagtgtcgatactccctgaagaccttgaggagttgtatgatctgtttaagagagagcatatgatgagttgctattgggaacagccgaggccaatggcttctcggcacgacccctcaagaccatacgcagaacagtatcggatagacgctcggcagtttgctcacctctttcagcttgtctccccatggacatgtggcgcccacaccgagattttggcagagcgcactttcaggttattagacgacaacatggaccagctaattgagtttaaggcctttgtgtcttgtttggatattatgtataatggagagatgaatgagaaaatcaagttgctgtacagactgcacattccccccgccctgactgaaaatgatagggactctcaatctcccctgaggaaccccctcttgtctacctcccgccccctcgtattcggaaagccaaatggagatgccgtggactatcagaagcaactcaagcaaatgattaaggatctagcgaaagagaaagataagaccgagaaggagttaccgaaaatgagtcaaagggagtttatccagttttgtaaaaccctgtactctatgtttcatgaggaccccgaagagaatgacctgtaccaggctatcgctacagtaacaacacttctcctgcagatcggtgaggtagggcaaaggggctccagcagcgggagctgctcccaggagtgtggcgaggaactgcgggcgagcgctccttcccccgaagactctgtgttcgctgacaccgggaaaactccccaggattctcaagcatttcccgaggcagcagaacgcgactggacagtgtccctcgaacatatacttgcttctctattgaccgagcagagcctggtcaatttctttgaaaaacccctggacatgaagagcaaattggagaatgccaagatcaaccaatacaatttgaagaccttcgagatgtcgcatcagagtcagtccgagctgaaactctctaacctgtag

SEQ ID NO: 33811 - DNA, 3468 bp, Artificial Sequence
  Description of Artificial Sequence: Synthetic coding sequence
atgtggttaaagcctgaagaggttctgcttaagaacgccctgaaactgtgggtgacccagaagagctcttgttattttatcctgcagcggcgacgggggcatggtgaaggaggcggacgtttgaccggaagactcgtgggggcacttgacgcagtgctggattcaaacgccagggtcgcaccttttaggattttgctccaggttcctggaagccaagtgtattccccaatcgcatgtggagagctcctaaacggttccgatgtgtattgggccatagccaccggagccacgctggaggaaatcaatcagcactgggattggcttgagcaaaatttactgcataccctttcagtctttgacaataaagacgacatcgctagcttcgtcaaggggaaggtgaaagccctgattgctgaagagacctcgagcagactggctgaacaggaggaggaacccgagaagtttagggaagccctggtgaaattcgaagctaggttcaatttcccagaagcggagaaattggtgacctactattcctgttgctgttggaaggggagagtgcctaggcagggatggttatacttgagcataaaccacctctgcttctattccttcttcttgggcaaggagctgaagctggtggtgccttgggtggatattcagaagcttgagagaaccagtaatgtattcctcaccgacacgattcgaattacaacccagaataaggagcgggacttctctatgttcctgaatctcgatgaagtattcaaagtcatggagcagctggccgatgtcacgctccggcgactgttagacaatgaagtcttcgacctcgaccctgatcttcaggaaccatctcagattaccaaaagggaccttgaagcgcgcgcacagaacgaatttttcagggccttctttaggttacccaggaaggaaaagcttcatgctgtcgttgactgctccctctggacgcctttctcacgctgccatactacaggccgcatgtttgccagtgactcttacatatgctttgcttcaagagaggacggctgctgtaagattatactgccgctgcgagaagttgtctcaattgagaagatggaggatacctcattgctgccccaccctatcattgtgagcatcagaagtaaagtggccttccagttcattgagctgcgagacagggattcattggtggaagcactgctagccaggctgaaacaagtacacgccaaccaccccgtacactatgatacaagtgccgatgatgacatggctagccttgtctttcactctacatctatgtgttccgaccatagatttggggaccttgaaatgatgtctagtcagaactccgaggagtcggaaaaggaaaaatcccccctgatgcatcccgacgccctggtaactgcgttccagcagagcggctctcagtcccctgacagtagaatgtctagagagcaaattaaaatctcactttggaacgaccacttcgtggaatacggccggaccgtttgtatgttccggaccgaaaaaatccgcaaactggttgctatgggcattccggagtctctgagaggacgtctgtggctgttattcagtgacgctgttacggacttggcgtcccaccccggatattatggcaacctagttgaagagtccctgggtaagtgttgtctcgtgacggaggagattgagagggacctgcaccggtctctacccgagcatccagcttttcagaatgagactggtatcgccgccttgcggagagtgctcaccgcctacgcccaccgtaatcccaagataggttactgtcagtcaatgaacattctaacatctgtattgctcctgtacaccaaggaggaagaggctttctggctcctggtggctgtgtgcgagagaatgctgcctgattattttaatcaccgcgttataggggcgcaggtggatcagtcggtgtttgaggagttgatcaaggggcatctacccgaactggccgagcacatgaacgacctgtccgctctggcctccgtgtcactgtcctggtttctgactctcttcctgtccattatgcctttggaatcagccgtgaatgtcgtggattgcttcttctacgatgggatcaaggctatttttcagctggggttggctgtgttggaggcaaacgccgaggatctatgcagttccaaggatgatggccaagctctcatgattctgagccgcttcctcgaccatatcaagaatgaggattcacccggccctcccgtaggatcccatcacgccttttttagcgacgaccaggagccatatcccgttaccgacatctcggatcttatcagagattcgtacgaaaagttcggagaccagagcgttgaacagatcgagcacctacgctacaagcacaggattcgcgttttacagggacatgaagacaccacgaaacagaatgtgttgagggtggtgatccctgaggtcagcattcttcccgaagacttggaagagctatatgatttatttaaacgagaacatatgatgtcatgctactgggagcagcctagaccgatggcgtccagacatgacccctcacgaccttatgctgaacaatatcgcattgatgctcggcagttcgctcacctttttcaattggtgtccccgtggacctgtggagcccacacagaaatcttggccgagcgaacattccgtctactagacgacaacatggatcagctgatagagtttaaagcattcgtatcctgcttggacataatgtacaacggagagatgaacgagaaaatcaagttgctgtaccgcctgcacattccccccgctttgacagagaacgacagagactcccagagccccctccgtaatcccctactgagcacctcccggcctttggtctttggaaagcctaacggggatgctgttgactatcagaagcagcttaagcaaatgattaaggacttagctaaggagaaggataagactgagaaggaattgcccaaaatgtctcagagagaattcatccagttttgcaagaccttatatagcatgtttcacgaggatcccgaggaaaatgatctttatcaggcaatcgctacagtgaccacccttctgttacagatcggcgaggtaggccagagggggtcctcaagcgggtcgtgttcgcaagagtgcggagaagagctgagagctagtgccccatcacctgaggattcagtgttcgcagacacagggaaaacccctcaggactcacaagcctttcctgaggcagccgaacgggattggacggtgtctctggaacacattctggcttctctgttgacagagcagtccctcgtgaatttcttcgaaaaaccactagacatgaagtctaagctcgagaacgccaagatcaatcagtacaatctaaagactttcgagatgtctcaccaatcacagagtgagttgaaacttagtaatctctag

SEQ ID NO: 33812 - DNA, 1899 bp, Artificial Sequence
  Description of Artificial Sequence: Synthetic coding sequence
atgtggctgaagcccgaggaggtactgctgaagaacgctctcaaattgtggttgatggagcgatcaaacgactatttcgttctgcaacgaagaagaggttatggggaagagggaggcggcggcctgacaggcctgttggtcggcactctggattctgtccttgattcaactgcgaaggtggcaccgttccgaattctgcatcagactccggactcgcaagtttacttatccatcgcctgcggagccaaccgcgaagagataaccaagcactgggactggctcgaacagaatatcatgaaaacgcttagcgtgttcgactctaacgaagacatcacaaattttgtccagggcaagatccggggtttgatcgccgaggaagggaaacactgcttcgctaaggaggatgatcctgaaaaattcagagaggccctcctgaagtttgagaagtgtttcggactgcccgagaaggaaaaactcgtaacatattattcctgttcctactggaagggccgagtgccatgccaaggatggctgtacctgagcactaattttctgtcattctatagctttttgctggggtcagaaattaagctgattatttcctgggatgaggtgagtaagctggaaaaaacttctaacgtaatcctcacagaatctatccacgtatgctcccaaggagagaaccactacttctctatgttcttacatatcaaccagacctatctccttatggagcagctggctaactacgccatcagacgattgtttgacaaggaaacgttcgataacgaccctgtactgtacaatcccctgcagatcactaagcgcggcttggaaaatcgggcccactcagagcagttcaacgcctttttcaggctccctaaaggagagagtttgaaagaggtgcacgaatgtttcctgtgggttcccttcagccactttaatacccacgggaagatgtgtattagtgaaaactacatctgcttcgcttcacaggatggtaatcaatgttcggtgatcatcccccttagagaagtgctggccatcgataaaacaaacgactcttcaaagtctgttataatttcaataaagggtaagactgcgttccgttttcatgaggtgaaagacttcgaacagcttgttgctaaattgcggttgagatgcggagctgcatccacacagtatcacgacatcagtacggaactggccatatcatccgagtccaccgaaccttcagacaactttgaagtacagtcgctgacctcccaacgcgaatgctccaaaactgtaaatactgaagcgctgatgaccgttttccatccccagaatctggaaacactcaatagcaagatgctgaaggagaaaatgaaggagcaatcttggaaaattctgttcgccgagtgtggcaggggtgtgtccatgtttcgcaccaaaaagacacgggatctcgtcgtgaggggcatacctgaaacactacgaggggagctgtggatgttgtttagcggggccgtgaatgacatggccacaaacccggattattacactgaagtcgtcgaacagagcctcggcacttgtaacctggccaccgaggaaattgagagagaccttagaaggtcactgccagagcaccccgcgttccagtctgataccgggattagcgctctgcgacgcgttttaaccgcctatgcttaccggaaccctaagatcggttactgtcaggccatgaacattttgacctcagttttgcttctctacgctaaagaagaggaagcattctggctgctggtggcggtttgtgagaggatgctgcctgactactttaaccgccgaataataggatcagacgacttcatgccattggtcagaatccagggccagtgtgtgattggagagaagtag

SEQ ID NO: 33813 - DNA, 3363 bp, Artificial Sequence
  Description of Artificial Sequence: Synthetic coding sequence
atgtggctcaagcccgaagaggtccttctgaagaatgccctaaagctgtggctgatggagcggtcgaatgattatttcgtgctgcagaggcgacgcggatatggagaggaagggggaggagggttaaccggattgctggtcggtacactggactcggtgctggattcaacagccaaagtggcgccttttagaattctccatcaaacccctgacagccaagtgtacctgtccattgcctgtggcgcaaatcgtgaggagatcacaaagcattgggactggctggagcaaaacatcatgaagaccttgtcagttttcgactctaacgaagatattactaattttgtccagggcaagatccggggtctaattgccgaagagggcaaacattgcttcgctaaagaagatgaccctgaaaaatttcgcgaggcactattgaagtttgaaaaatgttttggattacctgaaaaagaaaagttagttacctactacagttgcagttactggaagggccgggttccttgtcagggttggctttatctgtctaccaatttcctgagcttctacagtttcttgctgggttccgaaattaaactcatcatatcatgggatgaggtgtcgaagttagaaaagacttcaaacgtcatccttaccgaaagcatccacgtgtgctctcagggagagaatcattatttctcaatgttcctacacatcaaccagacatatctgctcatggaacagcttgcgaattatgcaatccgtcgcttgtttgacaaggagacattcgacaacgaccctgtgctctacaatcccctccagatcaccaagcggggtttagaaaacagggcacattcagagcagtttaatgccttttttaggttgcccaaaggtgagtccctgaaggaggtgcatgagtgtttcttatgggtgcctttttcacacttcaacacacacggaaagatgtgcatttctgagaattatatctgcttcgccagtcaagacggcaatcaatgctctgtgatcatacccctgcgggaggtcctggctatcgataaaacaaacgatagctccaagtctgtcattatttccattaaaggaaagactgcattcaggttccacgaagtcaaggactttgaacagctggtggccaaacttcgactgaggtgcggtgccgccagcacacagtaccatgacatttccaccgaactcgcaatatcttccgaatctaccgagccgtcagacaactttgaagtgcagtccctgacctcccaaagggagtgtagtaaaaccgttaatactgaggcgttgatgacagtgttccacccacagaacctagagaccctgaactccaagatgttaaaggaaaagatgaaggaacagagctggaagatcctttttgccgagtgtgggagaggggttagtatgttccggaccaaaaagactcgggacttagttgtgcgaggtattccggagacgctaagaggggaactgtggatgctgttctccggtgccgtgaacgacatggccactaaccctgattactacacagaagtcgtcgagcagtctctaggtacgtgcaacctcgccacggaggagatcgaaagggacctgaggcgatccctgcctgaacatccggcatttcagagcgataccggcatctccgcgctcaggcgggtgctaaccgcttatgcctatcgcaatccgaagatcggatattgccaggctatgaatattctcactagtgtcctcctcctgtacgctaaagaggaagaagccttctggcttctggttgccgtgtgtgagagaatgttgccagattactttaacaggagaattatcggcgccctcgttgaccaggcagtgttcgaggaactcattagagaccacttgcctcagctcacagagcatatgacagacatgaccttcttctcatccgtgtccctttcctggtttctgactttgttcataagcgttctccctatcgagtccgccgtgaacgtggtggactgcttcttctatgacggcatcaaagctatcctgcagctcggccttgcaattctcgactacaatctcgataaactgttgacttgtaaagacgatgccgaggccgtgaccgctctgaatagattttttgataatgtgaccaataaggattctccactcccgagcaatgtgcagcagggatccaacgtatccgacgagaagaccagtcacacaagagtagacataacagatctcatacgggagtcgaatgagaaatatggaaatatcaggtatgaggatatacatagcatgagatgccgtaatcgcctctatgtgattcagaccctcgaagagacaacaaagcagaacgtgctgcgagtggtcagtcaagacgtgaaactctctctccaggagctggacgagctatatgtaatattcaagaaagaactctttctatcgtgttactggtgtctgggctgccccgtgttgaagcatcatgatcccagtttgccttatctcgagcaatatcagatcgactgccagcagttccgggcactctaccacctattaagcccatgggcacactcggccaacaaagattccctggcgctatggaccttccgcctgctggatgagaattccgattgcttgataaacttcaaagagtttagctctgctattgatataatgtataacggctccttcaccgaaaagctcaagctcctgttcaaactccatatccctccagcttacaccgaagtgaagtccaaggacgcgtctaagggtgacgagctatcaaaagaggagctattgtattttagtcagctgcacgtgtccaaacctgctaacgagaaagaggccgaatctgcaaagcactccccagaaaaagggaagggaaaaatcgacatccaggcttatctgtcccagtggcaggacgaactctttaagaaagaagaaaatattaaagatctgcctcgaatgaaccagagccaattcatccagttctcaaaaacgctctacaatctgtttcacgaggaccccgaggaggagtcgctgtaccaggccatcgccgtcgtcacgtccctccttctgagaatggaggaggtggggcggaagctgcacagccctacctcttctgctaaaggatttagtggaacagtttgcggctcagggggaccatcagaggagaaaacaggaagtcatttagaaaaagatccttgcagctttagagaggagcctcagtggtctttcgcattcgaacagatcttagcttccctgctgaacgaaccagctctggtgagattttttgagaagccaatagacgtaaaggctaagctggaaaacgcccggatctctcagctgcgttctaggaccaagatgtag

SEQ ID NO: 33814 - DNA, 654 bp, Artificial Sequence
  Description of Artificial Sequence: Synthetic coding sequence
ttcaacagatttttcgacaacgtgacaaataaagatagccctctgccatccaatgtgcagcaggggtcgaacgtgtccgatgagaagactagccacaccagagtcgacattaccgacctgatacgggagtccaacgaactgcgtgtggtctcccaggacgtgaagctctcacttcaagagctggacgagctgtatgtcatttttaaaaaggagctttttctttcttgttattggtgtctgggttgcccggtcctaaagcatcacgaccctagtctgccttatctcgagcagtaccagatcgactgccagcaattcagggccctgtatcacctcctgagcccatgggcacacagtgcaaataaggatagccttgctctgtggaccttccgactgttagatgaaaattccgactgccttatcaacttcaaagagtttagttctgctatcgacataatgtacaatggctcatttaccgaaaaacttaaactgctcttcaaattacacattccccccgcctacactgaagtgaagtccaaagacgcctctaagggagacgaactgagtaaggaggagctgctctatttctcacagttgcacgtgagcaagccggcaaacgagaaagaagccgagtctgctaagcacagccccgaatag

SEQ ID NO: 33815 - DNA, 3801 bp, Artificial Sequence
  Description of Artificial Sequence: Synthetic coding sequence
atgtgggtgaatccggaggaagtcctactggctaatgcgttgtggataaccgagcgcgccaacccatacttcattctccagcggagaaagggccacgctggggacggaggcggggggggggggttggccggcctgctagtgggtaccctggacgttgtgctggactctagcgctcgggtggctccctacagaatcttatatcaaaccccagattcactggtctattggactatcgcctgcggtggctcaagaaaagaaatcaccgaacactgggagtggttggagcagaacctgctccaaactttgtcgatctttgaaaacgaaaacgatattacaacgttcgtgcgcggcaagatacaagggatcatagccgagtataacaaaataaacgatgtgaaagaggatgacgacacagaaaagtttaaggaggcaatcgtaaaattccatagactcttcgggatgccagaggaagaaaagctcgtaaactattacagctgcagctattggaaggggaaagtacccaggcagggttggatgtacctgtctattaatcatctctgcttctactcatttctcatgggccgagaggccaagctcgtgatcagatgggttgatattacacagcttgaaaaaaacgcgacactactcctccccgacgttattaaagtgagtaccaggtcatctgagcacttcttttctgtgtttctgaatataaacgaaactttcaaactgatggagcaactggctaatattgccatgcgccaactgctggataacgaagggtttgagcaggatcgctctcttccaaaattaaagcgcaagagccccaagaaggtgtcggccctgaagcgcgacctggatgctcgagctaaaagcgaacgctaccgggcactgttcaggctccctaaggatgagaagctggatgggcatacagactgcacgctgtggacgcccttcaacaagatgcacatactcggacagatgtttgtgtcgacgaattacatctgtttcaccagcaaagaggaaaacctgtgtagtctgatcatccctctgcgggaggtgacaattgtggagaaggcagattcctctagtgtgctgccttctccgctctcaattagcacgagaaaccggatgaccttcttgttcgccaacctgaaagatcgcgatttccttgtccagaggataagtgattttctgcaacaaacaacttccaaaatatactccgacaaggagttcgccggttcatataattcctctgatgatgaagtatacagccgtccttctagcttagtcagttcctcacctcagaggtccactagctctgacgccgacggcgagcgtcaattcaatctgaacggtaacagcgttcctaccgcgacgcagacgttaatgaccatgtatagacggagaagtccagaggagttcaatcccaaacttgccaaagaattcctaaaagagcaagcctggaagattcattttgccgaatatgggcaggggatttgcatgtacaggactgaaaaaacccgagagctcgttcttaaaggcattcccgaaagcatgagaggtgagctctggttattgctttcaggggccatcaatgaaaaagccacacatcccgggtactatgaggacctggttgaaaaatccatgggcaagtacaatctcgcgactgaagaaattgaaagagacttgcacaggtcactgcctgagcatcccgcgtttcagaatgaaatggggattgcagccctcagacgagtcctgacggcatatgccttcagaaacccaaatatcgggtactgtcaagccatgaacattgtgacaagcgtgctgctgctctatgcgaaagaagaggaggccttctggcttctggtggcgctttgtgaaagaatgctgccggactattacaacacacgggttgttggcgcactcgtggaccagggagttttcgaagaattggcacgggactacgtgccccagctgtacgattgtatgcaggacctgggggtgatcagtaccataagcctgagctggtttctgaccttattcttgtctgtgatgccctttgaatccgcggtggtggtggtcgattgctttttctacgagggcattaaagtcatcttccagctggcactcgcggttctggatgcgaacgtggataagctgcttaattgtaaggacgacggggaagccatgaccgtcctgggtcgctatctcgattctgtaacgaataaggacagtacgcttccacccatcccccatctgcattcactgctttccgatgacgtcgagccctatcccgaagtagacatattcagattgattcgcacctcgtacgagaagttcggcacgataagggccgatctgattgaacagatgcggttcaagcagaggcttaaggtcatacagactcttgaagatacgacaaagaggaatgtggtaagaacaatagtaaccgaaacctcattcaccattgacgagctcgaggagctctacgccctgtttaaggccgaacacttgaccagctgctattggggcggcagctcaaacgccttggatcggcatgaccctagtttgccatatttggagcagtacagaatcgactttgaacagtttaagggaatgttcgcattgttatttccgtgggcttgcggtacccactcagacgtgctggcctcccgcctcttccagctgctggatgagaacggcgacagtctgattaattttcgggaattcgtctcaggcctgagtgctgcttgtcacggcgatctcaccgagaaactgaagctcctttataagatgcacgtgctccctgaaccatcatccgatcaggacgaacccgattcagcattcgaagctactcaatattttttcgaagacattacccccgagtgtactcatgtggtcggtttagacagtagatctaagcagggggcagacgatgggttcgtcactgtctctctcaagcccgataaggggaaacgggcaaactcccaggagaatcgaaattacctgcggttgtggacgcctgaaaacaagagcaagagcaagaatgcaaaggacctgccaaaattaaatcagggccagttcatcgagctgtgtaagaccatgtacaacatgttctctgaagatcctaacgagcaagagttgtatcacgctactgccgctgttactagcctgctgctcgaaatcggcgaggtggggaagctgttcgtggctcagcccgccaaggaaggtggcagcggaggctcagggccatcttgccaccagggaataccaggagtgcttttccctaagaagggtccgggccagccttacgtcgttgaaagcgtggaacccttgcctgcctctctggcacctgactcagaggaacattcccttgggggccagatggaggatataaagttggaagactcatcccctcgggataatggggcatgctcatccatgctaattagtgacgacgataccaaagacgactcctctatgtcaagttattccgtcctgtccgctggatcacatgaagaggacaagctgcactgtgaggatattggagaagacacagtcctggtccgtagtggccaggggacagccgcactcccgcgatccacgagcctggacagggactgggcaatcactttcgaacagttcctcgcctctcttttaacagaaccggcactggtgaaatactttgacaagccagtgtgcatgatggcccggatcacatccgccaagaacatcaggatgatgggaaagcccctcacctccgcatcggactatgaaatcagcgctatgtctggctag

SEQ ID NO: 33816 - DNA, 1848 bp, Artificial Sequence
  Description of Artificial Sequence: Synthetic coding sequence
atggaaagcatgtttgaggatgacatctcaatcttgactcaggaggcactgggcccctccgaggtgtggctggattcgcccggggacccatcgctcggtggggacatgtgtagcgcaagccatttcgctttgatcaccgcctatggagatatcaaagagcggctgggcggattggagcgggaaaacgcaactctccggaggcgcctgaaggtatacgaaatcaagtaccccctgatcagcgacttcggggaggaacacggattcagtctctacgaaattaaagatggctccctgctggaagtggaaaaagtgtctctgcagcaacggcttaaccagttccaacacgagctacagaaaaacaaagagcaggaagaacagctgggagagatgatacaggcctacgagaaactgtgcgtggaaaagtctgatctcgagaccgaactgcgcgaaatgagagctctggtggaaactcatctgcgccaaatctgtggcctggaacagcagctcagacaacagcagggcttgcaggatgccgcgttcagcaacttaagtcctccccctgcccccgctcctccatgcaccgacctagacctgcattatctcgcactgcggggtggcagcggcctatcccacgccggctggcctggaagcacaccatcagtgtcggacctggagcgcaggagactagaggaagctttggaggccgctcagggcgaggcccgcggggctcagcttcgggaagaacagctccaggccgagtgcgagaggctacagggggagctcaaacagctgcaggaaacgcgcgcccaggatctcgctagcaaccagagtgagcgggatatggcttgggtgaaacgagttggcgacgaccaagtcaatctggccttagcttacaccgagcttacggaggagctaggtcggctcagagagctgtcctctctgcagggccggatcctgcgtacactgcttcaggagcaggcacgtagtggcggccagcgtcactcacccttatcacagcggcattctcctgcaccccagtgccctagcccgagcccgcccgctagagctgcccctccctgccctccctgccagtcacctgttccccaaagacggtcgcctgttcctccctgcccttcaccccagcaaaggcgctccccggccagtccatcttgcccatctccagtacctcagcgccgttcacccgtgcctccatcgtgtcagagtccttcaccgcagagaagaagcccagtcccaccttcttgccctgcacctcagcctaggccccctcctccacccccaccgggagaaaggacactggccgaacgtgcctatgcaaagccaccaagtcaccacgtgaaggcggggttccagggccgtcgcagctattctgaactcgctgagggcgctgcgtacgcgggcgccagtcctccttggcttcaggcggaagccgcgactctgcccaagccacgggcatacggtagcgaattatacggccccggcaggcccctgagcccgaggagagctttcgaaggtattcgcctgaggttcgaaaagcagccaagcgaagaggacgagtgggccgtgcctaccagtcccccgtcaccagaagtcgggactatccgctgcgcctccttctgcgcgggatttcctatcccggaatcacctgcagctaccgcatatgcccacgcagagcacgcccagagttggccttccatcaacctgctcatggagacagtcggaagtgacattaggagctgcccattgtgtcagttggggttccctgtcggatacccagatgatgctcttatcaaacatatcgatagtcatttggaaaacagcaaaatttag

SEQ ID NO: 33817 - DNA, 672 bp, Artificial Sequence
  Description of Artificial Sequence: Synthetic coding sequence
atggagtctatgtttgaggacgatatctcaatactcacacaggaagcgctgggacccagtgaagtgtggttggatagccctggagaccccagccttggtggtgacatgtgttcagcaagccattttgccctgatcactgcctatggtgatataaaggaaagattagggggtctggagagagaaaatgccacactgcggcgacggcttaaagtatacgaaattaagtatcccctgatctcggatttcggtgaggagcacggatttagtctgtacgaaattaaagatggctctctccttgaagtggaaaaggtgtctctgcaacagcggctcaatcagtttcagcatgagttgcagaagaataaagagcaggaggaacagttgggggagatgatacaggcttacgaaaagctgtgcgtggaaaaaagcgacctcgagacagaacttagggaaatgagggcactggtcgaaacacacctgcgccaaatttgtgggctggagcagcagctacggcagcagcaagggcttcaagatgccgcattctctaacttaagcccgccccgacgcgctagggctgtgttagccgtccaccagctagcagatggcgacggaggtttacgccatccccaactcccccccctgcccgccgggttcccttgtagggtgcctggatag

SEQ ID NO: 33818 - DNA, 1062 bp, Artificial Sequence
  Description of Artificial Sequence: Synthetic coding sequence
atgctcgagggacagttggaggccagagagccgaaggaaggaacacaccccgaagatccgtgccctggagcaggggccgccatggaaaaaaccccagcggccgccgaggtccccagggaggattctaacgcgggagagatgcctagtctccaacagcagatcactagcttacaccaagaactgggtcggcagcaatcgttgtgggccgacatccatcgcaagttgcaaagtcacatggacgcactccgcaagcaaaaccgcgagctccgcgaagaactgcgcggactgcagagacagcagtgggaggccggtaagaagcccgctgcgtctccccatgctgggcgcgagtcccacaccctcgcgttagaacccgcattcgggaaaatcagccccctcagtgctgacgaagagaccacaccaaagtacgcaggaaggaagtcacagtctgcgactttgctgggacagaggtggagtagtaaccatctggcgccaccgaaaccgatgagtcttaagaccgaaaggatcaacagtggaaagactcccccccaggaggacagagaaaaatcaccaccgggtcgacgacaggaccgatcccccgcacctaccggacggcccactccaggggccgagaggcgggaagtttctgaagatggcaaaattatgcaccctagtagccgcagccttcagaactccgggggaagaaagtcacccgtgcaggcctcacaggctgccacactgcaagagcagactgccgcagccggagtcgcagaccgttcctctagtgttcttggcagctctgagggaggcttcctgtcacgtgtccaggcagaggaattcgcaagctcctccccagactctgccgagcgacagaatttacccgtgaatcccccatcttctctggagattgcccaggctatggataccaagatgaaaaaggaagaggtccaagaagagaaaaggcatccaaacggaaaagccgacgattgcaggcgaagtgggtttccctcagagttccctggggcgctccacgccgccccatcacgacaggacatggggccttag

SEQ ID NO: 33819 - DNA, 1125 bp, Artificial Sequence
  Description of Artificial Sequence: Synthetic coding sequence
atgaaggtggatatggctaactttgctatttcatccattagaccacatttgatgcaacagtctgtggagtatgagcgaaaaaaattccaggagattctggagaggcagccaaactcacttgatttcgtaacccagtggctagaagaagccagcgaagacctgatgacccagaagtataaacatgccctgcccgtgggcggcatggccgctgggagcggcgacatgccgcggctctcaccggtagctgtacagaactacgcatatctcaagctccttaaatgggatcatctgcagagacctttccctgaaaccgttcttatggatcagagccgattccacgagctccagctccagttggaacagttaacgattctaggagctgtgctgctcgtcaccttctcaatggccgcacctggtatatcttctcaagcagatttcgcagagaagctgaaaatgatcgtgaaaatcctgctgactgacatgcatcttcctagtttccacctcaaagacgtcctaactactattggcgagaaagtttgcttggaggtgtcatcatgtctgagcctgtgtggttcctctccgttcacgaccgataaagaaacagtacttaaggggcagatccaagcagtggcgagccccgacgatcccattcggcggatcatggaaagtagaatcttaacattcttggagacctatctggcatccggacaccaaaagcccctaccgaccgtgccgggtgggctgagcccagtccagcgcgagcttgaagaggtcgctataaagttcgcccgcctggtgaactacaacaagatggtattttgcccctattatgatgcaattttgaggaaaagatggataagtttcggcaacttctttggcagcagcaataccgacatgagtccctggaactgccgcacggactatcctatgtccctgcatattaggtttccaaagaaccacgtgatcgaggcccccatgactatccagctatgttttcaggaaccatgcaacaaagcactgtcgcttctgaacatccctctggaagccaagggaatcctagatcgaagcttcctccagcgaagattgaaaccatatcgcatcagattctgctgccgcgctctctag

SEQ ID NO: 33820 - DNA, 1530 bp, Artificial Sequence
  Description of Artificial Sequence: Synthetic coding sequence
atgtctgagaatttagacaaatctaacgttaatgaagctggcaaatctaagagtaatgattccgaagagggactggaggacgccgtggagggggctgatgaggccctgcaaaaagcaatcaaatctgattcatcatctccacaaagggtgcaacggccccatagctccccccctcgcttcgtcactgtagaagagttgctcgagacagccaggggcgtgactaatatggctttggcacacgagattgtggtgaacggagattttcagatcaaacccgtggaactgccagaaaactcactgaaaaagagagttaaagagatcgtgcataaggccttttgggattgtttaagtgtgcagctaagcgaagaccctcccgcctacgaccacgctataaaattggtcggagagataaaagaaacgctactttcctttctgctgcccgggcatactagactcagaaaccagataaccgaggttttggacctagatcttattaagcaggaagccgaaaacggagctctggacatctcaaaactggccgaattcatcatcgggatgatgggtacgctgtgcgcgcccgcgcgggatgaagaggtcaagaagctgaaagatataaaggagatagtgccactgtttcgcgaaatcttctctgtgctggacttgatgaaggtggacatggctaactttgccatcagtagcattagaccgcacttgatgcaacagagcgtcgagtacgagaggaagaagtttcaggagattctcgaaaggcaacctaactccctggattttgtcacccagtggctcgaagaggcgagtgaggacctgatgacccagaagtataaacacgcacttcctgttggcggtatggctgcaggttcaggggacatgcctaggctgagccccgtggctgtccaaaattacgcctatctgaagctcctgaagtgggaccacctgcagcggccttttccagagacagtcttgatggaccagtctcgcttccacgagttgcagttgcagctggagcagctcaccattttaggcgcagtgttactggtgacattttcaatggctgcacccggaatcagtagccaggcagatttcgcggaaaagctgaagatgattgtgaagatactgttgaccgatatgcatctgccctcattccaccttaaagacgttctcactaccattggggaaaaggtgtgtttagaagtgtcttcatgtctcagcctgtgtgggtcctccccgttcactacagataaggagacggtcttaaaaggccagatccaggctgtggcctcccctgatgatcccatccgccgcattatggagtctaggatcctgactttcctggaaacatacctcgcaagtggacaccagaagcctctacccactgtcccaggcggcttatcccccgtccagcgcgagttggaggaggttgccattaagtttgcccgattagtgaattacaacaaaatggtgttttgtccttattacgacgccatcctcagcaaaatccttgtaaggtcctag

SEQ ID NO: 33821 - DNA, 1530 bp, Artificial Sequence
  Description of Artificial Sequence: Synthetic coding sequence
atgagcgagaatctggacaaatccaatgtcaacgaggccggcaagtccaagtcgaacgacagcgaggaaggcttggaggatgccgtggagggtgcggatgaggcactgcagaaagcaataaagtccgatagttcaagccctcaaagggtgcaaaggccccatagttcccccccacgttttgtgacagtagaggagctccttgaaactgcaagaggcgttactaatatggcattggctcatgaaattgtagtgaatggcgatttccaaattaaaccagttgaactgccagaaaattctctgaagaaaagagtgaaggaaattgtgcacaaagctttttgggactgtttatcagtacagctctcagaagatccacctgcttatgatcacgcaatcaagttggtaggggagattaaagaaacattactgagttttctgctacccgggcacacacgcttacggaaccagattactgaagtgctcgacctggatctgatcaagcaggaggctgagaatggggcgctcgatatttccaaactcgccgaattcatcattggtatgatggggacactctgtgcacccgctagggatgaagaagtgaagaaactgaaggacatcaaagagattgtacccctctttagggagatctttagcgtccttgacctgatgaaagtcgatatggctaattttgcaattagcagcatcagacctcacctcatgcagcaaagcgtcgaatacgaaagaaaaaaattccaagagatattggaacggcagcccaattctttggatttcgtgactcaatggctggaggaggcctccgaagaccttatgacccagaaatacaagcacgctcttcccgtgggcggtatggctgcagggagtggggacatgccaagactgtcacctgttgctgttcaaaattacgcatacttgaagcttttgaagtgggaccacttgcaacgtccctttccagaaaccgtcttgatggatcagagcagattccacgagcttcagttgcaactggaacagttgactatcctgggcgccgtactgcttgtgacctttagcatggcagcaccaggaatctcttctcaggcagacttcgcagaaaagcttaaaatgattgtgaaaatcctcctaaccgatatgcatttaccgagctttcatcttaaggatgttctcacaactattggcgagaaggtatgcttagaagtgtcttcctgcctgtcgctgtgcggttcctccccctttactacagataaggaaaccgttcttaaaggccagatacaggctgttgcgagccccgatgatccaatcaggagaataatggaaagcagaattttaacatttctggaaacttatctggccagtggccaccagaaaccccttccgacagtgccaggtggactgtcccccgttcagcgggaactagaggaggtggccataaaattcgccagactggtgaattataacaagatggtgttttgcccgtactacgacgcaatactgagcaagattctggtgcgctcctag

SEQ ID NO: 33822 - DNA, 165 bp, Artificial Sequence
  Description of Artificial Sequence: Synthetic coding sequence
atgagcgaaaatctagacaagtctaacgtcaacgaggcaggaaagagcaaatcgaacgattccgaagagggcctcgaagacgccgtggaaggggcagatgaagccctccaaaaggcgattaagtccgatagcagtagtcctcagcgagtccagcggccacattag

SEQ ID NO: 33823 - DNA, 435 bp, Artificial Sequence
  Description of Artificial Sequence: Synthetic coding sequence
atgtccgagaatcttgataaaagtaatgtgaacgaagccggcaagtccaaatctaacgactctgaggagggactagaggacgccgtagagggcgccgatgaagcccttcagaaggctattaagtccgacagctcatctcctcagagagtccagcgcccccacagttcccctcctaggttcgtaactgtcgaggagttgctggagactgcgcgaggggtcaccaatatggcattggctcacgagatcgttgtgaatggggacttccagattaagcctgtagaacttcccgagaacagcttgaaaaaacgggtcaaagagattgtccataaagcattctgggattgcctgagtgtgcaacttagcgaggatcccccagcctatgaccacgcaatcaagctggtcggtgagataaaggaaactttgttgtcgttctag

SEQ ID NO: 33824 - DNA, 1530 bp, Artificial Sequence
  Description of Artificial Sequence: Synthetic coding sequence
atgagtgaaaacctggataaatccaatgtcaacgaggccggcaagagcaaaagcaacgactctgaggagggcctcgaagatgccgttgagggcgctgatgaggcacttcagaaggcaatcaaatcagacagcagctctccccaaagggtccagaggccccacagctcccctccacgtttcgtgaccgttgaggagctgctggaaacggcccggggcgtaaccaatatggccctggcacacgagatagtggttaatggagacttccagataaaaccagttgagctaccagaaaacagtctgaagaagcgcgtgaaggagattgtccacaaggcattttgggactgtctcagtgtgcagctgtcagaggacccaccagcatatgaccatgccattaagttggtgggggagatcaaagaaaccttgcttagttttctgctgcccggtcacacacgactacggaaccagatcaccgaagtcttggatctggacctaatcaaacaagaagccgagaatggagctctggatatctcaaagttggctgagttcattatcggtatgatggggacgctgtgtgcccccgccagagacgaggaggtgaaaaaactgaaggacatcaaagagatcgtgcccctgttccgagaaattttttccgtcttggacctgatgaaggttgatatggccaacttcgcaataagttcaatccgacctcacttaatgcaacagtccgtcgagtacgagcggaagaagttccaagagattctggaaagacaacctaatagtctggatttcgtgacacagtggctggaggaagctagcgaagacctgatgacgcagaagtacaagcatgcactacccgtagggggcatggctgcaggcagcggtgacatgccgagactgtctcccgtcgccgtgcaaaactacgcttatctgaagctcctgaagtgggatcaccttcagaggccattcccagagacggttcttatggatcagagccgattccatgagctccagctgcagctggagcaactgactattctgggagcagttttactggtgaccttctccatggccgctccggggatcagtagccaggctgattttgccgagaagctgaagatgatagtgaagatcctgctcacagatatgcacctgccatcctttcacttgaaagacgtgcttaccaccattggtgaaaaggtgtgcctggaggtctcatcttgcctctctctgtgtggatcaagcccattcaccactgacaaggagaccgtgctgaaagggcaaatccaggccgtcgcaagcccagacgaccctatccggaggattatggaaagcagaatactaacatttctcgaaacctacttggcaagcggccatcagaagccccttccgactgtgccaggaggcctgagcccagtccagcgcgaacttgaggaggtggctattaagttcgcacgcctcgtcaattacaacaagatggtgttctgtccttattacgacgccattttgtcaaaaatactggtgcggtcgtag

SEQ ID NO: 33825 - DNA, 1560 bp, Artificial Sequence
  Description of Artificial Sequence: Synthetic coding sequence
atgcccttcaatggagagaagcaatgtgttggagaggatcaaccatctgactctgactctagccgcttttcagagtcaatggcctcactgtcagactatgaatgtagcagacagtcgttcgctagcgactcgtcctccaaatcctcctccccagcttcaacatccccaccgcgtgtggttacatttgacgaggtgatggctaccgctagaaatctttctaacctgaccttagctcatgaaatcgctgttaacgagaactttcagctaaaacaggaagcactaccagaaaaaagcctggctggacgcgtgaaacacattgtgcaccaggccttctgggacgttttggacagcgagttaaacgcggatccgcccgagtttgaacatgccatcaaactgttcgaagaaatccgcgagatcctcctctcttttctgacacccggcggaaacagactcaggaatcagatctgcgaggtactcgacacggacctgattagacagcaggccgaacactcagcagtggacattcagggcctggccaactatgtgattagcacgatggggaagttgtgtgctccagttcgcgacaacgatatcagggagttgaaggccaccggaaatatcgtagaagtgctgcgacagattttccacgtgctggatttaatgcagatggacatggccaatttcaccatcatgagtttgaggccgcatctgcaacgccagctggtcgaatacgaaagaactaagtttcaggaaatactggaggagactcctagcgcgctggaccaaaccaccgaatggatcaaggagtcggtcaatgaagagctgttttctttgtctgaatccgccctgacgcccggcgccgaaaacacttcgaaaccttcactgagccctactctcgtcctcaataacagttatttgaaattacttcaatgggattaccagaaaaaagagctccccgagacactcatgaccgacggtgccagactgcaagagctaaccgagaagctgaaccagctgaagatcatcgcgtgcttatctttaatcaccaacaatatggtgggagccatcactgggggcctaccggaacttgcatccagactaacccgaattagcgccgttttgctcgagggcatgaacaaagaaacattcaacctgaaggaggtgctgaatagcatcgggatccaaacctgtgtagaagtgaacaaaacactgatggaaaggggtctgcccactttaaacgccgagatccaggccaacttgatcgggcaattttctagcatcgaagaagaagataatcctatctggtcccttatcgacaagcgaatcaagttatatatgcgccggcttctgtgtctgccttccccccagaaatgcatgccgcccatgccaggaggcttggccgtgattcagcaggaactagaagccctgggctcccagtacgccaatatagtgaacctcaacaagcaggtgtatgggcctttctacgcaaatatccttcgcaagctgctttttaacgaggaggctatgggcaaggtggatgcatcaccgccgactaattag

SEQ ID NO: 33826 - DNA, 294 bp, Artificial Sequence
  Description of Artificial Sequence: Synthetic coding sequence
atgccttttaacggggagaaacagtgtgtgggcgaggaccagcctagcgactcggatagctcaaggttttccgaatccatggctagccttagtgattatgagtgcagccgccagagctttgcatccgactcgtcgtcaaagtcctccagccccgcatcgaccagtcccccccgcgtcgtcacattcgatgaggtgatggctacagcgcgcaatctgtcaaacctgacccttgctcacgaaatcgccgtgaatgagaacttccagttaaagcaagaagcccttcctgaaaagtag

SEQ ID NO: 33827 - DNA, 57 bp, Artificial Sequence
  Description of Artificial Sequence: Synthetic coding sequence
atgcccttcaatggtgagaagcagtgtgtgggcgaagatcagcccagcgattcttag

SEQ ID NO: 33828 - DNA, 399 bp, Artificial Sequence
  Description of Artificial Sequence: Synthetic coding sequence
atgccttttaacggtgagaagcaatgtgtaggtgaagatcagccgtctgacagtgacagcagtcggttctccgagtcgatggcatccctgtcagattatgagtgctcccggcaatcatttgcttcagactcttccagcaagagcagtagtccggcgtcgacctcaccaccaagggtggtgaccttcgacgaagtcatggctaccgctcggaacttgtccaacctaaccttggcacatgagatcgcagttaacgagaatttccaacttaaacaggaggcattacccgaaaaaagcttagcaggccgggtgaagcatatcgtgcaccaggccttctgggacgtgcttgactcagagctgaacgctgacccccctgaattcgagcacgctattaagctgtag

SEQ ID NO: 33829 - DNA, 705 bp, Artificial Sequence
  Description of Artificial Sequence: Synthetic coding sequence
atgcctttcaacggagagaaacagtgcgtaggcgaggatcagccctctgattctgatagcagtcgattttccgaatctatggcgtccctgtctgactatgagtgcagccgacagagctttgcttcagattcctcatccaaatctagttctccagccagtaccagccctcccagggttgttacatttgatgaggtgatggctactgctagaaacctcagtaacctgaccttggcccacgaaatagcagtgaatgagaactttcaactgaagcaggaggccttacccgagaaatcactggctggtcgagtgaagcatatcgtccaccaagcattttgggacgtccttgatagtgagttgaacgctgaccctccggaattcgagcacgctataaaactctttgaggagatcagggagatcctgctttctttcctaacccctgggggaaacagactgagaaaccagatttgcgaggtcttagacaccgatcttatcaggcagcaggctgaacactcggcggtggatatccagggcctggccaattatgtaatttcaaccatgggcaaactctgtgcgcccgtgcgcgacaatgatattagagagctaaaagccactggcaatattgtggaagtgctaaggcaaattttccacgtgctagacctgatgcagatggacatggccaattttactatcatgtcactcaggtag

SEQ ID NO: 33830 - DNA, 57 bp, Artificial Sequence
  Description of Artificial Sequence: Synthetic coding sequence
atgcccttcaatggcgagaagcagtgcgtgggggaagaccagccttccgacagttag

SEQ ID NO: 33831 - DNA, 540 bp, Artificial Sequence
  Description of Artificial Sequence: Synthetic coding sequence
atgatgatgagcgataatgctaagggcagagccgcgcacagctggaagaagcgcgggtcaatctcttcgctctcaaaccacgaattctggagaaaagagattcatggcaggattaaggacagtatgtccactgtttcctatatggaggagccatctcagcgagacgacatctcccggcttacagtgcagatggagaacacataccagctgggtccccccaagcattttcctgtcgtcacggtgaaccatattctgaaagacgtggtcacgtcctatctccaggtggaagagtacgaacccgagctctgccgccagatgacaaaaacaataagcgaggtcattaaagcccaggtgaaggatttaatgattccaaggtacaagttgatagtgatagtgcacataggccaactgaacagacaatccatccttataggctctcgctgcctctgggatcccaagtctgataccttttcgtcctatgtatttaggaactccagtttgttcgcccttgccaacgtgtatgctgtctacctggaatag

SEQ ID NO: 33832 - DNA, 429 bp, Artificial Sequence
  Description of Artificial Sequence: Synthetic coding sequence
atggctaccagtatcggcgtgtcctttagtgtcggagacggggtgcccgaggctgaaaagaacgctggggaaccagaaaacacgtatattctgcgcccggtgttccaacagagatttcgccccagtgtagtaaaagattgcattcacgcagtactgaaggaggaactggccaacgcggaatactcgccagaagagatgccccaactgactaaacacctttccgagaatatcaaagataaactgaaggaaatggggttcgaccggtacaaaatggtcgttcaggtggttatcggggaacagcggggagagggcgtgtttatggcttcccggtgtttctgggatgctgacacagataattacacgcacgacgtatttatgaacgattctttattttgtgtggtggctgccttcgggtgtttctactattag

SEQ ID NO: 33833 - DNA, 255 bp, Artificial Sequence
  Description of Artificial Sequence: Synthetic coding sequence
atggcaactagtatcggtgttagcttcagtgtaggtgatggagtcccggaggccgaaaaaaacgcaggagaacccgaaaacacctatatactgcggccagtttttcaacagcgctttagacccagcgtagttaaggactgcatccacgccgtgctaaaagaagagctggccaacgccgagtatagccccgaggagatgccccagctgactaaacacctgtctgagaacattaaagacaaaaaaaagaaaaaatag

SEQ ID NO: 33834 - DNA, 1053 bp, Artificial Sequence
  Description of Artificial Sequence: Synthetic coding sequence
atgagtgccgcttgttgggaagagccatgggggctacccggcggctttgccaaaagggtccttgtaaccggcggcgcaggattcattgcttcacatatgatagtgtcgctggtggaggattaccctaattatatgatcatcaatctggacaaactcgactactgtgcatctctgaaaaatctggagacgatctctaataaacagaattacaagttcatccagggcgatatctgcgacagtcacttcgttaaactgctgtttgagaccgagaaaatcgacatcgtgctccacttcgctgcccaaacccatgttgatctctcatttgtccgcgccttcgagtttacctacgtgaacgtttatgggacacatgtgctggtgagcgcggcccacgaggctcgggtcgagaagtttatctacgtgagcacagacgaagtgtacggtggcagcctggacaaagagtttgatgagtcctcaccaaagcagccaacaaacccctacgccagctcaaaggcagcagccgaatgcttcgttcaatcctactgggagcagtacaagtttcccgttgtgatcacaaggtcctctaacgtatacgggccgcaccagtacccggaaaaagtgataccaaagtttatcagtctgttacagcataatcggaagtgctgcattcacggtagtggcctgcagacaagaaacttcctgtatgcaacagatgtagtcgaagcattcctgacagtgcttaaaaaaggaaaaccgggggagatatacaatatcggcaccaacttcgaaatgtccgtggtgcaactggcaaaagagttgattcagcttataaaggaaacaaactcagagagcgagatggagaattgggtggattacgttaatgatcgaccaaccaatgatatgcgatatccaatgaagagcgaaaagattcacggactggggtggaggcccaaagtcccttggaaggagggaatcaagaagaccatagaatggtacagagaaaactttcataactggaagaatgtcgagaaagcactggagccttttcccgtatag

SEQ ID NO: 33835 - DNA, 4236 bp, Artificial Sequence
  Description of Artificial Sequence: Synthetic coding sequence
atggcatcaatctccgaacctgtgaccttcagggagttttgtcctctctattatctccttaatgcaataccaacaaagatccaaaagggattcaggtccatcgtggtgtacctcaccgcactggatacaaatggtgactacatcgctgtaggcagtagcatcgggatgctgtatctgtactgcaggcaccttaatcaaatgagaaagtataatttcgaggggaaaaccgagtcaatcacggttgtgaagctgctgtcttgcttcgacgacctggtggcagctggcactgcctctggaagggttgccgtttttcagctggtgagctctctgcccggccggaataaacaactgcggcgtttcgatgttaccggtattcataagaacagcatcacggcactcgcttggtcgccaaatggaatgaaacttttctccggggatgacaaagggaaaattgtctacagcagcctggaccttgatcagggactgtgtaacagccagctggttctggaagagccatcctccattgtgcaattggattattctcagaaagttctattggtttctactctccagaggtctttactgttttacaccgaggaaaagagcgtcaggcagatcggcacacagccacggaagtccacgggaaagttcggcgcatgttttattccgggtctttgcaaacagtccgacttaactctttatgcctctagacctgggttgagattgtggaaggcagatgttcatggtaccgtgcaggctacgtttattctcaaggatgctttcgccggcggcgtcaagcccttcgagctgcaccctcggttggagtcacctaactctgggagctgtagtctacctgaaaggcacctcggattggttagttgcttttttcaagagggctgggttctgtcctggaatgagtacagtatttaccttctcgacaccgtcaatcaggcaacggttgcagggctcgagggatcgggcgacatcgtgtctgtatcttgtacagagaacgaaatcttttttttaaagggagatagaaatattattagaattagctcccgcccagaaggcttgacgagcacagtgcgtgacggcttagaaatgtctggttgttcggagcgtgtgcacgttcagcaagcggagaaactgccaggcgcgacagtgagcgaaaccaggttgaggggctccagcatggcatcgtctgtggctagcgagcccagaagtagatcgtctagccttaattcaaccgatagtggctccgggttgctgccccccggcctgcaggcaacgcctgagctcggtaagggtagccagcccttaagccagcggttcaacgccatatcctccgaagactttgatcaggagctggtcgttaagccaatcaaagtcaagagaaagaagaagaagaaaaagactgagggaggctctcgcagcacgtgccatagcagcctcgagtccacaccatgttccgagttccctggcgattcgcctcagagtctgaatactgacctcctaagtatgacaagttccgtgttagggtctagcgtagatcaactctctgccgagtcaccagaccaggagagttctttcaacggtgaggtaaacggtgtgcctcaagagaacaccgacccggaaacgtttaacgttctggaggtctcaggttccatgcccgactcattggccgaagaagatgacataagaaccgagatgccccattgtcatcatgcccacggaagggaactgctgaacggggcgagggaggacgttggaggctctgacgtgactggcctgggggacgagccatgtcccgctgacgatggtccaaatagtacccagctgccttttcaggagcaggattcttccccgggcgctcacgacggggaggatatccaaccgatcggccctcagagcaccttctgcgaagtacccctgctaaacagcctgacggtcccctccagcctcagctgggcaccttccgcggagcagtggctacctggtacaagggctgacgagggctcccccgttgaaccaagccaggagcaggacatcctgacatccatggaggccagcgggcacttatccaccaatctatggcacgccgtgacagacgacgacacagggcaaaaggaaatccctatctcagagagggtcttgggctcagtcggagggcagctcacccctgtaagcgctctcgcagcctctactcataagccctggcttgagcaaccaccccgtgatcagaccctgacttcctcagatgaagaggatatttacgcccacggactcccaagctcttccagcgaaactagcgtgacagagctgggaccaagttgttcccagcaggacctgtccagactgggagctgaggacgccggcctcctgaagcccgaccaatttgccgaaagctggatggggtacagtggccccggctacggaatcttgagccttgtggtgagtgaaaagtacatttggtgcctggattacaaaggcgggctcttttgcagtgcgctgcctggagccgggctacgctggcagaagttcgaggatgccgtgcagcaggtcgctgtctctccatctggagctctactgtggaaaattgagcaaaagagtaacagggccttcgcctgtgggaaagtcaccattaagggaaagaggcactggtacgaggcccttcctcaggccgtattcgtcgctttgagcgacgataccgcctggattataaggacgtctggcgatttgtacctccagactggcctcagcgttgaccgcccgtgcgctagggccgtgaaggttgactgtccatacccactttctcagatcacagctagaaataacgtggtgtgggcattgactgaacagcgcgcactcctatatcgggagggtgtgtcctcgttttgccccgagggcgagcaatggaagtgcgatatcgtgtccgagcggcaggcactggaacccgtttgtatcactttgggggatcagcaaaccttatgggccttagacattcacggcaacctctggttccgcaccggtataatctcaaagaagccccagggcgatgatgaccattggtggcaagtaagtataaccgactatgtggtcttcgaccagtgttctcttttccagactattatccatgccactcattcagtggcaacagctgcccaggcgccggttgagaaagtggctgacaaactgcgcatggcattctggagccagcaattgcaatgtcagccatctttgttgggtgtcaataatagtggggtctggattagtagcggaaagaacgaatttcacgtggccaaaggcagtctgatcggtacgtactggaaccatgtcgtccctcgcggaacagcctccgcgacaaaatgggcatttgtgttagctagcgctgcccccactaaggaagggtccttcctctggctgtgtcagtccagcaaggacctttgctctgtgtccgcacaatcagcgcaatctcgaccgtccacagtacagctcccacccgaggctgagatgcgggcatacgctgcttgtcaggatgctctatgggccttggatagtctgggacaggttttcatacgtaccctcagtaaaagttgtccaacaggaatgcactggacccggctagacttgtcccagctgggcgcggtgaagctgacatctcttgcctgcggcaatcagcatatatgggcttgtgacagtagaggcggcgtgtattttcgggtcggtacccagcctctgaacccctctcttatgctacctgcatggataatgattgaaccccccgtccagccggcaggcgtctcgctggtgtcagtccatagtagccccaatgaccaaatgctctgggtcctggacagccgatggaacgtgcacgtgcggacggggatcacagaggagatgcctgtggggaccgcgtgggaacatgtgcctgggctccaggcctgccagcttgctcttagtactcgcacggtctgggcacgctgtccaaacggggacctggcgagacggtatggcgtcacggacaaaaacccagccggggactattggaaaaagatacccggatccgtctcttgttttacagtgacagccagcgatgaactgtgggctgtcggcccccctgggtacctactacagcggctgactaagacctttagccactctcatgggacacaaaagagctcccaagccgctatgccccaccctgaagacctggaggatgagtgggaagtcatctag

SEQ ID NO: 33836 - DNA, 2202 bp, Artificial Sequence
  Description of Artificial Sequence: Synthetic coding sequence
atggccagcattagtgaacctgtgacattccgcgagttttgtccactttactacctactgaacgcgattcccacaaaaatccaaaaaggtttccggtcaattgtggtgtacttgacggccctcgataccaacggcgattacatcgctgtgggcagttcgattgggatgctatacctgtactgccgccatctcaatcaaatgaggaagtataactttgaaggtaagactgagagcatcaccgtagtgaaattactgagctgtttcgacgatctagtcgccgcaggtaccgcctcaggccgagtggccgtctttcagcttgtcagtagtctcccaggccgtaacaagcagttacgccgattcgacgtgaccggcattcacaaaaactccatcaccgcgctcgcatggtccccaaatggaatgaaactgttttctggagacgataaggggaaaatcgtatatagcagccttgacctcgatcaggggctctgcaacagccagttggtcctggaggaacccagcagtattgtgcaactggattattcccagaaggtgttattagtatcgacattgcagcgttcattacttttctacacggaggaaaagtctgtgaggcagattggtactcaaccccggaaatccactggaaaattcggcgcatgttttatcccaggtctttgcaaacagtctgatctgaccctctatgcgtccagacccggactgaggttgtggaaagccgatgttcatgggactgtccaagcaacttttatccttaaagatgcatttgcagggggggtgaaaccatttgagctgcaccctcggctagagtctcctaacagcgggtcatgtagcttacccgagcggcatctcggactggtgagttgcttctttcaagagggctgggtcttgtcgtggaacgaatatagtatctatctcttggacaccgttaatcaggccactgtggccgggctggagggttctggcgatatagtgtccgtcagctgtactgagaatgagatcttcttcctgaaaggcgataggaacattatcagaatctcttcaaggcctgagggccttacatccaccgtgcgagacggactggagatgagtgggtgctctgagcgcgttcatgtgcagcaggccgaaaagctgccgggggctaccgtgagcgagacgcgtttacgaggtagctctatggctagttctgtcgcatcagagccccgctctcgctcttcctctctgaattctaccgactccggcagcggtcttctcccgcctgggctccaggccacccccgaactggggaaaggctctcagcctctatcccagcgttttaatgcgataagctctgaggattttgaccaggaactggtagttaagcctattaaggtaaaacggaagaaaaaaaagaagaagactgaggggggtagccgatccacgtgccattcctcgttggagagcaccccatgctcagagtttcccggcgactctcctcagagcctgaacacagatctccttagcatgacatcctctgttctgggtagttctgtcgatcaactgtctgctgaatcccccgatcaggagagcagcttcaacggcgaggtcaacggagtcccacaggagaacacggatcccgaaactttcaatgttctggaggtgagcgggagcatgcccgactcccttgccgaagaagacgacatcaggaccgagatgccccactgtcaccatgcacatgggagggagctactgaacggagctcgcgaagatgtcggaggctcagatgtgaccggtctaggcgacgaaccctgtcctgccgacgacgggcccaatagcacacctcaacacaccacccacctgacctcccaccattctacgccacatcataccactcctcactgtacaattccacatcacatctctccccaccatagcacgcctcaccatactacacatcatactcctcaccgcacagcgccccataggacagcaccgtacttggccacgagtcaccacaccacccctcatcacacaagcctcccaacacacggcgcgggatgtccacctccaggggaacacacatcagctgaaacggtgaaaccagatggttgtaagtggaacctggatgtatgtacctgcgttcccggacgcgacggaactggcggatgtatgggcagagggggtgccgagcaggggtcgttaacatag

SEQ ID NO: 33837 - DNA, 3804 bp, Artificial Sequence
  Description of Artificial Sequence: Synthetic coding sequence
atggctagcattagtgagcccgtgacgttcagggagttttgccccctctattacttgcttaatgcaatccccacaaagatccagaagggattccggtccattgtcgtgtatctgaccgcccttgacaccaacggcgattacatcgctgtcggctcctccatcggcatgttgtatttgtattgtcggcaccttaatcagatgcggaagtacaacttcgagggcaaaacggagagcatcacagtagtgaagctgctgagttgtttcgatgacctcgtggcagctggtaccgctagcggacgcgtggcagtattccagctggtctccagtctccctggcaggaataaacagctgcggaggtttgacgtcaccggcattcacaaaaactcgataactgcactggcatggtcccctaatggcatgaagctcttctccggcgatgacaaaggcaaaattgtctactcatcactggacctggatcaggggctgtgtaacagccagcttgttcttgaagagccctccagtattgtccaattggattactcacaaaaggtgctattggtatctactctgcagcggtcactgcttttttataccgaggagaagtcagtgcgtcagattggaacccagcccagaaagagcaccgggaaatttggagcatgtttcatccctggtctttgcaagcagtccgacctgactctctacgcgtcgcgtcccggcctgcggctctggaaagcagacgtccacggtactgtgcaggccacatttatactgaaggacgcctttgctggcggggtgaagccattcgaactccaccctcggttggagtctcccaattccggaagctgtagtctgccagagaggcatctgggactggtgtcctgcttcttccaggagggctgggttctgtcctggaatgaatactcaatctacctgctggatacagttaatcaggcaactgtggctggtctcgaaggctctggcgatattgtgtccgtgtcttgcacagaaaacgagatcttctttctgaagggagatcgcaacatcattagaattagctcacggcccgagggcctcaccagcaccgtacgtgatggtttagagatgagcgggtgctcagagcgggtccacgtccagcaggccgagaagttaccgggggccaccgtgagcgagacacgcctgcgcggcagttccatggccagctccgtggcatccgagcctaggtctcggtcttcctcactgaactctacagattccggctcgggcttactgccgcccgggttgcaggcaacccctgaactcggcaagggatctcagccgctgagtcagagattcaacgcaatcagtagtgaggatttcgatcaagaactggtggtgaagcctataaaggtcaagagaaagaagaagaaaaagaagaccgaagggggatctcggagtacttgtcactcgagcctggagtccaccccttgttctgagtttccaggggacagccctcagagcctcaatactgatctactgtccatgacttctagtgtgttgggatcatccgtcgatcagttgtccgctgaatcccccgatcaggaaagtagcttcaatggtgaggtcaatggagtgccacaggaaaatactgaccccgaaacctttaacgtgctggaggtgagcggctcgatgccggactccttagcggaagaagacgacatccgtacagagatgcctcactgccaccatgctcacggccgcgaactcctcaacggcgcgcgagaggacgtgggcggaagcgacgtcactggcttgggagatgagccctgcccggcagatgatggacccaactcaactcagcttccattccaggaacaggattcatctcctggagcgcatgacggagaagatatacagccgatcgggccccagtccaccttctgcgaggtccctctactgaatagcctcacagtaccctcttctttatcatgggctccttccgccgagcagtggctgccaggcactcgggccgatgagggaagcccagtggagccctcccaagagcaggacattctgactagcatggaagctagcggacacttgtctacaaatctgtggcatgcagtgacagatgacgatacaggtcaaaaggaaatccccatttctgagagagtgctcggaagtgtgggtgggcaactgacgcctgtatctgctctagccgcctctacccataaaccatggctggaacagccaccaagggatcagactttgacgtcatcagacgaggaagacatctacgctcacggactcccatccagtagcagcgagacttctgtgaccgaactgggaccatcctgtagtcagcaggatctgagccgactcggagctgaggacgctggactgctgaaaccagatcagttcgccgagagttggatggggtacagtgggcccggctatggaattctttctctggttgtgtcagaaaaatacatttggtgtctcgactacaaagggggtctgttttgctccgctttgccaggagccggcctcaggtggcaaaagtttgaagatgccgtccagcaggtggctgtctctccttccggcgccctactgtggaagatcgaacagaagtcaaatagggccttcgcttgtggaaaagtaacaatcaaagggaaacgtcattggtacgaagcccttccgcaggccgtttttgtggccctgtcggacgatacggcctggattatccgtacaagcggggacctctaccttcagactgggctgagtgttgacagaccctgtgcccgcgctgtgaaggtggactgcccatatccactgagtcaaatcaccgctcgtaacaatgtagtgtgggcgctgacggaacaaagagctctcctatatagagagggcgtttctagtttctgccctgagggggagcaatggaagtgtgatatcgtgagtgagcggcaagccctcgagcctgtgtgcattactctcggagaccagcagactctctgggcacttgatatccatggaaatctttggttccgcactgggataatatcgaagaagccgcaaggcgatgatgaccattggtggcaggtctcaatcacggattacgtagtcttcgatcaatgcagcttgttccaaaccattatccatgcgacacatagcgtggctactgctgcccaagctccagttgagaaagtagccgacaagctgcggatggcattttggagccagcagctgcaatgccagcccagcttgctaggtgtcaacaactccggggtttggattagctccggcaagaatgaattccacgtggcgaagggcagcttgatcggaacctattggaaccacgttgtgcctcgaggaacagcatcggctaccaaatgggctttcgtgctcgcttccgcagcgccaactaaagaggggagttttctttggctgtgccagtccagcaaggacctgtgcagtgtgtctgcccagtccgcccagagtagaccttccaccgtccagctgcctccggaagctgagatgagggcgtacgccgcatgccaggatgccctgtgggccttggattccttaggtcaggtgttcatcagaacactgagcaagtcttgtcctacgggaatgcactggactaggttagacttatcacagctcggtgcagtcaagcttacatccctcgcatgtggaaatcaacacatttgggcttgcgacagccgcggcggcgtgtatttccgtgtggggacccaaccattgaatccatccctcatgctgcccgcctggattatgattgagccccctgttcaagtgtctcgatcctag

SEQ ID NO: 33838 - DNA, 453 bp, Artificial Sequence
  Description of Artificial Sequence: Synthetic coding sequence
atggatagtaggaaacttagccctcgaggcaagaagcttgagtcccacctgagccaggaacacaggcgcccacctttaggactaatagctgcctggggacagccatccattcagtcgtccgtgcagcaaggcctacagacacaagactgggtgtgcgagccccctgagcggcggcgacccggtcgacggtggtcggtctctattgacgaacgcagacggcttgcaacactgggaggtcgggagcgacccggtgccgccggaacccagctgcattgcagagatgttgtgcaaatggtggcacaactcgtgtcagaggatgtggataaagatgtcttgctgccccaccccttgcgctccactgagagcactaacgccttccaagcttttcttgctagatctgccccgttctggcataatgccacattcgaggcgtccaggtcccctccatcttag

SEQ ID NO: 33839 - DNA, 621 bp, Artificial Sequence
  Description of Artificial Sequence: Synthetic coding sequence
atggactctcagcaggaagaccttaggtttcctgggatgtgggtgtcactatacttcggaatcctgggcctgtgtagcgtgatcacaggaggctgtattatattcttacactggcgtaagaatcttcgacgcgaggagcacgctcagcagtgggtggaagtgatgcgagccgcaaccttcacctactctccattgttgtactggattaataagcggagacgctatggaatgaacgcagctatcaatacaggacctgctccagccgtcaccaaaaccgagaccgaggtccagaatcctgatgtcttatgggatctggacatcccagagggacgctcacatgctgaccaagactccaacccgaaagctgaagccccagctcccctgcagccagcactgcagttggcccctcagcagcctcaggcccgtagtccatttccactccccatctttcaggaggtgccattcgctcctcccctttgtaatttacctccactgttgaatcatagcgtgtcctacccccttgcgacttgtcctgaacgcaatgtgttgtttcattctctgctgaacctggcccaggaagatcacagcttcaatgccaagcctttcccatccgaattatag

SEQ ID NO: 33840 - DNA, 1176 bp, Artificial Sequence
  Description of Artificial Sequence: Synthetic coding sequence
atggcaggccggagcctttgcctcacacggtcttcagtgcccgggactccattcccacccccagtgcaacagccttcaacacctggcccagatctgctcgccctggaagaagagtacaaacgcctcaacgccgaactgcaggctaagaccgcagacgtcgtgcagcaggcgaaagaaatcataagagatcgacaggaagtgcgctcaagaccagtgtctacacagatgaagtcatgtgacgatgaagatgactattccttgagggggctgcttccatccgaagggatcgtgcatctgcactcggagacgaaacctaagaccaagaatatcgacccagtcaacaaggtccaaaataagctgcatagcgccaacaagggaagaaaaaccaatagtagcgttaaactcaagtacagcgacgttcagacagctgacgacgttgccatccccgaggacttctccgatttctccctcgcaaagaccatctcgaagattgagggacagctcgaggaggagggcctcccagagtatattgacgacatcttttccggcgtctctaatgatatcggtaccgaagcacagatacgatttcttaaggcaaaactgcacgtcatgcaggaagagctggacaatgttgtgtgcgagtgtaacaagaaggaggatgagattcaaaatctaaagtcccaggtgaagaatttcgaagaggacttcatgcgtcagcagcgcaccatcaatatgcaacagtctcaggtcgagaagtataagaccctgttcgaggaagcaaacaagaagtatgatggcctccaacaacagctgtcttccgtggagagggagctggagaataaaaggagactccagaagcaggcagccagctctcagagcgccaccgaggtgcggctgaaccgggcactggaagaagcagaaaaatacaagctcgagctgtccaagctgcgtcagaataataaggatatcgccaacgaggagcataagaagattgaggtgttgaagtccgagaataagaaactggaaaagcaaaaaggcgagcttatgattggcttcaagaaacagctcaagctcatagatgtcctcaaaaggcaaaagatgcacatcgaagctgctaaaatgctgtcctttacagaggaagaattcatgaaagcccttgagtggggcaacagctag

SEQ ID NO: 33841 - DNA, 951 bp, Artificial Sequence
  Description of Artificial Sequence: Synthetic coding sequence
atgaaatcatgcgatgacgaagatgactattcattacggggcttgctccccagcgaaggaatcgtccatctgcattcagagaccaagcccaaaactaaaaacatcgacccggtaaataaggtgcaaaacaagctgcattccgccaataagggacggaagaccaattccagcgtaaaactcaagtattcagatgtccagacggcagatgatgtggccatccccgaggacttctctgatttttctcttgcaaaaacaatttccaaaatcgaaggtcagttggaagaggaaggcctccccgagtatatcgatgatatatttagcggtgtgtccaatgatatcggcactgaggcccagatccgttttctgaaggcaaaattgcacgtcatgcaagaggagctagacaacgtcgtgtgtgaatgcaacaagaaagaagacgaaatccagaacttgaaaagtcaggttaaaaacttcgaggaggactttatgcgacagcagcgtacaatcaacatgcagcagtctcaggtcgaaaaatacaagaccctgtttgaagaagcaaacaagaagtacgacggcctccaacagcagctgagttccgttgagagagagctggaaaataagagaagactccagaagcaagccgccagttcccagtctgctacagaagtgaggctgaatcgtgctctggaagaagcagaaaaatacaagttggagctctccaagcttcggcagaacaacaaggacattgcaaatgaagaacataagaagattgaggtgttgaagagcgaaaataaaaaactggaaaagcagaagggggagctgatgatagggtttaagaaacagcttaaactcatcgacgttctcaagaggcagaaaatgcatatagaggccgccaagatgctatctttcacggaagaagaatttatgaaagccctcgaatggggaaattcttag

SEQ ID NO: 33842 - DNA, 828 bp, Artificial Sequence
  Description of Artificial Sequence: Synthetic coding sequence
atgtcccagaagcggcagaccaagtttcagaacgggaagtctaaaacctctgaaaactcttctgcaaaaagagaaaaagggatggtggttaatagtaaggagatcagcgacgccgtaggtcaatccaagttcgtcctcgaaaacctgcggcactacacagtacacccaaatctggcacagtattataagcctcttaaggccacagctctccagaagtttctggcccaaaataggaagaacaccagctttatgttgaaagtcactcaatacgatcaagataaaactctactgatcatgactaacaacccccccccctgttcaattactcaacaggataaggagtcggccagcaagtacttcagcaaagagctactgttaaaggtgatggagagtcaccaccagcataagcccacagaaaatctctggctgccccgaatgccccagaagaaaaaacttcggagtaaacttaagcccatcttccccctgattctgagcgatgaccccacttcaaagagagaacaatggtttcggttttcaaccgacaacgacttcaaaagcgaggggaagtactccaaggtttatgctctcagaacccaaaagaaaatgtaccctcaattgaccttcgcacctgtccacgaaagggacatgaggaaggacgcgtcgaaaaagtctgcatctgagcgacctatctccaaggtcattagggagccactgacattggccagcctgttggaggacatgcctactcggaccgccccgggcgaaagcgccttcaggaacggcagggcccctcagtggatcattaaaaaagctaccgtgataggctag

SEQ ID NO: 33843 - DNA, 927 bp, Artificial Sequence
  Description of Artificial Sequence: Synthetic coding sequence
atgcgacctgaggggtcactcacttacagggtccccgaaagactgagacagggcttttgtggtgtcgggcgtgcagctcaagctctggtctgcgccagtgcaaaggagggaactgcatttcgcatggaggctgtccaggagggggcggccggcgtggagagcgaacaggcagcacttggagaggaggcagtactcttgctggatgacatcatggccgaggtggaagtggtcgccgaggaagagggactcgtcgagagaagggaagaggcgcagagagcccaacaggcagtgcccggcccaggacccatgaccccagagtcagcattggaggagctgttggctgttcaagtcgagcttgagcccgtcaatgcacaagccaggaaagctttttctcgccaaagagaaaaaatggaacgccgccggaagccgcacctggacaggagaggcgctgtcattcagagtgtgcctggcttctgggcaaatgtgatagccaaccacccacaaatgagcgcactcataaccgatgaggatgaggatatgctctcttatatggtcagtctggaggttgaggaagagaagcacccggttcacctctgcaagatcatgctgtttttccgctccaacccttacttccaaaataaggtcatcaccaaggaatacctcgtgaatatcactgaatatcgtgcctcccattcaactcctattgagtggtatccagactatgaggtcgaggcctaccgccgacggcatcataacagctccctgaacttcttcaactggttctccgaccacaacttcgctggctcaaacaaaattgctgagattctatgtaaggatctgtggaggaatcctctacagtattacaaaagaatgaagccacctgaggaggggacagagacgagtggcgactctcagctgttaagctag

SEQ ID NO: 33844 - DNA, 441 bp, Artificial Sequence
  Description of Artificial Sequence: Synthetic coding sequence
atgagacctgagggatccctcacatacagggtgccagagcgtttacgccagggcttttgtggcgttgggagggcagctcaggccctggtggaactggagcccgtaaacgcccaggccagaaaagcatttagtagacagagagaaaaaatggaacgcagacgcaaacctcatctcgacaggaggggtgccgttatacagagcgtgccgggcttctgggctaatgtgatcgccaaccatccccagatgagtgctctcattacagacgaggatgaggacatgctctcttacatggtgtctctggaggtagaggaagagaaacaccctgtccatctatgcaagatcatgttgtttttcaggtccaatccctacttccagaataaagttatcacgaaggaatatctcgttaatatcacagagtacagagcttcccacagtacctag

SEQ ID NO: 33845 - DNA, 885 bp, Artificial Sequence
  Description of Artificial Sequence: Synthetic coding sequence
atgcggcctgaaggtagcctcacgtatagagttcccgagagacttcgacagggcttttgcggggtggggagggctgcccaggcgctggtgtgtgcgtccgccaaagaaggaactgccttcaggatggaggccgtgcaggaaggtgcagcgggggtggagtcagaacaggcagcactcggagaggaggccgtgcttctgctggacgacattatggctgaagtggaagtcgtagctgaggaggagggtctggttgagcgacgcgaggaggcacagagggctcagcaggcagtgcctggacctgggccgatgactcctgagtcagcattggaggagctgctcgccgttcaggtagagctagaacccgttaacgctcaggccagaaaggcatttagccgacagagggaaaagatggaaagaagaagaaaaccccatctggacagaagaggggcagtaattcagtctgtcccgggattctgggccaatgtgatagccaaccaccctcaaatgagcgctctcatcaccgacgaggacgaagatatgttatcctatatggtcagtcttgaggtggaggaggagaaacatcctgttcacttgtgcaaaattatgctgtttttccggagtaatccctactttcagaacaaggtcatcacaaaagaatacctcgtgaacatcaccgagtacagagcgagccattcaacaccaatcgagtggtaccccgactacgaagtggaagcgtatagaaggagacaccacaactcttccctgaactttttcaattggttttctgatcacaattttgccggctcaaacaaaatcgcggagagccccgatcgcagctacgtcagaacctgcggcgcaatcccttgtaatactacacggggatag

SEQ ID NO: 33846 - DNA, 927 bp, Artificial Sequence
  Description of Artificial Sequence: Synthetic coding sequence
atgcgccctgaaggcagcctgacataccgtgtgcctgagagactcaggcagggaagctgcggggttggccgggcagcccaggccctggtgtgtgctagcgccaaggaaggcacggccttccgaatggaagcggtccaagaaggagcagctggcgtagagagcgagcaggcagcgctgggggaggaggctgtcctgttgctcgatgatatcatggccgaagttgaagtagtagctgaagaagagggtctggtggaaaggcgagaggaggcccagagggcccagcaagcagtccccggtccaggacccatgacacctgagtccgcattagaagaactgctggccgtgcaggttgagttggaacccgtgaacgcccaagcgcggaaggcattcagtcggcaaagggaaaaaatggaacgaaggaggaagcctcacctggatcggaggggagcggtgatacagtcggtaccggggttttgggctaacgttatcgctaaccaccctcaaatgtcagctctgatcactgatgaagacgaggacatgcttagttatatggtgtcactcgaagtggaggaggagaagcacagagttcacctgtgtaagattatgctgttcttccgctcaaatccctattttcagaacaaggtgattaccaaagaataccttgttaacatcactgagtatcgggcctcgcactctactcctattgaatggtacccagactatgaggttgaagcatatagacggcgccatcacaactccagcttgaacttcttcaactggttctccgatcacaattttgcaggcagtaataaaatagctgaaatcctgtgtaaggatctgtggaggaaccctcttcagtactacaaacgaatgaagccgcccgaggaagggactgagacctctggagattcacagcttctgagctag

SEQ ID NO: 33847 - DNA, 795 bp, Artificial Sequence
  Description of Artificial Sequence: Synthetic coding sequence
atgcggcccgagggtagtctgacgtaccgggtacccgaacgcctgcgccaggggttctgtggtgtcgggcgagccgcccaggccctggtctgcgcgagcgcaaaggaggggacagcatttcgcatggaggcagttcaggagggcgccgcaggagttgaaagtgaacaggcggcactgggtgaagaggccgtgctattgttagacgatataatggccgaggtggaagtggtcgcagaggtggaagtggtggccgaggaggaggggcttgtcgaacgtagagaggaagcccaacgagcacagcaggcagtgcccgggcctggacccatgacccccgaaagcgcccttgaagagttgctggctgttcaggtggagttggagcccgtcaacgcgcaggcacggaaggcattttctagacagcgggagaagatggagcgcagacgtaagcctcacctagatcggcgcggagccgttatccagagcgttcctgggttttgggcgaacgtgatcgcgaatcacccacagatgtccgctctcattacagatgaagacgaggacatgctgtcgtatatggtgtccctcgaagtggaggaggagaagcatcctgtgcacctctgtaagattatgttgttcttccgcagcaatccctactttcaaaataaggtcatcaccaaggaatacctcgtgaatattacaggagacaggtggctgccaggctgggtcgtggagggaaggtggtgggttgaccactgtcaacgtgatccggcaccattcccccagaagctactaagtttgtag

SEQ ID NO: 33848 - DNA, 516 bp, Artificial Sequence
  Description of Artificial Sequence: Synthetic coding sequence
atgcggccggaagggtcactgacatatcgcgtccccgagaggttgaggcagggcttctgtggagtaggaagagctgctcaggcgctggttgagttagagcctgtgaacgcacaggccaggaaagccttctccagacaacgcgagaaaatggagaggcgacggaagccacatttagaccgacgcggcgccgtaatccagagcgtcccaggattctgggccaacgtcattgctaatcatccacagatgagtgccctgattacagacgaggacgaggatatgctttcatacatggtgagcctagaggtggaggaagaaaagcatccagttcatttatgcaagataatgttgtttttccgcagcaacccttatttccagaacaaggtaatcactaaggagtatctggtgaacattaccggagacaggtggctgcctggctgggtagtcgaagggagatggtgggtggatcactgtcagcgagaccctgccccattcccccagaagcttctttcactctag

SEQ ID NO: 33849 - DNA, 927 bp, Artificial Sequence
  Description of Artificial Sequence: Synthetic coding sequence
atgcgccccgaaggttctctcacttacagagttcccgagcgcctgcgccagggattttgtggtgtgggacgcgccgcccaggcactggtctgcgcctcggctaaggaggggaccgcctttagaatggaggctgtgcaggaaggcgcggcaggagtggagtccgaacaggctgcgttaggtgaagaagccgtcttactcctggatgatataatggctgaagtggaggtggtggccgaggaggagggtctcgttgaacggagggaggaggcacagagagcccagcaagctgtgccaggacctggccctatgactccagagtccgccttggaagaactgctcgcagtccaggtggagctggagcccgtaaatgcacaagccagaaaggcattctcccgccagcgggagaagatggaacgccgtagaaaacctcacttagacaggcggggggcggttatccagagcgtgccagggttttgggcaaatgtgattgcgaaccacccacagatgtcagcccttatcaccgacgaagacgaggatatgcttagctacatggtgagcttagaagttgaagaggaaaaacatcctgtccacctctgcaagatcatgctctttttccggtcaaacccctattttcagaataaggttattaccaaggagtatctggtcaacatcactgagtatcgagccagccacagcacccctatcgagtggtatccagactacgaggttgaagcttacaggagacgccatcacaactcatccctgaacttctttaattggttctccgatcataattttgctggcagcaataaaattgctgagatcctgtgcaaagacttgtggcgcaatccccttcagtactacaagagaatgaagccacctgaggaggggacagaaacaagcggggacagtcagctcctgagctag

SEQ ID NO: 33850 - DNA, 927 bp, Artificial Sequence
  Description of Artificial Sequence: Synthetic coding sequence
atgagacccgaggggtcccttacctatcgcgtgcccgaacggcttcggcagggcttttgcggagtgggcagggcggctcaggcactggtgtgtgcctcagcaaaagagggcactgcttttcggatggaggcagtacaggaaggcgctgctggagtcgaatcagagcaggccgctctaggggaagaggctgtgctgttgcttgacgatattatggcagaagtagaagtggtggctgaagaggagggcctcgtagaaaggagagaggaggctcagcgggcccagcaagccgttccaggtcccgggcctatgaccccggagtcagccctcgaggagctgctagcagtgcaggtggaacttgagcctgttaacgcacaggcacgaaaagcattttcacgacaaagagaaaagatggagcgtcggagaaagcctcatctggatcgtaggggtgcggtgatccaatcagttcctgggttttgggccaacgttatagcgaatcacccacagatgtccgcactcatcacagacgaggatgaggacatgctgtcgtacatggtgagcttagaggtggaagaggagaaacacccagtccatctctgtaagataatgctcttcttccggagcaatccgtacttccaaaataaggtgataaccaaagagtacctggtgaacattaccgaatatagagcctcccactcaacacccatagagtggtatcctgattatgaggtcgaagcatacaggagacgtcatcataacagctccctgaatttctttaattggttctccgaccataactttgcggggtccaataagatcgctgagattctgtgtaaggacctctggcggaaccctctccagtattataagcggatgaaaccaccagaggagggaaccgagacaagtggcgatagtcagctgttaagctag

SEQ ID NO: 33851 - DNA, 903 bp, Artificial Sequence
  Description of Artificial Sequence: Synthetic coding sequence
atgagacccgagggctctttgacctatcgagtgcctgagcgcttgaggcaagggttttgtggtgtgggacgtgctgcccaagctcttgtgtgtgcaagcgccaaagaagggacagcatttcgtatggaggcggttcaggaaggagcagctggggtcgagagtgaacaggcagcactgggggaggaagcagtcctgctgctcgatgatatcatggccgaagtggaagtagtagcagaggtggaagtcgtggccgaggaggaaggcttagtagaaaggcgagaggaggcccagcgcgctcaacaggcggtgcctggtcccgggcccatgacgccggaatccgccctcgaggagcttctggccgtgcaggtagagttggaaccagttaatgcccaagccaggaaggcgtttagcaggcagcgcgagaaaatggaacgaagacgaaagccacacctcgaccgcagaggtgcagttatccagtccgtgcctggtttttgggccaacgttatcgccaaccatcctcagatgtcggccctcatcactgatgaagatgaagatatgctgagttacatggtgtcattagaagtggaggaagagaagcatccggttcatctgtgcaaaataatgctcttttttaggagtaatccctactttcagaacaaggtcatcacgaaggaatacctcgtaaacatcacagaatatagagcaagccatagcacacccattgagtggtacccagattatgaagtcgaagcttacagaaggagacaccacaattcatcactaaatttctttaactggttttccgaccataactttgcagggtctaacaagatcgcagagtcacccgatagaagctatgtgagaacctgcggggcaatcccctgcaacaccaccagaggctag

SEQ ID NO: 33852 - DNA, 945 bp, Artificial Sequence
  Description of Artificial Sequence: Synthetic coding sequence
atgaggcccgagggcagtctgacttaccgtgttccagagcgtctgcggcagggcttttgcggtgttggccgggctgcccaggccctcgtgtgcgcaagcgccaaggaagggaccgccttcaggatggaggctgtgcaggagggtgctgccggagtagaatctgaacaagctgccctcggcgaggaggccgtcttattgctggatgatatcatggcagaggtggaagtggtagctgaagtcgaagtcgtggccgaagaagagggcctcgtagaaaggagggaggaggctcagcgcgcccagcaagctgtgcccggccccggcccaatgacgcccgaatctgccctggaagaactccttgctgtccaagtcgaattagaacccgttaatgcgcaggcacggaaggctttttcccgtcagagggagaagatggagaggaggcgcaaaccacatctggacaggagaggtgctgtaattcagtccgtaccaggcttttgggccaatgtcattgccaaccaccctcaaatgtctgcgctgattacagatgaagatgaggacatgttgtcttatatggtgagcttggaagtggaggaggaaaagcatccagtacacttgtgtaagattatgctgtttttccgcagtaatccttacttccagaataaagtgattaccaaggaatatctggtcaacattaccgagtatagagcatctcattcaacccccatcgaatggtacccagactacgaagtggaagcttacaggaggaggcatcataactcctcgctcaatttctttaattggttctccgaccacaatttcgccggatctaacaaaattgctgagattctgtgcaaggacctttggcgtaacccattacaatactataagagaatgaagcctcctgaggagggcacggagacgtccggcgatagtcagttgttgtcatag

SEQ ID NO: 33853 - DNA, 927 bp, Artificial Sequence
  Description of Artificial Sequence: Synthetic coding sequence
atgcgccctgaggggagcttaacatactgggtgcctgagagattgcgccaaggattttgcggcgttgggcgcgctgctcaagctctcgtgtgcgcttccgcaaaggaaggcacagcgttccgcatggaggccgtccaagaaggcgcagctggagtggagtctgagcaagctgctctgggggaagaagcggtcttgttactcgacgacatcatggccgaagtcgaggtggttgcagaagaggaaggcctggttgagcggcgggaagaagctcagcgtgctcaacaggctgtccccggaccaggcccaatgacacctgaatccgctcttgaagagctcttggcagtgcaggtggaattggaaccggtgaatgcgcaggcacggaaggcattctctcgccaacgcgagaagatggagaggaggaggaagccccatctagaccggcggggagctgttattcaatcagtccccggtttttgggctaatgtgattgccaaccatccacaaatgtccgcgttgatcacagacgaggacgaggatatgctgagctatatggtatcacttgaggtggaggaagagaagcacccggtgcacctgtgcaagataatgctgttcttcagatcgaatccgtattttcagaataaggttatcaccaaagaatacctggtgaatattaccgagtaccgggcatcacatagcacccctatcgaatggtatttagattacgaggtggaagcttatcggcgtagacatcacaattcctcactgaacttctttaattggttttcagatcacaattttgctgggagcaataaaattgccgaaatactctgtaaagatctgtggagaaatccccttcagtattataagcgaatgaaacctccggaggagggtaccgagacaagcggcgattcacagttactttcctag

SEQ ID NO: 33854 - DNA, 942 bp, Artificial Sequence
  Description of Artificial Sequence: Synthetic coding sequence
atgcgccccgagggatctctgacttactgggtgcccgaacgcttaagacaaggtttctgtggagtcggccgcgccgcacaagccctagtgtgcgcatccgcgaaggaaggcactgcctttcgcatggaagcagtgcaggagggcgcagctggggtagaatcagaacaggctgccctcggggaggaagcggtgttattactagatgacattatggctgaggttgaggttgtcgccgaggtcgaggtagtggccgaggaagagggcctcgttgagcgacgtgaagaagcccagcgcgcacaacaggcagtgcctgggcctggccccatgacccccgagtccgccctggaagagctgctggctgttcaagtagagcttgaacccgtgaacgcccaggcacgaaaggccttttccagacagcgcgagaagatggagcgcagcaagccacatcttgatcgcagaggagcagtcattcaaagcgtgccaggcttttgggctaacgtgattgccaatcaccctcagatgtccgccctgattaccgacgaggacgaagacatgctcagctatatggtgtctcttgaggtggaggaggaaaagcaccctgtgcatctgtgtaaaatcatgcttttttttcggagtaacccctacttccagaataaggtaatcacaaaggagtatctcgtgaacataaccgagtacagagcatcacattcaactcctatcgagtggtaccctgattacgaagtcgaagcttatagaagacgccaccacaatagttcgctcaacttcttcaactggttttctgaccacaatttcgcagggagtaataaaattgccgaaatcttatgtaaagatctgtggcgaaacccacttcagtactataaaaggatgaagccccctgaggaaggaaccgaaacctccggggactcacagttactttcctag

SEQ ID NO: 33855 - DNA, 885 bp, Artificial Sequence
  Description of Artificial Sequence: Synthetic coding sequence
atgcgtccagagggatcattaacttattgggtccctgagcgcctgcgtcaaggcttctgcggagttggcagagctgctcaggctcttgtctgcgctagcgcgaaagaaggcactgccttcaggatggaagccgtgcaggaaggtgctgccggcgtagagtccgaacaggccgctctcggagaggaggctgtgttgcttctggacgatatcatggccgaggtggaagtggtggcagaggaagagggcttagtcgagaggcgggaggaagcacagcgtgcccagcaggcggtgccaggacccggccctatgacaccagagagcgcactggaggagctgctggccgtgcaagtggagttggaacccgtcaacgcccaggcgcgcaaagctttcagccgccagcgagagaaaatggagagacgtcgtaaacctcacctcgatcggagaggcgctgtgattcagagcgttcccggattctgggccaacgttattgcgaatcatccccagatgtcagcactgatcacggatgaagacgaggacatgttatcatacatggtttctttagaggttgaggaggaaaaacatcctgttcacttgtgcaaaatcatgctgttcttccgcagtaatccatacttccaaaataaagttattactaaggagtacttagtgaacatcactgaatatcgtgcatcccatagtacccctatcgagtggtacctggattacgaggtagaggcataccgcaggcggcatcacaattcgtccctgaactttttcaactggttcagtgaccacaattttgccggatccaataagatcgccgaaagcccagataggagctacgtgagaacatgtggagcgattccctgtaatacaacgcgcgggtag

SEQ ID NO: 33856 - DNA, 927 bp, Artificial Sequence
  Description of Artificial Sequence: Synthetic coding sequence
atgcgaccagaaggctccctgacatattgggttccagagcgcctacgccaggggttttgtggcgtaggccgagccgcccaggcgctcgtatgtgcctcggctaaggaagggactgctttcagaatggaagccgttcaggaaggcgcggcaggggtagagtccgagcaggcagcgctgggagaggaagctgtgctcctactggacgatatcatggcagaggtggaggtcgtggcggaggaggagggactagtcgagagaagggaggaggcacaacgggcacagcaggctgtcccagggccagggcctatgacacccgagtcagctctagaggaactgctcgccgtccaggtggagctagagccggtgaacgctcaggcccgcaaagcgttttcgaggcaaagagaaaagatggagagaaggcggaagccccacctcgaccgcaggggcgcggtcatccagtccgtgcctggcttttgggcgaacgtcattgccaatcatccccagatgagcgccttaataaccgatgaagacgaggacatgctgtcatatatggtgtctctcgaggtcgaagaagaaaagcatccagtgcacctatgcaagatcatgctgtttttcaggtctaatccatacttccagaataaggtaatcactaaagaatacctcgtgaatattaccgagtaccgggcctcccattcaacacccatcgaatggtaccccgactatgaggtcgaagcatatcgtagacggcatcacaactcaagccttaacttcttcaactggttcagcgatcataacttcgcaggctctaataaaatcgctgaaattctctgtaaggacttgtggagaaatccacttcagtattacaaacgaatgaaaccaccagaggaaggaacagaaacttccggtgacagccagctgctttcatag

SEQ ID NO: 33857 - DNA, 621 bp, Artificial Sequence
  Description of Artificial Sequence: Synthetic coding sequence
atgacaccagagagcgccctggaagaattgctagccgtgcaggtggaactcgaacccgttaatgcccaagcccgtaaagcattttccaggcagcgggaaaagatggagcggcgcagaaaaccacacctcgaccgcaggggggcggtgattcagagtgtccctgggttctgggccaacgtaattgcaaatcacccacagatgtccgcactcataacagacgaagatgaagacatgctgtcttacatggttagcctcgaagtggaggaggaaaagcatcccgtgcatctatgcaagattatgctgttcttcagatccaatccctacttccagaataaagtgatcaccaaagaatatctggtaaatatcaccgagtatcgtgcctcccactcaacgcctattgaatggtatctggattacgaggtcgaggcctacagaaggcggcatcacaattcaagcctgaatttcttcaattggttctcggaccacaacttcgctggctccaataaaatcgccgagattctgtgcaaagacctatggcgaaaccccctgcagtattataagcggatgaaacccccagaggaggggaccgagacatctggtgagcctctcgtagggacttag

SEQ ID NO: 33858 - DNA, 828 bp, Artificial Sequence
  Description of Artificial Sequence: Synthetic coding sequence
atgtctcaaaagcgacagaccaagttccagaacggcaagagcaagaccagcgagaatagctcagcaaaaagggaaaaaggaatggtcgtgaatagtaaggagattagtgacgctgtgggacaaagcaaattcgtattggagaacttaagacactacacagtgcatcctaacctggctcagtattacaagcctttaaaggccaccgccctacagaagtttctggcccagaaccgcaagaatacatctttcatgctcaaagttacgcagtatgaccaggataagaccctgctgattatgacgaacaatccccctccctgtagcatcactcagcaggataaggagagcgcgtctaagtatttcagcaaagaattgctcctgaaggtgatggagagtcaccatcagcacaaaccaacagagaatctttggctgcccagaatgccgcaaaaaaagaaacttcgttctaaactgaagccaattttcccactcatcttgagcgatgatccaacttcaaagagggagcagtggttccgcttctctacggataacgactttaaaagtgaaggaaagtactctaaggtgtacgccttgcgcactcagaaaaaaatgtacccacagctgactttcgcgcccgttcatgaacgtgatatgagaaaggatgctagtaaaaaatcagcgtctgaacgccctatttcgaaagtgattcgagagcccttgaccctggcatccctgctcgaagatatgccaactcgcaccgcgcccggggagagcgccttcaggaatgggagagcccctcaatggattatcaagaaggctacggtcatcggttag

SEQ ID NO: 33859 - DNA, 177 bp, Artificial Sequence
  Description of Artificial Sequence: Synthetic coding sequence
atgagtcagaaacggcagacgaagttccagaatggtaagtcgaagacatcggagaactcctcggccaaaagagagaagggcatggttgtgaattccaaagaaatttcagacgcagtgggtcagagcaaatttgtgctggaaaatctgagacattatacagtgcacccaaacctttag

SEQ ID NO: 33860 - DNA, 231 bp, Artificial Sequence
  Description of Artificial Sequence: Synthetic coding sequence
atgtcacagaagcggcagacaaagttccagaatgggaagtctaagacgtcagagaattcctccgcgaaacgggagaagggcatggtcgttaactcaaaggagataagtgacgccgtggggcagtctaaattcgtcctggagaatctgcgccattataccgttcaccccaatctcgcacagtattataagcccctgaaggccactgctctgcagaagtttctggcccagtag

SEQ ID NO: 33861 - DNA, 828 bp, Artificial Sequence
  Description of Artificial Sequence: Synthetic coding sequence
atgagtcagaaaagacagaccaagttccaaaacggcaagagcaagacttctgagaacagctccgcaaaaagagaaaaggggatggtcgtgaactcgaaggagattagcgacgcggttggacagtctaagttcgtgctggagaatctgaggcattataccgtacaccccaacctggcccagtattacaaacctctgaaggcaacagctttgcagaaatttttggcacagaatcggaagaacacctcattcatgcttaaggttacgcagtacgatcaggataaaaccctgctgataatgacgaacaacccccccccatgctccatcacccagcaagacaaggagagtgccagtaagtatttctctaaggagttgctgctgaaggtcatggaatcacaccaccagcataaacccacagagaacttgtggctgccaagaatgccccaaaagaaaaaactgagaagtaaacttaaacctatctttccactgattctcagtgatgaccctacctcaaaacgggaacagtggtttcgcttttccaccgacaatgattttaagtccgagggcaagtactccaaggtgtatgctcttcgcacccagaagaagatgtatccacaactaactttcgcccctgtccacgagcgcgacatgcgtaaggatgcgtccaaaaagtcggcatccgaacggccaatctcgaaagtaatccgcgaacccctgaccctggcaagcctgctagaggatatgcctacgaggaccgctccgggagagagtgccttcaggaacggacgcgcgccgcaatggattatcaagaaggctactgtgattggctag

SEQ ID NO: 33862 - DNA, 1230 bp, Artificial Sequence
  Description of Artificial Sequence: Synthetic coding sequence
atggccctgcggcctgaagaccctagctccggatttcgtcactcaaatgtggtcgcctttatcaatgagaagatggcccgacacacaaagggaccggaattttatctggaaaatatctcgctgtcttgggagaaggtggaagataaactcagagctatcctggaggacagtgaggttccttctgaagtgaaagaagcttgcacttggggcagcctggccctgggcgtgaggttcgcacatcggcaggcccagcttcagcgccacagagtccggtggctgcacgggttcgcaaaactccataaatccgctgcacaggcgctggcatccgatttgaagaagctgcgggagcaacaggagacggaacgaaaagaagctgccagccggctgcgcatggcccaaacctctctggtggaggtgcagaaagagagagataaagagctggtgtctcctcatgagtgggaacagggggctggttggccaggcctcgcaaccgcggggggcgtctgtaccgagggggccgcggaggaggaagaggaggctgccgtcgctgcagcaggggccgcaggcggcaagggagctgaagaggagcagagggatgtcgaggttgtggccgctcctgttgaggcgatggcaccgccagtggaggctggtgcagcacctatggaaactcagtttcctcacgttgaggcaagagcagccagcatggagacgacagagaagctggagagaattcttttacaactcctgggtgatgccgatcaggaaaagtacacctattgggggcagaaagaaggggacctccggagtgtggaaactgcaacttcatatttttctggaaccaccaacccatggagccgagcgtcttctgaacctctaccagtccagctgccagcttcatattcatattcgtactcctcacccttctcttcattcagtgacatccccactatttcaccaccacaggccaccgttactgccccggtgcccccacaactgccttcggactgggaggcattcgatacatcattgtggtctgatggggggccgcaccgaattgaccaccaagaacatcctagggacaggcgttactccgagccacaccagcaacgaccacccgtataccggaggcccggcgattgggattgtccttggtgcaacgccgttaacttctctcgacgagacacttgttttgattgtggaaaaggcatttggctgcagaagccccactag

SEQ ID NO: 33863 - DNA, 2637 bp, Artificial Sequence
  Description of Artificial Sequence: Synthetic coding sequence
atgtacgaaggcaagcacatacacttctcagaggtggataataagcccctgtgcagctactctccaaaactgtgcaagcagcggagactgaatggctacgctttctgcattcgtcatgtgctggaggataagactgcaccctttaaacagtgcgagtatgtggccaagtataacagtcagaggtgcaccaatcctatccctaagtctgaggataggcggtactgcaactctcacctccaggtcctcggctttattcctaagaaggaacgcaagaagaaaaatgatccaattgacgaggtgaaagtccgacaccaaatggacactatggctttttccctgactgtcccgaccctggccctgaagatgccaaatggtcttgacgggatgtccctgtccccccctggcgctcgggtgcctttgcactatcttgagactgaactcgaggaccccttcgcgttcaatgaggaagatgacgacttgaaaaagggcgccactgttcgaaaaaagttacagtccaaactcgcgcagaacaggcaaaggcaaagagagacagagattttgaaagttaggcaggaacatttttcacctcctccagccccctcccagcaacagccccctcagcagcattcacacctttcacctctgagcacgagcttaaaacctccagcccccccgcagggctccgtgtgcaaatccccccagccccaaaacacctccctgcccatgcagggcgttgcacccacaacacacaccatcgcacaggctagacaactcagtcacaaacgtcccctccccctcctcccctcttcccgcgcacctaccgtggatcctcccaggaccgaccggattctgatgaaggcgaccgcgttcagcccccactttagttgcatctcgcgacttcagcgattggtcaaattgtgcacgcagaaacaccagctcgacaccgatctatttcctcatctgggacttgattggagcgaggagagcggcgaggaacccgaggattccgaacaggcatcgccctaccaagttgcatggtctatccgggaaactttacgctatcagcgtcacgcgtcagatgatgatgacgccgaatcccggtcctctcgggttacccagctttgtacatactttcagcagaagtacaagcatctgtgtaggcttgagcgcgctgagtccaggcaaaaaaaatgtagacacactttcagaaaagccctgctgcaggctgccagcaaggagcctgagtgcaccgggcaactgatccaggagctgcggagggctgcctgttctcggaccagtatttcccggacaaaactccgcgaagtggagccagctgcctgctccggtactgtaaaaggcgagcaatgtgcaaataaggccctgccttttactagacattgttttcaacatatattgctcaaccactcccagcagctcttttcctcttgcaccgccaaattcgccgatgggcagcaatgcagcgtccccgtgtttgacatcacgcaccagacaccactgtgtgaggagcatgccaaaaaaatggataattttctccgaggagacaactcgcgtaaggtgcagcatcagcagcaaaggaagccacgtaagaagaccaagcctcctgccttaaccaaaaaacacaagaagaagaggagacgcggcccaaggcggcctcaaaagcctatccctccggccgtgccccaagggaatctatcgatgcctgcctctgtctcgctacccgttgaggcctcccacatcagatcaccttccacgcccgagctcagcgccgatgagctgcccgacgatatcgccaacgagataaccgacatccctcatgatctggaactgaaccaagaggacttcagtgacgttctcccacgactcccagatgatctacaggacttcgatttctttgaaggcaagaacggggatctcctgcctaccactgaagaagcggaagagcttgaacgagccctccaggcggtcacttcactggagtgcctgtccaccatcggagtgcttgcgcaaagcgacggggtacccgtccaggagctgagtgatcgcggaataggagtcttctccaccggcacgggcgcttccggcatccagagccttagtagagaggtaaacactgacctgggggaactcctgaacgggcgtatagtccacgataacttttccagtcttgagctggacgaaaacctcctgcgcagtgcaactctgagcaatcctcccacacccctggccgggcagatccagggtcagttctcggcccctgcgaatgttggccttacctctgctactctcatttcacagtcagctcttggtgagagagcatttcctggacaattccacggtctgcatgacggctcgcatgctagtcagcgcccccaccctgctcaacttctctccaaggccgacgaccttatcaccagccgtcagcagtacagctctgatcacagtcacagctcaccccatggctcccactatgattctgaacatgtgccctccccttacagcgaccacatcacgtcgccgcacactacctcttacagcggcgacaatatggccgcacccgtttgctttcgcggatatcacagaccggcttctgtggcctggggcctccttctgaactag

SEQ ID NO: 33864 - DNA, 4983 bp, Artificial Sequence
  Description of Artificial Sequence: Synthetic coding sequence
atggacagtggccccgtctaccacggcgattcacgccaactgagcgcctctggggtcccagtaaacggggcgcgcgagccagcaggcccatctctccttggcaccgggggcccttggcgggtggaccagaaaccggattgggaagccgccccaggtccggcccacactgcaagactggaggatgcccacgacctcgtggcattttctgcggtagcagaggctgtgagtagctacggggctctaagcactcgtctgtacgaaactttcaatagagagatgtcccgtgaggccggaaacaatagccgagggcccagacccgggccggaaggatgttctgccggctcagaggatttggataccctgcaaaccgcacttgccctggcgagacatggaatgaagccacctaactgcaactgtgatggacccgagtgccccgattatttagagtggctggaagggaaaataaaatcggtggtaatggagggtggggaggaaaggcctaggctgcccggtcccctgccacctggcgaggctggcctgcctgctccatctacccgcccgctgctctcaagcgaagtcccgcagatttctcctcaggaggggctgcccctttctcagagtgccctctccatagcaaaggagaagaacatctccctccaaaccgcgatagccatcgaggccctgacgcaactgtcaagcgctctgcctcaacccagccatagcactccacaggccagttgcccccttcctgaggcattgagcccaccggctccttttcggtctccgcagtcctacttacgggccccaagttggccagttgtgccgcccgaggaacatagcagcttcgctcccgatagctcagcttttcccccagccacccctcgcacggagtttcctgaggcatggggtacagataccccgcccgcaacaccgcgatccagctggccaatgcctagaccaagccctgaccctatggccgaacttgaacaattgctgggaagcgccagtgactatattcagtcagtgttcaagcgtcccgaagctctgccaactaagcctaaagttaaggtggaggcgccgagttcgtcccccgcccccgccccgtctccagtcttacagcgtgaggccccaacaccatccagcgaaccagatactcatcagaaagcgcagaccgccctgcagcagcacctacaccacaagcgatctctgtttttggagcaggtccatgacacaagttttcctgctcccagcgagccaagcgcacccggatggtggccgcctccttcttcccctgtccctcggctgcccgaccgacctcccaaggagaagaagaagaaactgccaacccctgctggtggccccgtgggtacggagaaggctgcacctggtatcaagcctagtgtgcgtaagcccattcagatcaagaaaagtcggccccgggaagcccagcccctgtttccacccgtccggcagatcgtgcttgagggcttgcgctctcccgccagtcaggaagtgcaggcgcatccgcccgcgcctctccccgcaagccagggcagtgctgtgccactgcctcccgagccttccctggcactgtttgcccctagtccgtctcgcgacagtcttctgccccctacccaggaaatgagaagccccagccctatgactgcactgcaacctggaagcacagggccactgcccccagccgatgataagctagaggaattaatacgccagtttgaggccgagtttggtgatagctttggactacctggacctcccagcgtgccaattcaggatcccgagaatcaacaaacttgtctccctgccccagaatctccatttgctacaagatcccctaagcagatcaaaatcgaatcatcaggggctgtgacagtgctgagcacaacatgtttccacagcgaggaagggggccaggaagccaccccgacgaaggctgaaaacccattaaccccaactctttctggcttcttggaaagtcccctcaagtatctggacacacctaccaaaagcctgctcgataccccggctaaaagagcccaagccgagttccctacttgcgactgtgtcgagcagatagttgagaaagatgaagggccctactatactcaccttgggagcggccccaccgttgcttcaattagagaactcatggaggaaaggtatggggagaagggcaaagcgattcgaatcgagaaagtaatctacacaggaaaggaaggcaagagcagcagaggttgccctatagctaagtgggttatcagaaggcatacactggaggaaaagctgctgtgcctcgtacggcatcgggctgggcaccactgccagaacgcagtgatcgtgattctgatcctcgcctgggaaggcatacccagatctttgggcgacacgttgtaccaagagttaacagacactttgcgtaagtacggcaaccccacatctcggaggtgtggcttgaatgatgataggacgtgcgcatgtcagggcaaggatcccaatacctgtggcgcttccttttcatttgggtgtagctggagcatgtattttaatggctgcaagtacgcaaggagcaaaacccccaggaagttcagactggctggagataatccaaaagaggaagaagtccttcgaaaatccttccaggacctggctactgaggtggcccctctgtacaagcgcctggcgccccaggcctatcagaatcaggtcacgaatgaggagattgctattgattgtcgccttggcctcaaagagggtagaccattcgcgggggttacggcatgtatggatttttgcgcacacgcgcataaggaccagcacaacctgtataacggatgcacggttgtctgcacgcttacgaaggaggacaacagatgcgtcggcaaaataccagaagatgaacagctgcacgtcttaccactgtataaaatggctaatacagatgagtttggctctgaggaaaatcaaaatgctaaggtcggcagcggagccatccaggtgctcacggcctttcctagggaggtgcgcaggcttccggaaccagctaagtcatgtcgccagagacagcttgaagccagaaaagctgcagccgagaagaagaagattcagaaagaaaagttgtccacgccagaaaagatcaaacaggaggctctggagctcgccggcataaccagcgaccccggactcagcctaaagggagggttgtcccagcagggtctcaagccatccctgaaagtggagccgcagaatcacttttcctctttcaagtatagcggcaatgctgtagtggaatcttactctgtgctcggaaactgccggccgtctgatccttactcaatgaattcagtgtattcttatcattcctactacgcccagccatcgctgacaagcgtgaatggcttccactccaagtacgcgcttccatcctttagctattatggtttcccttcttcaaacccagtattcccttcacaattcctgggaccaggagcttggggacactccggcagcagcggctccttcgagaaaaagccggatctccatgccctgcacaattcgctgtctcctgcttacggaggggcagagttcgctgagctgcccagtcaggctgtcccaacagatgcccaccaccccaccccccaccaccagcagcctgcatacccagggccaaaggagtaccttctgcctaaggcccccctattgcattcagttagcagggacccctccccttttgcacaaagtagcaactgctacaacaggagcattaagcaggagcccgttgatccgctgacacaggccgaacctgtacccagggatgctggtaaaatgggaaagaccccactgagtgaagtgtcgcagaacggtggtcctagtcacctctggggacagtactcaggaggtccaagtatgagtcccaaacgcaccaatggggtggggggctcatggggcgtcttctcaagcggggaatctcctgccatcgttccggataaactttcctcttttggagcttcttgtcttgctccctcccacttcacagacggccagtggggcctcttccctggagaaggccagcaagctgccagtcactctggcggtagactgcgtggaaagccctggtcaccatgtaagtttggaaactccacctccgctctggcgggccctagcctgactgagaaaccctgggctctgggcgcgggggactttaacagcgcactaaagggctcacccgggtttcaggataaactgtggaaccccatgaagggtgaagaagggcgcatccccgccgctggagctagccagcttgatagagcttggcagtcttttgggctgcccctgggatcttccgagaaactgtttggggccttaaagtccgaagaaaagctctgggatccttttagcctcgaggaaggacccgcggaggagcccccctcaaagggtgccgtgaaggaggagaaaggagggggaggcgctgaggaggaggaggaggaactctggagcgactcagaacacaattttctggatgagaatatcgggggcgtggccgtggctcctgctcacggctctattctgattgagtgcgctaggagggagctccacgctaccactccactaaagaaacccaataggtgtcatccaaccaggatatccttagtcttttaccagcataagaaccttaaccaacccaaccacggattagcactttgggaagctaagatgaagcaattagccgagcgagccagagcacgccaggaggaggcagcaagactcggccttgggcagcaggaagctaagctgtatggtaagaagcgaaagtgggggggtaccgtcgtggccgagccacaacagaaagagaagaagggcgtggtgccaactcgacaggctcttgctgtcccgacggattctgcagtgacagtttctagctatgcatataccaaggtgacaggaccgtactcccgttggatttag

SEQ ID NO: 33865 - DNA, 759 bp, Artificial Sequence
  Description of Artificial Sequence: Synthetic coding sequence
atgacacatgacaaaagctggagacgctgctcaatttctggttctactaagtgcagatgcggctctaggatcgccggccccaatgctcttggatctggcggctcacgatcctcatcgtcatcctccagaagcatcctgagttcttctattctctcaagttccatcccgagcagctccagcagctctagttcaccatcgagcagtccatcaagttcgtcccccagctcttcccattcaagttctagcccgagcagttctagcagcacctcctctccgtcctctagctcttcttctagcagcagctctccctcatcttctaacagcagcagctcctccagttccagctctccttcaagttctagttcctcctcatccagctctccctccagtagctccagctcaccatccagttcgagctcttcgagcagcagttccccatcttcctcatccagcagcccctcttcttcctctagcagctcttccagctcttcttcaagtccttcaagcagtagtcccagctcctctggcagttctccttcatccagcaatagttccccatcatctagttcctctagcccctcttctagcagcagcagtccctcaccacgcagtagcagcccttcatcctcctcaagcagtacgagtagccctagctcctcaagcccctctagctcaagcccctctagctcttgtccctctgctgccctgggcaggcgcccccagtcccctcaaagctcacattgtgctccatttccatag

SEQ ID NO: 33866 - DNA, 759 bp, Artificial Sequence
  Description of Artificial Sequence: Synthetic coding sequence
atgactcatgacaaatcctggcggaggtgtagcatatcgggaagcacaaagtgtcgatgtggctccaggattgcgggtccaaatgcactaggatcgggagggagtaggagctcttctagtagctcccggagcattttgtcatcatctattctgagttcctcgatcccaagtagtagtagctctagctctagccctagttcctccccttcatctagtagcccaagtagcagccacagttcatcatccccttctagctcctcgtctacctcctcccccagttctagttcctcttccagcagttctagtccatcttcctccaattcttcttcttccagcagttcgtccagtccttcgagctcttcatcctctagttcatcttcacctagctcatcctcttcaagccccagctctagttctagtagctcctcaagcagtcccagcagttctagtagttctccatcctcttcatcttccagttcttcttcctccagctccagtccctcctctagttcacctagcagcagtggctcctcgcccagctcttccaatagttcaccaagctcttctagctctagcccttcgtcatcgagttcaagtccttccccaaggtcatcctcaccttcatcatctagctcaagtacttctagtccaagcagttcttcccccagttcttcttcacctagcagtagctgccctagcgctgcccttggacggagaccgcagagtcctcagtcctcccactgcgcccctttcccctag

SEQ ID NO: 33867 - DNA, 759 bp, Artificial Sequence
  Description of Artificial Sequence: Synthetic coding sequence
atgactcatgataagtcatggcgccggtgttctattagcggaagcaccaagtgcaggtgcggcagtcggattgccggaccaaatgccttaggatccggaggctctcgtagcagtagctcatccagtagatccattctgagctcctctatcttgagttcctctatcccaagttcttcttcgagcagcagcagcccttcgtcctccccttccagctcttcccctagctcatcacattcttcttcctccccttcttcttctagttctacgagcagcccttcatcttcctcatcttctagctctagttccccttcttccagtaacagtagctcgagctcctcctcaagcagtccatccagctcttctagtagctcatcatcgtcaccatcatcgtcttccagttctccatctagcagcagttcatctagctcaagcagcccttctagttcgagttcctccccaagttctagctctagctcttcctcaagcagctctagcagtcccagtagcagctcgccaagcagttcaggaagcagcccgtcaagtagcaacagtagcccctcttcctcttcgtcttctccatcttctagctcctccagtcctagcccccggtcctcgtccccctcgtctagctccagcagcacaagttctccttcgtcgagttctccatcttccagttccccgtcatcttcatgtccttcagcagccctgggcagaagaccacagtcaccccagtcgagccactgcgcacctttcccatag

SEQ ID NO: 33868 - DNA, 156 bp, Artificial Sequence
  Description of Artificial Sequence: Synthetic coding sequence
atgactcatgataagtcttggaggagatgttcaatctccggcagtactaagtgccgctgcggtagtcgcatcgctggcccgaacgccctggggagcggggggtccagaagttcgtccagctcctctcgctcaatcctgtcctcgtccatcctgtag

SEQ ID NO: 33869 - DNA, 66 bp, Artificial Sequence
  Description of Artificial Sequence: Synthetic coding sequence
atgacccacgataagtcctggaggcgctgcagcatatctgggtcaacaaagtgtagatgcggttag

SEQ ID NO: 33870 - DNA, 228 bp, Artificial Sequence
  Description of Artificial Sequence: Synthetic coding sequence
atgacacacgataagagctggcgcaggtgttcaatcagcggttccacaaaatgcagatgtgggagcaggatcgccggtcccaacgccctgggctccggaggttctcgctcatcatcctcaagctcacggagtatattaagtagtagcattctgtcctctagcataccgagtagttctagctcaagctcatccccgtccagttcccctagcagctctagccccagctag

SEQ ID NO: 33871 - DNA, 132 bp, Artificial Sequence
  Description of Artificial Sequence: Synthetic coding sequence
atgacacatgacaagtcttggcgccgctgctctataagcggctcaacaaagtgtaggtgtggctccagaattgccggacccaacgccctcgggagcggaggctcacggtcctcctcatcaagctcaaggtag

SEQ ID NO: 33872 - DNA, 117 bp, Artificial Sequence
  Description of Artificial Sequence: Synthetic coding sequence
atgacccatgacaaatcatggcggcggtgctcaatctctggatcaacgaaatgtcgatgcggcagccgtattgcagggccaaatgcactgggctctggaggcagcaggagttcgtag

SEQ ID NO: 33873 - DNA, 39 bp, Artificial Sequence
  Description of Artificial Sequence: Synthetic coding sequence
atgactcatgacaagagttggcgtcgatgttccatttag

SEQ ID NO: 33874 - DNA, 63 bp, Artificial Sequence
  Description of Artificial Sequence: Synthetic coding sequence
atgacacacgacaaaagctggcggaggtgctccataagtgggtcgacaaaatgtagatgttag

SEQ ID NO: 33875 - DNA, 453 bp, Artificial Sequence
  Description of Artificial Sequence: Synthetic coding sequence
atgactcatgataaatcatggcgacggtgtagcatctccggcagcaccaagtgccggtgcggaagtagaatagccggacctaacgccttgggaagcggtggcagcagaagctcctcctcatcatccagatcaattctcagctcaagcattctaagttcgtccatcccgtcttcgagtagttcaagctcaagcccgagtagctcccctagttcgagttctccctctagttcacacagcagtagttcaccatcgagctcttctagcacctccagcccttcgagttctagttcttcgagttcctccagcccaagtagctccaacagctcctcctcttcatcctcgagctctcccagctcatccagcagttcctcgtcctcaagtccgtcatccagctccagttccccctcgagcagcagttcttcatcttctagctcgccctcctcttcctcctag

SEQ ID NO: 33876 - DNA, 747 bp, Artificial Sequence
  Description of Artificial Sequence: Synthetic coding sequence
atgctgaggaataacaagacaatcatcattaaatattttctcaatctgatcaatggcgcctttcttgtcctcggcctcctgttcatggggttcggggcatggctgctccttgatagaaataattttcttacagctttcgacgagaacaatcactttatagtgcccatatcacagattctaatcggcatgggtagttccaccgtgctattttgtctgctgggatacattggaattcataacgagattcgctggctactgatagtttacgccgtcctaatcacatggacatttgccgtccaagtggtgctatccgctttcatcatcactaaaaaggaggaggtgcagcagctctggcatgataaaattgattttgttatcagcgagtacggaagcaaagacaaaccagaggatattaccaagtggactatccttaatgcgttacagaaaaccctccagtgctgcggtcagcacaattacactgactggatcaaaaacaaaaataaggagaactccggccaagtgccttgctcttgcacgaaaagcaccctcagaaagtggttctgcgacgagccacttaatgccacctacctggagggctgtgaaaacaaaatttctgcctggtataatgtgaatgtactgactctcataggcatcaacttcggactgttgacgagcgaggttttccaagtctctctcaccgtatgcttcttcaaaaatatcaaaaacataatacatgctgagatgtag

SEQ ID NO: 33877 - DNA, 267 bp, Artificial Sequence
  Description of Artificial Sequence: Synthetic coding sequence
atgttgcgaaataataagactattataatcaagtattttcttaatttaatcaatggggcctttctggtgttgggtctgcttttcatgggttttggcgcatggctgctgttggatagaaataacttcttgacggcatttgacgaaaacaaccatttcatagtacctattagtcagattctgattgggatgggatccagcaccgtgctcttctgcttgcttgggtacatcggaatccataacgagatacgctggctcctaattgtttag

SEQ ID NO: 33878 - DNA, 7128 bp, Artificial Sequence
  Description of Artificial Sequence: Synthetic coding sequence
atgcacatactcttccagaaggggatgctaaagcgggtgaagaagttactagatctgctggtgaaatttgacatcaactttaatctcaagaataaagagggaaaggatgccagacaccgaatcaaaaaaaatgattccttattgctcgcatggaacaaagctctgatggagaaccgcagacgaagccgacaggacagtgctgcccatctggggaaattaagtaaaagcacagcccccggccacacatctcaactgaaaagccaggggagttttaagtccgtaccctgtggcgccaccgcacgaacactgccagaaggctcagccgtgcctgattcttgggaaaccctcccaggaacgcaggtgacccgaaaagagcctggggcactgaggccctgcagccttcgagattgtctgatgcaggacattacggtgcttatccagcaggtggaggtggaccctagtttcccggaggattgtctgcagtcctctgagccactggaagccggtgcaggcaaggaaggtaagaaggatgacaaacctactttaggagccggagctccagactgctcagaagtgggcgaagggcatgcacaagtaggcctgggagcacttcagcttgtgcccgacgacaaccgaggcaaggagggcaacgatgatcaagatgactggagcacccaggaaatcgaggcgtgcttacaggacttcgataatatgacttgggagattgagtgtacctctgaaatgctcaagaaactgagttccaaagttatgactaaggtaataaaaaaaaaaataattctcgccatacagcagcttggtaacggagaatggacccaagggttacaaaaaaggttgaaacatttaaaagggtccatacagctgtttgaagctaagctcgataaaggcgcccggatgctatgggagctggccatcgatttttcccccaggtgcagtgagaacccagaaaaaataatagctaccgagcagaacacttgtgcaatggaaaagagcggacgaatttatacagaaattatcagaatctgggacatcgtgctggaccattgtaaactagccgacagtattaaagcaatctgtaatgcttataatcgtggactcagctgcgtgctaaggaagaagctcaaaggcatcaacaaaggtcaggtaagcgctaatatgaaaattcaaaagcggattcccagatgttacgtcgaggacacagaggctgagaagggtcgtgagcacgtcaacccagagtattttcctcccgcctccgccgtggagaccgagtataacattatgaagtttcactcttttagtacaaacatggcttttaatatccttaacgatacaactgcgacagttgagtacccttttcgagtgggcgaactagaatacgcggtcattgatctcaaccctaggccgctagagcctatcatcctgattgggcgatctggcacgggcaagacaacgtgctgcctgtataggttatggaaaaaatttcacgtatactgggagaaagcagaacaggcaggtagcccacttctggcaaaacaggtgtggctgaagcgcagactggaggtcgagccaggcaaggagagtcctggaggggaagaagaggaggaggaggaggacgaagaggaggaggacagtattgaagtcgagaccgtcgaatcaattgacgagcaggaatacgaggcctgcgctgggggcgcaggtgtcgagccggccggcgacggtcaagccgcggaggtatgcgctcccgaacatccccaccagcttgagcacctgcatcaaatctttgtgactaagaaccacgtcctttgtcaggaagtgcagcggaacttcatagagctaagcaaatctactaaggccacatctcactacaaacctctggacccaaacatccataagcttcaggatctgagggacgagaattttccactgtttgtgacgtccaaacaactactgctattgctggatgcctctctccctaaacccttctttctgaggaacgaagatggcagcctgaagagaacgataattggttggtctgcccaagaggagagcacaatcccttcttggcaggaggacgaggaggaagcggaagtggatggcgactacagcgaagaagacaaagccgtagagatgcgcacaggtgatagtgaccccagggtctatgtaactttcgaagtcttcaagaatgaaatttggcccaagatgaccaaggggcgcaccgcctataaccctgcccttatctggaaggaaatcaagtctttcctgaagggatcatttgaggcactgtcttgcccccacggaaggctgacagaggaggtgtacaagaaactgggcagaaaacgctgcccaaactttaaggaagaccgatccgagatttactccctattcagtctctatcagcagatcaggagtcagaaggggtattttgatgaggaggacgtattgtacaacatttccagacgcttgtcaaagttgagggtgttgccctggtcgattcatgaactctatggcgatgagatccaagattttacccaagcggaattagctctgctgatgaagtgtattaacgaccctaatagcatgttcctgacaggcgacacagcccaatcaataatgaagggtgtggcgttcaggtttagtgacctacgctccctttttcactatgcctccagaaataccatcgacaaacagtgcgctgtgagaaagcctaagaaaatccatcaattataccagaactacaggtctcatagtggaattcttaatctggcaagcggcgtggtggacttactccagttttacttcccggagtcgttcgacagactgcccagggattcaggcttgtttgacggtcctaagccgacagtccttgaatcctgctccgtcagcgatctggctatcctcctccggggcaacaaaagaaagacccaacctatcgaattcggcgctcaccaagtgatcctcgtcgcaaacgaaaccgcgaaggaaaaaattccggaagagctgggactcgccctggtcctcacaatttacgaagccaaggggctcgagttcgacgacgtcctcctgtataatttcttcacagatagtgaggcctacaaggaatggaagatcatatcctcatttaccccaacttccaccgattccagggaggagaatcggcccctggttgaagtgccgctggacaagcccggaagtagccagggtaggtctctgatggttaaccctgaaatgtacaaattgctcaatggcgagctgaaacagttatatacggccataacccgcgcccgagttaacttatggattttcgacgagaatagagagaagagggcccccgctttcaagtacttcattagacgcgactttgtccaggtggtaaagaccgacgagaataaggatttcgatgacagtatgtttgtgaagacatccacgcccgccgaatggatcgcccagggagactactacgcgaagcatcaatgttggaaggtggccgccaagtgctaccagaaaggaggggcatttgaaaaagaaaagcttgcactcgcccatgatactgccctgtcgatgaaatcaaagaaggtaagcccaaaggaaaaacaactggaatatcttgagctcgcaaagacatatctggagtgcaaggagccgacattaagtctgaagtgcctttcatatgcgaaggaatttcaactgagcgctcagctctgtgagcggctcggcaagattcgggatgccgcctacttctacaaacgatctcagtgctataaagatgcctttcggtgcttcgagcagattcaggagttcgatctggctttgaagatgtactgccaagaagaactgtttgaggaggccgcaatagccgtggagaaatacgaggaaatgctgaagactaaaacactccctatctctaagttgtcctactccgcttcccagttttacctcgaggctgcagccaagtacctgtcggctaacaagatgaaggagatgatggctgtcctgtccaagttggatatcgaagaccagttagtttttttaaagagccggaaaaggcttgctgaagctgcggatctccttaatagggaaggtcggcgcgaggaggccgctcttctgatgaaacaacacgggtgtctgttggaagccgctaggttgactgcggataaggactttcaggcatcctgtctattgggagcagcacgattgaacgtggcgagagactcagacatcgaacatactaaagacatccttcgagaggcccttgacatttgctaccagactggccagctcagcgggattgccgaggcccattttctccaaggtgtgattctacgggactttcagaaattacgtgatgcatttttcaagttcgataccttgaatcattctgccggcgtcgttgaagccctctatgaggccgcctcgcagtgcgaagcagaacctgagaagatcctggggctcgctcctggaggccttgagatactcctctccctggtcagggcccttaaacgtgtgaccaacaacgctgagaaagagatggttaaaagctgttttgaattctttggcatctctcaagtcgatgcaaaatattgccagatcgctcagaatgatccagggcctattctcaggatcatatttgatctggatctaaacttgagagagaagaagactaaagaccactttctcatcatgaccgaccaggtgaagctcgcattaaataagcacctgctgggccgcctttgtcagatcactcggtcccttctggggaaaacttatcgtggcgtgtgcatgcggttcatagtgggtctgaaatgcgaggacgagaattgtgaacactttcatcgacccctgcggagatgcgaggccaagtgcctcgtacagtccaagatgaacctggtcgccatcaatggcttactcctagaagcaaagaaagtgtttcccaagatacttgctgaggagttgaaggagattgattacatcctgtcgacagatatgtatggtttgtgcaagtccatcctggacgttctctttcccaagcattttcaccagagggtcctgtcagagaatcccatggcgtgtaaggaaatcctgaagcccaattacaaaagcttcagattctatcgatttgccctgaaggagtacattcatttcctgttcgagaacgagagtgcccgtaatcggcgagagtcaaccgatctctggctttctgcaatgcaggcgttcctgctgagctccaactacccagaagagtttgaaaaactcctgcatcaggaagaagacaactataaccgggagctgaaggcactagagtccgaaaaggacgagaggggacggggccgtgggtcgaggataaaggggatagaaggaaagttcggcatgctcgcccctaacagggatgatgagaacatggacaaaacccatttgtgctttattcggctcttggaaaattgtatcgatcagttctacgtgtatcgaaatcccgaagactacaagcggcttttcttccggttcatgaatgtgttgatcaagagatgtaaagagcccctgatcccttccatcgggaacacagtcgctttgctcgagttccagttcatccattgcggagtggtcctcgcaagattatggaagaacgtcatcttatgcttgcccaagtcctatatagctctgctgcactattgggaattcctgttttccaagaaagacaaggaactgggggacgtattcagtattatccaggagtataaaccaaaagatgtgacaagagccatccaagacttcagattccatctttcatacctcgctaaagtgctctgcgggtacgaaaatgtcaacttcaatgttcttctggatgccttctccgagatcgactatgtggtttccggcgaggctgagagaaccctcgtgctgtgcctggtcatgttggtgaacgctgaggaaattctccaaccttattgtaaacctcttctgtatagacactttcgggagattgaatccagattacagctgatgagtatggactgtccggggcaggtgcccgagcggctgctcaaggtggttaagagggtgttggtggctgtaaatgtaaagagcgtggctgaagcacttcaggatttgctcttcgagagggatgaggagtaccttatggattgtgattggcgttgggatcccgtccataccaagggttcgatcgtccgcggtctctattacgaggaggtccggcttaatcggctgctttgcttggatcctgtggattacttcgcagaaccggagtgtgagttcgggcaggatgagatggatgagcttgcgctcgaggatcgggaccatgtgctggccactatactaagccagaagcagcgtaaggctagcatccagcgcaaattacggcgggcttgtctggttgtcagcctctgcataagctggagacggcgcgtgggcacacagatggaaagggtcagagaggaagcccgggaaccccgggcgggcaattttaaaaaggctgatgtcgacaggacgcagtgcgacctgtgtggtgtgaaatttactaggggcccagagaattatttttctccatctaaagcattcgagggagccgccagcgaggtcgccgtgctgtctagggccgagttggagcgggaagagtgtcaggaacgaaacagcgagtcttacgaacagcatattcacctggagcaccaccagcgccagcaggttgcctaccagaaatactctgaattttttcacgaaaaggtcgatccagctatcgacgaaggcaaactggtggttcaggatattgaacagagtgtatggattcacagccatgtggggtctaaggaacattctcatatgctacaaaaagtacaggaacacataaaacgcgtgtcagatatggtggaggacctctaccgcaggaaagcatgggccggcgccgaagaggccatgacaagactggtaaacatccttattttaagcgttcgggatgctcgcgactggctgatgaaaacagaaacacggctcaaaaaggagggaatcgtccaggaagatgattacgagaacgaagtggaggactttggagaactgcgtcccagacgacggtcacgcaagtgcggaaaacagcggaagtactag

SEQ ID NO: 33879 - DNA, 7128 bp, Artificial Sequence
  Description of Artificial Sequence: Synthetic coding sequence
atgcacatcctatttcaaaaaggaatgctgaaacgtgtgaagaaactgctcgatctcctcgtgaaatttgatatcaatttcaacctcaaaaacaaagaaggtaaagacgccagacacaggatcaaaaagaatgacagtttactacttgcctggaataaggctttgatggagaatcggagacgttcacgccaggactccgcggcacacctgggcaaactcagtaaatctacagcacccggacacacatcacaactaaaatcacagggctcatttaagtccgtcccctgcggagctacagcccgaacgttacctgaagggtccgcagtcccagatagttgggagaccctcccgggaacccaggttacccggaaggaaccaggcgctttaaggccttgctccctacgcgactgcttgatgcaagacatcaccgtcctgattcagcaggtagaagttgatcctagttttcccgaagattgcctacagtcctctgagccactagaggctggagccgggaaagagggaaaaaaagatgacaaacctacactaggagccggtgcgcctgattgctcagaggtaggcgaagggcacgcacaggtcggactcggcgccctgcagctggtccccgatgacaaccgggggaaggagggcaacgatgaccaagatgactggagcacccaggagatagaggcctgtctgcaggactttgataatatgacttgggaaattgaatgtacctccgagatgctgaaaaaattgagttctaaggtgatgaccaaagtcattaagaagaaaatcattctggccatccaacagctagggaacggggaatggacacagggtctgcagaagcggttaaagcatttgaaaggcagtatccagctgttcgaggctaaactggacaaaggcgcccgaatgctgtgggaactggctatcgacttcagccctcggtgctcagagaaccctgaaaaaataatcgccaccgagcaaaacacttgcgccatggagaagtccggccggatttatactgagattatccggatatgggacatcgttctggatcattgtaagctcgcagattctattaaagccatttgcaacgcctataatcgggggttgtcatgcgtgctccggaagaagctcaagggcatcaataagggccaggtgtccgcgaacatgaaaattcagaaacggattccccgatgttacgtcgaagatacagaggccgagaagggcagagagcatgtcaacccggaatactttccgcccgctagtgccgtggagacggagtataacatcatgaagtttcactccttctctacgaatatggcattcaatattctgaacgatacaaccgctactgttgagtatccgttccgggtgggcgagctggaatatgctgtcatagacctcaatccacgccccctggagcccattattcttatcggaagaagcgggactgggaagaccacctgttgcttgtacagactctggaaaaagtttcacgtgtactgggagaaagcagagcaggccgggtcgccactactggccaagcaggtttggctgaaaagaagactcgaagtagaaccaggtaaggaatccccgggcggggaggaagaagaagaggaggaggatgaagaggaggaagactcgattgaggtggaaacagtggaatccatcgacgaacaggaatatgaagcctgcgccggcggagcaggcgttgagcccgcaggggacggccaagcagcagaagtgtgcgcacctgaacacccacatcagctggagcatctacaccaaatcttcgttaccaaaaaccacgttctgtgccaagaggtccagcgcaatttcatcgagctgtccaagagtactaaagccactagccactacaagccactggaccctaacattcacaagctccaggatctgagggatgagaatttcccactgtttgttacctctaagcagctcttgctgctgctggatgcttcactaccaaagcccttctttctgcgcaatgaagatgggagcttgaaacgtaccatcattggttggagcgcccaagaggaaagcacaatccccagctggcaggaggatgaagaggaagcagaggtggacggagactactccgaagaagataaggccgtagaaatgaggactggggattctgatcctcgcgtttacgttaccttcgaggtgtttaagaatgagatatggccaaaaatgacgaagggtcgcactgcttataatcctgcattaatctggaaagaaattaagagtttcctgaaggggtcctttgaggccctttcgtgtcctcatgggagactcactgaggaggtatataaaaagctggggcggaaacgctgccccaacttcaaagaggacaggagtgagatctactcactgttttctctgtaccagcagatccggagtcagaaaggttatttcgacgaggaagatgtactctacaatattagtcgccgactgtcaaagctgagagtgctgccatggtcaattcacgagctctacggggacgagatccaggattttacccaggccgagctggctttactgatgaaatgtattaacgatcctaactccatgttcttaacaggggacaccgcccagtctatcatgaaaggagtcgcgtttcggtttagcgacttgcgcagcctgttccattacgcttctagaaataccattgataaacagtgtgccgtgcgcaaacctaaaaaaattcaccagctttaccagaactatcgttcccatagtggaatcttgaacctcgcctctggggtcgttgaccttctgcagttttacttcccagaaagttttgaccgtctcccgagggacagcggcctctttgacgggccaaagccaacggtgttagagagttgcagcgtctccgacctggcaatactcctgagggggaataaaaggaaaacccagccaattgaattcggcgctcaccaggttatcctggtggccaacgagactgccaaagaaaagatccctgaggaattgggtctagctctcgtgctcacgatctacgaggccaaaggcctggagtttgatgacgtgctcctatataacttttttaccgatagtgaagcctataaggagtggaagataatttccagcttcacccccacgtccaccgactcacgcgaggagaaccgaccccttgtggaggttccactggacaagcccggcagcagccaaggaagaagtctgatggtgaaccccgaaatgtacaaactgctgaacggggagctgaagcagctctacaccgccattacccgtgcgcgtgtgaacttatggatcttcgacgagaacagagagaagcgggcgcccgcctttaaatactttatacgtcgagatttcgttcaagtagttaagactgacgagaataaggattttgatgattcaatgttcgtgaagacctccactcctgcggagtggatcgcccaaggggactattacgccaaacaccaatgttggaaggtggccgcaaagtgctatcaaaaaggtggggctttcgagaaggaaaaactggcactagcccacgacacagccctatcaatgaagagcaaaaaggtgagcccaaaagaaaagcaacttgagtacctggagcttgccaagacatatctggagtgtaaagagccaaccttgtctctcaagtgtctatcctatgcaaaagaattccagctgtcggcacagctctgcgagcgactcggtaagatccgcgacgcggcctacttttacaaacggagccagtgctacaaggatgccttccgatgttttgaacaaatacaggagtttgacctggccttgaagatgtattgccaagaggagctctttgaagaggcagcaattgccgtggaaaaatacgaggaaatgctcaagactaaaaccctccccatctccaaactttcatactctgccagccagttttacctggaggcagctgctaagtatttatccgccaacaagatgaaggagatgatggccgtactctcgaagctagacatcgaggaccagctggtgtttttaaagagcagaaagaggttggctgaggctgcagatttgctgaaccgcgaaggccggcgcgaggaagcagcactgctaatgaagcagcacggctgcctattagaggccgcaaggcttacggcagataaagactttcaggcaagctgcctccttggggctgcgcgccttaacgtggcccgggactccgatattgaacacacaaaagacattctcagggaggccctcgatatctgttaccaaaccggacagctgagcggtatagccgaagcccacttcctgcagggtgttattctgagggacttccagaaactgcgggacgcctttttcaagttcgatactctcaatcatagcgctggcgtggttgaagcattgtacgaggctgccagtcagtgcgaggccgaaccagaaaagatcctgggactagccccaggcggattagaaatcttgctgagcctggtacgagcactgaagcgtgtgacgaacaacgcggagaaagaaatggttaaaagctgttttgagttttttgggattagtcaggtggatgctaagtactgccagattgcccagaacgaccccgggcctatacttcgtattatattcgatttggacctaaatttgcgcgagaagaagacgaaggaccattttttgattatgactgaccaggtgaaacttgctctgaataagcatctccttgggagattatgtcaaattacaaggagtctactcggcaagacatatcgaggcgtctgtatgagatttatcgtcggcctgaaatgcgaggacgagaactgcgagcacttccatagacccctgcggagatgtgaggcgaagtgcctcgtgcagtcgaaaatgaacctggtcgcaattaacggtctactgctagaagctaaaaaagtgttcccaaaaattctcgccgaagaactgaaagaaatcgactacatcctgagcacggacatgtatgggctatgtaagagtattctggatgtcctttttcccaaacatttccaccaaagggtgctctccgagaaccctatggcttgtaaagagattctcaaaccaaactacaaaagttttcgcttctataggttcgctctgaaagagtatatccactttttgtttgagaacgaatctgcacggaacaggcgggaaagcaccgacctatggctctccgcaatgcaggcctttctgctttcctctaattaccccgaagagttcgagaaattacttcatcaggaagaggataactataatagggagctgaaagctctggagagtgaaaaagacgagcggggccgaggaagaggctcaagaattaagggtatcgaggggaaattcggcatgctggctccaaatagagacgatgaaaacatggacaagacacacctgtgttttatacgactgctggaaaactgtatcgatcaattctacgtataccgcaaccccgaagactataagcgtctcttcttccgttttatgaacgttctaattaagcgttgcaaggaacctctcatccccagcatcggaaacaccgtggcacttctcgagttccagtttatccattgcggtgtcgttttggcccgactatggaaaaacgtaatcttatgtctccctaagagctatatcgccctgctccattattgggagttcctcttttctaagaaagataaagaacttggcgatgtgttcagcataatacaggagtacaagcccaaagacgtcacaagggctatacaggacttcaggtttcacctgagctatcttgctaaagtgttgtgcggctatgagaacgtgaactttaacgtcctcctcgatgcgttttccgagatagattacgtggtatcaggcgaagctgagcggacactagtgctgtgtttggtgatgcttgtcaatgcagaagagattctgcagccgtattgtaagcctctgctttatcgccatttccgagaaattgaatcgcgactgcagcttatgtctatggactgccccgggcaagttcctgagagattgttaaaggtagtcaagagggttctggtggccgtcaatgtgaagtccgttgccgaagcactacaagatctgctgtttgagagggacgaagagtatctcatggactgcgactggcgatgggatcccgtccatactaaagggagcatcgtacgggggctttattacgaagaggtgcggctaaataggctgctgtgtttagaccctgtggattacttcgccgaacccgaatgtgagtttggacaggacgagatggatgaactggcactggaggatagggatcacgtgctggccacaattttgtctcagaagcaacgcaaggcatcgattcagcggaagctgcggagagcctgcctggtcgtttctctctgcatttcgtggagacgccgagtggggactcaaatggagcgggtccgtgaagaggctcgggagcctagagccggtaatttcaagaaggcagacgtagatcgaacacaatgtgatctttgtggagttaagttcactcgcgggcccgagaactactttagtcctagcaaggcatttgagggcgcggcctccgaggtggccgtgctgtctcgagcggaattagagcgagaagagtgccaggagaggaattccgagagttacgaacagcacatccacttagagcaccaccaacgccagcaggtcgcttaccagaaatactccgagtttttccatgaaaaggtagaccctgccatagacgagggaaagcttgtggtccaggatatcgagcaaagcgtgtggatacactcacacgtgggctctaaagaacactcccatatgctgcaaaaagtgcaagaacacattaagcgggtttcggatatggtggaagacctctacagaagaaaggcttgggccggggcagaggaggccatgacccgcctggtgaacatcctgattctttccgtgagggacgcgcgggactggctgatgaaaaccgagactcgactgaagaaggagggtattgtgcaggaagatgattacgagaatgaagtggaagactttggggagctgcggccgagacgacggagccgcaaatgcggcaagcagaggaaatattag

SEQ ID NO: 33880 - DNA, 8778 bp, Artificial Sequence
  Description of Artificial Sequence: Synthetic coding sequence
atgtgggaccctagggcagcacgagtgcctccaagggaccttgcagtgctgttatgcaacaagtcgaatgcctttttcagcctgggcaaatggaacgaagccttcgtggccgccaaggagtgtttgcagtgggaccccacttacgtcaaagggtactatcgcgccggatactccttgctccgactgcaccagccgtatgaagccgcacgaatgttttttgagggcctgcggttggttcagcgatcgcaggatcaggcacccgtggcagatttcctggtcggagtcttcacaacgatgtcaagcgactccatcgtattgcagagctttctgccttgcttcgatcatatcttcacaacgggttttccgacggaggtctggcagagtgttattgagaagctcgcaaagaaagggctgtggcattcctttttactgctgagtgccaagaaagatcgcctgcctcgtaatattcatgtacccgaactgtcactgaaaagtctctttgagaagtacgtgtttatcggcctgtacgagaagatggagcaagtgcccaaactggtacagtggctcatctcaattggtgcttccgtcgaaacaatcgggccctacccactgcacgcgctaatgaggctgtgcatccaggcccgcgagaaccacctgttcagatggctgatggaccacaagccagagtggaaggggagaatcaatcaaaaagatggagacgggtgcaccgtgctgcatgtggtggctgcccactccccaggctacctcgtgaaacgacagaccgaagatgtgcagatgctgctgagattcggtgctgaccccacactgttggatcgccagtcgcgcagcgtagtggacgtgttgaaacgcaataagaactttaaagctattgagaaaattaacagccacttggaaaagttagcgacatgttccaaggacctgtctggcttctcaaacggcgacggaccaacatccgagaatgacattttcagaaaagtactagagcagttagtgaaatacatgaattctgggaatcgacttttacacaaaaattttctcaaacaagaagtcgtgcaacgcttcttaagactcctgtccactctacaagagatccctcccgatttagtgtgcgatatcaatcaggactgcgcaacgaccgtcttcaagttcctacttgaaaagcagcgctggccagaagtgctgctgctgttgactcggaaagtgtctggcgaaccaccactaggagattgtctcatcaaggattgtaatttctctgacttggatatctgcactatcatacctcatctcagtacttgggatcagcgcaaaaaacagctcctcggctgcctgatagactcaggagctctgccagatggactgcaagagtctcaggaacgccctgtggtcacgtgcttgaaacatgaggattttgagctcgcgttcctgctcctgactaaaggtgctgatcctcgggcaataagtcttacggaaggagacacacccctccacgccgccctacacatttttctggagattaaggccgacataggcttctccttccttagtcacctgcttgatcttttttggtcgaaccccactgaattcgactatctcaaccccaacgtccaggatagcaatggtaatacactgatgcacatccttttccagaagggtatgctgaaaagagtgaaaaagctcctggacttactagtaaaattcgatatcaactttaatctaaaaaacaaggaaggaaaggacgccaggcacaggatcaaaaaaaacgattccctcttgcttgcgtggaataaggcccttatggaaaacagaaggcggagtcggcaggactctgccgctcatctgggaaaattgtcaaagagcacggcccctggacacacttctcagctgaaaagccaggggtccttcaaaagtgtaccttgcggggcgaccgcacgtacgcttcctgagggatcggctgtccccgattcatgggagacactccccgggacccaagtcactcgaaaagaacccggggcactgcgaccatgctccttaagagattgcctgatgcaggatatcaccgttctgattcagcaggtcgaggtggatccttcatttccagaggactgcttgcagagtagcgagcctctggaagctggggcgggaaaggagggtaaaaaggacgataaacctaccttgggagccggtgcaccagactgctccgaggtgggtgagggacatgctcaggtaggactgggggcgctacagctggtgccggatgataatcggggtaaagaggggaacgacgaccaagacgactggagcacccaggaaatcgaggcatgtcttcaagattttgataacatgacatgggagatcgaatgtaccagcgagatgctcaagaaactctcctccaaagtgatgactaaggtgatcaagaaaaaaataatcttggcaatccagcagttgggcaacggcgagtggactcagggcttgcaaaaaaggctcaaacatctgaaaggctcgattcaactgttcgaagccaagcttgacaaaggagcaagaatgttgtgggagcttgctatcgatttcagcccccgctgctcagagaacccagagaagatcatagccacggaacagaacacttgcgccatggaaaaaagtgggcgtatttataccgagatcatccggatctgggacattgtgctggaccactgcaagctggctgacagcattaaggccatctgtaacgcatacaaccggggcctaagctgtgtattaagaaaaaagttgaaggggatcaataaggggcaggtatcagccaacatgaaaattcaaaaacgcatcccaaggtgctatgtggaggatactgaagctgagaagggccgagaacatgtaaacccggagtatttccctccagcatcggccgttgagactgaatataatatcatgaagttccacagtttctcaactaacatggctttcaatattttaaatgacaccactgccactgtcgagtatccttttcgtgttggcgagctcgaatatgctgttattgatctgaaccctcgtcctttggagccgatcattctgataggccgaagtggtactggcaaaactacgtgttgtctgtaccggctttggaagaagtttcacgtgtactgggagaaagccgaacaggcaggctcaccactcctggcaaaacaggtgtggctgaagagaaggctggaggtagagccgggcaaggaatcaccggggggcgaggaagaggaggaggaagaagacgaggaagaggaggactccatagaggtcgagactgtggaaagcattgacgaacaggaatatgaagcatgtgccggtggcgctggagtagaacccgctggagacggccaggcggccgaagtctgcgcccccgaacatcctcaccagctcgagcacctccatcagatttttgtgaccaaaaatcatgtcctgtgccaggaggtccagaggaatttcatagagctctccaaatctacgaaggccacctctcattacaaacctcttgatcctaacatccacaagctgcaagacctacgcgatgagaattttccattgtttgttacaagtaaacagctcctgttgctgttggatgcttccctgccgaaaccattctttctgcgcaacgaagacggcagcttgaaacggacaattatcggatggtccgcgcaagaggagagcacgatcccgtcgtggcaggaagatgaggaggaagccgaggttgatggcgattacagtgaggaagacaaagccgtagagatgaggacaggggatagcgacccaagagtgtatgtgacatttgaggtattcaaaaacgaaatttggccaaagatgaccaaggggcggacagcctacaaccctgcgctgatttggaaggagataaagtcatttttaaaagggtcatttgaggcattatcttgcccacatggaaggctcaccgaagaggtctacaagaagctgggccgtaagagatgccccaattttaaggaggaccgttctgagatatactccctgttttccctgtaccagcagatacggtctcagaaggggtattttgatgaagaggatgttctgtacaacatcagcagacgactgagcaagctgcgagtgctcccttggagtatacacgagctgtatggagacgagatccaagattttacccaggcagagttggctctcctgatgaaatgtatcaacgacccgaacagtatgtttctgaccggggacaccgcacaatccattatgaagggcgtcgcgttcaggttcagtgacctgcgatcccttttccactatgcctcgcgtaatactatcgacaaacagtgtgccgtccgcaagcccaagaaaatacaccagctttaccagaactaccgttcacacagcggtatattaaacctggccagtggcgtggttgacctgctccagttctactttcctgaatcattcgatcggctgccccgggattcaggattatttgatggacctaagcccaccgtcctggaatcctgttccgtctctgaccttgccattcttctcaggggcaataaacgcaaaacccagccaatagaatttggcgcccaccaagtgatactggtcgctaacgagactgcaaaagagaaaattcctgaagaattgggcctcgctctggtgctgactatctacgaagctaaaggactggagttcgacgacgtcctgctttacaacttcttcaccgacagcgaggcgtacaaagagtggaaaatcatttcatcctttacccccacgtccacagactcccgtgaagagaatcgaccattggtcgaagtgcctctcgacaagcctgggagttcacagggccgcagccttatggtcaaccccgagatgtataagttgctcaacggtgaattaaaacagctttacaccgctattacgcgcgcccgcgtgaacctgtggatattcgacgagaacagagagaaacgggcccctgccttcaagtatttcattcgccgggacttcgtgcaggtcgtgaaaaccgacgagaataaagacttcgacgattcaatgttcgtgaagacttccacccctgctgagtggattgcccagggggattactatgctaagcatcagtgttggaaggtcgctgccaagtgttaccagaagggcggcgcgttcgagaaggagaagctggcattggcccatgacacagcactgtcaatgaagagtaaaaaagtgtcgcccaaggagaaacagctcgagtacctggagctggccaagacatacctcgaatgtaaggagcccactctttcactgaagtgtctgtcttacgccaaagagtttcagctatccgctcagctatgcgaacgcctcgggaagattcgcgatgccgcatacttctacaaacgctcacaatgctataaagacgcgttccggtgcttcgagcagatccaggaatttgatctggcactaaagatgtactgccaggaagaactgttcgaggaagccgccatcgccgtggaaaagtacgaggagatgctcaaaactaaaaccttgcccattagcaagctgtcatattctgcttcccagttctacttggaggctgcggccaaatacctgagcgccaataaaatgaaggagatgatggctgtcctttctaagttggacatcgaagatcagctggtgtttctgaagtctcggaaacgactggcagaggctgccgatcttctgaatagggaggggcgacgggaggaagctgccctcctgatgaagcagcacggctgcttactggaggccgctagactcaccgctgacaaagactttcaggctagctgtctgctgggcgcagcccgcctgaatgtggcaagggactctgacattgaacacaccaaagatatcctgcgggaagcactcgacatctgttaccagactgggcagttgtccggcatagccgaggcacacttcctgcagggggtgatcctgcgagactttcagaagttgcgagacgctttctttaagtttgatactcttaatcactcagcgggggtcgtcgaggccttgtatgaagctgctagccagtgtgaggcggagccagaaaagatcctgggcttagccccaggaggtttagaaatcctgctgagtcttgtgcgagccctgaagagagttacgaacaacgctgaaaaagaaatggtgaaatcatgttttgaattcttcgggatctctcaggtcgatgccaagtactgtcaaatcgcccagaacgaccccggcccaattttgcggatcatattcgacctggacctgaatctcagagagaagaagaccaaggaccacttccttattatgacggaccaagttaaactggccttgaataaacatctactgggtcggttgtgtcagatcactcggagcctgcttggcaagacctaccgcggtgtctgcatgcgcttcattgtcgggctgaagtgcgaggacgaaaactgcgagcatttccaccgtccactcagaaggtgcgaggccaaatgtctggtgcagtcaaagatgaatctcgtggctatcaacggcttgttactggaggctaagaaggtgtttcctaaaattctagccgaagaactgaaggagatcgactacatcctctccactgacatgtatgggctgtgtaaatctattctcgatgttctttttcctaagcattttcaccagcgagtcttgagcgaaaacccgatggcttgcaaggagatactcaagcccaattacaagtcatttcgattctatcgatttgcattgaaggagtatatacacttcctcttcgaaaatgaaagcgctagaaatcgcagagagagcaccgatctttggttgtcggcgatgcaggcattccttctgagttctaattacccagaagaattcgaaaagctgctgcatcaggaggaggataactacaaccgtgaacttaaggcactggagtctgagaaggacgagagaggcagagggaggggaagccggatcaaaggaatcgaagggaaattcggcatgttagccccaaatagagacgacgagaacatggacaagacacacctttgcttcattcggttacttgaaaactgcatcgatcagttctatgtgtaccgtaaccctgaagactacaagaggctgttcttccggttcatgaatgtacttataaaaagatgcaaggaacctctaatcccctccattggaaataccgtggctttattagaattccagtttattcattgtggggtcgtgttggcacgcttgtggaaaaacgtgatactctgtctccctaaatcttacatcgcattactccattactgggagtttttgttctctaaaaaagataaggagctcggagacgtattttcaataatacaggagtataagcccaaggacgtcacccgtgccatccaggactttagattccacctgagttatcttgctaaagttctgtgtggatacgagaatgtgaatttcaacgtactgttggatgccttctcagaaatcgattacgtggtgtctggtgaggctgagaggactctggttctatgtctggttatgttggtgaatgcagaggagattcttcagccgtactgtaaacctctgctgtatagacatttccgcgagatcgaatctcggcttcagttaatgagcatggattgtccgggacaggtgcccgaaaggttgctgaaagttgttaagcgggttctcgtggcggttaacgttaagagcgttgcggaggcactgcaagatctgctgttcgagcgggacgaagagtatctgatggattgcgactggagatgggaccctgtgcatacaaagggctctattgtgcggggcctgtactatgaagaggtgcgccttaacaggttgctgtgtttagacccggtcgactactttgctgagcccgagtgtgagttcggccaggacgagatggatgagctcgctctggaagacagggaccatgtgttggccaccattctgagccagaagcagcggaaagccagcatccagcgtaagctccgccgcgcttgcttagtggtaagtctttgtatatcatggcggagaagagtgggaacccaaatggaacgcgtcagagaggaagctcgagagcctagagcaggaaatttcaaaaaagcagacgtggatcgaacccagtgtgatctctgcggagtaaaatttacgagaggccctgagaactacttcagccctagcaaggctttcgagggcgccgcgagcgaagtcgccgtattgtcgcgggcagagctggagagagaagaatgccaggagcgaaatagcgagagttatgaacagcatattcacttagaacatcaccagagacagcaggtcgcgtatcagaagtacagtgaatttttccacgagaaggtcgatccggccatcgatgaaggcaagcttgtagtgcaggacatagagcagtctgtgtggatacactcacatgtaggttctaaagagcatagccatatgctgcagaaggttcaggagcacatcaagagagtgtccgacatggttgaggatctgtatcgcagaaaggcttgggccggcgccgaggaggccatgacgagattggtgaacattctcatcctcagcgttcgcgacgctagagattggttgatgaagaccgagacccgcctgaagaaggagggcattgtgcaagaggacgactatgaaaatgaggtcgaggattttggtgaactccgcccccggcgcagaagccgcaagtgtggcaaacagcgcaagtattag

SEQ ID NO: 33881 - DNA, 2583 bp, Artificial Sequence
  Description of Artificial Sequence: Synthetic coding sequence
atggctccagccgggtgttgctgctgctgttgcttttggggaggagccgtagccgccgctggggcagccaggcgggtcttgctattgctcttgctcggcgtgctgtccgctgggctgcggcctggcgccctcgcgactgagcactatagcccactgagtctgttgaagcaggagctacagcatagacagcagcaggaggctcccgccggagggggagggtgcagtcctcagtcgggggattggggcgatcaatactcagcagaatgtggcgagagctcattcctgaatttccacgactcagattgcgagcccaaagggtcctccccttgcgacagcctgttgagtctcaacacagaaaaaatactgagccaggcaaaatccatcgcagagcaaaaacgcttcccattcgccaccgacaatgattcgaccaatgaggagttggctatcgcgtatgtgctgataggcagtggcctgtatgatgaagccataaggcattttagtacgatgcttcaggaagaaccagacctggtttccgccatctatggacgcggaatagcttacgggaaaaaagggctgcacgacatcaaaaacgccgaacttgccctgtttgaactaagtcgcgtgattacgttggagcccgacagacccgaggtatttgagcagagagccgaaattctaagcccgctgggacggattaacgaagctgtgaatgatctgaccaaggccatccagcttcagccttctgcccggctctatagacatagggggacactttacttcattagtgaagactacgctactgctcatgaagacttccagcagtctctagagcttaataagaatcagccgatagccatgttgtacaaaggcttgaccttctttcacaggggtctcttaaaggaggctatcgaatctttcaaggaagctctcaagcagaaggtggacttcatcgatgcctacaagagcctgggacaggcctatagggagctgggtaactttgaggccgccacagaaagtttccagaaggccttgctgctgaatcagaaccatgtccagactctgcagctccgggggatgatgctgtatcaccacggctcacttcaagaagccttaaagaattttaaacggtgccttcagctcgagccatataacgaagtctgccagtacatgaaagggttatcacacgtggccatgggccagttctatgagggaatcaaggcccagacgaaggtgatgttaaatgaccctctgcctggccagaaggcatctcccgaatacctcaaagtgaaatacctgcgcgagtactctcgctatttacacgcacacctcgacacccctttgacagaatataacatcgatgtggacctccccggctccttcaaggatcactgggcaaagaacttgccgtttttgattgaagattatgaagagcagcccgggttgcagccccatatcaaggatgtcctccaccaaaatttcgaaagctacaaaccggaggtgcaggaactgatctgtgtggccgaccggctcgggagcttgatgcagtatgagacccctggttttctgcccaataagagaatccaccgggcaatgggcctggctgcactggaggtgatgcaggccgtgcaacggacctggacgaatagcaaagtgcgcatgaacggtaaaacacggctcatgcaatggagggacatgtttgacattgcagtgaagtggaggcgaatcgccgacccagatcagcctgtgctgtggctagaccagatgccagctaggtcgctgtcacggggcttcaataaccacatcaacctgattcggggccaggtgataaacatgcggtatctcgagtactttgagaaaatcttgcacttcatcaaagataggattctcgtctatcatggggctaataacccaaagggcttgctggaggttcgggaggccttggagaaggtgcataaagtagaagatctcctgcctattatgaagcaattcaacaccaaaacaaaggatggatttacggtcaacaccaaagttcccagtttaaaggatcaggggaaggagtacgacggattcaccataactatcactggtgacaaggtgggcaatattctgttctctgtggagacccaaacgaccgaggagcggacccaattgtaccacgctgagatagacgcgctctacaaagacttaaccgctaaggggaaggttctgatcctctcgtcggagtttggagaggctgatgcagtgtgtaaccttattctctcattggtctactacttctacaacctgatgcctttgtctcgggggtcctccgtcatcgcctattctgtgatcgtgggggctctcatggccagcggcaaagaagttgccggtaaaatcccgaagggaaaattggtcgatttcgaggcgatgacggctccgggatctgaagcattctcgaaagtcgcaaaaagctggatgaatttgaaatctatctctccaagttacaagacactgccgtctgtaagcgagacttttccgacactgagaagcatgatcgaagtcctcaacaccgattccagtccgcggtgcttgaagaaactctag

SEQ ID NO: 33882 - DNA, 2421 bp, Artificial Sequence
  Description of Artificial Sequence: Synthetic coding sequence
atggcccccgccgggtgttgttgttgctgttgtttctgggggggcgctgtggctgctgcgggtgctgccagaagggtactgctactcctcctgctcggcgtgctctcagccgggctccggcccggggctctcgcaaccgaacactatagtccccttagtctgctaaagcaggaattacagcatcggcagcagcaagaagcccctgctggcggtgggggctgctccccacagagtggagattggggagaccagtactcggccgagtgcggcgaatcatcgtttcttaatttccacgacagtgattgtgagccgaaaggatcaagcccgtgtgattctctgctgtccctcaataccgaaaaaatcctctctcaagctaaaagtatcgccgaacaaaagcggtttccattcgcaacagacaatgattctactaacgaagagctcgcgatcgcttacgttttgatcggaagcggcctgtatgatgaagccatcaggcatttcagtacgatgctgcagatcctgagtccactgggccgaatcaatgaggcagtgaacgacctgaccaaggcaatacaattacagcccagcgctagactgtacaggcatcgggggactctgtacttcatctcagaggactatgcaactgcacatgaagacttccagcagtcattggaactgaataagaaccagccaatcgcgatgttatataaaggccttacgttctttcacagaggactgcttaaagaagccattgaaagtttcaaagaggcactcaaacagaaggtcgatttcattgatgcatataaaagtctggggcaggcctacagagagctcggaaacttcgaggctgccaccgaaagcttccaaaaggccttacttctgaaccagaatcacgtccagaccctccagttgcgcggcatgatgctgtaccatcacggatcattgcaagaagccctcaaaaactttaagaggtgcctacagctcgagccatacaatgaagtgtgtcagtacatgaaggggctatcccatgtcgccatgggtcagttctacgaagggatcaaggcccagaccaaagttatgcttaacgaccccctgcctggacagaaagcctcccctgagtacctgaaggtcaagtacttgcgggagtactcccgatatttgcacgcccatttggatacccctctaaccgaatataacattgatgtggatttgcccgggtcatttaaggaccattgggcaaagaacctcccctttctaatagaggattatgaagaacaacctggactccagccccatataaaagatgtcctgcatcagaattttgagtcttacaaacccgaagtccaagagcttatctgtgtggccgaccggctgggatcactcatgcaatacgagactccgggattcctgccaaataaacgcatccatcgcgctatgggactggccgccctcgaggtgatgcaggccgtgcaaaggacttggacaaacagtaaagtccggatgaatggcaaaacacgtcttatgcagtggcgagatatgtttgacatcgcagtgaaatggcgccgcattgccgaccccgatcagcccgtcctgtggctagatcaaatgcccgccaggagccttagccgcggttttaataatcacatcaatctgatccggggccaagtgattaacatgaggtacctggaatacttcgaaaaaattctgcacttcatcaaagatcgcatcctcgtttatcatggggccaataaccccaagggacttctcgaggtcagagaagccctcgagaaagtccataaagtggaggatctcctccccatcatgaagttcaatactaagaccaaagatggctttaccgtaaacaccaaagtgccatctcttaaggaccaagggaaggaatatgatgggttcactattactatcacaggagataaagtagggaatattctattctctgtggaaacgcagaccaccgaggaacggactcagttgtaccatgccgagatcgacgcgctctataaggatctgaccgcaaaaggaaaggtgctcattctgagcagcgagttcggggaagcagatgccgtgtgtaacctcatcctaagtttggtctattacttttacaatctcatgccacttagtagaggatcctctgtgatcgcgtattctgtgatcgttggagcattgatggcgtcaggaaaggaggttgctggcaagattccaaagggcaaactggtggactttgaggccatgacagcgcccgggagtgaagccttctctaaagttgctaaatcttggatgaatctgaaaagtatctcaccatcctacaaaacccttccctcggtctccgagacttttcctacccttcggtctatgatcgaggtgctgaacaccgactcatccccccggtgcctgaagaagttgtag

SEQ ID NO: 33883 - DNA, 2424 bp, Artificial Sequence
  Description of Artificial Sequence: Synthetic coding sequence
atggctcccgccggatgctgttgctgctgttgcttctgggggggggcagtagccgctgctggtgccgctcggagagtgctgctgctcctattactgggagtgcttagcgctggcctcagacctggggcactggcaacggaacactactcccccctgtccttattgaagcaggagttgcagcatcgccagcagcaggaggcgcctgccggcggtggaggctgttccccacaatctggagactggggcgatcagtactcagccgagtgtggagaatcgtccttcctgaacttccacgatagcgactgcgagccaaaagggtcctcgccttgcgactcactgctgtccctcaatactgagaaaattctttcacaggccaagagcatcgccgagcagaaaagatttccgtttgcaacagacaacgatagcactaacgaggaattagcaatcgcatacgtactgattggcagtggcctgtacgatgaagctatccggcacttttccacaatgctgcaaatcctgagtccgctaggaaggattaacgaggccgtcaatgacctaaccaaggcaatacagttgcagccatctgctaggctttatcgtcatcgggggaccttgtactttatctccgaggactacgcaacagcccacgaagattttcagcaatctctggaattaaacaagaaccagcccatcgccatgttatacaaaggtctgacgttcttccacagaggattgttaaaggaggctatcgaatcgttcaaggaggccctgaaacagaaggtggacttcatcgacgcatataaatctctggggcaggcttacagagagctggggaatttcgaggctgctaccgagtcatttcagaaagctctgcttctgaatcaaaaccatgttcaaaccctgcaacttagaggcatgatgttgtaccaccacggatctctgcaggaggcccttaaaaacttcaagcgctgcctgcagctggagccatacaatgaagtgtgtcagtacatgaagggtctgtctcacgtcgctatggggcaattctatgaagggattaaggcccagacgaaagtgatgctgaacgacccacttccgggccagaaagcctccccggaataccttaaagtaaaatatctccgggagtatagccgttatctgcacgcccacctggatacaccactgacagaatacaacattgacgtggacttgcccggttctttcaaagaccactgggcaaagaatctgcctttcctgatcgaggactatgaggagcagccgggactgcagcctcatattaaggacgtccttcaccaaaatttcgaatcatacaaaccagaggtacaagagctgatctgcgtggctgaccggctgggctcccttatgcagtatgagactccggggtttctcccaaataaaaggatacatagggccatgggtctggcagcactggaagtgatgcaggctgtgcagcggacctggaccaatagcaaggtgagaatgaacgggaagacacggctcatgcaatggagagatatgtttgacatcgctgtgaaatggcggcggatagctgatcctgaccagcccgtgttgtggcttgatcagatgccagcccggagcctgtcaagaggctttaacaatcatatcaatcttattcggggacaggtaattaacatgaggtatctggaatattttgagaaaatcctgcatttcattaaagatagaatcctggtctaccacggagccaataaccccaaaggacttctagaagtgcgcgaggcccttgaaaaagttcataaggtggaagacctgctgcccattatgaagcagtttaatactaagacgaaggatggatttacagttaacacgaaggttccctccctgaaggaccaaggtaaagaatatgatggattcaccatcaccatcactggcgataaggtgggcaatattctcttcagcgtggaaacccagacgacggaggagcgcacgcaattataccacgcggaaattgatgcactgtacaaggaccttacagccaaaggaaaggtactgatcctcagctcagaattcggagaggccgacgcagtgtgtaacttaattctaagtctggtctattacttctacaacttgatgccactgtccaggggctctagcgtgattgcatatagtgtcatcgtcggcgcgctaatggcttctggcaaagaagttgccgggaaaatccctaaaggcaaactggtcgatttcgaagcaatgaccgctcccgggtctgaggccttctccaaggtggccaaatcttggatgaatttaaagagcatcagtccctcatacaagactctgccctccgtttctgagacgtttcctacactgcggtctatgatcgaggtgcttaacacagattctagcccaagatgtctcaagaaactgtag

SEQ ID NO: 33884 - DNA, 2313 bp, Artificial Sequence
  Description of Artificial Sequence: Synthetic coding sequence
atggatagggatctcctgcgccagtccctcaattgccatggaagtagtctgctttcccttctgagatctgagcagcaagacaacccccacttccgatcgctgctgggatctgcagccgaaccagctagggggcctccccctcaacatcccctacagggtcgcaaagagaagcgggttgacaacattgagatccaaaagttcatctctaagaaagccgaccttctgtttgctctgagttggaagtcggacgctcctgctacaagcgagatcaatgaagactcagaggatcattacgccatcatgccacctttagaacagttcatggagatcccatctatggataggcgagaacttttcttcagggacatcgagagaggggacattgtcatcggccgtatctctagtattagggagttcggcttcttcatggtgcttatatgtcttggttctggtatcatgcgcgatatagcccacctggaaattacagccctctgtcccctccgcgacgttcccagccactccaatcacggcgatccattgagctactatcagacgggggacatcatcagggccggaatcaaagacattgacaggtaccacgagaaactggcagttagcctctatagtagttccctgccgccccatctctcaggcattaaactgggtgtgatctcctcggaggaacttcctctgtactaccggcgcagcgtcgaactgaactccaacagtttggagtcttatgagaacgtgatgcaatcgagcttgggcttcgtaaaccccggggttgtcgagttcctactggagaagctagggatcgacgaatcgaaccccccatctctcatgcgcggacttcagtcaaaaaactttagcgaggatgatttcgcctctgctctgcgcaagaagcagtcggccagctgggcacttaagtgtgttaagataggcgtcgactattttaaggttggaagacacgtcgacgccatgaatgaatacaacaaggcactcgagatcgataaacagaacgtagaagctttggtggctaggggtgccctgtacgccactaaggggtctcttaataaagctattgaagactttgaactggccttagaaaactgcccgactcacagaaatgctcgtaaatatctgtgccagactctggttgagcggggcggccagcttgaggaggaggaaaagttcctgaatgcggagtcctactataagaaagcattagcattagacgaaacgttcaaagatgcggaggatgcgctccagaagcttcacaaatacatgcagaagtcattggaactgagggagaagcaggctgaaaaagaagagaaacagaaaacgaagaagatcgagacatctgcagaaaagctcagaaagctgttgaaggaagagaagcggctgaaaaaaaaacggcgcaaatcgacctccagctcgtctgtgagctccgctgacgagagcgtgtcctcttcaagcagttcttcctcctcggggcacaagcgccacaaaaaacacaagaggaacaggtctgagtcgagccgcagtagcaggcggcattcgagtcgagctagctctaaccagattgaccagaacagaaaagatgaatgttatccagtccccgccaatacgtccgcaagcttcctgaaccacaaacaggaggtcgaaaagttgctcgggaaacaggataggctgcaatacgagaagacgcaaattaaggagaaggatagatgtccactgtcatcatcaagtcttgagatcccggatgactttggcggcagatcagaggaccctcgggacttttataattcctataagacacaggcgggaagcagtaaaacggagaagccgtacaagagcgaacggcatttctcatcccgcaggaactcatctgactccttctgcagaaactccgaagacaaaatatacggataccggcggtttgagaaagacatcgaaggcaggaaggaacactacaggaggtgggagcccgggtccgtgcgccactcgacaagcccggcaagctctgaatactcttggaaatctgtggagaagtacaagaaatatgcccacagcggatcgcgtgattttagtcgccacgaacaaaggtatcgcttgaacaccaatcagggagagtatgagagggaggacaattatggcgaggacattaaaaccgaagtcccggaggaagatgcactaagttcaaaagaacactcagagagctccgtgaagaaaaatctgccacagaacttactgaatatctttaaccagatcgccgagtttgaaaaagagaagggcaataaaagcaaaaactag

SEQ ID NO: 33885 - DNA, 1962 bp, Artificial Sequence
  Description of Artificial Sequence: Synthetic coding sequence
atggatcgtgatctgctgagacagtccctgaattgccacgggtcatcattgttgagcttattgagatcagagcagcaggacaatcctcattttagatctctgctaggctccgccgccgagccggcaagaggaccgcccccacaacatccattgcagggtaggaaggagaagcgggttgacaacattgagatccagaaattcatatccaagaaagctgacttgttgtttgccttgtcttggaaatctgacgcaccagctactagcgaaatcaatgaggacagcgaggatcactatgctatcatgcccccactagagcagtttatggagatccccagtatggataggagggaacttttttttagagacatcgagcgtggcgatatcgtaatagggcgcatatcctccatacgcgaatttggcttttttatggtattgatttgcctgggaagcggtattatgcgggacatcgcacacctggagatcacagcgctgtgtccgctgcgggacgtgccttcccattcaaaccacggagaccctttgtcttactaccagacaggtgatatcatacgagccggcatcaaggatatagatcgataccacgaaaaactagcagtgtccctgtacagcagttctcttccaccccacctttctggtataaagctcggagtcattagctccgaggaattgcctctgtattacaggcggagcgttgagctgaatagcaacagcctggagtcttacgaaaacgtgatgcagtcatcactcggctttgtgaatccaggcgtggttgaattcctgctcgaaaaactcggcatcgacgagagcaatccaccatccttgatgcgcgggctgcagagcaaaaatttcagtgaagatgatttcgcatctgccctgcgcaagaaacaatcagcatcatgggccctaaagtgcgttaaaataggcgtagattattttaaagtcggcaggcacgttgacgccatgaatgagtacaataaagctctggaaattgataagcagaatgtagaagcactcgtagcaagaggggccctgtacgcaactaagggatccctaaataaggccattgaagatttcgaacttgcactcgagaactgtcccacccatcgcaacgcgagaaagtacctgtgtcagacgctggtggagcgcggtggtcagctggaagaagaggagaaattcctgaacgcagagtcctactacaaaaaagctttagctctggatgaaacttttaaagatgctgaagatgccctacagaagctgcataagtacatgcagaagagtcttgaactccgcgaaaaacaggctgaaaaagaagagaagcaaaagacgaaaaaaatcgaaacttcagccgagaaattaaggaagctgctgaaggaggaaaaacgcctgaagaaaaaacgtcggaagagtacctcttctagcagcgtgtcctcagcagacgaatccgtttcctcctcttctagcagttcaagttccgggcacaaaaggcataagaaacacaaacgcaaccggagtgagagctcaagatctagtagacgccatagcagcagggcaagcagcaaccagatcgaccaaaatcggaaagacgagtgttacccagtgccagccaacaccagtgcctcgttcctaaaccacaagcaggaggtggagaagctcctggggaagcaagataggctgcagtacgagaaaacgcagattaaagaaaaagatagatgtcctctgtcatcctcatctctcgagattccagatgacttcggcgtctactcgtacctcttcaagaaactgactatcaagcaaccccaggccgggccgtctggcgacattcccgaggaaggcattgtgataatcgatgattccagcatacatgttacagatccggaagacctgcaggtggggcaagacatggaagtggaagactctggaatcgatgatccagaccacggttag

SEQ ID NO: 33886 - DNA, 1320 bp, Artificial Sequence
  Description of Artificial Sequence: Synthetic coding sequence
atggaccgggatctactgcgccagtccctaaattgtcacggctcttcccttttatccttgcttaggtctgaacagcaggacaacccacacttcagaagccttctgggcagtgcagccgagcctgctcggggacccccacctcagcacccactacagggcaggaaagagaagcgggtggataatatagagattcagaagttcatctctaaaaaggccgatctcctgtttgctctctcttggaagtcagatgcccctgccacatccgagattaacgaggactccgaggaccattatgcaattatgccgccactcgaacaatttatggagatcccaagtatggacagacgcgagctgttctttagagacattgagagaggcgatatcgtaattgggcgcatttcttctataagagaatttgggttcttcatggtgttaatttgtctgggaagtggcatcatgcgggatattgctcatttagaaataacagctctttgtccactgcgcgatgttcccagccattcgaaccacggggaccccctcagctactaccagaccggcgacattatacgagccgggattaaagacatcgacagataccatgagaagctggccgtgagcctgtacagctccagtctgccccctcacctgagcggcataaagctaggcgtgatttcctcagaagagctgccactctattatagaaggtccgtggagctaaacagcaattcactagaatcttacgagaatgttatgcaaagctctttgggtttcgtcaacccgggggtggtcgaatttctcctggagaagttgggaatcgatgaatctaatccaccaagcttgatgcgaggcctccaatcgaaaaatttttcggaagacgatttcgcatccgccctgcggaaaaaacagagcgcatcctgggccttgaaatgcgtcaaaatcggagtggactactttaaggtcggaaggcatgtcgacgccatgaacgaatataacaaagccctcgagattgacaaacaaaacgtggaggccctggtggcccggggagctctatacgcgacaaaggggagcctgaacaaagccatcgaggatttcgagctcgcccttgagaactgtcccacacacaggaatgcccggaagtacctttgccagactctagtcgagagagggggacagctggaggaggaggagaaatttttgaatgctgaatcatattataagaaagccttagcattggatgaaacttttaaggatgccgaggacgcattgcagaagctccacaagtacatgcaggtgatcccctattttctcctggaaatttag

SEQ ID NO: 33887 - DNA, 1125 bp, Artificial Sequence
  Description of Artificial Sequence: Synthetic coding sequence
atggcctggctggactctcgtaatacatcattaccaagcctagggttttgtcttctgttgctgcccttacatccggctccattattgcccaccacgcccacacccgccctgtgccctgggctggtgcactcacaggggcatcctagcgcgtgtcctcacttcccacacagttattcccgcggacagcagtgcctggagcaggccgattgggagacagccgtgttactgttcagtagagccctgcatcttgaccctcagctgggtcagtgtttatttgagcagtgtgccttcctagacgctctgaacgttttttctcacgctgctgagctgcagccggagaagccgtgctttcgctatcgatgtatggcatgtctgctggctcttaagcagcatcaggcttgcctcactctgatcaccaacgagctaaaacaggacaccacgaacgcagacgtatatatcttccgggcacgtctttacaacttcttacagaaaccccatctctgctatcgggatttgcacagcgctctgctgctgaatcccaaacaccctcaggcccgcatgttgttacaaaaaatggttgctcaggcccagcaagcgagacaggatgctggaattcttgccgttcagggaaaactcgcccgcacggctgccgatcagccttgccaccgagaacagccgagtggccctcagagtctgccactgccaggacatcatgttcccacagccccaggagtccgctggggatccggggggctccccgagggtgctggccatggagaccgcggcccggggggacatggcgcagcaggcacagcgcctgccgtcgccgatcttcaacggctttgccgggccctgttacaggctggcagacttccaggagggcgggctgcagcggaacagggccctcccgggagagcagccggggaaaggacactgcatcagccccgccgacagtttcagaaggctgaaaaccatttctccactgccattcggcataacccacagaaggcgcagtactatctgtacagggccaaaagcaggcagctgcttcagaatatctttggtgctagacaggatgtggccacggtgttgcttcttaatccaaagcagcctaaggacgcttag

SEQ ID NO: 33888 - DNA, 1230 bp, Artificial Sequence
  Description of Artificial Sequence: Synthetic coding sequence
atgcacggtcttagtcccggcccacaggccgcatctggactgcctcacgctcatcatcaacgagcggaggccggacatcatcagcgcaggtgcttgcacctgcccgggcagactttgcagctcagccctgaggctccaccactgctaccaggcccagcccagagactagccgtagagagccaagcaccagcaggtcaggatgcagcaccagaagacggtggccccgggcctgcaggagctcctcgctgtggcgaccctgggtgcgcgggccaagccgccgcccgcacagcagcagaccagccctgccaccgggagcagcctagcgggcctcaaagcctccctcttcctggacatcatgtgccgactgcccccggagtgaggtggggttccggaggcttacctgagggcgccggtcacggggaccggggtccaggcggccacggcgccgccggtacagcccccgctgtggccgacctccaacggttatgcagagcccttctccaggctggccgtctgcctggaggtcgggcggccgctgaacaagggccccctggtcgggctgcgggggaacggacattgcatcagccccgccggcaattccaaaaggcggaaaaccacttttcaacggccattaggcacaatccacagaaggcgcaatactatttgtatcgggcaaaaagccggcaactcctgcagaacatttttggggctcgccaggacgttgcaactgtgcttctgttgaatccgaaacaacctaaactgtctctgctcatgacgaatctttttcccggcatgagtgtcgaagaagtgcttagcacgcagatcgcccacttggcccggcttcaactggagcagatggtagagggctcgctgcaggctggaagccctcaaggtattgtcggaatgttaaagaggcacgagttggagcgccaaaaggctttagcacttcagcattcctggaaacagggcgagcctctcatcgcaaccagcgaggagcttaaggctactcccgaaatcccccaggtcaagcccggatcgtcagaaggagaagccgaggcacccgaggaggaagaggagaaagaaaaagaaaagaaagaagtgagcggggtccaggctcgcgcacggagcccatggggacttggccactccgtcccccagcccagggccgaaggatgccgccccgttgagagtggatttcaggcctggctctgcacaccttccgccgtgtag

SEQ ID NO: 33889 - DNA, 2622 bp, Artificial Sequence
  Description of Artificial Sequence: Synthetic coding sequence
atgaccgattctgatgaggacgcgcttaaggtcgatcagggcccatcacgggatattcccaagccctgggtgattccggctcccaaagggattcttcagcatatatttggtacctcccatgtcttccaatctatctgtgatgtgaagccaaaagtcaccggtctaacagtgcctcttaaggttagagagtactactctcgtggtcaacaatgtctcgaacaggcagactgggagacagcggtcctcctgttttccagggctttgcacctggacccacagctcgtcgatttctacgccctgagggccgaggcatacctgcagttatgcgatttcagcagcgctgctcagaacctgagaagggcctactccctccagcaggataattgtaagcatctggagcgactgaccttcgtgctgtacttacaggggcagtgtcttttcgaacagtgtgcattcttggatgcgctgaacgttttttcacatgctgctgagctgcagcctgaaaaaccgtgcttcaggtatagatgcatggcctgtctacttgcacttaaacaacatcaggcatgtctaacactgatcactaacgagctgaaacaggacaccacaaatgcggacgtgtacatctttcgtgcccgactttacaattttctgcagaaaccacatttatgttacagagatctacatagcgctttgcttttgaaccctaagcatcctcaagcgcggatgctgctgcaaaagatggtggcacaggcccaacaagcccgccaggatgccggcatcctggcagtgcaaggtaagctgcagcatgcacttcagaggatcaacagagcgattgagaataaccccctggatccaagcctatttctttttcgcgggactatgtatcgaagattgcaggaatttgacggtgcggtcgaggacttcctgaaagtgctcgatatggtgactgaagatcaagaggacatggtgaggcaggcccagcggcagctcctgctgacgtataatgatttcgccgtgcactgttacaggcagggcgcatatcaggagggcgtgctgctgctgaataaagctctacgggatgagcagcaggagaaggggctatacataaaccggggagattgcttcttccagttaggcaatctcgccttcgcagaagccgattatcagcaggctctcgccctgtcaccacaagatgagggcgcaaataccagaatgggtcttctacaggagaagatgggcttctgcgaacagagaagaaaacagtttcagaaagccgaaaatcattttagtaccgctatacgccataacccccaaaaagctcaatattacttgtacagagccaaaagtcgacagttgctccagaacatcttcggagcacgccaggatgtggccaccgtgctgcttctaaaccccaagcagcccaaactgagcttactaatgacaaatttatttcccggcatgtcagtggaagaggttctgtcaacacagatagctcatttggcgaggcttcagctcgaacagatggttgaaggcagtctgcaggcagggtccccgcaggggatagtgggcatgcttaaaagacacgaacttgaaaggcaaaaagctctagccctgcagcactcctggaaacagggggaacctctgattgccacctctgaagaattgaaagccacgcccgaaatcccgcaggtcaagcctgggtcgtcagagggtgaggccgaggccccagaggaggaagaagaaaaggagaaggaaaagaaagaggaaaagaagagtgaattgatcccctccaaagtggcttctctgtccgactcatatctggatcaaacgtcctccgcttcttccatgtccttcagaaccaccggcacttccgagacagagatgtccgcaatctgccaggagtatcgctctacttctgccacggcagtgaccttctcagattcctccctgttgaaaacacagtcatctgattctggaaacaacagagaagccctcagtcacgggccacggaagattaaggccacccagggacagcgccaatctttatcaaagactgaacccactcagtctcagagaaggaacagtagtaaaacaaaggcaaccattcataagaggaacagttcaaagaccaaagccacacagtcccagagacgaaatagctccaagactagagccacacaagggcagggccagagctcttctaagactgaagcaacgcaggggcagcgccagtccagcagcgaaattgaggccacacaggggccccgtcaggagcccagtaaaacaaaaacaacccggagccctcgccagcgcccccgcaaggtcaaggctgctcgcggaagaagttggcggcctagtaaagtcgatgccacccaggggagatcccggggcttattgagatcctcaactaagacagaagcattttacgattccaactggtctttaagcaagacagagtatgctcaaggacagggtcaacgctcctccaaagccgagggcgcccagggaaaatcacagggcatgagctccacgtccagtaaagctgagtccacatggggtccttcaccttctctgtctaaaaccgaagtagaccaggatctcacatattacgaggcagtctag

SEQ ID NO: 33890 - DNA, 726 bp, Artificial Sequence
  Description of Artificial Sequence: Synthetic coding sequence
atggcttgtctgttggccttgaagcaacaccaggcatgtctgacgctgattaccaacgaactaaaacaggacacaacaaacgcagatgtgtacatattcagagcgcgcttgtacaactttcttcagaaaccccatttatgctaccgcgatctgcactctgctctccttctgaacccaaagcatccccaggcccggatgctcctgcagaagatggtggcccaggcgcagcaggctcggcaggacgcgggtatccttgccgtccagggcaaactccaacatgccttgcagagaatcaaccgggcaatcgagaataatccgctggatccttccctatttctgttcagggggacgatgtatcgtcgtctgcaggaatttgatggcgcagtggaagattttttgaaagttcttgacatggtgactgaggaccaggaagatatggtgaggcaggcacaacgtcagttgctgctgacctacaacgattttgccgtacattgctacaggcaaggggcttaccaggaaggagtcttgttattgaataaagccctgcgggatgaacagcaagaaaagggcctgtatatcaataggggcggcgctcaaaggcccgggcactggggtggtggagttcgaggaagtcttgctattagcaaagctcctacagggcacctccgccctttgggcggacgccgaaaaggcgaacggaaagaagcgagggaagaggaaatgtag

SEQ ID NO: 33891 - DNA, 3426 bp, Artificial Sequence
  Description of Artificial Sequence: Synthetic coding sequence
atggcggccgctgtgggggtccgagggaggtacgagctgccaccctgtagtggaccagggtggctcctaagtctgagcgcactgctgagcgttgccgccaggggcgccttcgcaaccacacattgggttgtgacagaggacgggaaaatacagcagcaggtggactctccaatgaacctcaagcatcctcacgacttagttatactcatgagacaggaagccactgtgaattacctcaaagagctcgagaagcagctggtggcacaaaagatccatatcgaagagaatgaagatcgcgatacggggctggaacagaggcacaacaaagaggacccagactgcattaaagccaaagtgccattaggcgacctcgatttgtacgacggtacttacatcacattagaatccaaggacatcagccccgaggactatatcgacaccgagtccccggtcccaccagatcctgaacagcccgattgcaccaagattttggaattgccttacagtatacatgctttccaacatttgcgcggtgtccaggagagagtgaacctgtcagctcccttgcttccgaaggaagaccccatttttacctatctgtcaaagcgcctgggacgctcaattgatgacatcgggcacctaatccatgagggcctgcagaaaaatacaagcagttgggtgttatacaatatggcttcattctactggcgcatcaagaacgagccataccaggtcgttgagtgcgctatgagggcgctgcacttttcaagccgacacaacaaggacattgcgctcgttaacttggcgaatgtcctgcatcgcgctcacttctccgccgacgctgcggttgtagtgcacgccgccctggatgatagcgatttctttacttcctactataccctcgggaatatctacgccatgctgggggagtataaccacagtgtcttgtgctacgatcacgccttacaggcccgccccgggttcgagcaggccataaagaggaaacatgcagtactctgtcagcaaaagctagaacagaagttggaggcgcagcataggtctctgcagaggaccctcaacgagctaaaagagtatcagaagcagcacgatcattatctgcggcaacaagagattctggagaagcataagctgatccaagaggaacagatactcagaaatatcatccacgaaactcagatggcaaaagaagcccagttgggtaatcaccaaatttgccggttggtcaatcagcagcacagtttacactgccaatgggaccagccagttcgctatcaccggggtgacatcttcgagaacgtggactatgtgcagttcggagaggatagctcaaccagcagcatgatgagtgtcaactttgacgtacagagcaatcaaagcgacatcaatgatagcgtcaaaagcagtcccgtggctcattccattctatggatttgggggcgtgacagcgatgcttaccgcgacaaacaacatatactgtggcccaagcgggctgactgcaccgaatcatatcctagagtgcccgtgggcggtgaactccctacctatttcctccctcccgaaaacaaaggactcagaattcacgagctgagctcagatgattactccacagaggaagaagcccaaacacctgattgtagtattacagattttcgcaaatcccacaccctctcttatctagtgaaagagctcgaggtccgcatggacctgaaggcaaaaatgccagatgaccacgcaagaaaaattctgttatcacgcattaataactataccattcctgaggaggagatcggcagttttctatttcacgcaatcaacaaacccaacgcacctatttggcttatactcaatgaggccggtttgtattggcgggcagttggtaactccacctttgcaattgcttgcctccaaagggccctgaacttggcccctcttcagtatcaggacgtgcccttggtgaacctggcgaatttactcatccactatggtttacacctggacgccactaagttactgctgcaggcgctggccatcaattcttccgagccccttacctttctctctctggggaacgcctacctggctctgaaaaatattagcggagcactggaggcattccgccaagctctcaaactgactactaagtgtcctgagtgcgagaactcactgaagctaattcgctgcatgcaattctacccatttctgtataatataaccagctctgtttgctctggcaccgtcgtcgaggagtcaaacgggagtgacgagatggaaaattctgatgagacgaaaatgtccgaggagatactcgctctggtagacgagtttcaacaagcttggcccttagaaggctttggcggtgctctagagatgaaaggccgacggcttgaccttcaaggcatacgagtgctaaagaaaggcccgcaggacggggtcgctcggagttcctgctatggggattgccgatccgaagacgacgaagctactgaatggattacattccaggtgaagcgggttaagaaacctaagggagaccataagaaaacgcccggcaagaaagtcgaaactggccagatcgaaaacggccaccgctaccaggccaacctggaaattacaggccccaaagtcgccagccctggaccccaggggaaaaaacgtgactaccaaaggctgggctggccaagtccggatgaatgcctaaagttgcggtgggtggagctcaccgcgatcgtaagcacctggttagccgtcagctctaagaacatcgatattacagaacacatagacttcgccactccaatccagcagccagccatggagccactatgcaatgggaacctgccaaccagtatgcacacactggaccacttgcatggcgtatccaatagggctagccttcactacaccggagaatcccagctgacagaggtgctgcagaatttgggtaaggaccagtaccctcaacagtctctggagcagatcgggactcggatcgccaaggtgttggaaaagaaccagacctcctgggtgctttcttctatggccgcactctactggagggtgaagggtcagggaaagaaggctattgactgtctgagacaggccctgcactacgctccgcatcaaatgaaagacgtgcccctcatctcactcgcaaacatactgcataatgctaagctgtggaacgatgcagtgattgtcgctaccatggctgtggagattgcccctcactttgccgtgaaccatttcactctcggcaacgtctatgtggccatggaggaatttgagaaggccctcgtttggtacgagagcaccctgaagctgcagccagagtttgtccccgctaagaacagaatccagactattcagtgtcatctgatgctgaaaaagggtcgccggtccccttag

SEQ ID NO: 33892 - DNA, 2871 bp, Artificial Sequence
  Description of Artificial Sequence: Synthetic coding sequence
atggctgccgctgtcggcgtgcggggacggtatgaacttcctccatgttctggccctggttggctactctctctgagtgccctattgtccgttgcggcaagaggagcattcgctacaacacactgggtcgtgacagaagatggaaaaattcaacagcaagttgacagccccatgaacttaaagcaccctcacgatctggtgatactgatgagacaagaagccacagtaaattacctaaaagagctggagaagcaactggtagcgcaaaaaatccatattgaggagaacgaggatcgggatactggcctcgagcaaaggcataataaggaagaccccgactgtatcaaggcaaaagtgccactaggcgatctggatctgtacgatggtacgtatattactcttgaatctaaggatatctccccagaggactacatagatacagagagtccggttcctcctgacccggaacaaccagattgtacaaaaatcttggagttgccttattctatccacgcgtttcagcatcttcgaggagtgcaggaaagggttaatctgtctgccccactgctgcctaaggaagatcctatcttcacatacttgtctaaaagattaggccgatccatcgatgatattgggcaccttatccatgaggggcttcagaagaacacatctagttgggttctatataatatggcgagcttttattggaggataaagaacgagccttatcaagtcgtagaatgcgcaatgagagccctacactttagctctcggcataacaaagacatcgctttggtgaacctcgctaacgtgctgcaccgggctcatttctctgccgatgctgcagtagtggtgcatgcagccctcgacgacagtgatttcttcacatcttactatacacttgggaatatttatgctatgttaggggaatacaatcatagtgtgttgtgttacgaccacgctctccaggcccgacctggcttcgagcaggcgataaaacgcaaacacgccgtcctgtgtcaacaaaaattagagcagaagctagaagcccagcacagaagccttcagcgaacacttaatgagctcaaagaatatcaaaaacaacatgaccactatttgagacagcaagagatcctggaaaagcacaagctcattcaggaagagcagattctacgcaatattatacacgaaacccaaatggccaaagaagctcaactggggaaccatcaaatctgtcggctcgtgaaccagcagcactctctccattgtcagtgggaccagcccgtccgatatcatagaggcgatatctttgaaaacgtcgactatgtccagttcggggaggattctagtaccagcagtatgatgtcggtgaattttgacgtccagtctaatcagtctgacatcaatgacagtgtgaagtcctcccctgttgcacactcgatcctgtggatctggggccgagattccgacgcttatcgagacaaacaacatattttgtggcctaagcgggctgattgcactgaaagctacccacgggttccagtgggcggagagttgccgacatactttttaccccccgaaaataagggcttgcggatccatgagctgtcttcagatgactactccactgaagaggaagctcagacaccagattgcagcatcacagatttccgcaagagccacacactgagttacctggtgaaagaacttgaggtgcggatggatcttaaggctaaaatgcctgatgaccacgcacggaaaattctactatctaggatcaataattacacaataccggaggaagagattggttccttcctgtttcacgctatcaacaagcctaacgccccgatctggctgatcttgaatgaggcagggttgtactggagggctgtgggcaatagcactttcgcaatcgcctgtttacaacgcgctctgaatctagctccactgcagtaccaagatgtcccgttggtgaacctcgctaacctgttgatacactacggccttcacctcgatgcaacaaaacttctccttcaagctctggccattaattcaagtgagcccctgacatttttgtccctcggaaacgcctatttggccctaaaaaacatctctggagcccttgaagcattcagacaggccctcaaactgaccaccaagtgtccagagtgtgaaaatagtctgaagctcatcaggtgcatgcagttctacccatttctttacaacattacaagcagcgtgtgctctggaaactgtcatgagaaaaccctggacaatagccatgacaaacagaaatattttgacaactcacagtctctggatgcagcagaagaagaaccttcagagcgaggaacagaggaggatcccgtgttctcagtagagaacagcggaagggattcagacgccctccgcctagaatccacggttgtagaggagtccaatgggagcgatgagatggagaactcagatgagactaagatgtcagaggaaattctggcactcgtggacgaatttcagcaggcatggcccctagaagggtttggcggggctctggagatgaaaggcagacgactggatcttcaaggcatcagggtgctgaagaaaggccctcaggacggagttgcccgctcgtcatgctatggggactgtcgctcggaggacgatgaggctaccgaatggataacatttcaggtgaagagagttaagaagcccaaaggggatcacaagaaaaccccagggaaaaaggtggagacaggacagatcgagaatggccatcgctaccaagcgaatctcgaaatcactggccccaaggtggcctctcctggacctcaaggcctgcttgattggaagactaggaaagtgccctag

SEQ ID NO: 33893 - DNA, 3366 bp, Artificial Sequence
  Description of Artificial Sequence: Synthetic coding sequence
atggagcaggtgccttcagccgggcgtctcgtgcagattaccgtcaccgagggctatgacctgaaaggctttaagggagacacacctgtcacctttatccgcgctgagtttaaccaggttgttctgggagactctgccaaaatcactgttagtcccgaaggctccgccaagtataacttcacatctagcttcgaattcaaccctgaggggggcattacctctgatgatctggcccataaacccgtgtttttgactgtgacagaggtgttaccgaaggagaagaaacagaaggaagaaaagaccctgatactaggccaggccgtggtagatctgctgccacttcttgagggccagtctagttttcaaactaccgttccattacatcccgtgcagggcagcccgctcgaaacccctcgatcctccgccaagcagtgctcgctggaagtgaaagtccttgtagccgagcctctcctgactaccgcccaaataagcggcggaaatttactgaaggtgaccttggaagcagcctacagcgtgcctgagtcctttattccgaccggtcccggacaaaactacatggtgggcctgcaggtgccgagcctaggcgagaaggactaccctattctatttaagaacggaaccctcaaacttggaggagaacgggagcccgtcccacggccaaagaagtggcctattgcaaatatactggcccccggcgcgaacaacatcccggatgcctttatcgtaggaggaccctacgaagaagaggagggggagttgaatcacccggaggactcagagttccgaaaccaagccgagtgcataaagaaaagaattatctgggatctggagagtaggtgttacctggatccaagtgccgtggtcagcttccagaagaggattgcagactgccgcttatggcccgttgagatcacccgagttccattagttacaattccaaaaggaaaagctggcaaaactgagaagacagacgaggaggctcagctgtcttttcacggtgtggcctacgtgaatatggtgcccttactataccctggcgttaaacgtatacggggagcattccatgtgtacccttatctggacagcgtcgtccatgagaagacaaaatgtctgttatctctatttagagacatcggccatcatttaatccacaacaacaagattggagggatcaattctctgctaagcaagcaggctgtctcaaaaaacctgaaggaagacaagcctgttaaggagaaagacatcgacgggaggccacgcccgggggacgtgcaggctccgagtatcaagtcacaatccagcgacaccccactcgagggagaacctcccctctcacataacccggaggggcagcagtacgtggaagcgggaacctacatagtgctggaaatccagctggataaagcccttgtgccaaagcgaatgccggaggagctcgcgcggcgggtcaaggagatgattcctcccaggccccccttaacacgacgcacagggggggctcagaaagctatgtccgactaccacattcaaattaaaaatatcagccgcgctatcctggatgagtactaccgaatgttcggaaagcaggtcgcgaagctggagtctgacatggattccgagaccctcgaggagcagaagtgtcaacttagctacgaactcaattgctccggaaaatatttcgccttcaaagagcagttaaaacatgcggtcgtaaagattgtgagagataagtacctgaaaactaccagctttgagagtcaggaagaactccagacatttatcagcgaactgtacgtcttcctggtggatcagatgcatgtggctctcaatcaaacaatgcccgatgacgttcagggcacagtcgccacaatttatacttctagcgaacaactgcaactatttgcgttcgaagccgaagttaatgagaattttgaaatggcggcggcttactacaaggagcgtctggtccgagagccccaaaacttggaccactggctagactatggagctttttgtctgctgactgaagacaacattaaggcacaggaatgctttcagaaggctttgtccctgaatcagtcgcacatccactccctgctgctgtgcggggtgcttgcggtactgttagaaaactatgaacaagccgagatcttcttcgaagatgcaacctgcttagagcccaccaatgtcgtggcctggactttactaggcctgtactatgaaatccagaacaatgacatccgtatggagatggcatttcacgaggcaagcaagcagttgcaagcccggatgctacaggcacaggtaacgaagcagaaatctaccggcgtggaagatacggaagagagaggtaagcgagagagctccttgggcccctggggcattacaaacggttcagctaccgccatcaaagtcgaggcccccgctggcccaggtgcagctttaagtattttggataaattcttggaggagtcatccaagctacaaagtgactctcaggaaccgatcctgacaacacaaacatgggatccaagtatatcacagaaaccctctaatacatttataaaggagatccccaccaaaaaagaggcgtccaagtgtcaagattcctcagccctgctgcatcccggactccattatggtgtgagtcaaacaacaactatcttcatggaaacgatccatttcttgatgaaagtgaaagccgtgcaatatgttcatagggtgcttgcacacgagcttctgtgtccacaaggcggaccgtcctgcgagtattacctggtcctggcacagacacacattctgaagaagaactttgcgaaggcggaagagtacttgcagcaggccgcgcagatggactatctcaaccccaatgtctggggcctgaagggtcacctttacttcctgtccgggaaccatagtgaagcgaaggcctgttacgagaggaccatttcattcgtggtcgatgccagcgaaatgcactttatcttccttagactcgggcttatctaccttgaggagaaagagtatgagaaggccaaaaagacctacatgcaagcatgtaagcgaagccccagctgtctgacatggctgggcctgggcatcgcatgctaccggctggaggagctgaccgaggcagaagacgctctctcggaagcaaatgcactcaataactataacgccgaagtttgggcctaccttgcactggtctgcctcaaggtggggaggcaacttgaggctgagcaagcatacaagtacatgatcaagctcaagctcaaagacgaggctctattggcggaaattcatactctgcaggagaccgtggggttcggaaacccaagcttctag

SEQ ID NO: 33894 - DNA, 1086 bp, Artificial Sequence
  Description of Artificial Sequence: Synthetic coding sequence
atggaacaggtgccttccgcaggtcgcctggtacaaatcaccgtcaccgagggctacgatctgaagggttttaagggggacaccccagtgacattcattcgagcggagttcaaccaggtcgtgcttggcgattcagccaaaataaccgtgtctcccgaaggttctgccaagtacaattttacttcctcctttgagttcaaccctgaaggcggaattacctctgacgatttagctcacaaacctgtttttctcacggtgacagaggttcttccaaaagagaaaaagcagaaggaggaaaagactttaatcttaggacaggcggtggttgaccttctgccgttgctggaaggacagagctcctttcagaccactgtgcctctgcacccggtgcagggttcccccctggagacacctagatcttctgctaagcaatgttccctcgaagtgaaggtgctcgtggccgagcccttgttaaccactgcccagatttctggaggaaacctgcttaaggtaaccctcgaggcagcatatagcgttcccgagtcattcatccctacaggccctggacagaattacatggttgggctgcaagtgccgtcccttggcgagaaagattatccaatcctgttcaagaacgggacccttaacgggaatcacagcgaagcaaaggcctgctatgaaagaactataagcttcgtggtggatgcttccgaaatgcacttcatcttcttgagattgggactgatatatttggaagagaaggaatatgagaaggcaaagaagacatacatgcaggcgtgcaaaaggtcccccagctgtctgacctggctgggtttaggtattgcttgttatagactggaagagctgactgaggccgaagacgccctctctgaggcaaacgccctaaacaattacaatgccgaagtgtgggcgtacttggccctggtgtgcctgaaagtcggtcgccagctcgaggctgaacaagcatataaatacatgattaagctaaagttgaaagatgaagcgctgttggccgagattcataccctgcaggaaacggttggatttggaaatccttctttctag

SEQ ID NO: 33895 - DNA, 3366 bp, Artificial Sequence
  Description of Artificial Sequence: Synthetic coding sequence
atggaacaagtaccctccgccgggcgactagttcagattaccgtcactgaaggctatgacctgaagggatttaaaggagataccccagttacatttattcgggccgagtttaatcaggtcgtgctgggcgacagcgcaaaaattactgtgtcccctgagggatccgccaaatacaacttcacctctagctttgaattcaatcccgagggggggattacttcggatgacctggcacataagccagtgttcctgactgtgacagaggtattgccgaaagagaagaaacagaaagaagagaagactctcatactgggacaggccgtcgtggacctgctaccccttcttgaggggcagagctcctttcaaaccaccgttccattacatcccgtccagggttccccgctggaaaccccgagatccagcgccaaacagtgctctctagaagttaaggtgctggttgccgagccattactgactacagctcaaatttcaggcggcaacctgctaaaagtgacattggaagccgcctactcagtgcctgaatcatttattcccaccggtcccggacagaattacatggtcggcctgcaggttcctagcttgggggaaaaggattatcctatcctcttcaagaacggtacactgaaactaggaggcgaaagggaacccgtgccacgtcctaagaaatggcctattgcgaacattctggcaccaggggccaacaacattcctgatgcctttatcgtgggaggaccttatgaggaagaggaaggagaactcaaccaccccgaggatagtgagtttagaaaccaggccgagtgcatcaagaagcgtatcatttgggatctcgagagtcgttgctatttggaccccagtgccgtggtgagcttccagaagaggatcgccgactgcaggctttggcccgtcgaaattactcgagtgcctctggtaactattcctaagggcaaggcaggcaaaaccgaaaagacagacgaagaagctcagctgtccttccacggggttgcctatgtgaatatggtgccactgttgtaccctggcgtaaaacgaattcgaggggcgtttcatgtgtatccatatctcgactccgtggtgcatgagaagaccaagtgcttgctgtcccttttccgggacatcggacaccacctcatccacaacaataagatcggcggcataaattctctgctctctaagcaagctgtgtctaaaaacctgaaggaagataagccagtgaaggagaaggatatcgacggtagaccgcgcccaggtgatgtgcaagccccatcgataaagtctcagtcctccgacacacccctggagggcgaaccccccctgagccataaccccgagggccagcagtacgttgaggctggtacctatattgtactggagatccagcttgacaaggccctggtaccaaagcgaatgcctgaggaattggctagaagagtgaaggagatgataccacctcgcccacctttgacgcgtcgtacaggtggtgcccagaaagccatgtctgattatcatatccagattaagaacatcagccgagccattctagacgaatattaccgcatgtttggaaaacaggttgcgaagctggagtccgacatggactccgaaacgcttgaggaacagaagtgtcaactgtcctatgaactgaattgcagcggtaagtatttcgcattcaaggagcagcttaaacatgccgtggtgaaaattgtcagggataaatacctaaagacgacctctttcgagtcacaggaagaactacaaactttcatctcagaactgtacgtgttcttggtggatcagatgcacgtagcactcaaccaaactatgcccgacgacgtccaagggacagtggcaacaatctacacctcttcagaacagttgcagctgttcgctttcgaggccgaggtgaacgagaatttcgagatggcagcagcttattacaaagagagattggtgcgggagcctcagaacctggaccattggctcgattatggggccttctgtctcctgaccgaggacaatattaaggcccaggagtgcttccagaaggccctctcgctaaaccagagccacatccattcgttgctgctgtgtggagtgctggccgtgcttctggaaaattacgaacaagctgagatttttttcgaagatgctacctgtttggagcccaccaatgtggtcgcctggacacttctgggattatactacgagatccagaacaatgatattaggatggagatggcattccacgaagcttccaaacagcttcaggctcgaatgctgcaggcccaggtgacaaaacaaaagtcaactggtgtagaggacacggaggagaggggcaagcgagagtcaagcctcggaccttgggggatcaccaacggaagtgcaaccgccattaaggtggaggctcccgctggcccaggggcggccttgtcaatcctggataagtttctcgaggagtctagcaagctgcagagcgatagccaagaacctatactgacaacgcagacctgggatccctcgatttcgcagaagccatccaatacatttatcaaggagatcccgactaagaaagaagcctcgaaatgccaggactcatctgcattgctacatccgggtctgcactatggagtctctcagacgaccactatttttatggaaaccatccactttctgatgaaggtcaaggcagtgcagtacgtacacagagtgctggcccacgagcttctctgcccacaaggggggcccagttgcgagtattacctggtcttagcccagactcatatcctcaagaagaactttgcaaaagccgaggagtatctgcagcaggcggcacagatggattatctgaaccccaacgtgtggggtctgaaaggacacctttactttctgagcgggaaccactcagaagcgaaagcctgctacgagcgcaccatcagtttcgtcgtagatgcgagtgagatgcactttatcttcctgaggttgggtctgatctacctggaagaaaaagaatatgagaaggctaagaaaacatatatgcaagcctgtaaacgtagtccttcttgtctgacttggttaggcttgggcatcgcctgttatcgtttggaggagcttactgaagcagaagacgccctttcggaggcaaatgccctgaacaactataacgctgaggtgtgggcttacctagctttggtttgcctgaaggttggtaggcagctggaagctgagcaagcttacaaatacatgattaagctgaagctgaaggatgaagcactcctagctgagatccatactctgcaagagactgtaggctttggcaatccaagcttctag

SEQ ID NO: 33896 - DNA, 1758 bp, Artificial Sequence
  Description of Artificial Sequence: Synthetic coding sequence
atggagcaggttcctagtgcaggacgcctggtccagatcacagtaaccgagggctatgacctcaagggattcaagggtgacaccccagtcacttttattagggcggagtttaatcaggtggtcttgggcgattcagccaaaattaccgtgagtcccgaagggagcgctaagtataacttcacctcctcctttgagtttaatcccgagggtggcatcactagcgacgacctcgcccataagcctgttttcctcacggttactgaagtgctgccaaaagagaaaaaacagaaggaggagaaaacactgattctgggacaagctgttgtggacctgctgcccctgctcgagggtcagagctctttccagacaacggtgccactgcaccccgtgcaaggctccccactggaaactccgaggtcttcagctaagcaatgcagcctcgaggtcaaagtcctggtggctgaacccctgttaactactgcacaaatttctggcgggaacctgttaaaggtaacactggaggcggcatactccgtcccggagagcttcatccctacggggcccgggcaaaactacatggttgggctccaggttcccagcctgggggagaaagactaccctattctgtttaagaacggtacactgaagctagggggggagagagagccagtgccccgtcccaagaagtggccaatagccaatatactcgccccgggcgccaacaacattcctgacgcctttatcgtcggagggccttatgaagaggaagagggtgagctgaatcatcccgaggacagcgaattcagaaaccaagcagagtgcatcaagaagagaataatttgggacctagaaagtcgttgttacttagacccaagcgcagtggtgagcttccagaaaaggatagccgactgtagactgtggcctgtggagataacaagagttcctttggtaacaattcccaaagggaaagctggtaagaccgaaaaaacagacgaggaggctcagctaagttttcacggagtggcttatgttaacatggtaccccttttgtatccaggcgtgaaacggattcgaggagctttccatgtgtatccctatctggactctgttgtccacgaaaaaacaaaatgtcttctttctctttttagggatataggacatcacctgattcataacaataaaatagggggcattaactctctgctctccaagcaggcagtcagcaaaaatctgaaagaggacaagccagtcaaggagaaagacattgatggccgccctaggccaggagatgtgcaggccccttccataaaaagccaatcctctgatacccctctggagggtgagcctccacttagccacaatccagaggggcagcagtacgtcgaggccggtacttacatagtgctcgagatccagctggataaggctctcgtgcctaaacggatgccagaggagttggccaggcgtgtgaaagagatgatacctcctcgacccccacttactaggaggacggggggtgcacagaaagccatgagcgactatcacatccaaatcaagaacatcagtcgcgctatattagatgagtattatagaatgttcggtaagcaggtggccaagttagaatctgatatggactctgagaccctggaggagcaggcctataaatatatgattaaattaaaactcaaggacgaagctctgctggccgaaatccatacactgcaggagaccgtggggttcggaaatccatcattttag

SEQ ID NO: 33897 - DNA, 360 bp, Artificial Sequence
  Description of Artificial Sequence: Synthetic coding sequence
atggaacaggttcctagtgccgggcggttagttcagataactgtgacagagggctacgaccttaaaggattcaaaggtgacacgccggtcacctttattagagccgagtttaaccaggtcgtgctcggggattctgctaagattactgtctcccctgagggtagcgctaagtataatttcacgagctcctttgaattcaaccccgagggagggatcacaagtgatgatcttgcacacaagcctgtcttcctcaccgtcactgaagtgctacccaaggagaagaaacagaaggaggagaagacattaatccttggacaggctgtggtcgaccttctgccgcttctcgaaggtcagtcctag

SEQ ID NO: 33898 - DNA, 3276 bp, Artificial Sequence
  Description of Artificial Sequence: Synthetic coding sequence
atggagcaggtgccaagtgctggaagacttgtacagataacagtcacagagggttacgacctgaagggctttaagggagatacccccgtcacttttatccgcgcggagttcaaccaggtagtcctgggcgactctgccaagattactgtgtctcccgaggggtctgcgaagtacaacttcactagctcatttgaattcaatcccgagggcggcatcactagtgacgatctcgcgcataaaccagttttcctgacggtgactgaggtgttgcctaaagagaagaagcagaaggaggagaagactctgattcttggacaggctgttgtggatctcctgcccctgctggaagggcaatccagctttcagacaactgtgcccctgcatccggtccaagggtctcccctggagaccccccgtagtagcgcaaaacagtgctctcttgaagtgaaagtactcgtggctgaaccgctgttaactacagcccagattagcggcgggaacctactgaaagtcaccctcgaggccgcatattcggtacccgaatcattcattccaacagggcctggccagaactatatggtcggcttacaagtcccatctttgggggagaaggactaccccatactgttcaaaaatggcactctcaagttggggggcgaacgcgagcccgtaccccgccctaaaaagtggcccatcgcaaacatcttggcgcccggcgcaaataacatccccgacgcttttatcgtcgggggcccctacgaggaagaggagggggagctgaaccaccctgaagattctgaatttcgcaaccaagctgagtgcataaagaaaaggatcatctgggatctagagtctaggtgctatctcgacccgagcgccgtcgtgtccttccagaaaaggatagcagactgtaggttatggccagtcgaaatcacgcgcgtgcccctagtgactattccaaaggggaaggcaggtaagaccgagaaaaccgatgaagaggcccagcttagctttcacggagtagcctatgtcaatatggtgcccctcctgtatcctggagtcaaaagaatacgcggcgcctttcatgtgtacccttaccttgatagtgttgtgcacgagaagactaaatgtctgctaagtctgtttagggacattggacaccatctgattcacaacaacaagattggcgggatcaacagtctgctctccaagcaggccgtatcaaaaaacctgaaggaagataagcccgttaaagaaaaagatatcgatggccggcccagacctggtgatgtgcaggcccctagtattaagagccagagctccgatacaccgctagaaggcgagccacccttatcccacaacccggaaggacagcagtatgttgaagcgggtacgtacatcgttctggaaatacagctggataaggctctagtcccaaaacgcatgcccgaggaattggcacgtagagtcaaagagatgatcccgccacgcccacctcttacccggagaacaggcggagcccagaaggctgtgtccgactatcatatccagattaagaatattagccgagccatcctcgatgaatactatcggatgtttggaaagcaggtagcaaaactggaatctgacatggacagcgagaccctggaggaacagaagtgccaactgagctatgagctcaactgctcaggcaaatatttcgccttcaaggagcagctgaaacatgccgtggtaaagatcgtcagagacaagtacctgaaaactacgtctttcgagagtcaggaagagcttcagaccttcatcagcgagttgtacgtcttccttgtggaccagatgcatgtcgcactgaatcagactatgccagatgatgtgcagggaacagttgcgaccatctacacaagctctgagcagctgcagttgtttgctttcgaagcagaggtcaatgagaacttcgaaatggcagccgcatactacaaagagaggctggtgcgggaaccacaaaacctagaccactggctggactacggggccttttgcctcttaacagaggataacattaaagcccaggagtgcttccagaaagcgctctcccttaatcaaagtcacattcacagtctcctgctctgcggcgttctcgctgtgctcctggagaactatgaacaggccgaaatattctttgaagatgccacatgccttgagcccacgaatgtagttgcatggacactccttggactctactacgagatacaaaacaacgacataagaatggagatggcttttcacgaggcgagtaagcaactccaggctcgaatgcttcaggcccaggtaaccaagcaaaaaagtacaggagtcgaagatactgaggagcgaggtaaacgggagtcctcattggggccctggggcattacaaatggttccgctaccgcgatcaaagtggaggcccccgctggaccaggcgcagccctgagtattctggacaagttcctggaagaatcgagcaaactccagtccgacagtcaggaacctattctcaccacacaaacgtgggacccatccatctcacaaaagcccagcaacacttttattaaggaaatacctacaaagaaggaagcatctaaatgccaggatagttctgccctgcttcatccgggtttacactacggcgtcagccagacaacaaccattttcatggagacgatccacttcttaatgaaggtgaaagcagtccaatatgtgcatagggtcttggcgcacgagctgctgtgcccacaaggtgggccttcatgcgagtactatctggtgctcgcccagacgcacattctaaaaaagaatttcgctaaggccgaggagtatctgcagcaagccgcccagatggactatctgaaccccaacgtgtggggcttgaaggggcacctttacttcttatcaggaaaccactcggaggccaaggcctgttatgagcgcactataagcttcgtagtggatgcgagcgagatgcactttattttcctgcgcctgggactcatatacttggaggagaaagaactggaagagcttacagaggcagaggacgcgctcagcgaagcaaatgctctcaacaactataatgctgaggtgtgggcgtatcttgcacttgtctgtctcaaggtcggccggcaactagaagctgagcaggcctacaagtatatgataaaactgaaactcaaagacgaagcactgctcgccgaaatacataccctacaggagactgtgggttttggaaacccctcgttctag

SEQ ID NO: 33899 - DNA, 3366 bp, Artificial Sequence
  Description of Artificial Sequence: Synthetic coding sequence
atggaacaggtaccctcagcaggccgactggtgcagattacagtcactgagggctacgacctgaaaggattcaaaggcgatacccccgtcacgtttatcagagcagagttcaatcaggtggtgctgggcgattccgcaaagattaccgtcagtccagagggtagcgccaagtacaacttcaccagctcatttgagttcaatccggaaggtggtattacatctgacgatctcgcacataagcccgtcttcctgaccgtgaccgaagtgctgccaaaagagaagaaacagaaagaggagaaaactctgatccttggtcaagcggtcgttgatctgctgcctttgttggagggccaatcttcgtttcagacaaccgtccctctgcacccagtgcaaggaagccctctcgagacacctagatcaagcgctaaacagtgttctctggaagtcaaagtattggtggctgaacctctgctgacaaccgctcaaattagtgggggtaacctgctgaaggtaacactggaagcggcctactccgtcccagagtctttcatcccaacagggccaggacagaattacatggtgggactgcaggtgccctctttaggtgaaaaagactacccaatcctgtttaaaaacggaaccctgaaattgggaggcgaacgcgaacctgtccctaggccgaaaaagtggcccattgctaatatcctggccccaggcgcgaataacattccagatgccttcattgtggggggtccctacgaggaagaagagggcgagctgaatcatcctgaggactccgaatttcgcaatcaagctgaatgtatcaaaaagcgcattatttgggacctggaatcacgctgctacctggacccctccgccgtggttagctttcagaaacggattgctgactgccgcctatggcctgtcgaaatcactcgtgtgcctttggtgacaatcccaaagggcaaggccggcaagaccgagaagaccgacgaggaggctcagttatcctttcacggcgtggcttacgtaaacatggtaccacttctttaccccggcgtgaagagaattaggggcgctttccatgtgtacccatacctggacagcgtggtgcatgaaaagactaagtgtctacttagtctgtttcgggatataggtcatcacctcatccacaacaacaaaatcggcggaatcaatagtctcctatccaaacaggctgttagcaagaatctcaaagaagacaagcccgttaaggagaaagacattgacgggcgcccccgccccggagatgtacaggcaccctcgattaaaagccagtcatctgacaccccactggaaggtgaaccgcccctttcgcataatcctgagggtcaacagtacgtggaggcagggacctatatcgtcctagagattcagttagataaagcacttgtacctaaaaggatgcctgaggagcttgccagacgagtcaaggagatgatacctccccggcctccacttacgaggagaactggcggcgcacagaaggctgtaagcgattatcacatccagattaagaatatttctagagctatactcgatgaatactacaggatgttcggaaagcaggtggctaagcttgagtctgatatggacagcgagacactggaggaacaaaagtgtcagctgtcctacgagctcaattgttcaggaaagtattttgccttcaaggaacagctcaagcacgccgttgtgaagatcgtccgtgataaatacctcaaaactacatcattcgagtcgcaagaggagctgcagacatttattagtgaactctatgtgtttcttgttgaccagatgcacgtggcactgaaccagactatgcctgatgacgtgcagggtaccgtggctacaatttatacatcctccgaacaattgcagctgtttgccttcgaggccgaggtcaatgagaactttgaaatggccgcagcgtattacaaggaacgtttggtccgggaaccccagaacctggaccactggctggactacggagccttttgcctgctgactgaagataacattaaagcccaggaatgctttcagaaggcattgtccttaaaccagtcacatatccattccctgctgctgtgcggcgtactcgctgtactgctcgagaattatgaacaggccgaaatcttctttgaagacgctacctgtctggagccgaccaacgtggtagcttggacattgttaggtctttactacgagattcaaaacaacgacatccgtatggagatggcctttcatgaagcatctaagcaactgcaagccaggatgttacaggcgcaggttacaaagcagaaaagcacaggtgtggaggacactgaagaaagaggtaaaagggagagtagcctgggcccctggggcataactaatggatccgcaactgctattaaagtggaggcccctgccggcccaggagctgctctgagcatcctggataaattcctggaggaatcgagcaaactccagtcggattcccaggagccgatcctaaccactcagacttgggatccatccatatcccagaagccttcaaacacttttattaaggagattcctacgaaaaaggaagcgtcgaaatgtcaagattcaagcgcactcctacaccctggcctgcattacggtgtgagccaaaccaccaccatttttatggaaacgatccactttctgatgaaggtaaaggctgtgcagtatgtgcacagagtgctggcacacgagctgctgtgcccccaaggtgggccaagctgtgaatattacctcgtgcttgctcagacacacattttaaaaaagaatttcgcaaaggcagaagaataccttcagcaggctgcacagatggactatctgaacccgaatgtatgggggctaaaggggcacctttatttcctgagcggcaatcacagcgaggcgaaggcctgctacgagcgcactatatccttcgtggtggatgcgtccgaaatgcatttcatctttctgagactcggcttgatctatctggaggaaaaggagtacgagaaggccaagaaaacatatatgcaggcttgcaaaagatcccccagttgtttaacatggctaggcctgggtatcgcttgctatagacttgaggagttgaccgaagcggaggatgctctgtccgaggcgaatgcactgaacaactacaatgctgaggtgtgggcctacctggcgttagtgtgcctaaaagtgggccggcagcttgaagccgagcaggcttacaagtacatgatcaaactgaaactgaaagacgaggctctccttgcggagattcatacgttacaggaaaccgtgggatttggcaacccctccttctag

SEQ ID NO: 33900 - DNA, 1497 bp, Artificial Sequence
  Description of Artificial Sequence: Synthetic coding sequence
caggaagagcttcagactttcatctccgagctgtatgtttttctcgttgaccagatgcatgtagcacttaaccagaccatgcctgatgacgtgcagggcaccgttgcaactatctataccagctcagaacagctccagctgtttgcatttgaagcagaggtgaatgagaacttcgagatggccgcggcctactacaaggagcgactcgtgagagaaccgcaaaatctggatcactggttggactatggggcattttgtctgctgacagaggacaacatcaaggctcaggaatgtttccagaaggctctatcactgaatcagtcccatatccactctctcctcctatgcggcgtgctggccgtccttctggagaactacgagcaggctgagatcttttttgaggacgccacctgtcttgagcccacaaatgtggtggcgtggaccttgctgggcttgtactatgagatacagaacaatgatattcgtatggagatggccttccacgaagccagcaaacagttacaagcccgcatgttgcaggcacaggtgactaaacaaaagtccacgggtgtggaggacacggaggaacgtggtaagagagagagttcactgggaccttggggtatcaccaatgggtctgccacagccatcaaggttgaagcccccgcaggacctggggccgccttgtcaattctggacaagttcctggaggaaagttccaaacttcagagcgattctcaagaaccgatccttactacccagacctgggatccttccatctctcaaaaaccctcgaatacgttcatcaaagagattcccaccaaaaaagaggccagcaaatgccaggactcgagtgctctcttgcatcccggccttcattatggcgtttcccagacaacaacgattttcatggaaaccattcattttctcatgaaggttaaggccgtccagtatgtgcacagggtgttagcacacgagctgctctgccctcagggaggtccaagttgtgagtattatcttgttctcgcgcagacccatatcctgaagaagaacttcgcaaaagctgaagagtacctgcagcaggccgcccagatggattatctgaaccccaacgtgtgggggctcaaggggcacctgtattttctatctggcaaccacagcgaggccaaggcctgctacgaaaggaccatctctttcgtggtggatgcttccgaaatgcacttcatcttcttacgacttgggcttatttacctcgaagagaaggagttggaagagctcaccgaagccgaggacgcactcagcgaggcgaatgctctgaacaattataacgccgaagtgtgggcctacttggcgctcgtgtgtctgaaagtggggcgacagttggaggccgagcaggcttataaatatatgattaaactgaaactgaaagatgaggcactgctggcagagatccatactcttcaggagactgtgggtttcggaaatccatcattttag

SEQ ID NO: 33901 - DNA, 3966 bp, Artificial Sequence
  Description of Artificial Sequence: Synthetic coding sequence
atgagtagcaatgacagcagtttaatggcgggcatcatttactattcccaagagaagtatttccaccacgttcaacaagcagcggctgtaggcctcgagaaatttagtaatgatcctgtgctgaaatttttcaaggcttatggtgtgttgaaggaagaacatatacaggacgccatttctgacctcgaatcaatccggcatcaccccgacgtctccctttgtagcactatggccctgatttatgcacacaagcgttgtgagatcattgacagggaggctattcaggaacttgagtattccttgaaagagattaggaagaccgtgtccggaaccgcgctatattacgccggcctgttcttgtggctgatcggcagacatgacaaggctaaagagtatatagaccggatgctgaagatttcccggggatttcgcgaagcatatgttctccgggggtgggtggatctcacctcagataagccccacacggccaaaaaagcaatcgagtacctagaacagggaatacaagatacaaaggatgtgttgggattaatgggcaaggctatgtattttatgatgcaacagaactactccgaggctctcgaagtggtcaatcagatcaccgtcactagcggttcctttctcccagcactcgtcctgaagatgcaactttttctcgcaaggcaggactgggagcagaccgtggaaatgggacacaggatcctcgaaaaagatgaaagcaatatcgacgcatgccaaattctgaccgtgcacgagctggctcgagaggggaacatgacgacagtgagttcacttaagacccagaaggcaactaatcacgtccgaaacctcatcaaagctctggaaacccgcgagcccgaaaatcctagtctacatctgaaaaagataattgttgtgtcccgactgtgcggctctcaccaggtcatcctaggcttggtttgttcttttatagagaggaccttcatggctacccccagttacgtgcacgtcgccaccgagctcggctatctatttattctgaagaaccaggtgaaggaggccctactgtggtactccgaggctatgaagctcgataaagacgggatggcaggactcacggggatcatcttgtgccacattctggaaggccacctggaggaggcagagtatcggttggagttcctaaaggaggttcagaagtccttgggcaagtctgaggtgctgattttcctgcaagccctcctgatgagcagaaagcataagggggaagaagagacaaccgccctgctcaaggaggccgtggagctgcactttagtagcatgcaggggatccctctcggatctgagtacttcgagaaactcgatccctactttctggtatgcatcgcaaaagaatatcttctgttttgtcccaagcagcctaggctccctggacaaattgtgagcccgctactgaaacaggtggcagtaatcctgaatcccgttgtcaaggctgctcccgcactgatcgacccactctacctcatggcccaggtgcgatattattccggcgaacttgaaaacgctcagtccattcttcaaagatgccttgagttggatcctgctagcgtggacgcacatctcctgatgtgtcagatttatctagcccaaggaaattttggaatgtgctttcactgtctcgagcttggagtgtctcacaactttcaggttagagaccatcctctataccacctgattaaggcaagggccttgaacaaagccggggattatcctgaggccattaagaccctcaaaatggtgattaaactgcctgcgctgaaaaaggaggaaggccggaaattcctgaggccatcagtccagccatcccagcgagccagtatcctcctcgagctggtggaggccctccggttgaacggggaactgcacgaggcaacaaaggttatgcaggacactatcaatgaatttggcggcacccctgaagaaaatcgcatcactatcgccaatgtcgatttagtcttatccaagggcaacgtcgatgtggccctgaacatgctgcggaatatcctcccaaaacaatcttgctatatggaagccagggagaaaatggcaaatatatacctgcaaaccctgcgagaccggcggctatatattcgatgctatcgtgagctgtgcgaacatctaccagggccccatacctcactgctgctcggcgacgcactcatgagcattctcgagcccgagaaagcgctggaagtgtacgacgaggcatatagacaaaacccccatgacgcgtccctcgcctcacgcatcggccacgcatacgtgaaggcccaccagtatacagaagcgatcgagtattacgaggcagcccagaaaattaatgggcaggactttctttgctgtgacttgggcaaattactgttaaaactgaagaaggttaacaaagctgagaaggttttgaagcaggccctggaacacgacattgttcaggatatcccttctatgatgaatgatgtgaaatgtctcttgttgttggccaaagtttacaagagccataaaaaagaggccgtcattgaaaccctcaacaaagctctggatctccagtcgcggatcctcaaacgcgtgcccctcgagcaacctgagatgatcccttctcagaagcagctggccgcctctatctgtattcagtttgctgaacactacctggcggaaaaagaatatgataaggccgtgcagtcttacaaagacgtgttttcatatctcccaaccgataacaaggtgatgcttgaactggcacagttgtacctcctccagggccaccttgacctctgtgagcagcattgtgccatcctacttcagacagagcagaatcatgagactgcatctgttcttatggcagatctcatgttccggaaacagaaacatgaagctgccattaacctctaccatcaagttctggaaaaggcccccgataattttcttgtgttacataagcttatagacctcctgagacgtagcgggaaactcgaggatatacccgcattcttcgaactggccaaaaaggtctcctccagagtccctctcgagccgggatttaactactgtcggggaatctactgctggcacatcgggcagcccaatgaggcactgaaattcctaaataaggctcgtaaggatagtacatggggccagtctgctatctaccatatggtgcaaatttgcctgaatcccgacaacgaggtggtgggcggagaagccttcgaaaatcaaggtgccgaatccaattatatggaaaagaaggaactcgagcagcaaggcgtctccaccgcagaaaaacttctgagagaattctacccccattctgactctagtcaaacccagctacgcctcctgcagggactctgcaggcttgccactagagaaaaggcaaatatggaggcggccctcggcagcttcatacagatagcacaggctgagaaggacagtgttcccgccttgctcgcgttggctcaggcatacgtctttcttaaacagatcccaaaggccaggatgcagctgaagaggcttgccaagactccgtgggtgttgagcgaggccgaggacctcgagaagagctggctgcttctggcagatatttattgccaaggatccaaatttgatcttgcccttgaattgcttcggagatgtgtgcagtataataaatcatgctacaaggcctacgagtatatgggatttataatggaaaaggaacagagctataaagatgccgtaacaaactacaagctggcttggaagtatagtcaccacgccaatcctgctattggcttcaagttagcctttaattatctcaaggacaaaaagttcgttgaagccatagagatctgcaacgacgtgctccgtgagcatcccgactatccaaaaattagagaggagatcctcgaaaaagccaggcggtcgctgagaccctag

SEQ ID NO: 33902 - DNA, 3912 bp, Artificial Sequence
  Description of Artificial Sequence: Synthetic coding sequence
atgtcctccaatgacagttctctgatggctgggatcatttactactctcaggaaaaatattttcaccatgtgcagcaggctgctgctgtcggactggaaaaatttagcaatgacccggttctaaagttttttaaagcttacggtgtgctgaaagaagagcacattcaggatgctatcagcgatctggaatccatccgccatcacccagacgtaagtctctgcagtacaatggctcttatctacgcccacaaacgctgtgagataatcgatcgtgaagcgatccaggaactcgagtatagcctaaaggagattaggaaaaccgtgtccgggacagcattgtactacgcaggcctattcctgtggctgattgggaggcatgataaagccaaggagtacatagatcggatgttgaaaatctccagaggttttcgcgaagcctatgtgctcagaggatgggtggatctgacatctgataaaccccacaccgccaagaaggccatcgaatatctggaacagggaattcaagatactaaagacgtgctaggcctgatggggaaagccatgtatttcatgatgcaacagaactactcagaagctcttgaagtggtaaaccaaatcacagttacctcgggctcatttctaccagctctggttctgaagatgcagttgtttctggcccgccaggattgggaacagacggtggaaatgggccatcgtattcttgaaaaggatgagtctaacatcgatgcctgccagatattgacggtgcatgaattggctcgggagggcaacatgaccaccgccacgaaccacgtccgtaacctgataaaggctctcgaaaccagagagcctgaaaacccgtcactccacctcaagaaaatcatcgtggtgagtagactgtgtggctcacatcaggtgatactgggattagtctgtagctttatcgaaaggacattcatggccacaccctcatacgttcacgtggctacagaactcgggtatctctttatcttaaaaaaccaggtgaaggaagctcttctgtggtatagcgaggccatgaaattggacaaagacggaatggctggactcaccggcattatactttgccatatcctggaaggacatctggaagaggttcagaagagtctaggaaaatccgaagtcctgattttcttgcaggcgctgctgatgtctcgtaaacataaaggcgaggaagagactacggcactacttaaggaggcagtggaattgcactttagttccatgcaaggtatccccctgggatctgagtactttgaaaaactcgacccatacttccttgtttgtatcgctaaagagtacctgttattttgccccaagcaacccagactgcccggacagatagtgtcgccactgctcaagcaggtagctgttattctgaaccccgtggtcaaggcagctcctgcccttatagaccccttgtatcttatggcacaggtaagatactatagtggagagctcgaaaatgctcagagtattctacaacgctgcctggaacttgatccggccagtgtcgacgcccatctgctgatgtgccagatttacctagctcaggggaacttcgggatgtgcttccactgcttggagctcggcgtcagtcataatttccaggtgagggaccaccctctctaccatctcattaaagcaagggccttgaacaaggccggggactatcccgaagccattaagacactcaaaatggtaattaagctgcccgcacttaagaaggaagaaggcagaaagttcctgaggcctagcgtccaacccagccagcgggctagcatactgttagaactcgtcgaggccctgaggcttaacggggaactgcacgaggcaacgaaggtgatgcaagataccattaatgaattcggaggtacacccgaggaaaacaggatcaccatcgcgaacgtagatctggtactcagtaaaggaaatgtagacgtagcactgaatatgttgagaaatatactgccaaagcagtcctgttacatggaagctcgcgaaaagatggcgaacatctaccttcagacccttcgcgacaggcgtctttacatccgatgttaccgggaactgtgcgaacacctgcccggaccacacacttcgttgttactaggcgacgccctgatgagtatcttagagccggaaaaggcactggaggtctatgacgaggcttataggcagaacccacacgatgcttctctggctagccggatagggcacgcctacgttaaggcccaccagtataccgaagctatcgagtactacgaggccgcacagaagatcaatggacaagatttcttgtgttgtgacctcggcaagctgctcctgaagctgaaaaaagtaaacaaagccgaaaaggtcctcaagcaagcccttgagcatgatatagtgcaggacattccctctatgatgaacgatgtgaaatgcttgctgctgttagccaaggtgtacaaatcacacaaaaaagaggccgtaatcgagaccctgaataaggcattggacctgcagtctcggattcttaagagagtgccgctggaacagcctgagatgatcccttcccagaaacaattggcagcaagtatatgcatccagttcgctgaacactaccttgcagaaaaagagtacgataaagcagttcaaagttacaaagacgtcttttcatacttgcccacagacaacaaggtgatgttagaattagcccagttgtatttgctccagggccatctcgacttatgtgagcagcactgtgcaatccttttgcaaacggagcagaatcatgaaacagcaagtgtgttgatggccgatctgatgtttagaaagcagaagcacgaggctgcgatcaacctgtaccaccaggtgctggagaaagctcctgacaacttcctggtactgcataagctgatagatctgctgcggagatctgggaaactggaggacattccggctttcttcgagctggccaagaaagtgtccagtagagtccctttggaaccgggtttcaattattgtagaggcatctactgttggcacatcggccaacctaatgaggccttaaaatttctcaacaaggccagaaaggatagcacatggggacagtccgcaatttaccatatggtccagatttgtctgaatcccgataacgaggttgttggtggagaggccttcgagaatcagggcgctgagtccaactatatggagaagaaagagctggaacagcagggcgtgagcactgccgagaagctcttgcgggagttctatcctcacagtgatagttctcagacacagctgagactcctgcaaggactatgcagacttgctacaagggagaaagcaaacatggaggctgctctggggtcatttattcagattgctcaggctgagaaggacagcgtgccagccctgctcgccttggcccaggcctacgtgttcctgaagcagatcccaaaggccaggatgcagctgaagaggctcgctaagactccctgggttctgtccgaagctgaagacttggaaaaaagttggctcttgctggccgatatttactgtcagggatccaaatttgacctggccctggagctgttacgccggtgcgtccaatacaataagtcctgctataaggcatatgagtatatgggctttataatggagaaagagcaaagttataaggatgcagtgacaaattacaaactcgcttggaagtactcgcatcacgctaacccggctattggattcaagctcgcatttaattaccttaaggacaaaaagtttgtcgaggccatcgagatctgtaatgatgtgcttcgggagcaccccgattaccctaagattcgcgaggagatccttgagaaagctagacggtccctgcgaccgtag

SEQ ID NO: 33903 - DNA, 3963 bp, Artificial Sequence
  Description of Artificial Sequence: Synthetic coding sequence
atgtcctcgaatgactcctcgctcatggccggcatcatctattactcgcaggaaaagtatttccaccacgtgcaacaggcagccgctgttggcctcgagaagttttcaaatgacccagtccttaagttctttaaagcgtatggcgtgctgaaggaagagcacatccaggacgccatttctgacctggaatccattaggcatcacccagacgtctccctctgctctacaatggccctcatttacgcccacaagcgctgcgaaataatcgaccgagaggcaattcaggagcttgagtacagtcttaaagagattcgtaagacggtgtctggcaccgccttgtattacgccggcctattcctctggttaattggtcgtcacgacaaggcaaaggagtatatcgataggatgctcaaaatcagcaggggctttcgcgaagcctatgtactgcgaggctgggtggacctcacaagtgataaacctcacaccgccaagaaagctattgagtatctggagcagggtatacaagacacaaaagacgttttagggctgatggggaaggccatgtattttatgatgcagcagaactactctgaggcactcgaagtcgtgaatcaaatcacagtcaccagcgggtccttcttacctgctctcgtcctcaaaatgcagctgtttctggccaggcaggactgggaacagacagttgagatgggacatagaattctcgaaaaagatgaatccaatatcgacgcatgtcagatcctaaccgtacacgagcttgctcgagaaggaaatatgacaactgtgagttccctcaaaacccagaaggctacaaatcacgtgcgcaacctgataaaggccctggagactagagaacctgaaaatccatccctgcacttaaaaaagatcatcgtggtaagtcggctctgcggctcccaccaggtcatcctcggcctagtgtgttccttcattgaaaggaccttcatggcgaccccttcttacgttcatgtagctaccgagttagggtacctgttcatcctgaagaaccaggtgaaggaagcattactgtggtacagcgaagcaatgaagctggacaaagacgggatggctggcctcactggtattatcctgtgtcatatactggagggccacttagaggaagctgagtatcgactggaatttttgaaggaggtacagaagtctctgggaaagtcagaagtactgatctttctgcaggctctcttaatgtcccgcaagcataagggtgaagaagaaacaacggccctccttaaggaggcagtggagctgcacttttcttctatgcagggtatccctcttggctccgagtattttgagaaactggatccctattttctggtgtgtatagccaaggaatacctgcttttctgtcctaaacagccccgccttcctggtcagattgtgtccccgctccttaagcaggtggccgtaatccttaatccagtagtgaaggctgccccggccctgatagaccccttgtatctgatggcccaggtgcggtactacagtgagctggaaaacgcccagtcaatattacaacgctgcctggagttagatcctgcttcagtggacgctcacttgctcatgtgtcagatttaccttgcgcaaggaaacttcggtatgtgctttcactgcctggagctgggcgtgagtcataatttccaggttagggaccatcctctataccatctgatcaaagctagggctctgaataaggccggcgattatccagaggccataaagaccctcaaaatggtgattaagctccccgcacttaagaaggaggagggtagaaaatttctacggcccagcgtccagcccagtcagcgcgcatcaatactgctcgagctcgtcgaagctctacgactcaatggcgagttgcacgaagccactaaggtgatgcaggacactattaacgagtttggcggaacccccgaagagaataggatcaccatagccaacgttgatctcgttctaagcaagggtaatgtggatgtggctctcaatatgctccggaacatcctgccaaaacagtcctgctacatggaagcccgcgaaaagatggccaatatttacctgcagacccttcgcgaccgacgtctttatatccggtgttatagagaactgtgtgagcatctaccgggccctcacacttcactgctcctcggagacgctcttatgagcatcctggaacctgagaaagctctggaggtgtacgacgaggcatatcgacaaaacccgcatgatgccagccttgcttccaggatcgggcacgcatacgtcaaagcacaccaatacaccgaagccatcgagtattacgaggcagcacagaagataaacgggcaagacttcctctgctgtgatctaggaaagctgcttctcaagctcaaaaaagtcaacaaggccgaaaaagtgctgaagcaggccctcgagcatgacatcgtacaggatattcctagtatgatgaacgacgtgaagtgtctgttgttgttggccaaagtgtacaaatcccataaaaaagaggcagtcattgagacactgaacaaggcactcgatttacagagtcgtatcctgaagagagttcctctcgaacagccagaaatgataccctcccagaaacagttggctgccagcatctgtatccagtttgcggaacattacctggcggaaaaggaatacgacaaggctgtgcagtcttacaaggacgtgttctcatatctgccaaccgataataaggtgatgttggagttggcccagctttatctgctccagggacatctggatttgtgtgaacaacattgtgcaatactcttgcagaccgaacaaaaccatgagactgccagcgtgctgatggctgacctgatgtttcggaaacagaagcacgaagctgctattaatctctaccatcaagtgttagagaaagcaccagacaatttcttggtgcttcacaagctgatcgacctgttaaggcgatctgggaagctggaagacatccctgcatttttcgaactggcaaagaaggtgtcctccagagttcccctcgagcctgggttcaattactgccgagggatctattgttggcatatcggccagcctaatgaagcactgaagttcctgaacaaggctagaaaagactccacttggggacagtccgccatctaccatatggtgcagatttgtctgaatcctgacaatgaggtcgtaggcggtgaggctttcgagaaccaaggcgccgaaagcaactatatggagaagaaggaactggaacaacagggcgtgtccaccgccgaaaagctgctgagggagttttatccgcactccgactccagccagacccagttacggctgttgcagggactatgtcggctggccactcgtgagaaagcaaacatggaagccgccctaggatcattcatccaaattgcccaggccgagaaggactctgttccagccctactggctctggcacaggcatatgtattccttaaacagatcccaaaggcccggatgcagttaaaaaggctagctaaaacaccatgggtgctttctgaggctgaggacttggagaagtcctggttgctgctggctgacatttattgccaaggctctaaattcgacctggctctcgagcttctgcggcgatgtgtccagtataataagtcatgttacaaggcctacgagtatatgggcttcataatggaaaaggagcagtcctacaaagatgctgtgaccaattataagctggcctggaaatactcacatcacgctaatccagcaatcgggttcaaactcgcttttaactaccttaaggacaagaagttcgtggaggccatcgagatttgcaatgacgtgctgagggagcacccagattatcccaagatcagggaagagatcctggaaaaggcacggagatctctgagaccatag

SEQ ID NO: 33904 - DNA, 3819 bp, Artificial Sequence
  Description of Artificial Sequence: Synthetic coding sequence
atgtctagtaatgacagttcactgatggcgggcattatatattactcccaggagaagtacttccatcacgtgcagcaggcagctgccgtagggctcgagaagttcagcaatgatcccgtccttaaattttttaaggcctacggggtgctaaaagaagagcatatccaggacgccatcagcgatctggaatcaattcggcatcaccctgatgtgtctttgtgcagcacaatggcattgatttatgcccacaagaggtgtgaaattattgatagagaggcaatacaggaactggagtattcacttaaggagattcgtaaaacagtcagcggcaccgccttatactacgctggcctctttctctggctcattggtagacacgataaagccaaggaatatatcgataggatgttaaagatttctcggggattccgggaagccatgtacttcatgatgcagcaaaactacagtgaggccctcgaagttgtgaatcagatcacagtaacaagcggctcgtttctgccagcactggttctgaagatgcagctgttcctggcacgacaagactgggaacaaaccgtggagatgggtcaccgcatcctcgagaaagatgagagcaatatcgacgcgtgccagattctgacagtgcacgaactggctagggaaggcaatatgacaactgcaaccaaccatgttcgcaaccttatcaaagctctggagactcgtgaacctgagaacccttctttgcacctgaagaaaatcatagtcgtctcccgcctgtgtggctcacatcaggtaatactcggactcgtttgctcgtttattgaaaggacgttcatggccacaccatcttatgtccacgttgccaccgagctgggataccttttcattctgaagaatcaggtcaaggaggctctgctttggtactccgaggccatgaaactcgataaagatggcatggcaggcctaactggcattatcttgtgccacatcctggagggacacctcgaagaggccgaatatcgcctggagtttctgaaggaggtgcagaaaagcctaggaaaaagcgaagtgctgatattcttgcaggctctcttgatgagtcgcaaacacaagggagaagaggagaccaccgcactcctgaaggaggctgtggagttgcacttttcctcgatgcagggtatccccttgggcagcgaatattttgaaaaactggatccttattttctcgtctgtatcgcaaaagaatacttgctcttttgccccaaacaaccacgtctgcccggtcagatcgtctctccgctgttgaagcaggtcgcagtgatactcaaccctgtggtcaaggctgcgcccgcgttgatcgatcccctttatctgatggctcaggtgagatactattccggcgagctcgagaatgcacagtctatattgcagagatgcttggagctagacccagcatccgtcgacgcccatctgcttatgtgtcagatttacctggctcagggaaatttcggtatgtgttttcattgtctggagttgggggtgtcgcataattttcaggttagagatcatcctctttaccacttaatcaaggcacgcgccttgaacaaggctggggactatcctgaagcaataaaaacccttaagatggtgattaaattgccagcactgaagaaggaggaggggcggaaattcttgagacccagcgtccagccgtcacagcgcgccagcatcctgctggaactggtggaggcccttcggctaaatggagagctacacgaagctactaaggtgatgcaggatactatcaacgaatttggagggaccccagaggaaaataggattacaattgccaacgtggacctagtactgtcaaagggcaatgttgatgtggcgttaaacatgctgcggaatatcctgcctaagcagagctgttacatggaagcccgcgagaaaatggctaatatctatttacaaacattgagggataggagactctatataagatgctaccgcgagctttgcgagcacctgccaggtccacatacaagcctgttgttgggagatgcactgatgtctattctggagcctgaaaaagcccttgaggtatacgatgaggcctatcgccagaacccccacgacgcgtctctggcctcccggatcggtcacgcgtacgtgaaggctcaccagtacaccgaggcgatcgagtattatgaggctgcacagaagattaatgggcaggattttctgtgttgcgatctcggcaaattgctgcttaaattaaaaaaggtgaataaagcagagaaagtgctcaagcaagccctggagcatgacatagtccaggacattcctagcatgatgaatgacgtcaaatgccttttgttgctggccaaggtctataagtctcataaaaaggaagctgttatcgaaactcttaacaaagctttagatctgcagagccggatcctgaagcgcgttcctcttgagcaacccgaaatgatcccttctcaaaaacagctcgcagcttccatctgcattcagtttgctgaacattatctagccgaaaaggaatacgacaaggccgttcagagctataaagacgtattctcttatctccccactgacaataaggtcatgctggagctggcccagttatatctgctgcagggacatctcgacttatgcgaacagcattgcgcaatcttgctgcagaccgagcagaatcatgagacggcaagcgtgctgatggccgatctgatgttccgaaaacagaagcatgaggctgctattaacttgtaccatcaagtgctggagaaagcccccgataactttcttgtcttgcataaacttatagaccttctgaggcgttcggggaagctcgaggacatcccggcgttcttcgaactggccaaaaaggtctctagtcgggtccctttggaacccggcttcaattattgtaggggtatttattgttggcatattggacaaccaaacgaggccctaaagttccttaataaggctcgcaaagactcaacgtgggggcagagcgccatataccatatggtgcaaatctgcctgaatcccgataacgaggttgtgggcggagaggcttttgagaatcaaggggctgaaagcaactacatggagaagaaagaactagaacagcagggcgtgtccaccgccgagaaactgctcagagagttttatccccattcagatagcagccagacccagctgcgcctgttacaggggttgtgccgtcttgctactcgtgagaaggctaatatggaggctgctctggggagctttatccagattgcccaagccgagaaggatagtgtcccagcacttctcgctctcgctcaggcctatgtgttcttgaaacagatcccaaaggctagaatgcaactcaaacgcttggccaagaccccctgggtcctttccgaggccgaggatcttgagaagtcctggctgctgctggccgacatctattgccaggggtcgaagttcgacctggccctggaattactgagacgctgcgtgcagtataacaaatcttgctacaaggcctatgagtacatgggctttataatggagaaggaacaaagttataaagacgctgtgactaattataagctggcatggaagtactcccaccacgctaatcctgctataggtttcaagttggccttcaactatctgaaggataaaaaatttgttgaagcaattgagatatgcaacgacgtcctcagggagcaccctgattaccccaaaattagagaggaaattctggagaaggctaggcggagtctgcggccctag

SEQ ID NO: 33905 - DNA, 1119 bp, Artificial Sequence
  Description of Artificial Sequence: Synthetic coding sequence
atggcagagctggaggccgtggcggacgatctggacgcactcatagatgatttagactatctgcccggccacttccatctggagatgcagctgaattttgagccacggagccccgccccgcagcgagcccgcgatttaaaattgcagagggaggggctgagacaggagttgcagctggcagcagcccctcagcggcctgcagttaggcaccttctgggggccttcgcattttacctggaagagctcgatgaagcccgcgagtgttttctagaggtggcccacgagcatcccggaaacctgaatgcgtgggctaatttggctcacgtgtatgggagattggggcaagaggaagaagaggaggcttgtgctgccagactggccgacttgatgggtctggccgaagaacctgaggcagccggagatccccaactgcgggcagcaagatgcctcgccgaacagggctacgcccacggttttgacgtcggctgcgcctcccccgaagagcgggcacgaggccttgcagcaggcatcgccttatacgataaggctctagggtacggccagcagattccaatggaagaaaagcggggatggtacttcacaatggccactctgtacatacggctggatggcatctttttggaactcggttctgaggagcaaaaaagactgcctgccttcaatcgcaccttggcccttctgaggcaggtgctgaagtccgaagacccgcgtcaccgtgcactcgcatggtgttatctgggaatgctgttggaaaggaaagacactttctcaacgacaccaatgggtgtacacgattgcggttactcaggtaccgacccgctggactgttttggcaaggctattgaaattgccaagaatcagccaccaatcctcaatcgtctggctaagattttttattttctgggaaagcaggatatggccattggaacctgtaacatggcccttgatgtactgcgagacccagaactaaattggcaggcatactgtacgcgagctaagcgccgaggcctgacaatgctgccacgcctggtgagcaacagctgggcccaggccgtcctgcccccaaggccaccaaaagtgctggagttccaagtatag

SEQ ID NO: 33906 - DNA, 1710 bp, Artificial Sequence
  Description of Artificial Sequence: Synthetic coding sequence
atggccgaactggaggccgtggctgacgatctcgacgctttaattgacgatctggactatctgcctggacactttcacctcgaaatgcagttgaatttcgagccccggagcccagcccctcagcgtgctcgcgatttaaagctgcagcgagaggggcttagacaggagctgcagctcgctgcggctccccagcgccctgccgtgagacacttgctgggagcattcgcattttacctagaggagctcgatgaggctagagaatgcttcctcgaggttgcccacgaacatcctggaaaccttaacgcctgggctaatttggcccacgtctacggtcggctgggacaggaagaagaagaagaagcctgtgccgcgaggctggcggacctcatgggtctggccgaggaacccgaagctgccggcgacccacagctgcgggccgccaggtgcctggccgagcagggctacgcgcatgggttcgatgtgggctgtgcatctcccgaagaaagagcccgcggtctggctgctggtattgcgctgtacgacaaagccctcgggtatgggcagcagatacctatggaagagaagcgaggctggtattttaccatggccactctgtacatacgactggacgggattttccttgaactcgggtctgaggaacagaaacgcctgcctgcgttcaatagaactttagccctgctgagacaagtcctaaagtccgaggatccaagacacagagctttggcatggtgttatcttgggatgctgctggagaggaaggacacattcagtaccacccccatgggggtccacgattgcggatacagcggcacggacccccttgattgcttcggcaaggccatcgaaattgccaagaaccagccaccgatcctgaaccgactggctaaaatcttttactttctgggtaaacaggacatggccatagggacctgtaatatggccttggacgtattacgcgaccccgagctaaattggcaggcgtattgtactcgcgctaagatccatatccgtgcttatctgcacgatcttaaacgggccaaaatgggcctgggaggtatgcctgataggaaccatctggcgtgcgccaaagcggatcttgaggaagtcgtgcgagtgtgcccgggctttaaggcctacctcgacatcggtcaggtttactattatatgggagtcgatgctgtgcaggagttactggccgttgatgaggctgccctgaaccaggccctggtatttctcgcaaaggctggagagagcgaactcggggctaccctgcccgagctacaactgctgaggggcaagtgcctgcggataaagggcgaggatgctaacgccgccgcttgtttcaaacgagcagtggagttagatgatgcgggatcctcccacactgacggcttcggctgtctgctggaggcactgctggcccagtggtcacaggcccaactatcggacggagagctcggccgtgaggtcgatgcttggcttcgacgtgcgcaggacaagtaccctgctgctcgccttcgacaggaacttcagagggtgtggcgtggacatactgatgaagtgctggggctagcgagagccctggtggcgcagggcagacccgccttggtcaggttactttttgagaccatggaacgcgaaggcgagggcgcctctgcgcccagagaccgacgggctgtgtccttttag

SEQ ID NO: 33907 - DNA, 1344 bp, Artificial Sequence
  Description of Artificial Sequence: Synthetic coding sequence
atgcaggaaagtcaagaaacgcacatttcaaaccaccttgacgaagtcgttgccgccgtgagtataactcacaggaaaaaattccagaacaaacttttgcagacggctcttttccagccaccccgagagaagctgcatttatgcgaggagaaggccaaaagctacagcaattctcatgaatacaaacaggctgtccatgagctggtgcggtgtgtcgctcttacccgcatctgctacggcgattctcattggaaattggctgaggcacacgttaatttagcgcagggttatttgcagctgaaggggctcagtttgcaagccaagcagcacgccgaaaaggcccgacagatactcgccaacagtattgttccaccttactccgagaataccgatgtgtttaaattcagtatcgaattgttccacaccatgggccgagcacttctgtccctgcagaagtttaaggaggcagccgagaatctgacaaaggctgagcgtttgtctaaggaactgctgcaatgtggcagaattattaaagaggagtggattgaaatcgaggccaggattcggttatcctttgcccaggtgtaccaagggcaaaagaagtccaaggaagcgcttagccattaccaagctgcattagagtacgtggaaatttcaaagggtgaaacaagcagggagtgtgtgccaatcctgcgtgaactggcaggagtagagcaggcacttggacttcatgacgtaagtatcaaccactttttgcaggcacacctcatcatattaagcaggtcaccttcacaggtggaggctgcagattctgctcacatagtcgctcacgccgccgttgcctctggacggcacgagcatcatgacgtggctgaacagtactttcaggagtcaatggctcatctcaaagactccgaaggcatgggaaggactaagtttttgagcatccaggacgagttttgccactttctgcaaatgacgggacagaaggaacgggcaactagtatcctgagggaatcactggaagccaaggtagaggcttttggcgatttttctcctgaagtcgccgaaacctatcgtcttctcggaggagctgatttggcccagggcaaccactcgggggccagaaaaaaattgaagaaatgtctgcagatacagacactcctatacgggccacaagataaacggacacttgcaacccagcaggcaatgggaatgttgtcaacagctccaaaggtcgcaagcaaaccgcgacaggcatcaaaggctaaggttgcattctgtacatccatcccccaggacaccctgcttgggaaggcccgccccggaacgacagctgactag

SEQ ID NO: 33908 - DNA, 1182 bp, Artificial Sequence
  Description of Artificial Sequence: Synthetic coding sequence
atgcaggaatctcaggaaacacacatatcaaaccacctggacgaggtggtggcagccgtttcaatcacccatcggaagaaatttcaaaacaaactgctgcagaccgccctctttcagccaccccgagaaaaactacacctatgcgaggagaaggcgaagagctactctaattctcatgagtataagcaggccgttcacgaactggtccgatgtgtagctttgaccagaatctgttatggggacagtcattggaaactcgccgaggctcacgtgaatctggcacagggctacctgcagctaaagggactgtctctccaggccaagcaacacgctgagaaagcccgtcagatattggctaattctattgtccctccatacagcgagaatacagatgtctttaagtttagcatagagctctttcacacaatgggaagagcgctcctgtctctgcagaaatttaaagaagcagcagagaatttaactaaggcggagcgtctttctaaggaactcctgcagtgtggcaggatcatcaaggaggagtggattgaaatcgaggctcgcattagactgtccttcgctcaagtttaccaaggtcaaaaaaaatctaaggaagctctctcgcactatcaggcggctttggaatatgttgagatttccaaaggagagacaagccgggagtgtgtacctatactcagagagctcgccggggtggagcaggcattgggcctgcacgatgtttcgattaaccatttcctgcaggctcatctgatcatcctctctcggtccccaagccaggtggaggccgccgattcagctcatatcgtggcgcatgctgccgtggcaagcgggaggcacgagcaccacgatgtggctgaacaatactttcaagaatcaatggcgcacctgaaggatagcgagggcatgggccgcacgaaatttctgagcatccaggacgaattctgtcattttctccagatgactggccagaaggaacgtgctacatctatcttgcgggagagcctggaagcgaaggtggaggccttcggggactttagcccggaagtggcagagacatacaggcttctggggggtgctgatctcgcacagggaaaccacagcggcgcccgtaaaaagcttaagaagggcgacttgtcatttctgttgagcgctacgctcccatag

SEQ ID NO: 33909 - DNA, 1344 bp, Artificial Sequence
  Description of Artificial Sequence: Synthetic coding sequence
atgcaggagtcccaagaaacccatatttcaaatcacttagatgaagtggtagctgcagtcagcattacgcatcgcaagaaattccagaataaactgctacaaaccgccctttttcagccacccagagagaagttgcatctgtgtgaggaaaaggccaaatcttatagcaactcacacgaatataaacaggccgtccacgagctggttagatgtgttgcccttacacggatttgctatggggattcccactggaagctggccgaagcacacgtgaaccttgcacaaggttaccttcaactgaagggattgtcattacaggccaagcagcacgctgaaaaagcgcgacaaatactggccaactctatagtacccccgtactccgagaatacagacgtgttcaaattttcaattgagctcttccataccatgggacgggccctgctgagcttgcagaagtttaaggaagcggctgagaacttgaccaaggctgaaaggctctcaaaggaactcctgcagtgcggacgaatcattaaagaagagtggattgagatcgaagccaggatcaggctatccttcgcacaagtttaccaaggtcagaagaagagcaaagaggcactaagtcattaccaggccgctctggaatatgtcgaaatctccaagggcgaaactagtagagagtgtgtccctatcttgagggagctcgccggcgtggaacaggctctcggtctgcacgatgtgagtatcaatcacttccttcaagcacatcttatcatcttgagccggagtccctctcaggttgaggctgcggactccgcacatatcgtcgcccatgctgcagtcgctagcggacgtcacgagcatcacgatgtggcagaacagtatttccaagaaagcatggcacatcttaaggatagtgaaggtatggggcggaccaaattcttgtctatccaggacgaattctgtcacttcttgcagatgactggacaaaaggagcgagccacaagcatcctaagagaatctcttgaggcaaaggtggaagcgtttggcgacttctccccagaagtggcagagacctatcgcctgcttggcggagctgaccttgctcagggcaatcacagcggagcccgcaaaaagctcaagaagtgcctgcagattcaaactttactttacggtcctcaggataagcgcaccttggcgactcaacaggctatgggaatgctcagcacagcgcccaaagtggcttcaaagccaaggcaagcctcaaaggctaaagtcgccttctgtacctccataccccaggacacactgctgggcaaggcaagacctggcacaacagcggattag

SEQ ID NO: 33910 - DNA, 1344 bp, Artificial Sequence
  Description of Artificial Sequence: Synthetic coding sequence
atgcaagaaagtcaggaaacacacatcagtaatcatttggacgaggtagttgcagctgtctcaattactcaccggaaaaagtttcagaacaagctattacagaccgccttattccagcccccgcgagagaaactgcatctgtgcgaagaaaaagccaagagttactccaactcacatgaatataaacaggccgtgcacgagctggtgaggtgtgtggccttgacccgtatctgctatggcgactctcattggaagctcgctgaagctcacgtgaatttagctcagggctacctgcagctgaaaggcctgagccttcaggcaaaacagcatgctgaaaaagcacgacagattttggcaaacagcatcgttcccccctacagtgaaaatacagatgtttttaaatttagtattgagctgtttcacaccatgggacgcgccctgctgagtctgcagaaatttaaggaagctgcggagaacctaaccaaggcagagaggttaagtaaagaattgctccagtgcggtcggattattaaggaggaatggatagaaatcgaagcccgcatccgcctctctttcgcccaggtgtaccaggggcagaagaaaagtaaagaggctctctcacactatcaagccgcactggagtatgtggagatctctaaaggggaaacctcgcgggagtgtgtgcccattcttagggagctagccggggttgagcaggccttgggtctgcacgatgtctctataaaccatttcctgcaggcccaccttatcatactctcacgcagtccatcacaggtggaggcagcagacagcgctcatattgtggctcacgctgccgtggctagcggcagacatgagcatcacgacgttgctgagcaatattttcaggagtctatggcccatttaaaggactcagaggggatgggcaggaccaaattcttgagtatccaggatgagttttgtcactttctgcaaatgacggggcaaaaggagcgcgctacttcaatcctgagagagtcactggaagccaaagtcgaggcattcggcgatttcagtcctgaagtagccgagacatatcgcctgctgggaggtgcggacctcgcacagggaaaccactccggagcgcggaagaagctgaagaaatgcctccagatccagacattactgtacgggcctcaggataaaagaacactggcgactcagcaagccatgggcatgctgtctaccgctcccaaagtcgcctcaaaacccaggcaggcttcaaaagccaaggtggccttctgtacaagcatcccacaggatacgctattgggcaaggcccgcccaggcacgacagccgattag

SEQ ID NO: 33911 - DNA, 1344 bp, Artificial Sequence
  Description of Artificial Sequence: Synthetic coding sequence
atgcaggagtctcaggaaacccacatatccaatcatctcgacgaggtggttgcggccgtgtcaatcacccacaggaagaagtttcaaaacaagctgctgcagaccgccctgttccagccccctagggaaaagttgcatctatgcgaagagaaagctaagagctacagtaactcacacgaatataagcaggcagtacatgagcttgtgcgatgtgtggctttgactcggatctgctacggcgactcccactggaagctcgccgaggctcatgtcaatttggcccagggctatctgcaactgaaggggctgagtctgcaggcaaagcagcatgccgaaaaagctcgacaaatactggctaattccatagttcctccctactccgaaaatacagatgtctttaaattctccatagaactgtttcacaccatgggaagggcactcttgtccctccagaagttcaaggaggcggccgagaatctgacgaaagccgagcgattaagtaaggaactgctgcagtgcggaaggattattaaggaggagtggatcgagatcgaagctcgaatccgcctttccttcgctcaagtctaccaaggacagaaaaaaagcaaagaagccctctcccactaccaagccgctctcgagtacgtggaaatctccaaaggagagacaagtcgggaatgtgttcccatcttgcgggagctggccggagtggaacaggccctggggctgcacgacgtctccataaaccactttttgcaggcacacctgatcatcttgagccgctctccctctcaggtggaagccgccgactcagcccatattgtggcacacgcggccgttgcttccggccgccatgaacaccacgacgtcgcagaacaatactttcaagaaagcatggctcacctcaaagattctgagggtatggggaggactaaattcctgtctatccaggatgagttttgccattttttgcaaatgaccgggcagaaggaaagggcaacatctatactgcgagaaagtctggaagctaaagtcgaggccttcggagacttttcaccagaggtggcagagacctaccgtctgctaggaggcgctgacctcgcgcagggcaaccactcaggcgcccgcaaaaagctaaagaaatgtcttcaaatacaaacattactgtacggcccacaggacaaacggactctggctacccagcaggcaatgggtatgctgtctactgcccccaaagttgcttcgaaaccacggcaagcatctaaagcgaaagtggccttctgcacatctatccctcaggatacactgctgggtaaggcccggccaggaactaccgcagactag

SEQ ID NO: 33912 - DNA, 171 bp, Artificial Sequence
  Description of Artificial Sequence: Synthetic coding sequence
atgcaagagagtcaggagacacacatctccaatcatttagatgaagtggtggcggccgtgtctatcacccacaggaagaagtttcagaacaagcttcttcagacggcactctttcaaccacccagggaaaaactgcacctctgcgaggagaaggctaaaagttactcttag

SEQ ID NO: 33913 - DNA, 1344 bp, Artificial Sequence
  Description of Artificial Sequence: Synthetic coding sequence
atgcaggagagccaggaaacccatatatccaatcacctcgacgaggtggtcgcggctgtgagcattacccacaggaagaagttccagaataaactcttacagaccgccctttttcagccacccagggaaaaacttcatctatgcgaggagaaggcaaagagttactcgaatagccatgagtacaagcaggcagtgcacgagctggtgaggtgcgtggccctgacacgcatctgctacggggacagtcattggaagttagctgaagcccacgtaaatctggcacagggataccttcagctgaaaggactgagcctgcaggcgaagcagcacgccgagaaagcaaggcagattctggctaacagcatcgtgccaccgtactcagaaaatacagacgtcttcaaatttagtattgagttgttccacacaatgggaagggccctcctgagcctgcagaagttcaaagaagctgctgagaaccttacaaaagcggaacgcctatccaaggagctgctgcagtgcggccggatcattaaggaggagtggatcgagattgaagcaagaatcagactctcctttgcacaggtgtatcagggacagaagaaaagtaaagaagcactttcccactaccaggctgcgcttgaatatgtggagatttctaagggcgaaacgtctagagagtgcgtaccaatattgcgagaactggccggcgtagaacaggcactcggcctgcacgacgttagcataaatcacttcctgcaagcacacctgatcatcctcagtcggtctccaagccaggtggaagccgccgatagcgcccatattgtggcccacgcagcagtggcttctggccggcacgaacatcacgatgtcgccgagcagtacttccaagaatccatggcccacctgaaggattcggaaggaatgggtcggaccaagtttctcagtattcaagatgagttctgccactttctacagatgaccggacagaaggaacgcgccacctcaatcctcagagagagccttgaggcaaaagttgaggcattcggcgactttagtcccgaggtcgcagagacatatcgattgctgggcggagcagatctggcgcagggtaatcacagtggagcccgaaagaagctgaagaaatgtctacagatccagactctactgtacggccctcaggacaagcgcactcttgccacgcagcaggccatgggcatgctgagcacagcccccaaagttgcatcaaaaccccgtcaagcctctaaagcaaaagttgccttttgtacctctataccacaagatacactgctcgggaaagcccggccaggaacaacagctgattag

SEQ ID NO: 33914 - DNA, 1344 bp, Artificial Sequence
  Description of Artificial Sequence: Synthetic coding sequence
atgcaagaatcacaagaaactcacatctctaaccacttggacgaggttgtcgcggcggtgtcaattactcaccggaaaaaattccagaataagctattgcagaccgcgctgttccagcctccgagagagaagttgcatctgtgcgaggagaaagccaagtcctattcaaactcccacgagtacaagcaggctgtgcatgagttggtaagatgtgtggccctgacacggatatgctacggcgacagccattggaaactggcagaggctcacgtaaatctggctcagggatatttgcagctaaaagggcttagtctgcaagccaagcagcatgccgagaaggcaaggcagatcctcgcgaacagtatcgtgccaccctacagcgaaaacacagatgtgttcaagttctctatcgaacttttccataccatgggaagagccttattatctttgcagaaatttaaggaagcagcagagaatctgacaaaggccgagagacttagtaaagagttgctgcagtgcgggagaatcatcaaggaggagtggattgagattgaggcgagaatccgactgtccttcgcccaagtctatcagggtcagaaaaaaagcaaggaggcactcagtcactaccaagccgccttggaatatgtggagatatccaagggtgagaccagccgggagtgcgtccccattcttcgggagctggctggtgtcgaacaagcgctgggcctgcacgatgtgtcaatcaatcacttcctgcaggctcatctgattatcctgtctcgcagtccctctcaagttgaggccgctgattctgcacacattgtggcacacgcagcggtggcgtctggaagacatgagcaccacgacgtagctgagcaatacttccaggagagcatggcccacttgaaagactccgaagggatgggccgcacaaaattcttatccatccaggatgagttctgtcactttctccaaatgaccggacagaaggagcgtgccacatccattctcagagagtccctcgaggcaaaggtggaagccttcggagacttctctccggaagtcgcggaaacgtatcggctactggggggtgccgatttagcccaggggaaccattctggggcccgtaagaagctgaagaagtgcctccagattcaaactctgctttacggaccacaggacaagaggacactggctactcagcaagccatggggatgctgagcactgcacccaaggtcgcgtcaaagccccgccaggcctccaaggcgaaagtggcgttctgcacaagtattccccaggataccctgctcggcaaagcaagacctggaacaacagctgattag

SEQ ID NO: 33915 - DNA, 162 bp, Artificial Sequence
  Description of Artificial Sequence: Synthetic coding sequence
atgcaagaatcccaagaaacacacatttccaatcatttagatgaagtagtggcggccgtaagcataacgcatcgtaaaaaatttcagaacaagctattgcagaccgctctgttccaaccccccagagaaaaactgcatctctgcgaagaaaaggccaaatag

SEQ ID NO: 33916 - DNA, 456 bp, Artificial Sequence
  Description of Artificial Sequence: Synthetic coding sequence
atgcaggagagtcaggagacacatattagcaaccacctagatgaggtggttgctgccgtgtcgataactcatcgcaaaaagtttcaaaacaagcttctacagaccgccttgtttcagcctccccgagagaagctccacctctgtgaggaaaaagctaaaagctactccaacagccatgaatataaacaggccgtccatgagctggtgcgctgtgtggccctaactcgaatttgttatggcgactcacactggaagctggccgaggcacatgtcaatcttgcgcaggggtacctgcagctgaaaggtctctctctgcaagcaaaacagcatgccgagaaggctcgacagatcctcgccaactctatagtgcctccatatagcgaaaacacagacgtctttaaattttcgatagagctcttccatacaatgggccgtgccctgttgtccctgcaatag

SEQ ID NO: 33917 - DNA, 252 bp, Artificial Sequence
  Description of Artificial Sequence: Synthetic coding sequence
atgcaagagagtcaagagacccacatctccaaccatctagacgaggttgtggcagctgtatcaatcacgcatcggaaaaagttccagaataagcttctccagaccgccctgtttcagccgccaagagaaaagctgcacctctgtgaggaaaaggctaagagttattctaattcccatgaatacaagcaagcagtccatgagctcgtgaggtgcgtggctctcacacggatctgctacggcgacagccattag

SEQ ID NO: 33918 - DNA, 348 bp, Artificial Sequence
  Description of Artificial Sequence: Synthetic coding sequence
atgcaggagtcccaggagacacacatctccaatcatctcgacgaagtagtcgcagcagtatccatcacgcaccggaagaagttccagaataagctccttcaaactgctcttttccagccacctcgagagaaactccatctctgcgaagaaaaagctaagtcttacagtaacagtcacgagtacaaacaagcagttcatgagctggtgcggtgcgtggctctcaccaggatctgctatggggatagtcattggaagcttgcagaagctcacgttaatctcgctcaggggtatctgcaattaaaaggcctcagcttacaggcaaaacaacacgcagaaaaggctcgatag

SEQ ID NO: 33919 - DNA, 474 bp, Artificial Sequence
  Description of Artificial Sequence: Synthetic coding sequence
atgcaagagtctcaggaaacgcacatctcaaaccacctcgatgaggttgtagccgccgtgagtatcacccaccggaaaaagttccagaacaaactgttacagacagctctgtttcagccgcctcgcgagaagctgcacttgtgtgaggagaaggccaagtcttatagcaactcccacgaatacaagcaagcggtacacgaactggtacgctgtgtcgcactgacaaggatctgttacggtgactcacactggaagctggcagaggctcatgtgaatctggcacagggatatctacagcttaagggactgtccctgcaagctaagcagcatgccgagaaggcaaggcagatcttagccaactccatcgtgccgccttatagcgagaacacagacgtgtttaagttttcaattgaactctttcacacaatgggcagagccctcctgtccctccagaagtttaaagaggccgcatag

SEQ ID NO: 33920 - DNA, 1344 bp, Artificial Sequence
  Description of Artificial Sequence: Synthetic coding sequence
atgcaagagagccaggaaacccatataagcaatcatctagacgaggtggtggctgctgtctctatcactcataggaagaaattccagaataagcttctgcaaaccgccctcttccagcctccaagagagaaactccacctctgcgaagagaaagccaaaagttacagcaactctcatgaatataagcaagctgtccatgaactggtacgatgcgtcgcactgactaggatctgctacggcgacagccactggaagctggccgaggcccacgttaacctcgcccaaggttacctccagctgaagggcctctcgctgcaggccaaacagcacgctgagaaggcccggcagatccttgccaacagtatcgtacctccttattccgaaaacaccgacgttttcaaattttctattgagctgtttcataccatgggccgggccttactcagcctacagaaattcaaagaggctgctgagaatctcactaaagcagaaaggctcagcaaagaactcctgcagtgcgggaggatcatcaaagaggagtggatcgagatcgaggcacgaattaggctgagctttgctcaggtctatcaagggcagaagaaaagtaaggaagccttgtctcattatcaggctgctcttgaatacgtggagatctctaaaggcgagacgagtcgagagtgtgtgccaatcttacgggaactggccggagtagaacaagccctgggcttgcacgatgtaagcataaaccactttctccaggcacacttgataatcctcagcagatccccatctcaggtggaagcagccgacagtgcgcacattgtggcccatgcggccgtcgcctccggccgacatgaacatcatgatgtcgctgaacagtattttcaggagagtatggctcacctcaaggacagcgagggcatggggagaactaaatttctgagtattcaggacgagttctgtcactttttacagatgactgggcagaaagagcgtgccacttctattctgagggaaagcctggaggcaaaagtggaggcattcggcgattttagcccagaggtggcggaaacttataggttacttggcggcgccgatcttgcccaggggaaccactctggagccaggaaaaagctgaaaaaatgccttcagatacagacactcctttacgggcctcaggacaaaagaaccttggctacccaacaggcaatggggatgctgtctaccgccccaaaggtcgcatccaaaccacggcaggcctctaaggcaaaagttgccttctgtacgtccattccccaggacacactgctgggtaaagccaggcctggcacaaccgccgactag

SEQ ID NO: 33921 - DNA, 1344 bp, Artificial Sequence
  Description of Artificial Sequence: Synthetic coding sequence
atgcaggagtctcaggaaacacacatatcgaaccacttggacgaagtagtggcagctgtaagcattactcataggaagaaattccagaataagctgctccagaccgcactgtttcagcctcccagagaaaagttacacttgtgtgaagaaaaagctaagagctactcaaactctcatgagtataagcaggcagtacatgagctggtgcgatgtgtcgcactcaccaggatctgctacggggactcccattggaaactggcagaggcccacgtcaatctggcgcaagggtacctgcaattgaaagggcttagcctgcaagctaagcagcatgctgaaaaggcccggcagatcctagctaatagcattgtgcctccctactccgagaataccgacgttttcaagttcagtattgagctgtttcacacaatgggtcgcgccctcttgagcctgcaaaagtttaaggaggcagccgaaaatctaacaaaagcggaaaggctctcaaaggaactgctccagtgcggaagaatcattaaagaagaatggattgagattgaggcccggatcaggttaagcttcgctcaggtgtatcaaggacaaaagaagtctaaagaggctttgagccactaccaggcagccttggaatatgtggaaatctcaaaaggcgagactagccgggagtgcgttcccattctccgggaactcgctggcgtagagcaggccctcggtctgcacgacgtttctatcaatcactttttgcaggctcaccttattatcctgtctcggagtccatcacaggtcgaggctgcagactcagcccatattgtcgctcatgcagcagttgcatcaggcaggcatgaacaccacgatgtggcagaacaatactttcaggagtctatggctcaccttaaggatagtgaagggatgggaagaaccaaatttctctcaatacaggatgaattttgccacttcttgcagatgacagggcagaaggaacgcgctaccagcatattgcgcgaaagcctggaagcaaaagttgaggcatttggggatttttctcctgaagtggccgagacatacaggctgttgggcggggccgacctggcgcagggcaaccacagtggcgcaagaaaaaagctcaaaaagtgcctgcaaattcagactctgctctatggaccgcaggacaagaggaccctcgcaacgcagcaagctatggggatgctgagtacggctccgaaagttgctagcaaaccccggcaagcaagtaaggcgaaggttgcattctgtacatccattccgcaggatacattgttaggtaaggcccggcctgggactaccgccgactag

SEQ ID NO: 33922 - DNA, 1344 bp, Artificial Sequence
  Description of Artificial Sequence: Synthetic coding sequence
atgcaggagtctcaggagactcacattagcaatcaccttgatgaggtggtagctgccgtgtctataacccatcgtaagaaattccagaataagcttttacagacagcactgttccagcctccccgcgaaaaactgcacctgtgtgaggagaaagcaaaatcgtattctaactcccacgagtacaaacaggctgtacacgagctggtgcgatgcgtcgctctgaccaggatttgttatggtgatagtcactggaaattggctgaagcacacgtgaaccttgcccaagggtacttgcagctcaagggactctcccttcaagccaaacagcacgccgagaaagcccgccaaatcctggcaaactcaattgttcctccttactccgaaaacaccgacgtctttaagttcagtatcgaactgttccataccatgggccgcgcactgttaagtctacaaaagtttaaagaggccgcagaaaacctgactaaggccgagaggctgtccaaagagctcctgcaatgtggacgcataatcaaggaagaatggatcgagatcgaggcccggataagattatcattcgcacaggtttaccagggacagaagaaaagtaaggaagctctgtcgcactaccaggcagccctggagtacgttgaaattagcaagggcgaaacaagtcgggagtgtgtgcccattctccgcgaactggctggcgttgaacaggctctgggtctgcacgatgtgagcatcaatcactttctccaggcacacttaatcattctgagccgttctccatcacaggtggaggcagctgactccgcccacattgttgctcatgccgcggttgcatctggcaggcatgaacaccatgatgtggcagaacagtattttcaagaaagcatggcccatttaaaggactccgagggaatgggacgcacaaaattcctatctatacaagacgagttctgtcatttcctacaaatgactgggcaaaaagagagggctacatctattttaagggaaagcttagaagcgaaagtggaggcatttggggacttctcacccgaagttgccgagacataccgcctcctaggcggggccgacctagctcagggcaatcactccggagctcggaagaagctaaaaaaatgcctacagatccaaacgctgctttacgggccccaagacaagagaacgctcgctacacagcaagcgatgggtatgctgtcaaccgctcctaaagtggccagtaaaccgagacaggcttccaaggcgaaagtcgccttttgcacgagcatccctcaagacaccctgcttggcaaagcacgacctggcactacagctgattag

SEQ ID NO: 33923 - DNA, 1344 bp, Artificial Sequence
  Description of Artificial Sequence: Synthetic coding sequence
atgcaggagtcccaggaaacacacatatctaaccaccttgacgaggttgtcgcggctgtaagcatcacgcacaggaagaagttccaaaataagctgctgcagaccgcacttttccagccccctcgggaaaaactgcacttatgtgaagagaaggccaaaagctattccaattctcatgagtacaagcaagccgtgcacgaactggtgaggtgtgtagccttgaccagaatatgttacggagattcacactggaaattggctgaggctcacgtgaacctggctcaggggtacttgcagcttaaggggctgagcttgcaggccaaacagcatgcagagaaggccagacaaattctggctaactccattgtcccaccctactctgaaaacacggatgtgtttaagttcagcatcgaactgttccatacaatgggtcgcgcacttctgtcgctgcaaaagtttaaggaagcagcagaaaacctgacaaaagccgaaaggctgtcaaaagagctcttgcagtgcggacgtataatcaaagaggaatggatagagatcgaggcgcgcattcgcctgagcttcgctcaggtgtatcagggccagaaaaagagcaaagaagccctgtctcactatcaggcagccttggagtacgtagaaatctccaagggagaaacaagccgcgagtgcgttccaattctgcgcgagttagccggagtcgaacaggctctaggactgcacgatgtgtctatcaatcatttcttacaagcacatctgattatccttagtcggtctccctcacaggtcgaggccgccgactctgcccacattgtggctcacgctgctgttgcctccggtagacatgaacaccatgatgtagcggagcagtactttcaagaaagcatggctcacctgaaagattctgaggggatgggccggactaaattcttatcaatccaggacgagttctgccattttctacagatgacaggacagaaggaacgtgccacgagtatcctcagagagtctcttgaggcgaaggtggaggcattcggggactttagccctgaggtagccgagacttaccggttactgggcggtgctgaccttgctcaaggtaatcattctggcgcaagaaagaagctcaagaagtgcctgcaaattcaaacactcctgtatggcccacaggataagagaacattggctacccagcaggccatgggtatgctgtctacagcacctaaagtggcttctaagccaagacaggcatcgaaggccaaggtcgcattttgtacttccatccctcaggataccctgctgggaaaagctcgtccgggcacaacggcagattag

SEQ ID NO: 33924 - DNA, 1086 bp, Artificial Sequence
  Description of Artificial Sequence: Synthetic coding sequence
atgcaggcaagcccgatacgcatcccaacggtgagcaatgatattgattgggatttttgttttcacatgagccagcagacagaaatccccgcccaccagcagaccgatgaactctatcctacaggcggctgtggggagtcagaggaagaaacaaaggcaaaggaaaaagaaaaagcgatcgattgcatgagccatccaaaggaaaagcttgcccagtctcagaagaaagtcgcacagctcattaaagagaagatgaacactcaggctaacaaggagctcatccgctgcgtaatcctgagtagaataatctttggcgatcaccactggaaatgtgcacgggctctggccaacttagcatatggctacctcactcttagggggctcccagtccaggccaaaaagcacgcaacttcagctaaaaataccctcctgacatggaaagccaatactacgagtaacaaagagaaggaagaaatattggaggcccttgtcaagctctactacaccctcggcgtggcttggctactgcagaaccggggcagagaggcctactttaatctccagaaagccgagcgaaatatgaaagaactgaaagagctgtataagggcggagtctgtgagctgcaagtctctgagaatgaccttacactcgcactggggcgcgctagcttagctatccaccgactgaacctcgcgttggcatacttcgaaaaggccatcggtgatgtaatagctgcaaagggggataggacaagtgacctcatatctttgtacgaagaagctgcgcagattgaacaactccgccgtaatcataatcaagctatccagtacctgcagcaggcccactccgtgtgcgtgagcctgtttaccgaggtgtcgcctaaaactgctgagatgtctgctctgcttgcgaaggcctatgccatgtctggagaagcccagcatcgtgatgctgtggagatttatttcatcagatccataaacgcctatcgcgcaaccctcggatctgaagattttgagactttatccactacagaggagttttgtaaatggttggtgcagaacggtgaaaaacaggacaaatag

SEQ ID NO: 33925 - DNA, 1086 bp, Artificial Sequence
  Description of Artificial Sequence: Synthetic coding sequence
atgcaggcaagccccatccgcattcctactgtatccaatgatattgattgggatttctgtttccacatgagccagcaaacagagattccagcccatcagcaaacagacgaactgtatcctactgggggttgcggcgaatctgaggaggaaacaaaagcaaaagaaaaagaaaaagctattgattgtatgtcacatccaaaagaaaaactcgctcagtctcagaagaaggtggcccagctgatcaaagagaaaatgaatacccaggcaaataaggagctgatcagatgtgttattctgtcccgcatcattttcggcgatcaccattggaagtgcgccagagccctagctaacctggcttacgggtacctcacactgaggggactccctgtacaggccaagaagcacgccacctcagccaaaaacacgctcctcacttggaaggccaacaccactagtaataaggaaaaagaagagatactggaggcacttgttaagctgtactacaccttgggcgtagcatggcttctgcagaaccggtgtcgagaggcctacttcaacctacaaaaggctgaacggaacatgaaggaactaaaggaactttataaggggggcgtctgcgagttacaggtaagcgagaatgatttgacactggctctgggtcgagcctcactggctatccaccggctcaatctcgcgctggcttattttgagaaagctatcggcgatgtcattgccgccaaaggggaccgtaccagtgatctcatttcactgtacgaggaagcagcgcagatcgagcagcttcgtagaaaccacaatcaggctatacagtacctgcagcaggcccatagtgtgtgcgttagtctgtttactgaagtgagccctaagactgctgaaatgtccgctctgcttgctaaggcctacgccatgtctggggaggctcagcatcgcgatgccgtcgagatctatttcatccgatccattaacgcatatagagccacactgggcagtgaggattttgaaactcttagcaccaccgaagagttttgtaaatggttagtccagaatggagaaaagcaggacagatag

SEQ ID NO: 33926 - DNA, 1068 bp, Artificial Sequence
  Description of Artificial Sequence: Synthetic coding sequence
taaagcaccgaacggcgcctcctgggccatctttataacgatttagggctgggatactctcagttgcagctctttcctttggcagtggaagcgttcctacaggcactgcctctgtgctgggtgcctggagaacaggctaccgttctccggaacctggggatggcccacaatgccctcgggaattatcaggaggccagggagttccaccagaaggccgccgaccttcacgggtccgtaggccagcggtgggagcaaggccgtagtttcggctcattagccttcgccctttcacagctcggagaccacaaggctgcccgcgataactatctgcacgccttgcaggcggccagagacagcggcgacatgaagggtcagtggcaagcttgcgaaggcctcggagcagctgccgcacgtctcggacaatacgaccaggctttgaaatactataaggaggcactcgcacagtgccaaaaagaacctgatagcgtacgcgagcgcttggttgccaaattggcagatactgtcagaaccaggctggctcaggtgggattagtccagacacataccctcacatccgccccaggacgtctacaagcccctggcggagcatcccaggccgaaggaacacccgcaaaggccgggtcttccactgccggagtgcagcacagatcttctagcggatgggaggacgaggaattcgaagaggggcaccagaagaagaaggaggagcgctccgccaacgtcccagtgcgtgccggcccgggtcggcctgaactgtgcttcctgcctggtaccgtaaaccactctcatcatctggcctccagttgccccactttcaccaagcacaccccatgtagaggaaccgtcctgggcaaagctagtatttacagccctggcccacgggcccacctgcccttcgtggggcccggtcctcctagggccgagtaccctagcatattggtccctaacggaccacaggccaacaggtccagtcggtggcctcgtgagagtctgtcaagatcccgacagagacggccgatggagagtggaatctgcacaatagtttag

SEQ ID NO: 33927 - DNA, 1749 bp, Artificial Sequence
  Description of Artificial Sequence: Synthetic coding sequence
atgagttcaccaaatcccgaagatgtccctcggcgacctgaacccgaacccagcagtagcaacaaaaagaagaagaagagaaagtggctgcgtcaggaggcttcgattcaggctctgacccgggcagggcacggcgcattgcaggcaggccagaaccacgaggccctgaacaactttcagagagccttcctgttggcctctaaggcgccccaaaccagggatacgcccgttctccaggcatgcgccttcaacctgggcgccgcgtatgtggaaaccggggatcccgccagggggctggagttgctgctgcgggcgcaccctgaagagaaggcacagggacggaggcatggggatcagtgcttcaatgtggccctggcctatcacgcactcggagagttaccccaagctctggcctggtaccatcgtgctctgggacattaccagcctcagggcgatcagggcgaggcctgggccaaaatgggcgcctgctaccaggcactgggccagcctgaattggcagcacactgtttacaagaagcctcccaggcttacgcccaggagcgccagctgcgcgctgctgctttggcgctaggagccgcagcagggtgtatgcttaagtcagggcgccacagagttggagaggttgtccaggtgctggagaaaagtagacgattggccgaacgctccacagagcggaggcttctgggacacctgtacaacgatctggggctaggttacagccagcttcagctgtttcccctcgctgtcgaggccttcttgcaagccctcccactgtgctgggtgccaggcgagcaggcaaccgttctgaggaacctggggatggctcacaacgctctcggaaactaccaggaggccagggaattccaccagaaggccgccgacctgcacggcagcgtgggacagcggtgggaacagggtcgctcattcgggagtctcgcctttgccctttcccagctgggagatcacaaggcagcccgggacaactacctccacgccctgcaagctgcacgagatagcggtgacatgaaagggcagtggcaggcttgtgagggcctcggagcagccgctgccaggctaggccagtatgatcaagctctaaagtattataaggaagcccttgcgcagtgccagaaagaacctgacagcgtgagggaaaggctcgtggccaaactggcagatactgttagaactcggcttgcccaggtaggccttgtccagacacacaccttgacaagcgcccctgggagactccaggcaccagggggggcctcacaagccgagggtacccccgctaaagctggaagtagcacagctggggtccagcataggagctcatcagggtgggaggatgaggagttcgaagaggggcaccagaaaaaaaaggaggagcgaagcgccaacgtgcctgttagggccggacccggcagacctgagctgtgttttttaccagggaccgtgaaccattctcaccatctggcctctagctgccctactttcacaaaacataccccctgtcggggcaccgtgctgggtaaggctagcatctatagccctggtcccagggcccaccttcccttcgtcggaccaggtcccccgagagcagagtatccttccatcctggtgcccaatgggccgcaggctaatcggtcctcgaggtggccgcgtgagtcccttagcagatctaggcagcgcagaccaatggagagcggtatatgtacaatagtttag

SEQ ID NO: 33928 - DNA, 1749 bp, Artificial Sequence
  Description of Artificial Sequence: Synthetic coding sequence
atgtctagccccaacccagaagacgtgccaaggagaccagagcctgagccttcatcatctaataagaagaaaaaaaagcggaagtggttgaggcaggaagcaagcattcaggctttaacacgtgcaggacacggagcacttcaggccgggcaaaatcacgaagccctgaataactttcagcgtgccttcctgttggcgtcgaaagctcctcagactcgcgacactcctgtgctgcaggcttgtgccttcaacctgggcgcggcctacgtagagacaggggaccccgcacgcggacttgagctgctcctcagggcgcaccccgaagagaaagcccaagggagaaggcatggtgatcagtgcttcaatgtggctcttgcgtatcatgccctaggagagctgccccaagcgctagcttggtatcacagggccctaggtcactatcagcctcagggcgatcaaggggaagcttgggccaagatgggagcctgttaccaggcccttggacaaccagaactggccgcccactgtttacaggaggcctctcaagcatacgcgcaggaacggcaactgcgcgctgcagccctggcattgggggcagctgccgggtgcatgttgaagtctggccggcacagagtgggcgaagttgtgcaagtgttggaaaagagcagaagactggccgagcgttcaaccgagaggcggctgttgggtcatctgtacaatgacctgggcttagggtatagccagttgcagttgtttcctttggccgtcgaggcattccttcaggctctaccactgtgctgggtccctggagaacaggcgacagtcttacgcaacttaggaatggcacacaacgctctgggtaactaccaggaggcacgagaattccaccaaaaagctgcggatctccatggttccgtgggtcagcgctgggagcaagggcgatcgtttggctctctcgcttttgcactctctcagctcggagaccataaggctgcacgagataactatctgcacgcactgcaggctgccagggattccggggatatgaaaggccaatggcaggcctgtgagggcctcggcgccgccgccgcccggcttggccaatatgaccaggcgcttaaatattacaaagaggctctcgcccaatgccagaaagagccagactctgtgcgtgaaagactggtggctaagttagccgatactgtcaggacccggctcgcccaggtgggtctggtccagacgcatactctgacaagtgccccaggtcgactgcaggcacctggcggcgctagccaggccgagggcacgcccgctaaagcaggatcctccacagctggtgtgcaacatcgctccagctcaggatgggaggacgaggaattcgaggagggacatcagaagaagaaagaagagcggtccgccaatgtacccgtgagagctggtcccggtaggccagagctatgtttcctgcctgggaccgtgaaccacagtcaccacctggcatccagctgccccaccttcacaaagcataccccatgccgaggtaccgttctaggaaaagcctccatttacagccccggccctcgagcacacttacccttcgtgggccctggtccccctcgggccgaatacccatccatactggttcccaatggaccccaggccaacaggagttctcggtggccacgggagagcctctcgcggagccgccagcggcggcctatggaatcagggatctgcacgatcgtgtag

SEQ ID NO: 33929 - DNA, 552 bp, Artificial Sequence
  Description of Artificial Sequence: Synthetic coding sequence
taacatctatacaatgacctgggccttggatactctcagctgcagctcttcccactcgccgtcgaggcattcctgcaagcactgcctttatgctgggtgcccggggaacaggctacagtgttgcgtaatctgggcatggctcataatgccctgggcaactaccaggaagcgcgtgagttccatcagaaagcagcggacctgcacgggtcagtggggcagcgatgggagcaaggacggtccttcgggtcactcgcttttgcactctcccaactgggtgaccacaaagctgctagggacaactacctccacgcactccaggctgcacgggactcaggcgcccgcttttgcgccaggacagctggcgggcaggccggtcggcatcgcgaagatgccctgggtcccgggggcgctggccccgattctcatcccgacttcggaagcgggaagacccctggtagccgctggggtcagcccggcggaggtgatccatctaaggggcggaagcagcactctaggtgccctgctcagatcttccaatgggtgggtagatag

SEQ ID NO: 33930 - DNA, 2019 bp, Artificial Sequence
  Description of Artificial Sequence: Synthetic coding sequence
atgtctgatcctgaaggtgagacacttcgctccacctttccaagttatatggccgagggagagcgcctgtacctctgcggggaatttagtaaagcagcacagagcttctcgaatgccctgtatctgcaggacggcgacaagaattgtttagtggcccgatccaaatgttttctcaagatgggcgacctcgaacggagtctgaaagacgccgaggccagcctgcagagcgaccctgccttctgtaagggtattctgcagaaagccgagacactgtacaccatgggagactttgaattcgccctcgttttttaccatagggggtataagttgaggccagatcgggagttccgagtgggaatccagaaggctcaggaagctatcaacaattcagtgggcagtccgtcctccatcaagctcgagaacaagggggatctctcttttctatcgaagcaggccgagaacatcaaggcccagcaaaagccccaacccatgaagcacctccttcacccaaccaagggtgagcccaagtggaaagcatctcttaaaagcgagaagaccgttcggcagctgttgggcgagctatatgtggataaagagtacctcgagaagctgctgttggatgaagacctgatcaaagggactatgaagggcggccttacagtcgaggacctgatcatgacagggatcaactatcttgacacacactctaatttctggaggcagcaaaaaccaatttacgcccgcgaaagagaccgcaagctgatgcaggagaaatggcttcgcgaccacaagcgacgcccttctcagaccgctcactacatcttaaagagcttggaggacatagacatgctgttaacaagcggatccgccgagggctcacttcagaaagcagagaaggtgctgaagaaagtccttgagtggaacaaggaagaagtgcccaataaagacgagctggtgggaaacctatactcatgcattggtaacgcccagatcgagctgggccagatggaggctgctctgcaatctcacaggaaggacctcgaaattgccaaagaatacgacctcccagatgctaagtcccgggccttggacaacattggccgcgttttcgctcgggtggggaagttccaacaggccatcgacacttgggaagagaagatccctcttgctaagaccacgttagaaaaaacttggttgttccacgaaatcggccgctgttatttggaactggatcaagcatggcaagcccaaaattatggagaaaaaagtcagcagtgtgccgaggaagagggggacatcgagtggcaattgaacgcctccgtgctggtggcacaggcgcaggttaagctgagggatttcgagtcagcagtgaacaacttcgaaaaggccctcgagcgggcaaaactggtgcacaacaacgaggctcagcaggctatcataagtgctctggacgatgctaacaagggaataattagagaactccgcaaaacgaactacgttgaaaatttgaaagagaagtccgagggcgaggccagtctgtacgaggataggataattaccagggagaaggacatgcggcgggtgcgagacgagccagagaaagtggtcaaacaatgggatcattccgaggatgaaaaagagactgatgaggacgacgaagccttcggtgaagcccttcaatcccccgctagcggcaagcagagcgtagaggcagggaaagcgcgctctgacctgggcgcggttgccaaaggcctgagtggcgaactcggtacacgttcgggagaaactggaaggaagctgctcgaggcaggccgtagggagtctagagaaatctaccgaaggcctagcggagagctggaacagagactgagcggagaattttcacggcaggagccagaagagctaaaaaaactgtccgaagtgggtcgtagggagcccgaggagctgggaaagacacagttcggggaaatcggtgagacaaaaaaaactggcaacgaaatggagaaggagtatgaatag

SEQ ID NO: 33931 - DNA, 1464 bp, Artificial Sequence
  Description of Artificial Sequence: Synthetic coding sequence
atgatgttgtcaagggccaagcctgcagtgggacgaggcgtccagcacacagacaagcgcaagaagaagggtagaaaaatcccgaaattagaggaactgctatccaaacgggacttcaccggagcgataacactgctggagtttaagcggcacgtgggggaagaagaggaagatacgaatctttggattggatactgtgcctttcacctgggcgattataaaagagccctggaagaatacgagaacgctactaaagaggaaaactgtaacagtgaagtgtgggtgaaccttgcttgtacatatttttttttgggcatgtacaagcaggcagaagctgccggtttcaaggcctcaaaatctcggctacagaatagacttttattccatcttgcccacaagtttaatgatgagaaaaagctaatgagtttccatcagaacctccaggacgtgacggaggaccagctatcgctcgctagcattcactacatgcgttctcactatcaggaagctatcgatatctacaaaagaatcctgctggataatagagagtacctggcgctcaacgtgtacgttgctctctgctactataaactggactactacgatgttagccaggaagtgctcgcagtgtacctgcagcagatcccagatagcacaatcgcgcttaatttaaaggcttgtaaccacttcagactgtacaacgggcgggccgccgaggcagagctgaaatctcttatggataacgcaagctcgtcatttgaattcgccaaggagctgatcaggcataacctggtggtctttcgaggcggagagggcgccttgcaagtgctgccgcccctggttgatgtgatccctgaggcacgcttgaacctggtaatttactatctacgccaggacgacgtgcaagaggcctataacttgataaaggacctggagcccaccactccccaagaatacatcctaaaaggagtcgtgaatgcggccctgggtcaggaaatgggatctcgcgaccacatgaagatcgctcagcagtttttccagttggtggggggcagtgcctctgagtgtgacacaattcccggccgtcaatgcatggcatcctgcttcttcttgcttaagcagtttgatgatgtgttgatttacctgaacagcttcaagagttacttttacaatgacgacatctttaacttcaactatgcacaggctaaggccgctactgggaatacttccgagggtgaggaggcttttctgctgattcagtcagagaagatgaagaacgattacatttacttgtcctggctggcacgatgttatataatgaacaaaaaaccacgactggcctgggagctttacctgaagatggaaacctctggtgagtcattcagtttgctgcagctgatcgctaacgactgttacaaaagggatccctcaaggtccgcacctttcacagaaaaacacaggtag

SEQ ID NO: 33932 - DNA, 1665 bp, Artificial Sequence
  Description of Artificial Sequence: Synthetic coding sequence
atgatgctatctagagcaaagcctgccgttggtcgaggagtccaacatacggataaacggaagaagaaaggtagaaaaatcccaaagcttgaagagcttctgtccaagagggactttacaggtgcaatcacactattggaattcaagcggcacgtgggggaggaagaagaggacactaatctctggattggctactgtgcctttcatctgggagattacaagagggctttggaagagtacgaaaacgccaccaaagaggagaattgcaactcagaagtttgggttaacctcgcatgcacatatttcttcctgggcatgtataagcaggccgaagccgcaggcttcaaggcgagcaagagcaggctccaaaaccgcctgcttttccatctggcacataagtttaacgatgaaaagaagctgatgagcttccaccagaatctgcaggatgtgaccgaggatcagctctccctggccagcatccattacatgcggtcacactatcaggaagccatcgatatctacaagcgcatactgcttgacaatcgcgagtacctcgctctgaatgtctatgttgccctgtgctattataagctggactactacgacgtctcgcaggaagtcctcgcggtctacttgcagcagatccctgactctaccatcgccctgaatctgaaagcctgtaaccacttccgcttatataacggacgagccgccgaagctgaactgaaatccctgatggataacgcatcatcttcattcgagtttgcaaaggagctgattagacataatcttgtggtttttcgggggggagaaggggccctgcaagtgctgcctccgctggtagacgttattcccgaagctcggctgaacctggtgatctactatctgcgacaagatgacgtgcaggaagcttataatcttatcaaggacctggagcccaccactccacaagaatacatcctcaagggtgtggtgaacgccgccttgggtcaggaaatgggctcacgagatcacatgaaaatcgcccaacagttctttcaactggttggagggtcagccagcgagtgcgacacaattcccgggcgccagtgcatggcaagctgctttttccttttaaagcaattcgacgacgtcctgatttatctgaatagcttcaagtcgtacttctataatgatgacatttttaactttaattacgcacaggccaaggccgcaacaggcaatacctctgagggggaggaggccttcctattgatccagtccgaaaaaatgaaaaatgactacatttacctgtcttggctggcccgctgttatattatgaataaaaagcctcggctggcttgggaactgtaccttaaaatggagacttccggcgaatctttctcccttctccaactcatagctaatgattgctacaagatggggcagttctactattctgcaaaggcctttgatgtcttggagagactggaccctaatccagagtattgggaaggtaaaagaggcgcatgtgtcgggatctttcagatgattatcgcgggccgcgagccaaaggagaccctgagggaggtcctgcacctcctccgctccacgggcaacactcaagttgagtatatgatcaggatcatgaagaaatgggccaaggagaacagagtgtccatctag

SEQ ID NO: 33933 - DNA, 1572 bp, Artificial Sequence
  Description of Artificial Sequence: Synthetic coding sequence
atgatgcttagcagggccaaacccgctgtcgggcgaggtgtgcaacacactgataagcgaaagaagaaaggccggaagatacctaagctggaggagcttttgtctaagcgggatttcactggtgccattaccttacttgaggaatacgagaacgctaccaaggaagagaattgtaactccgaggtgtgggtgaacctcgcttgtacctacttcttccttggtatgtacaagcaggccgaagctgcaggttttaaggcatcaaagagtaggctccagaatagattgttatttcacctggcccacaaattcaatgatgagaaaaaacttatgtccttccaccagaacctgcaggacgtcactgaggatcagctttcactagcctcgattcactacatgagatcacattatcaggaagcaatagatatctataaacggatcctcctagataacagggagtacctggcgctgaacgtgtatgttgctctgtgctattataagctggattactacgatgtgagtcaggaggtcctggctgtgtacctgcaacaaattcctgactcaacaatagccctcaacctgaaagcatgcaaccacttccggctgtataatggtagagcagcggaggctgagctcaagtcccttatggataacgcgagctcttcatttgaatttgccaaagagctgatcaggcacaaccttgtggtctttcgaggcggggagggggctctgcaagtgctgccccctctggtggatgtcatacctgaagcacgcctgaacctcgtgatctattacctgcggcaggacgacgtacaggaggcatataacctgatcaaagatctggagccaacaaccccccaggaatacatacttaagggagtggtaaacgcggcactcggccaagaaatggggagtcgagaccatatgaagattgcgcagcagttctttcaacttgtgggcggttcagcctccgagtgtgacacaataccaggcaggcaatgtatggctagctgctttttcttgctgaaacagttcgatgatgtgttgatctatctaaattccttcaaaagctacttttacaacgatgacatatttaattttaactacgcgcaggccaaagccgcaacagggaacacctctgagggtgaggaagcattcctgctgatccagtcggagaagatgaagaatgattacatttatttaagctggttggcccggtgctatatcatgaataagaagccccggctcgcatgggagctttacttgaaaatggaaacctccggggaatcattctcactgctgcagctcatcgccaatgattgctacaagatggggcaattttactactctgcgaaagcattcgacgtcctcgagcggctggatccaaatcctgagtactgggaagggaaacgcggcgcatgcgtggggatcttccagatgatcattgccggcagggagcccaaggaaacgctacgagaggtgttgcatctgctccgatcaaccggaaatacgcaggtagaatacatgattagaattatgaaaaaatgggccaaagaaaacagagtgtccatctag

SEQ ID NO: 33934 - DNA, 2532 bp, Artificial Sequence
  Description of Artificial Sequence: Synthetic coding sequence
atgtggacgcctgaacttgccattctccgcggcttccccacagaggccgagagacaacaatggaagcaagagggagtcgtcgggtcggagagtggatcattcctgcagctattgctggaagggaattacgaagctatcttcctgaacagtatgactcagaacattttcaactccaccaccacagccgaagagaaaattgacagctacctggagaaacaggtcgtcacgttcctggattattcaacggatctcgataccacagagcgtcagcagctgatcttcctgctcggtgtaagttcccttcagctgttcgtgcagtcaaattggacaggacccccagtggatttgcacccccaagactttctttcaagtgtgctctttcagcaattttctgaagtaaagggcctggacgcctttgtactgagtctgttgactctcgacggcgagtccatttatagtctcacatcgaaacccattttacttctgctggcacgtataattctcgtgaacgtgagacataagctaacggctattcaatcgctaccttggtggaccttgaggtgtgtcaacattcatcagcatttgcttgaagagcggtcccctttactgtttaccttagccgaaaattgtattgaccaggtaatgaagttacaaaatctgtttgttgacgactccggtagatacttggcgattcagttccaccttgagtgcgcctacgtgtttctgtactactacgaataccgtaaagccaaggaccagctcgatatcgcaaaggacatcagccagctgcagattgatttgactggcgccctaggcaagagaaccagatttcaagagaactatgtggcgcagctgatcttggatgttcgcagagagggagatgtcctgtctaactgtgaatttacccccgcgcccactcctcaggagcacctcaccaagaaccttgagttaaacgatgacactatccttaacgatatcaaactggcggattgtgagcaattccaaatgcccgatctgtgtgccgaggaaatcgctatcattcttggaatctgcaccaacttccagaagaataacccagttcatactctgactgaggttgagctcctagcattcacttcttgtctcctatcccagccaaaattctgggccatccaaacatcagctctgatccttaggaccaaactcgaaaaaggaagcactcgccgagtagagcgagccatgaggcagacgcaagcactggccgatcaatttgaggacaaaactacctccgtcctggagaggttgaaaatcttctattgctgccaagtgcccccacattgggctatccaacgccagctggcatcccttctgttcgagttaggatgtacttccagtgccctacagatcttcgaaaagctggagatgtgggaagatgtggtgatctgttatgaacgggctggtcagcatggcaaagcagaagaaatcctccggcaggaactggagaagaaagagaccccaagcttatactgcctactgggggacgttctgggagatcatagttgctatgataaggcatgggagctgagtagatatcggtcggctcgcgcccagcggtcaaaagccctactgcatttgaggaacaaggagtttcaggagtgtgtggaatgcttcgagcggagcgtgaagatcaaccccatgcagctgggcgtgtggttttctcttggctgtgcttatctggcgctcgaagactatcagggctcagctaaggcctttcagagatgcgtgaccttggagcccgacaatgcagaggcctggaataacctctccacgtcatatatcaggcttaagcagaaagttaaggcattcagaacacttcaggaagcactgaaatgcaactatgaacattggcagatatgggagaactacattttaacatctactgacgtaggagagttttccgaggcaatcaaggcttatcaccgccttcttgatctccgggataagtataaggacgtacaggtcctgaaaatattggtgcgggcggtcatcgatggaatgaccgacagaagtggcgacgtcgctaccgggctgaagggcaaactgcaggaactgtttggcagggttaccagtagagtaactaacgacggggaaatctggagactgtacgcccatgtgtatggtaatggtcagagcgaaaagcccgacgagaacgaaaaggcatttcagtgtctgtctaaggcgtacaagtgtgacactcagagcaattgttgggaaaaggatattacctcttttaaagaagtggtacagcgagccctcggtctcgctcacgtcgccatcaaatgttctaaaaataagtcatcatcccaggaagcagtgcagatgttgtcgtccgttcggctgaaccttcgaggactgcttagcaaagccaaacagctattcactgatgtagcaactggagaaatgagccgtgagctggcagacgacattactgcgatggacaccctcgtgaccgagctccaggatctctcaaatcagttccgaaaccagtactag

SEQ ID NO: 33935 - DNA, 7446 bp, Artificial Sequence
  Description of Artificial Sequence: Synthetic coding sequence
atggaacagtctcccccgcccgcaccagagcctacccagggcccaactccagcgcgcagcagacgccgccgcgagccagaaagtccaccggcctctgctcccattcccttgtttggggccgacacaattggccagaggtcgcccgatgggcccgtgctatccaaagccgagttcgtagagaaagttcggcagtctaatcaggcctgtcacgatggcgacttccacaccgcaatcgtgttgtataatgaggctctggccgtcgatccacaaaattgtattttgtatagcaataggagcgccgcctatatgaaaatccagcagtacgataaagccttggacgacgcaataaaagcccgtctgcttaacccaaaatggcccaaagcttatttccgacagggagtcgccctccagtatctcggtagacacgctgacgctttggccgcattcgctagcggtctggctcaggatcctaaatccctgcaactgctggtgggaatggtcgaagccgcaatgaaaagccctatgcgcgattcccttgagccaacctaccagcagcttcaaaagatgaagctggacaaatccccctttgtggtggtatctgtggttggccaggagttgttaacggctgggcaccatggtgcaagcgtcgtcgtcctggaggccgcacttaagattggcacatgctccttaaagctgcgaggtagtgtttttagcgcactgtcgtctgcatattggagcctgggtaacaccgagaagagcacggggtatatgcagcaggacctggatgtggctaagactctcggcgaccagacaggagagtgtcgcgctcacggtaacctgggaagcgcctttttcagcaagggaaattatcgcgaggctctcaccaatcaccggcatcaacttgtgttagctatgaagctgaaagatagagaggcagcctcatcagctttgagtagcttgggtcacgtctatacggccattggagactacccgaatgctctcgcctctcacaaacagtgtgtgcttctcgccaagcagtccaaagacgaactttcagaggctagagaacttggcaacatgggtgcggtgtacatagctatgggcgatttcgagaacgccgtgcagtgtcacgagcagcatctcaagatcgcaaaagacttgggtaacaaacgcgaggaggctagagcgtattcaaatctgggctccgcctaccactataggcgcaattttgacaaggccatgagctatcacaattacgttctggaacttgcccaggagttaatggagaaggcgatcgagatgcgcgcatatgccgggctgggccatgctgcacgatgcatgcaggacttagagcgcgcaaaacagtatcacgaacagcagttgggaatcgctgaggacctgaaggacagggccgccgaaggccgcgcgagcagcaaccttggcatcattcatcagatgaagggagactatgacactgcccttaagctgcataagacacacctctgcatcgcacaagaactgtcagactacgcagcacaaggacgcgcttacggaaacatgggcaatgcgtataacgctcttgggatgtatgaccaggccgtgaagtatcatcgtcaagaactgcagattagcatggaagtaaacgacagggcatctcaagcctctacccacggcaacctggctgttgcctatcaggccctgggcgcccatgaccgggctctgcaacattatcagaaccacctgaatatcgctcgggagttaagggacattcagagtgaggccagggcgctgagtaacctagggaattttcactgctcccgtggagaatatgtacaggctgctccttattatgagcagtacctgaggctcgccccagacctgcaggatatggagggggaggggaaagtttgtcataatctgggatacgctcactactgcctcggaaactaccaggaggcggtgaagtattatgaacaggacctcgcgcttgctaaagatctgcatgacaaactgtcacaggccaaggcatattgtaacctcggcctagccttcaaggccctccttaacttctctaaagccgaggagtgccagaagtacctcctgtccttggcccagagcctgaacaactcgcaggccaaatttcgggccttgggcaatctgggcgacatttttatttgtaaaaaggacattaacggcgctatcaagttttatgaacagcagctcggccttgctcaccaggtcaaggacaggaggctggaagcctccgcatacgccgccctgggcacagcctaccggatgattcaaaagtatgacaaggccctgggataccatacacaggagctggaagtgtatcaggagcttagcgatttgcccggggaatgcagagcccacggacacttagccgccgtttatatggcgctcggtaaatatacaatggccttcaagtgttacgaggagcagctggacctaggacagaaactaaaagaccctagtctggaggcccaggtgtacggaaatatgggaattaccaaaatgaacatgaatgtcatggaggaggctattggctactttgagcagcaactcgccatgcttcagcagctcagcggaaatgaatccgtgctggaccggggaagggcatacgggaatttaggagattgttacgaggcactgggcgactatgaagaagccataaagtattacgagcagtatctctccgtggcgcaatccttgaatcggatgcaggatcaagctaaagcttatagggggctcggtaacggccacagggcaatgggttcgctgcagcaagccctggtgtgtttcgaaaaaaggctcgtggtggcccacgagctcggcgaggcctttaataaggcccaagcgtacggcgaactgggaagcctccacagccagttgggaaattacgagcaggccatcagctgtttagagaggcagctcaatatcgccagagacatgaaagaccgggccctagagtcggatgccgcctgcgggcttggcggggtctaccagcagatgggcgagtacgacactgctctgcagtatcaccagctggacctgcagattgctgaggagaccaacaatccgacatgtcaaggccgcgcttacggaaatctggggctgacatacgaatcattaggcaccttcgagagggccgtcgtgtaccaggaacagcatctgtcgatcgccgcacaaatgaatgatctcgccgcaaagaccgtctcatacagctctctgggccggactcaccacgccctgcagaactatagtcaagctgtcatgtacttacaggaggggctgcggttagccgaacaactggggaggagggaagacgaagcaaaaatccgccacggactgggcctttctctgtgggctagcggcaacctggaggaggcacaacatcagctttacagagcctccgctctgttcgagacgatacgccatgaggcacaattatccacggattacaaacttagtctgttcgacctgcagactagctcttaccaggccctgcagcgggtgttggtgtctttgggtcatcacgatgaggccctggcagtggcggaaagaggccgcacacgggcatttgctgatctgctcgtagaacgccagacaggccagcaagactcagacccatactctcctgtgacaatcgatcagatattggaaatggttaacggacaaaggggccttgtgctctattactcactggccgcagggtacctgtactcgtggttgcttgcacctggtgcgggcattgtgaagttccacgaacattatctgggtgagaatactgtggagaatagtagcgacttccaggcgagctcctcagtgacgctccccactgctacaggctcagcgttggagcagcatattgcctctgtgcgagaggcgttgggcgttgagtcccactatagccgagcctgtgcctctagcgaaaccgaatctgaggctggcgatattatggaccaacaattcgaagagatgaacaacaagctgaattctgtcacagatcccacgggatttctgagaatggttcggaggaacaatcttttcaaccgttcttgccagtccatgacatccctgttctctaacaccgtttctcccacccaggacggcacgagttcactgcctcgcaggcagtcttcctttgctaaacccccgctacgagcgctgtacgacctgctaattgcccccatggagggcggtttaatgcactcctctgggcccgtcggtcggcacagacaactgattcttgtgctggaaggagagttgtacttaattcctttcgccctgctcaagggatcctcgtccaacgaatatttgtatgaaagattcggccttctagctgtccccagcatccggagcctgagcgtgcagtcaaagtcccacctcaggaagaacccccccacttacagctccagcaccagtatggccgctgtgattgggaacccgaaactgccatccgccgtgatggacagatggctgtgggggcccatgccaagtgccgaagaagaagcctatatggtttcagagcttctgggttgccagcctctcgttggttcagtcgctacaaaagagagagtcatgtccgcgttgacccaggccgaatgcgtgcattttgccacccacattagctggaagctctcagctctggtgctcaccccttctatggatggaaaccctgcttcctctaagagcagcttcggacatccttacaccattcccgagagcctgagagttcaggacgacgctagtgatggtgaaagtatctctgactgccccccactgcaggagttactcctgactgctgcggacgttctcgacttacagctccccgtcaagctggtggtgcttggctccagccaagagtctaactctaaggtaactgccgacggggtgatagccttaacgagggctttcttagctgcaggtgcccagtgcgtgttggtttctttgtggcccgtgcctgtggctgccagtaaaatgttcattcatgctttctactcctctttactgaacggactgaaggccagcgcagctctcggagaggcaatgaaggtcgttcagagcagtaaggccttctcacacccctcaaattgggccgggttcatgctgatcggttctgacgtaaagctgaactcacccagctctctgatcggtcaggccttgacggaaattttgcagcatccagaacgcgccagagacgccttgcgtgtactgctgcacctcgtcgagaagagtctgcagcgaatccagaacggacaacgtaatgcgatgtacacctcccaacagagcgtggaaaacaaagtaggcgggattccaggatggcaagccttactcacggccgtaggatttagactggatccacccacaagtggccttccagctgctgtgttcttccctacaagcgaccctggcgaccggcttcagcagtgctcaagcacgctgcagagcttattgggtctcccaaatcccgcgttgcaggcgctgtgcaagcttatcacagcctcagagactggagagcagttgatctctagagccgttaaaaatatggtgggcatgctccaccaggtcctagtccagcttcaagccggagagaaggagcaggatctcgctagcgcaccaatccaggtttccatctccgtccagttgtggagactgccaggatgtcacgagttcctagctgccctgggcttcgatctctgtgaagtgggacaggaggaggtgatccttaagactggtaaacaggcaaatcgtcggacagtgcattttgccctgcaatcacttctttcactgtttgattctaccgagttgcccaagcgactgtccttagatagctctagcagcttggaaagcctcgctagcgcccagagcgtctccaacgcactgcccttggggtatcaacagccacccttcagtccaaccggtgccgactcaattgcaagcgatgctatttccgtgtactctcttagttccatcgcatcatctatgtctttcgtctcaaaaccagagggagggagtgaagggggcggacctggcggcaggcaggaccacgatcgtagtaaaaatgcctacctgcagcgcagcaccttgccacgctctcagctgcccccacagacaagacccgcgggcaataaagatgaagaggaatacgaggggtttagcataatctcgaatgaacctcttgcaacatatcaggagaatcggaatacctgtttctcccctgaccacaaacagcctcaacccggaacagccggaggcatgagggtatccgtaagctccaaaggctccatcagcacccccaactcaccggtcaagatgactttaattcccagtccaaacagtcccttccaaaaggtggggaagctagcgtcttccgataccggggagagtgaccagtcgtctaccgagaccgacagcaccgtgaagagccaggaggagagtaatcccaagctggatccccaggagctggcccagaaaatactggaggagactcagagtcacctgattgcggtggaaagactccagcgctctgggggccaggttagtaagagtaataatccagaagacggagtgcaggcccccagctcgacagccgtgttccgtgccagtgaaacaagtgccttcagtcgccctgtgctgtcccaccaaaaatcacagcccagcccagttactgtgaaacccaagccacccgccagatcttcatcactgccaaaagtcagttctgggtacagcagccccactacaagcgagatgtcaattaaggacagcccaagtcagcactccggtaggcccagtcccggttgcgacagccagaccagccaactggaccagccattgtttaagttgaagtatccctcttccccttacagcgcacacatttctaagtcaccgcgaaacatgagtccgtccagcgggcatcagtcaccagccggttctgcccccagcccagcactttcgtatagcagcgccggcagtgctcggtcttcccctgcggatgcccccgatatcgacaagctgaagatggcggcgattgatgagaaggtgcaggctgtgcacaatctcaagatgttttggcagtctacaccacagcactctacagggcccatgaaaatcttccgcggggcccctgggacgatgaccagcaagcgggacgtcctttctctgctgaatctgagtccccgtcacaataagaaggaagagggcgttgataaacttgaacttaaagagttgtccttgcagcagcacgacggcgctccacctaaagccccaccaaacggccattggcggactgaaactacatcactaggaagccttcccctccccgctggccccccagccacggccccagctcggcctcttcgcctgccgtcaggcaatggatacaaattcctcagccctggtcggtttttcccgagctccaagtgctag

SEQ ID NO: 33936 - DNA, 1428 bp, Artificial Sequence
  Description of Artificial Sequence: Synthetic coding sequence
atgaccaccctcccccctctgccaatgacgcgccccaaactcactgccctcgcaagacaaaagttaccttgttccagtaggaaaatccccagaagtcagctcataaaggagaaggatgacattgatcactacctggaagttaacttcaaggggctgtcaaaggaggaggtcgccgcttatcgaaactcctataagaaaaacatttgtgtggacatgctccgggacgggtaccataagtcgtttacggaactctttgctctcatggaaaggtgggatgcgctgcgggaggctgcccgggttagatcactgttctggttacagaaaccgctggaagaacagcctgataaactcgactacctctaccattacctgactagagcagaagatgccgagcggaaggaaagcttcgaagatgtgcacaataacctctacgctctagcctgttatttcaacaatagtgaggataagtgggtgagaaatcacttctatgagagatgtttcaagatcgcccagttgattaaaatcgactgtggcaaaaaggaggctgaggctcatatgcacatgggtctgctgtatgaagaagacggccagctcctggaggctgctgagcactacgaggctttccaccaattaacccaggggcgcatctggaaggacgaaaccgggcgctctttgaacctgctagcatgcgagtcccttcttagaacttataggctgctgagcgacaaaatgctggagaataaggaatacaagcaggcaataaagatcttgattaaggcctcagagattgccaaggagggcagtgacaagaaaatggaggcagaagctagttactacctgggccttgcccatctcgcagccgaggaatacgagactgctctcactgtcctggatacatactgcaagattagcacagatttagacgatgacctgtctctgggacgcggttacgaggccatcgccaaagtgcttcagtcacaaggggagatgactgaagctatcaaatacctgaaaaagttcgtgaagattgcccggaacaattttcagtcccttgatctggtccgggctagtacaatgctgggtgacatatataacgagaagggctattataacaaggccagcgaatgtttccaacaagcatttgatactaccgttgaactgatgtccatgcctctgatggatgaaacgaaggtgcactatggaatcgccaaggcccatcagatgatgttaaccgtcaacaattacattgaaagcgcagacctgaccagtttgaactacctgttgagctggaaggagtctaggggcaacatcgagcccgaccccgttaccgaggagttcagggggtccacagtcgaagccgtgagccagaactccgaaagacttgaggaactcagccgattccccggagaccagaaaaatgagacctag

SEQ ID NO: 33937 - DNA, 960 bp, Artificial Sequence
  Description of Artificial Sequence: Synthetic coding sequence
atgaccactctgccacccctgccaatgaccagacccaagctcacagcattagctaggcaaaaactcccctgctcctctaggaaaatcccgcgctcacaactgatcaaagaaaaagatgacattgaccactaccttgaagtgaatttcaaggggctgagcaaagaggaagtcgcagcttatagaaattcttacaagaagaatatatgcgttgacatgctaagggacgggtatcataagtcttttacggagctatttgctttaatggagagatgggatgccctacgcgaggccgccagagtgagatctttgttctggctgcagaaaccactggaagagcagccagacaaactagattacctgtaccattacttaactcgggctgaagatgctgagagaaaagagtcctttgaagatgtacacaacaatctgtatgccctagcatgttatttcaacaatagtgaagataaatgggttcggaatcatttctatgaaaggtgttttaagattgcacaactgatcaaaatagactgcggcaaaaaggaggccgaagcccacatgcacatgggcttgctgtacgaagaggacggacaacttctagaggccgctgaacattacgaagcctttcatcaacttacacagggccgcatttggaaagacgaaaccggaaggagcctgaacctgctagcgtgtgagtcgcttctgaggacttaccgactcttgagcgacaagatgctggagaataaagagtataaacaagcaatcaaaatcctgatcaaagctagcgagatcgccaaggagggatctgacaagaagatggaagcagaagcctcatactacttgggccttgcgcacttggcagccgaagaatacgagacagcactaactgtgttggatacatactgcaagtctcctcagacatggatgatgatatccgtgtggggagaggcgatgaagccctag

SEQ ID NO: 33938 - DNA, 1506 bp, Artificial Sequence
  Description of Artificial Sequence: Synthetic coding sequence
atgatccccatgttcacagtgactctcgaggacagtggtaccctttggaagagcctccacagcagctctgagtcggaaatgacgaccttgcccccccttcccatgacacggccaaagttgaccgcgctggcccgacaaaagctgccatgttcaagccgcaagatcccaaggagccaacttattaaggaaaaggacgacattgaccattacctggaggtgaatttcaagggactatctaaagaagaggtggccgcatatagaaactcctataaaaaaaacatctgtgtggatatgctgcgcgacggctaccacaaatcgtttacggagctattcgcattaatggaacgatgggacgccctccgggaagcagcaagggtgagatctctgttctggctccaaaaacctctagaggagcagccagacaagctcgactatttgtaccactatctcacccgcgcggaggatgcagagcgtaaggagtcatttgaagatgtgcacaacaatctttatgccctcgcctgctatttcaacaattcggaagataagtgggtgagaaaccacttttatgagcgctgcttcaagatagcccagcttattaagattgattgtgggaaaaaagaggcggaggcacatatgcatatgggccttctttacgaggaggacggccaactcctggaagctgcggagcactatgaggctttccaccagttgactcagggacgcatctggaaagacgaaactggaagaagcttgaaccttctggcctgtgaatcgctgctgcggacttatcgcctgctgtcagacaaaatgttagaaaacaaagaatacaaacaagcaattaagatcttgataaaggctagtgagattgctaaagagggctcagacaaaaagatggaagccgaggcatcgtactatctcggccttgcacacttagcagccgaggagtatgaaacggctctgaccgtgttagacacgtattgtaaaataagtacagatctcgatgacgatctgtcactgggccggggatacgaagccatcgccaaggtgctacagtcccagggggagatgacagaggctataaagtacctgaaaaaatttgtgaagatcgcccgaaataacttccagagcctggatttggtgagggcttcaacaatgctgggagacatctacaatgagaaaggatactacaacaaagcctcagaatgtttccagcaagcctttgacacaactgtagaattaatgtccatgccacttatggatgagacgaaggttcactatggaatcgccaaggcccaccaaatgatgcttaccgtaaacaattacatcgaaagcgcagacctgaccagtcttaactacctcctcagttggaaggagtcgagagggaatatcgagccagacccagtcacagaggaatttcggggttccaccgtcgaagctgtctctcagaacagcgagaggcttgaagaactctcaagatttcccggagaccagaagaatgaaacatag

SEQ ID NO: 33939 - DNA, 81 bp, Artificial Sequence
  Description of Artificial Sequence: Synthetic coding sequence
atgactactctacctccgctgcctatgacacgacctaagttgactgctcttgcaagacagaagttgccctgctcttcctag

SEQ ID NO: 33940 - DNA, 1425 bp, Artificial Sequence
  Description of Artificial Sequence: Synthetic coding sequence
atgaccacactgccaccattgcctatgactagaccaaaattaaccgctctcgctaggcagaagctcccctgttcaagcaggaagataccccgctcccagctcatcaaggagaaggacgatatcgaccattacttggaggtgaacttcaagggtctctctaaggaagaagtagccgcctaccggaattcctacaaaaaaaacatctgcgtggatatgctcagagacggctaccataaatccttcaccgaactcttcgccttaatggaaaggtgggatgcccttagagaggccgcaagggtgaggtctcttttctggttacagaagcccctggaagaacagcccgacaaactggattacctttaccactatttgacccgggctgaagatgccgaaagaaaagagagctttgaggacgtgcacaataacctgtacgctttagcttgttattttaacaattccgaggacaaatgggtccgcaatcacttttacgagcgatgcttcaaaatcgctcagctgatcaaaatcgactgtggcaagaaagaggctgaggcccacatgcacatgggattgttatacgaagaggatggtcagttgcttgaggccgctgaacattacgaggccttccatcagctcacacagggaagaatctggaaagatgaaactggtaggtctctaaatctgctcgcttgtgaatcacttctcagaacttaccgccttctgtctgataaaatgttggaaaataaggaatataaacaagccattaagatcctgattaaggccagcgagatagcaaaggaaggcagtgacaagaaaatggaagccgaggcatcctactatttaggtcttgcccatttggccgccgaggagtacgagacagccctgaccgtgttagacacgtactgtaagatttcaactgacctggacgacgacctgtctcttggtcgaggatatgaggctattgcaaaggtgcttcagtcacagggcgaaatgacggaagccatcaagtatcttaaaaagtttgtgaaaatagcgaggaataatttccagtcacttgatttggtacgagcatcaacaatgctaggggacatctacaatgagaaaggatattacaacaaggccagcgagtgttttcaacaggccttcgacaccaccgtcgaactcatgtctatgcctctaatggacgagaccaaagtgcactacgggattgccaaagcgcaccagatgatgctaactgttaacaactacatagagtccgccgacttaactagcctcaactacctgttaagctggaaggagtccagaggaaacatagagccagatcctgtgaccgagtttaggggcagcacagtggaagcagttagccagaattccgaacggttggaagaattatcccgctttcctggtgatcaaaagaacgaaacctag

SEQ ID NO: 33941 - DNA, 1506 bp, Artificial Sequence
  Description of Artificial Sequence: Synthetic coding sequence
atgatcccgatgtttactgtaactcttgaggactctggtactctgtggaagtccctccactcgagctcggaatcggaaatgaccactctgccaccgttacccatgactaggccaaaactcaccgccctggccagacagaagctgccttgctcatctcgcaaaattcccagaagccaattgattaaggaaaaggacgacatagaccactatctggaggtaaactttaaaggtttgtcaaaggaggaagtagccgcctatcgaaattcctataaaaagaatatctgcgtggatatgttgagggacgggtaccacaagagttttacggaactgttcgccctgatggagcggtgggacgcgctgcgcgaagcggcccgtgtgaggtctctgttttggttgcaaaaacctttggaagagcagccagacaagctcgactacctgtatcactacctaacacgagctgaggatgcagagagaaaagagagctttgaggatgtgcacaacaatctgtacgcgctggcctgctactttaacaacagcgaagacaagtgggtccgtaaccacttttatgaacggtgtttcaagatcgctcaacttataaaaatagattgcggaaagaaagaagctgaagcccacatgcacatggggctcctctacgaggaggacggtcaactgctagaggcagctgagcactacgaagccttccaccagttgacgcaagggcgaatttggaaagacgagaccggccgcagtctgaatctgttagcctgtgaaagccttctgcgcacttatcgcttgctcagtgataaaatgttggaaaataaagagtacaagcaggcgatcaaaatccttatcaaggcttccgaaatcgctaaggagggatctgataaaaagatggaggctgaggcttcctactacttgggcttggcacacctggccgcggaagagtacgaaaccgcactgacagtcctggacacttactgtaagatatccactgatttggatgacgatctttcgctcggtagaggatatgaggccatcgccaaggttttacagtctcagggcgaaatgactgaggccataaaatacttaaaaaaatttgtgaaaattgcacgaaacaattttcagagcctcgacctggtccgcgcctctacaatgctcggcgatatctataacgagaaaggctactataataaagccagcgagtgtttccagcaggccttcgacacaaccgtggaactaatgagtatgcctttaatggatgagacaaaggtgcactacggaattgcgaaggctcatcagatgatgctcactgtgaacaactacatcgagagtgcggatctgactagcctcaattacctgctgagttggaaagaatcgcggggcaatattgaacccgaccctgtcacagaggagttcagagggtccactgtcgaggctgtgtctcagaattccgaacgcctggaggagttgtccagatttccgggggaccagaagaatgagacctag

SEQ ID NO: 33942 - DNA, 282 bp, Artificial Sequence
  Description of Artificial Sequence: Synthetic coding sequence
atgattcctatgtttacggttacattagaggactctgggacactgtggaagtccttgcacagttctagtgagtctgaaatgacaactttacccccacttcctatgaccaggcccaagctcactgcgcttgccaggcagaagctcccatgcagctctcgcaaaataccaagaagtcagttgattaaggagaaggatgacattgaccactacctggaggtaaactttaagggactgtcgaaagaagaggttgctgcttaccggaatagttataaaaagaactag

SEQ ID NO: 33943 - DNA, 1998 bp, Artificial Sequence
  Description of Artificial Sequence: Synthetic coding sequence
atggccggtctgtcgggtgcccagattccagacggtgagttcaccgccctcgtgtatagactaatcagagacgctcgctacgccgaggcagtccagctactgggccgggaacttcaaaggagccccagatcccgagccggtctttccctcctcgggtactgctattacagactgcaagagtttgctctggcggccgagtgctacgagcagctcggacagctccatcccgaactcgagcagtacaggctatatcaggcccaggctctatacaaagcctgcctgtaccctgaggccacccgagtcgcattcctcctactagacaatccagcctaccattcaagggtgctgcggcttcaggctgctatcaagtacagcgaaggagacctacctggctcgcgctccctggtcgagcagctgctgtccggcgagggcggggaggaatctggcggggataatgagactgatggccaggtgaacctgggctgcctcctgtacaaggaggggcagtatgaagcagcctgttcgaaattttcagctacattgcaagcttccggctatcagcccgatctctcctacaatctggccctagcgtactactcatcgaggcagtacgccagtgctctgaaacacatcgctgaaattatcgagcgtggcattcgccagcatcccgaacttggagtgggcatgacaaccgagggcttcgacgtcaggagcgtcggtaacacactcgttctacatcagacggcactggtagaggccttcaacctaaaggccgccattgagtaccagctgcggaactatgaagttgcccaggagacactgaccgacatgccccctagagcagaggaggagctagatcccgtcaccctgcacaaccaggcgttgatgaacatggacgcccggcccaccgaaggattcgagaaactacagttcctgctgcagcaaaaccctttccctcccgaaacctttggcaacctgctgctactctattgtaaatatgaatatttcgatttggcagccgatgtcttggccgagaacgcgcacctgacatacaagttccttacaccctacctgtacgactttcttgacgctctgattacctgccaaacagccccagaggaagcttttattaagctcgacggcctggccggcatgctgactgaacaactccggagactaacaaaacaggtgcaagaggctaggcataatagggacgatgaagctatcaagaaggccgtaaatgagtatgacgaaactatggagaagtatatcccagtgctcatggcccaggcgaagatttactggaacctggagaactaccctatggttgagaaggtcttccgcaaaagcgtcgagttttgtaatgatcatgacgtatggaagctgaatgttgcgcatgtgctgttcatgcaggagaacaaatataaggaagctattggcttctatgaaccgattgttaaaaagcactatgataacattctgaacgtcagcgctatcgtgctcgcaaatctatgcgtttcctacataatgacttcccagaacgaagaggcggaagagctaatgaggaaaatagagaaagaagaggaacagctgagctacgacgaccccaataggaaaatgtaccatctttgtattgtgaacctggtcatcgggacattgtattgtgcgaagggaaattatgaatttggcatctccagagtgattaagagtctcgaaccctataataaaaagttaggtactgacacatggtactatgctaagagatgctttctttctctgcttgagaatatgtccaaacacatgatcgtgatccatgactctgttattcaggagtgtgttcaatttctcggtcattgcgagttatacgggaccaacatccccgctgttatagagcagcctttggaagaggagagaatgcacgtcgggaagaacaccgtaacggacgaaagtaggcaactgaaagcgctgatctacgagattatcggatggaataaatag

SEQ ID NO: 33944 - DNA, 381 bp, Artificial Sequence
  Description of Artificial Sequence: Synthetic coding sequence
atgtaccacctgtgcatcgtaaatttggtgatcggaaccctttactgtgctaagggcaactatgagttcggcatttcaagggtgataaagtcactggaaccatataataaaaagctgggcactgacacttggtattacgctaagcggtgtttcctgtcactcctcgagaacatgtctaagcacatgatcgtcatccacgactcagtaatccaggagtgtgtccagttcctaggacactgcgagctctacgggacaaacatccctgctgttatagaacagcctctcgaggaagagcggatgcacgtcggaaagaacacagtgactgacgaatcccggcagcttaaggcattgatctacgagatcatcgggtggaataaatag

SEQ ID NO: 33945 - DNA, 1998 bp, Artificial Sequence
  Description of Artificial Sequence: Synthetic coding sequence
atggctggcctctcaggagcccaaatccctgacggcgagtttacagccgtggtgtatagattaatccgcaacgccaggtatgccgaagcggttcagttgctcggcggtgagctgcagcgctcccctagatctagggccggactgagcctgcttggatattgctattataggctgcaggagttcgccctggctgctgagtgctacgagcagctgggccagctgcaccccgagttagagcagtataggctgtaccaggcccaggcactttacaaggcttgcctgtatgctgaagcaactcgagtggcattcctgctgctagataatccagcataccattctcgggtgctgcgactacaggctgccataaaatattccgaaggagacctccctggaagtcgctcactggtggagcagctaccgagccgggaagggggggaggagtcgggtggcgagaacgaaaccgatggacagatcaatctcggatgtctgctgtataaagagggccagtacgaggccgcttgctcaaagttttttgcagctttgcaagcttccggataccagcccgatctaagctataacctcgccctggcctattacagcagtagacagtacgcctccgccctgaaacacatcgctgaaatcattgagagggggatcagacagcacccggagctaggagtgggcatgactaccgaaggtatcgatgtgagatctgtgggcaatactttagtcctgcatcaaactgccctcgttgaagcttttaacctgaaggccgcaatcgagtatcaactgagaaattacgaagcggctcaggaagcgctgacagacatgcctccacgagcagaggaagagctagatcccgtgaccctccacaaccaggctctaatgaacatggacgctcgccccacggagggtttcgaaaaactgcaatttctgctccaacagaatccttttccccccgagacatttggcaacctgctgcttctatactgcaagtatgagtacttcgacctagcagccgatgtgctcgcagaaaacgcacatctcatctacaaatttttgactccttacctgtatgattttctcgacgctgttatcacttgccagactgcccccgaggaagcattcatcaagttagatggactggctgggatgctgaccgaagtcctccggaaactgactatacaagtgcaggaagctcgccacaacagggatgatgaagcaatcaagaaagctgtgaacgagtatgacgagacaatggagaagtacatcccagtccttatggcccaggccaagatctactggaatctggagaattaccctatggtggagaagatatttcggaaaagcgtcgagttctgcaatgaccacgatgtatggaaactcaacgtggcccatgttctgttcatgcaggaaaataaatataaggaagccattggtttctatgagccaatcgtgaagaaacattacgataacattctgaacgtgtccgctatagtgctggccaacctctgtgtcagctatatcatgacctcacaaaacgaagaggccgaagaattgatgagaaaaatcgaaaaagaggaggagcaactatcctacgatgatcctgacaagaagatgtatcacctctgtatcgtaaatttagttatcggcactctgtattgcgctaagggaaactacgactttgggatctcgcgagtgatcaagagtctggagccctataacaaaaaacttgggaccgacacttggtactatgcgaaaagatgcttcttatccttgctggaaaatatgagcaaacacacgattatgctgcgggattctgtcatacaggaatgtgtccagtttctcgaacactgcgagctgcatggccgaaacattcccgccgtgatcgagcagccgctggaggaagaaaggatgcatgtgggcaaaaatacggtgacctatgaatctaggcagctgaaagcgctgatctatgagatcattggctggaatatctag

SEQ ID NO: 33946 - DNA, 1857 bp, Artificial Sequence
  Description of Artificial Sequence: Synthetic coding sequence
atggccggcctgtccggcgcacagatccccgatggggaattcgccttagctgccgaatgctacgagcagctgggtcagctccaccccgaattggagcagtacaggttataccaagcacaggcgctatataaagcctgcctttatgctgaggctacacgcgtcgcctttctgctgcttgacaacccagcttaccactctagggtcctcaggctacaggcggcgattaagtattcagaaggcgacttgcctggtagcaggtccctggtagaacaactgccgagtagagaggggggagaagagagcggcggtgaaaacgagacagacggacagatcaacctcggatgtctgctatataaggagggacagtatgaggccgcttgttctaaattttttgctgcccttcaggccagcggataccagccagatctgagctataatctggctctcgcatactactcaagccggcagtacgcatccgccctgaagcatatcgcagaaatcatagagcgcggtatacggcagcaccctgaattaggagtgggcatgacaactgagggcatcgacgttcggtcagtcggcaataccctagtgcttcatcagactgcacttgttgaggccttcaatctaaaggccgcaatagagtaccagctccgaaattacgaagctgctcaggaggccctcaccgacatgccccctagggcagaggaagagctcgatcccgtgaccctgcacaaccaagcattgatgaatatggacgcccgacccactgaagggtttgagaagctgcaattcctgctgcagcaaaacccatttccgccagagactttcggcaacctgctccttctctactgtaaatatgagtacttcgacttagctgctgacgtgttggcagagaatgctcatctaatctataagtttttgacgccgtacctgtatgacttccttgatgcagtgatcacttgccagaccgcaccagaggaagccttcataaagctggatggtttagccgggatgctgacagaggtgctgcgaaaacttacaatacaggtccaggaagcaagacataatcgcgatgacgaggcaattaaaaaagccgttaatgagtatgacgaaacaatggaaaaatacatccctgtgctgatggcccaggccaagatttattggaacctagagaactaccctatggtggaaaagatttttcgcaagtccgtcgaattctgtaacgaccatgatgtgtggaagttgaatgtagctcacgtcttattcatgcaagagaacaagtacaaggaagcaatcggattctacgaaccaatagtgaaaaaacattatgacaacattttaaacgttagtgcgattgtccttgccaatctgtgcgtgtcttatatcatgaccagccagaatgaggaggccgaagaacttatgagaaaaatcgagaaagaagaggaacagctgagttacgacgatcccgacaaaaagatgtaccacctgtgcattgtaaacttggtgataggtacattgtattgtgcgaagggcaactacgatttcggtatcagcagggtaatcaaatcactggaaccatacaataagaagctgggaaccgatacttggtactacgccaaacgttgttttttgagtctgctggagaacatgtcaaagcatacgatcatgcttagggacagtgtgatccaggaatgcgtgcagttcctggaacattgtgagctgcatggaaggaatattcccgctgtgatcgaacagcccctcgaggaggaaaggatgcatgtcggaaaaaatactgtgacatacgagtccaggcagttaaaagctttgatatatgaaatcatcggatggaatatttag

SEQ ID NO: 33947 - DNA, 468 bp, Artificial Sequence
  Description of Artificial Sequence: Synthetic coding sequence
atggcacctattcccaagaccgttggtcgtataaaactcgactgtagcctacgtccatcgtgtcctctggaagtcgcagctgctcctaaattgtgtaaagagttcggcccggaggactacggggaagaggacatcgtggactttttacgacgcctggtggaatctgatcctcaaggtcttcataggattcatgtggatgggtcgagcggacgacttcagttatggcaccacgactacctcctgggccacttagacgatgaaggtaaatccacaggacagagcgatcgcggcaagggcgccgagggcctcggcacctactgtgggctgcgaaaaagttttctgtatcccccctttcctcaggtcccgtccaagcactgttttgaggtgccctggcccgtcagtactttagcactgagtttcatgtccccgaagccaccacagcccgctccattgccggactcagagtag

SEQ ID NO: 33948 - DNA, 858 bp, Artificial Sequence
  Description of Artificial Sequence: Synthetic coding sequence
atggccccgattccaaaaaccgttggcagaatcaaactggactgctccctgcgcccctcgtgccccctcgaggtggcagctgcccctaaactctgtaaagagttcgggcccgaagattacggtgaggaagacattgtcgactttcttaggcgacttgtggagtctgatccccaggggctgcacagaattcacgtggacggcagttctggccgtctgcagctgtggcaccacgactatctgttgggtcacctcgacgacgaaggtaaatccactggacagagcgaccggggaaaaggtgccgagggcctgggtacgtactgcggactgcggaaatcctttctttaccccccccaggaatccgagccttgcccacagtcaccttctgccagcgccacattcccatcagttagtgattccctgctccaggtggctatgcctcagaagctgttagtcactgaagaagaagccaatcggctggccgaggagctggtcgccgaggaggagagaatgaaacagaaggctgagaagaaacggttgaagaaaaaacgtcagaaggagcgaaaaaggcaggagaggttagaacagtattgtggcgaacccaaagcaagcaccacttcagatggggatgagtcaccaccttcttcgccagggaacccggtgcagggccagtgtggcgaggaagaggactcactggatttatccagtaccttcgttagcctggctctacgcaaagtgggagattggcccctgtccgcccgtcgagagaagggtctgaatcaagaaccgcagggaagaggtctcgccctacagaaaatgggccaggaggaagagtcaccacccaccacatctccttgttag

SEQ ID NO: 33949 - DNA, 603 bp, Artificial Sequence
  Description of Artificial Sequence: Synthetic coding sequence
atgcctcagaagcttctggtaaccgaggaggaagccaatcggctagcagaggaactggtggcagaggaggagcgaatgaaacaaaaagccgagaaaaaacggctcaagaagaagaggcagaaggagcgcaaacggcaggagcggctcgaacagtactgtggggagcctaaggcgagcaccacgtccgacggagatgagtctcccccctccagcccgggcaatcctgttcagggacagtgcggggaggaagaagattctctggatctctcgtctacttttgtctcactagcactgagaaaagtgggggattggcccctttcggcaagacgcgagaaaggactgaatcaggaacctcagggtaggggacctctcgcctgcctccattcctgtatcatcttgcacgtgaccgaggctacccccacctcccccagtccccggctcagagttgagggtcccatcctctcgtctccgagaaccctgcagcgcgcagggacttcttgggacctggggtcaagtatttgtctgaggccggatgagggcgcacctgttccacacagagctgggccttgcatttaccctctggtcggtgacatcgtctggtag

SEQ ID NO: 33950 - DNA, 741 bp, Artificial Sequence
  Description of Artificial Sequence: Synthetic coding sequence
atgccgttgagaatcttggactacctgttgggccatctggacgatgagggaaagtcaacaggccagagtgaccgcggaaaaggagccgagggattaggcacgtattgtgggcttcggaaatccttcctttacccacctcaggaatcagagccttgtccacaatctccctctgcgagtgcgacgtttccatccgtgtctgatagcttacttcaagtagccatgccacagaaactgcttgtgaccgaggaagaagcaaatcggctggcggaggaactggtggccgaggaggaacggatgaagcagaaggcggagaagaagcggttgaaaaagaaaaggcagaaggagcgtaagcggcaggagaggctggaacagtactgcggcgagccgaaagcgagtacaacctcagacggagatgagtcgcccccgtccagtcccggcaaccctgttcaggggcaatgtggtgaggaagaagattccctggacttaagtagcacatttgtaagcctggcgcttcgaaaggttggggactggcccctgtccgcaagacgcgaaaagggcttgaatcaagagccccaggggaggggcctcgctctccaaaagatgggtcaagaggaggaatctccgccacgcgaagagcgcccccagcaatcccccaaggtgcaggtgagatggctgaagaatctgatccagttagagccgtggaagggacataaggaactgttagggaggcacagggtgtag

SEQ ID NO: 33951 - DNA, 2514 bp, Artificial Sequence
  Description of Artificial Sequence: Synthetic coding sequence
atggcccggggagaaagacgcagacgagccgtgccagctgagggggtgcgcaccgcggagagggccgccaggggtggtccgggccgccgcgacggtcggggcggtggcccaagatctacagctggaggcgtcgcactggccgtagtcgtcctaagtcttgctctgggaatgtctggccggtgggtactcgcctggtatcgcgctaggagggctgttaccttgcactcggcaccccctgtgctcccagccgattccagttcaccagctgtggcgcccgatctcttttggggcacataccgtccccacgtctatttcggtatgaagacccgttccccaaagccgctgttaactggactgatgtgggcgcagcagggcacaacacccggcaccccaaagctgcgccacacctgtgagcagggagacggagttggaccctacggatgggagttccatgacggcctctctttcggtcgacagcatattcaggacggggccctccgcttaaccactgagttcgttaagagacccgggggacagcacgggggggattggtcatggagagttacagtggaaccccaggattccggcacctctgctttacccttggtatcactgtttttctatgtcgtgactgacggcaaagaggtcctgttaccagaagtcggtgccaaaggtcaattgaagtttatctccggacatacctccgagctaggagacttccgttttacgttgctaccgcccaccagccccggagacaccgctcccaagtacgggtcatataacgtgttttggacctcgaacccaggtctccctctgttaacagagatggtaaaatcccgccttaacagctggttccagcatcgtccacccggagcccctccagagaggtatcttggcctgcccggctcactgaagtgggaggatcgcggaccatctggccaaggacagggtcagttcctcattcagcaggtgacgctcaagatccctatatctattgagttcgtgttcgaaagtggcagtgctcaggctggagggaaccaggcgctcccgcgcctggcagggtccttactgacccaggccctcgaatctcacgcagaaggattccgggagaggttcgagaagacattccagctgaaagaaaagggactgtcatccggggaacaggtgctcggacaggcggcactatctggtcttctggggggcatcggctatttctatggacagggcttggtactaccggacattggggtggaggggagcgagcagaaggttgatccggctctttttcctccagtacctttgttcacagcagttccttccagatccttctttcccagaggatttttgtgggacgagggattccatcagctggtcgtgcaacggtgggatcctagcctcacacgcgaggcactgggacactggttgggactgctgaacgcggatgggtggatcggccgagagcagattctgggagacgaagcccgggcgagggttcctccagagttcttggttcagcgggctgtgcatgcaaaccccccgaccctactcttgcccgtcgctcatatgctggaagtgggcgaccccgatgatcttgcttttctcagaaaggctctacccagattgcacgcatggttcagctggctccaccagtcgcaggccggtccattacctcttagttatcgctggcgggggcgtgatccggctctgcccacgctgctaaaccctaagaccttgccaagtgggctggatgactacccgcgggctagccacccttccgtgactgagcgtcacctcgatttgcgctgttgggttgcgctgggtgctcgggtcttgactcgccttgctgagcatttgggcgaggcagaagttgcggctgagctggggccactggcagccagtctggaagctgccgaatcactggatgaacttcactgggccccggagctcggcgtgtttgctgactttggtaaccacacaaaggctgttcagctgaaacctagacccccccaaggccttgtacgcgtggtgggccggccacagccacagcttcagtacgtggacgcattgggttacgtgtcattgtttcccctgcttctccgtttactggatcccacttcttctaggctcgggcctctgttggacatcctggccgactctcgacatttgtggtccccttttggtttgcgtagccttgctgcgagctcctcgttttatgggcagcgcaacagcgagcatgatcccccgtattggcgaggggctgtgtggcttaacgtgaattacctggccttgggcgccctgcatcactacgggcatctggaggggccgcaccaggctcgtgctgcaaaattgcatggggaactcagagccaacgtcgtgggcaacgtgtggcgccagtatcaggcgaccggattcctatgggagcagtatagcgaccgggatggtaggggaatgggctgtaggccattccacggatggacttccctggtgttgctggctatggctgaggattactag

SEQ ID NO: 33952 - DNA, 456 bp, Artificial Sequence
  Description of Artificial Sequence: Synthetic coding sequence
atggagggccagcggcaagaatcacatgccaccctaaccctggcacaggcgcactttaacaacggagagtatgccgaagcggaagcattgtatagcgcctacattcggagatgcgcttgcgcggcctcgtccgacgaaagccctggttccaagtgtagccctgaagatctagccactgcttacaacaacaggggacagatcaagtactttcgggtcgatttttacgaggcaatggatgattacacaagcgcgatcgaggtacagcctaactttgaagtcccttactataatcggggcctaatcctgtaccgtctgggctacttcgatgatgctctcgaagacttcaaaaaagtgttagatttaaaccccggattccaggatgcaacattgagcctcaagcagacaattctagataaagaggagaagcagcggcgcaacgtcgccaagaattactag

SEQ ID NO: 33953 - DNA, 789 bp, Artificial Sequence
  Description of Artificial Sequence: Synthetic coding sequence
atggcgagcttcggctggaagcgcaagattggcgaaaaggtctcgaaagtgacaagtcaacagtttgaagctgaggccgcggacgaaaaagacgtggtggataacgatgagggaaattggcttcatgcaatcaaacgtcggaaagagatcctgttggagggatgtgccgagaagagcaagcagttgaaggacgaaggagctagcctggcggagaacaagcgctaccgggaagctattcagaagtgggacgaggctcttcagttgacacccaacgatgccaccctctacgaaatgaaatcccaggtcttgatgagtctgcatgagatgtttccagccgtacacgccgcagagatggcagtgcaacagaatccacacagttgggagtcctggcagactctgggccgtgcccaattgggcttaggagaaatcatccttgcaatcagatctttccaagtcgccctgcatatatacccaatgaacccggaaatctggaaggaagacttatcctgggctaggacactgcaggaacaacagaaagtggctcagcgcatcaagaagtccgaggcccccgcggaagtgacccatttttccccaaagagtatccccgactatgactttgagagcgatgaaattgttgccgtctgcgcagccattgccgaaaaggagaaaacggtgagcgcaaacaagaccatggtgatcgtttcagcttccggagctatcgagaccgtaaccgaaaaagaagacggcgcaactcctcccgacggttccgtcttcattaaagctcggtag

SEQ ID NO: 33954 - DNA, 1701 bp, Artificial Sequence
  Description of Artificial Sequence: Synthetic coding sequence
atgctacagcggagccctcgagccggcccgagtcgagcacagggccgcagggaggcagctgagacggggggtccaacgacacaggagggggtcgcatgcggggtgcatcagctggcaacattgcttatggagcttgactcagaggacgaggcctccaggctgcttgctgccgacgccctgtatcggctgggcaggctggaggagactcataaagcactgcttgttgcgctgtctagaagaccccaggctgcccctgtcctggccaggctggcactcctacagctccgacgcggtttcttctacgacgctaaccaactagtcaagaagctggttcagtctggagatacagcatgcctgcaaccgacattggatgtgttttgtcacgaggacagacagttgctccagggccactgtcacgcgagagctctggccatcctgcgagctcggcctggcggagctgatgggcgtgttcacaccaaggaagcaatcgcatacctgagcctggccatctttgcagctggctctcaagccagtgagtccttactggcccgggcccgatgctatggcttcctggggcaaaagaaaacagctatgttcgacttcaacaccgtgttgagggcggagcccgggaacgtgcaagcactgtgcgggcgagcgctggtccatctggctttagatcaactccaagaggccgtggacgatatcgtaagcgctctcaaactcggccccgggacagttgtccccgagctgcggtccctcaaacctgaggcacaggcacttattacccagggcctgtactcacactgtcgggccctactctctcagctccccgatacaggcgcccccctggaagataaggacactcagggtttacttgcggtgggtgaagcattaattaagatagacagtggccaaccccactggcacctactgttagccgatatactcatggcacaagggagctacgaagaggcgggcacgcaccttgagaaggccctccatagagccccgacttctgaggctgctagggccagattgggtctgcttcagctgaagaagggtgacgtgcctggggctgccagggaccttcagagtttagcagaggtggacgccccagacttgagctgtcttctgcatttactggaggcgtccgaaaggcaatcactggcccaggctgccgcgcaggaggcgggcaccttactggacgcaggtcagccccgacaggcactgggctattgcagtctgtctgtactggcttctggatcgagcgcctgtcacttacggcttagagccacgtgcctggcagagctgcaggaattcggccgcgcacttcgagatctagaccacgtattgcaagaagccttaggagacggcgatcttccccgacgagcagaagacttttgcagacagggccgccttttattgagccttggggacgaagctgcggcagcaggagctttcgcccaggccctgaaattagctccctcccttgcccagaattctttatgcagacagcccggccgggcacctacagcccgtatgttcttgttgagaggccagtgttgcctggaagagcagcgccatgcagaggcctggacggcagtcgagtccggactgctggtcgaccctgaccaccgggggttaaagcgccttaaggcgagaatccggcgtgaggctagcagtgggtgctggctgcagtag

SEQ ID NO: 33955 - DNA, 570 bp, Artificial Sequence
  Description of Artificial Sequence: Synthetic coding sequence
atgggtactcccaatgaccaggccgtcctgcaggcgattttcaaccccgatacccccttcggtgacatcgtgggcctcgatctaggagaggaggccgaaaaggaggagagggaagaggacgaagtgttccctcaggctcagctggagcagagcaaggccctagagctgcagggcgtgatggccgcagaagctggggatctctccaccgcattggagaggtttggccaagccatctgtctgcttcccgagcgggcttctgcctataacaatcgagcccaggcccgccgcctgcagggagatgttgctggcgctttagaggacctagagagggctgtcgagctttctggtggacgaggccgggccgcccgacaaagcttcgtccagagggggctgctggcccggttgcagggccgggatgatgacgcccggcgcgatttcgaacgtgccgcacgcctgggttccccatttgccagaaggcagctagtgttgctcaacccttatgccgctctctgcaatcgtatgcttgcggatatgatggggcagctccgacggccacgggatagtaggtag

SEQ ID NO: 33956 - DNA, 393 bp, Artificial Sequence
  Description of Artificial Sequence: Synthetic coding sequence
atggccgctgaggccggggacctgagtacggctttggaacgctttgggcaggctatctgccttctgcccgaacgcgcctccgcttataataaccgggctcaagcacggaggctacagggagatgtggctggcgcactggaagatctcgaaagggccgtcgaactctctggtggaaggggtagagcagcacgccagtcattcgtacaaaggggtctcctcgcaagactgcagggccgggacgacgatgctagacgcgattttgagcgggctgcacgtctcggtagtcccttcgctcgacggcagctggtcctgctcaatccatatgcagccttgtgcaaccgcatgctggccgacatgatgggccagctgcggcgccccagggactccaggtag

SEQ ID NO: 33957 - DNA, 4695 bp, Artificial Sequence
  Description of Artificial Sequence: Synthetic coding sequence
atgagctccaaagaagtcaagaccgcattgaaatcagccagggacgccatcagaaataaagaatataaagaagcgttaaagcattgcaaaacagtgctgaagcaggaaaagaacaactataacgcctgggttttcatcggtgtagccgccgccgagctcgagcagcccgatcaggcccagtccgcatataagaaagcagccgaactggagccagaccagcttctggcctggcaagggttggctaatctatacgaaaaatataatcacattaatgccaaagatgatctgccgggcgtgtaccagaaattgctggacctgtacgagagcgtcgacaagcagaaatggtgcgatgtgtgtaaaaagctggttgacttgtactaccaggagaagaagcatcttgaggtggctcgcacctggcataaactcatcaaaacccgacaggaacaaggcgcagagaacgaagagctgcatcaactgtggagaaaactgactcaattcctagctgagagtacagaagaccagaataacgaaacacagcagctgctgttcacggctttcgaaaacgcactgggtctcagcgacaaaataccaagcgaagaccatcaggtgctgtacagacacttcattcagagcctgtccaaattcccacacgagagtgcccgcttgaagaaagcgtgtgaaggaatgattaacatctatcctacagttcagtatcctctagaggtgctctgcctgcatctgattgaaagtggaaatttgacagacgaaggccagcagtattgttgccggctcgtggagatggattccaaatctgggcctgggctgattggcttaggaattaaggccttgcaggataaaaaatacgaggatgccgtaaggaacctcaccgaaggcttgaaggaatcaccagtgtgcacctcaggatggtaccatctggcagaagctcaggttaaaatgcatcgaccgaaggaggctgtgttgtcttgttctcaggcccttaagattgtggacaatctgggggcttcaggaaacagtctctaccaaagaaatctgtgcttacacctgaaagccgaggctcttattaaactgtctgattacgactccagtgaagaggccataagaactcttgatcagatttcagacgcagataatattcccggactattggtgctgaagagtctcgcataccgaaacaaaggctccttcgacgaggcggcgaagataatggaggacctcctttcaagttatcccgacctcgctgaagtgcatgccctggaggcactgattcattttactaagaaggactacctccaggcagagaagtgttttcaacgcgccctggaaaaggatactgaggttgccgaataccactaccagttaggtctaacatactggttcatgggagaggagacccgaaaggataaaacaaaagcactgacacactttttgaaagccgccagactagacacctacatgggcaaggtgttttgttatctgggtcactattacagagacgtcgtcggcgataaaaatagggcccgcggctgttaccggaaggcttttgaactggatgacaccgatgcggagtcaggtgctgctgccgtggatctctctgttgaactcgaagatatggagatggccttggcaatactgacaaccgttacacagaaggcctccgctggcaccgcgaagtgggcctggctgcgacgaggcctatactatctgaaagccgggcagcactcgcaggcagttgcagatttgcaggccgccctgagggccgacccaaaggacttcaactgctgggaatcattgggtgaggcctacctgtcccgtggcggatacaccacagccctgaagtcttttacgaaggccagcgaattaaaccccgaaagtatctactccgtctttaaggtggccgcaattcagcagatactgggaaagtataaggaggcagttgcccagtaccagatgattattaagaaaaaggaggactacgtgccagcactgaagggtctcggtgaatgccatctaatgatggcaaaagctgcactcgtcgattatctcgatgggaaggccgtggactacattgagaaggccctcgaatattttacttgcgccctccaacacagggccgatgtgtcttgtctgtggaagctcgccggcgatgcctgtacctgcctctacgcagtagcaccctccaaagtgaatgttcacgtgcttggcgtccttctggggcagaaggaaggaaaacaggtactaaaaaagaacgaactcttacaccttggggggcgctgctacggtagggcactcaagttgatgagtaccagcaatacctggtgtgatcttggcattaactactacagacaggcccagcacctggctgagaccggcagcaatatgaatgatctcaaggaattgttagaaaaaagcttgcactgtttgaagaaggccgtccgcctagatagcaataaccatctttattggaacgccctgggcgtggttgcgtgttactctggcatcggcaactacgccctggcacagcactgtttcataaaatccattcaaagcgaacagatcaatgcagtggcctggacgaacctgggcgtgctgtatctcactaatgagaatatcgagcaggcccatgaagccttcaagatggcgcagagtctggacccctcttatctgatgtgttggattggccaggccctcatagctgaggccgtcgggagttatgataccatggatttattcaggcacacgacggaattgaatatgcatacagagggcgcactcggttacgcttattgggtctgtactacgctgcaagataagtccaacagagaaacagagttgtaccagtacaatatcctgcagatgaacgcgatacccgccgcccaggtaatactaaacaaatatgtcgagcgtatacagaactatgctccagcattcacaatgcttgggtacttgaatgagcatttacagctcaagaaggaggccgccaatgcataccaaagagcaatcctgctgcttcagacagctgaagaccaggacacatacaatgtagcgattaggaattacggcagacttctgtgcagcacaggcgaatatgataaggcaatacaggcctttaagtctaccccacttgaggttcttgaggacatcatcggatttgcattagcattgtttatgaagggcctatacaaggagagctctaaagcatacgaacgggcactgagcatcgtagagagtgagcaggacaaagcccacattttgaccgccctcgccattactgagtacaaacaggggaaaacagacgttgccaaaactttactgttcaaatgtagtatcctcaaagagcctaccaccgagtctttgcaggctctctgcgctttgggactggccatgcaggatgccactctgtcaaaggctgccctcaacgaacttttaaaacatattaagcacaaggatagtaactaccaaaggtgtctgctgacaagtgcaatttatgctctgcagggaaggtccgtggcagttcagaagcaaattagtaaagccgtgcatagcaatcccggcgatccagccctttggagcctgctgtccagagtggtagcccagtacgcgcagcgcaatgctaaaggaggtgtggttgccgggaatgtcgcgcatattctggacagcaatcatggtaaaaaggctctcctgtacacggcggtcaaccagctcgccatgggctcatcctccgccgaggacgagaagaacaccgcactcaagacaatccagaaagccgccttgttgtcacccggagatccagctatttgggcaggcctcatggccgcatgccatgcggacgacaagttggccctcgtcaataacacacagcccaaacggatcgacctgtacctggctctgctatccgccgtgtcagcctctattaaagatgagaaattctttgaaaactacaatcagtctttggagaagtggagcctaagtcaggcagtgactggcctcatagacaccggaagaatatcagaggcagaaacgctgtgcaccaaaaacctcaagtccaacccagatcaacccgccgtgatcctgctactcaggcaggtccagtgtaagcctctgctggagagtcagaagccactgcccgatgccgtgcttgaggagctgcagaagacagttatgtccaacagcacatctgttccagcttggcagtggttggctcacgtataccaaagtcaaggaatgatgcgcgctgctgagatgtgttaccggaagtcacttcagcttgcatcacagcgcgggtcctggtccggcaagctaagcagtttgctccgccttgccctgctcgctcttaaggtttgcatggccaatataagtaacgaccattggccgagcctcgtgcaggaggctactacggaggccctcaagctttgcttctgtccccttgctgttcttcttcaggccctgttgcaatttaagagaaaaatgggagcccgcgaaacaagacgactgttagagcgagtggtgtaccagcccggatacccgaagtcaattgctagcaccgctcgatggtacttgctgaggcatctgtatgccaaggacgattacgagctgatcgacgtcttggttaataacgccaagacacacggagatacccgggcattagaattaaatcaacggctgtctagccaatag

SEQ ID NO: 33958 - DNA, 288 bp, Artificial Sequence
  Description of Artificial Sequence: Synthetic coding sequence
atgagctctaaagaagtgaaaactgccctgaaatctgccagggacgctatccggaacaaagaatataaagaggcattgaagcactgcaagacagtgttgaagcaagaaaagaacaattacaatgcttgggtgtttattggagtcgccgctgcagaactggaacagcctgaccaggcgcaaagtgcgtacaaaaaagccgctgaactcgaaccagaccagctgctcgcctggcaggggttggcgaacctttacgaaaagtacaatcacattaatgctaaagatgattag

SEQ ID NO: 33959 - DNA, 1236 bp, Artificial Sequence
  Description of Artificial Sequence: Synthetic coding sequence
atggccgctgcctcgcccctgcgcgactgccaagcatggaaagacgccagacttcccttgtctactacgagcaatgaggcctgtaagttgtttgacgcgacccttacccaatacgtgaagtggacaaacgataagtccctggggggcatcgaaggatgtctttcgaagcttaaagctgcagacccaactttcgtgatgggccacgcaatggccaccggactggtgctgatcgggaccggatccagtgtcaagttagacaaggagttggacctcgctgtaaagacaatggttgaaatcagcagaacccagcctctgacacgaagggaacaactccacgtctcggccgtagagactttcgcgaacgggtacgtgaaaggcatttattccttcggcctcatggagactaatttctacgaccaggctgaaaagcttgctaaagaggctctatcaattaaccccactgatgcctggagcgttcatactgtcgcccacatacacgagatgaaagccgagatcaaagacggtctcgaatttatgcaacactcagagactttttggaaagactccgacatgctggcatgtcataactactggcattgggccctatatctgatcgaaaaaggcgagtatgaggcggcactcaccatctatgatactcacatactgccatcactacaggccaacgacgcaatgttggacgtggtcgattcatgctcgatgttgtaccgcctccaaatggaaggagtgtcagtcgggcagagatggcaggatgtcctccctgtcgcacgtaaacactccagggaccacattctgctgtttaacgatgcccacttcttaatggcttccctcggggcacacgacccgcaaactacacaggagttgctaacaacgctgcgggacgcctccgagtccccgggtgagaactgtcagcatcttttggccagggatgtcgggctgcctctctgccaggcccttgtcgaggctgaggatggaaaccccgacagggtgcttgagctcctcctgccaattcggtatcgtatcgttcagctaggcggaagcaatgcccagagggatgtctttaatcaactactcatccatgcggccctcaattgcaccagttccgttcacaagaacgtcgcccgatccctcctcatggagagggatgctcttaagcccaattcaccactgacggagagactgattcgcaaggccgccactgtccatttgatgcagtag

SEQ ID NO: 33960 - DNA, 1410 bp, Artificial Sequence
  Description of Artificial Sequence: Synthetic coding sequence
atggccgccgcttctccgcttcgggattgtcaagcgtggaaggatgcccgtttaccactgagtactacgtctaacgaagcatgtaagctgtttgacgcaacccttacccaatacgtgaaatggactaacgataaatcactgggcggcatcgaggggtgtcttagcaaactcaaagccgccgatccaacatttgtaatggggcatgcgatggctactggccttgtgctcatcggcacaggaagttctgtgaaactggacaaggagttggacttggccgtcaagactatggtggaaatcagccgcacgcaacccttgactaggagggagcagctccacgtctctgctgtagagacatttgctaatggcaattttccgaaagcctgcgagctctgggagcagatcctccaggatcatcccacggacatgcttgctctgaaattcagccatgatgcttacttctacttggggtaccaggagcagatgcgggactcggtcgcacggatctatccattctggacacctgacattcctctgagttcttatgttaagggaatctacagcttcggcctcatggagacgaatttctacgaccaagccgaaaagctcgctaaagaggcattgtcaatcaatccgactgatgcatggagcgtccataccgtggcccatatccatgagatgaaggccgaaatcaaggatgggctggaattcatgcagcactcggaaactttttggaaggactcagatatgcttgcctgtcataactattggcactgggctttgtaccttatcgaaaaaggggaatatgaggcagctctgacgatttatgatactcacattctgcccagtctgcaagcaaacgacgctatgctggacgttgtggacagttgcagcatgctttatagactacagatggaaggcgtatctgtgggtcagaggtggcaggacgtgcttcctgtggccagaaagcactctcgcgaccacattttactcttcaatgacgcacacttcttgatggcctctctaggggcgcacgatccacaaactactcaagaactcctcaccactctacgcgacgcttccgaatcccctggtgagaattgtcagcacctcctggcccgagatgtgggccttcctctgtgtcaggcgctggtggaggccgaagatggcaaccccgaccgagtcttagaactactgctcccaattaggtaccggattgtgcagctaggcgggtcaaatgctcaacgcgacgtttttaaccagctgcttatccacgccgctctgaactgcacatcctcggtccacaaaaacgtggcccggagcctgttaatggagcgcgacgccttgaagccgaattcccctctgactgagcgtttaatccgaaaagctgccaccgtccacctaatgcaatag

SEQ ID NO: 33961 - DNA, 1263 bp, Artificial Sequence
  Description of Artificial Sequence: Synthetic coding sequence
atggactccagcccttcactccccttgataaggacaccagaaagctccctccatgaagccttggaccagtgcatgaccgcactggatctatttcttacgaatcaattcagtgaagcactctcttacttaaaaccacgaaccaaggagtctatgtaccacagcctgacatatgccacaatactcgagatgcaggctatgatgacattcgatcctcaggatattctgctagctggaaacatgatgaaagaggctcagatgctttgccagcgccatcggaggaaatcctccgtgacagactctttctcgtcattggttaatagacccaccctggggcagttcaccgaagaggaaatacacgcagaagtttgttatgccgagtgccttctacagagagcagctctcacattcctacaggggagtagccatggtggcgctgtgagaccgcgagctcttcatgatccgtcccatgcatgcagctgtccgcccggccccggacggcagcacctctttctcctccaggacgaaaatatggtgagttttatcaaggggggcattaaggtaagaaatagctatcagacttacaaggagctcgactctctcgttcaatcgtcccagtactgtaagggcgagaatcaccctcacttcgaagggggtgtcaagctgggagtcggcgcattcaacctgacactgagtatgctgcctacaaggattttgcgtctgctggagttcgtgggcttcagcggaaacaaagattatggcctgctgcaactggaggaaggcgctagtggtcactcgtttcggtcagtcctttgcgtgatgctcctgctgtgctatcacacatttctgacatttgttctgggaacgggcaatgtgaatatcgaggaggctgaaaagctcctaaagccatatttgaaccgttatcccaaaggggccatattcctgttcttcgctggccgcattgaggttatcaagggcaacatcgatgctgtctcagatggtggacctggtaggggatggggctctctcggcgtgtctcagacaagccgaaagagtggcacctgcgatatcctgagagatcggattgattggggtagggggggggggcaggagcggaccaatcagagagcgggagctggggaggcacttctggctgaacagccagggaagaccagggaggaagaagccttcgtagtgccagggattctgacaggtcggtatcggacagccgccttgcagtggagggaggtcgagggtggtgcttag

SEQ ID NO: 33962 - DNA, 1737 bp, Artificial Sequence
  Description of Artificial Sequence: Synthetic coding sequence
atggggcagaaaggacataaagattccctgtatccatgcgggggaacaccagagagcagccttcacgaggccctggatcagtgcatgacagcactggacctctttttgacgaatcagttcagcgaagcgctgtcctatctaaagcctcggactaaagaaagcatgtatcattctcttacctacgcaaccatcttagagatgcaagccatgatgactttcgacccacaagatatcctgctagctggaaatatgatgaaagaagcccagatgctctgtcagaggcaccggcgcaagtccagcgtaaccgattcgttctcttctctcgtgaatcgccctactctggggcaatttaccgaggaggagatccatgccgaggtgtgctacgcagaatgtctccttcagcgggccgcgctgactttcctgcaagacgaaaacatggtgtctttcatcaagggcgggatcaaggttcgcaacagttatcaaacatataaggaactggatagcctggtgcagtcgtctcagtactgcaagggggagaaccatccccatttcgaggggggcgtgaagctcggggtgggtgcctttaacctgacactaagtatgcttccaacacggatcctccgcctgctggagtttgtaggattttctggtaataaagattacggtctgctgcagttggaagagggagccagtgggcactctttccgatctgttctgtgtgtgatgctcctgttgtgttatcacaccttcctgacatttgtgctgggcacagggaatgtaaacatagaggaggctgagaagcttctcaagccctacttgaatcgctaccccaagggcgctatttttttatttttcgctgggaggattgaggttatcaaaggcaatatcgatgccgccattcggcgttttgaggagtgttgtgaggctcagcagcattggaaacagttccaccacatgtgttattgggagctgatgtggtgcttcacctacaaaggtcaatggaaaatgagctacttttatgcggacctcctatcaaaagagaattgctggagcaaggctacatatatttatatgaaggctgcttacctgtctatgtttggaaaggaagatcataaaccattcggcgacgacgaagtggaactgtttcgggccgtccccggcctgaagctgaaaattgcagggaaatccctgcctaccgaaaaattcgccatacgtaagagtcgacgatacttttcatctaacccaatcagtcttcccgtgcccgccctggaaatgatgtacatatggaacggttacgccgtcattggaaagcagcctaagctgaccgacggcatcctcgagattatcactaaagcagaggagatgctcgaaaagggccctgagaacgaatattccgtagatgacgaatgtttggtcaaactgttaaaaggactttgccttaagtatttgggtcgggtgcaagaagccgaggaaaactttagaagcatttccgccaatgagaaaaaaataaagtatgatcactatctcataccaaacgctttactcgagttggctctactcctgatggagcaagaccggaacgaagaggcgataaagctacttgagagtgccaagcagaactataaaaattattcaatggagagtaggacccattttaggatccaggcagcaaccctgcaggcaaaatcctcactggaaaacagtagtaggagcatggtctcaagcgtaagcctgtag

SEQ ID NO: 33963 - DNA, 1746 bp, Artificial Sequence
  Description of Artificial Sequence: Synthetic coding sequence
atggcttttttgactacatggaaagaggcagccagtggtaagagtgatagacgcaccccggagagctcgctccacgaagcccttgaccagtgcatgactgctctagacctttttctgactaatcagttcagcgaagcactgtcttacctgaagccccgcacaaaagaatcaatgtaccacagccttacttacgccacgatcctggaaatgcaagccatgatgacattcgacccccaagacatattgctagcagggaacatgatgaaggaagcgcagatgctctgtcaaagacatagacggaagtcaagcgtcaccgacagtttttctagtctagtcaaccgacctacacttggacagtttactgaggaggagatacacgctgaagtgtgctacgcggagtgtcttttgcaacgtgccgccctgacttttctgcaggatgagaacatggtgagtttcataaaaggcgggattaaggtgcgtaattcctatcaaacctacaaggaactggattcgttggtccagtcttcacaatactgtaaaggcgagaatcacccgcacttcgaaggcggagtgaagcttggcgtaggagccttcaacctcacactgtcgatgttacctacaagaattcttagactgctggaattcgtgggattctccggaaacaaagattacggtctgctgcagcttgaagagggagcttcaggacattccttccggagtgtactgtgtgtcatgcttttactgtgttaccatacctttctgaccttcgtcctgggcactggaaacgtcaatatcgaggaagcggagaagctgctgaaaccgtaccttaataggtaccccaaaggagcaatcttcctcttctttgcagggcggattgaagtaattaaggggaacatagatgctgccattcgcagattcgaagaatgctgcgaagcccagcaacattggaagcaatttcaccacatgtgctactgggaattgatgtggtgttttacctataaggggcagtggaagatgtcatatttttacgcagatcttctgagcaaagagaactgttggtcaaaagcaacctatatctacatgaaagccgcctacctgtcaatgtttggaaaggaagatcataagccatttggggacgacgaggtggagctgtttcgagcagtccccggccttaagctgaagatcgccgggaagtctctgcctactgaaaaattcgcaatccggaaaagccggcgctacttttcatccaaccctatctctttacccgtgccagcactggaaatgatgtacatctggaatggctacgcagttattggtaaacaacccaaactgacagacggtatactcgagatcatcaccaaagctgaagagatgctggagaaaggtcccgagaacgagtacagcgtggatgacgagtgcctggtgaaattgcttaaagggctgtgtttgaagtatctgggccgggtccaggaggcggaagagaattttagaagcatttccgcaaacgagaagaagataaaatatgatcattatctcatccccaatgccttactcgagctggccctcctcctaatggaacaagaccggaatgaggaggccatcaaactgctcgagtctgcaaagcaaaattacaaaaactattctatggaatcgagaacacatttccgtatacaggcagccaccttacaggctaaatcgtcgctcgagaactcaagtaggtccatggtcagctctgtgtccctgtag

SEQ ID NO: 33964 - DNA, 1842 bp, Artificial Sequence
  Description of Artificial Sequence: Synthetic coding sequence
atgggtcagaaaggacacaaagattccttgtatccctgtggggggactcccgagtcttcgcttcatgaagcgctggaccagtgtatgacagcgctggatctctttctgacaaatcagtttagtgaggccttgtcctacttaaagccccggaccaaggagtcaatgtatcacagtcttacctacgcaactatattggaaatgcaggccatgatgacgttcgatccacaagacatcctgcttgccggcaatatgatgaaggaggcccagatgttatgccagaggcaccggcgcaaaagcagcgtgacagacagcttcagctctcttgttaatcgcccaaccctgggtcagttcacagaggaggaaatacacgccgaggtatgctatgctgaatgcctgctccagcgggcagccctgacttttctgcaaggctcatctcacgggggggccgtgcgcccacgagcgttgcatgacccctcgcatgcctgcagctgtcctcctggccctggtcgccagcacttattcctgcttcaggacgaaaacatggtctccttcatcaagggtggcatcaaggtacgaaatagctaccagacatacaaagaacttgacagtctggtgcagtcaagccagtactgcaaaggcgagaaccacccccatttcgagggtggggtgaagttaggcgtgggcgccttcaacctgactctgagcatgctccccactaggatccttcggctccttgaattcgtgggtttcagtggtaataaggactacggacttctgcaattagaagaaggcgcttctggacattcttttaggtccgtattgtgtgtaatgctcctcctttgctaccacactttcctcaccttcgtccttggaacggggaatgtgaatattgaagaagctgagaagctactgaaaccctacctaaacagatacccaaagggggctatattcctgttctttgctggtcgcatagaggtaattaaaggcaatatcgacgcagccattagaaggttcgaggagtgctgtgaggctcagcagcactggaaacagtttcaccatatgtgctattgggaactgatgtggtgttttacttataagggtcaatggaagatgtcttatttttatgctgatctactctcgaaagaaaattgttggagcaaggctacttacatatatatgaaagctgcttacttatccatgttcggcaaggaggatcataagcccttcggcgacgacgaggtcgaactgttccgtgccgttccaggactcaagctgaagattgccggtaaatccctgccaactgaaaaatttgctatcagaaaaagtcgaagatatttttcttcaaaccctatctctttacccgttccagcacttgagatgatgtatatctggaatggttacgccgtgatagggaagcagcctaaactgactgacggcatcctggagatcatcacaaaggccgaggagatgctggaaaaaggccccgagaatgaatactcagtggatgacgagtgcctcgtgaaactgctgaaagggttatgtctgaagtatttgggccgagtgcaggaggccgaggaaaacttcagaagcatctcagctaatgagaagaagataaagtacgaccattacttaataccaaatgccctgcttgaattagcactgctactgatggaacaggaccgaaacgaggaggctattaagttactggaatcagcgaaacagaattataaaaattattctatggagagcaggacccacttccggatccaggctgcgactctacaagccaaatcgtcccttgagaacagtagtcgatccatggtaagcagcgtgagcctgtag

SEQ ID NO: 33965 - DNA, 1734 bp, Artificial Sequence
  Description of Artificial Sequence: Synthetic coding sequence
atgacatcagctgggggagcgccaggtgccctgcccgctgggaccccagaaagttccctgcatgaggcacttgaccagtgtatgactgcactagatctgtttttgacaaaccagtttagcgaagcccttagctacctgaaacctagaaccaaggaatcgatgtatcactcgctgacttatgcaaccatcctggagatgcaggcaatgatgacattcgatccacaggacatactgctggctgggaatatgatgaaggaagcccagatgttatgccagagacacagaaggaaatctagtgtgacggattccttcagttcattggttaatcggcctactctgggacagttcaccgaggaggaaatacacgccgaggtctgctatgccgaatgcctgttacagagggcagctctgactttcctgcaagatgagaacatggtgtctttcatcaaaggggggattaaggttcgaaatagttatcagacctacaaggagttagacagtctcgtgcagtcttcccagtattgcaaaggagagaaccaccctcatttcgaggggggggtgaaattaggtgttggggcattcaatttgaccctgagcatgctgcctactagaatactgagactgctagaattcgtgggcttctctggaaacaaggattacggcctgctgcaacttgaggaaggggcctctggacattccttcagatccgtgctgtgtgtgatgctcctcctttgctaccacacctttttgacattcgtgcttggtaccggcaacgtgaacatcgaggaagccgagaagcttttgaagccatatcttaaccgttatcctaaaggcgctattttcctgtttttcgccggaaggatcgaggtgattaaaggcaatatcgatgccgcaatacgccggtttgaagagtgctgcgaggctcagcaacattggaaacagtttcaccatatgtgttattgggaactgatgtggtgctttacctataaagggcagtggaaaatgagctatttctatgccgacctcctgagtaaggaaaattgttggagcaaggccacatacatttacatgaaggcagcttacctgtccatgtttggcaaagaagatcacaagcccttcggtgacgacgaggtggagctgttccgtgctgttcccgggctgaaactcaaaattgcgggaaaatccctaccaacagagaaattcgctattagaaaaagccggcgctatttctcaagcaatccgatttctctccccgtgccagcgctggagatgatgtacatttggaatggctatgccgtgatagggaagcagcccaaacttaccgatggaattttggagatcattacgaaagcagaagagatgttggaaaagggcccagagaacgagtactcggtggacgacgagtgtcttgttaagttattgaaaggattgtgcctgaagtacctgggacgggttcaggaagctgaagagaacttccggagcatttccgcaaatgaaaaaaagatcaagtacgaccactatttaattccaaacgccctgctcgagctggctctccttctcatggaacaggaccgaaacgaagaagcgataaagctactggagtctgccaagcagaactataagaactacagcatggaatcccgtacacatttccgtattcaggctgcaacactgcaggctaaatccagtctggagaacagttctagatccatggtttcatccgtaagcctatag

SEQ ID NO: 33966 - DNA, 339 bp, Artificial Sequence
  Description of Artificial Sequence: Synthetic coding sequence
atgaaggccgcctatctgtcaatgttcggaaaagaagaccacaagccatttggcgacgatgaggtcgagcttttccgggccgtacctggtctgaagttgaagattgcagggaaatcactgcccacagagaagttcgccattcggaaaagtagaaggtacttctcctcaaaccccatctctttgcctgtcccggctctcgaaatgatgtacatctggaatggctatgccgtgataggcaagcaaccaaagctcactgacgggatcctggagatcatcactaaggcagaggagatgctcgagaaggggccagaaaatgagtattctgtcgacgatgagtag

SEQ ID NO: 33967 - DNA, 666 bp, Artificial Sequence
  Description of Artificial Sequence: Synthetic coding sequence
atgaaggctgcttacttaagtatgttcggaaaggaggaccacaaaccctttggggatgatgaggttgagctgtttagagctgtcccgggtttaaaactcaaaattgcaggcaagtcacttcctacggaaaaatttgccattaggaagtctagacgctatttctcttccaatccaatttccctcccagtgcctgcactggagatgatgtacatctggaacggttatgcggtcataggaaagcaacccaaacttaccgacggtatcttggagataattaccaaagcagaagagatgctggaaaaggggccggaaaatgagtactcagtggatgacgaatgtcttgtcaaattgttgaaaggactgtgcctgaaatatctcggaagggtacaggaagcggaggaaaacttccgatctatcagcgccaacgaaaaaaagataaagtacgaccactatctaattcccaatgccctgttggaactggcccttctgttgatggaacaagatcggaacgaggaggcaatcaaactcctggagtccgcgaaacagaactataagaactacagtatggagtcccggacacattttcggatccaggcagcaaccctgcaggctaagagctccttggaaaatagctcaaggtccatggtttccagcgttagcctttag

SEQ ID NO: 33968 - DNA, 1569 bp, Artificial Sequence
  Description of Artificial Sequence: Synthetic coding sequence
atgtcgtttggcgcgtcttttgtcagcttcctgaacgccatgatgaccttcgaggaggagaaaatgcagctggcctgtgacgacctgaagaccactgagaaactgtgcgagtcagaagaggccggtgtgatcgagactataaagaacaaaattaagaagaacgtggatgttcggaagtccgcaccctcaatggtagataggcttcaacgccagattattatcgcggactgccaggtgtatctggcggtgttgagttttgtgaagcaagagctttcagcctatattaagggaggttggatcttgagaaaagcttggaagatctataataaatgctatctcgacatcaacgcattgcaagagctgtaccagaaaaaactcacagaggaatcacttaccagtgatgccgctaacgataatcacatcgtggcagaaggggtaagtgaggagtccctgaaccgcctaaaaggagctgttagctttggatacggtctgttccacctctgcatctctatggtgccgccgaacctcctcaagataatcaatcttctcggcttccccggcgataggttgcaagggttgtcatctctcatgtacgcttcggagagcaaagatatgaaggcacctctggccaccctagctctcctttggtatcataccgttgtacggccttttttcgccttagacggttcggataacaaagcaggcctggatgaagccaaggaaattctgctcaagaaagaggccgcttatcctaactcctcccttttcatgttctttaagggcagaattcagaggctcgagtgtcaaataaatagcgcactcacatcatttcacacggcccttgaactcgcagtggaccagcgcgagatccagcacgtgtgcctctacgagatcggctggtgttctatgatcgagctgaattttaaagatgccttcgactccttcgagcggcttaagaatgaaagccggtggtctcaatgctactacgcatacctgaccgctgtatgtcaaggagcgaccggtgatgtcgacggggctcaaatagtgtttaaggaggtacagaagctgttcaaaaggaaaaacaaccaaattgaacagttttccgtgaagaaggcagagcgcttcaggaagcagacgccgacaaaagccttgtgcgtgctcgcctctattgaggtgctgtatttatggaaggccctgcctaactgcagtttcccaaatctgcagcggatgagtcaggcctgccacgaggtcgacgattcttctgtagtcggcctcaaatatcttctgttgggcgctattcacaagtgtctcggaaactccgaggacgctgtccaatatttccaacgtgcagtgaaagacgagctgtgccgtcagaataatctgtacgttcagccatatgcctgttatgaactgggctgcctccttctggataaacccgaaactgtaggtcgaggtcgcgctcttctgttacaggccaaggaagacttctccggctacgatttcgagaaccgtcttcacgtgcgtatccatgctgcgcttgcctcccttcgggaactcgtaccacagtag

SEQ ID NO: 33969 - DNA, 1752 bp, Artificial Sequence
  Description of Artificial Sequence: Synthetic coding sequence
atggcagggtccgagcagcagcgcccaaggcgccgcgacgatggggattcagacgctgctgccgccgccgcagcacccctccaggacgcagaactggctctggctgggattaatatgctgctgaataatggattcagggaaagtgatcagctgttcaagcagtatcgcaaccactcgcctttgatgagctttggagccagttttgtctcgttcctgaatgccatgatgacgttcgaggaggaaaagatgcagctcgcttgtgacgacctgaaaaccacagagaagttgtgtgaatccgaggaggcaggcgtaattgagactataaaaaacaaaataaagaaaaacgtggacgtacggaagtccgccccaagcatggtggacaggctgcagcgccaaattatcatcgctgactgtcaagtgtatctagccgtgctgtcatttgtcaagcaagagttgagcgcctacatcaaaggtggttggatcctgagaaaggcctggaaaatatacaataaatgctacttggatataaatgcactccaggaactctaccaaaaaaagctgaccgaagagagcctgacatcggacgcggccaatgacaaccacattgtggccgaaggggtgtcagaggaatctctgaacaggctgaaaggagcggtgtccttcggctacggactatttcacctctgtatctcaatggtaccacctaacctgcttaagatcatcaacctactgggatttccgggggatcgcctgcagggactttcttctttgatgtacgcaagcgaaagtaaggacatgaaggccccgctcgccaccctggccctgctgtggtatcataccgtagttaggcctttctttgccctggacggcagcgacaacaaggccgggctggacgaagcgaaggaaatcctactcaaaaaggaggctgcctacccgaatagctctctgttcatgttttttaagggacgcattcagcgtctggagtgtcagatcaacagcgcgctcacctcatttcacacagccctcgagcttgcggtagaccaacgcgagatacaacatgtttgcctctacgagatcggatggtgttccatgatagaacttaatttcaaggacgccttcgattcattcgagagattgaagaatgaatcacggtggagtcagtgctattatgcctatctgactgcagtctgccagggagctacaggagatgtggacggcgctcagatagtatttaaggaggtccagaagttatttaaacggaagaacaaccagatcgagcaattttcagtcaagaaggctgaacggtttcgtaagcagacccccacaaaagccttatgcgttttggcttcaatcgaggtgctctacctgtggaaggctttgccgaattgttccttccccaacctccagcgaatgagccaggcctgtcatgaggtcgatgatagcagcgttgtaggcctgaagtacctcctcctgggggcaattcataaatgtctggggaactcggaggacgctgtgcaatacttccagcgagcagttaaagacgagttatgcagacagaataacctctacgtgcagccctacgcgtgctacgaactgggatgcctcctgctggacaaaccggaaacggtgggacgcggaagagctcttctccttcaggcgaaggaggatttcagcggctacgactttgagaaccgccttcacgttaggattcatgcggccctggcttcactcagggagctggtcccccaatag

SEQ ID NO: 33970 - DNA, 831 bp, Artificial Sequence
  Description of Artificial Sequence: Synthetic coding sequence
atgcacgcaccttttaggatctcatgccaggtggtgtggctgttcaagatttacctcctaatgtgccaaataaatagcgctctcacctcctttcatactgccttggagcttgctgtggaccagcgcgagatacagcatgtctgtctgtacgagataggatggtgcagcatgatcgagctgaattttaaggacgcattcgactctttcgagaggctgaaaaatgagtctcgatggtcccaatgctactacgcctatctcaccgcagtctgtcagggcgcaacaggcgatgtcgatggtgcccagatcgtgtttaaagaggtccaaaagctgtttaaaaggaaaaataaccaaatcgagcaatttagcgtgaagaaggcggagcggttcaggaagcagacacccaccaaagcactgtgcgtcctggcctctatcgaagtactgtacctgtggaaggcccttccaaattgctctttccccaacttgcaaagaatgagtcaggcctgccacgaggtagatgattcgtctgtggtagggctgaaataccttctgctgggggcaatccacaagtgtcttggtaatagtgaggatgcagtgcagtacttccagagagcggtgaaggatgaactctgtcggcagaacaacctgtacgtgcagccttacgcttgctatgagctcgggtgcttacttctcgacaaaccagaaaccgtcggccgagggcgtgccctgttgctgcaggccaaagaagacttttccggatatgattttgagaacaggctccacgtgagaatccacgccgcattagctagtttgagagaattggtgccacagtag

SEQ ID NO: 33971 - DNA, 231 bp, Artificial Sequence
  Description of Artificial Sequence: Synthetic coding sequence
atggctggtagcgaacagcaacggccacgcaggagggatgacggcgactctgatgccgcggcagccgctgctgctcccttgcaagacgctgaactggctctcgccggtattaacatgctgttaaataatgggtttcgcgaatccgatcagctgtttaaacaatacaggaaatcattcctgacttcagaaaaaacaagtgctctgcccggggagacccagagacgtctttag

SEQ ID NO: 33972 - DNA, 2631 bp, Artificial Sequence
  Description of Artificial Sequence: Synthetic coding sequence
atggctgaggaagagggaaggctccacagtgtgcaggggctgctgagcctccaggatctgcaaaacgtgaatactccgcttatgcgcaagctggccaggctgaagcttggccttgttgagatggcattggacatgctgcaatttatctgggaagaggctcacggtcaacagtccgagcagggttcacttgaaaagttgctagcagactacctgcaaaatacaagcgattacacctccgtgggtcttcagtggtttacgctgaagcgcaccttagctcacggggccttggcacaactcggctccctccagccgcttagtgtcggctgtgtggagatccgagcacgactactgggcttggccgggcgcgccctgcacctgcttgcaatgcaagcagatcctgtgcacccaacctgctactgggaggctggaccttccgtgggcgccaaattatccggtctaaaatcgttggaactcgaagtcgaggaagaaggagcaaccaagtcttcccgtgacccaccagctagccgtgccgcacccgaggagcattgcaggcggggcgaggacctcaagcgccgtatggtcctggcccagcaataccttgcgcaagcctccgaagtcctcctgcagtgcttacaggtagctctggggagcggactcctggacgtcgccgctgccgcgtcactggagatggtcgaatgtgtggggacactggatcccgccactacgtgccaatttttagcactgagccaaagctgtagtgctagcgaaacaatgagggatgtgttactggctgcgactgccaatacctcatcgagccaactggcagcgttgctccaactgcagcaccagctccggtgccaggatagaacaacaacatctttgggagccagagtcgaacagcgattggcggccgtgtccaaggcatggcagaacttgtgtgtaactgagcagcattttaacctcttgaatgaaatgccccccaccttttggatcctctttttacacctgtccggggaccgctctaggctgtacggtgctgcttacgaaaagccaaagtttattacagcggccaagggcaaagtccaggctgtgggaggatcctgtaaagttatgcgcctcgccatttcaccgacagccttctcgcatttgctcgcctgcgcacagcagtttaggaaacagacgcaggctcaggtgtatagtgaggacatggctcttaacattggctctgagcccgagggattgcaggtggaggaaaaagaaaggcctgtccaaaggctgtccagtgtactgggaccattggaggaactgctgcagcctttgtttccacttctgtctctttctaaagcgcgcgtgcagacgcctgctgtggttgcagatagtggtaagtcaaagggcaaggacaaagagcgcaagacttcaactggacagcatagcaccgtacagcccgaagtggcagataagattgtactcgtcgccgatcgccatctcctggaattacccctcgaaggtctttctgtgttcgatgaggggaccatttccagcgtatctagggaattcagtctgcagatgctctggaatcggctgcacaaagaggagacagagggaggggttaaaaaagaggggcggtctagggaccccaagaagagatccctggcaaagaaaggcagaaaaggaagcatccccaggacgatcccacctgactgtattatagtagactcagacaactttaagttcgtggtcgacccctatgaagaggcacaaggtcccgaaatgctcacccccgtcagtatcacacaggacattctggagagattccaggacacattcaccagtaggtgggcaggtcacctgggatccaaacacttcccttcccaagcgcagtgggagcaggccctgggtagttgttctgggtttttcttctatgggatggaaagctttctatctcacatcttagttgaaagattagtcgctatgaatcttcaggagtgccaggtggctgttttgctggatctcgctagatcctaccagtccctcaagcgacatatggaatcagtcgaacataggcgctctgtcggacggtgggaggccaactggcgaaatagcgcctcacctagcgaggacgaatggaggaggggcggcgaaccacgccgcggctttagcgatcttgagggccaagcggctgctgcccctaagttgagggccccgtcccaccacgcacagttaggaccagtgtgggccgcggcgccatcccacagggttgtgcaggcctggacgtgtctgccttctgctgccggagcgcccgcacttgcaagcgcattggggtctgcccccctcccaacccatccgcatctgcccgctcccatccccagcagtcagctcgccctccctttcttaggactgtcgcccgcgctgggcgccgcaagtgccagagatccacctcccgcgacatcccgcaaggcagcagcctggacctccagctctgcctgcttatgcgccccatggggcttgagaagaggttggagctgcgtgtctagccgaggacaggacaaaggcggtttgcccttggcagccctggtcctgagctgcctggatcagaagacaattcaaaccgtgtctctgttcctgatttag

SEQ ID NO: 33973 - DNA, 4593 bp, Artificial Sequence
  Description of Artificial Sequence: Synthetic coding sequence
atggatctggtgatcactcaagaattagcaagggccgaatcgcagcaggatgctgcaagtcttaaaaaagcttacgagctgatcaagagcgccaacctgggcaagagcgagttcgaccccagtgagtcattcagccccgatctcttcgtcctgtgtgctgagcaggctctgaagatgagacagccagaggtcagcgaggattgtattcaaatgtatttcaaggtgaaagcccccatcacacagttcttgggccgagcccacctctgtcgcgcccaaatgtgcgccccgaaatcggccgaaaatcttgaggagtttgaaaactgcgtaactgaatacatgaaggcgataaacttcgcgaaaggcgagccacgttactacttcttggtgtacaacgcatcagtcttatactggcagatggtgcgccctttcttgaagccaggctatcggcaccatttgatcccctctctctctcagatcattaatgttctctcacagacagaggaagaggacaaggaatggagggccgaattgatgcttgaattactcgagtgctacctacaagccggccgcaaagaagaggccgcaaggttttgtagtacagctgcccctttcattaaatcccacgtcccccagaaataccggcaaatcttcagcgtgatggtgagacatgagctcatggatgagttacagttaaaggaggaaaaaaaaaattctatttcactcagtgtgaccttctacatcaatatgctgaaggctaaggcggagcagaatgatttgcccggggatatcagtgtcatcctgcggaaggcctaccgccaccttggccactataaccaccagcggtttccttccattagtgaagaaaagatgctcctgttgttcgaactggcaagattttccctcaccttgaagtgtatggagatctccagtgcttgcttatcagacctgaagaagatggaatctaaagaccctggcaaactcatcgaaatggaatgtctggagtgtgaatccgaggccctgcgcctggagagcaaaatgaaagtctataaccgggcggccgttgaggctcaactggacatcattcaacggctggatgtagccttgcagcgggcagtgagactgggagatcctcgggtgattcatgtagtttgcgcaacccagtggaacacttgtcttcccctcctccagcacaacctccgacatcatctcaggaagcccctcgctggggtggctgatgttctggagaagttagactcacttatgacgctcctgagatgtcaggttcacatggagatggcacagattgaggaggacgaggaccggttggagcccgccaccgagcaccttagaaaagcagctaggctagacagcctgggtttatatagagataggattcagatggctagcaccagactgaggctctgcacaactttatatcaggccccagaaagggccgaagacaaggcaataatggccgtggagcaggccaagaaagccactcctaaggattctgttaggaaaaagagagcacttctggtgaatgctggtctggctcttgcacctgatgccttccagatagtgctggacagtgaaaatgaggccaaggtgtctacaggtaaaaaccgcgggcgcttcacgtatttatgcgcaaaggcttggcaccacaccgtatctgtggataaggcagcgggccacttgaggcggctgggcaacgagaatgacaaggagcgtatccagatctgggccgagcttgccaaggtggctagaaaacagggggtttgggacgtatgtagaacggcttcacggttctgtctgttgtacgacaatgtgaaggtgaagaagctgcgactcaggcgcggaaaaaaaaagcgtgggcgggacggcagcgttcaggacacctggtcccaaccggaggttgtcctccagcgacaggtttgtcccgacctcctgagaaagtttgcggaagtgggttttatccatgccgaagctacagtgcacctgctgcggtccgaaggggtggaacttaatgaccgcgcaattccgcctgaggacctttcacagcaccctgctgggtacgtgcccgaacctccagaagtcaatgccgaatggattacttaccgcacttggattgaatcgctttcaaggtgtgctatgaataactggctccgatcggctgagataggacaagaaatccaggaggcttggatcgtgcagaacgctgtcgtgtacgtgctgaatcataaccatcacctaatccttgcagggcggcagaaggagctggtggatgccctttaccaccttctaagcattgtgaaggccactggacattcaggcgaccctgtaatgcttgtgacactctgtaacactctggctcgcggcctgatcatttcctggataccagtacaggccgcggaaaagtctaggaagtttatgcggcctaacgcttttcatagtcctctggacgcaggggcaacttccgagattaaaacggcagtggaagtttgcgagttcgctctgaatttgacaaatggcagcgcccctgaagagactgtccccacaggaacccggcagcaactgatcgccacctgggttaaagcaaaacagctgctgcaacagcaaatcggcccacgactcggcactgaggagcaaggcactaacgaggatgtgtcgtctgttacacgcgtgctcgtggctctcgagatgtatagctgcaatgggttgggcctgatggattttaccgtgccttcgctggcccaactagtgaagatggcctctgagtgtaattggtccgatcccctagtggagctacagactctgacccgcctcactcacttcgcgcacgctgctagagatcacgagactaccatggcatgtgcgcacagggcactggaaatggggataaagtaccttaagaagttcggccctgaggaaagtcggcttgtggctgaaatgctctgtaccgccaccgccattcagggacgatccattatggaaaacctcaagggcagaaaacagttgcggcttgtggccgccaaagcttttactgagagcgccagattcggtggaatcgccggctcatccgcactcgttatgcttgcagcaaggcactattggaatgcctggctccccctactgtcaagtgcagtctaccgtaagaaggctaagggcgccctgaagagactgataggaatcattaacaagactgaagcacgcaagcaggagaagggcaagacactgctcctgcatcagtggccgaccgctgactttcaaggtggcgggacaaccgagggctatttccttcccggcgccgaggatgacctcgccctgcgggccgctttatatgggctgctcttccacagccacgcggatcaagatgactgggagggcggcctgaaagttctggacgaagcggtacaggtgctcccgaggacagcccatcggctgttaattttcaaacacatggtgatcgtcaaggcgaagctgggccaaaactttagcatggagatccagaagtttaaggccgagtccgaagactatctagccagaatgtggcaccgactggccttaaattcccctagcgtaagcggtgaactggcgtgctataataatgcgattcaggcactgcagaagcctgagatggagtggcagaaagtagaatatctaatggagtttggccagtggttacaccaccgccacttcccactggaagacgtcgtcttccacttgcgctgggcagtggaaattctgctggcaatgaagccaccaggcgatgttccagagccccagccaaccccagacggagagtatgtggctgttgaaatgccgcctcgttctcctgtcagcgaggccgaagaggccgtctccctcgaacaactacggtcggtcaggcagcttgaggcgctggccagagtccacattttgctcgctctcgtcctgtcgccaggagcagaaggctatgaggattgctgcctggcagcttatgcattcttcaggcatatttggcaggtctctttgatgacagcagggaagagcgtcctagaaaacaggcccctagcagcaacctcatcccacctgctcttacccaagaaggagaaggaaaatgagaggtccaaggaaaaggagaaagagcgcagtaaggagaaagaaaacgagcggtccaaggaaaaggataaagagaagggcaaggaagaaaaggttaaggaaccaaagcaatcacaaagccccgcaccaatcaaacagttggaagatctgccaatgtcaattgaggagtgggcaagctattcgtgcccagaggaagtcttgtctgtgctgaaacaggatagatctgatagcacagttaacccttcaagcattcaaaagcccacctactccctctactttttggatcacctggtaaaagccctgcagaaaatgtgcctccatgaacttactgtgcccgtgctgcagctgggcgttctcatcagcgattccgtagtaggatcaaagggcctgtctgacttgtatcaccttcgctgggttcaacttctgtttcgctcagttatttctccaaagcagaacaaaaataagcaacacgttaaggttcttatcttgtag

SEQ ID NO: 33974 - DNA, 1218 bp, Artificial Sequence
  Description of Artificial Sequence: Synthetic coding sequence
atggatctcgttattactcaggagctggcgcgagctgagagccaacaagacgcggcctccctgaaaaaagcctacgagcttattaagtcagctaacctggggaaatcagaattcgacccttctgaaagcttctctcctgacttgttcgttttatgcgccgaacaagcccttaagatgcggcagccagaggtgagtgaagattgtatccaaatgtactttaaggtgaaggcaccaattacgcagttcctgggtcgcgcccatctttgcagagcccagatgtgtgctcctaagtcagcagagaacttggaggaattcgaaaattgtgtgacagaatacatgaaagccatcaatttcgccaaaggggaaccccgttactactttctggtctataacgccagcgtcctgtactggcagatggtcagaccctttctgaagccgggctatcggcaccatctcatacctagcctgagccagattatcaacgtgttgtctcaaaccgaggaggaggacaaagaatggcgcgccgagctaatgttagaacttctggaatgttacctccaggccggtcgaaaggaggaagcagcacgtttttgctcaacggccgcaccgtttatcaagtcgcacgtgcctcaaaaataccgacagatctttagcgtgatggtcaggcatgagctgatggacgagctgcagctgaaagaggagaagaagaacagcatctccctgtctgtcacattctacatcaacatgctgaaagctaaggccgagcagaacgacctgcccggtgacatcagtgtgattttgcggaaggcctacagacacctgggacattacaaccatcaacggttcccttccatctcagaggagaaaatgttgctgctattcgaactggcacgcttcagtcttactctcaagtgcatggagatatctagcgcctgtctgagtgatctgaagaaaatggaatctaaagtgtcaggattcatgaccttgctgccgggggacgaagccctgcttacagtgcaactagataagagacagcgaaaggaggaacaatttactagacccaggccacccgggttgaggtctgttgtgggcacactgccatctttccttcctgtcttttgcaccgtcgccgtaagatggtgtttacagttttatacttgtccatttctattcacctttctggtcgccacaggcccacagcaccactcctgcttttag

SEQ ID NO: 33975 - DNA, 8148 bp, Artificial Sequence
  Description of Artificial Sequence: Synthetic coding sequence
atggacttggtgatcacccaggagctagccagagcggagagtcagcaggacgccgcctcgctgaagaaagcttacgagcttatcaagtcagcaaacctgggaaaatcagagttcgatccctctgagtctttcagtcccgatctttttgtcctttgtgccgagcaggccctgaagatgagacaacctgaagtcagcgaggactgtatccagatgtacttcaaagtgaaagcccctatcactcagtttctgggtagggcacacctgtgcagggctcagatgtgcgctcctaaatcagcagagaacctcgaagagttcgagaactgtgtgaccgaatatatgaaggcgatcaacttcgccaagggcgaacctcggtattacttcttggtgtataacgcttctgtcctgtactggcaaatggttcgaccttttctgaagcctgggtatcgccatcatctaattccgtcactaagccagataatcaatgtgctgtcacaaacggaggaggaggacaaggagtggcgagccgaattaatgctagaactgctcgaatgctacctgcaggccggcagaaaggaggaagccgcaagattctgttctacagccgctccatttataaaaagccacgtcccccagaagtatcgacagattttttctgttatggtgagacacgagctgatggacgagctgcagttgaaggaagaaaaaaaaaatagtattagtctgtctgtgactttctacatcaacatgctcaaagccaaggccgagcaaaatgacctgcctggcgatattagcgtcattctgcggaaggcctaccgacacctcgggcactacaatcaccaaagatttcccagcataagtgaagaaaaaatgctgctcctgtttgagcttgcgcgattctcgttaacgctgaaatgcatggagatctcatctgcatgtctcagtgacttgaagaaaatggaatcgaaggatccaggtaagttgatcgaaatggagtgtttggaatgcgaatccgaggccctccgcctcgaatctaaaatgaaggtctataaccgggcagcggtggaagctcagctcgacattatccaaaggttagacgttgctttacagagggcagtgaggctgggagacccacgggttattcatgtggtgtgtgccacacaatggaacacgtgcctccccctgcttcagcataatctgcgccaccacttaagaaaacctttggctggcgttgccgacgttcttgagaagctcgactctctgatgactctgcttcggtgccaggtccatatggagatggcccagatagaagaagatgaggataggttggagcccgctaccgaacaccttaggaaagcagcgcggttagattccctgggcctctacagggatcggatacagatggcttccactcgtctgagactatgcacaacgctgtatcaggccccagagcgagcagaggataaggcgataatggccgtggagcaagcgaagaaggctacaccgaaagattcagtgcggaagaagagggctcttctcgtcaacgccggcctggctctggctcccgacgccttccagattgtgctggacagcgagaacgaggcaaaagtgtcgaccggcaaaaaccgaggcaggtttacttatctttgcgcgaaagcttggcatcatactgtgtcagttgacaaggcggctggacacctgcggaggctaggcaacgagaacgacaaagagagaattcaaatctgggccgagttagcaaaggttgctagaaaacaaggcgtatgggacgtgtgccggactgctagccgcttttgtttactgtacgataatgtgaaggtaaaaaagctgcgcctgaggagaggcaagaagaaaaggggcagggacggctctgttcaggatacctggagtcagccagaagtggtactgcagcggcaggtgtgcccagacctgctccggaaattcgctgaggtcgggtttatccacgcagaggctaccgtgcacctgctgagatcggagggtgtggagttgaatgaccgagctattccacctgaagatctgtctcagcatcccgccgggtatgtgcctgagccacccgaggttaatgccgagtggatcacatatcgcacctggattgaatctctctctagatgcgctatgaataactggctgaggtcggcagagatcgggcaggagattcaggaggcatggatcgtccaaaatgccgtagtgtacgtgttgaaccataatcaccacctgatactcgcaggtcgtcagaaagagttagtggatgcactctaccacctcctctccatcgtcaaggcaactggccattcgggagatcctgtaatgctcgtcactttgtgcaacaccttggctcggggcctcattatttcgtggattccagtccaagccgcagagaaatcccggaaattcatgcgtccgaacgcctttcatagtcccctggatgcaggcgctacaagcgagataaagactgccgtcgaagtgtgcgaattcgctttgaatctgaccaatggttcagcccccgaagagactgtgcccaccggcactaggcagcagctgatcgccacatgggtgaaggctaaacagctcttgcagcagcagatcgggcctagactgggaaccgaggaacaggggactaacgaggacgtctcttctgtgacacgcgtgttagtagctctggagatgtactcctgcaatggacttgggttgatggattttacagttccttctctggctcagctcgtgaagatggcctctgagtgcaattggtccgatccgctggtggagctccagaccctgacaagattaacacattttgcacacgctgctcgggaccacgagacaacgatggcctgcgcacacagggcccttgagatggggatcaaatatctgaagaagtttggtcctgaagagagtagattagtcgccgaaatgctgtgcacagctacagcaattcagggtagaagcataatggaaaacctaaaaggtcgaaaacagctcaggctggtcgctgccaaggcattcacagagtccgcacgttttggggggatcgcgggtagcagcgcactcgttatgctcgccgccaggcattactggaatgcatggctaccccttctgagttctgccgtgtaccgtaaaaaagccaagggcgcactcaaacggctcatcggcatcattaataagaccgaagctagaaaacaggaaaagggtaagactctcttgttacatcagtggcccacagccgattttcagggtggcggtaccactgaaggatattttctcccaggagctgaagacgacctggccctgcgcgcagctttgtatggtctcctctttcactcccacgccgaccaggatgactgggaaggagggctcaaagtgctagacgaagcagtccaggttctgccgagaactgcccatcgactgctcatctttaaacatatggtcattgtcaaggccaaattgggacagaatttctccatggagattcagaaattcaaggcggaatccgaggactatctggccaggatgtggcaccgcttggccttgaactcaccttcagtttctggtgaattggcctgctataataatgccatccaggctctccaaaagcccgagatggaatggcaaaaagtagaatacctgatggaatttggacagtggcttcatcacagacactttcccctggaagatgttgtgttccatcttagatgggctgttgaaattctgttggctatgaaaccccctggcgacgttcctgaacctcagcctacccccgatggggagtacgtggctgttgagatgccccccagaagccctgtttctgaagccgaggaggcagtcagcctggagcaactgagatccgttcgacaattagaggctctggcgagagtgcacatcttgttagccttggttctgtcccctggtgccgagggctatgaagattgttgtctcgctgcatacgctttcttcagacacatttggcaggtaagcctgatgacagctgggaaatccgtgttagaaaaccgtcctctggccgccacctcctcgcacctgttactgcctaagaaggaaaaggagaacgaaaggagtaaagagaaagagaaggaacgaagcaaggaaaaggagaacgaacggtcaaaagaaaaggacaaggaaaagggcaaggaggaaaaggtgaaggaaccaaagcagtctcaaagtccagcccccatcaagcagcttgaagatctgccgatgtctattgaggagtgggccagctattcctgccctgaggaggtgctcagcgttctcaaacaggaccgcagtgactccaccgtgaacccctcttcaattcagaagccaacttactccctctatttcctggatcacttggtgaaggcccttcagaagatgtgcctgcacgagttgactgtccctgtcctgcagctgggagtgttaatttccgactctgtagttggaagtaagggcctgtcagatctataccacttacgcctggcccacgcatgctcagagctgaagctcagggaggccgctgcgcggcatgaggaagctgtcggccaagtttgtgtcagtgagctcgagcaagcttcttgccggaaagaaattgccctgaaaaaagaaaaaaacaaagagcccctactggaggaaagcctgcccgccctgaacgaacaaacgctgccggtgcagcctggggagatcaagccgctggatgctaaggataagatcctcaaaatgaatggggagacaggccgggatctggatgggacatcattccctcacttgtggatgttgaaggccgaggtgctgttagaaatgaacctgtaccagcccgcccgcctcttgcttagcgaagcctatcttgcctttcaggaactggacgagccgtgcgccgaggcccagtgccttctccttcttgctcagctcgccaataaagagaaaaattacgggcaggccaagaagatgatcgctcaggcccagcacctcggaggaagtgaggagttctggtataacagcacccttacactcgctgaagccctgttgagtatggagcacagtggtcgcgaggccacagtttgccacatttttcaaaagctgataaacgcttttaaaattctgaagaaggaaagaccaaatagactgccactgctcgaatttatgattactgatctggaggcgcggtgcctgtccctccgggtgagggtggcgcagcattccgccgttaccgagcccaccgagtgctccctgctcctcaaagagatggacgatggattgctggagatagagcggaaatttatagattgtggttgcaaggagaactgtgtggacgtgaagttggaacgggctaaaattaagcggttacgcgcacagaatgagaaggacgaagagcagaagacagcctattatctggaggcctacggtctggcacaaggggctgtggccgaggaggaagggcggctgcactccattcaggggctctatgggctggcccagggggctatggcagaagaagagggtagactccactccgtacagggattgctgtctttgcaagaccttcaaaacgtaaatactcccctaatgcgtaaactggcgcgacttaaactaggcctcgtggagatggctctggatatgttacagtttatttgggaggaagcccatggacagcagtcagagcagggatctctcgaaaagctcctggctgactacttgcagaacaccagcgattacacgagtgtaggcctccagtggttcacactcaagcggacattagcccatggtgcgttagcacaacttggatctttgcagccactttccgtcggatgcgtcgagatcagagcgcgactccttggcctggctggacgcgcattgcatctcttagccatgcaggcagacccagtgcaccccacatgctattgggaagctggcccctctgtcggcgccaagctctccggcttgaagagccttgagctcgaggtggaggaggagggagctactaagtcttcgagggatcctccagcatcccgagcggcccccgaggagcactgccggcggggagaggacctgaaaagacgtatggtgctcgcacaacagtacttagcccaggccagcgaggtgctcctgcagtgtctgcaggtggccctgggcagcggcctgctggacgtggcagcggcagcatccctggagatggttgaatgcgttgggacattggaccccgctaccacatgtcagttcctggccctatcccagtcatgttctgcttcggaaactatgagggacgtgctgctggcagcaaccgcgaacacaagctcttcccagctagccgcactgctgcagctgcagcaccagctgcggtgccaggatcgtactactaccagtctaggcgcacgcgtggaacaacgtttggccgcagtgagtaaggcttggcagaacctatgcgtgacggagcagcactttaatcttttgaacgagatgcccccaacgttttggatcctgtttctacacctctcaggtgaccgtagccgcctgtacggcgcggcctatgaaaaaccaaaatttatcacagctgcaaagggcaaagtgcaggcagtaggagggtcatgcaaagtgatgcgactggcaattagcccaaccgccttcagtcatctgctggcctgcgcgcaacaatttcgtaaacagacacaggcccaggtttacagcgaggacatggccttaaacatcggatcagaacctgaaggacttcaggtggaagagaaggagaggcccgtgcagcggctgtcctccgtacttggaccccttgaggagctattgcagccactattcccactcctgagcttatctaaagccagagtgcagacgcctgcagtggtcgcggatagtggtaaaagtaagggcaaggacaaggagcgcaaaacgagcactgggcagcacagcacagtccaacctgaagtggccgacaagattgtgctggtcgctgacagacacctgctggagttacccctcgaaggcttgagtgtcttcgacgagggcacaatttccagtgtgagtagggaatttagccttcagatgctttggaatcggctccataaagaggagacggaggggggagtgaagaaggaagggcgatctagggatccaaaaaaaagaagtctggcgaagaaagggagaaaggggtccatcccacggaccattcctcccgattgcatcatagtagactccgacaattttaagtttgtggttgatccatatgaagaagcccaggggcctgagatgttgacgcccgtgtctatcacccaggatatactggagaggtttcaagacacattcaccagcaggtgggccggtcacctggggtcgaagcacttcccctcacaggcccagtgggagcaggccctgggatcatgtagcggattttttttctatggaatggaaagcttcctgtcccatatcctggtcgaacggctagtcgctatgaacctgcaggaatgtcaggtggcggttctgttggatctggcccggagctatcagagtttaaaacgacacatggaatcagtcgagcaccggcggtccgtaggcaggtgggaggccaactggcggaatagcgcctctccaagtgaggacgagtggcggcgaggtggggagcccaggcgcggattttcggatctagaggggcaagcagctgctgcaccaaagctgcgagcgccctctcatcacgcccagctaggacccgtgtgggcagccgcccctagtcacagagtggtccaggcttggacgtgcctaccttcagcagctggtgctccagccttggcctcggccttgggaagtgcccccctgcccactcatcctcatctccccgcccctatcccttcttctcagttagcactgccttttctaggtctctcccccgcgctcggtgccgccagcgctcgcgatccccctcctgcaacaagcagaaaagcggccgcctggacctctagctcagcatgcctgtgcgcaccttggggattgcgcagaggttggtcttgtgtgtctagcagaggtcaggataaaggaggtcttccattggcggccctcgtcctctcctgtctcgatcaaaagaccatccagacggttagtctcttcctgatctag

SEQ ID NO: 33976 - DNA, 1563 bp, Artificial Sequence
  Description of Artificial Sequence: Synthetic coding sequence
atgatgaagtactacgaccttgccaaatttacaatataccagatcgcagagatggacaaaggactatccgaactttcgcctatgcaacaggccttgatttactccttttgcgagaatcatgacaaagccatagaagtactggatggtatcagctggaacagagccgaaatgactatgtgtgcactgctagccaaggttcagatgaaagccaaacggaccaaggaggccgtcgaagtgctgaagaaagcacttgacgcaatttctcactcagataagggacccgacgctaccgccatatccgcagattgtctatataacctgggactgtgctacatggaagaaggcaatctgcagatgacttacaagcttgccatcacagacctcacaacggccatctcaatggataaaaattcatacactgccttctacaaccgggcactatgttatacaaagatcagagagcttcagatggccctgaccgactatgggatagttctgttacttgatgccaccgagacagttaagctaaatacattcttgaatcggggacttatttacgtagaattggggcaatacggcttcgccctcgaggacttcaaacaagcagccctcatcagccggactaacggctctctgtgccacgcaactgctatgtgccatcacagaatcaacgaattcgaagaagctgttaatttcttcacatgggcactgaaaattaatccatgtttcctggatgcctacgtcggccgggggaacagctatatggagtatggtcatgatgaggccacaaaacaggctcagaaagattttcttaaagcccttcacattaaccccgcctatataaaagcgcggatctctttcggctacaatctgcaggctcaaggtaagtttcagaaagcctggaatcatttcactatcgccatagacacggaccccaagaactacctggcttacgaagggcgagcagtggtgtgtctgcagatggggaacaattttgcggccatgcaggacatcaacgctgccatgaaaatcagtacaacagctgagtttctgacgaaccgcggagttatacacgaatttatgggacataagcagaacgcaatgaaggattaccaggacgctataactcttaatccaaagtacagcttggcttacttcaacgcagggaatatttattttcaccacagacagtttagtcaggcaagcgactatttctccaaagccctcaagttcgaccccgagaatgagtacgtgctgatgaacagggcaattacaaacacgatcttaaaaaagtacgaagaggccaaggaggactttgccaatgtaatagaatcatgcccgttttgggcggccgtgtacttcaatagagctcatttttactattgcttgaaacaatatgagctcgccgaagaagatctgaacaaggcactctcactgaaaccgaacgacgccctcgtgtacaacttcagagccaaggttagagggaaaattggactgatagaagaagcgatggccgattacaatcaggcgttagacctcgaagactatgccagcgtcatatag

SEQ ID NO: 33977 - DNA, 1611 bp, Artificial Sequence
  Description of Artificial Sequence: Synthetic coding sequence
atggataagggtttgtcagaactgtcaccaatgcagcaagcactgatttactccttctgcgaaaaccacgacaaggcaatagaagtgttagacggcatatcttggaaccgggccgagatgacaatgtgcgctctgttggcaaaggtgcagatgaaggccaagcggacaaaggaagccgtggaagtccttaagaaagctctagacgcaatctctcatagcgacaaaggacccgatgcaacagcaatcagcgcggactgtttgtataacctgggactgtgctatatggaagagggcaacctacagatggcatttgactcctttacaaaggctgtgaaggccaatcccgacttcgccgagtcattttatcagcggggcctgtgtaaggtgaaactgcacaaagatagctctattttagacttcaatagagctatcaccctaaaccctaagcactatcaggcctacctgtctagagtggctttttatggccttaagggccgttactcaaaggccatcctcaattgtaacaaagccattaagatttacccagaatccgtgcgggcctacctctacaggggggtgttaaagtactataacaaaacgtacaagctagccattacagatcttactactgccatcagcatggacaaaaattcctataccgccttctataaccgagccttgtgctacacgaagatcagagagttgcagatggcgctcactgattatggtatcgtcctccttctggacgcaacagaaactgtgaaattaaataccttcctgaaccgggggttgatttacgtggaactcggtcagtacggttttgctctagaggattttaaacaggcagccctgatttctcggaccaatgggtccctctgtcatgctacagcaatgtgtcaccaccgtatcaatgagtttgaggaggccgtgaacttttttacttgggccctaaagatcaacccgtgcttcctcgatgcttatgttggccgtggaaactcatacatggagtatggccacgatgaggcaacaaagcaggcccaaaaggatttccttaaggccttgcacattaaccccgcttacataaaggctaggatttccttcggctacaatttgcaggcccagggcaagtttcagaaagcttggaatcacttcacaatcgctatagatacagatcccaaaaactacctggcttacgagggacgagcagttgtgtgcctgcaaatggggaacaactttgctgccatgcaagatattaatgccgctatgaaaataagcaccactgctgaattcctaacaaatcgaggggtgatccacgagttcatgggacacaaacagaacgccatgaaggactatcaggacgcgatcaccttaaacccaaaatactccttagcctattttaatgcgggcaatatttacttccaccatcgccagttttcacaggaagaatcattaggcctcgcttggagcctgtctctggattcgtttctacggaccggtggtgccacgttctcatcaggggtgaaccccctacagactctgcaccggcggatgtctatcttgtccccactgccaccaacatgtccccgggatgagatggattttacttcctag

SEQ ID NO: 33978 - DNA, 1563 bp, Artificial Sequence
  Description of Artificial Sequence: Synthetic coding sequence
atgatgaagtactatgatttggctaaattcacgatctaccagatcgccgagatggataagggcctttcagagctgtctccaatgcaacaggccctgatctattcattttgcgaaaatcatgataaggctatcgaagtcctggacgggattagctggaatcgtgccgagatgactatgtgcgccctcctcgctaaggtgcaaatgaaggcgaagcgaactaaggaggccgtcgaggtcctgaagaaggccctcgacgcaatatcgcattccgacaaaggaccggacgccacagccatatctgctgattgcctgtacaatctagggctatgctacatggaagaggggaaccttcagatgacatacaagctcgcaatcacggatctgacaaccgcaatcagcatggataagaattcatacaccgccttctacaatagagctctctgctacactaaaatacgtgagcttcagatggcattaacagactacggtattgtgctgctgctcgacgccactgaaactgtgaagctgaacacctttcttaatcgaggcctcatatatgtcgagctggggcaatacggattcgcgctggaagactttaaacaagctgctctgatttccagaactaatggctccctgtgccacgctaccgccatgtgtcaccatagaattaacgagttcgaagaagccgtcaatttcttcacctgggctttgaaaatcaatccttgcttcctggatgcctatgtaggccgcggcaatagttatatggaatacggccacgatgaggcaacaaagcaagcccagaaagatttcctaaaggctctgcatataaatccggcatatattaaggcgcgaatttcttttggctacaacttgcaagctcagggcaagtttcagaaggcctggaatcattttaccattgcaatcgataccgaccccaagaattacctcgcatatgagggtcgagctgtggtctgtcttcagatggggaataactttgctgccatgcaggacatcaacgctgccatgaaaatctctacgaccgctgaatttctaaccaacagaggcgtgatccacgaattcatggggcataaacagaatgcaatgaaggactaccaagacgcaattacactaaaccccaaatactcactcgcatactttaatgccgggaatatttacttccatcataggcagtttagtcaggcctctgactacttcagcaaggcgctcaagttcgatccagagaatgagtacgtcctaatgaacagagcaatcacaaacacaattctgaagaaatatgaggaggcgaaggaggactttgctaacgttatcgagtcctgccctttctgggccgccgtgtatttcaatcgggctcacttctactattgtctgaagcagtatgagctggccgaggaagacctgaacaaggcactttctttaaaaccgaacgatgctctggtctataattttcgcgctaaagtccggggaaaaataggcctgatcgaggaggcaatggccgattataatcaagccctggacctcgaagattatgcctccgtaatctag

SEQ ID NO: 33979 - DNA, 2532 bp, Artificial Sequence
  Description of Artificial Sequence: Synthetic coding sequence
atggcaaccaaaaaagccggcagccggttagaaaccgaaattgaacggtgtcgctctgagtgtcaatgggaacgtatccctgagctcgtgaaacagcttagcgccaagctgatagccaacgacgacatggctgagttgctcctgggagaatcaaaacttgagcaataccttaaagaacatcccctacggcagggagccagccccagaggtcccaagccccagttgaccgaagtgcgcaagcacctgacagcagccctggatcgcggaaacctcaaaagcgagtttttgcaagagagcaatctgattatggccaagctcaactatgtggagggggactataaagaggctctcaatatctatgcacgggttgggctcgacgacctgcccctcaccgctgtgcccccatacaggctccgggtgatcgccgaggcttacgccactaagggtctgtgtctggagaaactgcccatctctagctccacctccaatttacatgtggacagagagcaggatgttatcacttgctacgagaaagccggagatatcgccctgttgtatctgcaggaaatcgaacgcgtgatactgtccaatattcagaacagaagccccaagcctgggccagccccacatgaccaggaattagggttttttctggagacagggttgcaaagagcacatgtgctttatttcaaaaacggaaatctgacaagaggcgtggggaggttccgggagctgctgcgcgcggttgagactagaaccacccaaaatctacgaatgaccattgcgagacaacttgcagagattctgcttcgtggaatgtgtgaacaaagttactggaaccccctggaagacccaccttgtcaaagccccttggacgatcctctgcgtaagggggctaatacaaaaacctatactctgactcggcgggctagagtgtattcaggcgaaaacattttctgtccccaagagaacaccgaggaggccctgctgctgctcctcataagtgagtccatggccaaccgtgatgccgtgctgtctaggataccagagcacaagagcgataggctcatctccctccagagcgccagcgttgtttacgatttactaactattgccctcgggcgtaggggtcaatatgaaatgttgagtgaatgtctggagcgggcaatgaagtttgcctttgaagaattccatttatggtatcagttcgccctctcacttatggctgccggtaagtcagcacgcgctgttaaagtgctcaaagagtgcataaggctgaagcccgatgacgccactattcccctactggctgcaaagttgtgtatggggtctctgcattggttagaggaagccgagaaattcgccaagacagttgtcgatgtgggcgaaaagactagcgaattcaaggcgaaaggctacttggcactgggcttaacatacagccttcaagcaactgacgccagcttaaggggcatgcaggaggttctacagaggaaggcattactagcatttcagcgagctcactcactcagccccactgaccatcaggccgcattctatctagctctgcaattggctatatcacgccagatccctgaagctctcggttacgtgaggcaggcattacaactgcaaggggacgacgcaaacagcctgcacctgttggctctgctgctgagcgcccagaaacattatcacgacgcactcaacataatcgatatggctctctctgagtatcctgaaaacttcatcctcctgttttccaaagttaaattacagagcctgtgcagaggccccgacgaagccctcctgacatgtaagcacatgctgcagatttggaagagctgctacaacctcacaaatcctagtgattctggcaggggatcatcattgttggacagaacaattgccgaccgcaggcaattaaacacgataacactgcccgacttctcagaccccgagacgggcagtgtgcacgcgacctccgtcgcagcctcccgcgtggagcaggctctctctgaggtggctagttcgcttcagagcagtgccccaaagcagggtcccctgcacccgtggatgaccctggcccagatctggctccatgccgccgaggtgtacatcggcattggcaagcctgccgaggctaccgcttgcactcaggaggccgcaaatctatttccaatgtcacacaacgtgttgtacatgcgcggccagatagcagagctgagaggcagcatggatgaggcccgtcgctggtacgaagaagctctggccattagcccaactcacgtgaagagtatgcagagactcgctctgatccttcaccagctggggcgctatagtcttgccgagaaaattttgagggacgcagttcaggtgaattctacagcacacgaagtgtggaacgggctcggcgaagtgctgcaagcacagggcaacgacgccgctgctacagaatgtttcctgaccgcgcttgagttggaggcctcgtcccccgctgtacccttcaccattatcccacgggtgctgtag

SEQ ID NO: 33980 - DNA, 2583 bp, Artificial Sequence
  Description of Artificial Sequence: Synthetic coding sequence
atggccaccaaaaaggctggatctcggttggagactgagatcgagcgatgcaggagcgaatgtcaatgggagaggattcccgagctagtaaaacagctgtccgccaagcttatcgcaaatgatgatatggcagagctgttacttggcgagagtaagctggaacagtacctgaaggagcacccccttaggcagggtgccagtcctaggggccctaagcctcaattaactgaggtgagaaaacacttgactgccgcccttgaccgcggcaacctgaaatccgaatttctccaggaatctaatctgataatggccaagctcaactacgtggaaggagactataaggaggccttgaacatctacgccagagtgggcctggacgacctgccactgaccgccgtgcctccttatcggcttcgggtaatcgctgaagcatatgccaccaaaggcttgtgtttggaaaagctcccgatttcttctagcacctctaacctgcatgtcgatcgagaacaggacgtgattacttgttacgagaaagccggcgacattgccctgttgtacctgcaagagattgaacgggtgatcctgtctaatattcagaatcgttctcctaagcctggtccagccccacatgatcaagagttaggtttttttcttgagacaggcttgcagagagcccacgtgttgtacttcaaaaatggaaacctgacacgcggtgtgggtagattcagggagttattaagggccgtggaaacccgtaccactcagaatctccgcatgaccatagcccgccagctggctgagattctgctgcgcggcatgtgtgaacaatcttactggaaccccctcgaggatcctccatgtcaatcacccctggatgatcccttaagaaaaggcgcaaacaccaagacctacaccctgacgaggcgagcgcgggtgtatagcggggagaacatcttttgtccccaggaaaacactgaggaggcactgttgctgttgctgatatctgaatccatggcaaacagagatgccgttctgtctcgaatacccgaacataaatctgatcggctgatctctcttcaaagcgcttccgttgtttatgatctgcttactattgccctgggtcgtcgcggacagtacgagatgttgagtgaatgcctagagcgggcgatgaaatttgcattcgaagagtttcatttgtggtaccagtttgcactcagccttatggcagcaggcaagtctgccagagcagtgaaagtcttgaaggaatgtatccgactgaaaccagacgatgccaccatccctctcctcgctgctaagctgtgtatggggtcgttgcactggttagaggaggctgaaaagttcgcgaagacagtggtggacgtgggtgagaagacttctgaatttaaggccaaagggtacctggctcttgggctgacttatagcctgcaagctacagatgcttccctgagaggtatgcaggaagtgcttcagaggaaggcgctgttagcctttcagcgagctcacagcctgtccccgaccgaccaccaggctgccttttacctcgctctccaactcgccatcagccgtcagatcccggaagcccttgggtatgtacgtcaggctttgcagcttcagggggatgacgccaattccctacatctgcttgccctactcttgtccgcccagaagcattaccatgacgccctaaatatcatcgatatggcactaagtgaatatcccgaaaatttcatcctactgttctccaaggtgaaactgcagtcactgtgcagggggcccgatgaggcccttttgacctgtaagcacatgctacagatatggaagagttgttataatctgactaacccgagcgacagtggtcggggctcttctttgttagaccgaacaatcgccgaccgcagacagctgaacaccatcactttgcctgatttcagtgacccagaaactggaaattcccctgaggcgtactttcacgggtttccctccttgtttagtgtctcctccgtacacgccactagcgtggccgcatctcgagtagaacaggccctctctgaggtggcctcgagcttgcagtcctcggctccgaagcagggtccccttcatccttggatgacccttgcacagatctggcttcatgccgcagaagtttacataggcatcggtaaacctgccgaagccaccgcgtgcacccaggaagcggccaatctgtttccaatgtcgcacaacgtgctgtacatgcgcggacagatcgcggaactgcgagggtccatggatgaggctcggcgctggtacgaagaagccctcgccatctcccccacacacgttaagtcaatgcagcgactggcactaatcctgcaccagctcggaagatactctctcgcagagaagatactgagagacgccgtgcaggtcaactctaccgctcatgaagtgtggaacgggctgggagaggtcctgcaagctcagggaaatgacgctgctgctacagaatgcttcctgacggcgctggaactggaagcatccagtcctgcagtacctttcaccatcataccccgtgtgttatag

SEQ ID NO: 33981 - DNA, 1257 bp, Artificial Sequence
  Description of Artificial Sequence: Synthetic coding sequence
atgaccattgcccggcaactggcggaaatccttctccgagggatgtgtgaacagagctattggaaccccctggaggatcccccctgtcagtctcccttagacgaccccttgcgtaaaggcgcgaataccaagacttacaccttaacccggcgcgctcgcgtgtactccggagagaatatcttctgcccacaggagaacactgaggaggctttgctcctcttgttgatctccgagtccatggccaacagagacgctgttctttcgcggattccagagcataaatctgataggctgatctctctgcagtccgcaagcgttgtgtatgatctcctcaccattgccctcggccggcgtggtcaatacgaaatgctgtccgaatgtctggagcgcgccatgaaatttgcattcgaagaatttcacctctggtatcagtttgccctcagcctcatggctgctggcaaaagcgcccgtgctgttaaagttcttaaagagtgcataaggctgaagccggacgatgcaaccattcccctcctggccgcaaagctgtgtatgggcagcctgcactggttggaagaggctgagaagttcgccaaaacggtggttgatgtcggggagaagaccagcgagttcaaggcaaagggatatctggctctgggactcacttactctttacaggcaaccgacgcctcattgaggggaatgcaagaggtcctccagagaaaagctcttctggcatttcagcgggcccacagcctctctcccaccgatcatcaggctgcattctacttggcccttcagttagcaattagccggcagatccctgaggccctggggtacgtccggcaggcactccagctgcagggggacgacgctaattcactgcacctgctggccctgctcctgagcgcccaaaagcactatcatgatgccttgaacattattgacatggcattgagcgagtacccagagaactttattttgctcttctcaaaagtgaaattgcaatcattatgcaggggccctgacgaggccctattaacttgcaagcacatgcttcagatctggaagtcttgctacaacctgaccaatcccagcgacagcggaagagggagcagcctgctcgataggactatcgccgaccgcagacaattgaatacaatcacacttccggacttttcagacccagagacaggcaatcagtgttcatggatagcctttggagaaatgttggtggacatgggtatccagtgcatttag

SEQ ID NO: 33982 - DNA, 993 bp, Artificial Sequence
  Description of Artificial Sequence: Synthetic coding sequence
attcccgaggctcttggctatgtgcgtcaggcgttgcagttgcagggggacgatgccaatagcctgcatctcttggctctcctgctatcagcgcagaaacactatcacgatgcgctgaacatcattgatatggcactgtccgagtacccagagaatttcattctattattctctaaggtcaagttacagtccctttgccgtgggccagatgaagcccttcttacgtgtaagcatatgctgcagatctggaagtcctgttataacttgaccaacccctccgattccggtaggggaagtagtctattggaccggacgattgctgaccgacggcagctgaacacaatcacactacccgatttttccgaccccgagaccggcaattcacccgaggcctactttcacggattcccgtctttattctccgtctcctctgtccatgccacatctgtggctgcctcacgggtagagcaggccctgtccgaggtggcgtccagtttgcagtctagtgcacctaaacagggccctcttcatccatggatgaccctggcccagatctggctgcatgcagcagaggtgtacatcgggataggcaaaccagccgaagcgactgcctgcacacaggaagctgctaacctgtttccaatgtcacacaatgtgctgtatatgagaggtcagatcgctgaactacgcgggtccatggatgaggcacggagatggtatgaagaggccctggctatttcaccaacccacgtgaaatccatgcaaaggttggccctgatcctgcaccagctgggacgctattcactagccgagaagatactgcgggacgcggttcaggttaatagcaccgcccatgaagtatggaatggcctgggtgaggtgttacaggctcagggaaacgatgcagccgctactgagtgttttctgaccgctttggaactcgaggcatcctcacccgccgtgccttttaccattatacccagggtgctttag

SEQ ID NO: 33983 - DNA, 720 bp, Artificial Sequence
  Description of Artificial Sequence: Synthetic coding sequence
atgcagcgtggtgcactgtccccagtgctgatgctttcagctgctccagaaccaccccctcggcccccccctgccctcagtcctccagggtctggaccaggctcaggatctcgccatggttccgcgagacctggtcccaccccagaacctagtggcagcttgggagccgcactggattcgtctttaagggccgccgtcgcattcaaggcagaaggtcagcgatgttatagagagaagaagttcagagaagccattggcaagtaccaccgagccctgctacagctgaaggccgcacaaggcgctagaccaagcgggctccctgcccccgccccaggtcctacatctagcccagggcccgctcgactaagcgaggagcagagacgtcttgtagaatccacagaggtagagtgttacgattcgcttaccgcctgtctgctgcagagtgaattagtgaactacgaacgggtcagagagtactgtctcaaggtgttggaaaagcaacagggaaatttcaaagccacttacagggcgggaatcgccttttaccacctgggagactacgcaagagctctgaggtacctgcaagaagctcgcagccgtgagcccacagataccaatgtccttaggtacattcagttgacccagctcaagatgaaccgatgctctctgcagcgggaagactctggggccggaagtcagacaagggacgtgattggttag

SEQ ID NO: 33984 - DNA, 516 bp, Artificial Sequence
  Description of Artificial Sequence: Synthetic coding sequence
atggagaagagactgcaggaagcccaactgtataaggaggaaggaaatcagcgctacagagagggaaagtatagagatgctgtcagcagatatcaccgggcattgcttcagctgagaggattggacccctctctgccatccccgcttccaaacctgggacctcagggcccggcactcactccagagcaggagaatattctccacactacgcagaccgattgctacaataatctggccgcttgtttgcttcaaatggagcctgtgaattatgaacgtgttagggagtactcccagaaagtgcttgagcggcaacctgataacgctaaggctttatatcgggctggggtggccttcttccatttgcaggattacgaccaggcacgacactatctgctcgcagccgttaacagacagccgaaggatgctaacgtgaggcggtacttacagctcacacaatctgaactctcttcttatcaccgaaaagaaaaacagctgtacttaggaatgttcgggtag

SEQ ID NO: 33985 - DNA, 648 bp, Artificial Sequence
  Description of Artificial Sequence: Synthetic coding sequence
atgcttaataaggaggaagaactcgaactgctggaggcactatggtcgttttccacctctcccgcacacagcctgctgctgcctggcaggggaggagccgggcccatcgagagacgaaagcccgtaagtcaggctttcagcagaccacagcagtttctctcaagagcacttctcgagttctttggcaagtctcacccgcctccgcacaggctgtttagaaagagcttaaatgtgggactgcactattctcatattcccttcttgaccacctgtctgcacttcctcagaaaacgtttgcaaaaaggtgaagtgggtctttctgtcgaaacgagcaaaccacaagttcccgtgggtggactgagtcgcaagaaggtcccacaggagccttgggcaaccgtgatggaaaagcggctgcaggaggctcagctgtacaaagaggagggcaaccaacggtatagagaaggtaagtatagggacgccgtcagtcgctatcacagggccctgctccaattgcggggcctggaccccagcttaccttcccccctcccaaacctggggcctcagggaccggcacttaccccagaacaagaaaatatcctgcatactacgcagacagattgttacaacaacctcgccgtggtgaagtag

SEQ ID NO: 33986 - DNA, 423 bp, Artificial Sequence
  Description of Artificial Sequence: Synthetic coding sequence
atggaaaagaggctgcaagaagcccagctgtacaaggaggaaggcaaccagcggtaccgcgagggcaaataccgggatgccgtctccaggtatcacagggcattgctccagctgcgtggactcgatcctagtctgcccagtccattgcccaacttaggtcctcaggggccagctctgacacccgagcaggaaaatatactgcataccacccagacagactgctacaacaacctggcggcttgtcttcttcagatggaacctgtcaactatgaacgggtcagagagtatagccagaaggtgctggaaagacagcccgacaatgccaaggctctttatcgggctggagttgcgtttttccatctccaagactacgaccaggcgcgccactatctccttgccgccgtaaacagacagccaaagtag

SEQ ID NO: 33987 - DNA, 516 bp, Artificial Sequence
  Description of Artificial Sequence: Synthetic coding sequence
atggaaaaacgcctccaggaggctcagctgtataaggaagaagggaaccaacgctatagggaggggaagtacagggatgcagttagtcggtaccatagagccttgttgcagttgcgcggacttgatccatccctgccatcccctctgccaaatctcgggccccagggcccagctttgacaccggagcaggagaacattttgcatactacacagactgactgttataataatctggccgcatgcctccttcagatggagcccgtgaactacgaacgcgtaagagagtactctcagaaagtcctggaacggcagcccgacaacgccaaagccctttaccgggcaggagtcgccttttttcatctgcaggactacgaccaggcccggcattacctcctggcagctgtcaatagacagcctaaagacgccaacgttagacggtatcttcagctgactcagagcgaattatctagttaccacagaaaagagaagcagctttacctggggatgttcggttag

SEQ ID NO: 33988 - DNA, 6003 bp, Artificial Sequence
  Description of Artificial Sequence: Synthetic coding sequence
atgttccggaattctcttaaaatgctgctcaccggcggtaaatcatcccgtaagaataggtcttccgacggtggctcagaagagccgccagatcgtcgccaatccagtgtagacagccgacagagcaggtccggccaggggggtatctcaacggagtctgactgtgcttttgagcccgactatgccgttccccccctgccagtgagcgagggtgatgccgaacaggaactggggccacccccatcagtggatgaggcagcgaacacgctgatgacaagacttggatttttgctcggggaaaaggtgaccgaggtgcagcctggagaccagtacagcatggaagtccaggacgaaaaccagactagcgccattacacagcgaatttctccctgttctacattaactagttccaccgcctccccgcctgctagctccccctgtagtacactgcccccaatatccaccaacgccacagcaaaggactgtagctacggggcagtcacttcccctacatctacacttgaatcacgggactccggtattatagcgacacttacatcctattcagagaacgtagagcgcaccaaatatgcaggcgagtccagcaaggagctcggcagtggaggcaatatcaaaccttggcagtcacagaagtcatccatggacagctgcctttaccgcgtggatgagaacatgacagcaagtacttattcactcaacaagattccggagaggaacctcgaaaccgtcttgtctcaatccgtgcaatctattccgctgtacctcatgcccaggccgaacagcgtggcagccacttcctccgcccatctggaggatctggcctatctggatgaacagcgccacacacccctcaggacgagcctgaggatgccacggcagagtatggggggcgctcggactcagcaggacctgcgagtgcggtttgcgccttatcgtcctcctgatatctcactgaagccattgctttttgaagtaccatcaatcaccaccgaatcagtatttgtgggtcgggattgggttttccacgaaatcgacgcccagttgcagagttcaaatgcatccgttaaccagggggtggttattgtaggtaacatcggattcggtaaaaccgcaataatctctagattggtcgcactgagctgtcacgggacacggatgagacagatcgcatctgattcaccacacgcctcgcctaagcacgtggacgctaatagagaactgcccctcacacagcctccctccgcccattcttccatcacaagcggaagctgtcccggaacccccgaaatgagaaggagacaagaagaggcaatgagaagactggcatcccaggtcgtggcatatcactactgtcaggcagataacgcttacacctgtctggtgccagagtttgtgcacaatgtcgccgcactcctttgtcggtcacctcagctgacggcttaccgcgagcagctgctgagggagcctcacctccagagtatgctctccctcagaagttgtgtccaggatcccatggcaagcttcaggcgaggagtcctggagccgttggaaaatctgcacaaggagcgcaaaatccctgatgaagactttattatcctcatcgacggcctgaacgaagcagagtttcacaagcccgactacggcgacacgatcgtttcctttcttagcaaaatgataggaaagttcccatcatggctgaagctgatcgtgacagtcagaacctcactgcaggagattacgaagttacttccattccacaggatctttctggatcggctggaagagaacgaagctatcgaccaagatctccaagcttacatcctgcatagaatccactcgtcatccgaaatccagaataatattagcctcaatggcaaaatggacaataccacctttggtaaattgagtagccaccttaaaactctgagtcagggatcctatttgtatctgaagctgacctttgatctgatagaaaaaggatacttagtcttaaaaagtagtagctacaaggtagttcccgttagcttgagcgaagtgtacctgttgcagtgtaacatgaagttccctactcaatcctcttttgaccgcgtcatgccgcttctcaacgtagctgttgcctccctgcatccactgactgatgagcacatcttccaggccattaacgccggctccatcgaaggtaccctggagtgggaggacttccagcaaagaatggagaatctgagtatgttcctaatcaaacgccgggacatgacacggatgtttgtgcaccccagctttcgcgaatggttaatatggcgggaggagggggaaaagacgaaattcttgtgtgaccctaggagcggccatactcttctggccttctggttttcccgacaggaggggaaactgaatagacagcagacaatcgagttaggccaccatatattaaaagcccacattttcaagggcctatccaaaaaagttggggtttcttcctcaatcctgcagggcctctggatttcatactccacagagggactgagcatggctctggcctctctgcgaaatctgtatacccccaacatcaaagttagtagactgctcatcctcggtggtgctaacattaattatagaacggaggtgctgaacaacgcaccgatcctgtgtgtgcagagtcatcttggctataccgaaatggtagcccttctcctcgaattcggcgctaatgtcgatgccagctcagagagcgggctgacaccactcggctacgcagccgccgccggctacttatctatcgtcgtgctgctgtgtaaaaaacgtgccaaggtcgaccacctggataagaatgggcagtgcgcgctcgtgcatgccgcattgaggggccatctcgaagtggtcaaattcctgattcagtgcgattggacgatggccggtcagcagcagggggtgttcaaaaagtctcacgccatacagcaggctctgatcgcagcagcttccatgggctacactgagatcgtttcatatctactggatctgcccgagaaggatgaagaagaggtggagcgggcgcagataaattcattcgacagcttatggggggaaactgctctcaccgccgctgctggccgagggaaattagaagtgtgccggctcttattggaacagggcgctgccgtggctcagcctaatcgccgaggcgccgtccctctcttttctaccgtccggcaaggtcattggcagattgtcgatctgctattgacccatggggctgacgtaaatatggccgataaacagggaaggacccctctcatgatggcagcgagtgaggggcacctgggaacagtggattttttgctggcccagggcgccagcatcgcactaatggacaaagagggcttgacagccttgtcttgggcctgcctcaagggacacctctctgtcgtcagatccctcgttgataatggcgccgcgacggatcatgccgataagaacggtcggacaccgctggaccttgccgcattttacggggacgccgaggtggtgcagttcttggtggaccacggcgccatgatcgaacacgtggattactccgggatgagacctcttgaccgcgccgttggctgcagaaacacctcagtggtcgtgactctgctaaaaaagggcgccaaaattggatgtcaaactttaccatcccgtcctcgtggacctgcgacatgggcgatggctaccagcaaacctgacatcatgatcattcttctgtccaaactgatggaagaaggagacatgttctataagaaaggaaaagttaaagaggccgctcagcgttatcaatacgcactgaagaaattccctagagaggggtttggtgaggatctaaagaccttcagagaactgaaggtgtccttgctcctaaacctctctagatgtcgccgaaaaatgaatgattttggcatggccgaggagtttgctacaaaagcactggagctcaagccaaaatcctatgaggcgtactacgcgcgcgccagggccaaacgctcttccagacagttcgcagctgctctggaggacctgaatgaagccatcaagctgtgccccaataaccgcgagattcagagactgctgcttcgggtcgaggaggaatgccggcagatgcagcaaccgcagcagccgccgccacctcctcagcctcaacagcagctgccagaggaggctgagccagagccccagcatgaggacatttacagcgtgcaggacatcttcgaggaagagtaccttgaacaagatgtagagaacgtgagcatcggactacagactgaggcgaggccctcccaggggctgcccgtcattcagtctcccccatcgagcccaccacatcgagactcagcttatatttcctccagcccactggggtcccatcaggtcttcgacttcagatcaagctctagtgtgggttcacccacccggcagacctatcaatctacctctcccgccttgtcccccacacaccagaacagtcattatcgaccgagtccccctcacacctccccagcacatcaaggcgggagctacagattttctccccctccagtgggaggccagggaaaggaatacccctctccacctccgtcccctctccggcgtgggcctcagtaccgagcgtcccctcccgctgaatccatgtcagtgtaccgcagtcagtccggctctccggtcagatatcagcaggagaccagtgtgagccagctgccagggcggccaaaatctcctctcagcaagatggcccagcgtccctatcagatgccccagttacccgtcgcagtcccccagcaggggctgcggctccagccagctaaagctcagattgtgagatccaatcaacctagccctgccgttcactcttcaacagttattccaactggcgcatacggccaggttgcccattctatggcctccaaataccagtcatcccagggcgatattggcgtgtctcagtccaggctcgtgtaccaggggtctatcggcggcatcgtcggtgacggcagacccgtgcaacacgtacaggcctccttatccgccggtgccatctgtcagcacgggggactgacaaaagaagaccttccacaaaggccaagttccgcataccgggggggcgtacgttattctcaaacccctcagattggcaggagccagagtgcttcttattaccccgtttgtcacagcaaattagacctggaacgctcatcttcgcaactgggctcacccgacgtttcccacctgattagacgccctatcagtgtgaaccctaacgagataaagccgcaccccccaacaccccgccccctgctgcactcccagtccgtcggccttagatttagcccctcatctaacagcattagcagcacttctaatctgacccctacgtttaggccttcttccagcattcagcaaatggagataccattgaagcccgcgtacgagagatcctgtgatgaactgtctccagttagccctacacagggtgggtacccctcagaacctacccgtagcagaacaacccctttcatggggatcatcgataaaactgcccgtacacagcagtacccacacctgcaccaacagaacagaacttgggccgtttcttctgtagacacggtgctttcccctacctcaccgggaaacctgccacagcccgagtccttctccccaccatcaagcatctccaatatcgctttttataataaaaccaacaacgctcagaatggccacctgctggaagatgactactacagtccacacggcatgctggctaacggctccaggggggatttactggagagagtgagccaggctagttcgtacccagatgtgaaagtggcgcgtactctcccagtggctcaggcctaccaagacaatctctacagacagctgtcccgggacagtcgccagggtcagacttcaccaattaagccaaaaaggcccttcgtagagtcaaacgtgtag

SEQ ID NO: 33989 - DNA, 5973 bp, Artificial Sequence
  Description of Artificial Sequence: Synthetic coding sequence
atgtttcgcaacagcttaaaaatgctgctaactggcgggaaatcatcacggaaaaatcgaagttctgacgggggatccgaagagcctccagacagaagacagtccagtgttgactcgcgccagagtcgatcaggccaagggggcatcagcacggagtctgattgcgcatttgagccagactatgcagtcccgcccctgcctgtgtctgagggagatgctgagcaggagctcgggccacctccttctgtggatgaggctgctaacacactcatgactaggctgggctttctgttaggcgagaaagtcacggaggtgcagccaggagaccagtacagcatggaagtacaggatgaaaatcaaacctctgccatcactcagcgtatctcaccctgcagtacgctcaccagctcaactgcaagccctcccgcctcatctccttgctccacattgccaccaatcagtaccaacgcaactgcaaaggattgctcttatggggccgtcacaagcccaacctccactttggaaagcagggacagtgggattatagccaccctaacatcgtatagcgagaacgttgagcgaactaaatatgccggcgaatcttctaaagaactgggcagtggagggaatattaagccttggcagagccaaaagtcaagtatggactcctgtctgtaccgggtggatgagaacatgacagctagcacatattcactgaacaaaatcccagagcgcaatctcgagaccgtgctgagccagtcagtccagagcataccattatacctgatgcccaggcccaatagcgtcgccgccaccagttccgcccatttagaggatctggcctaccttgatgaacagcgccacacacccctcagaacaagcctgagaatgccacggcaatccatgggtggcgctcggacccagcaggaccttcgcgtgcgtttcgccccctatagaccaccagatatctcactcaagcccctgctgttcgaggtaccctctattaccacagaatctgtattcgtgggacgcgactgggttttccacgagatagatgcacagttgcagtcctcaaacgcctctgtcaatcagggcgtcgtcatagttgggaatatcggcttcggcaaaacggctatcatctcacgcctcgtcgccttatcctgccacggcactcgcatgagacagatcgcttccgattcgccccacgctagccccaaacacgtcgacgctaacagagagttgcccctgactcagcccccttcagcccattcctcgataacatctgggagttgccctggtacgcctgagatgcgacggcgccaggaagaagcaatgcgacgactggcttcccaggtcgtggcttatcactactgtcaggccgacaacgcctacacctgcttagtgccggagtttgtccacaacgtcgccgcactgttatgtagatccccccagctgactgcatatcgcgaacagcttctgagagagcctcacctgcaaagtatgctgtcgctgcgatcttgcgtccaggaccccatggcaagctttaggcgaggagtgctagagccactcgaaaatttacataaggagcggaaaatccctgacgaagatttcatcatcctcattgacgggctaaacgaagcagaattccacaaacccgattatggagataccattgtttcatttttgtccaagatgatcgggaaattcccaagctggctcaaactgatcgtgactgtccgcacttcattacaggaaatcacaaaactgttgcctttccacagaatttttctagaccgcctcgaggaaaacgaggccattgaccaggatctgcaagcctacattctgcaccggatccattctagtagcgagattcaaaacaatatttctctgaatggaaagatggacaatactacctttggcaagctttccagccacctgaagaccctgtctcaggggtcttacctctacctgaagctgacatttgatttgatcgagaagggctatttggtgctcaagtcctcaagctacaaggtcgtgcctgttagtttgagtgaggtctatctgctgcagtgtaacatgaagtttccaacacaatcatctttcgaccgcgtcatgcccctcctaaatgtggcagtcgccagcctacatccacttaccgacgaacatattttccaggccatcaacgccggcagtatagagggtacccttgagtgggaagattttcaacagcgcatggagaatctgagcatgttcctcataaagcgaagagatatgacacgcatgttcgttcacccctcctttcgcgagtggctcatttggcgagaggaaggagagaaaactaagtttctatgcgatcctcgttctgggcataccctgctggctttttggttttcaaggcaggagggaaaactgaaccggcagcaaaccatagagctggggcaccacatactgaaggctcatatctttaagggtctgagtaagaaagtcggggtgtcaagttctatactgcaggggctttggatttcctatagcaccgaagggcttagcatggccctggctagcttaaggaatctgtatacacctaatattaaggtgtcccggttgctgattttagggggcgccaacatcaactaccggactgaggtcctgaacaacgcaccgatcctttgcgtgcagagccatttggggtacacagaaatggtggctctcctgttggagtttggtgcaaacgtcgatgcatcaagcgagtcggggctgactcccttgggctacgctgccgctgccggctatctatccatagtggtgctcctttgcaagaaacgggctaaggtggatcacctagataagaacggtcagtgtgcacttgttcacgcagctctgcgtggacatctggaagttgtcaaatttttaattcagtgtgactggacaatggccgggcagcagcagggcgtgttcaagaagtcccatgccattcaacaggccctgatcgcagctgcctccatgggctatacggaaattgtatcctatctacttgatcttccagaaaaggatgaagaagaggttgaaagggctcagataaattcttttgactcactctggggcgagacagccctgaccgcagctgcagggagggggaagctcgaggtgtgcagattgttacttgagcaaggagcagcagttgcgcagcccaaccgtagaggagcggtgccccttttttccaccgtgcgccagggacattggcaaatcgtggatcttttactgacgcacggggctgatgtcaacatggccgacaagcagggacggacacctctgatgatggctgcgtctgaaggccatctgggcaccgtggattttttactggcacagggcgccagcatagccctcatggacaaagaaggtcttaccgcgctgagctgggcctgtctgaaaggccacctgtccgtcgtccgttctctggtcgacaacggggctgctactgaccacgccgataaaaacggtcgcacccccttagatttagcggccttctacggagatgccgaagtggtgcagttcctggttgatcatggggccatgatcgagcatgttgactactcaggcatgaggccattggatagagctgtgggttgccggaatacttctgtggtcgtgaccctgttaaagaagggggctaaaatcggcccagctacatgggcaatggcaacatccaagcctgacatcatgatcattcttctgagtaagctgatggaagagggtgatatgttttataagaagggcaaagttaaggaggccgctcaacgctatcagtacgcactgaagaaattccccagagagggctttggggaagatctgaaaacctttcgtgaattaaaggtcagtctgctgctaaatttatccagatgtcgtcggaagatgaacgactttggcatggcggaagaatttgctaccaaagctttggagctgaaacctaaaagttatgaagcctactatgctcgggctagagcgaagcgatcttctcgacagtttgctgccgccctggaggatcttaatgaggccataaaactttgccccaataatcgtgagatacaacgactactgctgagggtggaggaggagtgtaggcagatgcagcaaccacagcaaccgcctcctccccctcaacctcagcagcagctccccgaggaggcagagccagaaccccagcacgaggatatatacagcgtccaggacatctttgaggaggagtacctcgagcaggacgttgagaacgtgagcattggtttgcaaaccgaagcccgcccatctcagggactgccagtcatccagtcaccaccatctagtccaccccatagagacagcgcttacatttcctcgtccccattgggctcccaccaggtgtttgattttcgcagctcttcaagcgttggctctccaactcggcagacctaccagagtacttccccagcactgagtcccacacaccagaactctcactatcgaccatcacctccacatacttcacctgcccaccagggcggttcgtacagattctcgcccccccccgtggggggccagggtaaagaataccccagccctcctccttctccactgcgaaggggcccacagtaccgggcttctcccccagctgagtccatgtccgtgtaccgaagtcaaagcggctcccctgtgcggtatcagcaagagacttccgtgagtcaacttcccggtaggcctaagtctcccctgtcaaaaatggcacagcgcccataccagatgccccagttgcccgtggccgtgccccaacaaggactgcgccttcagcccgcaaaagctcagatcgttcggtctaatcagccaagtcccgcggtgcactcaagtacggtgatacccacaggtgcttatggccaagtcgctcattctatggcctccaagtaccagtcatctcaaggggacatcggggtgagtcaatctagactggtctaccagggcagcattggtggtatagtgggagatggcagaccagtgcagcacgttcaggccagcctatctgcaggcgcaatttgccagcacgggggtctaacgaaggaggaccttccccagcgtccctccagtgcttaccggggaggagtgcggtacagtcagaccccacagattggccgtagtcagagcgcctcatactatcctgtctgccattcgaagctcgatttagagcgctcctccagccagctggggtcccccgatgttagccatctgattcggcgccctatctctgttaatcccaatgaaataaagcctcatccaccgaccccacgaccactgctgcatagccagtccgtgggcttaaggttctctccatcgtcgaacagtatttctagcacatccaacctcacacccacttttagaccatccagttccattcagcagatggagatccccctcaaacctgcttacgaaagaagctgtgacgagttaagcccagtctcgccgacacaggggggctaccccagtgaacctacacgatcaaggaccacccccttcatgggaatcattgataagacagccaggacacagcagtacccccatttgcaccaacaaaacagaacgtgggcagtgagctctgtcgacaccgtgttgagtccaacatcccctggaaacttgccccagcccgaatcattctcccccccctcctctataagtaatatagccttctacaataaaactaacaatgcgcagaacggccatttactcgaggacgattattattccccccatggtatgctggccaatggatcaagaggtgacctgctggagcgagtgagtcaagccagttcctacccagacgtcaaggtggccaggacccttccagtggctcaagcctatcaggataatctttaccgacagttgagcagggattcccgccagggacaaacctcccctattaaacctaaaaggcccttcgtggaaagtaatgtctag

SEQ ID NO: 33990 - DNA, 468 bp, Artificial Sequence
  Description of Artificial Sequence: Synthetic coding sequence
atgtcggatagtgatctgggcgaagatgaaggattgctctccttggccgggaagcgcaagagaagaggaaatttaccaaaggaatcagtcaaaatattgcgggactggctgtacttacatcgctacaatgcttacccttccgaacaggaaaagctgtccctctcggggcaaacaaaccttagtgtgttgcaggacgaattcctggatgtaatttattggtttcggcagattattgccgtcgtcttgggagtgatttggggcgtgctgccactgcgaggctttctgggcattgctggcttctgtctaatcaatgcgggggtgctctatctgtacttttctaattacctccaaatagacgaagaggagtatggtggtacctgggaattgacgaaggagggcttcatgacatcgttcgccctgtttatggtcatttggattattttctataccgctatccattacgactag

SEQ ID NO: 33991 - DNA, 1398 bp, Artificial Sequence
  Description of Artificial Sequence: Synthetic coding sequence
atggagaaccaggaattcctctcttcctctgctcctagtgaagtaaccgatgggcaagttagcaccgagataagcacttgttccgaggtgtttcagaagcctatcgtgcttcgaatcctggatacccatcgagagctggaggagtctgaagatcctgaaaagcacgagaatcctgaggagcctgaggaggtgcgtgaacaggatcagcgggacgagagtgaggagtgcgatgagccccatgaatcctacgagccccacgcaccgtatgcacctcataaaccccgtgactcctatgcgccatacgaactgcatggcccccatgctgcaccgaagcttctcaaggctcgggagccgcggcaactgagacacaccagagagcctagaaagagtcgagaggctaaggaaactgaactactacccagtgcggcagtgatgatctctccttcgttaatcacccgtgcccctccgcgcccacaactgagtttcctcggcgctaatcccgtctcatgcgattttgttcggaagtgtttttcgtcaaggaagcggacccccaatttgtccaaacccaagaagcagtggggcacccccgaccgaaagctgttctggggcaaccaggaccccatcagacccgtcagtcagggagccctaaaagctcaacttacgaaacggctggaaaacttagcacagccaaaagaggtttcatgtcattatgttcccaaccgggcccagtactatcacagctgcggcagggagagcgtgatctgggaaattacaccccccgccctgtttcggcagccctcaaagcggatacaacgcctcagtcagcctaatgggtttaagcggcagtgcctgctcaatcgccccttcagcgacaacagcgcgagagatagtctccgaatctcagaccctagcccacgcattctgcagctgagcgtggccaaaggaaccgatccaaactaccacccgagcaagaagatgcagactaaaatcagcctgagcacattgagcgcaattgctacaccacgaattattgagctcgcacaccccaggataaaactagagggactttgttacgagcgccagagatcagaacttccaattaggcctgtgccccccgctgcaatgatagcgaaaccatcaccccgcacaatagccctggctaaaagcaaaagcgttcaccaggactatctccccgatcgggatgcccattggcctgtcagttatgccactacccactccaaggcaagcccaaggatacaggagctggccaatcctaacaaacgtgctcccgtgagaatagtgtactacgatcccgatgtcttcaagacaaagcccgcggctctgaaggctcagtgcagccagcgtatttgggaacttagccagcctttgaccaggtag

SEQ ID NO: 33992 - DNA, 318 bp, Artificial Sequence
  Description of Artificial Sequence: Synthetic coding sequence
atggcccagggactgatcgaggtcgagaggaaatttctgccaggtccaggaactgaggagaggctgcaggaactgggcgggacattggaatacagggtgacgtttagagacacatactacgacactcccgagctcagcttaatgcaagccgaccactggctgagacgcagagaagacagtggttgggaactcaaatgccccggcgctgccggggtgctaggcccccacactgaatacaaagagttgactgctgaacccacgatcgtcgcgcagctctgtaaagtctgcttgcaccgacggcagcaccagccgagctag

SEQ ID NO: 33993 - DNA, 753 bp, Artificial Sequence
  Description of Artificial Sequence: Synthetic coding sequence
tagtatgctctgcccaacgcaagctggtgctctgatatgctgagcctgtaccaggaattccttgaaaagaccaagagcagcggttggattaagctgccttcatttaagtccaaccgcgaccatatccgaggcttgaagctgccgagtggcctggctgtaagctcagataaaggtgattgtaggatctttaccaggtgtatccaggtcgagggacagggtttcgagtatgtcatattttttcaacctactcagaaaaaaagcgtgtgcctgttccagccaggatcctatctcgaagggccaccggggtttgcccacggtggctctctggccgccatgatggatgagactttctccaaaacagcatttctggccggagaggggctgtttacgctaagcttgaatatacgttttaagaacctgattcctgtggatagcctcgtcgttatggatgtggagttagacaagattgaggaccagaaactgtacatgtcgtgtatcgcacattcctcatggaaaaaatcacttccatctaatagccattgtgcttgcaggcgggctacagcatcacccgcatgtcttctgcctcctgcaagcccagcatgtctgctaccacctgcatctcctgcatgcttattgcctcctctgcccgcttcttgtctgctgccccccctgccagcatcttgtctccttccacccctgcccgcctgggatccttctaagtcgagagaaggcagtagttccagcaactggtag

SEQ ID NO: 33994 - DNA, 402 bp, Artificial Sequence
  Description of Artificial Sequence: Synthetic coding sequence
atgcgagacctcagcgaaagacggctgggtcaaccggaattaaaagccgagcagcagatgccactggagccagtgcgagctcgtttgtctgtgggccttgcgtgttgctgctcccacaccaccgctgaagcttcatctttagaacacggcgataaagtgttcgggcaaggctttcccagccctcttgaggaaatcaagcgcctgcttaaaatatcaagggctttgcaggctagatcagtgccatcaacgcaggaaaaggcaaaatgtctaagcggtgagcctggccagcctgaaggcaagggccaggagacttacccgggacctggaaaagtggaaggaaaagctgagccagctatgcgaaaggacgacgtgtgccctggtatgaaatgcatttctggatag

SEQ ID NO: 33995 - DNA, 402 bp, Artificial Sequence
  Description of Artificial Sequence: Synthetic coding sequence
atgcgtgatctcagtgaacgtcggctgggacagccagagctgaaagccgaacagcagatgcccctggaaccagtcagggcgcgattgagcgtcggtctggcttgttgctgctcccacaccacggcagaggcgagtagtctggagcatggcgacaaggtcttcggccaggggttccctagtcccctcgaagagatcaaacgcctgcttaagatttcgcgggctctgcaggcccgttccgtgccatctacccaagaaaaagccaagtgtctgagcggagagcctggacagccagagggcaagggccaggagacctatcccggccctgggaaggtagaggggaaggctgaacccgccatgcggaaggacgacgtttgccccgggatgaaatgtatctctggctag

SEQ ID NO: 33996 - DNA, 1551 bp, Artificial Sequence
  Description of Artificial Sequence: Synthetic coding sequence
atgccctcatctacttcccctgatcagggggacgacctcgagaactgtatcctacgctttagtgaccttgaccttaaggatatgtcactaatcaatccctcttcatcactcaaggccgaattggacgggtcaacaaagaaaaagtattccttcgcaaaaaaaaaggccttcgctctcttcgtgaagacaaaagaggtccctacgaagcgaagcttcgagtgcaaggagaaactttggaagtgttgtaggcagctcttcaccgatcaaacctccatccaccggcatgtggcaacccagcacgctgacgagatttaccaccagacggcttccatactcaagcagcttgctgtcactctttctaccagcaaaagcttaagctccgcagacgaaaagaaccccctcaaagagtgcctcccacattcccacgacgtgagcgcgtggcttcctgatatctcatgtttcaatccagacgaactaataagcggccaggggtcagaggaaggcgaggtcttgctgtactactgttatcacgatctggaggatccccagtggatctgtgcttggcaaaccgctctgtgccagcaccttcacctgaccggaaaaattcggattgcagcggagggaatcaacggcacggttggcgggtccaagctggctacaagactctacgtggaggtcatgctgtcttttccgctctttaaggacgacttatgcaaagatgatttcaaaacaagcaagggaggagcacattgttttcccgagcttcgtgtcggcgtttttgaagagatcgttccaatgggcatttctcctaagaagatttcctacaaaaagccaggcatccacctgagtcctggagagtttcacaaagaggtggaaaaattcctgagccaggccaaccaggaacaatctgatactatacttctagattgtagaaatttttacgagtcaaagattggccggttccagggttgccttgctcccgacattcgaaaattttcttatttcccatcgtatgtcgacaaaaacctggagctttttagagagaaacgtgtgctgatgtactgtactgggggcattagatgtgagaggggttcagcctatctgaaggctaagggagtgtgcaaggaagtcttccagctgaaagggggtatacacaaatatttagaggagttcccggacggcttctataaaggaaagctgtttgtcttcgatgagaggtacgccctgtcctacaatagcgacgtcgtgagcgaatgtagctattgcggcgccaggtgggaccagtataaactatgctccacgccccagtgccgtcagttggtgctgacttgcccagcgtgccagggccaggggtttaccgcttgctgcgtgacttgccaggacaaggggtctcggaaagtcagcggccccatgcaggactcttttaaagaggagtgtgaatgcacagcaagacgccccaggattccccgggagctgctgcaacatgtacgccagcctgtgtctcccgagccaggacccgacgccgatgaagatgggcctgtcctgatgtag

SEQ ID NO: 33997 - DNA, 504 bp, Artificial Sequence
  Description of Artificial Sequence: Synthetic coding sequence
atggatctatgcctggcagattctagcgtcagcgcccctgcaccacacagacaagggatacacctgagccctggcgaattccataaggaggttgaaaagttcctgtcacaggctaaccaggagcaatccgacacgatccttctggattgcaggaacttctatgagagcaaaatagggagattccagggttgccttgctcctgacatcaggaagtttagctactttccatcgtatgttgataaaaacctggagcttttcagggagaagcgcgtcctgatgtattgcaccgggggtatcagatgcgagagaggcagcgcctacctcaaggcaaaaggagtttgtaaggaggtttttcaactgaagggtggaatccataaatacctcgaggagtttcctgatgggttttataagggaaagctgtttgtttttgacgagcgctacgcactcagctacaactcagacgtggtgagcggccgatccgcccaggctcagtctccaaactag

SEQ ID NO: 33998 - DNA, 219 bp, Artificial Sequence
  Description of Artificial Sequence: Synthetic coding sequence
atgctaagtttccctttattcaaggacgatttgtgtaaggacgacttcaagactagcaaaggcggcgcccactgcttccccgaactccgcgttggagtgttcgaggagatcgtgcctatggggatctctcctaaaaagataagctacaagaaacctggcatgttggctttccggagattgtgttttaatagtcagggacagaaccttatcgataagtag

SEQ ID NO: 33999 - DNA, 504 bp, Artificial Sequence
  Description of Artificial Sequence: Synthetic coding sequence
atggacctgtgcctggctgattccagcgtgtccgcgcccgcccctcatagacaaggcatccacctgtcacccggtgaattccacaaggaggttgaaaagttcctgtcgcaggcgaatcaggagcagtcggataccatcctgctagattgccggaatttctacgagtccaagataggaagatttcagggctgcctggctccagacatacggaaatttagttactttccatcttacgtggacaagaacctcgagcttttcagagagaaaagggtccttatgtactgtaccggagggatccggtgtgagcggggtagtgcgtacctgaaggctaagggtgtttgtaaggaggtctttcaactaaaaggtggtatccataagtacctggaggaatttcccgacggattctataagggtaagctatttgtctttgacgaacgctatgcactttcctataactctgacgttgtttccggaagatctgcccaagcacagtctccaaactag

SEQ ID NO: 34000 - DNA, 648 bp, Artificial Sequence
  Description of Artificial Sequence: Synthetic coding sequence
atgctaagttttccgctgtttaaagacgacctttgcaaggatgacttcaaaacttccaagggtggcgcacattgtttcccggagttgcgcgttggtgtgtttgaggaaatcgtgcccatgggcatttcccctaaaaaaattagttacaagaagcctggtattcacttaagtccgggggaattccacaaggaggtcgaaaagtttctcagtcaggccaaccaggaacagtctgacacaatattgctggactgtaggaatttctatgagtcaaagatcggcaggtttcagggttgtctagctccggatatccggaaattctcatatttcccatcatatgtcgacaagaacctcgaactgtttagagaaaaaagagtgctgatgtattgcaccgggggtatcagatgcgagcgaggctctgcttacctgaaagctaaaggtgtatgcaaagaggtcttccagctcaagggtggaattcataaatacctggaggagtttccagatggcttctacaagggaaaattattcgttttcgacgaaaggtacgctttgtcctataattctgacgtggtcagcgagtgctcatactgtggggcgcgttgggaccagtacaagttgtgttcaacacctcagctggacaccctcccgtag

SEQ ID NO: 34001 - DNA, 339 bp, Artificial Sequence
  Description of Artificial Sequence: Synthetic coding sequence
atgtacgttttcataatgatggcgtttccatcatctcctgagtgcagctattgcggcgctcgctgggaccaatataaactgtgctctacacctcaatgcagacagcttgtgctgacgtgtcctgcatgccagggccagggattcactgcttgctgtgtaacctgtcaggataaaggaagccgcaaagtgtctggccctatgcaggactctttcaaagaggaatgtgaatgcaccgctagacgtcccaggattcctagggagctgctccagcacgtccggcagcccgtgtcaccggagccagggcctgatgccgatgaggacggtccagtgctgatgtag

SEQ ID NO: 34002 - DNA, 711 bp, Artificial Sequence
  Description of Artificial Sequence: Synthetic coding sequence
atgagcgaagctccccgggcggagaccttcgtgtttctcgatctggaggctaccggtttgcccagcgtagagcctgaaatagcagaactcagcctgttcgctgtgcacaggtcttctctagagaaccccgaacatgatgaatccggcgcgcttgttcttccacgcgtgctggacaagctgacgctgtgtatgtgcccagagaggcctttcaccgcgaaagctagcgaaattactgggctaagttcggaaggcctggcacggtgtcgcaaggcagggtttgacggtgcagtggtcaggacgcttcaggcattcttgagtcggcaggcaggacctatatgcctcgtggcacataatgggttcgattatgattttccgctattgtgcgctgagctgagacgactgggtgccaggctaccgagggatacagtatgtctcgatacactcccagcccttcgtggtctggatcgcgcccatagccacggtacaagagcacgcggtcggcagggctattcattgggctccctgtttcaccgttatttcagagccgagcctagcgctgcccattctgccgagggtgacgtccacacactgctgctgatattcctccacagagccgccgaactgttagcttgggctgacgagcaggcaagggggtgggctcacattgagccaatgtacctcccccccgacgacccgtcccttgaggcctag

SEQ ID NO: 34003 - DNA, 2232 bp, Artificial Sequence
  Description of Artificial Sequence: Synthetic coding sequence
atgctgcacttcaataggtgccatcacctgaaaaaaataacccaaaagtgttttagcagcattcatgtgaaaaccgacaaacatgcccagcggttccttagccgaacctttgccctggccgagctgagaaaatcatggtactctactcacagtctagtcggagataaaaatatcattttgatgggccccccaggtgccgggaaaaccactgtggggcggatcatcggtcaaaaattgggatgttgcgtgatcgacgtcgatgacgacatcctggaaaagacttggaacatgagcgtgtcagaaaagctgcaagatgttggaaacgagcagttcctggaggaagagggtaaggccgtgctcaatttctctgccagtggatcggttatctcactgaccggaagtaacccaatgcacgacgcgtctatgtggcaccttaaaaaaaatggcattattgtctacctggacgtcccgcttctggacctcatttgtcgcttgaaactcatgaagactgacagaatagttggccaaaattctggaactagtatgaaagacctgttgaaatttcgcagacagtactacaagaaatggtatgatgcccgcgtattttgtgagtccggagcctcccccgaggaggtggcagacaaggtgctcaatgccataaagcggtaccaggatgtggactccgagacctttatctctaccagacacgtgtggcccgaagactgtgaacagaaggtttctgccaaatttttctccgaggcggtcatcgagggcctggcatcagacggcggtttgtttgtgccagccaaggaattcccaaaactgtcatgtggcgaatggaagtccttggttggtgccacctacgtggaaagggcacagatcttgctagaaagatgcatacatcctgccgacattcctgctgcacgtttgggagaaatgattgagacagcttacggcgagaacttcgcctgttcgaaaatcgcgcccgtgcggcacttgtctgggaatcagttcatcttggaactgtttcatggccctacaggctccttcaaagacttgagccttcaactgatgcctcatatctttgcacactgcatcccaccctcctgtaattacatgattttggtggcgacttcaggagacacaggttctgctgtgttaaacggattttcacgcttgaacaagaacgacaagcaaaggatcgccgtggtcgccttcttcccagagaatggcgtatccgacttccagaaagcccagattattgggtcgcaacgggaaaacggttgggcagtgggtgtggaatcagacttcgacttctgtcagaccgccatcaaaagaatattcaacgactcagacttcaccggtttcctcacggtcgaatacggtaccatactctcgtccgccaacagcatcaactggggtcgcctacttccccaggtggtctaccatgccagcgcttatctggatcttgtaagtcagggtttcatctcctttgggtcacctgtcgatgtatgcatccctactggcaacttcggcaacatcctggccgctgtgtacgctaagatgatgggaatcccgatacgaaagtttatctgcgccagcaatcagaaccacgtactgaccgacttcataaagactgggcattacgacctgcgtgagcggaaactagctcaaacctttagtccatcaatcgatatcctgaaatcatctaatctcgagaggcacctgcacctgatggccaataaggacggacagcttatgactgagctttttaaccgcctggagtcccagcatcacttccagattgaaaaagcgcttgtcgagaaactacagcaggactttgtggcggactggtgtagcgagggcgagtgtctggccgccatcaatagcacgtacaatacatcaggttatatccttgatccccatacagccgttgcaaaggtagtagccgatcgcgtacaagacaagacctgtccggttattatctcctccaccgcacactacagcaaattcgcacccgccatcatgcaggctctgaaaatcaaggagattaatgaaacatcctctagccagttgtatcttctcggctcctacaacgccctgcctccactgcacgaagcactgctggagcgaaccaaacaacaggaaaagatggagtatcaagtgtgtgctgcggacatgaacgttctgaagtcccacgtggaacagctcgtacagaatcagttcatctag

SEQ ID NO: 34004 - DNA, 2232 bp, Artificial Sequence
  Description of Artificial Sequence: Synthetic coding sequence
atgctccacttcaatagatgtcaccatcttaaaaagatcacccagaagtgcttttcctctattcatgttaaaacagataaacacgcccagcgctttttgtctcgcaccttcgcactggccgaactgaggaaaagctggtactccacgcattccctcgtgggggataagaacattatcctgatgggcccaccaggagcgggcaaaacgacggttggcagaatcattggccagaaactcggctgctgcgtgatcgatgtcgacgatgacattctagagaaaacatggaacatgtcagtctccgaaaaactccaggacgtgggaaacgaacagtttctggaagaagaggggaaagccgtcctgaacttctccgcatctggtagcgttataagtcttacagggagcaacccgatgcacgacgcttctatgtggcacctgaaaaagaacggaattattgtgtacctcgatgtgcccctgctcgacttaatctgtagactgaagttgatgaaaacggaccggatagtgggacaaaattcaggaacctctatgaaggacttactcaaatttcggcggcagtattacaagaaatggtatgatgctcgagtcttctgcgagtccggagcttcccctgaggaggttgctgacaaggttcttaacgccattaaacggtatcaggatgtggactccgaaaccttcattagcacacgacacgtgtggcccgaggactgcgaacagaaggtgagtgcaaagttcttcagtgaggctgttattgaaggattagcttccgatgggggtctgttcgtccctgccaaggaatttcccaaactgtcttgtggtgaatggaagagtctggtgggagctacgtacgtggagcgggcgcagatcctgcttgagcggtgtatccacccagccgacattcctgccgcccgtctcggggagatgattgaaactgcctacggtgagaacttcgcctgctccaaaatagcacccgtcagacacctgtccggaaatcagtttatcctggagctcttccacgggcccacgggtagcttcaaggatctgtctctccagctcatgcctcatattttcgcccattgtatccccccaagctgtaattacatgatcctggtagcaacatctggcgatacaggcagtgccgtgctcaacgggttcagtagactgaataagaacgataagcagcgaatcgccgttgtggctttctttcctgaaaatggagtgagtgatttccaaaaggctcagataattgggtctcagcgggagaatggctgggctgtcggggttgagtctgatttcgatttttgccagacggctattaagaggatatttaacgattcagattttacgggctttctgacagttgagtatggcacaattctctcttccgcaaacagcattaattggggcaggctcctaccccaggtagtgtaccacgcatccgcttatttagacctcgtatcacagggattcatctcctttggctctccagtggatgtttgtattcccacgggtaattttggcaacatattggctgcggtctacgctaaaatgatggggattccaatccgcaagttcatctgtgcttccaaccagaaccacgtcctcaccgacttcatcaaaaccggacattatgacctgcgagagcggaagttggctcagactttttccccaagcatcgacattctcaaatcctctaatctagaaaggcacctgcatttgatggccaacaaagacgggcaacttatgacagaactcttcaatcgcctggagtcccagcaccactttcaaattgaaaaagcactcgtggagaaactgcagcaggacttcgtggctgactggtgcagtgagggagagtgcttggctgccattaattccacatataacacatccggttatatactggatcctcacacagctgttgcaaaggtggtggccgaccgcgtacaggacaagacctgccctgtaatcattagctcgaccgcccactattcaaaattcgccccggcaattatgcaggcactcaagattaaagagattaacgagaccagcagctcacagctgtatctactcgggagctacaacgccctacccccactgcacgaggccctgttagagcgaaccaaacagcaagagaagatggaataccaggtatgcgctgctgatatgaacgtgctgaagagtcatgttgagcagttagtccaaaaccagtttatctag

SEQ ID NO: 34005 - DNA, 2301 bp, Artificial Sequence
  Description of Artificial Sequence: Synthetic coding sequence
atggccgccgaggctcttgcagctgaggcagtggcgtcacggctggagaggcaagaggaggacattagatggttgtggtctgaggtcgagagactgagggatgaacaacttaatgcaccctattcttgccaggcagaagggccgtgcctgaccagagaagttgcccagctaagggctgagaactgtgacctccgacacaggttatgtagtttgcggctctgtctggccgaagaaagaagcaggcaggcgaccctcgaaagtgccgagttggaggctgcccaggaagccggtgcacagccacctccttctcaaagccaggataaagatatgaagaagaaaaaaatgaaggagtcagaggcagatagcgaggttaaacatcagcctatttttatcaaggaaaggttgaagctgtttgaaatcctgaaaaaggaccaccagcttttacttgctatctatgggaaaaagggggacacctccaacatcataacggttagggtagcagacgggcaaacagtgcagggggaagtgtggaagaccaccccctatcaagtcgctgctgaaataagccaggagctggcagagagtaccgtgatcgcaaaagtgaatggcgagctttgggatctcgatagaccattagagggagattcaagtctagaattgctgacatttgataatgaggaggctcaggcagtctattggcactcctctgctcacatcctgggcgaagcaatggagctgtactacggcggccatttgtgctacggaccgcccatcgagaatggtttctattatgacatgtttattgaggatcgggcagtctcatccacggaactctcagcactcgaaaacatctgcaaggctattatcaaagagaaacaaccatttgagcgactggaggttagcaaagagatattattagagatgtttaagtacaataagtttaagtgtcgcatattaaacgagaaagtgaacacagcaactacaacagtgtatcggtgcggcccactgatcgatctctgcaaggggccccacgttcgccacacagggaagattaagaccatcaaaatcttcaaaaactcttcaacttactgggaggggaatccagaaatggagacgttgcagaggatatatggaatctctttccctgataacaagatgatgagagattgggaaaagtttcaggaggaggccaagaacagagaccacaggaagatcggaaaggagcaagagttgtttttctttcacgatttaagtcccgggagttgttttttcctgcctaggggcgcttttatatacaatacgctgaccgactttatccgcgaagagtaccacaagagggactttacagaggttctgtcacccaacatgtacaactcaaagctgtgggaggcttcaggccattggcagcattactcggagaatatgttcaccttcgaaatcgaaaaggacacttttgcactgaagcccatgaactgtccagggcactgcttgatgttcgctcacaggcccagatcctggagagaaatgcctattcggtttgccgattttggcgtgctccaccgtaatgagctgagcggaaccttatctggtctgaccagagtgaggcgattccagcaggacgacgcccacatcttctgtaccgttgaacagatagaggaggaaatcaaagggtgccttcagttccttcaatcagtgtactcgacattcggattttctttccagttgaacctcagtactagaccggaaaacttcttaggcgaaattgagatgtggaacgaggcggagaagcagttacagaactctttgatggatttcggtgagccttggaaaatgaatccaggggacggtgctttttacggtcctaaaattgacatcaaaatcaaggacgctataggacggtaccatcaatgtgcaacaattcagctggactttcagttaccaatcagattcaacctaacctacgttagcaaagatggtgatgacaaaaagagacccgtcattatccatagggcaattctcggatccgtggagcgaatgatagcaatcctgagtgaaaactacgggggcaagtggcctttctggcttagcccaagacaggtgatggttattccggtaggccccacatgtgaaaaatacgcactgcaggtttcttcagagttctttgaagagggttttatggcagacgtggacttagaccattcttgtactcttaataagaagattagaaacgcccaacttgcccagtacaacttcattcttgaccgatttcttccttccgtttggcaggaagcttggctctag

SEQ ID NO: 34006 - DNA, 4830 bp, Artificial Sequence
  Description of Artificial Sequence: Synthetic coding sequence
atgttccccaaatccaacttgacagtgacctgctgggtctggcggtcaatgagaaaattgtttcttctgcttagtctgctactttcccacgctgctcatctagagggtaaaaaagataatcagtttatttggaagccggggccctggggacgatgcaccggagactgcggacctggcggcgtgcagagccgggctgtgtggtgctttcacgtggatggatggacatcacacctcagcaactgtggagagtcaaatcgtccccctaaggagcgttcctgctttagggtgtgtgactggcattctgatctgtttcagtgggaagtgtctgactggcatcattgcgtgctcgtgccgtacgcccgcggagaagtgaagcctagaacagcagagtgtgttactgctcagcacggactgcagcatcgcatggtaagatgtattcaaaaactgaatcgaacagtcgttgcgaatgagatatgcgagcacttcgctttgcagcctccgaccgaacaggcttgtctgattccctgcccaagagattgtgtggtctctgagtttctgccttggtctaactgttctaagggttgtggtaagaaactgcaacacaggactagggctgtaatcgcgccaccgctgttcggcggactgcagtgccctaatttgacggaatcccgcgcgtgcgacgcccctattagctgtccactgggcgaagaagaatacacattttctctcaaggtagggccttggtccaagtgccgcctgccacacctcaaggaaatcaatccaagcggtcgtacagtcttagatttcaatagtgacagcaatgagagagtaaccttcaagcaccagagttataaggcacaccaccacagcaagtcctgggccattgagatcggctaccaaacacgccaggtgtcatgtacacggtctgacggacagaacgctatgttgagtctgtgtctccaggatagcttccccctgacggtgcaaagctgcataatgcctaaggactgtgaaacctcccagtggtcgagttggagtccctgtagtaaaacgtgcaggagcggctcactgctgcctgggtttaggtctcgctctcgaaacgtgaaacacatggcaatcggaggaggcaaagagtgcccagagttgctcgagaaggaggcttgtatcgtcgagggagagctcctgcagcagtgtccacgctatagctggagaacttcagaatggaaggaatgccaagtcagcctactccttgaacagcaggaccctcactggcacgtcacgggtcccgtttgtgggggggggatccagacccgggaagtgtattgcgcccagtccgttcctgcagctgccgccttgagagctaaagaagtctcgaggccagtagaaaaggccctgtgtgtagggcctgcccctttgcctagccagctgtgcaatatcccctgcagcacagactgcatagtgtccagctggtccgcatggggtctgtgtatacacgagaactgccacgacccccaaggaaagaaggggttcagaaccaggcagaggcacgtcctaatggagagcactggtccagcgggccattgcccccatttggtagaatctgtgccctgcgaagatcctatgtgctatcgttggctggcatctgaggggatttgtttccctgaccatggtaaatgtggactgggtcaccgcattctcaaggcagtctgtcagaacgaccggggggaggatgtgtctggcagcctgtgtccagtcccacctccccctgagcggaagtcatgcgaaattccttgtcgtatggattgcgtactctctgagtggactgagtggagcagctgcagccaatcttgtagcaacaagaactccgatgggaagcagactaggtcccgcacaattttggcattagcaggcgaaggcggcaaaccctgtcctccaagccaggcgctccaggaacatagactctgtaatgatcattcatgcatgcagctgcattgggaaacaagcccatgggggccgtgtagcgaagacacactcgtgaccgctctgaatgcgacaatcggctggaatggggaggctacatgtggggttggaatccaaacccgccgagtgttttgtgtaaaaagccacgtgggacaagtcatgacgaaacgatgccctgactccacgagacccgagacagtgcggccctgctttttaccttgtaagaaagactgtatcgtgacggcattttcagagtggaccccatgtccccgcatgtgccaagctggtaacgccacagtaaagcagtcacgatatagaatcataattcaagaggcagcgaacggcgggcaagagtgtcccgacactttgtatgaagaacgcgaatgtgaggatgtttctttatgtcccgtgtacaggtggaagcctcagaagtggtccccctgtatcctggtcccagaatcggtgtggcaaggcataaccggaagcagcgaagcatgtgggaaaggcctccagacccgcgccgtgtcatgcatcagcgacgacaataggtctgctgagatgatggaatgtctcaagcagaccaatggcatgcctttgctggtgcaggagtgcaccgtgccttgcagggaggattgtactttcaccgcctggagcaagtttactccctgcagtactaattgcgaagctactaaatcaaggaggaggcagctcaccggcaagtctcgaaaaaaggaaaagtgccaggattccgacctgtatcccctggtggagaccgaattgtgcccatgtgacgagttcatctcccaaccttacgggaactggagcgattgtattctgcctgaggggagacgcgagccgcaccgcggactccgcgtacaagcagattcaaaggagtgcggcgagggcctcagattcagagcggtagcctgctccgacaagaatggacggcctgttgatccttctttttgttctagcagcggttatattcaggagaagtgcgttatcccctgtcctttcgattgcaagctcagtgattggtcctcctggggctcatgttcctcgagctgtggtatcggggtgaggattcggagcaagtggttgaaggagaaaccctacaacggcggccggccatgtcctaagctggacctgaagaaccagaacgctcaggtgcacgaggccgtgccatgctacagtgaatgcaatcagtacagctgggtggtggagcactggtcttcatgtaagatcaacaatgaattgagaagtctgcgttgtggcgggggtacgcagagccgcaagataagatgtgtgaacacagctgatggagaaggcggagccgttgactccaatctctgtaaccaggacgagattccgcccgagacccagtcatgctcactgatgtgtcctaatgagtgcgtaatgtccgaatgggggctgtggtccaaatgtccccaaagctgtgatccccacaccatgcagcggcgtacacgacatctactgagaccttctctgaattcacggacttgcgctgaggattcacaggtgcaaccatgcctgctgaacgaaaactgctttcagttccagtacaatttgactgaatggagtacatgccaattgagtgaaaatgccccgtgtgggcagggcgtgcgcacgagactattaagctgtgtgtgttcagatggcaagccagtttctatggatcagtgcgagcagcacaatctcgagaaacctcagagaatgagcatcccatgtttagttgagtgtgtggttaactgccaactgtcgggttggacggcttggactgaatgttcacagacgtgtggacacggcggacgcatgtcgagaacccgttttatcattatgccgactcagggtgagggccgcccgtgcccgaccgagctgacccaagagaagacatgtcccgtcaccccctgctattcctgggtgttggggaactggtctgcatgtaagcttgaaggcggggactgcggcgaaggagtgcagatcaggtcattgagctgcatggtacactcagggagcattagccacgcggcaggtagagttgaggacgcgctctgtggtgagatgccctttcaagacagcatcctcaagcagctgtgttctgtcccctgtcccggcgattgccacttgactgagtggtctgaatggagtacctgtgagctgacgtgtatcgacggtaggtcattcgagactgtgggtcggcagagcaggagtcgcacttttatcatccagtcttttgagaaccaagattcctgcccccagcaagttctggaaacacggccatgcaccggggggaagtgctatcactatacatggaaggcctctctatggaacaataacgaacgaacagtatggtgtcagcggagtgacggggtaaacgtaaccggcggatgttcacctcaggctcgacccgctgccataagacagtgtattcctgcctgccgtaagcctttcagctactgtacacagggtggcgtttgtggatgtgaaaaaggctacaccgaaataatgaagagtaacggttttctggattattgcatgaaagtacccggttccgaagacaagaaagctgacgtgaagaatctcagtggaaagaaccggcccgtcaattcaaagattcacgacatctttaaggggtggagcttacagcccttggatcccgatggacgcgtgaagatctgggtgtatggtgtgagcggcggggcttttctaatcatgatcttcttgatctttacctcctatctggtgtgtaaaaagccaaaaccacatcaatcgaccccccctcagcaaaaaccactcaccctggcttatgacggcgatctggatatgtag

SEQ ID NO: 34007 - DNA, 4737 bp, Artificial Sequence
  Description of Artificial Sequence: Synthetic coding sequence
atgcataacaccgccgatgaggtggttctgtaccacaaactcgcgggcccctggggaagatgtactggagactgtggccctggtggcgtgcagtcacgcgctgtgtggtgtttccacgtggatggctggacttcccacttgagtaactgtggggagtccaatagacccccaaaagagaggtcctgctttagggtgtgcgactggcacagcgacctgttccagtgggaagtgagcgactggcaccattgcgtgctcgttccttatgcccgcggcgaagtgaagcccagaaccgcagaatgcgtaactgcccagcatggattgcagcacagaatggtgaggtgcatccagaaattgaaccggacagtggtggcaaacgagatctgtgaacactttgctctgcaacccccaactgaacaggcctgccttatcccttgtccgagagactgtgtggtgagtgaattcctcccttggagcaattgtagtaaaggttgtggaaagaaacttcagcaccggacccgtgccgttattgcgccgccactgtttggtgggctgcagtgtcctaaccttacagagtctcgggcctgtgacgctccgattagctgccccctgggggaggaagaatacactttttctttgaaggtgggcccttggtcaaagtgcaggctgcctcacctaaaggagataaacccatctgggagaacagtgctggattttaattccgactccaacgagcgagttacctttaagcaccagtcttataaagcccaccaccatagcaaaagctgggccatcgaaattgggtatcaaaccaggcaggtgtcatgtactcgatctgatggacagaatgccatgctctccctatgtctgcaggactcattcccactgaccgtgcagtcttgtattatgcccaaagattgcgaaaccagtcagtggtcctcttggtctccctgtagtaaaacttgtcgctctggatcacttcttccaggatttagatctcgctcgcgcaacgtgaaacacatggctatcggcggcggaaaagagtgtcctgaacttctggaaaaggaagcctgtattgttgagggcgaactgctgcaacagtgtccccgctacagctggcgtacctctgaatggaaagagtgccaggtgtccctactactcgaacagcaagacccccactggcacgtgactggcccagtttgtggcggcgggatccagacacgggaggtgtactgcgctcagtctgtaccagctgctgccgctttgcgcgccaaagaagtttcccgccccgttgaaaaggctctttgcgtaggaccagcccctttaccgtctcagctctgcaatatcccctgttctaccgactgtattgtgagttcatggagcgcctggggtttgtgtatccatgagaattgtcatgatccacagggcaagaaagggttcagaacgcgtcagcggcatgtgctgatggagagtaccgggcctgctggtcattgcccccatttagtggaaagcgttccctgcgaagaccccatgtgttatcggtggcttgcttctgagggcatctgtttccccgaccacggcaaatgtggcctggggcaccgtatactcaaagcggtctgccagaatgaccgtggggaagatgtctccggttctctctgtcctgtgccaccaccccctgagaggaaatcgtgcgagattccgtgccgcatggactgcgtgctctctgagtggactgagtggagctcttgcagccaaagctgttcaaacaagaatagtgacgggaagcagacgaggtcccgcacaatcctggcactggccggggagggaggaaagccctgtcccccatctcaggcccttcaggagcacagactgtgcaatgaccactcgtgtatgcaactgcactgggagacctccccatggggtccttgttcagaagacactctggtgactgctctgaatgcaaccatcggatggaatggcgaagctacctgcggggtcggaatccaaactcggcgcgtgttctgtgtgaaatctcatgtcggacaggtaatgacaaagcggtgtccagatagcacacgccccgaaactgtcaggccttgctttctcccctgtaaaaaggactgcattgtcaccgcgttctccgaatggactccatgtcctagaatgtgccaggccggaaacgccacggttaaacagtccaggtaccgtataatcattcaggaggccgccaacggaggtcaggaatgtcccgacacactatatgaagagagggaatgcgaggacgtgtctctctgccctgtgtaccgctggaaaccgcagaagtggtcgccttgcatcctggtcccagagtccgtgtggcaagggatcacgggctctagcgaggcctgcgggaagggattgcaaaccagggcagtaagctgtatatcagatgataacaggtcagcagagatgatggaatgcctgaagcagactaatggaatgccattgctcgtacaggagtgcacagtgccatgccgggaagattgtaccttcacggcttggtcaaagttcacgccttgcagcactaactgtgaagctactaaatcccggcgccgccagctgaccgggaaatccagaaagaaggagaagtgccaggactcagatctttacccactcgtggaaacagaactctgcccctgcgacgaatttatttcacaaccgtacggaaactggtcagattgcatcttgcccgagggaagacgagagcctcaccgtggcctgagagtccaggctgattcaaaagagtgcggcgaggggttgcgctttcgagccgtggcctgctccgataaaaacggaagaccagtagacccgtccttttgtagctccagtggctatatacaggagaagtgtgtgattccttgtccatttgattgtaaattatctgactggtccagctggggatcctgtagcagttcatgtggcataggagtgcgtatcagatccaagtggctcaaggagaagccctacaatggcggccgaccatgcccgaagttggatctaaagaaccagaacgcccaggtccatgaagccgtcccatgctatagtgagtgtaaccagtactcctgggtggttgagcactggtccagttgcaagatcaacaatgaactgaggtcattacgttgcgggggcggcacccagtcaagaaagatccgctgtgtcaacacagcggatggggaagggggcgcggtggattctaatctgtgtaaccaagacgagatcccgcctgagactcagtcctgcagcctgatgtgcccgaacgagtgtgtgatgtctgaatgggggctctggagcaagtgcccacagtcttgcgacccccacacaatgcagcgccggacgcggcatttgctgaggccgagcctgaactcaagaacctgtgccgaggacagccaagtgcagccctgccttctcaatgaaaactgcttccagttccaatacaatctgacagaatggtccacctgtcagcttagcgagaacgcaccctgcggacagggggttcgcacccgcctgctctcctgcgtatgttccgatggcaagccagtctctatggaccagtgtgaacagcacaacttagagaagccgcagcgtatgagcatcccatgccttgtggaatgcgttgttaactgtcagctttcagggtggactgcgtggacggagtgcagtcaaacctgtggacacgggggtcgcatgtcacgaacacgcttcattattatgcccacacagggcgagggccgcccgtgccctacggagctgacgcaggagaagacctgtccagtgactccttgttactcctgggtgcttggcaactggagcgcttgcaaactcgagggcggtgactgtggggaaggtgtgcaaatacggagcctctcgtgtatggtgcactctgggtctatatctcatgccgcggggcgcgttgaggatgccttatgtggggaaatgccctttcaggactccatccttaagcagctttgcagcgtcccgtgtccaggcgactgccacttaacggaatggagtgagtggtctacttgcgaactgacctgcatcgatggtcggagtttcgagactgttggtaggcaatcccggtcgcgaactttcatcatccagtcattcgagaatcaggacagttgcccgcagcaggtgctagagactagaccttgcactggcggcaagtgctatcattacacctggaaagctagtttatggaacaataatgagcggacggtgtggtgccagaggtctgatggggtcaacgtcacaggtggatgctcgccacaggcacgacctgctgccatccggcagtgcatacccgcctgccgcaagcccttttcctattgcacccaggggggcgtgtgtggatgcgagaagggatatacagagattatgaaaagcaacggattcctggactactgtatgaaagtccccgggtctgaggacaagaaggccgacgttaagaatttgtctggaaagaacaggcctgtaaatagtaagattcacgacatctttaaagggtggagcctgcagcccctggaccccgacggtagggtgaagatttgggtttacggcgtctcgggcggagcctttctgattatgattttcttgatcttcacttcctatctggtatgtaaaaaacccaaaccccaccagtctacacctccccagcagaaaccccttacgctagcttacgacggagacctagacatgtag

SEQ ID NO: 34008 - DNA, 1002 bp, Artificial Sequence
  Description of Artificial Sequence: Synthetic coding sequence
atggtgcgatgcatccagaagctgaatcggaccgttgtcgccaacgaaatatgcgaacacttcgctctgcaaccccctacagaacaagcgtgtctgataccctgtccgagggactgtgtcgtttcagaattcttgccctggtctaattgctcaaagggttgcggcaaaaaactccagcatcgcactagagcggttatagcccccccactctttggaggtctgcagtgcccgaacctgacagaatcgagggcatgcgacgcgccgatatcatgcccactaggtgaggaggagtacacattcagcctaaaagttgggccatggtccaaatgccggctgcctcatctcaaggaaataaatccatccggacggacagtcctcgacttcaacagtgacagtaacgaaagagtaaccttcaaacaccagtcttacaaggctcatcaccactcaaagagttgggctatagaaatcgggtaccagactcggcaggtgtcatgcaccaggtccgacggccagaacgcaatgctgtcgttgtgcttgcaagattctttcccacttactgtccaatcctgtattatgcccaaggactgtgaaaccagccagtggtcatcatggtctccttgcagtaaaacatgccggtctggatccctcctccccgggttcagaagcagatcccggaacgtgaaacacatggctattggaggtggcaaggagtgcccggaactgctggaaaaggaggcttgtatagttgagggtgaactgctccagcagtgcccaagatacagttggcgtacttctgagtggaaagagtgccagcaggtctttggaacaataaccaatgagctgtacggcgcttctgtccagatggctttaatgtctcaggaagccgctcccctgagacccgtgctcctcccatttgggtccgccttccagcccgcagagaatcttagcccaactgtacatagggttgagtcagtggtggttcggcgcgctatccagaggtag

SEQ ID NO: 34009 - DNA, 1062 bp, Artificial Sequence
  Description of Artificial Sequence: Synthetic coding sequence
atggcggcccctgcgcagcaaaccacacagcccggcggaggaaaacggaaaggaaaggcccagtatgtgctggccaaacgggcgcggagatgcgatgcgggaggcccgcgccagctggagccagggctgcagggaatcctgatcacatgtaacatgaacgaaaggaagtgtgtggaggaagcttactcccttctcaacgagtacggggacgatatgtacggaccagagaaatttaccgataaggatcagcaaccaagtgggtctgaaggagaagacgatgacgccgaggccgccctcaagaaggaggtaggcgatatcaaggcgagtactgagatgcgactgcggcgcttccagtctgtcgagtctggcgcaaacaacgttgtcttcataagaaccctgggaattgaacccgagaagctagtgcatcatattctccaagacatgtacaaaacgaagaagaaaaagacgcgcgtgatcctccgcatgctcccgatctcaggaacatgtaaagcctttctggaagatatgaagaaatacgctgaaacttttctagagccctggtttaaagcccccaacaagggcactttccagatagtttataagtctcgcaataattcccacgtgaatcgggaggaagtgataagagaattggctggcattgtctgtacacttaatagcgaaaacaaggtggacttgaccaacccacagtataccgtggtggtcgagattattaaggcagtctgctgtctgtctgtggtcaaagattacatgctcttcagaaagtacaatttgcaggaagtggtgaagagccctaaggaccccagccagctgaatagtaaacaggggaatggcaaagaagccaagctggagtccgccgacaaaagcgaccaaaacaatactgcagagggcaagaacaatcagcaggtgcccgagaatacagaagagctggggcaaaccaaacctacttcaaatccccaggtggtgaacgaggggggcgccaagcccgagctggcttctcaggccactgaaggaagcaagagcaacgagaatgatttttcctag

SEQ ID NO: 34010 - DNA, 1062 bp, Artificial Sequence
  Description of Artificial Sequence: Synthetic coding sequence
atggcagcccccgcgcagcagacaactcagcccggcggcggcaaacggaagggcaaagcccagtacgtccttgctaagcgtgcacgtagatgcgacgccggaggacccaggcaactggagcctggcctgcagggtatcctcataacttgcaacatgaacgaacgcaagtgtgtcgaggaagcttactcactgctaaacgagtacggagacgacatgtatggacctgagaagttcaccgataaagatcagcagccctccggttctgagggtgaggacgatgatgccgaagccgcactgaagaaggaggttggggatatcaaggcttcaaccgagatgagattgaggcgctttcagtcagtcgagagtggcgcaaataacgtggtctttatccgcactctcggaatcgaacctgagaagctggtgcaccacatcctccaggacatgtacaagaccaagaaaaagaagactcgggtgattctccggatgcttccaatctcaggcacttgtaaggcttttctcgaagacatgaagaagtatgccgaaacgtttttagagccttggttcaaagctcccaataaaggtacattccagatagtttacaaaagccgcaacaattcacatgtgaacagggaggaggtcatacgagagcttgccggtattgtttgtaccttgaatagtgaaaacaaagttgatctgaccaacccgcagtataccgtggttgtggagattatcaaggcagtatgttgcctcagcgttgtaaaagattacatgctgttccgtaagtacaatcttcaagaagtcgtgaaaagccctaaagatccatcacaactgaacagtaagcaggggaatggcaaggaggccaagctagagtctgcggataagtcggaccagaacaacaccgccgaaggtaagaacaatcagcaggttcctgagaacacagaagagctgggtcagactaagcccacaagcaatccccaggtcgtcaacgagggcggcgcgaaacccgaattagccagtcaggccactgaaggatctaaaagcaacgagaacgacttctcatag

SEQ ID NO: 34011 - DNA, 1320 bp, Artificial Sequence
  Description of Artificial Sequence: Synthetic coding sequence
atggcagccatgctgccattactcgacagcggctgctcaagggaagcaggccaggaggccggcctgggcagggtgtccctgcatcccttccacgactgtcgcccggcactcgggcctggtgcagcacgcaatgaggcctctcgcccagctcgtggagggaggcgcagctatcctacgagccctgttcgagccggagacaggcgaggacggcagcaacagagaaggaatgtgagcctgagcagccagttcgcccacactatggcagcccccgcacagcagaccactcagcctggcggaggcaagcggaaagggaaggcccagtacgtcttggccaagcgggcccgcaggtgcgacgccggaggcccaagacagcttgagcccgggctgcaaggcatcttgattacgtgcaacatgaatgagcgcaagtgcgtggaagaggcatactccctactcaatgagtacggtgacgatatgtacggtcccgagaagtttactgacaaagaccagcagccctccggaagcgagggcgaagatgacgacgcagaggcggctctaaaaaaggaggtcggtgacataaaggcttccaccgagatgaggttgagacggttccagtccgtagaaagtggcgccaataatgtggttttcattcgaacgttaggcattgagcccgagaagttggtgcaccacattctgcaagacatgtataagacaaagaagaagaagacccgagtcatcttgaggatgctgcccatctccgggacctgtaaagcttttctggaagatatgaagaaatacgcagagacattcctggaaccctggttcaaagcacccaataaaggaacttttcagatcgtgtacaaatcgcggaataatagtcacgtcaatcgggaagaggtaatcagggagctagcaggcatcgtgtgcacactcaattcagagaataaagtcgatcttaccaatccacagtacaccgttgtggtagagatcattaaagccgtgtgttgtcttagcgtagtgaaagactatatgctctttaggaaatacaacctgcaggaagttgtcaagtccccaaaggatcccagccagctgaattcaaagcagggaaacggcaaagaggctaagctcgagagcgccgataagtcggatcagaataatactgctgaaggcaagaataaccagcaagttccagagaacactgaggagctggggcagaccaagccaacaagtaatccacaagtggtcaatgaaggtggagcaaaacctgaattggccagtcaagctaccgaaggatctaaaagcaacgagaacgatttttcctag

SEQ ID NO: 34012 - DNA, 1524 bp, Artificial Sequence
  Description of Artificial Sequence: Synthetic coding sequence
atgtgcgacatcgaagaagctacaaaccagttgttggacgtcaacttgcacgagaaccagaagtccgtgcaggttaccgagagtgatctgggatccgaatctgagttactcgttacgattggtgctacagttccaacagggttcgagcaaactgccgccgacgaggtgagggagaaacttggttcctcctgtaagatcagccgcgaccggggcaagatttacttcgttattagcgttgaaagcttggctcaggtgcactgtttgagatcagtggataacctctttgttgttgtgcaagaatttcaggactaccagttcaagcagactaaggaggaggtccttaaagactttgaagatctcgcggggaaattaccctggtccaaccccttgaaggtctggaagatcaacgcaagcttcaagaagaagaaagctaagcgaaagaaaatcaaccagaatagttcgaaggaaaagatcaataatggccaggaagtcaagatcgaccagaggaacgttaaaaaagagttcacttctcatgcccttgacagtcacatcttagattactacgagaatccagccatcaaggaagacgtgagcaccctgatcggcgacgacctggccagttgtaaggatgagacggatgaatcttctaaagaggagacagaacctcaggtgctcaaatttcgagtgacttgtaatcgggccggtgagaaacattgttttaccagcaatgaggctgctagggactttgggggggcagtacaggactactttaagtggaaggcagacatgaccaattttgatgtcgaagtcttgctgaatatccacgataatgaggtgatcgtgggcattgctcttacagaggagtcgttacacagacgtaatatcacccattttggccctaccacactgcgttcaacactggcatacgggatgctccgcctttgcgatcctctgccgtacgacattattgttgacccaatgtgtgggactggcgcaatcccgatcgagggggccactgaatggtcagactgctttcacatcgccggagataacaatccgctggcggtgaatagggctgctaacaatatcgcatcactcctgacaaaaagtcagataaaagaggggaaacctagctggggacttccgatcgatgccgtgcagtgggacatttgcaatctgccgctcagaacaggatccgttgacattattgtgaccgacctaccctttgggaagaggatgggaagtaagaagcgaaactggaatctttaccccgcctgccttcgcgaaatgtctagggtttgcacccccaccactggtagggccgtgctcctgacccaggatacaaaatgttttaccaaagccctgtctggaatgcggcacgtgtggaggaaagtggatactgtgtgggtcaacgtgggcgggctccgggccgctgtgtacgtcctaatcaggacaccacaagccttcgtgcatcccagcgagcaggacggggagcgaggtacactttggcagtgcaaggagtag

SEQ ID NO: 34013 - DNA, 126 bp, Artificial Sequence
  Description of Artificial Sequence: Synthetic coding sequence
atgtgtgatatagaagaggctacaaatcagctgcttgacgtcaaccttcatgaaaatcagaagtcagtgcaggtaacagagtctgacttaggtagcgaaagtgagttactggtgaccattggatag

SEQ ID NO: 34014 - DNA, 372 bp, Artificial Sequence
  Description of Artificial Sequence: Synthetic coding sequence
atgtgcgacattgaagaggccacgaatcaactgctggacgtcaacctgcatgagaatcaaaagagtgtgcaggtcactgagtccgatctgggctccgagtccgagcttctggttaccatcggggccacagtgcccacgggatttgagcagactgctgccgatgaggtgcgagaaaagctcgggagctcttgcaagatttctcgggatcgaggaaagatttatttcgtcatctcggtggagagccttgctcaggtccactgtctgcggagcgttgataatctgtttgtcgtagtgcaggaattccaggactaccagttcaagcaaacaaaagaggaagtccttaaagatttcgaagacctggcagggaagtag

SEQ ID NO: 34015 - DNA, 1524 bp, Artificial Sequence
  Description of Artificial Sequence: Synthetic coding sequence
atgtgtgatatagaggaggccactaaccaactgttggacgtgaaccttcacgaaaaccagaagtcagtgcaagttaccgagagcgacctcggaagtgagtccgagcttttagtgaccattggggcaacagtacctacgggcttcgagcagactgctgccgatgaggtacgcgaaaaattaggtagcagttgcaaaatttcacgggacagaggaaagatatactttgttatctccgtggaatctctcgctcaagtgcactgcctgcgcagtgtggacaacctatttgttgtggttcaagaatttcaggactaccaatttaagcagacgaaggaggaagtgcttaaggatttcgaagacttggccggtaaattaccatggagcaaccccttgaaagtgtggaagattaacgcatctttcaaaaagaagaaagccaaaagaaaaaagataaatcagaactcctctaaagagaagatcaacaatgggcaggaggtgaaaatcgaccagagaaacgtcaagaaggaatttacaagtcatgcactcgacagtcatatcttggactactacgagaaccccgccattaaggaggacgtctctacgctgatcggcgacgacctcgcctcttgcaaagacgagaccgacgagagctccaaggaggaaacagaacctcaggttctgaagttcagggtgacatgtaacagagccggagaaaaacattgtttcacatctaacgaagccgccagagatttcggaggggctgttcaggattatttcaaatggaaggctgacatgacgaactttgatgtggaggtgcttctcaacatccatgacaatgaagtgatagtgggaatcgccctgacagaggagtcgctccaccgccggaatattacgcacttcggacccacaaccctgaggtcaaccctggcttatgggatgctaaggctgtgtgatcctctcccatatgatattatagtcgatcccatgtgtggcaccggcgccatcccaattgagggagcgacagaatggagcgactgttttcatattgctggagataataatcctctcgcggtcaaccgtgccgccaataatatcgcctcactcttaacaaaatcgcagatcaaagagggtaaaccgagctgggggttacctatagacgctgtccagtgggatatctgcaatctgcccctccggaccggctctgttgatatcatcgtgactgatctgccgtttggaaaaagaatgggctcaaagaaaaggaactggaatctgtaccccgcctgtttgcgtgaaatgtcccgagtatgcacccccaccactggaagagcagttttactcacccaggataccaagtgttttactaaggcactgtccgggatgagacacgtttggcgtaaggttgatactgtgtgggtgaacgttggcggactgagggctgccgtttacgtactgatccgcacacctcaggcgttcgtgcacccgagtgagcaggacggcgaacggggaactttatggcagtgcaaggagtag

SEQ ID NO: 34016 - DNA, 1524 bp, Artificial Sequence
  Description of Artificial Sequence: Synthetic coding sequence
atgtgtgacatagaggaagccacaaaccaactcttggatgtgaacctgcacgagaaccagaagtctgtccaagtaaccgagagcgacctaggcagcgaaagcgaactccttgtaaccatcggtgcaactgtgccgaccggatttgaacagaccgccgcagacgaggtgcgagaaaaactgggcagttcttgtaagattagccgcgatcggggtaagatctattttgtgatcagcgtggaatccctggcacaagtccactgtctgcgctcagtcgataatttattcgtcgtcgtccaggaattccaggattaccagtttaagcagaccaaagaggaagtgctcaaggattttgaggacctggccggaaaactgccatggtccaacccattgaaggtctggaagattaatgcttccttcaaaaaaaaaaaggctaagaggaagaaaataaaccaaaattcctcaaaggaaaaaatcaacaacggtcaagaggtgaagatagaccagaggaatgtgaagaaagagtttaccagtcatgcgttggatagccatatactggactactacgagaatcccgctatcaaagaggatgtgtccaccctaatcggagatgatttggcgagctgcaaggatgagaccgacgagagttctaaggaagaaacggagccccaggtacttaagttcagggtgacatgcaatcgggctggcgagaaacactgcttcacatccaacgaagcagctcgcgactttgggggggcggtccaggattactttaagtggaaagctgatatgaccaattttgacgtggaggtgcttctcaatatacatgataacgaagtgatcgtggggattgctctgactgaagagtctttgcaccgcagaaatatcacccatttcggcccaacaacactccggtccacgcttgcgtacggcatgcttaggctttgtgacccacttccgtacgatatcattgttgacccgatgtgtggtacaggtgcaatccctatcgagggcgcaaccgagtggagtgactgctttcacattgcgggagacaacaaccctttagctgtgaatcgtgctgccaacaacatcgcttctctgctgaccaaaagccagatcaaagagggcaagccaagttgggggcttccaattgacgcagtgcagtgggacatctgcaacctccccctgcgcacggggtcagtggacatcatagttaccgacctgcccttcgggaaacggatggggagtaagaagaggaactggaatctctatcctgcctgtttgcgggaaatgagtagagtctgtacgcccactactggacgcgctgtgctgctgacgcaggatactaaatgctttaccaaagctttgtccggcatgagacacgtctggcggaaagtagacaccgtgtgggtcaatgtgggcggccttcgggctgctgtttatgtcctaatcagaactccccaggcctttgtgcatccgtccgagcaggacggcgagaggggaaccctatggcagtgtaaggaatag

SEQ ID NO: 34017 - DNA, 1566 bp, Artificial Sequence
  Description of Artificial Sequence: Synthetic coding sequence
atggaggcctcagtgttgtctccgacctcttgggagaagcgccgcgcttggctcagacagtcacgcaactggcagacccaagttctcgaagaggaagccgccgccgcactccaagacgtgcccgaccccgaaccgtccagtctggacgacgtatttcaggagggcaaccctatcaacaaaatcgaagactggctccaggactgcggatattcagaggagggcttctctgaggaagcgggtcagtttatctataatgggttttgctcccatgggacatcatttgaagacgacttaacccttggagcagaagcaacgctgctggctgccaatgggaaattatttagcaggtcatttctggaaaccgctcggccctgtcaacttctggaccttggctgtagcctagcttcttcctcaatgacaggtggaacgaataaaacatcctcatcgatttctgaaattcttgataaggtgcaggaggacgctgaggatgttctgtttagtctgggtttcggccaagaggaccacaaggatacatctcgaatccctgcccgcttcttcaccaccccatctcaagccaaagggattgatttccaactgttcctcaagtcccaagtacgccgcattgaaatggaagacccgtgtttgatgctggcctcccgcttcaagcaggtacagaccctcgcagtgaccgcagacgccttcttctgtctgtacagctacgtctctaaaacaccggtccagaagttcacaccctcgcacatgttttggaattgtaaccatccgaccgacgtgccgagcatcaggattctgtcacgcgagcccgaacctcagtcgccgcgggatagattaaggaaggccatttccaagatgtgcctgtatacttgtccgcgggacagacccccgcctccccacaacactcccaaaaggaattccctggatcaggttgtcctggaagttatggacaaggttaaggaggaaaagcagtttttgcagcaggactccgacctgggtcagtttagccaggaggacccggttccccctgctgaaggaaaaaaactacccacatctccatacccgtgtgtcttctgctgcgaggaagagactcagcaacgtatgtccaccgttctggcgccttcgcaaacccttgattccaaccctaaggtcccatgttgtactcactctctgccgatcgaagatccccagtggagtaccgacccagctcagattcgccgagagctctgttccctgcctgcgactaacacagaaacccacccagccaaagatgaaacgttttggaagagaaaatctcgcgctaggaagagtttattccagaaaaacctgatggggaggaaagtcaagtccctcgacttgagcattactcagcaaaaatggaaacagagtgttgaccgaccagagctcaggaggagtctgtcgcaacagccacaggacacctttgatctggaagaagtgcagtccaatagtgaggaagaacaatcccaatctcgctggcccagccgccctcgtcatccccaccaccatcagacttttgcgggtaaagattcgtag

SEQ ID NO: 34018 - DNA, 1152 bp, Artificial Sequence
  Description of Artificial Sequence: Synthetic coding sequence
atgacaggcggaaccaataagactagcagctctattagcgagattctggacaaggtgcaggaagatgctgaggacgtgctcttttccctagggtttggacaggaggaccacaaggatacgagtcgaatccccgctcgtttttttacaacgccttcacaggccaaggggatcgactttcagctgtttctaaaatcacaggtgcgcagaatagaaatggaggatccatgcctgatgctggcctcacgcttcaagcaggtgcagacactggctgtgaccgcagacgccttcttctgcttatatagctacgtatcaaaaacccctgtacagaagtttacccccagtcatatgttctggaactgcaatcaccccactgacgtgcctagcatccgaatcttgtcccgcgagcccgaaccccagtcaccccgagacagactgagaaaagctatttcaaagatgtgcctctatacttgtccacgcgacagaccaccgccaccacacaacacaccgaaaagaaatagcctggatcaggtcgtgttggaggtcatggataaggtgaaggaagagaaacagttcctgcagcaggattcagacctcggccagttctctcaggaagaccctgtcccaccagccgaaggaaagaagctccccacatccccctacccctgtgttttctgttgtgaggaggaaacccaacagagaatgtctactgtgctggcaccgtctcagaccttggacagtaatccgaaagtgccttgttgcacccattctctgcccattgaagatccgcagtggagtaccgacccagcccagattaggagggagctgtgctccctgccggcaactaatactgagacacaccccgccaaagacgaaaccttttggaagcgcaagtccagggcacggaaatctctgtttcagaaaaatctgatgggtcggaaagtaaagagcctggacttgtctatcacccagcagaaatggaaacaatcagtggacagaccggagttacggaggagtttgtctcagcagccccaggacacttttgatctggaggaggttcagtccaactccgaggaggagcaatcccagtctcgttggccatcccggcccagacatccacaccaccatcagaccttcgcaggcaaggattcatag

SEQ ID NO: 34019 - DNA, 249 bp, Artificial Sequence
  Description of Artificial Sequence: Synthetic coding sequence
atggaggcctcagtgctgtccccaacgagttgggagaaaagaagagcatggctgcgacagagtagaaactggcagactcaggtgctcgaggaagaagccgcggctgcattacaggatgtgcccgaccctgaaccttcatctctggatgacgtgttccaagagggaaacccaatcaacaagattgaggactggctccaggactgcggttacagtgaggagggctttagcgaggaggctggtcagttctag

SEQ ID NO: 34020 - DNA, 147 bp, Artificial Sequence
  Description of Artificial Sequence: Synthetic coding sequence
atggaggcctctgtcttgagcccaaccagttgggaaaaaaggcgggcctggctgcggcaaagccgcaactggcagactcaagtccttgaagaggaggccgcagctgcccttcaggatgtgccggacccagagccatcaagcctgtag

SEQ ID NO: 34021 - DNA, 138 bp, Artificial Sequence
  Description of Artificial Sequence: Synthetic coding sequence
atgagtgataagccagacctaagtgaggtagaaaagtttgaccggtctaagctcaagaagactaataccgaggaaaaaaatacgctgccctctaaggagaccatccagcaggaaaaagagtgcgtgcagacttcttag

SEQ ID NO: 34022 - DNA, 588 bp, Artificial Sequence
  Description of Artificial Sequence: Synthetic coding sequence
atgcccaacttcctcggactgcaccgcgcgcggagcttcacggtcctgtgcttctggtcaaccgcggacgtgctgaatgcatcgggaccaaggcgccagtggcatccactcgcctcttgctcatcttggtctcgcccacaatctcagggatccacccccggcgtgttgtgcaagaccggcatgggtcgggagcccattcctgagacgcagtgtcacttcgccaattcaatgtgctcactgcatgtcagtgtgccgtacttcggcaactcccctaatattagtaacttttttcgctggagcctggctctgtcccccagacagtggtgcgatcttggctcattacagcctccaagtccaaggtttaaaggttttagctgcttgtctctgccatcttcttgggattaccgtagggccccctcgcctgctaatttttgcatattagtggagatgggattccatcatgttggccaggcagacttagaattgctcacaagcgccgacctccctacttctgcatctcagtctgcaggtattactggggtgtctcatcatgcatggccacagaccctgtctctgctcctctactag

SEQ ID NO: 34023 - DNA, 795 bp, Artificial Sequence
  Description of Artificial Sequence: Synthetic coding sequence
atggccccaaccggccttctggttgccggagcttcttttctggccttccggggactccattggggcctgagacgactccccacaccagagtccgccgcccgggatagatggcaatggtggaatttgtgtgtgtcgctggctcacagcctgctgtctggaaccggtgccttactaggcctcagcttatatccccagatggcggccgacccgattcacgggcaccccagatgggcattggtgctggtggctgtctcggtcggttactttttagcggatggggcagatctgttatggaaccaaactttgggcaagacctgggatcttttgtgccatcatcttgttgtagtgtcttgcctctctaccgccgtcctgtccggacactacgtggggttttccatggtgtccctccttttggagctgaattcagcatgcctgcatctcagaaaactcttattgttgtctaggcaggctccctcacttgcgtttagcgtcacttcttgggcaagcctcgcaacacttgcccttttcagacttgtacctctggggtggatgagtctgtggttatttaggcagcatcatcaggttcctctggctctcgtcaccttggggggcatcggactggtcaccgttggcattatgtccattatcctgggaatcagaatactagtgaatgacgtgctgcagtcccgaccacaccctccttctcctgggcatgaaaagacaaggggcactcgcaccagacgagacaacgggcccgtgaccagtaacagttcgactcttagtttaaaggattag

SEQ ID NO: 34024 - DNA, 3561 bp, Artificial Sequence
  Description of Artificial Sequence: Synthetic coding sequence
tagtgcgctgcaccagcaccactgaccagcgcagaacgcgaactgcagcaaatccgcattaacgaagttaaaactgaaatcagcgtggagagcaagcaccaaacgcttcaaggcttggcatttccgctccaacccgaggcccagcgtgcactgcaacagctcaaacagaagatggtgaactacatccagatgaagttggacctggagcgggagacaatcgagctcgtgcataccgagccaactgatgtggctcaactgccaagtagagtgccacgggacgcggcccggtatcactttttcttgtataaacatacacacgaaggggaccccctcgaatcggtggtgttcatttattctatgccaggatacaagtgtagcatcaaagaaaggatgctctatagctcctgcaaaagccgacttttagactctgttgaacaagactttcacctggaaattgcgaagaaggggttctgtcgctctgccttgcacccactgtctctactcgtgcaggcaatcatgttggccatgacactggcacttggtactctcccagcctttctcccgtgtgagctccagccccatggattggtcaactgcaattggctcttcctgaaaagcgtcccacacttctcgatggctgctcctcgcggaaacgtaacctctctctcactcagctccaacaggatccatcatctccatgatagtgactttgcccacctgccgtccctcaggcacctgaacctgaaatggaactgtcctccggttggattgtcacctatgcacttcccatgtcatatgaccatcgaaccatcgactttcctcgccgtccctactttggaagagttgaatcttagttataataatatcatgacagtgcccgccctacccaaaagtctcatctctctgtccctgtctcacactaatattctgatgttggactcagccagcctggctggattgcatgccctccggttcttgttcatggacggcaattgctattataaaaatccgtgcaggcaggccctggaagttgcccccggagccttactcggcttaggcaacctgactcatcttagcctcaagtataacaacttgactgtggtgcctcgcaatttaccctcctcattggaatacctcctcctgtcatataaccgtatcgtcaaattggctcctgaagacctggccaacctgaccgccctgagagtcctcgatgtgggtggtaattgcagacggtgcgatcacgcgcccaacccgtgcatggagtgtcccaggcacttcccgcagttacaccctgatactttcagtcatctgtctaggctggaggggcttgtgttgaaggattctagtctcagttggttgaacgcgtcttggtttagggggcttggcaacctgcgagtcctggacctgtctgaaaactttctatacaaatgcattaccaaaaccaaagcctttcaggggcttacccagctcaggaaacttaatctcagttttaactaccagaaacgggtatcctttgcacatctcagccttgcaccaagttttggatccctggtcgccttgaaggaactggacatgcatgggattttctttcgctcactggatgagacaaccctcagacctctggcaaggctgccaatgctccagacccttaggttacagatgaatttcattaatcaagcccagctggggattttcagggcattcccggggttacgatatgtggacttaagcgataaccgcatctcgggtgcctccgaattgacggcaactatgggtgaagcagacggcggtgagaaggtgtggttgcagccaggtgacctggcccccgctcccgttgacacacctagtagcgaggacttcagacccaattgtagtacactcaactttacgctcgatctcagccggaacaatctagtcacagtgcaaccagaaatgtttgcccagttgagccatctgcagtgtttgagactgtctcacaactgcatttcccaagcagttaacgggtcccagtttttaccgcttaccgggctgcaggtgctggatctttctcataacaagctggacctgtatcacgaacactcttttacagagctaccaagactggaagccctggatctgtcgtacaattcccaacccttcggaatgcagggagtcggccacaacttcagcttcgtggctcatctgaggaccctccgtcacctcagcctcgcccataacaatatacattcacaggtgtcccagcagctgtgctctactagcctgagggcacttgacttctccggcaacgccctggggcatatgtgggccgagggcgatctgtacctccacttctttcagggcctgagcgggctcatttggttggatctgtctcagaaccgactccatacgcttttgccacagaccctgaggaatctcccaaagtctctgcaggtcctgcggctccgggacaattacctggcctttttcaagtggtggtctttgcacttcctgccaaaactcgaggtgctggatctggccggaaatcagctgaaggccttgacgaatggcagtctgcccgcaggaacacgattgagacgtctagatgtgagttgcaacagtatcagcttcgtcgcccccggattcttttcaaaagccaaagagctgcgagaactgaatctttctgcaaatgccctcaagactgtggaccactcctggttcggacctctggcgagcgccctgcagatcttggatgtgtctgccaatccattacattgtgcctgtggcgccgcattcatggatttcctcctcgaggtccaagcagcagtgcccggtctgccgagcagagttaaatgtggcagtcctgggcagcttcaaggactctctatcttcgcccaggacctgagactgtgtcttgatgaagctctgagttgggattgtttcgccctttctctgctggcagtggctttggggctcggcgttcctatgctccaccatttatgcggctgggatttgtggtactgtttccatttgtgcctggcttggctgccatggcgtggtaggcaaagtggcagagacgaggacgccctcccttatgatgctttcgtcgtttttgataaaactcagagcgccgtagcggactgggtctataatgaactcaggggccaactggaagaatgtcggggacgttgggccttaagactgtgtttggaggaacgggattggttgcctggtaaaactctatttgaaaatctttgggccagcgtctacggatctcgaaagacgctgttcgtcctggcccatacagatagggtgtcaggactgctccgggcatcattcctgctggcccaacaaaggctactcgaagaccggaaggacgtggtggttctggtaatcctttcgccggatggcagacgctcacgatatgtgaggctgaggcagcgactgtgcaggcagagtgtgcttctgtggcctcatcaacccagcggccagaggagcttttgggcccagcttgggatggctcttacccgggacaatcatcacttctacaatcggaacttctgtcagggccccactgccgagtag

SEQ ID NO: 34025 - DNA, 1113 bp, Artificial Sequence
  Description of Artificial Sequence: Synthetic coding sequence
atggcaggtgcagaaaattggcccggacagcagctggaacttgacgaagatgaggccagttgctgcagatggggcgcccagcacgcaggtgcccgagagctggccgcgctatacagccccggcaaacgcctccaagagtggtgctccgtgattctttgcttctctctaattgctcataacctggtgcatttgctactgctggctagatgggaggacaccccactggtgatcttgggagtggtggctggtgcgctgatcgcggatttcctgagcggcctggtccattggggagccgatacttggggttctgtggagctacccatagtgggcaaagcattcatacgtccttttcgcgagcatcacattgatccaacagccattacaaggcacgacttcatagaaactaacggcgataactgcctcgttacacttttaccactgctgaacatggcttacaagtttagaactcattctcctgaagcactcgagcaactgtacccgtgggagtgttttgttttttgccttatcattttcgggacattcacaaatcagatacacaagtggagccatacatatttcggcctgccccgatgggttacactgttgcaggattggcacgttatcttaccacgcaagcatcaccgaatccaccatgttagcccccacgagacctacttttgcattactacaggcgtcaaggtcccacgaaactttcgacttctggaggagctcgaagagggccaaaaaggagtgggagacggcaccgtgagctggggactggaagatgatgaggacatgaccctaacccgttggactggcatgatcatcgggcccccgcgtacaatttatgagaacaggatttattcactgaagatcgaatgtggccccaaatatccagaagcaccacccttcgtccgatttgttacaaaaatcaacatgaacggcgtgaactcctctaatggcgtggttgacccaagggctataagcgtcctcgcaaagtggcagaattcttactcaatcaaggtggtgctccaggagttaaggcgcttgatgatgtcaaaggaaaacatgaaactcccccagcccccagaagggcagtgctatagcaactag

SEQ ID NO: 34026 - DNA, 978 bp, Artificial Sequence
  Description of Artificial Sequence: Synthetic coding sequence
atggcccatttcgtccagggaacctcccgcatgattgccgcggaaagctccactgaacacaaggagtgcgcggagcccagtacccgaaaaaacctcatgaactccctggagcagaaaatacggtgtcttgaaaagcagcgaaaagagctcctggaggtgaaccaacaatgggaccagcagttcaggtcaatgaaagagttgtatgagcgaaaggtggccgaactaaaaactaagctggatgccgccgaaagatttctgtcaactagggagaaggaccctcatcaacgacaacgcaaggacgacagacagcgagaggatgaccggcagcgcgatttaactcgtgaccgcctgcaaagagaggaaaaagagaaagaacggctgaacgaagagctgcatgaacttaaggaggaaaacaaactgctcaaaggaaagaatacattggccaacaaggagaaagagcactacgagtgcgaaattaaacggcttaacaaggcgctccaagatgctctgaacattaagtgtagtttctccgaagactgtctccgtaaaagcagagtcgagttctgtcatgaggagatgcgaaccgagatggaagtactcaaacagcaagtgcagatttacgaggaggattttaagaaggaaaggtccgaccgggagaggttgaatcaggaaaaagaggagctgcagcagatcaacgaaacatcacagagccagcttaaccggctcaattctcaaattaaggcctgccagatggaaaaagagaagctggaaaaacagctgaagcagatgtattgtcctccctgcaattgtggtctggtgtttcatttgcaagacccctgggtaccaacaggacctggggctgtccagaagcagcgtgagcaccccccggactatcagtggtacgcactggaccagctgcccccagatgtgcaacataaggccaacgggctgtcatcggtcaagaaagtacatccttag

SEQ ID NO: 34027 - DNA, 978 bp, Artificial Sequence
  Description of Artificial Sequence: Synthetic coding sequence
atggctcactttgtgcagggcacgagccgcatgatcgcggccgaatcatctacggagcacaaggagtgcgccgagcccagcacaagaaagaatttaatgaattccttagagcagaagattagatgcctcgagaagcagagaaaagaattactggaggtcaatcagcagtgggaccagcagtttcggtccatgaaagaattatatgaaagaaaggttgcggagctgaagacaaaattggacgctgcggaaaggtttctgagtacccgtgagaaggacccacatcaacggcagcgtaaggacgaccggcagcgggaggatgataggcaacgcgacttgactcgggaccgcctgcagagagaagagaaggagaaggaaaggcttaacgaggaactgcacgagttgaaggaggagaacaagttgctaaaaggtaagaacacactggcaaataaggaaaaagaacactacgagtgcgaaatcaagagactgaacaaagccctccaggacgccctcaatatcaaatgttccttctctgaagattgcttgaggaagagcagggttgagttctgccatgaggaaatgaggacggaaatggaggttcttaagcagcaggttcagatttatgaggaggatttcaagaaagagcggtctgaccgggagaggctgaaccaggaaaaagaggaactgcagcagataaacgagacatcccagtcccagttgaatcgtctgaactctcaaataaaggcctgccaaatggaaaaggaaaagctggagaagcagctcaaacagatgtactgcccaccatgcaactgtggattggtgttccatctgcaagatccatgggttcctaccggccctggcgctgttcaaaagcaaagagagcaccctcccgactatcagtggtacgcactggaccaactaccgccggatgtgcagcacaaggcaaacggcctctctagcgtgaagaaggttcatccatag

SEQ ID NO: 34028 - DNA, 1110 bp, Artificial Sequence
  Description of Artificial Sequence: Synthetic coding sequence
atgaataagaacgagaaacacgacgataaactcgttatgttcactaatcaaagcgaggactctgagagatgcgaatcgatggagctggacaaaaaaatacaggatctgatcgaacgcaacgcttccccccaccctaaacggtttacccctgaggctatgcccacccaccgcaacttatgcagcctcaaaacacctggcaagacggcatcaatggcccattttgtgcaaggcacctcacgcatgattgctgcagagagcagcactgaacataaagagtgcgctgagccaagcactcggaaaaacctgatgaacagcttggagcagaagattaggtgcctggaaaagcaaaggaaagaactgctggaggtgaaccagcagtgggaccagcagttcagatccatgaaggagctgtatgaacgtaaagtggcagaactgaagaccaagctcgatgcagccgagcgctttctctccactcgcgaaaaggaccctcaccaaaggcaacgcaaagacgacagacaaagagaagatgaccggcaacgcgaccttaccagggacagattgcaaagagaagaaaaggagaaagaaaggctcaatgaggagctgcatgagcttaaagaggagaacaagcttcttaaagggaaaaatacacttgccaacaaagagaaagagcattacgagtgcgagatcaagcgcctgaacaaggcccttcaggatgccttgaatatcaagtgttctttctccgaggactgcctccgtaagtctcgggtggagttttgccacgaagagatgcgaaccgagatggaagttttgaaacagcaggtgcagatttacgaggaggacttcaagaaagagaggtctgaccgagaaaggcttaaccaggagaaggaggaacttcagcagatcaacgagacctctcagagccagttgaaccgcctgaattcgcagattaaggcgtgtcagatggagaaggaaaagctggagaagcaacttaagcagatgtattgcccaccctgtaactgtggacttgtgttccatctccaggacccctgggtgccaaccggccccggcgccgtacagaaacagcgagaacaccccgtgtacccacagtag

SEQ ID NO: 34029 - DNA, 1029 bp, Artificial Sequence
  Description of Artificial Sequence: Synthetic coding sequence
atgtccgaagagtcggactctctcaggacatcccctagcgtggcctctctcagcgaaaatgagctgccacccccacccgaacctccaggttacgtctgctctttgactgaagatctggtgacgaaggcccgggaggagctgcaggagaagcccgagtggcggctgagggacgtacaggcattgcgcgatatggtaagaaaggaatatcccaacctttctaccagcctggatgacgcctttctgttaaggttcttgcgagctcggaagttcgattacgatcgggccctccagcttctggtgaattatcattcgtgtaggcgcagctggcccgaggtgtttaataatctgaaacccagcgctctgaaggatgttctggccagtggtttcttgaccgtcctgccccatacagatcccagaggctgccatgtggtttgcatcagacctgacaggtggataccatcaaattaccctataacagagaatataagagctatctatctgacccttgagaagttgatccagagtgaagagacccaagtcaatgggattgtaatcctcgcagactataaaggagtttccctgagcaaggcttcacactttggccctttcatcgcaaaaaaggtgatcggcatcctacaggatggcttcccaatcaggattaaggccgtgcatgttgtcaatgaaccccggatttttaagggtattttcgcaatcataaagccttttctgaaagagaagatcgctaacaggttttttttgcatggcagcgatctcaactctctgcataccaatctccctcggagcatcctcccaaaagaatatggaggcaccgccggcgagctcgatacagccacatggaacgccgtgcttctggcaagcgaagacgactttgtgaaagaattttgccagcctgttcctgcttgtgacagtatcctgggccagaccttactccccgaagggctgaccagcgatgcgcaatgtgacgactctcttagagcagtgaagtcacagttgtacagctgttactag

SEQ ID NO: 34030 - DNA, 1029 bp, Artificial Sequence
  Description of Artificial Sequence: Synthetic coding sequence
atgagtgaggaatccgattccctgaggacttcaccctcagtggcatctttgtccgagaacgaattgcctccaccccctgagcctccaggctacgtttgttcattaacagaggatctagtaacgaaggcccgagaggagctccaggaaaagcccgagtggcgcctcagagacgtgcaggcgctgagagatatggtccgtaaagagtatcccaacctcagtacgtccctagacgatgcctttcttcttagatttctgagagcaaggaaattcgattacgatagggcactgcaacttctggtgaactatcactcgtgccgtcgatcttggccagaagtgttcaacaatttgaagcctagtgcattaaaagacgtgctggcgagcgggtttttgaccgtcctgccccacaccgacccacggggctgtcacgtcgtgtgcatccggcctgacagatggattccctctaactaccccattacggaaaatattcgtgccatatacctcaccctcgagaaactcatccaatccgaagaaactcaggtaaacggcatagttattcttgccgattacaagggagtgtccttatctaaagcgagccactttggtccattcatcgcgaaaaaggtgattgggatcttgcaggacggattccctattcggatcaaagctgtacatgtcgtaaacgagccccggatatttaagggcatttttgctatcatcaagccttttttaaaggagaagatcgccaatcgtttctttctgcacggcagcgaccttaactcactgcacaccaacctccctcgttcgattttgccaaaggagtatggaggaaccgccggggaactggatacagctacctggaacgccgtgctgctcgccagtgaagacgactttgtcaaggagttctgccaacctgtgcccgcttgtgacagcatcctggggcaaaccttactccctgaggggttgacctccgacgctcaatgtgacgattctctgagagccgtcaaatcccagctgtatagctgctactag

SEQ ID NO: 34031 - DNA, 840 bp, Artificial Sequence
  Description of Artificial Sequence: Synthetic coding sequence
atgagcgaggaatccgattccctgagaaccagcccaagtgtggcgtcgttgagcgaaaacgagctgccccccccccccgaacctccaggctacgtttgctcactgacagaggatcttgttacaaaagccagagaggagcttcaagaaaagcccgaatggcgcctgagggatgtgcaggcactaagggacatggtccggaaagagtaccccaacttgagcacctccctggatgacgcttttctcctccgtttcctgcgtgcacgcaaattcgactacgatagagctcttcagctactggtgaactaccattcctgtagaagatcttggcccgaggttttcaacaacctgaagccaagcgcgctgaaagatgtcctggccagcggatttctgaccgtcctgcctcacacggacccaagaggctgccatgttgtgtgtattcgccctgatcgctggatccccagtaactatcccataaccgaaaatattcgagctatctatttgactctagaaaagttgatacaaagtgaggagactcaggacggatttccaattaggatcaaggccgtgcacgtggtgaatgaaccgagaatctttaagggaatttttgccatcatcaaacctttcctcaaagagaaaatcgccaataggtttttcctccacggtagcgatcttaattctctgcatacgaacctcccgcgctccatcctgccgaaagagtacggcggaacagcgggggagttagacacagccacctggaacgccgtgcttctggcttccgaggatgattttgtcaaggaattttgccagccagtcccagcctgtgacagcattctgggctag

SEQ ID NO: 34032 - DNA, 309 bp, Artificial Sequence
  Description of Artificial Sequence: Synthetic coding sequence
atgagagcatctccctgtatcagccagccagccgcttcttggcaccctagaccttccgctctcaggcccaccgctggaagcggaccagatacccgcaccccaggcaccgtggaggacggtagcgctccatgccccgctttcagatctccagccgtaagcccttgtggtgaagagccttgctgttttcagatatctcccgccgaagagaccctggagctcggccgtctggtctcacctggttgtcataaatccagtgcaccacaagaacgacgactggacccaagagcacgatgcgtggttcacatctag

SEQ ID NO: 34033 - DNA, 375 bp, Artificial Sequence
  Description of Artificial Sequence: Synthetic coding sequence
atgcgtgctagcccatgtatttcccagcccgcggcctcttggcatccccggcccagtgccctccgcccgaccgccggtagcggccctgacacgcgtactcccggcaccgtggaggacggctcagctccgtgcccagcattccgttcccctgccgtgtctccctgtggggaagagccttgttgttttcagatctcacccgcggaggaaacactggagctcggaaggctcgtgtcacccggcaactgtgataccctgtctccacgggctgcaggcttttacgcctgtcatgtccgaagtctgattccttgtagaagcaccaaaggtaggtggccgctaactgcaagcgccgccggcctttcctctttctcagggtag

SEQ ID NO: 34034 - DNA, 1131 bp, Artificial Sequence
  Description of Artificial Sequence: Synthetic coding sequence
atggatggggaggagcaacagccgccgcacgaggctaatgtcgaaccagtggtaccttctgaagccagtgagcctgtcccccgagtcttaagcggggatccacagaatttatccgacgtggacgccttcaacctgctgctggagatgaagttgaagagacggaggcaaagacctaatctacccaggaccgtaactcaacttgtcgcggaggacggttctcgcgtgtatgtggtcgggacggcccactttagcgacgattcaaaaagagacgtcgtgaaaactattcgcgaggttcagcctgatgtggttgtggtcgagttgtgtcagtacagggtatctatgcttaagatggacgagtccacactcctgagggaagcccaggagctgagcctcgaaaagctgcagcaagccgtcagacagaacggcctaatgtccggcctcatgcagatgcttttgctgaaggtgagcgcacacattacggagcagctagggatggcaccaggcggggaattccgcgaagctttcaaagaagcctcaaaggtgccattctgcaaatttcacctaggtgatcgtccaattcctgtcacatttaagcgcgcgattgctgccctcagcttctggcaaaaggttcgcctagcctggggactctgcttcctctccgatcccatttctaaggacgatgtggagcgctgtaaacagaaggatctcctcgaacagatgatggccgaaatgataggagagtttccagacctccaccgaacaatcgtcagtgagagagacgtttatctgacttacatgctaaggcaagctgcccgccgcctggagctcccgcgggcgtccgatgcagaaccccgtaagtgcgtccccagtgtggtagtgggtgtggtaggtatgggccatgtgcccggaatagagaagaattggtcgaccgatttaaacatccaggagattatgacggtgccgccaccttccgtctcaggacgcgtcagcagattggccgtgaaagcagccttcttcggactcctcgggtatagtttgtactggatgggtagacgcacagccagcctggtcttatctctgcccgctgcccaatactgtctgcaacgggtcaccgaggctcggcacaagtag

SEQ ID NO: 34035 - DNA, 1131 bp, Artificial Sequence
  Description of Artificial Sequence: Synthetic coding sequence
atggacggggaggagcaacaacctcctcacgaagcaaacgtggaaccagtagtaccctctgaagctagcgaacctgtgccacgagtcctgtcaggtgatccccagaatctcagcgatgtggatgcctttaacctcctgttggagatgaagttgaagcggagacggcagcggcccaatctgccacggactgtaacccagcttgtggctgaggacggcagtagggtgtatgtcgtggggaccgcccacttctctgacgacagcaagcgcgacgtggtcaagaccatacgggaagtgcagcccgatgtggtggtggtggaactttgccagtacagagtgtctatgttgaagatggatgagagtacccttctgagagaagcccaggaactctcactggagaagctgcagcaggcggtgaggcagaacggccttatgtcggggctgatgcagatgcttctcctaaaggtctcggcgcacataacagaacagctgggaatggcacctgggggggagttcagggaggcttttaaggaggctagtaaggtgcccttctgtaaattccacctgggggatcgaccaattccagttacatttaaacgtgcgattgcagccctgtcattctggcagaaggtgagactagcctggggcctgtgcttcctctctgacccgattagcaaagatgacgtcgagcgatgtaagcagaaagacctgctcgaacagatgatggccgaaatgatcggcgagttccctgaccttcaccgcaccatcgtctcagaacgcgacgtttatctcacatatatgctgaggcaagctgccaggcggttagaactgcctcgtgcctctgatgctgagcctcgaaaatgcgtgccctcagtggttgtaggggtggtgggtatggggcacgtgccagggatcgaaaaaaattggtccacagacttgaatattcaggaaatcatgaccgtaccccccccctcagtgagcggacgtgtgtctcgcctggctgtcaaggccgcatttttcggtttactcggttattccttgtattggatggggagacgaacagcgagtttagtactctccctgcctgcagcccagtattgcctgcagcgggtgacagaagcccggcataaatag

SEQ ID NO: 34036 - DNA, 1131 bp, Artificial Sequence
  Description of Artificial Sequence: Synthetic coding sequence
atggatggagaggagcagcagcccccccacgaggcgaacgtggaaccggttgtccctagcgaggccagcgaacccgtcccacgggtgctttcaggggatccacagaatctgtccgatgtggatgccttcaacttattattggagatgaagcttaagagacgccgccagcgcccaaacctgccacgcacagtaacacaactcgtggccgaagatggaagcagggtctatgtggtgggaacagcccacttctcagacgactcaaaacgtgacgtggtgaagacaattcgggaagtgcagccagatgtcgtggtggttgaactgtgtcagtaccgtgtgagtatgttgaaaatggatgagagcactctcctgagagaagcccaggagctgtcattggagaaattacagcaagctgtgcgacaaaacggattgatgagcggtttgatgcagatgttgctcctgaaggtaagcgcgcatattacagaacaactgggtatggcaccaggaggagagtttagagaggcctttaaggaagcgtccaaggtgcccttctgcaaattccatcttggggatcggccgataccggtcacgtttaaacgtgccatcgccgcactatcattctggcagaaggtgcgcttggcctggggcctgtgcttcttgagcgatcctatctccaaggacgatgtggaaaggtgtaagcagaaagatctacttgagcagatgatggccgagatgatcggggaattcccagaccttcataggaccatcgtgtctgaaagggatgtttatctgacatacatgctaagacaagctgcaaggcgcctcgagctgccgcgcgccagtgacgcggaaccccgcaaatgtgtcccttccgtagtggtgggcgttgtaggcatgggccatgtcccagggattgagaagaactggagtaccgacctcaatatccaggaaattatgactgtaccacctccttccgtgtctggcagggtttcccgtctggctgtgaaggcagctttcttcggtctcctcgggtattctctgtactggatgggtcggcggacggcaagcctcgtgctgtcactacctgctgcccagtactgtctgcaaagagttaccgaagcaagacacaaatag

SEQ ID NO: 34037 - DNA, 1554 bp, Artificial Sequence
  Description of Artificial Sequence: Synthetic coding sequence
atgcacgcagccctcgccgggccactgctggccgcccttttggccaccgccagagcccggccacagcccccagacggcggacagtgtagacctcccggatctcagcgagacttaaactctttcctctggactatccggagagaccccccagcgtatctgtttgggacaatacacgtgccatacactcgggtgtgggattttatcccagacaactccaaagcagcatttcaggcctccacaagggtttatttcgagctcgatttgactgatccctatacaatcagcgcacttgcatcctgtcagcttttaccacacggtgagaacctgcaagacgtactcccccacgagctctattggcgcctcaaacggcacctggactacgttaagctcatgatgccttcgtggatgacccccgcacaaagggggaaaggcctttatgctgattacctgttcaatgcaatcgccggcaattgggagagaaaacgacccgtttgggtgatgttgatggtcaatagcctgaccgagagggacgtgaggtttagaggcgtccctgtgttggacctctatctcgcgcagcaagccgaaaagatgaaaaagacgacgggggcggttgaacaggtcgaggaacaatgtcaccctctaaataatggacttaactttagccaggtcctcttcgcattaaatcagaccctgctgcaacaggaatcagtaagggctggcagtctgcaggcttcctataccaccgaagatttgattaaacactacaattgtggagatttgagcgcggtgatctttaaccacgatacatcccagctgcccaattttatcaacactaccctgcctccccatgagcaagtgacagctcaggagatcgattcttacttccgccaggaactgatatacaaacgcaacgaacggatgggcaagcgggtgatggcacttcttcgcgagaatgaagacaaaatctgtttctttgcgttcggcgcaggccactttttgggcaacaatactgtgattgatattctaagacaggccgggttggaggtggaccacacccctgcaggccaggctattcactcccccgcccctcaaagccccgcccccagtcccgagggaaccagcacatcaccagcccccgtgacacctgccgcggctgtcccagaggcaccttctgtgactcctaccgcccctcctgaagacgaggacccagctctatctccccatctactcctacctgattctctcagccagctcgaggagtttggtcggcagcggaagtggcacaaaaggcagtccacccaccagagaccacggcagtttaacgacctttgggttaggatcgaggacagtacgacggcctctccccctcccctccccttgcagcccactcattcttcagggaccgcgaagcccccattccagttgtctgaccagttacaacagcaggaccctcccggccctgctagctcctcagcccctaccctggggttacttccagctatcgctaccaccatcgctgtctgcttcctgcttcattctctgggaccctcttag

SEQ ID NO: 34038 - DNA, 555 bp, Artificial Sequence
  Description of Artificial Sequence: Synthetic coding sequence
atgacctcgttcgaggacgccgacactgaggagaccgtgacttgcctccagatgacagtctaccatccaggccagttgcaatgtggaattttccaatccatcagtttcaacagggagaagctgccctcttctgaagtggtgaagttcggcagaaatagtaatatctgccattataccttccaggacaagcaggtcagccgcgttcagttttcgctccagctatttaaaaaattcaacagctccgtgctcagctttgagatcaagaacatgtctaagaagacaaacctcatcgtggattccagggaactgggatacttaaacaagatggacctgccctatcggtgtatggttagattcggggagtaccagtttctgatggagaaggaagacggagagagtctcgaattttttgaaacccagtttattctaagccctaggtccctgctgcaagagaacaactggcccccccacaggcctatccccgaatatggtacttatagcctctgctctagccagtcctccagccctacggaaatggatgagaatgagtcttag

SEQ ID NO: 34039 - DNA, 255 bp, Artificial Sequence
  Description of Artificial Sequence: Synthetic coding sequence
atgactagcttcgaggatgcagacactgaggaaactgtgacctgtctgcagatgacagtgtatcatcctgggcagctgcagtgcggaatcttccagtctatctccttcaatcgggagaaactcccgagctcggaagtagtgaaattcggcaggaactccaatatctgtcactatacatttcaggacaagcaagtaagcagagttcagttctccctgcagctctttaagatacagcagctctcatccctgctttag

SEQ ID NO: 34040 - DNA, 555 bp, Artificial Sequence
  Description of Artificial Sequence: Synthetic coding sequence
atgacatcttttgaggatgccgacaccgaagagaccgtcacatgcctccaaatgacggtctaccacccagggcagttacagtgcgggattttccagagcattagctttaaccgtgaaaagctgccatcttctgaagtagtaaaattcggccgcaacagcaacatttgccactatacgtttcaggacaagcaagtctcaagggtgcagttttctctccagctcttcaagaagttcaacagctccgtactgagcttcgagatcaaaaacatgtcgaagaagaccaatctgatcgtcgactcccgcgagttagggtacctgaacaaaatggacctcccttacaggtgtatggtgagatttggggaataccagtttctcatggagaaagaggatggggagagtctggaattcttcgagacgcagttcatactgtcgcctagaagtcttttacaagaaaacaactggcctccacaccgcccgataccggagtacggaacttattcattgtgtagcagccagtcatcgtctcccaccgaaatggatgagaacgagtcttag

SEQ ID NO: 34041 - DNA, 552 bp, Artificial Sequence
  Description of Artificial Sequence: Synthetic coding sequence
atggagaaaccgtataataagaatgaggggaacctggagaacgaaggcaaaccggaagacgaggtggagcctgatgatgagggaaagtccgacgaggaagaaaagccggatgccgagggaaaaacggagtgtgagggcaaaaggaaggctgaaggggagcctggtgatgagggccagttggaagacaaagggtcccaggaaaaacaaggtaaatctgagggtgagggaaaaccgcagggggaaggcaagccagcgtcccaagccaaaccagagggtcagccacgcgccgcagaaaaacgacctgccggagactacgtgccgaggaaggccaagaggaagactgatcggggcacagatgattcccctaaagattcccaggaggacttgcaagagaggcacctctcatccgaagagatgatgagagaatgtggtgatgtgagtagagcacaggaggaacttaggaagaaacagaaaatgggcgggttccattggatgcagcgggacgtgcaagatccgttcgctcagggagacaatggggtgagcggcgaatag

SEQ ID NO: 34042 - DNA, 1641 bp, Artificial Sequence
  Description of Artificial Sequence: Synthetic coding sequence
atggcagctggctccacgaccctcagagcggtgggcaaactgcaggttagattagcgacgaagaccgaaccgaagaaacttgaaaaatacctgcagaagctgtcagcgttgccaatgacagcagacatattggcggagacagggatcaggaaaactgtcaaacggctgcgaaaacatcagcacgttggggatttcgcccgggatttggccgcacgatggaagaaactcgtgcttgtcgacaggaacactggccctgatccgcaagatcccgaggagtcagcgagtaggcaaagattcggcgaggccctgcaggaacgcgagaaagcctggggcttccccgaaaacgcaaccgcccctcggtctccttcccacagccccgaacatagaaggactgcgagacgcactccccccgggcagcagcggcctcatccacgctctccctctcgagaaccaagagccgaacggaagcgaccacgaatggcacccgcagattcaggccctcatagggatcctccaacgcgtaccgcccctctgcctatgcctgagggcccagagccagcagtccctggcgagcagcctggccgcggtcacgcccatgcagcacaggggggccctctgctgggccagggctgccaagggcagccccagggagaagcagtcgggtctcactctaagggacataagtctagcagaggggcctccgctcagaagagccctcccgtgcaggagtcccagtccgagaggctgcaggccgctgtggcagattctgcaggaccaaaaactgtgccttctcacgtcttttccgagttgtgggatccatccgaggcatggatgcaggcaaattatgatttgctcagcgcttttgaagccatgacttcccaagcaaatcctgaggccctgagcgcccctacactgcaggaagaagcagcattccccggtaggcgagtgaatgcaaaaatgccagtctactcaggttcccgccctgcatgtcagttgcaggtgcccacattgcgtcagcaatgcctgcgcgtaccccgcaataacccagacgcattgggtgatgtcgaaggcgtcccatattcagcgctggagcccgtgttggaaggctggacgcccgatcaaccctataggacagagaaagacaacgctgccctcgccagagagacggacgagctttggcgcatccattgcctacaggattttaaagaggagaagccacaggagcatgagtcatggagggaactttacctgcggctgagagatgccagagagcagcgattaagggtcgtgaccaccaagattaggtcagcccgggagaacaagccatccggacgccagacaaaaatgatttgttttaattctgtggcaaagacaccttacgatgcatcgcgacgccaggagaaatcagctggcgccgcagacccagggaacggcgagatggagccagcacccaaacctgccggatcttcacaagccccttctggtctgggtgacggagatggcggatccgtgtccggtggtgggagttccaataggcacgccgcccctgccgacaagactcggaaacaggcagccaagaaggtcgcgcccctgatggctaaagcgatcagggattataagggcagatttagcaggcggtag

SEQ ID NO: 34043 - DNA, 1761 bp, Artificial Sequence
  Description of Artificial Sequence: Synthetic coding sequence
atgcaggccggggccagatttcagaggaggagaagacagctacagcagcaacagccaaggaggcgccagcccctgctgtggcctatggacgccgagcctcctccaccccccccctgggtgtggatggtgccagggtccgccgggcttttgaggttgtctgccggggtggtggtgccgccagtcctgttagcttccgcccccccacccgccgctcctctgttacccggactccccgggtggcctgccccgtcagaaccggtgttacccctgctccctctgccaagcgctcctgacagcgcagccgcagcagccgctcaccccttcccagcactgcacggccagtggctgtttggaggccacagccccagcctcggcctgcctcccagctctaccgttgaacttgtccctgtctttccgcacctttgtcccagtgctctcgcgacacctatcggcaaatcctggattgataagagaataccaaattgtaaaatcttcttcaataatagctttgctctcgattccacttggatccaccccgaggaaagtcggttttttcacggccacgaaaagccaagactccttgccaatcaggtggctgtgagcttgagtaggcctgctccggcatccagaccacttcccaccgtggtcctagcacctcaacccattccaggcggctgccataattccttaaaggtaactagctcccctgccatcgcgatcgcaacagccgcagccgccgctatggtgtctgttgatcccgagaacctgagagggccaagcccatcttccgttcagccacgccattttttgaccctggcaccaattaaaatacctttacggacctcgcccgtgtcagacactcgtacagagcgaggcagagtggccaggcctccagccctgatgcttagagcgcagaagtccagggacggggataaagaggacaaagagccccctccgatgctgggaggcggcgaagactccaccgcccgcgggaataggcccgtggcgtctaccccagtgccaggatctccctggtgcgttgtgtggaccggtgacgacagagtgttcttcttcaatccaaccatgcacctgagcgtgtgggaaaagcctatggatctcaaggaccgcggagacctcaaccgaatcatcgaagaccccccccacaagaggaagctggaggcacccgctactgataactccgacggtagcagcagcgaagataacagagaagaccaagatgtgaagacaaaaagaaaccgcactgaaggttgcggaagccccaaacctgaagaagcaaaaagagaggataaagggaccagaaccccacctcctcaaatcctgctgcccctggaggagcgggtcacacacttccgcgatatgctcctggaacgaggggtcagtgccttctcaacttgggagaaagaacttcacaagatagtattcgatccaaggtacctgttgttgaattccgaggagagaaagcaaatctttgagcagtttgttaagacaagaatcaaggaggaatataaagagaagaagagtaagctgttgctcgctaaggaggaattcaagaaactcttggaggagtccaaggttagcccgaggacgacgttcaaggaattcgcggagaaatacggcagagaccaacggttccgacttgtgcagaaaagaaaggaccaggaacacttttttaaccagttcatcctgatcctgaaaaagcgagataaggaaaatcgtctaagactgaggaaaatgaggtag

SEQ ID NO: 34044 - DNA, 504 bp, Artificial Sequence
  Description of Artificial Sequence: Synthetic coding sequence
atggacagaggcaggcccgcaggctccccactgtccgcctctgctgaaccggctccactggcagcagcaattcgggactccaggcccggtcgtactggaccaggaccggcaggcccaggtggagggtcgcgatccgggtcgggcagacctgccgcagctaacgccgcacgggaacgtagccgggtgcagacgcttcgccatgcctttcttgaactgcagagaacgctgccctctgtgccccctgacacaaagctgagcaagttggacgtgttgctgctggctaccacctatattgctcacctcactcggagcttacaggacgacgccgaggccccagccgacgctgggctgggtgctctgagaggagacggctatctgcacccagtgaaaaagtggcctatgcgcagccgattatacattggggccacaggtcaatttctgaagcattccgtgagtggcgagaaaaccaaccacgataatacacccacagatagccaaccttag

SEQ ID NO: 34045 - DNA, 11580 bp, Artificial Sequence
  Description of Artificial Sequence: Synthetic coding sequence
atggcgttcgtcgccacccagggagctactgtggtcgaccaaaccaccctcatgaagaaataccttcagtttgttgcagcactgacagacgttaatactcctgatgagaccaagctgaaaatgatgcaggaagtcagcgagaattttgaaaacgtcacaagctctcctcagtattctacgttcctcgagcacataattcctaggtttctgacttttctacaggatggcgaagtccagtttttgcaggaaaaacccgcccaacagctaagaaagctcgtgctcgagataattcataggataccaaccaatgagcacttgcgtccccacacaaaaaacgtgctgtcggtgatgtttaggttcctcgagactgagaacgaggagaacgtgctcatttgtcttaggataatcatcgagctacacaagcagttcagaccgcccatcacccaggaaattcaccattttctggactttgtcaagcaaatctataaagagctccctaaagtggtcaaccggtacttcgaaaacccccaagtgataccagagaacaccgtcccccccccggaaatggtggggatgataaccacaattgctgtaaaagtgaatcccgagagggaagactccgaaaccaggacccacagcattatcccccgcgggtcactttcgctgaaggtattggccgagcttcccattattgtagtgcttatgtaccagctctacaagttaaatatacataacgtcgtggctgagttcgtccccctgatcatgaataccattgctattcaggtcagtgctcaggcgcgccaacataagctgtataacaaggaattatacgcggatttcatagccgcgcagatcaaaacactctccttccttgcatatatcattcgcatctatcaagagctggtaacaaagtatagccaacagatggttaagggtatgctgcagctgttgagcaactgtcccgcagaaaccgcgcatctgaggaaagaactgctgatcgccgccaaacatatactgactactgagttaagaaaccaatttatcccttgtatggacaagctgttcgacgagtccattcttataggctcggggtacacagctcgcgaaaccttaagacctctagcctacagcaccctcgccgacctggtgcatcatgtccggcaacatctccctctgtctgatctatctctggcggttcagctttttgccaagaatattgacgatgagtcgcttccatcctctatccagaccatgtcgtgtaagctgctcctcaatctggtcgactgcatccgatcaaagtcagaacaggaatccggtaacggtcgcgatgtgttgatgcggatgctggaggtgtttgtgctgaagtttcacactatcgcccggtaccagcttagcgctatattcaaaaaatgcaagcctcagtctgagttaggcgcggtggaggccgcgctgccaggggtgcccactgccccagccgcaccaggcccagccccctcacccgcacctgtgcccgccccgcctccaccccctccacccccaccaccagccacacctgtgacccctgcacccgttccaccatttgagaaacagggcgaaaaggataaggaagacaagcaaacctttcaggtgactgactgcaggtctttagtcaaaacactggtctgcggagtgaagactataacttggggcataacctcctgtaaggcacctggcgaggctcagtttatccccaacaaacagctgcagcctaaagaaacccagatttacatcaaactcgtcaagtatgctatgcaagccctggacatttaccaggtgcagatagcggggaatggccaaacatatattcgagttgcaaactgtcagactgtacgcatgaaagaggagaaggaggtgcttgaacacttcgcgggagtatttaccatgatgaacccactcacctttaaagagatatttcagacaacagtgccctacatggttgagcgaatcagcaaaaattacgcgctgcagatagtggccaactctttcttagctaaccctacaacctcagccctgttcgccactatcctggtggaatacctgctggacaggctgcccgagatgggctcaaatgtggagttatcaaatctgtatttgaagctgtttaaattagtattcggatctgtctccctttttgccgcagagaacgagcaaatgctgaagccccatctgcacaaaatcgtgaactcatccatggagctagcccagacagctaaagagccctacaattatttcctccttttgcgggcactctttcgcagcatcggaggcgggtctcacgacctgttgtatcaggagtttctacctctcttgccaaacttgctgcaggggctgaatatgctccagtccggcctgcataagcagcatatgaaggatctcttcgttgaattatgtctaactgttcctgtgcggctctcctcactactgccatatctcccaatgctgatggacccgctcgtgtcagcactgaatggctcccaaaccctggtgagccaaggactccggacactggaactttgtgtggacaatctgcagcctgacttcttgtatgatcacatacaaccggtgagggccgagctgatgcaggccttgtggcggacacttcgcaatccagcggactctatctctcacgtcgcgtaccgagttttaggcaagttcggaggctcaaataggaaaatgctaaaagagagccaaaagcttcattatgtggtaaccgaggttcaggggccttctatcactgtggaattttctgactgtaaagcctccctccaactccctatggaaaaagccattgagacggctctggactgtttgaagtctgccaataccgaaccttactaccgccgccaagcctgggaggttatcaagtgtttcctggtagccatgatgagcctcgaggataataaacatgccctctatcagttactggcccaccctaactttactgagaagaccattccaaacgtgatcatcagtcaccggtataaagcacaagacactcctgctagaaagaccttcgagcaggcactcactggggcatttatgagcgccgtgattaaggacctgcggccctccgctctaccgtttgtggccagcctgattcgccactatacaatggtcgcagtcgcccagcagtgtggtcctttcctgctgccatgttaccaggttgggtcgcagcctagcaccgctatgttccactctgaagagaacggatctaagggaatggatcctttggtgctaatcgatgcaatcgccatttgtatggcttatgaagagaaagagctgtgcaagatcggcgaggtggctctggccgtgatttttgacgtagcaagtataatactcggtagtaaggagagagcttgtcagctgcccctgttcagttatatcgttgagaggttgtgcgcttgctgttatgagcaggcttggtatgctaagcttgggggtgtggtgtcaattaagttccttatggaaaggctcccactgacctgggtgcttcagaaccagcagaccttcctcaaggcgctgctgttcgttatgatggatttgaccggtgaggtgagcaatggggcagtggctatggccaagactacactggaacagcttcttatgcggtgtgccacacccctcaaagacgaggaaagggccgaagagatagtggccgcccaggaaaagtctttccatcatgttacacatgacttagtacgggaagtgacctccccaaacagcaccgttagaaagcaggccatgcattcccttcaggtccttgcccaagtgacaggaaagagcgtgacggtaattatggagccccacaaagaggtgttgcaggacatggttccacctaagaagcatctgctccgtcaccagccagctaacgcccaaatcgggttgatggaagggaatacattttgcacaactctacagcctcggcttttcactatggatcttaacgttgtggaacacaaggtgttctacacagagcttttaaacctgtgcgaagctgaagattccgcattaactaagctgccctgctataaaagccttccgtccctggttccgctgcgcatcgccgctctgaacgcgctggccgcgtgcaattatctgccccagagtcgtgagaagatcattgccgccctgtttaaagctctcaattctacgaactctgagctgcaggaggctggcgaggcttgcatgcgcaaattcctcgaaggcgctacaatcgaggtggatcagattcatactcatatgcgccctctgttaatgatgttgggagactatcggagtctgaccctgaacgtggtgaatcgactgacttcggttactaggttgttcccgaattcttttaacgacaaattctgcgaccagatgatgcagcacctgaggaaatggatggaagtcgtggtcataacccataagggtggccagcgatccgacgggaatgaaagtatcagcgagtgtggcaggtgcccactgagtccattctgccagttcgaagaaatgaaaatatgttccgcaatcatcaatctgtttcatctcatcccggccgccccacagacgctggtgaagccactgctggaggtggttatgaagaccgagagggcaatgctgatcgaggcaggatctccctttcgcgagccgcttattaagttcctgacgcgacacccaagtcaaaccgtggagctgttcatgatggaggccacattgaatgacccacaatggagccgaatgtttatgagctttctcaagcacaaggacgcccgcccgctgagagacgttttggctgcaaatccaaaccgttttatcaccctgctactgcccggtggtgcacagacagctgtgaggcccggctccccttcaacttcaaccatgcgactggatctgcagttccaggcaattaaaataatttcaatcattgtaaagaacgatgactcttggcttgccagtcagcactccctcgtgtcccagctgcgcagagtatgggtgtcagagaacttccaggagcgccaccggaaagagaatatggcggcaactaattggaaagagcctaagctgctcgcctactgcctgcttaattattgcaagcgcaactatggagacattgagcttctgtttcagttgctgcgcgcattcaccggtcgcttcctctgcaatatgacgttcctgaaggagtacatggaggaggagattcctaagaattattccattgcgcagaagagggcactgttttttcggtttgtcgatttcaacgacccgaactttggcgatgagctgaaggcgaaagtgctgcagcacattctgaacccagcgttcctatacagttttgaaaaaggagaaggggaacaactgctggggccccccaatcccgagggcgacaatccagagtcgattacttctgtgtttattactaaggtcctggatccagaaaagcaagcggacatgctggactcactgcgaatttacttgttgcagtacgcgacgctgctggtcgagcatgcgccacatcatatccatgacaataataagaatcgcaatagtaagttgcggagactgatgaccttcgcctggccctgcctgttgagtaaggcatgcgttgaccccgcctgcaaatattcaggacacttactcctggcccacatcatcgccaaattcgccatccacaagaagatagttctgcaggtttttcactctctcctgaaggcccatgcaatggaagcgcgcgccatagtcaggcaggccatggctatcctaaccccggccgtaccagctcggatggaggacggtcatcagatgctgacacattggactcggaagatcatagtggaagaagggcacactgtgccccaattggtgcacatcctgcacctcattgtgcaacatttcaaagtgtactaccctgttcgccaccatcttgtccagcacatggtatctgctatgcaacggctgggcttcaccccctcagttacgatcgaacagcgccgcctagccgtggacctaagcgaagttgtgatcaagtgggagctacagcgcatcaaggatcaacaaccagattcagatatggacccaaattccagtggagagggtgtcaattccgtgtcctcatctatcaaaaggggcctgagcgtggattccgcccaggaggtgaagaggttccggacagcaaccggcgccatatctgccgtcttcggccgaagccaatcgctcccaggggctgattccctgctggccaagcctatcgacaaacaacacacagacacagtggtgaatttcctgatacgcgtggcctgtcaggtgaacgacaacacgaacaccgcgggtagccccggcgaggtgctatctaggcggtgtgtgaacctgctgaaaacagcgctgcgaccggatatgtggccaaagtctgagcttaagctgcagtggttcgacaaacttctgatgaccgtagagcagcctaatcaggttaattacggtaacatctgtacaggtctggaggtactgtcctttctcctcacggtgctacagtcgcctgccatcttgtcttccttcaagccactccagcgcggtatcgctgcctgcatgacttgcggaaataccaaggtcctaagagcagtacactccctcctgtccaggctgatgagtatcttccctacagagccttccacatcttccgttgcctccaaatatgaggagcttgaatgtctgtatgcagctgtggggaaagttatatatgagggcctcactaattacgaaaaagccacgaacgccaaccccagccaactgttcggcaccctaatgattctgaagtccgcctgttcaaataaccctagttacatagatagactaattagtgtgttcatgagatccctacagaagatggtgagagaacacctgaacccacaggctgcaagtggctcaaccgaagctacctctggcactagcgaactggtaatgctgagcctagagctggtgaaaacaaggctggcagtgatgtcgatggagatgcggaagaacttcatccaggccatcctcacatcattgattgaaaaaagtccggatgcaaagattcttagagctgtggtaaagattgtggaagaatgggtgaaaaataatagccccatggctgcgaatcagacgccgacccttcgggaaaagtccatcttattggttaagatgatgacttacattgagaagcgcttcccagaggatcttgagctgaacgcgcaatttctggacctggttaattacgtctacagagatgagacattgtctgggtctgagctcaccgctaaactcgagcctgcctttctaagcggcctacggtgcgcccagcctctcatcagagctaagttcttcgaggtgttcgataacagtatgaaacgacgcgtctatgagaggttactgtacgttacctgctcgcagaactgggaggccatgggaaaccatttttggattaagcagtgtatagaactacttttggcagtgtgcgaaaagagcacaccgatcggcaccagctgccagggtgcaatgttgccaagcataactaatgtgataaacctggctgattcacatgatcgcgctgccttcgcgatggtcactcacgtgaagcaggagccccgggagcgagaaaacagtgaatctaaagaagaagacgtggagatcgatatcgagctagcaccaggcgatcagaccagtacacccaaaaccaaagagctcagtgagaaagacatcggaaaccagttgcatatgctcactaaccggcacgacaagtttcttgatacattacgtgaagtgaagactggagccctgttgtcagccttcgttcaactctgccacataagtaccacactggccgaaaagacctgggtccagctatttccacgattgtggaagatcctgtctgacaggcaacagcatgctttggcaggggagatctccccattcctgtgttcaggcagccatcaggtgcagcgcgactgccagccctccgcactgaattgctttgtggaagcaatgtctcagtgcgtcccccccatacccataaggccatgcgtcctcaagtacctgggcaaaacacacaatctctggtttaggagtacactcatgctggagcaccaggcctttgagaaaggcttatccctgcagatcaaacccaagcaaacaactgaattctatgaacaagaaagtataactcctccacagcaagaaatcctggacagtcttgctgaactgtacagcctgctgcaagaggaggacatgtgggccgggctatggcagaagcgttgcaaatattcagagactgccacagccattgcgtatgaacaacacggattcttcgagcaggcccaggagagctacgaaaaggccatggataaggctaagaaggagcatgagcggagcaacgcgtcacccgctatcttcccagagtaccagctgtgggaggaccactggatccggtgcagtaaggagctgaatcagtgggaggcactgaccgaatacgggcagtcaaaggggcacatcaatccatatctggttcttgagtgcgcctggcgtgtcagtaattggacagcaatgaaggaagccctggtccaagtggaagtttcttgtcctaaagagatggcctggaaggttaacatgtacaggggctacctagcaatctgtcatcccgaagagcaacaacttagcttcattgagaggttggtggagatggcatcctctcttgccatccgtgaatggcgaagattgccccatgtggtgtcccacgtacacactcccctcctgcaggccgcccaacagatcattgaacttcaagaagccgcccagattaacgcaggcctgcagcctaccaatctgggaagaaataactccttgcatgatatgaagacagttgttaagacttggagaaacagactgccaattgttagcgatgacctgtctcattggagctccatttttatgtggcggcaacaccattaccagggtaagccaacttggagcggaatgcattcctcctctattgtgaccgcctatgaaaattccagtcagcatgacccttctagtaacaatgccatgctgggagtacacgcctctgccagcgctattattcagtacggaaagatcgcacgcaagcagggtcttgtcaacgttgcgctggacatcctctcgagaatacacacgattccaacggtgcctatagttgactgcttccaaaaaatacggcagcaggtgaagtgttatctgcagcttgcaggagtaatggggaaaaatgaatgtatgcaagggctggaagtaatcgagagcaccaacctgaaatattttactaaggaaatgaccgccgaattctatgccttgaaggggatgttcttagcgcagataaacaagtccgaggaagcaaataaagccttttcggctgccgtgcagatgcatgacgtcctggtgaaggcgtgggcgatgtggggagattacctggagaacatcttcgtcaaggagcggcagctgcatctgggggtgtcagccatcacatgctatctgcatgcatgtcgccaccagaacgagtccaagtcgaggaaatatttggccaaggtattgtggttgttatcattcgacgacgacaaaaatacgctagccgatgctgtcgataagtactgcattggtgtcccgcccatacagtggcttgcatggattccccaactgctgacatgccttgtgggaagtgaaggtaaactgctcctcaacctgatctctcaggtggggcgggtctaccctcaagccgtctacttccctatacggactctttaccttaccctaaagattgaacaacgggagcgctacaagagtgacccagggcccattcgggcaaccgccccaatgtggcgatgcagccgtatcatgcatatgcagcgggaactgcaccccacattactttccagcctggagggcatagtcgaccaaatggtctggtttagggaaaactggcatgaggaggttctgagacaactccaacaaggactggctaagtgttactccgtggcctttgagaagagcggcgccgtgtccgatgccaaaataaccccccacacgctgaatttcgtcaagaaactggtaagcaccttcggggtgggtctagaaaatgtttccaatgtcagtactatgttcagctcagctgcttccgaatcactggcccgccgggcgcaagccacagcccaggatcccgtgttccagaagcttaaaggacagtttactaccgactttgacttcagcgtacctggttcaatgaaacttcacaatctcatctccaagttgaaaaaatggatcaagatcctggaagctaagaccaagcagctacccaagttctttctgatagaggagaaatgcaggtttcttagtaacttcagcgcccaaactgctgaagtcgaaatccccggggagttcttgatgcccaaacccacgcattattatatcaaaatcgcacggtttatgccccgcgtggagattgtgcagaagcataatacagccgcaaggcggctatacatccgaggtcacaacggaaaaatttacccgtacttggtgatgaacgatgcttgtctgacagaaagtaggcgcgaagaaagagtgctgcagcttctgcggctgctcaatccatgtctggagaaaaggaaagaaaccacaaaacgtcatcttttcttcactgtccctcgtgtagtggctgtatcccctcaaatgcgcctcgtcgaggacaatccgtcctcactttcgttagttgaaatatacaagcagcgttgcgccaagaagggcatcgagcatgataatcccatatcacgttactatgacaggctagccacagtgcaggctcggggtacgcaggcctcacaccaggtccttcgggacatactgaaagaggtgcaaagcaacatggttcctcggtcaatgttaaaggaatgggctctacacacctttcccaatgctaccgactactggaccttccgcaagatgttcaccattcagctagccttaatcgggttcgccgaattcgtgctgcaccttaaccgcttgaaccccgagatgctgcagatcgctcaagacaccgggaagctcaacgtagcatacttccggttcgatatcaatgatgccacaggggacctggacgctaatagacccgtgccctttagactgacacctaacatctctgagtttctgaccacaatcggggtctccgggccactgaccgcaagcatgatcgcagtggcccgatgttttgcacagccgaatttcaaagttgatggaattctgaagacagtgctccgggacgagattatcgcgtggcataagaagacccaggaagatacatcaagccccctatccgccgccggacaacccgagaacatggattcacaacagttggtaagtttagtgcagaaggctgtgaccgcgatcatgaccaggctgcataatttggcacagtttgagggtggcgagagtaaagtaaacacgttggtggcagctgccaattcactggataacctgtgcaggatggatcccgcatggcacccatggctgtag

SEQ ID NO: 34046 - DNA, 951 bp, Artificial Sequence
  Description of Artificial Sequence: Synthetic coding sequence
atgggggagtcagctgctgccaccgcaagtttgtttcagcgacgccgtcgcggaagagggggaagagtcacctttccaggcggcctcaagggcagtgctagatttttgtcctttgggccacccttcccagccccccctgcccctcctttccccgcagcaccaggcccttggctgcggcgtcccctcttctcactgaaattgtcagacacagaggatgtgttccctcgtagggctgggccgctggaagtccctgccgattcccgcgtgtttgttcaggctgcactggctagaccttctccccgctggggactggccctccatagatgctccgttacacccagctctaggcctgctcctggccctgccctagccttgctgcgggagggttgccctgcagatacaagtgtggcctttcctcccccgccgccaccctcccctggagctgcaagaccagcccgtttctcttttcgactgcgaccggtcttcaatgcaagtgtgcagtttctgcattgccagctgagccgatgtagacgcctacgaggggtccgaagagcccccgctccgctaactccacccccaccaccacctccatccagatgtttgccccaagacgaagcttgtgctgatacgggctcgggcagcgcagagggtcttgctgccgatgggccacatctgcacaccctgacgcagcctatcgtggtgactgtgccccgccccccaccaaggccgccaaagtccgttcccgggagagctgttcgtccagagcccccagccccagccccggcggccctagagcctgcacctgtcgttgcattggttctcgctgcctttgtcctgggcgctgccctggctgctggactgggcctagtgtgtgcccatagtgctccccacgctccaggccctcccgcaagggccagcccttctgggcctcagccgcgacggtcccagtag

SEQ ID NO: 34047 - DNA, 600 bp, Artificial Sequence
  Description of Artificial Sequence: Synthetic coding sequence
atggccaaccgaggaccttcttatggtttgtccagggaggtacaagaaaaaattgagcagaaatacgatgccgatctcgagaataagctcgtagactggattattctgcagtgtgctgaagatatagaacaccccccgcccggtcgggcccacttccagaagtggctgatggatgggaccgtgctttgcaaactcatcaatagtttgtatccacccgggcaagagcccataccaaaaatctccgagtccaagatggcattcaagcaaatggagcagatttcccagtttttgaaagcagctgaaacttacggcgtgcgaactactgatatctttcagacggtggacctgtgggaaggaaaggatatggctgcagtccaacgcactctgatggccctaggatccgtcgctgtcaccaaagacgatggctgctaccgcggcgagccctcctggttccacaggaaggctcagcagaacagaagagggttcagcgaagagcagctgagacagggtcagaatgtaatcggtctgcagatgggatcaaacaaaggggcctcacaggcaggcatgaccggctacgggatgccccgccagatcatgtag

SEQ ID NO: 34048 - DNA, 600 bp, Artificial Sequence
  Description of Artificial Sequence: Synthetic coding sequence
atggcaaacagggggcctagctatggcctatccagggaggtgcaggaaaagattgaacagaaatacgatgccgatctcgaaaataagttggtggactggataatcctgcagtgcgcagaggatatcgaacacccacctcccggccgtgcgcacttccaaaagtggctgatggatggcaccgttctttgcaagttgattaatagcctttatccacccgggcaggaacctatcccgaaaatcagtgaaagcaagatggctttcaaacagatggaacagattagtcagtttctgaaagccgccgagacatatggggttcgcactaccgacatattccaaacggtggatttgtgggaaggcaaagatatggctgcagtccagcgcactctcatggctctgggctcagtagccgtcaccaaggatgatgggtgttatagaggtgagccatcctggtttcataggaaagctcagcagaacaggcggggcttctctgaagagcagttgaggcagggccagaatgtgatagggcttcagatggggagtaataaaggtgcctcacaggcaggcatgaccggctacggaatgccccggcagataatgtag

SEQ ID NO: 34049 - DNA, 600 bp, Artificial Sequence
  Description of Artificial Sequence: Synthetic coding sequence
atggccaatcggggaccctcatatggtttaagcagagaggtgcaggaaaagatcgaacagaaatatgatgcagatctggagaataagctcgtggactggatcatccttcaatgcgccgaagacatagagcatcccccccccggtcgggcccatttccaaaagtggctgatggatggcactgtgttatgcaaattaattaactccctgtacccccctggtcaagagccaattccaaagatctccgaatctaagatggctttcaagcaaatggagcagatatcccagttccttaaggctgcggagacgtatggcgtccggacaaccgacatcttccagactgtcgacctgtgggagggcaaggacatggcagccgttcagagaactctcatggctctgggcagcgttgccgtgaccaaagacgacggctgttaccgtggagagccatcctggttccacagaaaagctcagcagaatcgccgtggcttcagtgaggaacaactccgtcaaggccagaacgtgattggcctgcagatgggttccaataagggagcttctcaggccgggatgaccgggtatggcatgccccgccaaataatgtag

SEQ ID NO: 34050 - DNA, 600 bp, Artificial Sequence
  Description of Artificial Sequence: Synthetic coding sequence
atggctaaccgggggccgtcatatgggctgtcacgggaagtgcaggagaagattgaacagaagtacgatgccgacctcgaaaataaactcgttgattggattatcctacagtgcgccgaagacatcgagcaccctcccccaggcagagcacacttccagaaatggctcatggacggtactgtgttgtgtaagttgatcaattcactgtatccacccggacaggaaccaattccaaagatttcggagtctaagatggccttcaagcagatggaacagatttcacagttcctgaaagctgccgaaacatatggagtccggacgaccgacattttccagaccgtggatctttgggagggcaaagacatggctgccgtccagcgaacattgatggctttgggcagtgtggccgtaaccaaggatgacggctgttatcgcggggaacccagctggtttcatagaaaagctcagcagaataggcgtgggttctcggaggagcagctgcgccagggacagaacgtcatagggttacagatgggatctaacaaaggggcaagccaggccggcatgacgggctatggaatgccccgccagatcatgtag

SEQ ID NO: 34051 - DNA, 666 bp, Artificial Sequence
  Description of Artificial Sequence: Synthetic coding sequence
atggccaatagaggaccttcctatggcctgtcacgggaggtgcaagagaagatagagcagaagtatgatgcagacctggaaaataagctggtggattggatcatccttcagtgtgcggaagacattgagcaccccccccccggccgagcccacttccagaagtggctgatggacggcaccgtgctgtgtaaactgataaattctctttatccccctggacaggaaccaatccctaagatttcagaatcaaagatggctttcaaacagatggagcagatttctcagttcctcaaggccgcagaaacatacggggtgcgaaccactgacatttttcagaccgtggacctttgggaggggaaggatatggctgcagtgcaacgtacgcttatggctctcggcagcgttgctgtaactaaggacgacggctgttaccgcggagagccctcctggttccataggaaggcccagcaaaatcggcgcggcttcagtgaggaacagcttagacagggccaaaatgtgatcggactccagatggggagcaataaaggggcctcccaggcaggcatgaccggatatggcatgcccgggaggtcgtgccgcactcgccaccttcccttggtggaaagaaccaatgtgccacaccatgggctatatgaaaagaaatag

SEQ ID NO: 34052 - DNA, 2520 bp, Artificial Sequence
  Description of Artificial Sequence: Synthetic coding sequence
atgaaaaagtggagctctactgacctgggagcagccgctgatccccttcagaaggatacatgccccgatcccttagatggagatcccaacagccggcccccccccgctaagccgcagctctccacggctaaaagtcgcactagactgtttggcaagggggactcagaagaggcttttcccgtcgattgcccgcacgaagagggggagttggattcatgtcccaccattacagtatcccccgtgatcaccattcaacgaccaggcgatggacctaccggggccagactcctgtctcaggattccgttgctgcttcaaccgagaagactcttcgactgtatgaccggagatcaatctttgaagcagtggcccagaataactgccaggacttagagtcactcctgctatttctccagaaaagcaagaagcatctgactgacaacgaattcaaggatcccgaaacagggaaaacttgcctcctaaaggcaatgctgaacctgcacgatggtcaaaacaccaccatcccactgttgctggaaatagcaaggcagacagattctctgaaagagttagtgaacgcgtcctatactgattcttattacaagggccaaaccgccctccacattgcaattgaacgcaggaatatggcactcgtgactctgctggttgagaacggggcagacgtgcaagcagccgctcacggggatttttttaaaaaaaccaaaggtcgtcccgggttttacttcggtgaattacctctgagcctcgctgcctgcactaatcaacttggaatagtcaagttcctcctgcagaacagctggcagacagccgatataagcgcacgggacagcgtagggaacacagtcctgcatgccctcgtagaagttgcagacaacacagctgacaatactaaattcgtgactagcatgtacaacgagatcctcatgcttggggcgaagctgcacccaacgcttaagttggaggaattgaccaacaagaagggcatgacgcctctggctctggctgccgggacggggaaaattggcgtcctggcctatatcctgcagagagagattcaagaacctgaatgccggcatctgtctcgtaagttcacagaatgggcttacggtcctgtccattcctctctctatgatctgagttgtatcgacacctgcgaaaaaaattcagtactagaggtgatcgcctattcgtccagcgaaaccccaaatagacatgatatgctgctggtagagccgctcaaccgcctgttgcaagataagtgggataggttcgtgaaacgcatcttctattttaacttccttgtgtactgcctctatatgatcatctttactatggctgcctactaccgcccagtggatggattaccccccttcaaaatggaaaaaacgggagattacttccgcgtgacgggagaaatcctttcagtcttgggaggtgtatatttcttctttagaggcatccagtatttcctccaacgcaggccttctatgaagaccctgttcgtggacagctattccgagatgttattcttccttcagtcactgtttatgctggccaccgtggtcttatacttctctcatctgaaagaatacgtggcaagtatggtcttcagcttggcccttggctggactaacatgctgtactacacccgaggcttccagcagatgggcatatatgcagttatgatcgagaaaatgatccttcgtgatctttgccggttcatgttcgtttatattgtgttcttgtttggattcagtacagctgttgtcacactcattgaggatggtaagaacgacagcctcccttcggaatccaccagtcacaggtggcgaggtcccgcctgcaggccaccggattcatcgtataacagcttatacagtacctgcttagagctcttcaaattcaccattgggatgggcgatctcgaatttactgagaattatgatttcaaggccgtctttatcattctgctattggcatatgtgatactgacatacatcctgctcttgaatatgctgattgctctgatgggggagaccgttaataagattgcgcaagaatctaaaaatatctggaagcttcagcgtgcaatcaccatactggacacggaaaagtctttcctgaagtgtatgcggaaggcgttcagaagcggtaaactgttacaggtcggatatacaccagatggcaaggacgattaccggtggtgttttagggtggatgaagttaactggacaacttggaacacaaatgtgggcattattaatgaagatcccggtaattgtgagggcgtgaagcggactctgtcattttctctccgatctagtcgcgtgagcgggcgacactggaagaacttcgccctggtgcccttgttgcgggaggcctctgctagggatcgccaaagcgcccagcctgaggaggtgtatctccgacagttctctggttccttaaaaccagaagatgcagaggtttttaaaagccccgccgctagtggagagaaatag

SEQ ID NO: 34053 - DNA, 1791 bp, Artificial Sequence
  Description of Artificial Sequence: Synthetic coding sequence
atggctgacgcagaggccagggcagaatttccggaagaagcgaggccagaccgcggtacactgcaggtcctgcaggacatggcctccagattaagaatacacagtatccgggccacatgcagcacaagcagcggccacccaacctcctgttcatcttcctctgaaattatgtctgtgttatttttttatataatgcggtacaaacagtcagatcccgagaaccctgataacgacagatttgtcctcgcgaagcgcctgtccttcgttgacgtagccacaggctggctaggacagggactgggagtggcttgtggaatggcgtatacgggtaagtatttcgaccgagcctcctatcgggtgttctgcctgatgagtgacggtgaatcctcggagggatccgtttgggaagccatggctttcgcctcctactactctctggataatctagtggccattttcgacgtgaatagactagggcactcaggggccctccctgccgaacattgcatcaatatctaccagaggcgctgcgaggcatttggatggaatacttatgttgtagatgggcgcgatgtcgaagccctatgtcaagtattctggcaggcttctcaggtcaagcataaaccaacagccgtggtggccaagacttttaagggccgcggcaccccttccatcgaagacgcagaatcttggcatgccaagcctatgccaagggagcgagccgacgccatcatcaaactgattgagtcgcaaatccagacttcgagaaacctggacccgcaaccaccgatcgaagacagccctgaagtcaatattacggatgtaaggatgactagtccccctgactaccgcgtcggtgacaaaatcgcaaccagaaaagcctgcggactggcgctggccaaacttgggtacgccaacaaccgagtggtagttctcgatggagatactcggtattcaaccttcagcgagatattcaacaaggaatatccagaacgcttcatcgagtgctttatggcagaacagaacatggtcagtgtcgccttaggctgcgctagcagagggagaacgatagccttcgcgagcaccttcgctgccttcctgacccgggctttcgaccacatcaggatcggtggcctggccgagtctaacatcaatatcatcggatcccattgtggtgtgtcagtgggggacgacggagcatcgcagatggccctcgaagatattgctatgttcaggacaatccccaagtgtacaattttttacccgaccgatgctgtgtctacagaacatgcagttgccctggctgccaatgccaagggcatgtgtttcatccgtaccacacggcctgaaacgatggtcatttacacgccacaggagcggttcgaaataggacaggctaaagtgctccgtcattgtgtctccgacaaagtcactgtgatcggcgccggcattaccgtatacgaagcactcgccgccgccgacgaactcagtaagcaagacatctttattcgcgttatcgacctttttaccataaaacccctggacgttgccacaatcgtttctagtgctaaagcaacggagggtcgaataattaccgtcgaagatcactatccccaaggaggtatcggcgaggccgtctgtgccgcagtttccatggatcctgacatccaggtgcacagcctggccgtgtcaggcgtgccccagtcgggcaagtcggaggagctgctggatatgtatggcatctctgcccggcacatcattgttgctgtcaagtgcatgctgctgaactag

SEQ ID NO: 34054 - DNA, 1500 bp, Artificial Sequence
  Description of Artificial Sequence: Synthetic coding sequence
atgtggagccgcagacaaggccgactcaggccaacagtgtgtggcgtggaggaactgcgtcgacggcgccgcgagcgggaggctgctcttcgaaaagcccgccgtgagcagcaacttgtgagcaagcgcctattgcggaacgatgcaccagaggaagccggagaggggtgtgtagccgccattctgggggaaaccgaagtgcaacagttcctccgacaggcccagagaggtactgaggaaaaagaacgggagggggcactggtctccttgaggagaggactgcagcaccccgagacgcagcagacattcattcgactggagggatcgatgcgcactcttgtaggcctccttacgtcaaatcaagcactgctgcaactggaagctgcccgttgtctacacgagctgagccatagcgagcagtccaccgtcgctgaggcgtgccttcctgcaacgtcatacctccttacctatctgtcttcacactcatctgacttcatagagctgtgtctgtacactttgggcaacctgatcgtggaatcagaggctgttcggaggcagctgctcccacagggtatagtccccgcactggccgcctgtatccagtcgccacacgtggcagtgctggaggccctcggctacgctttgtcccagttactgcaagctgaggaggcaccggaaaagataatccccccggcgagcgcaagcagctccattttagcatcaaccttgcctcagcatatgcttcagatgctgcagcctggcccgaaactgaacccaggcgtggccgtcgagttcgcctggtgtctgcattatatcatatgttcacaagtcagcaaccccctgcttatcggtcatggcgcacttagcacgctgggactgctcttgttagacctagctggagccgtccaaaagacagaggacgccgggttggaactcctggcttgtccggtcctgagatgcctctcaaatctgctgacggaagccgcagtggagacagtcggcggtcagatgcagcttcgggacgagcgcgtggtcgctgccttgttcatccttctgcaattcttctttcagaagcaaccctcgctcttacccgagggcctctggctgcttaacaacctgacggccaactcgccctcattttgcacctccctgctatccctggacctaatcgaaccattgctacagttacttcctgtcagtaatgttgtttctgtgatggttcttacagtcctgtgtaacgttgcagagaaaggcccggcctattgccagcgactgtggcccggaccactgttgccagccctgctgcacacgctggctttttccgataccgaggtggttggtcagtccctggagctgttgcacctcctttttttataccagccagaggcagtgcaagtttttcttcagcagagtgggctacaggccttggaaaggcatcaggaagaggctcagctgcaggaccgtgtgtacgcgttgcaacaaacagccctccagggttag

SEQ ID NO: 34055 - DNA, 1482 bp, Artificial Sequence
  Description of Artificial Sequence: Synthetic coding sequence
atgtggagccgccggcaaggacgcctgcgacctaccgtgtgcggagtcgaggaacttcggcgccggagaagagaacgggaggccgccctgcgcaaggctaggcgggagcagcagctagtgtcaaaacgactgttgagaaatgacgcccccgaagaggcaggcgaggggtgcgttgctgctatactgggagagacagaggtgcaacagtttctgcggcaggcgcagcgaggcaccgaggagaaggaacgcgaaggggccctggtgtctctgcggaggggtctccagcatcccgagacacaacagacattcatcaggctggagggctcgatgagaaccctggtcggactccttacaagtaatcaggctctgttacagctggaagccgcccggtgtctgcatgaactcagtcactccgaacagagtaccgtagccgaggcctgcctccccgccacttcttacctgctgacatacttaagttcacattcctccgacttcatcgaactctgtctttataccctaggaaatctgatcgtggagagcgaagccgtacgcagacagcttctaccccaaggtattgtgcctgccctcgccgcatgcatccagagcccccacgtggccgtgcttgaagccttgggttacgctttatcccagttgctgcaggccgaggaggctcccgagaagattatcccttcaattctggcctccaccctcccgcaacacatgctccagatgctccagccaggcccaaagctgaatcctggggtggccgtggagttcgcctggtgcttgcattacattatctgctcccaggtgagcaatccgctgctgatcggccatggcgctctgagcacactcggcctgttgttgctggatttagctggcgcagtgcagaaaacggaagacgccggcctggagctcctggcttgccccgtgctgagatgtctcagcaaccttctgaccgaggctgcggtcgaaactgttggtgggcaaatgcaactgcgggacgaacgggtagtcgccgcgttgttcatcctactgcaattcttctttcaaaagcagccctccctactgccagagggcctgtggctcttgaacaacttaaccgctaattccccaagtttttgcacttccctgctgtccctggatttgatcgaaccacttctgcagttgttgccagtctcaaacgttgtaagcgtcatggtgttaacagtattatgtaacgtggctgaaaagggacccgcctactgccaacggttgtggcctggccctctgctccctgccctcctccacaccctggcatttagtgacaccgaggtggtagggcagtcccttgaactgctgcacctgctgttcctgtatcaacctgaggctgttcaggttttcctccagcagtcaggcctccaggcgctggagcgacaccaggaggaagcgcaactacaggaccgggtgtatgccctccagcaaactgcactccaggggtag

SEQ ID NO: 34056 - DNA, 357 bp, Artificial Sequence
  Description of Artificial Sequence: Synthetic coding sequence
atgtggagccgaaggcagggtcgcttgcgcccaaccgtgtgcggcgtggaagagctgcgcaggcgcaggcgggaacgagaagcagctctacgcaaagctagacgcgagcagcagttggtctctaaacgcctgctgcgaaacgacgcacctgaagaggcaggcgaaggatgtgtggccgcgatcctcggagagactgaagttcagcagtttttgcggcaagcccagcgcggtactgaggaaaaagagagggagggtgccctggtctctctacggcggggcttacagcatcctgaaacgcagcagacatttattcgatccgtctggatggtctggtggcgggaggaattagggttgtag

SEQ ID NO: 34057 - DNA, 762 bp, Artificial Sequence
  Description of Artificial Sequence: Synthetic coding sequence
atgcttcagatgttacagccagggccgaagttgaaccccggcgttgccgtcgagttcgcatggtgcctgcactacattatttgctcacaggtgtccaaccctttgctgattgggcatggagcactctccaccctaggcctgctgctgctggatctcgcaggggctgtgcagaaaacagaagacgctggactggagttgcttgcttgcccggttttacgctgcctctccaacctcctgacagaggcagccgtcgaaactgtaggaggtcagatgcaactgagggacgaacgggtggttgctgccctcttcatattactgcagttcttctttcaaaagcagccgtctctcttgcccgaaggtctgtggctgctgaataatctcacagccaacagcccctcattttgcacatcgctgctctccctcgatctcattgaaccgctgctgcagcttctccctgtgagcaacgtggtctctgtgatggtgcttaccgtcctgtgcaacgtggccgaaaaagggcccgcgtactgccagcgattatggcccggtcctctcttacctgcccttctgcacacactcgcattttcagacacagaggttgtcggccaatccctggagctgttgcaccttttgttcttgtaccagccagaagccgtgcaggtgttcctgcagcagtccggactccaggccctagagcggcatcaggaagaagcacagctgcaggatagggtgtatgccctgcagcagaccgctctgcaaggatag

SEQ ID NO: 34058 - DNA, 903 bp, Artificial Sequence
  Description of Artificial Sequence: Synthetic coding sequence
atgctccccctgttggcagctctccttgctgccgcctgtcctcttcccccagtaaggggcggtgccgctgacgcccctggcttgctgggcgtgccttctaacgcctcagtcaatgcctcatcagccgatgaaccaattgcacctcgcctgctagcgtccgcagctcccggcccccctgagcgtccagggcctgaagaggctgctgccgccgccgccccatgcaatatatctgtacaacgccagatgctcagctcactcctggtgaggtggggcagacctcggggctttcagtgtgacttgcttctgttctctaccaacgctcacggaagggcgttctttgctgcagctttccatcgggttggcccccctctgttgatcgagcacctggggttagcagcagggggcgcccagcaggatctcaggctgtgtgtggggtgcggatgggtgcgtgggcgaaggaccggccgccttcgccccgcagctgcaccatccgccgcagccgctaccgctggggctccgaccgcccttcctgcttaccctgctgccgagccccccgggccactctggcttcagggcgagccactccacttctgttgtctggacttttcactggaagagctgcaaggggaaccaggttggcgactgaaccgcaagcccatcgagagtactttagtggcttgcttcatgaccctcgtcattgtcgtttggtcagttgctgccctaatttggcctgtccctatcatcgccgggtttttacccaatggcatggagcagaggaggacaactgccagcactacagctgctacccccgccgctgttcctgccggtacaaccgcagctgccgctgcggccgccgctgcagccgcggcagctgccgttacctctggagttgccaccaagtag

SEQ ID NO: 34059 - DNA, 2526 bp, Artificial Sequence
  Description of Artificial Sequence: Synthetic coding sequence
atgcctctcgccgcttactgctacctcagagtggtggggaagggctcttacggtgaagtgacgctggtaaaacatcgtcgcgacgggaagcagtatgtgatcaagaaactgaatttacggaacgcctccagccgtgagcggcgggccgccgaacaggaggcccagctcctgtcccagcttaaacacccgaacattgtcacctacaaggagtcctgggagggaggggatggacttctgtatatcgtgatgggattttgtgaaggcggtgacctgtatcgcaagttgaaggaacaaaaggggcagctgctccccgaaaaccaggtggtcgagtggttcgtgcagattgcaatggccctgcaatacttgcatgagaaacatatcttacatagggatctgaagactcagaacgtctttctcactaggacaaacatcattaaagttggggacctgggcatcgcgcgggtgctggaaaatcactgcgatatggcatctacactgataggaactccttactatatgtcgcccgagctgttctctaataagccctacaactacaagagcgacgtgtgggcacttgggtgctgtgtgtatgaaatggctaccctgaagcacgcttttaatgcgaaggacatgaactcattggtgtatcgaatcattgagggcaagctccctcccatgcccagggactactcccccgagctggctgagctgatccggaccatgctctccaagcggccagaagagagaccttccgtcaggtcaatccttaggcaaccatatattaagcgtcagattagcttttttctggaggcgaccaaaatcaagacttcgaaaaacaacatcaagaacggcgacagccagtctaaacctttcgctacagtcgtttccggagaggcagaatcaaatcacgaggtgatccatcctcagcccttgtctagcgaggggtcgcagacttatattatgggggagggtaagtgcctttctcaggagaagccacgagcaagcggtctgctgaagtcaccggcctccctgaaggcccacacatgcaaacaggatctgagcaataccactgaattggccactatttcaagcgtgaatatagatatcctgccggccaagggtcgagacagcgtaagcgatgggttcgttcaggagaaccagcctaggtacctggacgcatctaatgaacttggaggaatctgcagtattagccaggtggaggaggaaatgttgcaggacaacactaagtcaagtgctcagccagaaaatcttattcctatgtggtcaagcgacatcgtgacaggcgagaagaacgagcctgtgaagccactgcaaccactgatcaaggaacagaagcccaaagaccaaagtctggctttgagccctaagctggaatgctctggcactatcttagctcattcgaatctccgtttgctcggaagcagcgacagtcctgcttctgcaagcagggtggctgggattacgggtgtttgtcatcatgcccaggatcaggtcgcaggtgagtgtatcattgaaaagcagggtagaatccacccagaccttcaaccccataattccggctcagagccttcactcagtcgtcaacgccgccaaaaacgccgcgaacagactgagcatcggggcgagaagaggcaggtacgacgggatctctttgcctttcaggagtcccctccccggttcttgcccagtcatcccattgtcgggaaggtggatgtaacaagtacacagaaagaagccgagaaccagcgaagagttgtcaccggcagtgtcagctcttccaggtcctctgaaatgtcatccagcaaagaccggcctctgtcagccagggagagacgccggctcaagcagagccaggaggaaatgtcctctagtgggccgtccgtgagaaaggccagtctgtccgtagccggcccaggaaagccacaagaagaagaccaaccattgcctgcacgccgtctttcctctgactgtagtgttacccaggagaggaagcagattcattgcttgtctgaagacgagctgagtagtagcacctcatctactgacaaatcagacggcgactatggggaggggaaaggacagactaacgagattaacgccctggttcagctgatgacccaaacactgaagctcgattccaaagagagctgtgaggacgtgcccgtggccaatcctgtctctgagttcaagctgcaccggaaatacagggataccttgatcctgcatggaaaggtcgctgaagaggctgaggaaatccacttcaaggagttgccatctgccatcatgcccggttccgaaaaaatccgacgcctggtggaggtgctgcgaacagacgtgatccgcgggttgggcgtgcagctcttggagcaggtttatgacctgctggaggaggaagatgaattcgatagggaagtgaggctgcgagaacatatgggcgagaaatacacaacttactccgtgaaagccaggcagctaaagttctttgaggaaaatatgaatttttag

SEQ ID NO: 34060 - DNA, 486 bp, Artificial Sequence
  Description of Artificial Sequence: Synthetic coding sequence
atggctaaggaagagccccagtcaattagccgtgacctgcaggagctgcaaaaaaaactgtcactcctgatcgactcctttcagaacaattcgaaagttgtcgcctttatgaaaagcccagtaggacagtacctggacagccacccttttttggccttcacactgcttgtgttcatcgtcatgtctgcagtgcccgtaggtttctttttactgatcgtggtgctcacaacccttgccgcactccttggagtcatcatcctcgaaggcctggtcatctcggtgggcgggtttagcctcttgtgtatcctgtgcggcctgggatttgtttcgctagccatgagtggtatgatgattgcatcttacgtggttgtgtccagcctaatcagctgctggttcagccctcggccactcacccaacagaatacctcctgcgactttctgcctgcaatgaaatctgccgaatttgaggggctataccaagagtag

SEQ ID NO: 34061 - DNA, 558 bp, Artificial Sequence
  Description of Artificial Sequence: Synthetic coding sequence
atggctaaggaggaaccacagtccatttctagggatctccaagagttgcaaaagaaactaagcctcctgatagactccttccagaacaattcaaagttacctcaacattcacggatctccctggattccgacgatggagtgtcaaggctgggctctgcaggctcaaaagtcgtcgctttcatgaaatcgccagtgggacagtacctcgactctcaccccttcctggcgtttacgttgcttgtctttatcgtcatgagtgctgtgcccgttggctttttcctgctgatcgtagtattaacaacactggcggcgctgctgggggtaatcattctagagggtttggttatctccgtgggggggttctcccttctatgcatcctatgcggactaggattcgtgagtctggccatgagcggaatgatgattgcgtcttatgtagtcgttagttctttgatctcgtgttggttttcccccagaccattgacacaacagaatacctcctgtgactttctgcccgccatgaagtccgcagagttcgaaggtctttaccaggaatag

SEQ ID NO: 34062 - DNA, 885 bp, Artificial Sequence
  Description of Artificial Sequence: Synthetic coding sequence
atggcagctggaagactcttgctctacacaggtttgtcactggccctgtgtgctttgggcatgctggcagtggctatttgcagtgatcactggtacgagaccgatgcccgaaagcaccgggaccgctgcaaggcctttaataccagaagagtggatcctggatttatctacaacaataacaataaccttccgctccgggccagccggagccgtctggatcgctgggaagggaaactgctgagagcacgtaacagacgtcagctctttgccatgtcccccgccgatgaatgctcccgccagtataacagcactaatatggggctgtggagaaagtgtcaccggcagggctttgatcccgagattgccgcacttatccgtaagggtgaaatcgagcggtgtacttacattaagtatcactattcatcagccaccatcccgcgaaatctcacgttcaatatcacgaagacaatccgccaagatgagtggcatgcactccatctaagacggatgacagccgggttcatgggcatggccgtggccattatcttgtttggctggattataggtgtactcggctgttgttgggatagaggcttgatgcaatacgtggcgggacttctctttcttatggggggcacattctgtatcatttccttgtgcacctgcgtcgccggtatcaattttgaactgagccgctacccacgttatctgtacggactccccgatgacatcagccacgggtatggatggagtatgttctgcgcctggggggggctgggcctgaccttgattagtgggttcttctgcaccctggcccccagcgtgcagccggtgcctaggacaaattaccctaaatcaagaccagagaacggcaccgtctgctag

SEQ ID NO: 34063 - DNA, 1053 bp, Artificial Sequence
  Description of Artificial Sequence: Synthetic coding sequence
atgaatctgagagggctctttcaagatttcaatccatctaagtttttgatctacgcttgcctcttgctgttcagcgtcctgctcgctcttagactggacggcatcatacagtggagttattgggccgtgttcgcacccatctggctctggaagctgatggtaattgtcggtgcgtccgttggcaccggcgtgtgggctaggaacccacagtaccgtgctgaaggggaaacctgtgtggaatttaaggccatgctaattgccgtgggcatacacctgctactgctgatgttcgaggttctcgtttgcgaccgaattgagcgtggtagccacttctggctgctagtgttcatgcctctgttctttgtcagtccagtatctgtggctgcctgcgtgtggggcttcaggcatgacagatcgctggagcttgaaattctttgcagtgtgaatatacttcagttcatattcatagctctgcggctggacaaaatcatccattggccatggcttgtggtgtgtgtgcctctgtggatcctcatgtcgtttctgtgcctcgttgtgttatattacatcgtgtggtcagtcttattcctgcggagcatggatgtcatcgcagagcagcgaagaacccatatcactatggccctgtcctggatgactattgttgtccccctcctcacattcgaaattctgctggtgcacaaactcgatggacataacgcattttctagcatcccaatctttgtgcctttatggctttccctgataaccctcatggcaacgacattcggtcagaaaggaggcaatcattggtggtttggcatccgaaaggacttctgccagtttctgctggagatcttcccgttcttgcgtgaatacggcaacattagctacgatctccatcacgaggataatgaagagactgaggaaactcctgtccctgaaccaccgaagatcgcaccgatgtttcgcaaaaaagccagggtggtgattacccagtctcccggaaaatacgtgcttcctccacccaagctcaacatcgaaatgcccgattag

SEQ ID NO: 34064 - DNA, 876 bp, Artificial Sequence
  Description of Artificial Sequence: Synthetic coding sequence
atgaaccttaggggcctgttccaagactttaaccctcgagccgagggtgagacatgtgttgagtttaaagctatgctgatagccgtgggcatccacctcctgctcctaatgttcgaggtgctggtttgcgaccggatcgaaagaggctctcacttttggctgctagtctttatgccgttgttcttcgtgtccccagtttccgtggccgcctgcgtctggggtttccggcatgaccggtctttggaactggagattttatgctcagtaaacattttgcagttcatattcatcgcgcttaggctggataaaatcatacactggccttggctcgttgtgtgtgtgccactttggatcctgatgtcgtttctttgcttggtggtcttatactatatcgtttggagcgtgctctttcttcggtcaatggatgtgatcgccgagcagagacggacacacataacgatggccctcagctggatgactatagttgtgcctctcttaacctttgagattttactggtccacaaactggacggccacaacgccttctcttctattccgatcttcgtccctctctggttgtctttaatcactctgatggctactaccttcggccagaagggaggaaatcactggtggttcggcatacggaaggacttctgccagttcttactggaaattttcccattcctgagggaatatggtaacattagctacgacctccatcacgaagacaatgaggaaaccgaggagactcccgtgcctgagcctccaaaaatagccccaatgtttaggaaaaaggccagagtcgtgattacccagtcgccagggaaatatgtgctcccccccccgaagctgaacatcgagatgcctgactag

SEQ ID NO: 34065 - DNA, 519 bp, Artificial Sequence
  Description of Artificial Sequence: Synthetic coding sequence
atgtctttcctctgtctggtcgtgctgtattacattgtttggagtgtccttttcctgagaagcatggatgtgatcgcggaacagcggaggactcacatcacgatggcactctcgtggatgacaatcgtggttccacttttgacttttgagattctgcttgtccacaaactcgatggacataacgcctttagttccattcccatatttgtgcccctatggctgagcctcatcacactcatggcaaccacattcggacagaaaggaggcaatcattggtggttcggtataaggaaagacttttgccagttcctgcttgaaatcttcccatttctccgggaatacgggaacatctcttacgatttacaccacgaagataacgaggaaacagaggaaacacccgtcccggaaccgccaaaaatcgcccctatgtttcgaaaaaaagcacgcgttgtcataacccagtctcctggaaagtatgtgctccccccacctaaactgaacatcgagatgccagattag

SEQ ID NO: 34066 - DNA, 1254 bp, Artificial Sequence
  Description of Artificial Sequence: Synthetic coding sequence
atgggtccaagacaggggcgctggtggttgctcctgtggctgccgcctctcgctacattgccagtgagaggggaagcggccgcggccgccttgtccgtccgccgatgtaaagctctcaaagagaaggacctgattagaacgagtgaaagcgattgttactgctataatcagaactcccaggtggagtggaaatacatatggtctactatgcaagtgaaaattactagtcccggactgttccgaatcgtgtacattgctgagaggcacaattgtcagtatcccgaaaacattcttagtttcattaagtgcgtgattcataatttctggattccaaaggaatccaacgaaatcactataatcattaatccataccgtgaaaccgtatgcttctctgttgaacccgtgaaaaagattttcaactacatgattcacgtcaatagaaatattatggacttcaaattgtttctagtgtttgtggcaggggtgtttctcttcttttatgctaggacactctctcagtcgccaactttttattactcttccggaacggtgctcggggttctcatgaccctggtcttcgtgctgctgctggtgaaacgtttcatccccaaatatagtactttctgggctttgatggtagggtgttggttcgcgtcagtgtacatagtgtgccagctgatggaggatctgaaatggttgtggtacgagaatcgcatttatgtgctgggctatgtcctgattgtcggcttcttctcattcgtggtttgctacaagcacggccccttagccgatgatagaagcagatcgttgttaatgtggatgctccgcctgctctctctggtgctggtgtatgccggcgttgcggtgccacagtttgcctacgctgctatcatcctcttgatgagtagctggagtctgcactaccctctccgagcctgtagctacatgcggtggaaaatggaacagtggttcactagcaaagaattggttgtgaagtacctaacagaagacgagtaccgtgagcaggccgacgcggagacaaatagcgccctcgaggagttgagacgtgcgtgcagaaagcctgacttcccaagctggctggtggttagccggctgcacaccccctccaagtttgcagatttcgtgctgggcggctctcacctgagtccggaggaaatttccctccacgaagaacagtacggattgggcggcgccttcctcgaggaacagctctttaatccctcaactgcctag

SEQ ID NO: 34067 - DNA, 822 bp, Artificial Sequence
  Description of Artificial Sequence: Synthetic coding sequence
atggagaggcgcgaacaccttacactgacctttcatagcccggaagtacccaagatcaaggggaatcgtaagtatcagagacccaccgtgcccgcgaagaagcatcccagcgcgagtatgtcatgccagcgccagcagcagttgatggaccaggctcacatctatatccgcaccctgtgtgggagcctttgtagtttctcattattgatgctgatcgccatgtctcctttgaactgggtgcagtttctcgtgataaagaatggattggaactgtatgccggtctctggaccctttgtaaccacgaactctgttggtcgcacacccccaaacctccgtactacctgcagtacagtagggccttcttcctcatttcagtgttcacgatactgacaggactgggatggctgttctctagttggatcctgaaccgagggtctatgactacaaacttagatctcaaggtaagcatgctgtctttcatttccgccacatgcctgcttttgtgtctgaacctcttcgtggctcaggtgcactggcatacccgtgatgctatggaatcggacctactgtggacctactatctgaactggtgctctgatattttctatatgtttgctgggatcatctctctgttaaactacctaactagtagatcacctgcctgcgacgaaaacgtcacagtcatacccactgaacggagtcgcctcggcgtgggaccagtaactaccgtgtcgcctgccaaggacgaaggaccacgcagcgagatggagtcactctccgtacgcgaaaagaacctgcccaagtctggcttatggtggtag

SEQ ID NO: 34068 - DNA, 585 bp, Artificial Sequence
  Description of Artificial Sequence: Synthetic coding sequence
atgaagggattatatcaggccgcaggacgaatactggtcacgctcggaatcctaagtgtgtgctcaggtgtgatcgctttttttcctgtgttctcatataagccttggtttactggatggtctgtcaggattgcctgtcctatctggaatggcgcactagctatcacaacgggggtgctcttgctcttggcataccgcgagtggacccagcggtatctcggagaagccacattcacttttgtgatcctcagcatcatgggctgtcctttgcacttcgccattgctctggagagcgctctgctcggcccctactgtttctattctttcagtggtattgccggcacgaactatctggggtatgccgttaccttcccctatccttacgcaaagttcccccttgcttgcgtggatccaccgcactatgaagaatatcatttaacgctgcaggctctggatctctgtttgagttttacgcttctgtgcacatccctcacagtgttcattaaactctctgctaggcttatccaaaatggccatattaatatgcagttaccagcgggcaatcccaatcctttttcaccgtag

SEQ ID NO: 34069 - DNA, 453 bp, Artificial Sequence
  Description of Artificial Sequence: Synthetic coding sequence
gcgtgtcccatttggaatggagccctggctatcaccaccggagtattactcttgcttgcttaccgagagtggacccagcgatatctgggggaagccacatttacattcgtgatattaagtattatgggctgccctctccacttcgcgattgcattggaaagcgcactgctcggcccatactgtttctacagtttttctggcatcgcggggaccaactaccttggatatgccgtgaccttcccttatccctacgccaaatttccgttggcttgcgtggatcccccacattatgaagagtaccacctcacactgcaagccctcgatctgtgtctctcgttcaccctactgtgtaccagcctgactgtgtttatcaagctttctgcccgtctgattcaaaacggacacatcaatatgcagctccccgcagggaatcctaatcctttctctccttag

SEQ ID NO: 34070 - DNA, 876 bp, Artificial Sequence
  Description of Artificial Sequence: Synthetic coding sequence
atggcgcgctcgtacggcgggagggttcttgccgccatgacactgcttggaatcgcagccgccgtgctcgcagccttaggcgcgcagctgctgttccaattgcaggctggtagagcggaacttagaggactaagagcagaaggactgggacaggagctgggagcaggaccagggctccctgaagacgcggctggcacactgttaccacttgccgctgcccttgcggcactcgtcctagtgctgggctttacttgcttattattagcggccctgtgtggtcacctcggcgctgagcttgccagaggccctggtccccgtcgttccgactggttcttgtacgactgtagactcctgagacatgtggcactgggtttgttttgttgtggaatctctgtgtacctcgccgccctgagcatctatgcattactcctgttcgaaatcgaaacaggggctgctgctgcctccatactggggagcggaacattggtgctggtggcggtcttgacacacacactgctgcgggcagccagagctgctcggagagggcttcacgagctgagccccccaagctttgaggatgatttagcgcgcccggccgaggtgtcaaaagcttccccccgtgctcagccccagcaaggcatacatagaagaacaccatactccacctgccctgagccaggggacccttttgggtctatggccaccgccactgcgccagccgccttggagggcggctgggaatcaagcctcccagctagcagaatgcatagaactctgtcagccgggctcgggcactgggatggcgtgacacacgagatgaggcggatgctcggtcacagacccggaagcatggggaaagacagcactctggtgtag

SEQ ID NO: 34071 - DNA, 1056 bp, Artificial Sequence
  Description of Artificial Sequence: Synthetic coding sequence
atggctagcggccgactaatcaaattcgttgtgttcgaactgctcgagttcgccgccttcagcatccctactctcgttatcactgagcaattcgcaaccgcataccagggcaccagagccagatcggataacacgcactattggctcatcatttcctgcagcattgcctatgtggccctggtgactctattgatctgggttcctgtcaaggtaatcttgcacaagaaacgctatatctaccgcaaaataaagggatggcgcccggtgctaatgatgtgcgttgttctgaccaccctcccgtgtctgacctttagtatcgccgttaccgaggtacagaaatctattaacggatccgccgacgtcctgcctgacatgctgccagaccttcctgtctcactggtactgctgagcctcatcatggtggatattatcgagaagctccggatttacccccttcggggatctcaaaaatcgtccgaaaatggccatatccacagtacatccctccagcacattaagactgtgaccgaacaggtgaggcagtcacccgagaacgctgcgtcaccacaagccaccaattctacccaggtcagccaacccagcggcgctatgaccaggagccaggaatccgtcttcatgggccctcaggagccctcttgtgactctggaatcctacgaatgatgtccaggcgggatgttagggccgagctatttctttggtccttcctactgtggagtgatacaattgagatggtgagggtggctggacacccaaatgtttacaagtcctcctggctgtatccggtttatattttctcttttatcagtttgttgcggattaccttcaccccacagaatcctttgctgaattccctgagcgtgttgttacaggatctgccctttgttttcgtacgccttggcctgattattgccctcgggaccatcacccctgtcctgggactgtgtaagaatatacttgtcacactttcctatatctatttcaactatctgacgcgcattcgcatcttttccgcattcgagatgagccccttctag

SEQ ID NO: 34072 - DNA, 531 bp, Artificial Sequence
  Description of Artificial Sequence: Synthetic coding sequence
atggcagcagctccagccgtttgcgccagccaaggttctcctcccggagcgccgtccgcccccgcggccgccccggctcctgccgccggccttggtagatgtcgtatggccctcctcctggctgtggccctggacgtggctggcatggccgcattgctcaccggtgtttttgcccagctccaggttagaggccgcgacttcggcgacctgctcatctactcaggcgccttgctggtttttctgtccctcctcgggtggatcctgtggtatacaggtaacattgagatctcccgtcaagagctagagcgcgactatggactgcgcccctcagccttggcccggctggctcgtaagctgtctagaagatggtcggcacccgcagcagctgggcagaggccagcacccggaagtagacgagcacgccgcgccgctcgggcccctcccccgccggcggctggatccaggcgcgtccgactgcaacttgcaaccttggaagcaggaccaggggccgccggggctggatccgagtag

SEQ ID NO: 34073 - DNA, 588 bp, Artificial Sequence
  Description of Artificial Sequence: Synthetic coding sequence
atgagagttggcacgtggatctgtttgccaggtaggcctggcaggtgccggaagcagcatgacctgggtaactgcccagaggtccccgggatcttcaagaccctggctctctccccaggcgcccccgatatgatgcagcagcctcgcgttgagaccgatacaataggtgctggcgaaggcccacagcaagctgtgccctggtctgcctgggtgacaaggcacggatgggtccggtggtgggtcagccacatgcctccctcctggatccagtggtggtctacctccaactggcgccagcccctacagcgcttactgtggggcttagagggcatcttgtatctcttgttggccctaatgctgtgtcatgctttgtttacaacaggatctcacctgctgagctccttgtggccagtagtcgccgcagtctggcggcatctgctccccgccttgcttctgctggttctctcagcgcttccagctcttctatttactgcgtcattcttactcctttttagcacacttttaagtctggtggggctactaacctccatgacacaccccggggatacacaggaccttgatcagtag

SEQ ID NO: 34074 - DNA, 765 bp, Artificial Sequence
  Description of Artificial Sequence: Synthetic coding sequence
atgacccggctctgcctgccgcggccagaggcgagagaagatcctatccctgttccaccacgggggctgggcgccggagaaggaagcggttctcctgttcggcccccagttagcacatggggcccaagctgggcacagctactggattccgtgctatggctgggtgccctcggcctgaccatccaggcagttttttcaactacaggtccagcccttctcctgttgctagtaagctttcttacctttgacctgctgcacaggtgcactcgccacgacgccgcagctgctagtggcgatcggtatcatcgggggtggaggggggccacagccggttccgccctcgtgagtctggggcatgaggcctggttgggtgctctcgtgggtgagccccacgccccggaattggatccagtcgtggaacacctagagttggcggcgaccgcagcagctcctgccgtgggatctggcggcgatacgcttcccgcagccggcacggatgtggttccttgcacattgcaccactggttgccccccgctgagctgctcgtggcctgcagagggcggggtgtagctccgcctgcaacaggcagcccagccgccggagcccagtgctcggcctgccctcctctgcatggccttctgccggcagccctgctacataccgcagagccttgcgggccccctcacctgcacgactcgcccagacgccactcagggtttggcagtatcgaagggcaaccccacccaaccgcgtgcgtatgttag

SEQ ID NO: 34075 - DNA, 459 bp, Artificial Sequence
  Description of Artificial Sequence: Synthetic coding sequence
atgatgcagcagcctagggtggaaaccgacactatcggggcaggggagggacctcaacaagctgttccatggagtgcttgggtgactcgccacggctgggtgaggtggtgggtaagccacatgccacctagctggatccagtggtggagcacctccaactggcgacagccgttacagagactgctttggggcttggagggaatactctacctgctgttggccctcatgctttgtcatgccctgtttaccaccgggtcacatttactgtcttcgctgtggccagtcgtcgccgctgtgtggcgccatctactccccgccctgctgctcctcgtcttgagcgctttgcccgccctgctttttaccgccagttttctgttactattcagtacactattatcattagtcgggttgcttacaagcatgactcatcccggcgacactcaggatttagatcagtag

SEQ ID NO: 34076 - DNA, 969 bp, Artificial Sequence
  Description of Artificial Sequence: Synthetic coding sequence
atggccttacctccgggccctgccgccttacgccatactctgctcctcctaccagcgctgctatccagtggctggggggaactggagccacaaatagatggccaaacatgggcagagcgtgctctgagagagaatgagagacacgccttcacctgtcgggtcgccggtggccccggtactcccaggttagcttggtatctggatggccaactgcaggaagcaagtacttcacgcttactcagcgtggggggagaggccttctctggtggtacttcaacctttaccgtcactgcacacagggcgcagcatgagttgaattgttcactgcaggacccccggtcagggaggagcgctaacgcctctgtgatcctgaacgtccaatttaagccggaaatcgctcaagtgggcgccaaataccaggaggcccagggccctggtctcctagtagtactgttcgcgctcgtgagagccaacccacccgccaatgtcacctggatcgatcaggatggacccgtcacggtgaacacaagtgattttctggtgctcgacgctcagaactatccctggctcaccaatcatacagttcaattgcagcttaggagtctagcgcacaacttgtctgtcgtggcaaccaatgacgttggggtgacttcggctagcttacctgcacctggaccaagcaggcacccaagtctgatcagctctgactctaataacttaaaacttaacaatgttaggttacccagagagaacatgtccttaccttccaatttgcaattaaatgatctaacccctgactccagagcagtcaagcctgccgaccggcagatggcacagaataacagccgccctgagctgttagatcccgagccaggcggcctactcacctcacaaggatttattcgccttcccgttcttggatatatttaccgggtgtcgtcagtgtcgagcgacgagatttggttgtag

SEQ ID NO: 34077 - DNA, 969 bp, Artificial Sequence
  Description of Artificial Sequence: Synthetic coding sequence
atggccctaccaccgggaccagccgctctgcgccatacactgctgcttttgccggctctcttgtcctcaggctggggcgaactggaaccccagatcgatgggcagacctgggccgaacgggccttacgcgagaacgaaagacacgccttcacatgcagagtggccggtggcccaggaacgcctaggttggcatggtaccttgacggccagttgcaggaggcttccacgagccgcctgcttagtgtgggtggggaggccttttcgggggggacctccacttttacagtgaccgcacaccgagcccagcacgagctgaattgtagtctgcaggatcctcgatcggggcgatccgccaacgcctccgttattctgaacgtgcagttcaaacctgagatcgcacaagtgggcgcaaagtatcaggaagcccagggtcccggtctgctggtggtgctgtttgcattagttcgggctaatccaccagcaaacgtgacctggatcgaccaggatgggcccgtcacggtcaatacaagcgacttccttgtcctcgatgcccagaactacccttggttgacaaaccacacagttcaattacagcttagatcccttgcacataacctctccgtggtggccacaaacgacgtgggggtgaccagcgcttctttgccggcacccggcccatcacgtcatccaagcctgatcagtagcgactccaataacctcaaactcaacaacgtgagactgccacgcgaaaatatgtctctgcccagcaacctgcagctaaatgatttgacaccggattctagagctgttaaaccagcggaccggcaaatggctcaaaacaactctcgtcctgagttgctggatcctgagcccgggggcttgctgacttcacagggatttatccggcttcctgtgttagggtatatctacagggtctcttccgtgtcttctgatgagatatggctgtag

SEQ ID NO: 34078 - DNA, 660 bp, Artificial Sequence
  Description of Artificial Sequence: Synthetic coding sequence
atggccgccgaagaccgggaaatgatggaagccagaggcgccggggaatcctgtcctacttttccaaaaatggtccccggcgattcaaaaagtgaaggtaagccaagagcctacctcgaagccgagagtcaaaaacccgactcctcttacgactatctcgaagagatggaggcttgcgaagacggcgggtgccaggggccactaaagtctctgtcccctaagtcatgtagagccaccaaagggcaagcgggggatggcccgaaaccagccgagctacccccgaccccagggacagaaaggaatccggagatggagctcgaaaaggttcgcatggagtttgagctcacgcgactcaagtatctacatgaaaaaaaccagaggcaaagacagcatgaggtcgttatggagcagttacagagagaacggcagcacgaggtggtcatggaacagctccagcaagaggctgcaccgcggttgtttagcggcgggctgcagaactttctcctgcctcagaaccagtttgcaatgtttttatattgcttcattttcatccacatcatctatgtgactaaggagatggtgtttttcttattcgccaagcactatctcttctgcattgccgctatcctgctgtgcctgattaaaaccttttggtcatag

SEQ ID NO: 34079 - DNA, 1320 bp, Artificial Sequence
  Description of Artificial Sequence: Synthetic coding sequence
atgggggaggcaccgtcacctgcccccgccctatgggactgggattacctggaccgctgttttgcccgacaccgcgtatgtatttccttcggcctgtggatatgcgccagttcctgttggattgctgctcatgctttgctattgtatctgcggtgcgctcagaagccccgacaggaccagtctgcactatgcgcagcttgttgcttactgacatccttatgtgacactgtgggcgcccttctcgcccgacaacttactatccaggtcttcacgggggcttatcttgccgctatagacctggtaaattttatgttcattctgtttcccgtgtgtgggtctaagttcaagtctaatagcgaccgtgaagcccgcgagagaaagaggcgtaggcagcttcgtgcgtcagtgtttgccctggccttacccctgagcttaggcccctgctgggcactgtgggtggcggtgcctaaagcttctgctacaattcgggggccccagcgcagattactggcatccctcctccaggaaaacactgaaatcctcggatacctcctgggcagtgtagccgcctttggaagctgggccagcaggatccccccactgtcccggatctgtcgcggcaagactttccctagcatacacctgtggacacgcctgttgagcgctcttgcgggtctgttatatgcgagtgccatagtcgcccatgaccagcatccggaatatctcctgagagcgacaccctggtttctgacgtcgttaggcagggcagcactggacctggccattattttcctcagctgcgtgatgaagagcaaaatgcgtcaggccctcggattcgccaaggaggcgcgtgagtcaccagatacgcaggctttgctgacctgcgctgagaaggaggaggagaaccaggagaacctagactgggtacccttaacaaccctctctcactgtaaatccttgcggacgatgacggctatatcccgttacatggagctcacaattgaacctgtccaacaggcgggatgtagcgccactaggctgcccggcgacggtcagacctctgcgggggacgcttcactgcaggacccaccgagttacccgcctgtgcaggtcattcgtgcccgggtctcatccggcagctctagcgaggtaagcagtattaattccgacctggaacagaagtactgggaagccctgaatagcgagcagtgggacccagaagatgtcaacctggaaggcagtaaagaaaatgtggagctgctgggctcacaggtccaccaggattctgtgcggacagcacatctcagcgatgatgactag

SEQ ID NO: 34080 - DNA, 342 bp, Artificial Sequence
  Description of Artificial Sequence: Synthetic coding sequence
atgtttattctgttccctgtatgcggtagcaaatttaagagtaactcagacagggaggcccgcgagaggaaaaggcggcgacagctgagagcttcagtcttcgcactggctttacctctttctctgggcccttgttgggccctgtgggtggcagttccaaaagcgagcgcaacaatccggggcccacaacgccgcttactcgcctccttgttacaggagaatactgagatcttaggctatctgctgggatccgtggcagcatttggatcctgggctagcaggattcctcccctgtccaggatcgtgagacctggggtcggcatggggctctgggtgacctag

SEQ ID NO: 34081 - DNA, 1287 bp, Artificial Sequence
  Description of Artificial Sequence: Synthetic coding sequence
atgggagaagctcccagcccagccccagcactgtgggattgggattacctggataggtgttttgctcgccaccgagtgtgcatcagtttcgggctgtggatctgtgcctcctcgtgctggatagccgcccatgctcttctgctctatctgagatgcgcacagaaaccacggcaggaccagagcgccttgtgtgccgcctgctgtctgttaactagcctctgtgacaccgtcggagccctactggcccgacagcttaccatccaggtctttaccggcgcatacctggcggcaatcgacctggtgaatttcatgttcattctgtttccagtatgcggatctaagtttaagtccaacagtgaccgggaagcccgcgagaggaagcggcgaagacagctcagggcaagcgtgttcgctttggcgctacctctatcgctcggcccttgttgggcactctgggtagctgtgcctaaggccagcgctactattcggggaccccagagacggctcctggcaagcctcctgcaggagaacactgagattcttggatatctgttggggtccgtggccgcattcggcagttgggcctcacgcatccccccactcagcagaatctgccgcgggaagacatttccatcaatccatctctggactcggctcctgagcgcactggcaggactgctctacgcgtccgccatcgtggcacatgaccagcacccagagtacctcctgcgggctaccccgtggttcttgacctcccttgggcgagcagcgctagatctcgcgatcatatttctctcatgcgtaatgaagtccaaaatgaggcaagcgctcggttttgccaaggaggcccgcgagtctccagatacacaagctctccttacctgtgcagaaaaggaggaagagaatcaagagaacctagattgggtccccctgaccacgttaagccactgcaagtcactccgtacaatgactgctatttcccggtatatggaacttaccattgagcctgtccagcaggccggctgctcggcaacacgccttcccggcgacggccaaacttctgctggtgatgcgagtctccaggatccaccaagttacccccccgtccaggtaattagggcccgtgtgtccagcgggagttcctccgaagtatccagtatcaacagcgacctggagtgggaccccgaagacgtgaacctcgagggatctaaagagaatgtagaattgcttggatctcaggttcaccaggattcggttcgcaccgctcatctgagtgacgacgactag

SEQ ID NO: 34082 - DNA, 1191 bp, Artificial Sequence
  Description of Artificial Sequence: Synthetic coding sequence
atgggggaggcacccagccctgcgcctgccctgtgggattgggattacctcgataggtgcttcgcgaggcacagggtttgcatctcattcggcctatggatatgcgccagtagctgctggattgcagctcacgctctcttgctgtatttgaggtgcgcccagaagccccgccaagaccaatctgccctctgcgccgcctgctgcctgctgaccagtctgtgcgacacagtcggggccctcctggcacggcagcttactatacaggtattcacaggcgcgtatttggccgcgatcgacctggtcaatttcatgtttatcttatttccggtctgcggctccaaattcaagtctaacagtgatcgggaagcccgcgaacggaagcggcgacgtcagttgagggcaagtgttttcgcactggcattgccactgtcactcggaccatgctgggccctttgggtggccgttcctaaggcttccgccacaattagggggcctcaaaggagacttctggcctcattgctgcaggaaaacactgagattcttggctacctgctcgggagtgtcgcggcattcggaagctgggcctccagaatcccgcccctatctcgcatctgccggggcaagacatttcccagcatccacctctggactcgcttactgagtgcactagcaggcctgctttacgcctctgccatcgttgcccacgaccagcatcctgagtacctgcttcgggccaccccttggttccttacgtccctcggacgtgcagctttggatctggcaatcattttcctgtcctgcgttatgaaaagtaagatgagacaagccctcggttttgccaaggaggcacgtgagtccccagacacccaggccttattgacttgcgcggaaaaagaagaggaaaaccaggaaaacctggactgggtgcctctcacaacgctgtcgcactgcaaaagcctgcgcacaatgacggcaatctcccggtacatggaactgacgatcgaacccgtccaacaggccgcagtgcctcctggctgccaggtgaccgggcgtagggcccctgagatgcggccctgccgaacccctagacggacactaccctttcgatcgagtggtcccgggtgcctgcctgcggctccattaaggtctccacccagtacacccacatggtcgggtaccctcaagatgtag

SEQ ID NO: 34083 - DNA, 1428 bp, Artificial Sequence
  Description of Artificial Sequence: Synthetic coding sequence
atgggggaggcgcctagcccggccccagccttatgggattgggattatttggatagatgtttcgcaaggcacagagtgtgcatttccttcggtctttggatttgcgccagctcctgttggattgccgcccatgcattacttctttatctgagatgtgcacaaaagccgcgacaggatcagagtgctctctgcgctgcatgttgcttactgacttccctgtgtgataccgtcggcgcactcttggccagacaattaacaatccaggtcttcactggcgcttatctcgccgcaatagatcttgtgaactttatgtttatcctgtttcctgtatgtggatccaaatttaaaagcaatagcgaccgagaggctcgggagcgcaaacgccgcagacagctacgggcaagtgtcttcgcattggcactcccactttccttgggcccttgctgggccttatgggtggctgtcccaaaagcttctgccactatccggggaccacaacgtcggttgttggccagtctgctgcaagagaataccgaaattctcggctacttattgggtagcgtggcagcttttgggtcatgggcgtcccgcattccgcctctatcccggatcgctcccccacctaccctggggatcacgactcagcatgaaatatggaggggacaaatgtccaagccaagtcagagccccagtagaagcccctccggacattggagagctgctgcccagcggcaggtcctcggaactgagatgtgcaggggaaagaccttcccaagcatccatctgtggactcggctgttgagtgctctggcaggccttctctatgctagcgccatagtggcccacgatcagcacccagagtatctgctccgcgccactccctggtttctgaccagtctcggcagggcagccctggatctggctatcatattcctgagctgcgtgatgaagtctaaaatgaggcaggctctgggcttcgctaaagaggctagggagtcaccagacactcaggccctgttgacatgcgcggaaaaagaggaagaaaaccaggaaaatctggactgggttccacttaccaccctctcccattgcaagagcttgcgtactatgacagccatcagtcggtacatggaactcaccatcgagcccgtgcaacaggctggatgttctgctactaggctccctggtgatggtcagacttcagccggggatgcttccctgcaagatccaccctcctacccaccggtgcaagtcatccgcgctagggtcagcagtggaagctcatctgaagtgtcctcgattaacagtgatctggagtgggatcctgaagacgtaaaccttgaaggcagtaaggagaatgtcgaactcctcggcagtcaagttcaccaggacagcgtccgcactgcccatctgtctgatgatgattag

SEQ ID NO: 34084 - DNA, 1317 bp, Artificial Sequence
  Description of Artificial Sequence: Synthetic coding sequence
atgggtgaagcccctagtcctgcaccagctctgtgggattgggattacctggacaggtgcttcgcaagacatcgagtttgcatctcattcggcctttggatctgcgcaagtagctgttggatcgcggcccacgcgctgctgttgtacctgaggtgtgcacagaagccccggcaggaccagagtgctctgtgcgcagcttgctgtctgttaacatctctgtgtgacactgtgggcgccctcttggcacgtcaactgacaatccaggtgttcaccggagcctacttagctgccatcgacttggtgaacttcatgtttattctgttcccggtttgcggctcaaagtttaaaagtaacagcgatcgcgaagcacgtgaaaggaaaaggaggcgccagttgagagccagcgtgtttgcgcttgccttgcccttgagtttgggaccctgttgggccctgtgggtcgccgtcccaaaggcttccgccactattaggggcccccagaggcggttactggcttctctgctgcaggaaaatactgaaatcctggggtacttgttgggatcagtagccgcgtttggatcctgggcctctaggatacccccactgagtcgcatctgtcgggggaaaaccttcccctcaatccacctttggacaaggctgctgtccgcacttgcagggctcctgtacgcctctgcaatcgtggctcacgatcagcatcccgagtacctcctgagggctacaccctggttcctgacttctctaggtagagcagcgttggacttggccattatcttcttgagttgcgtgatgaaaagcaagatgcgtcaggcgctcggctttgctaaagaagcccgagaatctcccgatacccaagcactgcttacctgtgcagaaaaggaggaggagaaccaggaaaacctcgattgggtgcccctcactacgctgagccattgcaagagtctcagaactatgactgcaatctcaaggtatatggaactcaccatcgagccagttcagcaggctggctgcagcgcgacgagactgcccggagatggacagacctcagcaggggatgcatccctgcaagatcctccttcataccctcccgtgcaggtcatacgcgcgagggttagctcaggatcttcgagcgaggtgtcctctattaactcagatttagaaaagtattgggaggccttaaactcagaacagtgggacccggaggacgttaacttagagggctctaaggagaatgtggagctgctgggctcccaggtgcatcaagactctgtcaggaccgcccacctttccgatgatgattag

SEQ ID NO: 34085 - DNA, 477 bp, Artificial Sequence
  Description of Artificial Sequence: Synthetic coding sequence
atggcagggttcctggacaacttcagatggccggagtgcgagtgtatcgattggtccgaaagacggaacgcggtggccagtgtggtggccggaattctattttttacgggatggtggatcatgatcgatgctgctgtcgtctatccaaagccagaacagctgaaccacgcgttccacacgtgcggagtcttcagtaccttagcctttttcatgatcaacgccgtgagcaacgcgcaggtcaggggggacagttacgaatccggatgtttgggcaggacaggggctagagtctggttgttcattgggttcatgttaatgtttggaagcctaatcgccagtatgtggatcctgttcggtgcttacgtgacacagaacacagatgtataccctggcctggccgttttttttcaaaatgcattgattttcttcagtacattaatctacaagtttggccggaccgaagagctgtggacctag

SEQ ID NO: 34086 - DNA, 831 bp, Artificial Sequence
  Description of Artificial Sequence: Synthetic coding sequence
atgtacaggataagccaactgatgagcacccccgtcgcctcttcatcaagactggaacgtgaatatgcgggtgaactcagccctacttgtatatttccaagttttacatgtgacagtctggacgggtaccattctttcgaatgcgggagcatagaccctctgaccggcagccattatacatgtcgccggtctcctagactactgacaaatggctactacatctggacggaagactcttttttatgcgacaaggatggcaacattaccttgaacccatcccagacttcggttatgtataaagagaatctggtcagtacaagcaagtcatggctgcacggttccattttcggagatatcaattcaagccccagtgaggacaactggttgaaggggacccgtcgcttggacaccgatcattgtaatggtaacgcagacgatcttgactgctccagtcttactgacgactgggaatctggtaaaatgaacgccgagagtgttatcacctcatcctcgtcacacattatctcccagccgcccggagggaattcgcacagtctaagcctccagagccaactgacggcctcagagaggttccaggagaactcttccgaccactccgagacacggttgctgcaggaggtgttcttccaggccattttgctggcagtttgtctaatcattagtgcttgcgcccgctggtttatgggtgagatcctcgcctcggtcttcacatgctcactgatgatcacagtggcctatgtgaaatcattgtttctctctttggcctcttactttaaaaccactgcatgtgcccgctttgtcaaaatctag

SEQ ID NO: 34087 - DNA, 699 bp, Artificial Sequence
  Description of Artificial Sequence: Synthetic coding sequence
atgtaccgcatcagccagctaatgagtacccctgttgccagctctagtcggttagaaagagaatacgcgggcgagctgtcacccacatgcatcttcccttccttcacttgcgattccctggatggatatcattccttcgaatgtggctctatcgacccattaacaggctcccactatacatgtcgccgttccccaagactattgacaaatggctactatatctggactgaggactcattcctctgtgataaggacggcaacatcaccctaaatcccagtcagacctctgtgatgtacaaggagaatctcgttaggattttcaggaaaaagaaacgcatatgtcattccttctcatcccttttcaatctcagcactagtaagagctggctgcacggatctattttcggggatattaatagcagcccatcagaagacaattggttgaagggcacacgacggctcgacacagatcattgcaatggcaacgagacgaggctgctgcaggaagtcttcttccaggccattctgctggctgtttgcctgatcattagcgcctgcgcgcggtggttcatgggcgaaattctagcgtcagtgttcacgtgctcactgatgattacagtggcctacgtgaagagcttgttcctgtcgttggcaagctattttaaaactacggcttgcgccagatttgtgaagatctag

SEQ ID NO: 34088 - DNA, 300 bp, Artificial Sequence
  Description of Artificial Sequence: Synthetic coding sequence
atgtacagaattagtcagctgatgtctactcccgtggcaagttcatcccgtctcgaacgggaatacgcaggagaactcagccccacatgtatatttccttcattcacttgtgattccctagatggctatcactccttcgaatgcgggagtattgacccactaaccggtagtcattatacttgtcggcgatccccgcgactcctgactaatgggtactatatttggactgaagatagcttcctctgcgataaggatggaaacatcacactaaaccctagccagacttcggtgatgtattag

SEQ ID NO: 34089 - DNA, 279 bp, Artificial Sequence
  Description of Artificial Sequence: Synthetic coding sequence
atgtataggatctctcagcttatgtctactccagtcgcctccagctctagacttgaaagagaatacgccggtgagctgagccctacttgtatatttcctagcttcacatgtgattcgttggatggttatcactccttcgagtgcgggagcatcgatccactgacgggctcccactacacatgtcgtagatcccctcggctcctgactaacggctattacatttggacagaggactcttttctgtgcgacaaggacgggaacattactcttaatccctag

SEQ ID NO: 34090 - DNA, 666 bp, Artificial Sequence
  Description of Artificial Sequence: Synthetic coding sequence
atgggcactttggtcgcaaagcttctgctcccaactctcagctctctggccttcttacccactgtgtccatagcggctaagagacgcttccacatggaggcaatggtctatctctttacattgttcttcgtggccctgcatcacgcatgtaacggacctggtctcagtgtactatgttttatgagacatgacattctggaatatttttctgtgtatggaacggcactgagcatgtgggtgtcactcatggcgctcgcggactttgacgagccgaaaaggtccacatttgtgatgtttggggtgctgacaatagctgtgcgaatctaccacgaccgttggggatacggtgtctactccgggcctatcggcactgccatcttgatcattgccgcaaaatggctgcaaaaaatgaaagagaagaaaggcctgtaccctgacaagtcagtctatacacagcagataggacctggcctctgcttcggagccctggccctgatgcttagattttttttcgaggactgggactacacttacgtgcacagtttctaccattgtgcccttgcaatgagctttgtgctgctgctcccaaaggttaataaaaaggccggttctcctggtaccccagccaaacttgactgctccactctttgttgcgcatgcgtatag

SEQ ID NO: 34091 - DNA, 555 bp, Artificial Sequence
  Description of Artificial Sequence: Synthetic coding sequence
atgtggaggctggctctgggtggagtgttcctcgccgccgcacaagcatgtgtcttctgtcgccttcctgcccatgacctctccggacgtttggctagactctgctcccagatggaggcccgacaaaaggaatgcggtgccagccctgacttttcagcattcgctctagacgaagtgagcatgaataaagtgacggaaaagacacatcgagttctgcgcgtcatggagattaaggaggccgtcagctcactgccctcttactggtcctggctccgtaagacaaagctccccgagtacacacgcgaggctctgtgccctcctgcctgcccgttgccactactttcacccgcgggtggaagcactacgctgtacaattgctcaacatgtaaaggcactgaggtaagctgctggccacggaagaggtgttttccaggctcccaggatttgtgggaagccaagatactgctactgtctatctttggcgcttttctcctattgggtgtgctgtctctcctggtggagagccaccatctccaggctaagtccgggctgtag

SEQ ID NO: 34092 - DNA, 612 bp, Artificial Sequence
  Description of Artificial Sequence: Synthetic coding sequence
atgtggagattggccctgggtggcgtgtttctggcggccgctcaagcctgtgttttctgccggcttcccgcacatgacctctcaggcaggctagctcggttgtgctcacaaatggaggcacggcaaaaagaatgtggtgcatcccctgacttctcagctttcgcacttgacgaggtatctatgaacaaggtgacagaaaaaactcaccgggtcctccgtgtcatggagattaaagaagcagtgtctagtctacccagctactggagttggttgcgcaaaacgaaactgccagaatatacacgtgaggctctttgcccacctgcttgcagaggctctaccaccctgtataattgcagcacatgtaaaggaaccgaggtctcttgttggccgaggaaacgttgctttccaggaagccttggatcccaggactctgcccctttgcatcttcgcagcttcccggcatcgggctgctccgagccccccgggggtgtgcctccccccccgagtaaaaagtggctcgttaaaacactgaagaccagccagcccccggcactgaggggcatgcatagccagctgccacacccgctggaaggcaatcagtctgccccctag

SEQ ID NO: 34093 - DNA, 1755 bp, Artificial Sequence
  Description of Artificial Sequence: Synthetic coding sequence
atgccaggcaggacttgggaactgtgcttactgctgcttttaggactcggtctgggaagtcaggaggccctcccacccccttgcgagtccgaaatctactgtcacggcgaactcctcaatcaggtgcagatggcgaaactgtatcaggacgataaacagttcgtggatatgcctctatctattgctcccgaacaggttttacagacttttacagagctgagcagagatcataaccactcaatccctcgggagcagctgcaagcattcgtccatgaacacttccaggccaagggccaggaactgcagccctggacccccgccgattggaaagacagcccgcagttcctacagaagattagcgatgcaaagctgcgcgcttgggccggtcagctgcaccagttgtggaagaaactggggaaaaagatgaagcccgaggtactctcccaccccgaaaggttttccctgatctacagtgagcaccccttcatcgtccccgggggtcgttttgtagagttttattattgggactcttactgggtgatggaagggttgttgctctctgaaatggctgaaaccgttaaaggtatgctgcagaattttctcgacctcgttaagacatacggtcacgtccccaacggagggagggtttattatctccagcgttcccagcctccactcctaacccttatgatggactgctaccttacacatactaacgacacagccttcctgcaggagaacatcgagacactcgccctcgagttggacttttggactaagaacagaactgtgagcgtctcgttggaaggaaaaaattacctcctcaaccggtactatgtcccatatggaggcccacggccggagtcctactccaaggacgtagagttagcagatacattaccagagggggatcgagaagcactgtgggcagagctcaaggcaggcgccgaaagtggatgggatttcagctcacggtggctcatcggagggcctaatcccaatagtttaagcggcatcagaactagtaagctggttccggtagaccttaatgccttcctgtgccaggctgaggagctgatgtctaacttctacagccgcctcgccggaaacgatagtcaagccactaaatacaggatactgagatctcagaggcttgccgctctgaacacagtgctctgggacgaacagacaggcgcttggtttgattatgacctagaaaaaaagaaaaaaaatagagagttttatcctagcaatctgacaccattgtgggccggctgctttagtgaccctggtgtggccgacaaggctctgaaatacctggaagacaacaggattctaacatatcagtatggtattccgacaagtctgcaaaaaaccggccagcagtgggatttccccaacgcctgggcaccgctccaggacctcgtcattaggggtttggctaaagcccctctccggcgcgcccaggaagtggctttccagctggcacagaattggatcaggacaaacttcgacgtgtacagtcagaaatcggccatgtatgagaaatacgacgtcagcaacggggggcagccaggcggagggggagagtacgaagtgcaggagggctttggttggacgaacggagtggtgctcatgctcttggataggtatggcgaccgcctgacaagcggagccaaactggcatttcttgaacctcattgtctggcagcaacactgctgccatccctcctcttgagtttgcttccttggtag

SEQ ID NO: 34094 - DNA, 2715 bp, Artificial Sequence
  Description of Artificial Sequence: Synthetic coding sequence
atgcctcaactcctgcgcaacgttctttgcgtcatcgagaccttccacaagtacgcctctgaggactccaacggcgcaaccctgacgggcagagagttaaagcagcttattcagggggaattcggagatttcttccaaccctgtgtgctgcacgccgttgagaagaatagtaacttgttaaacattgactcgaatgggatcatttcattcgatgagtttgttctcgcaatcttcaacctactgaatctgtgctatctggacatcaagtcactcctctccagtgaattgcgacaggtaaccaaacctgagaaggaaaagctggacgatgtagacgtgcaggccacaaccggggacgggcaatggactgtaggtacgtctccgacacaggaaaaacggatgctccctagtggtatggcctcatctagccagcttatccccgaggaaagcggcgccgtgggaaataacagggttgacccttggcgtgaggccaagacacacaacttcccaggggaggcatccgaacataatgatcctaaaaataaacacctggaaggtgatgagcagagccaggaggtcgcccaggacattcagacaacggaggataatgaagggcagctgaagaccaataagccaatggccggttcaaaaaaaacctccagccccactgaaaggaagggacaggataaagagataagtcaggagggggacgaacccgctagagaacagtccgtgtcgaagattcgagatcagttcggagagcaagagggtaatctcgccacgcagtcctcaccaccaaaagaggctacccagcggccatgtgaagatcaagaggtcagaaccgagaaggaaaagcattctaacatccaggaacctccacttcagagagaagacgaaccttcaagccagcacgcggaccttcccgagcaggccgccgccagatcaccttcccagactcagaaatcaacagacagcaaagatgtgtgtaggatgttcgatactcaagagccaggcaaggacgccgatcagacccctgcaaaaactaagaatctgggcgagcccgaggattacggtcgcacatccgagactcaggagaaggagtgcgagactaaagatctgcctgtgcagtatgggtcacggaatgggagcgagacatccgatatgagagatgaaaggaaggaaagacgcggacccgaggctcacggtaccgccggacaaaaggagcgggacagaaagaccaggccactggtcctagaaacacaaacccaagatgggaagtaccaggagctgcagggccttagcaaaagtaaggacgccgagaaagggagtgagacgcagtacctatctagcgagggtggggaccaaacccatccagagctggaaggtacagccgtttccggagaagaggcggagcataccaaggaaggtactgccgaggcctttgtgaattctaaaaatgcccctgcggctgagagaactttgggagcccgcgagcggactcaggacctagcccccctcgagaaacagtcagtgggggagaacacccgcgtgactaagacacacgaccagcccgtggaggaagaagatggatatcagggagaggaccctgagtcacccttcactcagagcgacgaaggcagctccgaaactcccaactcccttgcgtcagaagaaggcaattccagctccgaaacaggggagttgccagttcagggggattcccagtcacaaggtgatcagcacggtgagtcagttcagggagggcacaacaataatccagatacccaaagacagggaactcccggcgaaaagaacagagccctggaagctgtggtccctgcagtgagaggcgaggatgtccagctaaccgaggatcaagagcagccagctcgtggcgaacacaagaaccaaggaccgggtacgaaggggcctggagccgctgttgaacctaacggacatcccgaggcacaggaatcaacagctggcgacgagaatcgcaaatcccttgaaatagagatcaccggcgcactggatgaggacttcaccgatcaattgtctttaatgcaactacccggcaagggtgattcacgaaatgaattgaaagtgcagggaccatccagcaaggaagaaaagggaagagcgactgaggcacagaatacactccttgagtcactcgacgaggataactcagcatcattaaaaattcagttggaaacaaaggaacccgtgacctcggaggaggaggatgaatcccctcaggagcttgccggagagggtggtgaccagaaatctccggccaagaaagaacataactcatcagttccatggtctagtttagaaaaacagatgcagcgggaccaagaaccctgctctgttgaacggggtgctgtatactcgtctcccctgtatcagtatctgcaggagaaaattctccagcagacaaatgtgacacaggaggagcaccagaagcaggtgcagatcgctcaggcatctgggccagagctctgctctgtgtcactgacaagcgaaatttccgactgcagtgtgtttttcaactactcacaggcctctcagccctacacgaggggccttcccctcgacgagagcccagctggcgcccaagaaacaccagcacctcaggcattggaggacaagcaaggacatccgcagcgtgagagactagttcttcagcgagaggcctctacaaccaaacaatag

SEQ ID NO: 34095 - DNA, 1248 bp, Artificial Sequence
  Description of Artificial Sequence: Synthetic coding sequence
gagatcgccaagcaattacaggcagtgaagagaaaaattcgtgatgaaagcctgtgcccgcagcaccatgaagcccttagtctgttttgttacgaggatcaggaggcagtttgccttatttgcgctatatcacacactcacagggctcacaccgtcgtgcctctggatgacgctacacaagagtacaaggaaaagttgcagaagtgccttgagcctttggagcagaagctccaagagatcacaagatgcaagtcttcggaggagaaaaagccaggcgaactcaaaaggctggtcgagtccaggcgtcagcagatattaagggagttcgaggagttgcatcgacgcttagatgaagaacaacaagtgttactttcccgcctcgaggaagaggagcaagacatcttgcagagactgcgtgaaaatgcagcccatttaggcgacaagcgccgggacttggctcacctggccgctgaggtcgaagggaagtgtctgcaaagcgggtttgagatgctgaaagacgtgaaaagcacccttgagaagtgcgagaaggtcaagacaatggaagttaccagcgtgtcaattgagttagagaaaaacttcagcaacttcccacggcagtacttcgctctgagaaaaatcctgaaacaattgattgcagacgttactttagatcccgaaaccgcccaccctaatttggtgctcagcgaggaccggaagtccgtgaagttcgtcgaaactcggctccgcgatctgccagacacgccaagacgtttcactttctatccctgcgtcctggccactgagggctttacgtccggtaggcattactgggaagtggaagcagctcactgcgtcctcgcccaggatccggagaaccaagccctggcccgattctactgctatactgagcgcactattgcaaagaggcttgtcctgcgtcgggaccccagcgtgaagcgcacattatgcagaggttgttctagcctgctcgtcccagggctgacatgcacccagcgacaaagacggtgccggggccagcgctggaccgtgcagacctgtctgacttgccagcgtagccagcgattcttaaacgatcctggacacctgctgtggggtgatcgacccgaggcccagttgggatctcaggctgattctaagcctctgcagcctctgcccaacaccgctcatagcattagtgacaggttgccagaagaaaagatgcagactcagggatcttccaaccagtag

SEQ ID NO: 34096 - DNA, 1602 bp, Artificial Sequence
  Description of Artificial Sequence: Synthetic coding sequence
atggaggagaaaggaagcaaacgcggcctcgaagccgcgggcaaggctggactagcaaccgccgggcccggtctccttcctcggaaacctcccggtttagccgctggccccgccggcacctacggcaaagccgtctctccccctcctagccccagagcctcaccagttgctgcattgaaggcaaaggttattcagaaactggaagatgtgtccaagcctccagcttacgcgtatccagccaccccttcatctcatcccacgtcgcccccacccgcctctcctcctcccacaccggggattacccggaaggaagaggcacctgaaaatgtggtggaaaagaaggatctggaactagagaaggaggcccccagcccctttcaagcactcttcagcgacatcccccctcgctacccattccaggccctgccccctcattacggacggccctacccattcctgctgcaacctaccgccgccgcagacgcagatgggctagcccccgacgtgccgctgcccgctgatggacctgagaggttggccctcagcccggaggacaagcccatacgcctgtctccgtctaagattacagaacctctcagggagggacctgaggaagagccactggctgagcgggaggtcaaagccgaggtggaagacatggacgaaggtccaacagagctcccccccctggaaagcccactcccactacccgccgcagaagccatggcaaccccctccccagccggcgggtgcgggggaggtttgctcgaggcccaggccctgtcggctactgggcagagttgcgcggagcccagcgagtgcccagacttcgtggagggaccagaaccaagagtagactcccctggaaggacagagccatgcaccgccgcgctagacctgggtgtccagctgactccggagaccttggtggaggcgaaggaagaaccagtggaggtcccagtcgctgtccctgtagttgaagctgtgcccgaagagggcctggcgcaagtcgcaccaagtgaatctcagcctacactggaaatgagcgattgcgatgtgcccgccggagagggacagtgcccctccttggaaccacaggaggccgtacctgtacttggctcaacttgcttcctggaagaagcttcctcagaccagttcctgccttcgctcgaagaccctcttgctggcatgaatgcactggcggctgcagccgaactccctcaggccaggcccctgccgagtcccggagcagccggcgcgcaggctttagaaaagcttgaagctgcagagagcctggttctggagcagagctttctgcacgggattacactgttgagcgagattgccgaattagagctggagcgcaggagcccacctcagggcctgcccccttgtatgggccagggctcccctatgcccgcggggctgccagactgtgctcgggggccagctcccacccttagcgggtggccccgcttaggcgagcagtccagggtgggcctgcagccaggggtgagtgtgaaaggtacccgctggaggggccctggcactggaccgccttggtctaagccctcccattatagaaaacctcagtggtgttag

SEQ ID NO: 34097 - DNA, 8907 bp, Artificial Sequence
  Description of Artificial Sequence: Synthetic coding sequence
atggacggacgggatttcggtccacaaagatcagtgcacgggccgccaccacctctgctctccggacttgctatggacagtcatagggtaggggcagcgaccgcgggtcgcctgcctgcctcaggcctccccggcccactgcctcccggtaaatatatggcgggactgaacttgcatccacatccaggggaggcgttcttagggagtttcgtcgcttccgggatgggcccctctgctagttctcatggctcccctgtccccttacccagcgatctgtcctttaggtcccccaccccttctaatctaccaatggttcaactctgggctgcccacgcacacgaaggcttctcgcatttaccgagcggactatatccatcttatttgcatctgaatcatcttgagcctccctcatccggatcccccctgctgtctcagctggggcaaccctcaattttcgacacccagaagggtcagggaccaggcggggacggtttctacttacctacagctggcgctcccggatcccttcatagccacgcccccagtgcacgtaccccggggggtggacactccagtggagctccagcaaaggggagcagttctagggatggacctgccaaagagcgcgccggtagaggcggcgagcccccacctctgtttgggaaaaaagaccccagagctcgaggcgaagaggcgagtggtccgaggggcgtcgttgacttgactcaagaggccagagccgaaggtcgacaggaccgaggacctccaaggctggctgagagactcagcccattcctcgccgaaagtaaaacaaagaatgccgccttgcaaccatccgttttgaccatgtgcaacggtggagctggagatgttggcctcccagcactggtcgccgaggcaggccgcgggggagccaaggaagccgcacgccaggatgaaggcgcccgcctcctccgccgtaccgagactttacttcctgggccacgtccctgccctagcccgctaccccctcctccagctccgccaaaaggcccccccgccccccccgccgcgacccccgccggcgtgtacacggtcttcagagagcaaggtcgagaacaccgggtggtagcgcctactttcgttccttcggtagaggcctttgacgaacggccaggtccaatccagattgcttcgcaggccagggatgccagggcccgggaaagagaagcaggaagaccgggtgtgctccaggcaccccccggttccccgagacccttggaccggcccgagggccttagggagaaaaactccgtcatcagaagcttaaagcggccaccaccagcggatgcaccaacagttagagcaactagggcatctcctgacccaagagcctatgtgcctgccaaagagctgcttaagcctgaagccgatccgcgaccgtgtgaaagggcaccgcgcggacctgccggtcctgcggctcagcaagcagccaagttgtttgggctggaaccaggacgcccaccacctaccggcccagagcacaaatggaagcctttcgaactggggaattttgccgccacccagatggccgtgctggcggctcagcatcaccatagcagggcggaagaggaagcagctgtggtcgcagccagctcaagcaaaaaggcttacttagatccaggggccgtattaccgcggtctgcggcaacctgcgggcgtcccgtggccgatatgcattcagccgcacacggcagcggggaggcatccgcaatgcagagcctgataaaatactctggatcctttgcccgtgatgcggtagccgtgcgccctgggggctgcggcaagaaatcacccttcggagggctaggcaccatgaaacctgagcctgctcccacatcggccggagctagtagagcccaggcccgcctgccacattccggcggaccagccgcagggggagggcgacagcttaagcgggaccccgaaagacctgagagcgcaaaggcattcgggcgggaaggtagcggcgcccagggagaagctgaggtgagacaccccccggtggggatcgctgtggccgtggcacgccaaaaggatagcggcggctctgggcggttaggaccgggtttagtggaccaggaacgatcactaagtctctctaacgtgaaaggacacggccgggcggatgaagactgcgttgacgaccgcgccaggcaccgggaggaacggctgctcggggcacgactggacagagatcaagagaaacttctgagggagagcaaagagctagccgaccttgccagactgcatcccacatcatgtgccccaaacggcctgaaccccaacctgatggtaaccggaggccctgccctggctgggtcaggccggtggtctgctgacccggccgcccatctcgccacccatccttggttgccacggtcggggaacgcgagcatgtggcttgctggccacccttatggcctggggcctccttcgttacaccaaggcatggccccagctttcccacccggactgggaggtagtctgccatctgcctatcaatttgtgcgtgacccccagagcggtcaattggttgtgatcccctcagatcacctgccacattttgctgagctgatggagagagccaccgtcccaccactctggccggccctctatcctccaggtcgaagccctctgcatcatgctcagcaactccaattattcagtcagcagcatttcctccgtcaacaggagttcctctacctgcaacagcaagctgcccaggctttagaactccagagatctgctcagctcgtccaggagagactcaaagctcaggaacacagagctgaaatggaggagaaagggtctaaacgaggtttggaagctgccggaaaagccgggctggctactgcggggccagggctgctcccaagaaagcctcccggcctggcggctgggcccgctggcacatacgggaaagcagtctctccgcccccttcccccagggccagtcctgttgccgctctgaaagccaaggtcatccagaaactggaggacgtctctaagccacccgcctatgcctacccagccaccccgtcaagccaccctacatccccgcccccagccagccccccccccacacccggaattacccgcaaggaagaagcccccgagaacgtggttgagaaaaaagatttagagcttgaaaaggaagctccaagccccttccaggcactgtttagcgacattccccccagatatccgttccaggccctgccaccgcactacgggagaccctacccttttctgctccagcccacagctgccgcagacgccgatggactcgcccccgacgtgccacttccagccgatggaccggagcgcctggcgttatccccagaggataagccaatccggctctccccaagcaagatcacagagcccttaagggagggacccgaggaagagcccctggctgagagggaggtaaaagcagaggtggaggacatggacgaggggccgacggagctcccccccttagagagtccactaccgcttcccgctgccgaggcaatggccaccccttctcccgcaggagggtgcggcggtggtctcctggaggcgcaggccttgtccgcgacggggcagtcatgtgcggagcctagcgaatgtccagactttgtggagggccccgagccccgggtcgatagccctggtcggactgaaccctgcacagctgcccttgacctgggcgtgcaactcactcctgaaacgttagtggaagctaaagaagagcctgtggaggtgcccgtggcagtgcccgtggttgaggctgtgcccgaggaagggctggctcaagtggctcccagcgagtcccagcccactttggaaatgtccgattgcgacgtcccagctggggagggacaatgcccctccctcgaaccccaggaggctgtccctgtgctggggtccacttgttttctcgaggaagcttcttccgaccagtttctgcctagcctggaagaccctcttgctgggatgaatgccctggccgcagcagcagagctgccacaggccagacctctccctagtcctggcgctgcaggagctcaagccctcgagaagctcgaggcggccgaatcactagtgctggagcagtcatttctccatgggataactctgctgtccgaaatcgccgagctcgagctcgagcgccggtctcaggagatgggcggggctgagagggctctggtggcgcgacctagcctggagtccctcttggccgctggatctcacatgttacgggaggtccttgacggcccggtcgtcgatcccctcaaaaatctacgattgcctcgggaattgaaaccgaacaaaaaatattcgtggatgagaaaaaaggaggagcgcatgtacgctatgaagagttcactcgaggacatggatgccctggagttagacttccgaatgcgcctcgctgaggtgcagagacagtacaaggagaagcagcgcgaactggtcaagctacagcggagacgcgacagtgaggaccgaagggaggagccccaccggagtctagcgcgaagagggccaggccgccctcgaaagaggactcacgctcccagcgctctcagtccacctcgcaagagaggaaagtccgggcattcttctggaaaactctcctcaaagtccctcttgaccagcgatgattacgagctgggagctggcattagaaagcgtcataaggggagtgaagaggaacacgacgccctgattggaatgggtaaggcccgagggcggaaccagacctgggacgaacatgaggcttcctccgactttatatcgcagctcaaaataaagaagaagaagatggcgagtgaccaggaacagctggcctcaaagttagacaaggccctgagcctgacaaaacaagataaactgaagagtccatttaaattcagcgattctgccggcggcaagtccaagactagcggcggctgcggccggtatttgaccccgtacgactccctattgggaaaaaaccgcaaggcactcgccaagggcctggggctctcacttaagtcatccagagaaggaaaacataagcgcgcagcaaagacccgaaagatggaagtcggcttcaaggcccgcggccaaccaaaatcagcgcatagcccttttgcttcagaggtctcttcgtactcttataatactgattctgaggaggacgaggagtttctgaaagatgagtggcctgcgcagggacctagctcaagtaagttaaccccatccctgctgtgttcgatggtcgctaagaattccaaggcagccggagggccgaagctcacgaagagggggctggcagctcctcggaccttaaaaccaaagccagctacatcccgaaaacagccattttgtctacttctgagggaagccgaagctcgctccagctttagcgattcctccgaggaaagcttcgaccaagacgagtcatccgaggaggaggacgaagaggaagaacttgaggaagaggacgaggccagtggagggggctataggttaggagctcgagagcgcgcactcagtcccggactggaagagtcaggcctgggtttgcttgctcgtttcgccgcgtcagcgctgccttccccaactgtaggacccagtctgtcagtggtgcagctcgaagcaaagcagaaagcgcgaaagaaggaggagaggcagagcctgctggggacagagttcgagtacacagattccgagtcagaagttaaggtcaggaagagatccccggccggcctcctgcgcccgaaaaagggactgggagaacctgggccatcactggcagctccaacaccaggcgctagaggaccggaccctagtagtcccgataaggctaagctagccgttgagaaaggccggaaagctagaaaactgcgcggccccaaagagccggggttcgaggccggccccgaagcttccgatgatgacctgtggacccgaaggagaagcgagcggatatttctgcacgacgcgtctgccgccgctcccgcgcccgtcagcacggctcccgcaaccaaaacctccagatgcgccaaggggggccccctaagcccacgcaaggacgcaggccgggccaaagatagaaaggacccgcgaaagaaaaagaaaggcaaagaagccggcccaggtgcaggcctgccccctccccgggctcctgccctcccttcagaagcgagagccccacacgcatctagcctgacagctgctaaacggtctaaagctaaagccaaaggcaaggaggtgaagaaggaaaacaggggcaagggcggagcagtttctaaactgatggaatccatggccgctgaagaggacttcgagcccaaccaggatagctcattttcagaagatgaacatctgcctcggggaggagctgtggaacggcctctgacgccagctcccagatcctgcattatagataaggatgagcttaaggacggcctcagggtcctaatcccaatggacgataaactcctgtacgcaggtcatgtccagaccgttcatagcccagatatctaccgtgtggtggttgaaggcgagagaggcaacaggccacacatttactgtctagagcagctactgcaggaagccatcattgatgtgagaccggcttccaccaggttcctcccacagggcactcgtatcgccgcctattggtctcagcagtatagatgtttgtatcctggcacagtagtccgcggcctactggacctggaagacgatggcgatctgattacagtcgagttcgacgacggagataccgggaggattccgctgagccacatccgactgctgccccctgattacaagatccaatgtgctgaaccgtccccggcacttctcgtgcctagtgcgaaaaggcgctcccgcaagacatccaaagataccggtgagggcaaggacggcggcaccgcaggctcggaggagccaggtgccaaggcaaggggccgagggcggaagcctagcgccaaagcaaagggcggtcgcgcagcgactctggaagagggaaacccaactgatgaggtgccgtctacccccctggcactggaaccaagctctactccgggatccaagaagtccccgcctgagcccgtcgataagagagctaaagctccaaaggcccgaccagcaccaccccagcctagtcctgcccctccagcgtttactagttgtcctgctcccgaacctttcgctgagctgcccgcacccgcaacatcactggcaccagccccgctcattactatgcccgccacacggcccaagccgaagaaggcccgagcagcagaggaatcaggtgcgaaggggcctcgtcgtcctggtgaggaggctgagctgctggtgaaactcgatcacgagggagtgaccagtcccaagtccaaaaaggcaaaggaggcactcctgctaagggaagaccctggcgccggtggctggcaggaaccaaaaagcctattgtcactggggtcttaccctcccgccgctggttcaagcgaacctaaagccccttggccaaaagcgaccgatggcgatcttgcacaggaacctgggccagggctgacttttgaggacagcggtaaccccaaatcgcccgacaaagcacaggctgagcaggacggagcagaagagagtgagtcgagttccagctcctcttcgggaagttctagcagcagcagctctagtagtagtagcgggtctgaaacagaaggcgaggaggagggggacaaaaacggcgatgggggctgtggtactggaggacgcaactgcagcgctgcgtcgtctcgggctgcttcccccgctagttccagttcctccagttccagttctagcagtagctcatcttcctcaagcagctccagctcttctagtagcagctcctcctcttcatcttccagcagctccagtagttctagttctagcagctcatcatctagcagcagtagttcctcgagctcgtctagctctagctctagtacgacagacgaagatagttcttgcagttccgatgatgaagccgccccagctccgacagctggcccttccgcccaggccgccctgcccactaaagcaacaaaacaggccggcaaggctaggcccagtgctcatagtcctggcaagaagacgccagctccacagccccaggctccaccccctcaaccaacgcagcccttgcagcctaaggcccaggcgggcgccaaatctagaccgaagaaacgcgagggggtccacctccccactactaaggaactggcaaaaaggcagagacttccaagtgtggaaaataggccaaaaattgcggccttcttgcctgctcgccagctgtggaaatggtttggaaagcccacccagcgaagaggaatgaaaggtaaagcgcgaaagctgttttataaggcaatcgtgagaggcaaggagatgattagaattggcgattgtgccgtattcctctcagcaggcaggccaaatcttccatatataggccgcattcagagtatgtgggaatcgtggggcaacaacatggtcgtgcgtgtgaagtggttctatcatcctgaggagacatcccctggtaagcagtttcaccagggtcaacattgggaccagaagagttcacgcagcctccccgctgcccttagggtgagctctcagcgaaaggacttcatggaacgtgcactctaccaatcctctcacgtggacgaaaatgacgttcagactgtctctcataagtgtcttgtggtcgggctcgagcagtatgagcaaatgctgaagaccaagaagtatcaggacagcgaggggctttactacctggccggcacatacgaacctaccacaggaatgattttctcaacagacggcgttcctgtgctgtgttag

SEQ ID NO: 34098 - DNA, 3939 bp, Artificial Sequence
  Description of Artificial Sequence: Synthetic coding sequence
atggaggagaaggggtctaagagaggactcgaggctgctgggaaggcgggattggcaaccgcggggcccggcctgctgcctagaaagccccccggcctggcagccggacccgccggcacctatgggaaagcagtgagccccccacctagtccccgagcatctcccgtggccgccctgaaagccaaggtgatccagaagctggaagacgtgtctaaacctcccgcctacgcctatccagcgacacctagctcccacccgacttcgccgccgccagctagcccccccccaacccccggcattactcgtaaggaggaggcccctgagaatgtggtagaaaagaaggacctggagttggaaaaagaggctccttccccttttcaggctttattcagtgacatccccccccggtatccatttcaggcgctgcccccccattatgggcgtccctatccctttctgctgcagcccactgcggctgccgatgccgatggacttgctcccgacgtgcccttgcctgccgatgggcctgaaagactggcattgagccctgaagacaagcccattcgcttaagcccctcgaaaatcaccgagcccctgagggagggaccagaggaggagcctctggcggagcgagaggttaaagccgaagttgaggacatggatgagggaccgacagaactgcccccactggaatccccactgccactgcccgccgctgaggcgatggcgacaccctcccctgccggtggttgcggcggcgggttgctcgaggcgcaggctctttcagctaccgggcagtcatgcgccgaaccatctgaatgtcccgattttgtagagggtccagagcctagagtcgattctccaggcaggactgagccctgcacagccgctctcgatcttggtgtccagctgacaccagagaccctggtcgaagccaaggaagagccggtggaagtccctgtggctgttcctgtggtggaggccgtcccagaagaagggctcgcccaggtcgcccccagtgagtcacaacccaccctggagatgtccgactgtgatgttcccgctggtgagggacagtgcccttccctagagccccaggaggctgtgcctgtcttgggatccacgtgcttcctagaggaggcttctagtgaccagttcctgccctcactggaggatcccctggcagggatgaacgcactcgcagccgcagccgaactgccccaggccagacccctgcccagccctggggcagctggagcacaagctctcgagaagttagaagctgccgaaagtcttgtcctagagcagtcttttttgcacgggatcacactgctgtccgaaattgccgagctggagctcgagcgacgttcacaggagatgggaggagctgaacgggccttggtggcccgaccttcactcgagtcgttgctggcagctggctctcacatgctgcgggaagtgctggatggccccgtcgtcgatccccttaagaatttgcggctgccccgagagctgaaacctaacaaaaagtacagttggatgaggaagaaagaagagcgcatgtatgcgatgaaatcaagcctggaggatatggatgctctggagttggatttcaggatgcggctggcagaggtccaaaggcagtataaggaaaagcaacgtgagctggtgaaactgcagcgccggcgtgatagcgaggatcgccgtgaggagccccaccggtctctggctcgtcgcgggcctgggaggcctcgcaagcgaactcacgcccccagtgctctgtcccccccccgcaaaagggggaagtccggccactcctccggcaagcttagcagcaaatctctgctcacctctgacgactacgaattgggggccgggatcaggaagcgccataaggggtctgaggaagaacacgacgccctgatcgggatgggaaaggcacgagggcggaatcagacatgggatgagcacgaagcatcgtcagactttatcagccagctcaagataaaaaagaaaaagatggcctctgatcaggagcagcttgcttctaagttagacaaggctttatctctgacaaaacaggacaaactcaaaagccccttcaaattctctgactctgccggtggcaaaagcaagacgtccggtggctgcgggaggtacttaaccccatatgacagcttactgggcaaaaaccgaaaggcgttggccaaaggcctgggattgagcctgaaatcatcccgggaggggaagcacaaacgggctgcaaaaaccaggaagatggaagttggattcaaagcccgaggccaacccaagagcgcccactctccctttgcctcagaggtttcttcatactcttacaacacggattcagaagaagatgaagagttcctgaaggatgaatggccagcacaaggaccatcatcttccaaactaactccttctctcctgtgctccatggtggccaagaattcaaaggccgccggaggacctaaacttactaagaggggcctcgcagccccaaggactttaaagcccaaaccagctacatcccgaaaacagcccttctgtttgctgcttcgtgaggccgaagccaggtcatcctttagtgactctagcgaggagtcgttcgaccaagacgaatcaagtgaagaagaggatgaagaggaagagctagaggaagaggacgaagcctcaggtggcgggtatcggctgggtgctagagagagggcactctcacccggcctcgaggagtccgggctgggtctgctggctaggtttgctgcctcagccctaccaagccccacagtgggcccgtccttaagcgtggtgcagctggaggcaaagcagaaggctcggaaaaaggaggagcggcagtctttgttaggcaccgaattcgagtacaccgactcagagagcgaagtgaaggtgaggaagcgttcacctgcaggcctactgcgacccaaaaaaggcctcggagagcctgggccaagcctcgccgccccaacacctggtgccagaggccctgacccgtcctctcccgacaaagcaaaactggcagtcgagaaaggcagaaaagcgaggaagttgcgcgggcctaaagaacctggctttgaagccggcccagaagctagcgacgacgacctgtggaccagaagaaggtccgaacgcatctttcttcacgacgcctcagccgcagcccctgcacccgtgagcacagcaccagcgacgaaaacaagcaggtgtgccaaagggggcccgctcagcccccgtaaagatgccggccgcgccaaagacagaaaggaccctcgaaagaaaaagaaaggaaaggaggctggaccaggtgcaggcctgcctccaccccgcgcccctgcacttcctagcgaagctagggccccacctccaccgcctccgccaccaccgccacacccaccgctgccaccccccccactgcccccgccccccctgcccctgagattgcctccattgcctcccccccccctgccacggcctcacccccccccaccgccgcccctgccgccacttctgcctcctcctcagacccgaacactccctgcggcccgtactatgagacaacctcctccacctcgattagccctgcctcgtcgtcggaggagtcccccacggcccccatctcgtcctgccaggagaggcccaaggcccaccccacaggcaagacgtcgccctcgaccgagccctcggagactgctccgcagccctcactctttgtgttctccccggctgcgtccaggccctcgagcagatcctcgtagagagcgggcctcaactagccctcccccacgcagttggcctagcgggagtgcgtgcagaccctggagaactggcccacgatccccaccatcatgccaacccggctcctccggctctggatcagcctctccccccagcggcgtcgcttag

SEQ ID NO: 34099 - DNA, 912 bp, Artificial Sequence
  Description of Artificial Sequence: Synthetic coding sequence
atggatggacgtgatttcggtcctcagagaagtgtgcacggcccacctccaccactgctatctggtttggccatggatagtcaccgcgtcggggctgccaccgccggtcggctgccggcctccggactgcctggacctcttccgcctggcaagtatatggctggcctgaacttgcatccccatcccgggaagtgcccagcaccctgtccttccccaccagtgtttcctggacgttcaacgaggcctggacctcctgtccactctcgccccggtctcggcgactcaccttccgtgggtcatggcggcgccggacgtctggggagccaaggctgggagactcctgggcccggagccaaggctgtcgagtcggtggcacggcttggctacctgttcaggagtgtgctgggcccccgggagcctaaggccggcgtagtagccagagctacgggggccataccaataccaggtgcccccgccgctagggcttgggctggggtatttaagatttgggcacgcaaagagcaaaccggcccagcacccagggagactccactacccgagttagaaagcttctcctggcagaccctgttattggccctggtgggacctcccggcttctgtagtcaactgcaccacagccgacgcgctgggtctctggctgtaacagagcgccgcggtatgcgcgagtatgccggaggatgcggtagtaccgtgacgcccgccctggggccttggcctcgtgggggtagagatgctccatttttccccggtagaacagctgccttgggaacgtgcacccccgtgggtggaaggcgcccccggcctagtggtactccttgtttccccgcccggaagcgtgttcggcggtgcgggagggacacagagaccggccctagccgatcccgaacgtag

SEQ ID NO: 34100 - DNA, 8907 bp, Artificial Sequence
  Description of Artificial Sequence: Synthetic coding sequence
atggacggacgtgactttggcccccagcgctctgtacatggccccccacctccactgctgagcgggctcgcgatggactctcaccgggttggagccgcgacagccggccgcctccctgcctccgggttgccaggtccactacctcccggaaaatacatggcaggtctgaatctgcatccccacccaggagaggcttttcttggctccttcgtcgcctccgggatgggccctagcgcttccagccatggctcccccgttccactcccaagcgacctgtcattccgctcacctacacccagtaatcttcccatggtccagctgtgggctgctcacgcccacgaaggattttcacacttacccagtgggctgtaccccagctatctgcatctaaatcatctcgaaccacctagttcagggagtccactgctgtctcagctggggcagccttccatatttgatactcaaaagggacagggccctggcggcgacggtttttatctcccaactgccggcgcccctggtagcctgcacagccacgcgccctctgctcgaacccccggcggcggacattcatccggagcacctgccaaaggatccagctcgagggacgggcctgctaaagagagagctgggcggggaggcgagccccctccacttttcggcaagaaagacccgagagcacgtggggaagaagctagtggtcctcgaggagtagttgatctgacacaggaagctagagcagagggacgccaggaccgcgggcccccccggcttgccgagagactgagcccatttttagctgaaagcaagacgaagaatgccgctttacaacccagcgtgcttactatgtgcaacgggggcgccggggacgtcggcctgccagcgctcgttgccgaagcaggaagagggggcgccaaggaagctgcccggcaggatgagggcgctagactcctcagaagaaccgagactctccttccggggccacgtccctgtccctctccactgccacctcctccggcacctcccaagggtccccctgcaccacccgcagctacgcctgctggggtctatactgtgttcagagagcaggggagagaacaccgcgtagtggcccccactttcgttccatccgtagaagccttcgacgagagacctggccccattcagatagcctctcaggcaagggatgctcgtgccagagaacgagaggcggggagacccggcgtattgcaggctccacccggaagccccagaccactggatcgacctgaaggactcagggagaagaactccgttattagaagccttaagcgaccccctcccgcagatgccccaacagtgcgcgcgacacgagcaagccctgacccgagggcttatgtccccgccaaggagctactgaagccagaagctgatcctcggccgtgtgagcgagcccctcggggccccgccgggcccgctgcacagcaggccgcaaagctatttgggcttgaacctggcagaccgcctccaaccggacccgagcacaaatggaaaccctttgagctaggcaactttgccgccactcaaatggcagtcttagcggcccagcatcatcactctagggctgaggaggaggcggccgtggtcgcagcttcaagctcaaagaaagcctatctagatccaggagctgtattaccccggtcagccgccacttgtgggaggcctgtagccgatatgcattccgcggcccacggtagcggcgaggcctcagccatgcagagcctcataaaatatagtggtagcttcgcaagggacgccgtagcagtacgaccaggggggtgcggcaagaagtcaccctttggcggcctcggtaccatgaagccagagcccgccccaacttctgcaggggcatcccgcgcacaggcccgcttgccgcactcgggcggccctgcagccggaggcggaaggcaactcaagcgcgatcctgagcgtccagagagcgcaaaggcgttcggtcgtgagggatctggcgcacagggggaggctgaggtgcggcatcctccagtcggaattgctgtggccgtggcccgacagaaggattcaggtggttcgggcaggctgggacccggattggtggatcaggaaaggtccctgtccttatcaaatgtaaaaggccacgggcgcgcggacgaagactgtgtggatgaccgcgcccggcatcgcgaggaacgactgctcggcgcccggttagacagggatcaggaaaagctgctaagagaatctaaagagctggccgacctcgcccgattgcatcctaccagctgcgctccaaacggcctgaatcccaacctgatggtgaccggagggccggcccttgcaggctctgggcgctggtccgctgaccccgccgctcacctagcgacccacccatggctaccgagaagcgggaacgcttcaatgtggcttgctggtcacccttacggtctagggcccccatctctccatcagggtatggcacccgcttttccacctggcctgggaggatccctcccctctgcttaccagtttgtccgcgatcctcagagcggccaacttgtggtaatcccatctgatcacctgccacactttgctgaactgatggagcgggctactgtgccccctctgtggcccgcattgtatcctcctggccgttccccactccaccatgctcagcaacttcagctattttcacagcagcactttctcaggcaacaggaatttctctacctacagcagcaggccgcacaggccctggaactgcagcgttccgcccagctcgtccaggagagactgaaggcccaagaacacagagctgaaatggaagagaaaggctccaaacggggcttggaagctgctgggaaagccggtctagccactgccggccccggcttactcccaaggaagcctccaggcctggcagccggtcccgcaggcacctacgggaaggccgtttcccccccacccagtccacgggccagccctgtcgcggcactaaaagctaaggttatccagaaactcgaggacgtgtctaagccccccgcttacgcataccctgcgacaccaagttctcatccaaccagcccccctcctgcatctccgcctcctacgcccggtatcactcgcaaggaggaagcccctgaaaatgttgtggaaaaaaaggatttggaactcgagaaagaagccccttccccttttcaagctctgttttccgatattcccccaaggtacccatttcaggctctccctccacactacggaagaccctacccttttctgctccagcccacagccgccgccgacgccgacgggctggcgcccgacgtaccactgccggcagacggacctgaacgattggcactctcacctgaagacaagccaatcagattgtccccttctaagattaccgagccactgcgtgaaggccccgaagaggagcccttggctgagcgggaagtcaaggcggaggttgaggatatggatgagggacctacggaattgcctccactggagtcacccttacccctgccagccgccgaagccatggcaacaccctctccagccggcggatgcggcgggggcctgctcgaggcccaggctctgagcgctaccggccagtcctgcgccgagccatctgagtgcccggacttcgtggagggccctgagcctcgggtcgatagcccgggtcgcaccgaaccatgtactgccgccttggacctgggagtgcaactaaccccagaaacactagtggaggctaaggaggaacctgtggaggtgcccgtggcagtcccagtcgtggaggccgtgccagaagaaggactggcacaagttgcaccaagcgaatcccaacctacgctcgagatgtcagattgcgacgtacctgccggcgaagggcagtgcccctccttggagccacaggaggcagtcccagtgcttggcagtacttgcttcctagaagaggcttcaagcgaccagttcttaccctcactggaggatcccttagccggcatgaatgcactcgctgccgccgctgaactccctcaggccaggcctcttccttctcccggagcggcaggagctcaggccctggaaaagctggaggccgcagaatctctcgtgttggaacagtcattccttcacggaattactctgctaagtgagattgccgagttagagctggaacgtaggtcccaagaaatgggtggcgcagagcgcgcactggtggcccggcccagtctcgaatccctgctggcagccggtagccatatgttaagagaagttctggatggccctgttgttgacccactgaaaaatttgaggctcccgagggagcttaagcccaataagaagtactcttggatgcggaagaaggaggagcgaatgtacgctatgaagagctctctcgaagatatggacgctttagagctggacttcagaatgagactcgctgaggtgcagagacaatataaagaaaagcaacgcgaactggtgaagctccagcggcggagggactccgaggacagacgcgaagagccacaccggagtttggcaagaaggggccctgggaggccacgcaagagaacccatgcaccaagtgcgctgtcacccccccggaagagaggtaaatcagggcattccagtggcaagttgtcctccaagtccctgctgaccagcgatgattatgaattgggggctgggatcagaaagcgccacaagggctccgaggaggagcacgatgccctgattggcatgggcaaggcacggggaaggaaccaaacatgggacgagcatgaggcgtcctcagattttatctcccagctcaaaattaagaagaaaaaaatggcttcagaccaggagcaactcgcctctaaactggataaagccctcagccttactaagcaggacaagctaaagagtccttttaaattttcagattctgccggcgggaaatcgaagacttctggaggttgtggtcgatatctgaccccttacgattcgttgctcggcaagaatcgcaaggcactggccaaaggattgggactgtcattgaaaagttcaagagagggcaaacataaaagagccgccaagactcggaagatggaggtagggttcaaagcgcgcggacagcccaaatccgctcatagcccatttgcctctgaagtgagcagctattcttacaacaccgattccgaagaagacgaggagtttctgaaagatgagtggccagcgcagggcccttctagctccaagctgacacctagcctcctatgtagtatggtggcaaaaaacagtaaagctgctggtgggccaaagctcacgaagagaggcctggccgctcccaggactctgaagccgaagccggctacgagcagaaagcaacccttttgtcttcttcttagagaggcagaagccagaagcagctttagtgactcgtccgaggagagtttcgaccaagacgagtcatcagaggaggaagacgaggaggaggaactggaagaagaggatgaagcttccggagggggttatcgtcttggagcccgggaacgcgcactctctcctggcttggaggaaagcgggctaggtttgctggccaggtttgccgcgagcgctttgccaagcccaacagtgggaccatctctcagcgtggttcagcttgaagccaaacagaaggctagaaaaaaggaggagaggcagtcattgttagggacggagtttgagtacacagatagtgaatctgaggtaaaagtcaggaagagaagcccagccgggttgctgcggccaaagaaaggattgggagaacccggcccttcattggccgcaccaacacccggcgccaggggacccgacccgagtagccctgacaaggcaaagctggccgtcgagaaaggacgaaaggcccgcaaactccgcggcccaaaagagcccgggttcgaggcaggccccgaggcctccgatgatgatctttggacccgtaggcgtagtgagagaatattcttgcatgacgcctccgccgccgctccagctccagtatccacggcacctgccacaaaaacaagccgctgtgcaaagggggggccgttatccccaagaaaggatgctggccgtgctaaagaccggaaagaccccagaaaaaagaaaaaaggcaaagaggccggccccggcgcaggcctgccccctccccgagctcccgcattgccgtccgaagccagagccccacacgcatcctccctgaccgctgcaaaaaggagtaaagccaaagctaaaggcaaagaagtcaagaaagaaaatcgtggtaaaggaggagcggtcagtaagttgatggaatccatggcggctgaagaagactttgagcccaaccaggattcttcatttagcgaggacgagcatctgcctaggggaggcgcagtggagcggcctctgacacccgccccccgctcttgcatcatcgataaggacgaactgaaggacggcctgcgcgtgctcataccgatggatgacaagctcctttacgctgggcacgtgcagactgtacactctccagacatttaccgcgttgtggtggagggcgaaagaggaaataggccacacatatactgcttggagcaactgctgcaggaagctatcattgacgtgaggccagccagcacacgtttcctccctcaaggaacaagaatcgctgcatactggtcccaacaataccggtgtctatacccaggaaccgtcgtgcgcggactcctggacttggaggatgacggagatctgattacagtagagttcgacgatggcgacaccggccggataccactctcccatatcagactgttaccccccgattacaagatccagtgcgcagagcctagcccggccctactcgtgcccagtgcaaagagacgctcccggaagacctctaaggatacgggagaaggaaaggacggcggcacggcaggcagcgaggagccgggagccaaggcacgtggaaggggacgtaaaccctcagcgaaagccaagggcgatagagcagcgaccctggaggaaggaaacccaacggatgaggtgcctagtacaccactggcactcgagcctagctcgacccccgggtcaaagaaatcccccccagaacctgtagataagcgggccaaagctccaaaagcccggcccgccccaccccagccctctccagctcctcctgcgttcacatcctgtcctgctccggaaccttttgccgaactacccgctccagccacaagcctagcccctgcacccctgattactatgcccgcaaccagacctaagccaaaaaaggccagagccgcagaggaaagcggggccaaaggaccgcgccgccctggagaagaagcagagctcctggtaaagttagaccacgagggtgttacttccccaaaaagtaaaaaggcaaaggaggcccttctgctcagagaagaccccggagcaggtggctggcaggagcccaagtccttgctctctctgggcagctaccctcctgcagctggctcatccgagcccaaagccccttggcctaaggcaaccgacggagacttagcacaggagcccggccccggcctgacttttgaggatagcgggaatcctaaatccccggataaagcccaggcggaacaagatggagcagaagagagtgagagcagctccagttctagctctggctcctcttcgtcttccagtagcagttcttccagtggttctgagaccgaaggtgaagaggaaggcgacaagaacggtgatggcgggtgcgggactggaggaaggaactgcagcgcagcaagctcaagggctgcctccccggcttcttcctcatctagtagcagctctagtagtagctcctcaagcagctcctcctcctcgtcctcatcaagtagttcatcttcttcgagctcatcgtcttccagttcttcttcttcaagttctagtagctcttcttcgtcttcctcctcatcttcttccagctcctcttcttcgtcgaccactgacgaggattcctcatgtagctcagatgacgaggctgcccctgcgcctaccgcaggtccctccgctcaggctgccttgcccaccaaggccaccaaacaggccggaaaggcgcgcccaagcgctcactcccccggaaagaagacccccgccccccaacctcaggccccccccccccagcccacccaacccctgcaaccgaaagctcaggctggtgctaagtccaggccaaagaagcgggagggcgtccacctaccgacaacaaaggaactagctaagagacagcggttgccatcggtggagaacagacccaaaatcgcggctttcctccccgctaggcagttatggaagtggttcggcaaacctactcagagaagaggtatgaagggcaaagcacgcaagcttttttataaagctattgtccgcgggaaggaaatgattaggatcggcgattgtgccgttttcctgagcgctggccgtccaaacctgccctatatcgggagaattcaatctatgtgggagtcttggggaaataatatggtcgtgagagtgaagtggttctaccaccctgaagagacatcaccaggcaagcagtttcaccaaggacagcactgggaccagaagtcctccaggtcactgcctgcggccttgcgagtgagctcacaacgcaaggatttcatggaaagagcactgtaccagagctcacatgtggacgaaaacgatgtccagacggtctctcataagtgtctagtggtggggctcgagcagtacgagcagatgctgaagaccaagaaatatcaggattctgagggcctttattacttagccggtacttacgagcccaccaccgggatgattttctccacagacggggtgcctgtgctttgctag

SEQ ID NO: 34101 - DNA, 504 bp, Artificial Sequence
  Description of Artificial Sequence: Synthetic coding sequence
atgattaaggactgtggggcaacttgggtggtactcgggcattcagagaggcggcacgtatttggcgagtctgacgagctgattgggcaaaaagtcgctcacgctcttgccgagggattaggggtcatcgcttgtatcggagagaaacttgacgagagagaggcagggattactgagaaggtggtttttgagcagactaaggtcatcgcggataacgttaaggactggtcgaaggtggttctcgcctacgaacctgtgtgggccattggaactggcaaaacagccaccccacaacaagctcaagaggtgcatgagaagttgcggggatggttgaagtccaacgtttctgacgcggtggctcagtctactcgcataatttacggggggtctgtaactggcgctacgtgcaaggagctagccagccagcctgacgtcgatgggttcctcgttggcggggccagcctcaagcctgagttcgttgatataatcaatgccaaacaatag

SEQ ID NO: 34102 - DNA, 1398 bp, Artificial Sequence
  Description of Artificial Sequence: Synthetic coding sequence
atgcctgcaacacctagcctgaaagttgtgcatgaactcccagcctgcacgttgtgtgccggaccgttggaggatgccgtgaccattccctgcgggcatacgttttgtagactctgcttgcccgccctcagccagatgggagcccagagcagtgggaagatactgctttgtcctctttgtcaggaggaggagcaagctgagactccaatggccccagtgcctctgggacccctcggcgaaacgtactgcgaggagcacggcgaaaagatctacttcttctgcgagaacgatgccgaattcttgtgcgttttttgccgtgaggggcccactcatcaggcacacaccgtggggttcttggacgaggcaattcagccttatcgcgaccgccttcggtcgcgcttggaggcactgagcacagaacgcgatgagattgaggacgtcaaatgtcaggaggaccagaagctccaggtgctgctgacgcagattgagagcaagaaacaccaggtggagacagcctttgagaggctccagcaagaactcgagcagcagagatgcctgttgctcgcgcgcctgagagaattggaacaacaaatctggaaagaaagggatgaatacatcactaaagtcagcgaagaagtcacaaggctcggggcccaggtaaaagaactggaagagaagtgccaacagccagcttccgaactgctgcaggacgtaagagtcaatcagtcaagatgcgagatgaaaacttttgtatcccctgaagcaatctctccagaccttgtcaagaaaatacgcgacttccaccggaaaatcctcaccctccccgagatgatgagaatgttctccgaaaatctcgctcatcacttggagatcgactccggggtcattacattggacccccagacagcgagtcgttccctggtgctgtccgaggatcgcaagagtgtgagatatacccggcagaaaaagtccttgcctgacagtcctttgagattcgatgggctccccgctgtgctcggttttcctgggtttagtagtggccgccataggtggcaggtggatctgcagctgggagatggcggtggttgcactgtgggagtcgcaggtgaaggggtgaggagaaaaggcgaaatggggttgagcgccgaagacggcgtatgggcagtgatcatctctcaccagcagtgttgggcttctacctcaccagggaccgacctccccttatctgagatcccacgcggagtgagggtggcccttgactacgaggcaggtcaagtgacactgcataatgcccagacccaagaacccatattcacatttacagcgagcttcagcggcaaggtgtttccgtttttcgcggtttggaagaagggctcctgcctgacactcaaaggctag

SEQ ID NO: 34103 - DNA, 348 bp, Artificial Sequence
  Description of Artificial Sequence: Synthetic coding sequence
atgccagccaccccctctctcaaggtcgtgcatgaactgcctgcatgtactctgtgtgcaggcccgttggaagacgccgtgaccattccatgtggccatactttttgtagattatgcttgccagccttgagtcagatgggtgcccaaagctcagggaaaatattgctgtgccctctttgccaagaggaagaacaggctgagacccccatggcacccgtgccactgggtccattaggagaaacttactgcgaagagcacggtgaaaagatctactttttttgcgagaatgacgctgagtttctgtgtgtgtcagagtgccgcaccaccgacggatttggttgcgcatag

SEQ ID NO: 34104 - DNA, 1398 bp, Artificial Sequence
  Description of Artificial Sequence: Synthetic coding sequence
atgcccgccacaccatctttgaaggtggtgcacgaactcccggcttgtacattgtgtgccggtccacttgaggacgccgtgaccattccctgtggacacacgttttgccgcctgtgcctgccagcattgtcccagatgggagctcagtcatcaggcaagattctgctgtgtcccctgtgccaggaggaggagcaggccgaaacacccatggccccagtccccctcggaccgctgggagagacctactgcgaagagcacggagagaaaatttattttttttgcgagaatgacgcggagtttctgtgcgttttttgcagagaagggcctactcaccaggcacacacagttggcttcctcgatgaggccatccagccctatagagataggctgcggtcccgactggaggcccttagcaccgaacgcgatgagatagaggatgttaagtgccaggaggaccaaaaactacaggtgttgctgacgcagattgaatctaaaaagcaccaggtggaaaccgcattcgaacggctgcaacaggaattggagcagcagcggtgtctcctgctggccaggctcagagagctggagcaacaaatctggaaagagagggatgaatatatcactaaagtaagcgaagaggtgacacgcctgggagcccaggtaaaggagctcgaggaaaaatgccagcagcccgcatctgagcttctccaagacgtgagagtgaaccagagccggtgtgaaatgaagacgttcgtgagtcccgaggctatctctccggatctggttaagaagatccgtgattttcatcgaaaaattctgaccttgccagagatgatgaggatgtttagcgagaacctggctcatcatctcgaaattgactccggggtgataactctggacccccagactgctagtcgatccctcgtgttatcggaagatcgtaaaagtgtcagatatactagacagaagaagagcctcccagacagtcccctccgatttgatgggctccctgccgttcttggctttccaggcttttcctcagggcgtcataggtggcaagtcgatctgcagctgggagacggaggaggctgtaccgtgggtgtggctggtgagggagtccgacggaagggtgagatgggactctcagctgaggacggggtttgggctgtgattatcagccaccagcagtgctgggctagcacttccccaggcacagacctgcctctctccgaaatacctcgtggcgtgcgggtagccctcgactatgaagccggtcaagtgacccttcataatgcacaaacacaggagcccatattcacattcacagcatcattctctgggaaagtttttcctttttttgctgtgtggaagaagggaagttgtttgaccctcaagggctag

SEQ ID NO: 34105 - DNA, 1191 bp, Artificial Sequence
  Description of Artificial Sequence: Synthetic coding sequence
atggcaccggtgcctctgggtcctctaggcgagacatattgtgaagagcacggcgagaagatctactttttctgcgaaaatgatgcagaatttctatgcgtgttctgccgggagggcccaacccaccaagcccacactgtggggttcctggacgaagctatacagccttaccgcgatcggctcagaagcagacttgaagccctttctaccgagagagatgagatcgaggatgtaaagtgtcaagaagaccaaaagctccaggttctcctgacacagattgagtccaaaaaacatcaggttgaaactgcctttgagcggttgcaacaggaactggaacagcagcggtgcctgctcctcgcacgcttgagggaactcgagcaacagatatggaaggaacgggatgagtatatcaccaaagtgagcgaggaagtcaccaggctgggagcacaggtaaaggagctggaagaaaagtgccagcagcccgcgagcgaactgctgcaagtaattagagaaggcctgcatggctgcgaaatgaagactttcgtttcaccagaagccatctcccctgatcttgtaaaaaaaatcagagactttcatcggaagatcctgacgctgccagaaatgatgcgtatgttttcagagaaccttgcccatcacctggaaatcgacagcggagtaattactttggaccctcagactgcttcacggagcctggtgctttcagaggatcgaaagtcagtgcgttacactcgacagaagaagtctctgccagattccccacttcggttcgacgggctgccggcggtgcttggcttcccaggtttctcctctgggcgccatcgttggcaagtagacctccagcttggggacggcggcggatgcaccgtgggcgttgcaggcgaaggagtgaggcggaaaggagagatgggtctgtcagctgaggacggagtctgggccgtgatcatatctcatcagcagtgttgggcctcaacatcccccggcacagacctgccactctcagaaatccccaggggcgtgagggtggccctggactatgaggcaggacaggtcacacttcataacgcacaaactcaggagcctatctttacttttactgcctccttttccggtaaagtctttccttttttcgccgtgtggaagaaggggagttgtctcaccctgaagggctag

SEQ ID NO: 34106 - DNA, 1398 bp, Artificial Sequence
  Description of Artificial Sequence: Synthetic coding sequence
atgcccgcaaccccctccctgaaggtggtgcatgagctacctgcgtgcacactttgtgcggggccactagaggatgccgtgacaattccatgtgggcatacattttgtcggctttgtctacccgctctctcccaaatgggtgctcagtcctcgggcaaaattctgctctgtcccctgtgtcaggaggaagaacaggctgagaccccaatggccccagttcctttaggcccattaggcgagacatattgtgaggagcacggcgagaaaatttatttcttttgtgagaatgatgcggagtttctttgtgtgttctgcagagagggcccgacacaccaagcacacaccgtgggattcctggacgaggcaatacaaccctaccgcgaccgactcagatcgagacttgaggctctgtctactgagcgagatgaaatagaagatgtgaaatgtcaggaggatcagaaactacaggtgctgctgacccaaattgagagtaagaagcatcaagtagaaacagccttcgagagattacagcaggaattggagcagcagaggtgtcttctcctggctcgcctgagagagctcgagcaacaaatctggaaagagcgggatgagtacatcaccaaggtgtccgaagaggtcactcgattaggcgcacaagtgaaggagcttgaagagaagtgtcaacagccggcgagcgagcttttgcaggatgttagggtgaatcaaagtaggtgcgagatgaaaactttcgtgagccccgaagcgatttctcccgatctcgtgaaaaaaatacgcgactttcatcggaaaatcctaactctgcctgagatgatgcgaatgttctctgaaaatttagctcaccacctggaaatcgactctggtgtaattacactcgatccacagacagcctcaagaagcctggttctcagtgaagatagaaagtcagtgagatatactcgacagaaaaagtccctcccagacagtcccctgcgttttgatggattacctgccgtgctcggctttcccggtttttctagtggacggcacagatggcaggtggacctgcagcttggggacgggggcgggtgcacggtgggagtggctggtgaaggtgtgcggcgaaaaggcgagatggggttaagcgcagaagacggcgtgtgggctgtgatcattagtcatcagcagtgttgggccagtacatctccaggaactgacctgcctctgagtgaaatacctcgcggggtccgagtggccttggactatgaagcaggccaagtcacattgcataacgctcagactcaggagcctatctttacctttaccgccagcttcagtggcaaggtgtttccctttttcgctgtgtggaaaaaggggtcttgtctcaccctcaagggatag

SEQ ID NO: 34107 - DNA, 1398 bp, Artificial Sequence
  Description of Artificial Sequence: Synthetic coding sequence
atgccggcaacaccctccctgaaagtggtccacgagcttccagcctgtactctttgtgcaggtcctctggaagatgccgtgacaattccatgtgggcacactttttgccggttgtgcttgcccgcactgtctcagatgggggctcagtcttcaggaaagatcctgctgtgcccactgtgccaggaagaggagcaggctgaaacacccatggctcctgtccccttgggacctttgggggaaacatactgcgaagagcatggggaaaaaatttattttttctgcgagaacgacgctgaattcctgtgcgtgttctgtagggaaggcccaactcaccaggctcatactgtgggttttttggatgaagctattcagccatatagggacaggctgcggtctagactcgaagccctgagcacggagcgggacgaaatcgaggacgttaagtgccaggaagatcagaaactccaggtactgctcactcagattgagagcaaaaagcaccaggtggagacagcctttgaacggttacaacaggaactggagcagcagaggtgccttctgctcgctcggcttagggaactggagcagcagatctggaaggagcgggacgagtacattacaaaagttagcgaagaagttacaaggctgggggcccaagttaaagagctggaagagaagtgtcaacagcccgccagcgaactgctacaggatgtcagagtgaatcaaagcaggtgcgaaatgaagacattcgtgtcaccagaggcgatctctccagacttggtcaagaagattagagacttccatcggaaaattttaacgttgccagagatgatgcggatgttctccgagaatttggcacaccacctcgagatcgattcaggagtgattactctcgacccacagacggcctcacgctccctggtacttagcgaggatagaaaaagcgtgagatacaccaggcaaaagaagtccctgcctgactctcccctgcgctttgacggactccccgctgtactaggctttccagggttttcaagtggtcgacaccgttggcaggtcgatcttcaactcggcgatggcggaggctgcactgttggagtagcaggggaaggtgttagacgcaagggagaaatgggactctccgccgaggacggggtctgggctgttatcatttctcaccagcagtgttgggcttctacttcccctggaacagatctgccactctctgaaataccgcgcggggtgcgtgtggcccttgactacgaagcaggccaggtgaccctccataacgcccaaacccaagagcccatctttaccttcaccgcctccttcagcggtaaagttttccccttttttgctgtgtggaagaaaggctcgtgccttacactgaaaggatag

SEQ ID NO: 34108 - DNA, 495 bp, Artificial Sequence
  Description of Artificial Sequence: Synthetic coding sequence
tgaaaaaaacatcaggtggaaacggctttcgagcgcctacagcaggagctggaacagcaaagatgcttattgctggcaaggttacgagagctggagcaacagatctggaaggagcgcgatgagtatattaccaaggtgtctgaggaagtgacaaggcttggcgcacaggttaaggaattagaagaaaagtgtcagcagcccgcctcggagctactgcaggatgtgagggtgaatcaatcacggtgcgagatgaaaacttttgtctctcctgaggcaatctcacctgacctggttaaaaagatccgagactttcacaggaagattctcactctacctgagatgatgagaatgtttagtgagaacctggcccaccacctggagatcgactccgatcggcagcccgaacccggatccctgggccggcaggaggtcagcgaagtccatcctgctgaggaagaaccggcccggcagccacccgcacttagacgaccttag

SEQ ID NO: 34109 - DNA, 495 bp, Artificial Sequence
  Description of Artificial Sequence: Synthetic coding sequence
tagaagaagcatcaagtagagacagcttttgagagactgcagcaggagcttgaacagcagagatgcctgctgctggctcgccttcgggagttggaacaacaaatctggaaagagcgagacgaatatattacaaaggttagcgaagaagtcacaagactgggtgcccaggtgaaggagctcgaggagaagtgtcaacaacctgcttctgagctgctacaggacgtgcgtgtgaatcagtctcgctgtgagatgaaaactttcgtgagtcctgaagcaatcagccccgatctggtaaagaagatcagggattttcatagaaagatcctgacacttcccgaaatgatgcgaatgttttcagagaatctggctcaccatctggagatcgactctgacaggcagccagagcctgggagcctcggcaggcaggaagtttccgaggtgcaccccgctgaggaggagccagcccggcagccccccgcactccgacggccctag

SEQ ID NO: 34110 - DNA, 495 bp, Artificial Sequence
  Description of Artificial Sequence: Synthetic coding sequence
taaaagaaacaccaggtggagacagctttcgaaagactccagcaggagctggagcagcaacgctgcctgctgcttgcccgactgcgcgaactggagcagcagatttggaaagaaagagacgaatacatcactaaggttagtgaagaagttacacgactgggagcccaggtcaaggaattggaggagaaatgccagcagccagcgagtgagttacttcaggatgtcagagtgaaccagtcacggtgcgaaatgaagacatttgtgtctcccgaggcaatctcacccgatctggtgaagaaaattagagacttccatcggaagattctgacactgcctgaaatgatgagaatgtttagcgaaaatctggcccatcatcttgaaatcgattcagatcgccagccagagccaggcagcctgggccggcaagaggtaagcgaggtgcatcccgccgaagaagagccagctaggcagccacctgccctgcgtcgcccttag

SEQ ID NO: 34111 - DNA, 495 bp, Artificial Sequence
  Description of Artificial Sequence: Synthetic coding sequence
tgaaaaaagcaccaagtagagacagccttcgagaggctgcagcaagaacttgagcagcagaggtgtttacttctcgcacggttaagggaactggagcagcagatttggaaggagagggatgaatatatcaccaaagtcagcgaagaggtgacccgtctcggcgctcaggtgaaagaattggaagaaaagtgccagcagccagcgtctgaactactgcaggatgttcgtgtcaaccagagccggtgtgagatgaaaacattcgtgtcaccagaggcgataagtccggatctcgtgaaaaaaatcagggactttcatcgtaagatcctgaccttgcctgagatgatgcgtatgttcagcgagaatctagcgcatcacctggagatcgacagcgatcgccaacctgaacctggctctctgggcagacaggaagtctccgaagtgcaccccgccgaggaggagcccgcccgccagccaccggctctgaggaggccatag

SEQ ID NO: 34112 - DNA, 1398 bp, Artificial Sequence
  Description of Artificial Sequence: Synthetic coding sequence
atgcccgctactccttcacttaaggtggtgcacgagttaccggcctgcacgctgtgcgctggtccattggaggatgccgtcactataccctgtggccataccttttgccgactctgcctccccgcactttctcagatgggggcccaatcttctggcaagattcttctctgcccactgtgtcaggaagaggaacaagccgaaaccccaatggcacccgtacctctgggccccctcggagaaacatactgtgaggaacacggagagaagatctactttttttgtgagaatgatgctgaattcctgtgcgtgttttgccgcgaagggccaacccatcaagcacacacggtgggatttttagatgaagccatccagccatatagggaccgtctcaggagccgcctggaggctctttccactgagcgggatgagatcgaggatgtcaagtgccaggaagatcagaagctacaagttctgctgacgcagatagaatcaaagaagcatcaggtcgagacagcctttgagaggctgcagcaggagctggaacagcagcgttgtctattgctggcacggttacgtgaactggaacaacagatctggaaggagcgtgatgaatacatcactaaagtaagtgaggaagtgaccagactcggggcacaggtcaaagaactggaggagaagtgtcaacaacctgcctcagaactcctccaggatgtgcgtgtgaaccagagtcgttgtgagatgaagacattcgttagcccggaggccatttcccccgatttggtcaaaaagattcgcgattttcacaggaagatattgacacttcccgagatgatgcgtatgtttagcgagaatcttgcccaccacttagagatcgattccggcgtcattaccctggacccccaaaccgcatcacgcagcctggtcctatccgaagacaggaagtctgtgcgatacacacgacaaaaaaagtcactgcccgattcacctctacggttcgacgggctgccagccgtgctgggatttcctgggttctcatctggtaggcacaggtggcaagtggacctccagcttggagacggaggcggatgcaccgtgggcgtggcaggggagggtgtgcgaaggaagggcgaaatgggactgtcggccgaggacggtgtgtgggcagttataattagccaccaacaatgttgggcttcgacaagcccaggaacagaccttcccctttctgagatacctcgaggcgtgagggtggctctggactacgaggctggacaagtgacgttgcataatgcgcagacccaggagcctattttcacattcactgcaagtttttctggcaaagtctttccgtttttcgcagtctggaagaaagggagctgcctcacactgaaaggctag

SEQ ID NO: 34113 - DNA, 495 bp, Artificial Sequence
  Description of Artificial Sequence: Synthetic coding sequence
taaaaaaagcatcaggtggagaccgcatttgagaggttacaacaggaattagagcaacagcgttgtcttctcctggctcgcctccgggagctagaacagcagatatggaaggagcgggatgagtatatcactaaagtatctgaggaagtgaccaggctgggcgcccaggtgaaggagctggaagaaaagtgtcagcaacccgctagcgaactgctgcaggacgtgcgtgtcaaccaatcgaggtgcgagatgaagactttcgtgagccccgaggcaatttctcccgacctggttaaaaagatccgagactttcacagaaagatactcactttgcccgaaatgatgagaatgttcagtgaaaaccttgcccaccacctggaaatagatagcgatcgccagccagaaccaggctcactcggccggcaggaagtctccgaggtccaccctgccgaggaagagccagcccgacaaccaccagctctccggcggccttag

SEQ ID NO: 34114 - DNA, 1398 bp, Artificial Sequence
  Description of Artificial Sequence: Synthetic coding sequence
atgcccgcaactccctcgctgaaggtcgtgcatgagctgcctgcatgcactctctgtgccgggccgttagaggacgccgtcaccatcccttgtggccacaccttctgtaggctctgtctgccagctctttcgcagatgggggcccagtcctccggtaaaattctgctctgccccctgtgccaggaagaggaacaggccgagactcctatggcccctgtgcctctgggtccgctgggagagacctactgcgaagaacacggagagaaaatttatttcttctgcgagaacgatgccgagttcttatgcgtcttttgtagagagggcccaacacaccaggcccacaccgtgggatttctggatgaggccatccagccctacagagatcgtcttcggtcccgtctggaggccctctcaactgagcgcgatgagatcgaagacgtgaaatgccaggaggaccaaaagctacaggtacttctcactcaaattgaatccaagaaacatcaagtagaaacagcctttgagagattacagcaggagcttgaacaacaaaggtgcttgcttttggcgagattaagagagctcgagcagcagatttggaaggaaagagacgaatacattactaaagtatctgaggaagtgaccaggctgggtgcccaggtcaaggagctcgaagagaaatgccaacaacccgcaagcgagcttctgcaagatgtccgcgtgaaccagtcacgctgcgaaatgaaaaccttcgtgtcccctgaggcgatatcccctgacctcgtaaagaagatcagggattttcacaggaagatcttaactctccctgagatgatgaggatgttctcagaaaatctggcccatcatttggagattgactctggggtgattacccttgaccctcagactgccagccgcagcctcgttcttagtgaagaccgtaagagtgtgcggtataccagacagaaaaagaacctccccgactcccccttgaggttcgacggtctgccagctgtgttagggtttccagggttcagcagcggtcgacacaggtggcaagtcgatttacagctgggcgatggcggtgggtgcactgtgggagtagctggggaaggcgtcagacgcaaaggtgagatgggtctgtccgcagaagatggcgtttgggcggtcatcatttcgcaccagcagtgttgggccagtacatcacctggtactgacctgcctctcagcgaaatcccacgcggcgttcgggtcgccctggattacgaagcagggcaggtgacactgcacaacgcccagacccaggaacctatcttcacgtttactgcctcattcagcggaaaagttttccctttctttgcagtttggaaaaaaggttcgtgcctgaccctgaaaggttag

SEQ ID NO: 34115 - DNA, 1398 bp, Artificial Sequence
  Description of Artificial Sequence: Synthetic coding sequence
atgcccgctacaccctccttgaaggtggtacatgagctgccggcctgcaccctttgcgcggggccattggaagatgccgtgaccattccctgcgggcacacattttgtaggctttgcctgccagcactgtcccagatgggagctcagagcagtggcaaaattctgctttgtccgctgtgccaggaagaggagcaagcggagacgcccatggcccccgtgcctctggggcctctgggtgaaacctattgcgaggagcatggcgagaagatttatttcttctgtgagaacgacgcagagttcctctgtgtcttttgccgcgagggccccacacaccaagcacacacagtaggcttcctggacgaagccatccagccgtatcgcgatcggctgagatccagactggaggccctctctactgagagggatgaaatagaagatgttaagtgtcaggaggatcagaaacttcaggtgctgttgacccaaatagaatcaaagaaacatcaggtggagaccgcctttgaaagattacagcaggaactggagcagcaaaggtgtctcttgctggctcgtttacgggagctcgagcaacagatttggaaagaaagagacgagtacatcaccaaagtctcagaggaagttacacgcttaggagcccaggtcaaggagctggaggaaaagtgccagcaacccgcaagcgaactccttcaggatgtcagagtgaatcagtctagatgtgaaatgaaaacgtttgtgtcacctgaggcgatctcccccgatttagttaagaagatccgggattttcatagaaaaattctgaccctgccagagatgatgcgtatgttcagcgaaaacctagctcatcatctggagatcgacagcggcgttatcacactggatccccagaccgcgagcagaagtcttgtcttgtcagaagataggaaaagtgtcaggtatacccgccagaagaagaacctacctgatagcccgctccgctttgatggtctgccggctgtacttgggtttcctggattctccagcgggagacaccggtggcaggtcgaccttcagctgggagatgggggtgggtgcaccgtgggggttgctggcgagggggtacgacgcaagggggagatgggtttaagcgctgaggacggagtctgggctgtgataatttcacatcaacaatgttgggcctctactagtccgggcacagaccttccactcagtgagatcccaaggggggtccgagtggcactcgattacgaagccggacaagtcaccctccacaacgcccagacccaggaaccaatatttacctttactgcttccttttctgggaaagtgttccctttcttcgcagtttggaaaaagggatcatgcttaaccctcaaggggtag

SEQ ID NO: 34116 - DNA, 1398 bp, Artificial Sequence
  Description of Artificial Sequence: Synthetic coding sequence
atgcctgcaacacccagtcttaaggtggtgcacgaactccccgcgtgcaccttgtgcgctgggcctctggaggatgcggttaccatcccctgtgggcataccttctgtagactttgcctacccgcactgagtcaaatgggagcccagtcttccgggaaaatactgctttgccctctatgtcaagaggaggagcaggccgagactcccatggccccggtcccactgggaccactgggggaaacatattgtgaagaacacggggagaagatttacttcttctgtgagaacgatgcggagttcctgtgcgtgttttgtagagagggccccacccaccaggcacatacagttggttttctcgacgaagctatccagccttatcgcgatcggctgcgttctcgcctggaggccctctctacagaacgcgacgaaattgaagacgtcaaatgtcaggaagatcaaaaattacaagtgttattgactcagattgagagcaaaaagcaccaggttgaaactgccttcgaacggctgcagcaagaattagagcagcagcgctgccttctccttgccaggttaagggagcttgaacagcaaatctggaaggaaagggacgagtacataacaaaagtgtcagaggaggtgacacgcctcggagcccaggttaaggagctggaagaaaaatgtcaacagccagcctccgagctcctgcaggatgttcgtgtgaaccaatcacgctgtgagatgaagacgttcgtgtcaccggaagcgatatctcccgacttggtgaagaaaattagagatttccacagaaaaatcctcactctcccagaaatgatgagaatgtttagtgaaaacctcgcccatcacctggagattgacagcggcgtcatcaccttagatccgcagaccgcaagccgtagcctcgtgctgagcgaggatcgcaagagcgtccggtacaccaggcagaaaaagtctttgcccgattccccgctgagatttgacgggctgcctgcagtgctgggctttcccggattcagctccggtaggcacaggtggcaagtcgatctgcagcttggtgatggcggcggctgcaccgtgggggtggctggtgaaggagttagacgcaagggcgagatgggactgagcgctgaggacggggtttgggccgtgatcatcagccaccagcaatgctgggcctccaccagcccgggtactgacctgcccttatccgaaattcctaggggcgtgagagtggccctggattacgaagctggtcaagtcacgctgcacaacgcccagacacaggaacccatttttacctttacagctagcttttccgggaaagtgttccctttctttgctgtgtggaaaaagggaagttgcctgacccttaagggttag

SEQ ID NO: 34117 - DNA, 495 bp, Artificial Sequence
  Description of Artificial Sequence: Synthetic coding sequence
tgaaaaaagcaccaggtggagaccgctttcgaaagattgcagcaggagctcgaacagcagagatgcttgctcctggccagactccgtgagctagagcaacaaatctggaaagagagggacgagtatatcacaaaagtgagcgaagaggtaacccggttgggagcacaggtgaaagagctggaagagaaatgtcagcagccggcctccgagttgttgcaggacgttagagtaaaccaaagccggtgcgagatgaagacatttgtgtctccagaagccatatcgcctgatctggtgaagaaaatccgtgatttccacaggaaaatcctgactctgccggaaatgatgcgaatgttttcggagaacttagcacaccatttagagatagactcagaccgccagcccgaaccaggttctctggggcgacaggaagtctccgaggtgcacccggcagaggaggagcctgcgcggcagcccccggccctgcgacggccttag

SEQ ID NO: 34118 - DNA, 495 bp, Artificial Sequence
  Description of Artificial Sequence: Synthetic coding sequence
tgaaaaaaacaccaagtggagacggcttttgagcggctccagcaggaactggaacagcaaaggtgccttctgctagcacgcctgcgcgagctggaacagcagatatggaaggaacgcgatgagtatataaccaaagtgtcagaagaggtaacaaggctgggagcgcaggtcaaggaattagaggagaaatgtcagcaacccgcttccgagctgcttcaggacgttagggtgaaccaaagccggtgtgagatgaaaactttcgtgagcccggaggctatctcacccgatttggtaaaaaagataagggacttccacaggaaaatcttaacccttcccgaaatgatgagaatgttttctgagaacctcgcccatcatctagagatcgattccgacaggcagcctgagccagggtccctgggcagacaggaagtcagtgaggtacaccctgccgaagaagagccagctagacagccacccgcccttcgaaggccgtag

SEQ ID NO: 34119 - DNA, 495 bp, Artificial Sequence
  Description of Artificial Sequence: Synthetic coding sequence
tagaaaaaacaccaggtggagacggcatttgaacgactgcaacaggagctagagcagcagcggtgtctgctccttgcccgtctgcgggaactagaacagcagatttggaaggaacgcgacgagtatattactaaggtgtctgaggaagtcacccgcctcggcgcccaggttaaggaactcgaggaaaagtgtcagcagccagcctcggagctgctgcaagatgtgagggtgaaccaaagtagatgtgagatgaaaaccttcgtgtctccagaggccatttctccggatctggtaaaaaagatccgggacttccataggaagatcttaactttgcccgagatgatgcgcatgttctctgaaaacctagcacaccacctggaaattgactccgatcggcaaccagagcctggaagcctgggccgccaagaagtgtcggaagtgcacccggcagaagaggaacccgcgcggcagcctcccgccctgcgtaggccctag

SEQ ID NO: 34120 - DNA, 1191 bp, Artificial Sequence
  Description of Artificial Sequence: Synthetic coding sequence
atggctcctgttccattggggccactgggagaaacctactgcgaggaacacggtgagaagatttacttcttttgcgaaaacgatgctgaatttctttgcgtattctgtcgcgagggccctacccaccaggcacacactgtcggttttctcgacgaagccatccagccttatcgcgaccggttacggtctcggctcgaggcgctaagtaccgaacgggacgaaatcgaagatgtgaagtgccaggaagaccagaagctgcaagttctgttaacgcagatagaaagtaagaaacatcaggtggagactgcatttgagcggctacaacaggaactggaacaacagcggtgcctgctactcgctaggttgagagagctcgaacagcagatttggaaggagcgagatgagtacataacgaaggtgagtgaagaagtgacaaggctcggggcccaggttaaagaactggaggaaaagtgccagcagcccgcctctgaattactccaagtgatcagggaggggctccacggctgtgaaatgaaaacattcgtctcacccgaggctatctctccagatctagtgaagaaaatcagagattttcaccgcaagattctgaccctacctgagatgatgaggatgttttccgaaaatttggcccaccacctcgaaatcgattccggtgtcattaccctggatcctcagacagcatcccggagcttggtactgtccgaggatcgtaaatctgtgcgatacacgaggcagaagaagaacctccctgattctcctcttagatttgatgggctgccagcggtattgggattccctggcttctcgagtggcagacaccggtggcaagtggatctacagcttggagacggtgggggctgtacagtgggtgtggccggcgagggcgtccgtaggaaaggcgaaatggggctatcagccgaagatggagtttgggctgttatcatatcccatcagcagtgctgggcctcaacttctcccggtaccgacttgcctctgagcgaaatcccgaggggggtgcgcgtcgccttggactacgaggcggggcaggtgactctccataacgcacagacccaggaacccatcttcaccttcacagccagtttttccggtaaagtctttcctttctttgcggtgtggaagaagggaagctgtctcactttaaaagggtag

SEQ ID NO: 34121 - DNA, 348 bp, Artificial Sequence
  Description of Artificial Sequence: Synthetic coding sequence
atgcccgcgaccccaagcctcaaagtggtccatgagcttccagcctgtaccctgtgtgctggtccactggaagatgcagtaaccataccgtgcggacacactttctgtagactctgcctgccagccctgagccaaatgggcgcccagtccagtgggaagattctcctatgtcccctgtgccaggaagaagagcaggccgagacccccatggccccggttccactcggaccacttggagagacctactgcgaggaacatggagagaaaatctatttcttttgcgaaaacgacgcggaattcctctgcgtcagcgaatgtcggaccacagatggcttcgggtgcgcgtag

SEQ ID NO: 34122 - DNA, 348 bp, Artificial Sequence
  Description of Artificial Sequence: Synthetic coding sequence
atgcccgctaccccctcccttaaagtcgttcacgaactgcctgcctgtaccttgtgtgccggacccctagaggacgccgttactattccttgcggccataccttctgcagactgtgtttgccagccctctctcaaatgggtgcccagagcagtggcaagatcttgctctgccccctctgccaggaagaagagcaagctgagacccctatggctcctgttcctctcggacccttaggtgagacatattgtgaggagcatggtgaaaagatttattttttctgtgaaaacgatgcagagtttctgtgcgtcagtgagtgtcggactacagatggcttcggctgcgcgtag

SEQ ID NO: 34123 - DNA, 1191 bp, Artificial Sequence
  Description of Artificial Sequence: Synthetic coding sequence
atggctcctgtccctctgggtcccttgggtgaaacctattgtgaggagcacggcgaaaaaatatacttcttttgcgagaatgacgccgagttcctctgtgtattctgcagggagggtcctacccaccaagcccacacggtgggtttcttggatgaagccattcaaccatatagagaccggctccggtccaggctagaagcgctcagcactgaaagggacgaaatagaggatgtcaagtgtcaggaggatcaaaagctgcaggtactgctgacacagatagagtcgaaaaaacatcaggtcgagactgccttcgagcgcctgcaacaggaattagagcagcaaagatgtttactgctagcaagactccgtgaactggagcagcagatttggaaagagagagatgagtacattactaaagttagtgaagaggttacacgcctaggtgctcaagtgaaggaactggaggaaaagtgccagcaaccagcgtccgaactcctccaggtgatccgagagggtctccacggatgcgaaatgaagacattcgtgtctccagaggccattagccccgacttagttaagaaaattagggactttcatcgcaaaattctgaccctgcccgaaatgatgaggatgttctcagagaatctcgcccatcacctggagatcgatagtggggtgattactttagacccacagacagcgtcaagatcactggtcctgtccgaagaccgcaagagtgtcagatacacacggcagaaaaagtctctccccgattctcccctgcgtttcgacggactacccgccgtgctgggtttcccaggattcagcagcgggagacacagatggcaggtggatttacagttaggcgacgggggagggtgcaccgtaggggtcgcaggtgagggcgtgcgaaggaagggtgagatggggctgtccgcggaggatggagtctgggccgttatcatatcacaccagcagtgctgggccagcactagtcccggtacagatcttccccttagtgagataccaagaggtgtgagggtggctctggactacgaggctgggcaagtaacgttacacaacgctcagacacaagaacctattttcacattcaccgcgagctttagcggcaaagtgtttccatttttcgcagtttggaagaagggatcctgtcttacactcaagggctag

SEQ ID NO: 34124 - DNA, 1191 bp, Artificial Sequence
  Description of Artificial Sequence: Synthetic coding sequence
atggcccccgtccccctgggaccactgggcgagacttactgtgaggagcatggcgagaaaatttatttcttttgtgagaacgatgctgaatttttgtgtgtgttctgccgtgagggacctactcaccaggcgcacacagtgggcttcttggatgaggccatacagccttacagggatcgattacgctcccgcttagaggctttgagcacagaaagggacgagatcgaagatgttaagtgtcaggaggaccagaagttgcaagtcctgctgacacagatcgaatctaagaagcatcaggttgagacggcttttgagagacttcagcaggagctggagcagcagcgctgtctacttctggcacgtctgcgggaattggagcagcagatctggaaggagagagacgagtacatcaccaaagtgagcgaggaggtcactaggcttggtgcccaggtgaaggaactcgaagaaaaatgtcagcagcccgcctctgaactgctccaagtgatccgtgaggggctgcacgggtgcgaaatgaagactttcgtctcacccgaggcaatcagccccgatctcgtgaagaaaattcgggacttccatcgcaagatactgacgctgcctgaaatgatgaggatgttcagcgagaacttagctcaccacttagaaattgattcaggcgtaattacgctggatccccagaccgcatctcgctcactggtactctcagaagatcggaagagcgtccgttacacccggcagaaaaagtccctccccgacagcccattaagattcgacggccttccagccgtcctgggctttccaggattctcctcaggacgacatcgctggcaggtggatctgcagttgggggacggtggcggatgcacggtgggcgtggccggcgaaggagtgcggcggaagggggaaatgggcttgagtgccgaggacggagtatgggccgtgatcattagtcaccagcaatgctgggcaagcacatcacccggtaccgacctgccattgagcgagatccctagaggggtgcgcgtggccttagactatgaagctgggcaggtcacactccataatgctcaaacccaggaacctatcttcacattcacagcttccttttcaggaaaagtgtttcccttcttcgctgtgtggaagaagggttcttgtctcaccctgaaagggtag

SEQ ID NO: 34125 - DNA, 348 bp, Artificial Sequence
  Description of Artificial Sequence: Synthetic coding sequence
atgccagccacaccgtcactgaaggtggtccatgagctgcctgcctgcaccctttgcgcaggccctctggaagatgccgtgacaatcccctgtggtcatactttttgtagactgtgcttgcccgcccttagtcaaatgggagcccagagtagcggtaagatacttctctgccccctatgtcaggaagaagagcaggcagagacacccatggctcccgtgcccttgggtcccctcggggaaacttattgtgaggagcacggggagaagatttactttttttgtgagaatgatgcggagtttctgtgcgtgtctgagtgcagaacgaccgatgggtttggttgcgcctag

SEQ ID NO: 34126 - DNA, 348 bp, Artificial Sequence
  Description of Artificial Sequence: Synthetic coding sequence
atgcccgccacaccctccctgaaagtcgtgcatgagttaccagcgtgtaccctttgcgccgggcccctagaagatgccgttacgatcccctgtggccataccttttgtcggctctgtctgcctgccctctcccagatgggtgcgcagagctctggtaaaatcctgctgtgtccactgtgtcaggaggaggaacaagcagagactccaatggcgcccgtcccattggggccgctcggcgaaacatattgtgaagagcatggagagaaaatctactttttctgtgaaaatgatgctgagttcctgtgcgtgtccgagtgccgaaccaccgatgggtttgggtgtgcttag

SEQ ID NO: 34127 - DNA, 1191 bp, Artificial Sequence
  Description of Artificial Sequence: Synthetic coding sequence
atggcaccagtgcccctggggccactgggagagacctactgcgaagagcacggtgagaagatttattttttctgcgagaatgatgctgagtttctctgtgtcttctgtagggaaggccccacacaccaggctcatacagttgggttcctcgacgaagccatacagccttatagagaccgtttgagatctagattagaagccctgtctacggaaagggatgagattgaggatgtcaagtgtcaggaagaccaaaaactccaagtgttgttgacacagatcgagtccaaaaaacatcaggtcgaaaccgcctttgaaaggctgcagcaggaattggagcagcagaggtgtcttctgctcgccagacttcgcgagttggaacagcagatatggaaggaaagggacgagtatatcacaaaggtgtcagaagaggtgacaagactgggggctcaagtgaaagagctcgaggaaaagtgccaacagcctgcttctgagttactgcaggtcattcgggaggggttgcacggatgcgagatgaaaaccttcgtaagcccagaggctatctcccctgatctggtgaaaaagatccgggactttcaccggaagatcttaaccctgccagagatgatgcggatgttctccgaaaacctggcccatcaccttgaaatagactccggggtaatcactctggatccccagactgctagccggtcactagtactgtccgaagacaggaaatcagtacggtacacaagacagaaaaagagtttaccagacagccctctgcgcttcgacggcctcccggcggtcctgggattccctggattctcctccggtcgacaccgatggcaggttgacctccaactcggagatggagggggatgtactgtaggggttgcgggcgaaggcgttaggcgtaaaggagagatggggctgtccgcagaagacggggtctgggccgtaataatctcccatcagcagtgttgggctagcacgtctcccggaactgatctgccccttagtgagatcccaaggggtgtccgggtagctcttgactatgaggcaggccaggtgactctccacaatgcacagacgcaagagccgatttttacctttactgcctccttttcagggaaagtgttcccattctttgctgtgtggaagaagggctcttgtctgactttgaagggctag

SEQ ID NO: 34128 - DNA, 1191 bp, Artificial Sequence
  Description of Artificial Sequence: Synthetic coding sequence
atggccccggtacccctgggacccttgggagagacatactgtgaggaacacggggaaaaaatttatttcttctgtgagaacgacgcagagtttttatgtgtcttctgccgagaaggaccaacacatcaggcccacaccgttgggttcttggacgaggctatccagccttaccgagaccgcttgaggtctaggctggaggcgctgagcacagaaagggacgagattgaggacgttaagtgtcaggaagatcagaaacttcaagtgctactgacccagattgagtcaaagaaacaccaggtggagactgccttcgaacggctacagcaggagctagagcagcagcggtgcctactcttggccaggctgagagagctggagcaacagatttggaaagagcgcgatgagtacatcactaaggtgtcagaagaggtcacccgcttaggggcgcaggtgaaagagctcgaggaaaaatgtcagcaaccagcttcggagctgctgcaagttattcgggagggtctgcacggctgtgaaatgaagacatttgtgtccccagaagctatctcacctgacctggttaaaaagattagggacttccaccgcaaaatcctgactctcccagaaatgatgcgaatgttttctgagaatctggcccaccacctcgaaattgacagtggtgtcattacactggacccacaaactgcctcacggtcactggtgctttccgaggacagaaagagtgtcaggtatactagacaaaagaagaaccttccagactctccactacggttcgacggcctcccggcagtactgggttttccaggctttagctccggtaggcatcgctggcaggtggatctccagctcggcgacggcggtggatgcacagtcggcgttgccggcgaaggggtacgaaggaagggtgaaatgggtctctctgcggaagacggcgtctgggcagtgattatcagtcatcaacagtgctgggcctctactagcccgggcacagacctccccctttctgagataccacgtggagtgagagttgctttagattatgaggcaggtcaggttactcttcacaatgcccagactcaggaaccaatctttactttcacagcatcttttagtggaaaggtgtttccatttttcgctgtttggaagaaaggctcatgcctcacactcaagggctag

SEQ ID NO: 34129 - DNA, 1191 bp, Artificial Sequence
  Description of Artificial Sequence: Synthetic coding sequence
atggcccccgttcccctaggacctttgggggagacctactgcgaggagcatggagagaagatctatttcttctgtgagaacgatgccgagttcctctgtgtcttttgtcgcgagggccccactcaccaggctcacacagtcggttttctcgatgaggcgatccagccgtatagagaccgattaagatcacggctggaggccctgtcaaccgagagggatgaaatcgaagacgtgaagtgccaggaagaccagaaacttcaggtgctgttgacccagatcgaatccaaaaaacatcaggtggaaacagcattcgaacgcctccagcaggaactggagcagcagcggtgtctgcttctggcgcggctcagagagctggagcaacaaatctggaaggaaagggatgaatacattaccaaggtttcggaagaggtcacaagattgggcgcacaggtcaaagagttggaggaaaagtgtcagcagcccgcatccgaactgcttcaagtcattcgggagggtctgcacggatgtgagatgaagaccttcgtgagtccagaagctatttccccggacctcgtaaaaaagattagagatttccacaggaagattcttactcttccggaaatgatgcggatgttctctgagaacctagctcatcatctagagatagatagcggagtgatcacactcgacccacagacagcctcacgttcccttgtattgagcgaagacaggaaatccgtgcgatacactaggcagaagaaaagtctcccagattcacccttacgattcgacggactgccagccgtacttggtttccccggctttagttccgggagacacagatggcaggtcgacttgcagctgggggacggcggagggtgtacagtcggcgtggcaggcgagggggtccgaagaaagggagagatggggcttagcgccgaggatggggtgtgggccgtaatcatttcccaccaacagtgttgggcgagcacctcccctgggaccgatctgccactgtccgagattccgaggggggtaagagtagctctagattacgaagccgggcaagtgacgctgcacaatgctcagacccaggagccaatttttacttttacagcttccttctccggaaaagtgttccctttttttgccgtgtggaagaagggctcatgtctgactctgaaaggatag

SEQ ID NO: 34130 - DNA, 348 bp, Artificial Sequence
  Description of Artificial Sequence: Synthetic coding sequence
atgccagccactccctctctgaaagtcgtgcatgagctgccagcctgtacactttgcgcaggcccattagaagatgctgtgacaatcccctgtggccacacattttgtagactgtgtctccccgcgctgagtcagatgggcgcacaaagctctggcaagatcttgctgtgtccactctgccaggaggaggagcaggccgagacacccatggccccagtccctttgggtccccttggagagacatattgtgaggagcacggagaaaaaatctacttcttctgcgagaatgatgccgaatttctctgtgtttctgagtgccggactacagacgggtttggttgcgcctag

SEQ ID NO: 34131 - DNA, 1191 bp, Artificial Sequence
  Description of Artificial Sequence: Synthetic coding sequence
atggctccagtgcccctgggtcccctgggcgaaacttactgtgaggagcatggtgaaaaaatttacttcttctgtgagaacgatgcggaattcctgtgtgtcttctgccgggagggccccacgcatcaggctcatacagtgggattcctggatgaagccatccagccctacagagaccggctgcgcagtagactggaggccctgagcacagaacgagatgagatagaggacgtgaaatgtcaggaagatcagaaattacaggtcctgcttacccaaatcgaaagcaaaaagcatcaagttgagaccgcattcgagaggctgcagcaagaactcgagcagcagagatgtctactccttgcccggttaagggaacttgaacagcagatatggaaggagagggacgaatacatcacgaaagtctctgaggaggtcacccgtttgggcgctcaggttaaagaactggaggagaagtgccaacagcctgcgagtgagcttctgcaggtaattcgggaaggattacacgggtgcgagatgaagacatttgtctcccctgaagccatttctcctgatttggtgaaaaagatcagagattttcaccgcaagatcttaactttaccagagatgatgcggatgttcagtgaaaatctcgcccatcacctcgagatcgattctggtgtgatcacactggacccacagacagcgtctcgtagcttagtgctgtccgaggatcgcaaatcggtgcgttacacaagacagaagaaatcccttcccgacagcccgctgagattcgacggtttgcccgccgttcttgggtttccaggatttagtagcggtcggcatcgctggcaggttgatcttcagctaggagatgggggcggatgcacggtgggtgtggccggggagggagtgagacgaaagggcgagatgggcctcagtgcggaggatggcgtgtgggccgtaattatctcccatcaacaatgttgggccagcacttcacccggaaccgacctgccgctttccgaaatcccaagaggggtgagggttgccctcgactatgaggcgggacaggtgaccctgcataacgctcagacccaggaaccaattttcaccttcactgcctctttctctggcaaggtgtttcctttttttgcagtctggaaaaaaggttcctgcctgactctgaagggttag

SEQ ID NO: 34132 - DNA, 348 bp, Artificial Sequence
  Description of Artificial Sequence: Synthetic coding sequence
atgccagccaccccaagccttaaggttgttcatgaactgcccgcatgcactctttgcgctggccctttggaagatgccgtgacaatcccctgcggacacacgttctgcaggctctgtctgcccgccctgtcccagatgggcgcccaatcaagcggcaaaatcctgttatgccccttgtgccaggaggaggagcaggcagagacgccgatggcaccggtcccactaggtcccttaggcgaaacttactgcgaagagcacggcgagaaaatttactttttctgtgagaacgacgctgagttcctgtgtgtgtcggagtgtcgtacgactgatggcttcggatgtgcgtag

SEQ ID NO: 34133 - DNA, 348 bp, Artificial Sequence
  Description of Artificial Sequence: Synthetic coding sequence
atgcccgccacgccgtcactgaaagtcgtccacgaactgcccgcttgcaccctgtgcgcgggccctctcgaggatgccgttaccatcccttgcggccatacattttgtcggttgtgtcttcccgccttgtcgcaaatgggagcgcagtcgtcgggaaagatcctcttatgccccttgtgtcaggaagaagagcaggccgaaaccccaatggcccccgtgcctcttgggcccctaggggagacttattgcgaagagcacggcgagaagatctacttcttttgcgagaatgacgctgaattcctgtgcgtctcggaatgtcggacaaccgacggctttggctgcgcctag

SEQ ID NO: 34134 - DNA, 1434 bp, Artificial Sequence
  Description of Artificial Sequence: Synthetic coding sequence
atggaggctgttgaactagccaggaaacttcaggaggaggcaacttgtagtatctgcctggattacttcactgaccctgtcatgacaacttgcggtcacaacttttgcagagcctgcatacagttgtcctgggagaaagcaaggggaaagaaagggcgacgcaaaagaaagggttcctttccctgcccagagtgccgagaaatgtcaccacaaaggaatcttttgcctaaccgtctgctcacaaaggttgccgagatggctcagcagcatcctgggctgcagaagcaggacctatgccaggagcaccatgagcctctcaaactgttctgtcaaaaagaccagagcccaatctgcgtagtttgcagggagtcccgcgaacacagactgcaccgcgtcctgcccgccgaggaggccgttcagggctataaactgaaattggaggaagacatggagtacctacgcgaacagattaccaggaccggcaacctgcaagcaagagaagagcagagcctcgccgaatggcaggggaaggtcaaagaaagaagagagcgcatagtactggagttcgagaaaatgaatctctatcttgtggaggaggagcagaggctgttgcaagccctagagactgaggaggaggagacagcaagtcggctgcgcgaaagtgtcgcctgtctggatcggcagggccactctctagagttactcctgctgcagctcgaggagcgcagcacgcaagggcccctgcagatgctgcaggacatgaaggagccactctcacgaaagaacaatgttagtgtgcagtgcccggaggttgcaccccccaccagacctcgcactgtttgccgcgtgcctggccaaatcgaggttttgaggggctttctagaggatgtggtccctgacgccactagtgcatacccataccttctgctgtatgaaagtaggcaaagacgttacttaggttcctcacccgagggcagcgggttttgcagtaaggataggtttgtggcctacccttgtgccgtcgggcagacagcttttagcagcggccgccattactgggaagtgggtatgaacatcacaggagacgccctttgggccctgggagtctgtcgggataacgtcagccgcaaggaccgagtcccgaagtgtccagagaatgggttctgggtagtccagctcagtaagggcaccaagtacctgagcacattctctgctttgacccctgtcatgttaatggagccaccctcccacatgggaattttcctcgacttcgaagcaggcgaggtgtcattttactccgtcagcgatggatcccatcttcacacatattctcaggcaaccttccctgggcctttacaaccattcttctgtctgggggccccgaagtcaggtcagatggtgatcagcactgtcacaatgtgggtgaagggatag

SEQ ID NO: 34135 - DNA, 528 bp, Artificial Sequence
  Description of Artificial Sequence: Synthetic coding sequence
atggaagcagttgagctggctagaaaattgcaggaggaagcgacgtgcagcatatgcctggattattttaccgatcctgtgatgactacttgcggtcataacttctgccgcgcatgtattcagttgtcatgggaaaaggccaggggcaaaaaggggcggcgaaagaggaagggatctttcccttgtccagagtgcagagagatgtcaccacagcgaaatctcctgccgaatagattattaacaaaggtggccgagatggctcaacagcacccaggtctccagaagcaggatctctgccaggaacaccacgagcccctgaagctgttttgccagaaagaccagagccctatatgtgtagtgtgcagagagtctcgggaacaccggctccatagagtgttgcctgcagaagaagccgtacaaggctacaagctgaagcttgaggaagacatggaatatcttcgggaacagattacccgcacaggcaatctgcaagccagggaggagcagtcactcgcagaatggcaatag

SEQ ID NO: 34136 - DNA, 1434 bp, Artificial Sequence
  Description of Artificial Sequence: Synthetic coding sequence
atggaagccgtggagcttgcgcgcaaactccaggaagaggccacatgcagcatatgcttagattatttcactgacccggtgatgacaacctgtggccacaacttttgccgcgcttgcattcaactaagctgggagaaggctagaggcaagaagggacgaaggaaaagaaagggcagcttcccctgcccagagtgccgggaaatgtccccacagaggaatcttctacccaacagactgctgactaaggtcgctgaaatggcccagcaacaccctgggctccagaaacaggacctgtgccaggagcatcatgagcctctgaagctgttctgccagaaggatcagtcgccgatctgcgtcgtttgccgcgaatctagagaacacaggctgcatagggtgttgccagccgaagaggctgtgcaaggctacaagcttaagctcgaagaagatatggagtacctccgcgaacagatcacacgaaccgggaacctccaagctcgggaggagcagagccttgctgagtggcagggtaaagtgaaggaaagacgtgagcgcattgtactcgagttcgaaaaaatgaacctgtacctcgtcgaagaggagcagcgactcctccaggccctggaaaccgaggaggaggagaccgcctcgcgacttagggaatccgttgcctgtcttgaccggcagggccattcactggagctcctgctgttgcagctagaggagcggtcaacccagggacctctccagatgctgcaggacatgaaggagccactaagtcggaagaataacgtgagcgtccagtgcccagaggtggccccgcccacaaggcccaggaccgtgtgtagagtaccaggccagatagaagtgctccggggatttctggaggacgttgtccccgatgcaacatctgcttatccgtacctgttactctatgaaagccgccagagaagatacttgggctcatcccccgaaggctccggtttttgttctaaagatagattcgtggcctacccttgcgccgtggggcagacagcttttagttcaggtagacactactgggaggtgggcatgaacatcactggcgacgcgctttgggcccttggtgtctgtcgcgataacgtgtccaggaaagatagggttccaaagtgcccagaaaacgggttctgggtagtgcagctgagtaaaggcacaaaatatctgagtactttttccgcactgacacccgtgatgttgatggagcctccctctcatatgggcatcttcctggacttcgaggccggtgaagtatccttttacagcgttagcgacggaagccatcttcacacatatagccaggccacattcccagggcccctccagccgttcttctgccttggcgcacccaaatcggggcaaatggtgatctcaacagtgacaatgtgggttaaggggtag

SEQ ID NO: 34137 - DNA, 1434 bp, Artificial Sequence
  Description of Artificial Sequence: Synthetic coding sequence
atggaagctgtcgagctcgccaggaaactgcaggaagaggccacctgctcgatttgcctcgactattttacggatcccgtgatgactacctgtggccataatttctgtagggcttgcatccaactcagctgggaaaaggcccggggaaagaaggggaggcggaagaggaaaggatctttcccgtgccccgagtgtcgcgagatgtccccccagagaaatttgctgcccaaccgcctcttaactaaagtggccgagatggcacaacagcatccaggtctgcaaaagcaagacttgtgtcaggaacatcacgaacccctgaagctgttttgtcagaaagaccagtcccctatctgcgtcgtttgccgggagtctcgtgagcaccgcctgcaccgcgtgttgccagccgaagaggccgtccagggatataaactgaagctagaggaagacatggagtatctgagggagcagattacccggaccgggaacttgcaagcacgcgaggaacagagcctggctgagtggcaaggcaaagtgaaggagcggagagagcgcatagtgctggagttcgaaaaaatgaatttatacctggtggaggaagagcagagactgctgcaagccctagaaactgaggaggaggagaccgcttcaagactgcgagagtctgtggcttgccttgatcgccagggccacagcctggagttgttactcctccaactagaagagcgctctacccaaggaccccttcagatgctccaagatatgaaggaaccactgtcaagaaagaacaacgtttccgtgcagtgtcctgaagtcgcccccccaaccagacccaggaccgtctgtagggtacctggccagatcgaggtcctccgggggtttctcgaggatgtggtgcccgatgccactagcgcctatccctacctactgctgtacgaaagtcgacagcggcggtatttgggatcaagtcccgagggaagcggtttctgcagcaaagatcgcttcgtagcctacccgtgcgccgtgggccaaactgcgttttccagtggaaggcattactgggaggtgggtatgaatattaccggtgatgccctctgggctctaggtgtgtgtcgggataacgtttccagaaaagatagagttccaaagtgccctgagaatggtttctgggttgtgcaactgtccaagggcacaaagtaccttagcacattctccgccttaacacctgtaatgcttatggagccacctagccatatgggcatcttccttgacttcgaagccggagaggtgagtttttactccgtgagtgacggaagtcatctacacacgtactctcaggcaacctttccaggcccgctgcagccctttttctgcttaggggcaccaaagagtggtcagatggtgatcagcacggtaaccatgtgggtgaaaggatag

SEQ ID NO: 34138 - DNA, 1032 bp, Artificial Sequence
  Description of Artificial Sequence: Synthetic coding sequence
atggaagctgtggagctggctcggaaactacaggaggaggctacctgctccatctgtttggattactttaccgaccccgtcatgaccacctgtggacacaatttctgccgcgcatgcatccagctgagttgggaaaaggccagggggaagaaaggcagacgcaaacggaagggatcgtttccgtgtccagaatgccgagagatgtccccacagaggaatctgctgcccaaccgtctcctgaccaaggtcgcagaaatggcacagcagcatccaggccttcagaagcaggacctttgccaagagcaccacgagcccttgaagctgttttgccagaaagatcaaagccccatttgtgtggtctgccgagagtctcgagagcaccgacttcatagagtgctgccagctgaagaggctgtacaaggctataagctcaagcttgaagaggacatggaatacctgcgcgaacagatcactcgtacagggaatctgcaagcacgggaggagcagtccctggctgaatggcagggtaaagttaaggagagacgagagcgcatcgtgcttgaattcgaaaagatgaacctctatctcgtcgaggaagagcagagactgctgcaggcactggaaaccgaggaagaagagaccgcaagtcggctgagggagagtgtagcttgtttagacagacaaggacactctctcgagctgctactgttacaactggaggaaaggagcacacaaggacctcttcaaatgttacaagacatgaaagaacctctaagcagaaagaacaatgtctcagtgcaatgcccagaagtggcacctccaaccaggcctcgcaccgtctgtagagttcctggacagatcgaggtcctcagaggctttctgggcaaatgggcacctagggcccgtacaagtgatccaggaagtctcggggacgcaccgctttacccactggcatccgaagccaccaacggaggcggcagcacctccgccttacctggcgacggccactggctgttcacagtcccttcttag

SEQ ID NO: 34139 - DNA, 153 bp, Artificial Sequence
  Description of Artificial Sequence: Synthetic coding sequence
atggaagcagtggagttggctaggaaacttcaagaggaggctacctgttcgatttgtctggactattttaccgacccagttatgaccacgtgcggccacaatttttgtagagcttgtattcaactgtcatgggagaaagcacgaggaaagtag

SEQ ID NO: 34140 - DNA, 1398 bp, Artificial Sequence
  Description of Artificial Sequence: Synthetic coding sequence
atggcatcaactacttccactaagaaaatgatggaagaagctacctgctccatttgcctgtcactgatgactaaccccgtgagcattaattgtgggcacagctactgtcatttgtgcattacagacttcttcaagaacccatcccagaaacagctgcggcaagagacattttgctgtccgcaatgccgagcaccatttcatatggactccctcaggcccaacaaacagctcggttctttgatagaagcccttaaagaaaccgaccaggagatgtcttgcgaggagcacggggagcagttccacttgttctgtgaagatgaggggcagctaatctgctggagatgcgaacgggcgccccagcataagggccacaccactgcacttgtggaggatgtatgccagggctataaggagaaattgcagaaggcagtgacgaagctaaagcagctggaagatcgctgcaccgaacagaagctcagcacggctatgcggataactaagtggaaggagaaggtacagatccaaagacagaagattcgctcagatttcaagaatcttcagtgctttttgcatgaggaggaaaaatcctacctctggagactcgagaaggaagaacagcagactcttagccgtttacgggactatgaggccggccttggcctcaaaagcaatgaactgaaatctcatatcctagagctcgaggagaagtgccagggaagcgcccagaagcttctgcagaacgtcaacgacaccttgtcccggtcatgggctgtgaagcttgagacctctgaggctgtgagcctcgagctccacacaatgtgcaacgtttcaaaattgtatttcgatgtgaagaagatgctgcgatcccaccaggtctccgtgaccctcgatccagacaccgcacatcacgagctgatcctgtccgaggatcgccgacaagtgacaaggggctatacgcaggagaaccaggacacctctagcagacggtttactgccttcccctgtgtgttgggttgcgagggcttcactagcggccgaagatactttgaggtggatgtgggggaggggacagggtgggatttaggcgtttgtatggaaaatgtccagagagggacagggatgaaacaggaaccccagagcgggttttggacactccgcctgtgtaaaaagaaaggatacgtcgccctgaccagtcctcctacttccctccacctgcatgaacagccactattagtcgggatcttcctcgattacgaagcaggcgttgtgagcttctataatggaaatacggggtgccatatcttcacttttcccaaggcatctttctccgacacattgagaccctatttccaggtatatcaatacagccctctgtttctccccccccctggcgattag

SEQ ID NO: 34141 - DNA, 1398 bp, Artificial Sequence
  Description of Artificial Sequence: Synthetic coding sequence
atggccagtaccacttcaactaaaaagatgatggaggaggctacttgtagtatctgtctgagtcttatgacgaatcctgtgtctataaattgtgggcatagttactgtcatctgtgcatcaccgatttctttaagaacccttcacagaaacagctccggcaagagaccttctgttgcccccagtgtcgagcaccctttcacatggactctctcagacccaacaaacagttgggttcacttattgaggctcttaaagaaactgaccaagagatgtcctgcgaagagcatggcgaacagttccacctcttctgtgaggacgaggggcagttgatctgttggcgctgcgagcgagccccccagcataagggccataccacagccctggtggaggacgtgtgccagggctacaaggagaagctccagaaggcagtcacaaaacttaagcaactggaggataggtgtactgagcaaaagctctctactgctatgagaatcaccaagtggaaggagaaggtgcagatccaaagacaaaaaatccgaagcgactttaagaacctgcagtgtttcctccacgaggaggagaagtcttatctttggcgcctggagaaggaagagcagcagactctgagccggttgagggactacgaagctggcctggggctcaagtccaacgaactgaagtcacacatcctcgagctggaggagaagtgccagggttccgcccagaagctgttacagaacgtcaatgacacactcagccgcagctgggccgtcaaactagaaaccagcgaggccgtatctctggagcttcatacaatgtgtaacgtcagtaagctttactttgatgtgaagaaaatgctacgatcccatcaggtgagcgtaacgctggatccagataccgcccaccatgagctgatcctgagcgaggaccgccggcaggttacaagagggtacacccaagagaaccaggataccagtagccggaggttcactgcgttcccctgcgtcctgggctgcgagggctttacatctgggagacgctatttcgaggttgatgtcggtgaagggacaggctgggacctgggagtgtgcatggaaaacgtccagcgcggcaccggcatgaaacaggagccccagagcgggttctggacactgagactgtgtaagaagaagggatacgtagctctcacgtccccacccacctctctgcacctacatgagcagccactcctcgtcggcatattcctcgactatgaggctggagtagtgagtttttacaacggcaacacaggatgccacattttcaccttcccaaaggcttccttttccgataccctccgcccatattttcaggtgtatcaatatagtccccttttcttgcctcctcctggggactag

SEQ ID NO: 34142 - DNA, 1398 bp, Artificial Sequence
  Description of Artificial Sequence: Synthetic coding sequence
atggctagcactacatccacgaagaaaatgatggaagaagctacatgcagcatctgtctatctctgatgacaaacccagtgtcaattaactgtggtcacagttactgtcatttatgcatcactgacttcttcaagaacccttctcagaaacagctacgacaagagacattttgttgcccccagtgtcgtgctccattccatatggattctctgcgacctaataagcagctggggagtctcatagaggctctgaaagaaacagaccaagagatgagctgtgaggagcacggtgagcaattccacctcttctgtgaggatgagggtcagttgatctgttggcggtgtgagagggctcctcagcacaagggccacacaacagccctggtggaagatgtctgtcagggatacaaggaaaagctccagaaggctgtcacgaaacttaaacagctggaagaccggtgtacagagcagaagctgtccacagccatgcggattaccaagtggaaagagaaagtccagatccaacggcagaaaataaggtcagacttcaaaaatctgcagtgctttttacatgaagaggaaaagagctatctgtggcgcctggaaaaggaagaacagcaaactttgtctcggctgagagactatgaagctggccttggtctgaagtctaatgaactcaaatcccacattctggagctcgaggaaaaatgccagggttcagcacagaagctgctgcagaatgtgaacgatacactgtcaaggtcctgggccgtcaagcttgagacctctgaagcggtcagcctggagttgcatacaatgtgtaacgtctctaagctgtatttcgatgtgaaaaagatgctgcgcagtcaccaggtcagcgtaaccctggatccggacacagcacaccacgagctcattctgagtgaagatcggaggcaggtcacccgcggctacacacaggagaatcaggatacctcttccaggagattcacagcctttccctgtgtgctcggatgtgaggggttcacatcaggacggcgttattttgaggttgatgtgggtgaaggcactggttgggatttgggagtatgcatggagaatgtgcaacgggggactggcatgaagcaggaaccccagtctggattctggaccctcaggctatgcaagaagaaagggtatgtcgcattaacatcacccccgaccagcctccatcttcacgagcagcccctgttggttggcatattcttggactacgaagcaggtgtcgtatccttctataatggcaatacaggctgccatatttttacattccccaaggctagcttttccgacacccttaggccatattttcaagtgtatcagtactctcccctatttctccccccccctggggattag

SEQ ID NO: 34143 - DNA, 690 bp, Artificial Sequence
  Description of Artificial Sequence: Synthetic coding sequence
atgataccactgcagaaggacaaccaggaggagggagtgtgcccaatttgccaggagtccctcaaagaagccgtgagtacgaattgcggccacctcttctgccgcgtgtgcctaacccagcacgtggagaaggcaagtgcatcaggcgtattctgctgtcctttgtgccggaagccctgtagcgaagaggtcctaggtacaggatatatctgtccaaaccatcagaaacgcgtgtgccgattttgtgaagaaagccgccttctcctttgtgtggagtgtctcgtgtcccccgaacacatgagtcatcatgaacttaccatcgagaacgccttgtcacactacaaggagaggctaaacagacgaagcagaaagctgaggaaggacattgctgagttgcagagactgaaggctcagcaggaaaagaaactccaagctctgcagcagtggctgggtcagttggaacacatgcccgccgaggcagcaagaatcctggacatctcgagagcagtgacacaactgaggtccctcgtcatcgatctggagagaacagcaaaagagctagatacaaacaccctgaaaaatgccggcgatctactgaatcgctccgccccccaaaaattggaagtgatatatccgcagcttgagaaaggtgtgtccgaactacttctccagccgccgcagaaactttag

SEQ ID NO: 34144 - DNA, 777 bp, Artificial Sequence
  Description of Artificial Sequence: Synthetic coding sequence
atgattccactgcagaaggacaaccaggaggaaggcgtttgcccaatctgccaggagagcctgaaagaagcagtttctacaaattgcgggcacctcttctgtcgcgtgtgtctgacacagcacgtggagaaggcatccgcttccggcgtcttctgctgccctctgtgccgtaagccatgttcagaagaagtgctggggacgggatacatctgcccgaatcatcagaaaagagtctgtcggttctgtgaggagtcacgactcctactatgtgtcgaatgcttggtttcaccggagcacatgtcccatcacgagttgacaatcgaaaatgccttgagtcactataaggagcgcttaaatagacggagtaggaagctccgaaaagacattgccgaattacaaaggctgaaagcacagcaggagaagaaactacaggctcttcagttccaggtggaccacggtaaccatagacttgaggctgggcccgaaagccagcaccagacaagagaacagttgggggcgctacctcaacagtggcttggtcaattggaacacatgcctgcagaggcggcaagaatcttggacattagtagggccgtcactcagcttagaagcttggtcatcgatctcgaacgaactgccaaagagctagacacaaacaccctcaagaatgctggcgatctcttaaacaggtccgccccccagaagctagaggtgatctacccacagctagagaagggagtatctgagctactattgcagcctccacaaaagctgtag

SEQ ID NO: 34145 - DNA, 777 bp, Artificial Sequence
  Description of Artificial Sequence: Synthetic coding sequence
atgattcccctgcagaaggacaaccaagaggagggtgtgtgccctatttgtcaggagagtctgaaggaggccgtttccacaaactgcggacacctgttttgcagggtttgtctgactcaacacgtggagaaggcctccgccagcggcgtcttttgttgcccattgtgcagaaagccgtgcagtgaggaggtcctgggtaccgggtatatttgtcctaaccaccagaagcgggtatgtagattctgcgaggagtcacgtttgctgctttgtgtggagtgcttggtctccccagagcacatgtcacatcacgaactcactatagagaacgctctgtcacactacaaagaacgtttgaatagacggagtcgaaaattaagaaaggacatagctgagttgcagcggctcaaagcccagcaagaaaagaaattacaggcccttcaattccaggtggaccatggcaatcacagactggaggctgggcccgagtcgcaacatcaaactagagagcaacttggcgccctcccccagcagtggttgggtcagctggagcacatgcctgcagaggccgcaagaattctcgacatctcgcgcgccgttactcagttaaggtcactcgtaattgacttggagaggacagcaaaggaactagacacaaatactctgaaaaatgctggcgacctgctgaaccggtccgcgccccaaaagctggaagtgatctacccacagcttgagaagggcgtcagcgaactgttgctgcagccccctcagaagctgtag

SEQ ID NO: 34146 - DNA, 777 bp, Artificial Sequence
  Description of Artificial Sequence: Synthetic coding sequence
atgatccctttacagaaagataatcaggaggagggagtctgtcccatctgccaagaaagtctgaaggaggctgtatccacgaactgcggccatctgttttgccgcgtctgcctcactcagcacgtggaaaaggcaagcgcatcaggggtgttctgttgcccattgtgtaggaaaccatgctccgaggaggtgctcggcactggatacatatgtcccaaccatcagaagagagtgtgtaggttttgcgaggagagtcgcctacttctgtgtgtggagtgcctggtgtcacctgagcacatgagccaccacgagctgaccatagagaacgccctgagtcactacaaggaaagactgaatcggagatcccgaaaactaaggaaggacattgccgaactgcagcgattgaaggcccagcaagaaaagaaactgcaggcactgcagtttcaggttgatcacggcaaccaccggctggaagctggccctgagtcgcagcatcagactcgggagcagcttggtgctttacctcagcaatggcttggtcaactggagcatatgcccgccgaagccgcgcggattttggatatttcccgtgcagtcacgcagctgaggtcgttggtgatagatctggagcgcactgccaaagagttggacacgaacaccctaaagaacgccggggacttgctcaacagatctgctccccagaaactggaggtaatctatccccagctggaaaaaggcgtgtccgagttgctcctgcagccaccccagaagctgtag

SEQ ID NO: 34147 - DNA, 690 bp, Artificial Sequence
  Description of Artificial Sequence: Synthetic coding sequence
atgatacccctgcagaaggacaaccaagaagagggtgtgtgccctatttgtcaggaaagcctgaaagaggccgtttccaccaactgtggtcacctcttctgtagggtttgccttacacaacacgtggaaaaggcgtcagcaagtggagtgttctgttgtcccctgtgccggaaaccttgcagcgaagaggtactaggtaccggctacatctgtcccaaccaccagaagagagtgtgccggttctgtgaagaatcacgactcctcttgtgtgttgaatgtctcgtgtcacccgaacacatgagtcaccacgaacttaccattgagaatgctctttcccactataaagaacgcctcaatcgacggtctagaaaactccgcaaagacatcgcggaactacaacggctcaaggcccagcaggagaagaagctccaggctttacagcagtggctagggcagctcgagcacatgccggccgaggcagccaggatcctggatatcagtcgagctgtgactcagctcaggagcctcgtgatcgatctggagaggactgccaaagagttagacactaataccctaaagaatgctggagatcttctaaataggtcggccccccaaaagctagaagtcatctaccctcagctggaaaaaggagtgtctgagttactgctccagccaccccaaaagctgtag

SEQ ID NO: 34148 - DNA, 690 bp, Artificial Sequence
  Description of Artificial Sequence: Synthetic coding sequence
atgatccctctgcagaaagataatcaggaggagggcgtttgccccatctgtcaggaatcattaaaagaagcagtctctaccaattgtggccacctcttttgtcgcgtctgtctgactcagcacgtagagaaagccagcgcttcaggcgttttctgctgtccactgtgccgtaagccttgcagcgaggaagtgctggggacagggtatatatgccctaatcatcagaaaagggtttgtcgtttctgcgaggagtcccggctcctcttgtgtgtcgagtgcctcgtaagtcctgaacatatgtcccaccatgagctgactatagagaatgctctaagccattataaagagaggcttaatagacggtctcgaaaactcagaaaggacatcgccgagttacagaggctgaaggctcagcaggagaaaaagttgcaagcccttcagcagtggctagggcagctcgaacatatgcctgccgaggccgcacgaatactcgacatctcgcgcgctgtgacacaacttaggtctctggtgatagatctggaacggatggccaaagagctggacacaaacactctaaagaacgcaggggacctactaaatcgctctgccccgcaaaaattagaggttatttacccccagctcaagaaaggggttagtgagttgttgctgcagcccccacagaagttgtag

SEQ ID NO: 34149 - DNA, 690 bp, Artificial Sequence
  Description of Artificial Sequence: Synthetic coding sequence
atgatcccccttcaaaaagataaccaggaggaaggagtatgccccatttgtcaagagagccttaaagaagccgtcagtaccaactgtggacacctgttttgtagagtatgtctcacccagcacgtggagaaagccagcgcctcgggagtcttctgctgccccttatgccggaagccttgctcagaagaggttctcgggacgggttatatttgtccgaaccaccagaagcgcgtgtgtcgtttctgcgaggaaagtagactgcttttatgtgtggagtgtctggtttctcctgagcatatgtctcaccacgaactaactatcgaaaacgcattaagccactacaaagagaggctgaacagacggtcaaggaagctgcgcaaagatattgccgaacttcagcgactaaaggctcaacaagaaaagaagcttcaggcattgcaacaatggttagggcaactcgagcatatgcccgccgaggctgctcggatcctcgatatttcaagggccgtgacacagctgaggagcctcgtgattgaccttgaaaggactgcgaaggaactggacactaatactcttaagaacgctggcgacctgctcaacagatctgcacctcagaaacttgaagtgatataccctcagcttgaaaagggagtgtctgagctgctgcttcagcctccacaaaagctgtag

SEQ ID NO: 34150 - DNA, 777 bp, Artificial Sequence
  Description of Artificial Sequence: Synthetic coding sequence
atgattcccctgcagaaggacaatcaggaggagggagtttgcccgatctgtcaagaatcactgaaggaagccgtttccaccaactgcggccacctgttttgccgcgtgtgcctgacccaacacgtggagaaagcctccgcgtctggcgtattctgttgtccactctgcagaaagccctgttccgaagaggtactgggaaccggttacatatgtcccaatcatcagaaacgcgtctgcaggttctgcgaagagagtcggctgctgctgtgcgttgagtgcctggtgtcccctgaacatatgagtcatcacgagctgactattgagaatgcactatcccactataaggagaggttaaaccggaggtctagaaaactgaggaaggatatcgcagagctccagcgacttaaggcacagcaagaaaagaagctgcaggcattacaattccaggtggatcacggtaatcatagacttgaggccggccccgagagccagcaccagacccgtgagcaactcggcgcactgccacaacaatggttagggcagctggaacatatgccggccgaagccgctagaatcctcgacatcagcagagctgtgacccagctgcggagtctggtgattgatttggagaggatggctaaagagctggacaccaatacgctgaagaatgctggagatttactaaaccgatccgccccccagaaactcgaagtgatatatccccaactcaaaaagggggtatctgaattgctcctgcagccaccgcagaagttatag

SEQ ID NO: 34151 - DNA, 690 bp, Artificial Sequence
  Description of Artificial Sequence: Synthetic coding sequence
atgatccccctgcagaaggataatcaggaagagggggtttgccccatctgtcaggagtccctaaaggaagccgtctccaccaactgcggacacctcttctgcagagtgtgcctgacacaacacgttgagaaagctagcgcctcgggcgtcttctgttgtcctttgtgcagaaagccctgctccgaggaagtgctcggcacaggctacatatgcccaaatcaccagaaacgcgtctgcagattctgtgaggaatctcgactcttactgtgtgtggaatgcctcgtgtctccagagcacatgagtcaccatgagctaaccattgaaaacgcgctgagccattataaggaaagattaaacaggcggagccggaagttaagaaaggacattgccgagctccagcggctgaaagcacagcaggaaaaaaaactgcaggcactccagcagtggcttggccagctggagcacatgcccgcagaggctgccagaatcctcgacatctcgagggctgtgactcaactgcgcagtctcgtcatcgacctggagaggactgcaaaggagctggatactaacactctgaaaaatgcaggggacctgcttaaccgctcagctcctcagaagctcgaagtgatctatccccagctggaaaaaggcgtgagtgaattgctgctgcaaccccctcagaaactctag

SEQ ID NO: 34152 - DNA, 777 bp, Artificial Sequence
  Description of Artificial Sequence: Synthetic coding sequence
atgatccctcttcagaaagataatcaggaagaaggcgtttgccctatttgtcaggagtcactaaaggaggcagtgtcaaccaactgcgggcatctcttctgtagagtctgtctcacacagcatgtggagaaggcctccgcctctggcgttttctgttgcccactgtgtcgcaagccatgctccgaggaggtgctgggcactggatatatttgcccaaatcaccagaagcgggtttgcagattttgtgaagagtcccgcttactgctctgtgtcgagtgccttgtatcacctgaacatatgagccaccacgagctgaccattgaaaacgcgctgtcacattataaagagaggctcaaccggcgctcgcgaaagctgcggaaagatatcgcagagctccagcgactcaaagctcaacaggagaaaaagctgcaggccctccagtttcaggtcgatcatggcaatcaccgactcgaggccggccctgagtcccagcaccaaactagagaacagttgggcgctctgccccagcagtggttaggccagctggaacacatgcccgccgaggccgctcgtatcctcgacatctcccgtgctgtgacccaactgagaagcctagttattgacctggagcgtatggcaaaggagctcgatacgaacactctcaagaatgcaggagacttgttgaacaggagcgctccacaaaaactagaagtgatatatcctcaactcaaaaagggggtttcagagctgctgctccagccaccacaaaaactgtag

SEQ ID NO: 34153 - DNA, 777 bp, Artificial Sequence
  Description of Artificial Sequence: Synthetic coding sequence
atgattcccctccagaaagataatcaagaagagggggtctgccctatctgtcaagaaagtctgaaggaagctgtgtcgacaaattgcggacaccttttctgcagggtatgtcttactcagcatgtggagaaggcctcagcgagtggcgtcttctgctgccccctgtgcaggaagccatgctctgaggaggtactcgggacgggatatatttgccccaaccatcagaagagagtctgccggttctgtgaggaatcaaggctcttgctctgcgtggaatgcctggtaagtccagagcatatgtcacaccatgaactcacaatcgagaatgctctgtctcattgcaaagagcggttgaaccgccgcagtaggaaactaaggaaagacatcgctgaactgcagcgtctgaaggctcagcaggagaagaaactccaagctctgcagttccaggtcgatcatggcaatcaccggctcgaggccggcccggaaagccagcatcagaccagagagcagttgggagctctgccacaacagtggctgggccaactggagcacatgccagcagaagcggcgcgaattcttgatatctcacgggcagtgactcagttgcggtctctcgtgattgacctggagcgcaccgccaaagagcttgatacaaacaccctgaagaatgcaggggatctcctgaacaggtcagccccccagaagcttgaagttatatatccacagctggaaaaaggtgtgtcagaactgttgctgcaaccacctcaaaaactttag

SEQ ID NO: 34154 - DNA, 777 bp, Artificial Sequence
  Description of Artificial Sequence: Synthetic coding sequence
atgataccgttgcagaaagataatcaggaggagggcgtttgccctatatgtcaagaatccttaaaagaagctgtgtcaacaaactgtggccacctattttgccgcgtgtgtctgacacagcatgttgagaaggcatctgcgtcgggggtgttttgttgtccactctgccggaagccctgcagtgaggaagttcttgggaccgggtacatctgtcccaatcaccagaaacgcgtgtgtaggttttgcgaggagagtcggctgttactctgcgtggaatgtctcgtgagtccagagcatatgtcccaccacgaactgaccatagagaatgccttgagccactacaaggaacggttgaaccgaaggagtcgcaagctgagaaaagatatagctgagctgcaacggttaaaagcccagcaggaaaaaaaattacaggccctgcaatttcaggtcgatcatggcaatcataggttggaagccggacctgagtctcaacatcagacccgtgaacagctgggtgcactcccacagcagtggctgggccagcttgagcacatgcctgcagaagcagccagaatactcgacatcagtcgggctgtgacacagctgcgctcccttgtgattgatcttgagcgcaccgccaaggaactggataccaacactctcaaaaacgccggggatctgctgaacagaagtgcccctcagaaactagaggttatctacccacagcttgagaaaggagtgtccgagctactcttacagccacctcaaaagttgtag

SEQ ID NO: 34155 - DNA, 777 bp, Artificial Sequence
  Description of Artificial Sequence: Synthetic coding sequence
atgatccctctgcaaaaggataaccaggaggaaggtgtgtgccccatctgccaggaatctttgaaggaggccgtttcaaccaactgcgggcatctgttctgcagggtctgtttaactcagcatgtagagaaggcttcagcctccggggtgttctgttgccccctttgccgcaaaccttgttctgaagaggtgttgggcaccggatatatctgccctaaccatcagaagcgggtgtgccgcttttgtgaggagtctaggctgctcttgtgcgtggagtgccttgtaagtcctgaacatatgtcccaccacgagctgacgatcgaaaacgctctgagccactacaaagaacggctcaaccgacgtagtagaaaattgcgaaaggacatcgccgagctccaaaggctgaaggcgcaacaggaaaagaagctacaggccttacagtttcaggttgatcatgggaatcatagactagaggccggccccgagtcccagcaccaaacacgggaacagcttggcgctctgcctcaacagtggctggggcagctggagcatatgcccgctgaagctgctagaatcctcgatattagtcgggcggtgacccagttgcggagcctggtcatagatctcgaaagaacagcaaaggaacttgacacaaacaccctcaaaaatgccggcgacttgctgaatagaagcgccccacagaagcttgaggtgatatacccccaactggagaagggcgtgtccgaactgctcctgcagcccccacagaaactgtag

SEQ ID NO: 34156 - DNA, 690 bp, Artificial Sequence
  Description of Artificial Sequence: Synthetic coding sequence
atgatccctctccagaaggacaaccaagaagagggcgtctgcccaatttgccaagagtcccttaaagaggctgtgtcgacaaactgtggccacctgttctgcagagtgtgtctgacccagcacgttgaaaaggctagcgcgtcaggagtgttttgctgccccctttgtagaaagccatgcagtgaagaggtgcttggcaccggatatatatgtcctaaccatcagaaaagggtctgcagattctgcgaagagagtcgcctgctactttgtgttgagtgcttagtttccccggaacacatgtctcaccatgagcttactatcgagaacgcactctctcattataaggaacgtctgaataggaggtcccgaaagctccggaaagatatcgccgaattgcaaagactcaaagctcagcaagagaaaaaactacaggcgctgcagcagtggctcggacaactcgagcatatgcctgcagaagctgccagaattctggacatttccagagccgtgacgcaactgaggagcctggttatcgacctggaacggacggccaaggaactcgatacgaatacattgaagaatgctggggatttgctgaatagatctgctcctcagaagcttgaagtgatttatccacagctggaaaaaggcgtgtccgagctcctacttcagcccccccaaaaactgtag

SEQ ID NO: 34157 - DNA, 777 bp, Artificial Sequence
  Description of Artificial Sequence: Synthetic coding sequence
atgatcccactccaaaaagataaccaagaggagggcgtgtgccccatatgccaggagagcctgaaggaggcagtcagcaccaactgcgggcacctgttttgtagagtttgtttgactcagcacgtcgagaaggcctccgcctctggagttttctgctgcccgttgtgccgtaagccttgttccgaggaggtcctgggtacaggatacatctgtccgaatcaccagaaaagggtgtgtcggttctgcgaggagtcccggctcctgctgtgcgtggaatgcctggtttcgccggagcatatgtcccaccacgaactgaccatagaaaatgccctttcacactacaaggaaaggctgaatagaagaagtcgtaagcttaggaaagacatcgctgagctgcagcgcctaaaagcccaacaagagaaaaagttgcaggccctgcagtttcaggtcgatcacggcaaccaccggttggaagccggccctgaatcacaacaccaaacgcgagagcagctgggggcactgcctcagcagtggctgggccaactcgaacatatgcctgctgaggcagcacgtatactggacatctcccgggctgtgacccagctgagaagcttggtgattgatctggagagaactgcaaaggaacttgacacgaacaccctcaaaaatgccggtgacctcctgaaccgcagcgccccacagaagctggaggtcatctatcctcagcttgaaaaaggcgtgagcgaactgctgttacagccgccacagaagctttag

SEQ ID NO: 34158 - DNA, 690 bp, Artificial Sequence
  Description of Artificial Sequence: Synthetic coding sequence
atgattccattacagaaagataaccaggaggaaggagtttgtcctatttgtcaagaaagcctgaaggaagccgtgtctacgaattgcggtcatctgttctgccgggtatgcctgacacagcacgtggagaaggccagcgcctccggtgtgttctgttgtccgctgtgcagaaagccctgttccgaggaggtcctgggcaccgggtacatctgtcccaaccaccagaaacgggtctgcaggttttgcgaagagtcgaggcttttattatgtgtcgagtgtctggttagccctgagcacatgtcccaccatgaactcactatcgagaacgctctgtcccactgtaaagaacggctgaatagaagatcccggaagctgcgaaaggacattgccgaacttcaacgcctgaaggcccagcaagaaaaaaagctgcaggccttgcagcagtggttgggccaactggagcacatgcctgctgaagcagcccgcatactagacatctcccgcgccgtgactcagcttcggagtcttgttattgaccttgaacggactgccaaggagctcgataccaacactctgaagaatgccggggatctgctgaaccgcagtgctccccagaagctcgaggtgatataccctcagctggagaaaggtgtttccgagttattgctacagcctccccaaaaactgtag

SEQ ID NO: 34159 - DNA, 690 bp, Artificial Sequence
  Description of Artificial Sequence: Synthetic coding sequence
atgattccactgcaaaaggataatcaggaggagggcgtgtgcccaatctgtcaggaaagcttaaaagaagctgtatcaacgaactgtggacatttattctgtcgagtctgtctgactcaacacgtggaaaaagctagcgcaagtggtgtgttctgctgccctctgtgcaggaaaccttgcagtgaagaagtcctgggaaccggatacatctgccccaaccaccagaagcgggtgtgtcggttttgtgaggagtcacgtctgctcctgtgcgtagaatgcctggttagccccgaacacatgagtcatcacgaactgacaatcgagaacgctctctcacattataaagaacggttgaacagacgttccaggaaactccgaaaggatatagcagagctgcagcgcctaaaggctcagcaggaaaaaaagcttcaggccctgcagcagtggttaggccagctggaacatatgcctgctgaagctgcgagaatcctcgacatcagtagagcggttacacagctgcgctccctggtaatcgacttagagcgcatggcaaaagagctcgataccaatacgctgaagaacgctggagacctgctgaacaggtcggccccacaaaaactcgaggtgatctaccctcagctgaagaaaggggtgagcgaactgttgctgcagccccctcagaagttatag

SEQ ID NO: 34160 - DNA, 777 bp, Artificial Sequence
  Description of Artificial Sequence: Synthetic coding sequence
atgatcccgctgcagaaggataaccaggaggagggagtctgcccaatctgccaggagtctttaaaggaagccgtctctacaaactgtggccatctattctgcagggtgtgcctgacacaacatgtagagaaggccagtgcctcaggtgtgttctgttgccccctttgccggaaaccgtgctctgaggaagtgctgggcacaggctatatctgcccgaaccaccagaagagggtgtgtcgcttctgtgaggaatcccggctgctcctctgtgtggaatgcctggttagccccgaacatatgtcacaccacgagcttaccatcgaaaacgcactaagccactacaaggagaggttaaatcgtaggagtagaaagctgcgaaaggacatcgccgagctgcagaggctgaaggcccaacaggagaagaaattacaggctctccaattccaggtcgatcacggaaaccatagactcgaggccgggcctgagagccagcaccagacccgtgaacaactgggagccctgcctcagcagtggctaggtcagctcgagcacatgccagctgaagccgccagaattttagacatctccagagccgtcacgcagctgcgaagccttgtgattgatttggagagaaccgccaaggagctggatacaaataccctgaagaacgccggggatctgctgaaccgatcagcaccacaaaaactggaggtgatctacccccagctggaaaaaggggtttccgaactgctgttgcagcctcctcagaaattgtag

SEQ ID NO: 34161 - DNA, 777 bp, Artificial Sequence
  Description of Artificial Sequence: Synthetic coding sequence
atgattccattacagaaggacaaccaggaggaaggtgtttgtcctatttgccaggagagccttaaggaggccgtatcgacgaattgcggtcatcttttctgtagagtctgcctaacccaacatgtggaaaaagccagtgcaagtggagtgttttgctgccctctatgccgcaagccatgttctgaggaagtcttgggaaccggttacatttgtccaaaccaccagaagcgcgtttgccgcttctgcgaagaatccaggctactgctttgtgtggaatgtctggtctcacccgagcacatgagccaccatgaacttactatcgagaacgccctgtcccactgcaaggagcggctgaataggaggtctaggaaacttcgtaaggatatcgccgagctgcaaaggttgaaagcacaacaggaaaagaaacttcaagccctccagttccaggtcgatcacggcaatcaccgcctggaagctggaccagagagccagcaccagactcgcgagcagctcggcgcactcccccagcagtggctcgggcaactagaacacatgcctgcagaggcagccagaatcctcgatattagtcgcgctgtgacgcaactgcgcagccttgtaattgatctcgagcgaaccgctaaagaactcgacaccaacactctgaaaaacgctggtgacctgttaaaccgatccgccccccaaaagttggaggtgatctaccctcagctggaaaagggcgtgagtgaacttcttcttcagccgccgcagaaactgtag

SEQ ID NO: 34162 - DNA, 777 bp, Artificial Sequence
  Description of Artificial Sequence: Synthetic coding sequence
atgatccctctccagaaggataatcaagaggaaggcgtttgtcccatttgtcaagagtccctcaaggaggctgtgtccaccaactgcgggcacctgttttgtagggtttgtctcacacagcatgtggaaaaggcctcggccagcggggtcttctgctgccccctgtgcagaaaaccgtgtagcgaggaagtgctgggcacaggttacatatgccccaaccatcagaaaagggtgtgtagattttgtgaagaatccagactattgctctgcgtggaatgtctggttagccctgagcacatgtcacaccatgagctgacaatcgaaaatgccctttcccattacaaggaacgccttaataggagatcaagaaagctgaggaaagacatcgcagagctacagcgactgaaggctcagcaagaaaagaagttgcaggcactgcagttccaagtcgaccatgggaatcaccgcctagaagctggtccggaatctcagcatcagactagagaacagctcggggcattaccccagcagtggctcggccagttggagcatatgcctgccgaggctgctaggattctggatattagtcgcgcagtgacacagctacgctccctagtcattgacctggaaaggaccgcaaaagaactggacacaaacacacttaaaaatgcaggagaccttctgaaccgctccgcaccccaaaaactggaggtcatttacccacagcttgagaagggagtttctgagctgcttttacaaccaccacagaagctgtag

SEQ ID NO: 34163 - DNA, 777 bp, Artificial Sequence
  Description of Artificial Sequence: Synthetic coding sequence
atgatacctctgcagaaggataaccaggaggagggtgtttgcccaatatgccaggagagcctgaaagaggcagtgagcactaactgtggacacctattttgccgggtatgtttgacacagcacgttgaaaaggcaagtgccagtggcgtattttgctgtccactctgtcggaagccatgcagcgaagaagttctgggaacaggatacatttgtcccaaccaccagaaaagagtttgtcgattctgtgaagagtcgcggctgctgctatgcgtggaatgtctggtgagccctgagcacatgagtcatcatgaactgaccattgagaatgcactttctcactataaagaacggctgaacaggcgcagcaggaaactgcgcaaagacatcgccgaactgcagcggcttaaggcacagcaggaaaagaaattgcaagcattgcagtttcaagtggatcacggcaatcataggctcgaggcgggtcccgagtctcagcatcagactcgcgagcaactaggggctcttcctcaacagtggctgggacagcttgagcacatgcccgctgaggcggcccgcattctcgacatcagccgagctgtaacacagctgaggagcttggttattgacctggagcggactgccaaagagttagatacgaacaccctcaagaatgctggagatctcctcaatcgcagtgccccccagaagctggaagtgatatacccccagcttgaaaaaggcgtctcagaattattactgcagcccccccagaaactctag

SEQ ID NO: 34164 - DNA, 2172 bp, Artificial Sequence
  Description of Artificial Sequence: Synthetic coding sequence
atggagactgcaatgtgtgtctgctgcccgtgctgtacctggcagcgatgttgccctcagttatgctcatgtctgtgctgcaagttcatctttaccagcgaacgcaactgcacttgtttcccatgtccatacaaggacgagcggaactgtcagttttgccactgcacttgcagcgagtctcctaactgccactggtgctgttgctcttgggccaacgaccctaactgtaagtgctgttgcactgcctcttcaaatcttaattgctactattacgagtccagatgttgtcgtaacacaatcatcaccttccacaagggcaggctgcgaagcatccacacttcttccaaaactgcactgcgtaccgggtccagtgatacccaggtcgatgaggtcaagtccattcctgccaattctcacctcgttaaccaccttaattgtccgatgtgctctcgcctccgcctgcactcgtttatgttaccctgcaaccactctctatgcgaaaaatgcttacggcaactccaaaagcacgcagaagtgacagaaaatttcttcattctgatatgtcctgtgtgcgatcggagccattgcatgccttattctaataagatgcaattgcccgaaaattacctgcacggcaggctgaccaaaaggtacatgcaggaacacggatatttgaaatggcgctttgatcggtcaagcggccccatcctttgccaggtttgtcggaataaacgcattgcttacaaacgctgcatcacatgcaggttaaacttatgtaatgactgcctgaaggcatttcactctgacgtagcaatgcaggaccatgttttcgtcgatacttccgcggaagaacaagacgaaaaaatctgtatccatcatccatcatcaaggatcatagaatactgtaggaacgacaataagctgctgtgtactttctgtaaattctcattccacaatggtcatgacaccatttcactcatcgacgcctgctctgaacgggcagcgtcattgttctccgctattgcaaaatttaaggcggtgcgctatgaaattgacaacgacttgatggagttcaatatccttaaaaatagttttaaagctgataaggaagctaagcgcaaggaaattcggaatggctttctgaagctgagatctatcctccaagagaaagagaaaatcatcatggagcagattgagaatctcgaggtcagccggcagaaggagattgagaaatatgtctatgtgaccacaatgaaggtaaatgagatggatggcttgatagcttatagtaaagaagcgttaaaggagacagggcaggtggccttccttcaatcagcaaagatcctcgtggatcagattgaggacggcatccagactacttaccgcccggatcctcagctcagattacacagtattaactacgtgccattggattttgtggaactatccagcgccatccatgaactgtttcctaccgggcccaagaaagtcagatcgtctggggactcactgccatctccgtatcctgttcactccgagacaatgatcgctcgaaaggtgaccttttcaacccattcactcggcaaccagcacatttaccagaggtccagttctatgctgagtttttccaacacagacaaaaaggccaaggtggggttggaagcttgcgggagggctcagagcgccactcctgccaaacccaccgacggattgtacacttattggtctgcaggggccgattcccagtcggtgcagaactcctctagcttccataattggtattcctttaatgatggaagcgtgaaaactcctgggccaatcgttatctatcagactttagtttatccccgagcagccaaggtgtactggacatgtccagctgaggatgtggacagttttgagatggagttctatgaagtgataacctcccctcccaacaacgtgcagatggaactttgtggacagatccgtgatatcatgcagcagaacctggagctccacaatctcactccaaataccgagtacgtatttaaggtgcgcgccatcaacgataacggcccaggtcagtggtctgatatctgcaaggtggtgaccccagacgggcacgggaaaaacagagcgaagtggggcctgctgaaaaatattcaatccgcactccagaagcacttttag

SEQ ID NO: 34165 - DNA, 1341 bp, Artificial Sequence
  Description of Artificial Sequence: Synthetic coding sequence
atggactccgacttttctcacgctttccagaaggagctcacctgtgtcatctgtcttaactatctcgttgatcctgtgaccatctgctgtggccacagcttttgtcgaccttgcttgtgcctctcttgggaagaagctcagtcccccgcgaattgcccagcctgtagggagccctcccctaaaatggacttcaagactaatatattgctgaagaacctcgtgactatagcgagaaaagcgagcctatggcagttcttgtcatccgagaaacagatctgcgggacacaccgccagaccaagaaaatgttctgtgacatggataaatctctcctttgtttgctgtgttccaactcccaagagcatggggcccataagcaccaccccattgaggaagcggccgaagaacaccgagaaaaactgttgaagcagatgaggattctgtggaagaaaatacaggaaaatcaaaggaacctgtacgaggaggggaggaccgcgtttctgtggcgaggcaatgtcgtgctacgggcgcagatgattcggaatgagtatcgtaagcttcaccctgtcctgcataaggaagagaagcagcacttggagagactcaacaaggaatatcaggaaatatttcaacagctgcagcgatcctgggtcaagatggatcagaagtcaaagcacctgaaagaaatgtatcaagaattgatggagatgtgccataaaccagacgtcgaacttcttcaggacctgggtgacattgttgcaagaagcgaaagcgttctgctccatatgccacagccagtcaacccagaattaaccgctggcccgatcacaggcctcgtatacagactgaataggttcagggtcgagatttccttccatttcgaggtaaccaatcataatataagactcttcgaggacgttcgatcctggatgtttcggcgggggccactgaacagtgataggtcagattattttgcagcttggggtgcgcgtgtcttctcttttgggaagcactattgggagttagacgtcgacaatagctgtgattgggcgctgggggtgtgtaataacagctggattcgaaagaactcaaccatggtgaattcagaagacatctttttgttgctttgcctgaaagtcgacaaccactttaacctcctgactacttctccagttttcccacactatattgaaaaacctctcgggcgagtcggggtgttcctcgatttcgagtcaggaagcgtatcgtttctgaatgtcacaaagagctcactgatctggtcttaccccgccgggagtctgaccttcccagtcaggccattcttttatactggacatagatag

SEQ ID NO: 34166 - DNA, 2280 bp, Artificial Sequence
  Description of Artificial Sequence: Synthetic coding sequence
atggccgagggtgaagatatgcagacgtttaccagcattatggacgccctggtaagaatttccacatccatgaaaaacatggaaaaagagctgctctgtcctgtgtgtcaagagatgtataagcagcccctcgtccttccttgtacccacaatgtgtgtcaagcctgtgcccgcgaggtcctgggacagcaaggttatattggccacggtggcgatccctcttctgagccgacgagtccagcgtcaaccccatcaacccggtctcctaggctcagccggcgcactctcccaaaacctgacagactcgaccggcttctcaaaagtggcttcgggacctaccctggcagaaagaggggcgctcttcacccccaggttatcatgtttccctgtccagcgtgccagggcgacgttgagttgggggaacgcggattggcaggccttttccgcaatctgacccttgagcgtgtggtggagagatacaggcagtccgtctccgtagggggggcaattctgtgccagctttgtaagcccccacctctagaggcgaccaaggggtgcacggagtgtcgggcaactttctgtaacgaatgttttaagttgttccacccttggggcactcagaaggcgcagcatgaacccaccctgccaactctctcttttcggcccaagggcctcatgtgcccagaccacaaggaagaggtgacccactattgcaaaacgtgtcagaggctggtgtgccagctgtgtcgggttcggcggacacattccggacataagattacacctgtcctgagtgcgtatcaggcactgaaggataaactcactaagagcctgacctacattctgggaaatcaggatacagtacagacacagatttgtgagctcgaagaggccgtccgccacactgaagtctccggacagcaagctaaagaggaggtaagccagttggtgcgcggcctaggcgctgtgctggaagaaaagcgggcttcactcttgcaggctatcgaagaatgtcagcaggaacgcttagctagactgtcggcacaaattcaggaacaccgctccctgcttgatggtagcgggctggtagggtatgcccaagaagtgctgaaagaaaccgaccagccatgttttgtgcaggctgcgaaacagctgcataaccgcatagcccgtgcaacagaagcgctgcagacgtttcgaccagctgcttcatcatccttcaggcactgtcagttggatgtcggccgggaaatgaagctcttaaccgaactcaatttcctcagagtccccgaagcccccgtaatcgatactcagcggacctttgcgtatgatcagattttcttgtgctggcggttgccaccacattccccccctgcctggcactataccgtcgagttcagaagaaccgatgtgccggcccagcccggccccacacgctggcagaggagagaagaagtccgcggaactagcgcccttcttgaaaatcccgacactggttctgtttacgtactgcgagtccgcggatgtaataaagccggctacggagagtactccgaagatgtgcatctccacactccacccgccccggtcctccatttcttcctcgactcaaggtggggggccagtagggagcgtttggctatctcaaaagaccagcgggcagttcgctcagtgcctggtctccctttgcttctagctgctgaccggttgctgactggctgccacctgtcagtggatgtcgttctaggcgatgtcgccgtcacccagggtcgctcctactgggcctgcgccgttgatccggcatcctatcttgtcaaggtcggtgtgggtcttgaaagcaagctgcaagagagtttccagggcgctcccgacgtgatatctccccgatacgatcctgattctgggcacgatagcggtgcagaagacgccactgtggaggcctctccgcccttcgctttcctaaccattggtatgggcaagattctgctgggctccggagcatcgagcaatgccggactaacagggagggatggacccactgctgggtgcaccgttccattgccccccagattgggcatatgccttgattacgaaaggggacgtgtttcattccttgatgccgtgtcattccgcggtctgctcgagtgcccgttagattgttcaggccctgtgtgcccagccttctgctttatcggaggcggggcagtccaactgcaggaaccggtgggtactaaacccgagcggaaagtaaccatcggaggatttgcaaagctcgactag

SEQ ID NO: 34167 - DNA, 2211 bp, Artificial Sequence
  Description of Artificial Sequence: Synthetic coding sequence
atgaaaaatatggagaaggagcttttatgtcctgtatgtcaagagatgtacaagcagccgctggtcctgccttgcacacataacgtgtgtcaggcatgcgcacgagaagtgctaggccagcagggttacataggccatgggggagatccatcctctgagccaacatccccagcgtctacaccctctacgagatctcctcggttgagcagacggacacttcccaagcccgatagacttgatcggctccttaaaagcggatttggcacctatcccggacgcaagcgcggggccctgcaccctcaagtgattatgtttccatgtccagcttgccagggggacgtagagctgggagagcgcggccttgcaggcctgtttcgcaatctaacacttgaaagggttgtggagcgttataggcagtccgttagcgtcggtggggccattctgtgccagctctgcaagccccctcccctggaagccacaaagggctgcacagaatgtagggccacattctgcaatgaatgtttcaagctttttcacccttggggcacacaaaaagctcaacacgagccgaccctgcctacactatcatttcgaccaaaggggttgatgtgtccggaccataaggaggaggtaacccattactgcaaaacatgccagagattagtctgtcagttgtgccgggtgcggcgcacgcacagtgggcataagattacccccgtcctgagcgcctatcaggccctgaaagacaagttgaccaaatcactaacttacatcttgggcaatcaggacacagtgcagacacagatttgtgagctggaagaggcggtgcgtcacacagaggtgtctggtcaacaggccaaagaggaggttagtcaactcgtacgcggcttgggagccgtcctggaggaaaagcgcgccagcctactccaggccatcgaggagtgccagcaagaacgactggctagactcagcgcccagatacaggaacacaggtctctgctggacggttccgggctcgtaggatacgcccaggaagtactcaaagagaccgatcagccgtgcttcgttcaggccgcaaagcagctgcacaataggattgcaagagcaacagaagccctgcagacctttcgacctgccgcatcctcttccttcaggcattgtcaactggacgtgggtcgggaaatgaaactattaacagagctgaattttctgcgagtgcctgaagccccagtgatcgacacacagaggacgttcgcatacgaccagatttttctgtgctggcggctgccgcctcattctcctcctgcctggcactacactgtagaattccgccgcacagacgtacctgcccaaccgggccctactcggtggcagaggagagaggaagtgaggggcacatccgccctcctcgaaaacccggatacgggtagtgtgtacgtcttgcgagtgaggggctgtaataaagctggttacggcgagtactccgaggatgtccacctacacacacccccagccccggtcctccatttttttctggacagcagatggggcgcgagccgcgagcgactagcaatatccaaagaccagagagccgttaggagcgtccctggtttgcccctgctgttggccgctgaccgcctgctcacaggctgccatttgtcggttgacgtcgtcctgggagatgttgccgtgacccagggacgcagctactgggcctgcgccgtcgacccggccagttatcttgtaaaggtgggggtagggcttgagtcaaaactgcaggagtccttccagggggcccccgacgtcatctcccctcgctacgatccagactcaggacatgattccggagccgaagacgctactgttgaggcgtccccccctttcgcctttctaactattggtatggggaagattctgttgggaagtggagcgagcagtaatgccggtcttaccggccgagacggacccaccgccggatgtaccgtgcctctgcccccccgcctgggtatttgcctcgactacgaacgtggcagggtgagttttttagatgcagtgtcctttcgcggactcctggagtgccccttggattgctctggacctgtctgtccagcattttgttttattggtggtggtgcagttcagctccaggaaccagttggtacaaagcctgaaagaaaggtcacgattggcggcttcgcaaaattggattag

SEQ ID NO: 34168 - DNA, 1935 bp, Artificial Sequence
  Description of Artificial Sequence: Synthetic coding sequence
atggcggagggggaggatatgcagacctttaccagtatcatggacgcgctcgtcagaatctccacttcgatgaagaatatggagaaggaacttttgtgccctgtctgccaggaaatgtacaagcagccccttgtccttccctgcacccacaacgtgtgccaggcttgtgcccgcgaagtgctggggcagcagggctatattggccatggtggggacccatcttccgagcctacatcccccgcatcaacaccttcgacacgctcaccgcgcctgtcacgacggacacttccaaagcccgatcggctggaccggttgctgaaaagcggcttcggtacttatccaggcaggaaaaggggagcgttgcatccccaggttatcatgttcccctgcccagcctgtcagggtgatgtggaattaggcgagaggggtctagctgggctgtttaggaatctgaccctggaacgtgtggtggagcgatataggcaaagtgtttctgtggggggagccatcctatgccagctgtgtaagcctccgcctctagaggccactaaaggttgcaccgagtgtcgggcaaccttctgcaatgaatgctttaaactctttcatccctggggcacacagaaagcccaacacgaacctacgctgccaacgctctccttccggccaaagggtctgatgtgtcctgatcacaaagaagaggtgacacactactgtaagacctgccagagattagtgtgccagctctgcagagtgaggcgcacacactccggtcataagattacccccgtcctgtctgcgtaccaggcccttaaggacaaacttacaaagtcactcacctacatcctagggaaccaggacaccgtacagacccaaatatgcgaactggaagaagcggtaagacacacagaggtctccggccagcaggccaaggaagaggtctctcaactcgtgcgcgggctcggggcagtgctcgaagagaaaagagcgtccctgttgcaggccatcgaagaatgtcagcaggagagactggcacgccttagcgcgcaaatacaggaacaccgctccctgctcgatggttctggactagtgggctacgcgcaggaagtgctcaaggaaactgaccagccttgttttgttcaagccgcgaaacagctgcacaacaggattgcccgggccaccgaggccctgcagactttccggccagccgcctcctccagctttaggcattgtcagctcgacgttggccgcgaaatgaagttactaaccgagctcaactttttgcgcgtgcccgaggcacctgtaattgacacacagagaactttcgcgtatgatcagattttcctttgctggcgcctgccccctcattcacctccggcatggcactatacggttgagttcaggcgcaccgatgtacctgcccagccggggcccacccggtggcagcgaagggaagaggtgcgcggcacttccgcactgctcgagaaccccgatacaggttcggtgtatgtcctccgggtacgcggctgtaacaaggctgggtatggtgagtatagcgaggatgtgcatttacacactcctcctgcaccagtgctgcacttctttcttgacagcagatggggcgcaagcagagaaagactggcaatatctaaagatcagcgcgcggtgaggtcggttccaggactcccactgttacttgccgccgatcgcctgctcacagggtgtcatcttagcgtcgatgtggtccttggggacgtcgcggtgacccagggcaggagctattgggcatgtgccgttgacccagccagctatctggtaaaggtaggagtcggtctggaatccaaactacaagagtccttccagggcgccccagacgtcatttcaccacggagcgacccaagcggtcgcgacggcgtctgggggtcctggtgggagtag

SEQ ID NO: 34169 - DNA, 1656 bp, Artificial Sequence
  Description of Artificial Sequence: Synthetic coding sequence
atggcagaaggggaagatatgcagaccttcacgtcaatcatggatgctttagtgcgcattagcacttccatgaaaaacatggagaaggagctcctgtgtcctgtctgccaggaaatgtacaagcagccactcgtcctgccttgtacccacaatgtttgccaggcctgtgcccgcgaagtactgggtcagcagggttacattgggcatgggggagacccgtctagcgagccaacatcccccgcctccaccccctccacccgatctccacggttgtcccgtaggacgctgcccaaaccagacagactggatcgattgctgaagtccgggttcgggacgtacccagggcggaagcgcggggctctacacccccaggtcattatgttcccatgtcctgcatgccagggagacgtggagctgggagagcgcggtctcgcagggttatttaggaaccttaccctggaaagagtggttgaacgctacagacaaagcgttagcgtcggtggtgccatactttgccagctttgcaagccaccacccctggaggctaccaagggctgcacagagtgtagggccacattctgcaatgagtgttttaaactcttccacccttggggcacacaaaaggcccaacacgaacccactctgccaaccctttccttccggcccaaaggtctgatgtgtccagaccacaaagaggaggtgacgcactactgtaagacctgccagaggttggtgtgccagttatgccgtgtgcgaagaacccactctggccataaaataaccccagttctgtctgcgtaccaggctttgaaagataaactgactaagtctcttacatacatccttggtaatcaggacaccgttcagacccagatctgcgaattagaagaggccgtgcgacacaccgaggtttctggccagcaggccaaggaagaagtttcccagctcgtccgaggcctaggggcagttttggaagagaagcgtgcttcactgctgcaggccatagaggaatgccagcaggaacgcctggctaggctaagtgcccaaattcaagaacacaggtctctcctagatggatcaggactagtgggatacgcccaagaggtgcttaaagagaccgaccagccatgtttcgtccaagccgccaaacagctccacaacagaatcgctcgcgctactgaagccctccaaaccttcagaccagccgcgtccagctcttttcgccattgccagttagacgtcggccgcgaaatgaagctgctgacggagctaaactttcttcgcgtcccagaggccccggtgatcgatacacagaggactttcgcttatgaccagatttttctttgttggcggttaccgccccatagtccccctgcatggcactatactgtggaatttcgtcggaccgatgtgcccgctcagcccggtcctaccagatggcagagaagggaggaggtgaggggcacctcagccctcctggagaatcctgacaccggcagcgtgtacgtactgagagtacggggttgcaacaaagccggttacggtgagtactccgaggacgtgcacctccacactccccccgcccccggaatccaaaatctggctcgaaggggtggggcctgcttacagttccaactcttagggcggttgaggtag

SEQ ID NO: 34170 - DNA, 1497 bp, Artificial Sequence
  Description of Artificial Sequence: Synthetic coding sequence
atggccgagggagaggatatgcagacctttacatccatcatggacgccttggtgcgtatttccactagcatgaaaaatatggaaaaggaactcctttgtcccgtgtgccaggaaatgtacaaacaaccactggtgctgccctgtactcacaacgtttgccaggcatgcgcacgggaagtgctgggccagcagggatatatagggcacggaggagacccaagctccgaacctaccagccctgcttcaacaccctccacacggagtccccgcctgagcagacgaactctgcctaaacctgaccggctagaccgcctgctgaagtcaggcttcggtacctatcctggccgaaagcggggggctcttcaccctcaggtcatcatgttcccatgccccgcctgccagggagacgtcgagctcggagagagaggcttagcaggtttgtttaggaaccttacgctcgaaagggtggtggaacggtatcgccaaagtgtcagcgtgggcggagccatcctttgtcagctgtgtaagcctcctccactggaagctacaaaaggctgcaccgagtgcagggccactttctgtaatgaatgtttcaaactgtttcatccctgggggacccagaaggcccaacacgaacctaccctgcctacactgtcatttaggcctaagggactgatgtgccccgaccacaaagaggaagtgactcattactgcaaaacttgccagaggctcgtatgccagttgtgtcgcgtcaggcgaacccatagtgggcataaaattacgccggtgctttctgcataccaagcactcaaggataagttgaccaagagcctcacctatatcctgggcaaccaggacaccgtgcagacacagatttgtgagctcgaagaagctgtgaggcataccgaggtgtcgggacaacaggccaaggaggaggtgtctcagttggtacgtggactgggcgccgttctggaagagaaacgcgccagtctgctccaagccatcgaagagtgccagcaggaacgattagccagactctccgcccagatccaggagcatagatccttgctagatggatctggattagtaggatacgcacaggaagtgttgaaagaaaccgatcagccctgtttcgtacaggcagccaaacagttacacaacaggatcgctcgggccaccgaagctctacagacattccggcccgccgccagcagctcctttcggcactgtcagctggacgttggtcgcgagatgaagctattgaccgaacttaacttcctgcgcggatgcggacatagggggttgtgctctggagcccctcagtgcttgcgtcctccttccttaaccccctcggcgccactccctatgatccgatcctcctgcgccggcggctgtccaccgattcaccacctacccggcacaatcccgttgagttcgggcgcccggatgtgtctcctgtcccaggcacctcccgcaggcagcggcggccgacggtag

SEQ ID NO: 34171 - DNA, 2154 bp, Artificial Sequence
  Description of Artificial Sequence: Synthetic coding sequence
atggctgctaagcgagggaccaagacctcaatgaagaacatggaaaaagaactactctgcccagtgtgtcaggagatgtataagcagccgctggtcctgccatgtactcataacgtctgtcaggcctgtgccagggaagtactgggtcagcaaggctacattgggcacggcggcgatccatcctctgagccaacttcgcccgccagcacaccaagtactcggtcacctaggttgtctcggagaaccctgccaaagcccgacaggttagacaggcttttaaaatcagggtttggcacctatcctggtcgaaaacgtggagcgttgcatccacaggttataatgttcccttgcccagcctgccagggcgacgtggaattaggagaaagagggctggctgggctgtttcgcaacctgactctggagagagtggtagagcgatatcggcagtccgttagcgtgggcggcgccattctgtgtcagttgtgcaaacccccccctctcgaggctacaaaagggtgtacagagtgccgcgccaccttttgcaacgaatgcttcaagctattccacccctgggggactcaaaaagctcagcacgagccaaccttgcccaccctctcgttccggccaaaaggactgatgtgcccagatcataaagaagaggtcacacattactgtaagacatgtcagaggctggtctgccagctgtgtcgtgtgagacgcacccacagcggacacaaaattacccccgtgctgagcgcctatcaggccctgaaagacaagttaactaaatccctcacatatatcctcgggaatcaggacactgtgcaaactcagatctgcgagcttgaagaaaagcgggccagcctgctccaggctattgaagagtgccagcaggagagactggcgcgtctgtctgcacaaatccaggaacacaggtcccttcttgatggaagcggcctggttggctacgctcaagaggtgctgaaagaaacggatcagccttgcttcgtgcaggcagctaagcagcttcacaaccgaattgctagggcaactgaggctctacagactttcaggcccgcagccagcagttcctttagacactgtcagctcgacgtgggcagggaaatgaaactcctcacagagttaaatttcctgagagtgccagaggcccccgtgattgacacccagagaacctttgcatacgaccaaatttttctgtgttggcgcctccccccacactcacccccagcttggcattacacagtcgaatttaggaggactgatgtgccagcgcagccggggccaacacgatggcagcgcagggaagaggtgagaggtaccagtgcacttctagagaatccagacaccggaagcgtgtacgtgttgagggtgagagggtgtaataaggccggctatggggagtactcagaggatgtgcacctccacacacccccagcaccggtcctccatttttttctcgatagtcgatggggggctagtagagagagattagccatcagtaaggaccagagagcagtgaggtctgtgcccggcctgccgctgcttcttgccgcagacagacttttgacaggctgtcacctcagcgtagatgttgtgctgggcgacgtggctgtcactcagggccgatcatactgggcctgcgccgtggacccggctagctaccttgtgaaagtgggcgttggactcgaatctaaactgcaggaatcctttcagggcgctccggacgtgataagccctcggtacgatccagattcaggccacgacagcggggcagaagatgccaccgtggaggcttcgccaccctttgctttcctcaccatcggaatgggcaagatactgctgggctctggagcaagtagtaatgcaggcctgaccggtcgggatggaccgaccgcagggtgcacagtgccattaccccctcggctaggtatatgcctggattatgagcgtggtcgcgtgtctttcttagatgcggtcagctttcgggggctcctcgagtgtccacttgattgttcgggccccgtgtgccccgcattctgttttataggtggaggggccgtgcagctgcaggaaccggtgggaactaaaccagaaagaaaggtcactataggaggatttgctaagctcgactag

SEQ ID NO: 34172 - DNA, 1518 bp, Artificial Sequence
  Description of Artificial Sequence: Synthetic coding sequence
atgagacggggaggcattttagggcaccgccccggaccacaggcattcctcgtcccaggcgcatccgccgcaactctgtataagacctctatgaagaacatggagaaagagctgctgtgccccgtgtgccaggagatgtacaaacagcctctagtgctaccatgcactcataatgtgtgccaggcctgcgccagagaggtgctcggacagcaaggttacattggacatggaggggacccctcgagcgagcctacatcgcctgcctccaccccaagcacccgctctcccagacttagccggcgcaccctgcctaagcccgaccgcctcgacaggctgttgaagtctggcttcgggacgtaccccggtcgaaagaggggagccctgcatccacaggtcattatgtttccctgtccagcgtgccagggagatgttgagctcggcgagaggggcctcgctggtcttttcagaaacctgactttggagagagtggtcgagcgatacaggcagagcgtgtctgtggggggcgcaatactgtgccagctgtgcaaacctcccccgctcgaagccactaagggctgtacagagtgtcgcgccaccttctgtaatgagtgcttcaaattattccatccatggggcacacagaaggctcagcatgagccaactctgccaaccctgtcttttaggccaaaggggcttatgtgtcccgaccacaaggaggaggttacacactattgtaaaacctgtcagcggctagtttgccagctgtgccgagttcggaggacccatagcggacacaaaataaccccagtcctgtctgcttaccaggcactaaaggacaagttgacaaaaagtcttacttacatcctcggcaatcaggatactgtgcagacgcagatctgtgagctggaagaggccgtaaggcacaccgaggtctctgggcagcaagctaaggaagaggtctcacaactggttcgcgggctgggtgccgtgctggaggaaaagcgagcttccttgctgcaagcgattgaggagtgccagcaggagcgccttgcacgactaagtgcccagattcaggaacatcgaagtttgttggacggatcaggactggtgggatatgcccaagaggtcctgaaggaaactgaccaaccatgctttgtacaggccgcaaagcagttgcacaatcggatcgcgagagccaccgaagcactgcagacctttcgacccgcagccagttccagctttcgacactgtcagctcgatgtgggacgggagatgaaattactgacagagttgaatttcctgcgaggatgtgggcatagaggtctttgctctggagcccctcagtgtttgcggcctccgtcgctgacaccttccgcaccacttcccatgattagatcatcgtgcgcaggcggttgcccccccatacatcacctccctggaaccatccccctcagcagcggagctagaatgtgcctgctgtctcaggctccgcccgccggctcaggaggccggcgctag

SEQ ID NO: 34173 - DNA, 1902 bp, Artificial Sequence
  Description of Artificial Sequence: Synthetic coding sequence
atgtttccctgtcctgcttgccagggcgatgtggagctcggagaacgcggactcgctggtctcttccgtaatctaacactggaacgagtggtggagaggtacaggcagtccgtcagcgtggggggtgcaattctctgccagctgtgtaaaccccctccacttgaagcaacaaaaggctgtactgaatgccgcgctaccttttgcaacgaatgtttcaaattattccacccctggggcacccagaaagcccagcatgaaccgaccctcccaactttaagtttcagaccaaaaggcctgatgtgtcctgatcataaggaggaagtcactcattattgtaagacctgtcagagactggtgtgtcagttatgtcgtgtcaggcgcacacattccggtcataagatcaccccagtactcagtgcctaccaggctctcaaagacaaactcaccaagagcctcacatacatcctgggcaaccaggacacagtgcaaactcaaatctgtgagctggaggaggccgtgcgtcatactgaggtgagcgggcagcaagcaaaagaggaggttagccagctggtgcgcggtctcggagctgttctggaagagaagagagcttctctgttgcaggccatcgaagagtgtcaacaggagaggttggccagactgagtgcacaaatccaggaacatcggagtttactggacggatcagggctggttggatatgctcaggaagtcctcaaagaaactgaccagccctgttttgtccaggctgccaaacagctgcacaatcgaatagcaagagctacagaggccctgcagacattcaggcctgctgcctctagctccttcagacactgccaactcgatgtggggagagagatgaagctcctgacagagctgaattttctgcgagtcccagaagcccccgtgatcgacactcagcgaaccttcgcttatgatcagatcttcctgtgctggcgactcccacctcacagcccccccgcgtggcactatacagtggagttccggcgtaccgacgtgcctgcccagcctgggcctacacgctggcaacgcagggaggaggttagaggcaccagcgcactgctggagaatccggatacaggatcggtttacgtcttgcgggtcagagggtgcaataaggcagggtacggggaatactccgaggacgtccatcttcataccccccccgcccccgtgctccatttcttcctggactcccggtggggggcaagcagggaacggcttgcgatttcgaaggaccaaagggctgtccgctcagtgcccgggttacctctcctgcttgcggcggatcggctgttgactggatgtcacctctccgtcgacgtcgtgctgggcgacgtcgctgtcacacagggtaggagctattgggcttgtgcggtggatccagcctcgtacctggttaaagtgggcgtgggtctggagtctaaattgcaggaaagcttccagggggcgcctgacgtgatcagccctaggtatgaccctgatagcggacatgattccggcgctgaagacgcaactgtggaagcttcaccgcctttcgccttcctcacaatcggcatggggaaaatcctcctgggatccggagctagttctaacgctggtctgactggcagggacggccctacagcaggctgcactgtccctttacccccacggctgggaatttgcctggactatgaacggggcagagtgtcattcctggatgccgtcagtttccgagggctgctggagtgcccactggattgctcagggcccgtgtgtcccgccttctgcttcattggaggtggcgcggtccagctccaggaacctgtgggcactaagcccgagaggaaggtaacaatagggggctttgccaagttggactag

SEQ ID NO: 34174 - DNA, 675 bp, Artificial Sequence
  Description of Artificial Sequence: Synthetic coding sequence
atgtctagacggatcatcgttggaactctgcagagaacccagcgcaacatgaacagtggaatctcccaggttttccagcgcgaactcacctgccctatttgtatgaattacttcatagatccagtaaccattgactgcggccattccttttgtcggccatgtttttacctcaactggcaggacatcccaatcctcactcagtgtttcgagtgtatcaaaacaatccagcaaaggaacctcaaaaccaacatacggttgaaaaaaatggcttctctggcccgcaaggcgtccctgtggttgtttctgagcagtgaggagcagatgtgtggaatccaccgagaaacaaaaaagatgttctgcgaagtcgacaggtctctgctgtgtctgctgtgtagctcctcccaggagcatcggtaccatagacactgcccagcagaatgggcggccgaagagcactgggagaaattactaaagaagatgcagagcctgtgggaaaaggcttgcgaaaaccagcgcaacctcaatgtggaaaccacccgtatatctcattggaaggccttcggagatatcctatataggtctgagtcagtgcttctgcatatgccacagccactgaacctggccctaagagccggtcctattacaggcttgcgggatagactcaatcagttctag

SEQ ID NO: 34175 - DNA, 1359 bp, Artificial Sequence
  Description of Artificial Sequence: Synthetic coding sequence
atgaattcagggatcctccaggtctttcaaggcgagctcatctgccctctatgtatgaattacttcatcgacccagtcactattgactgtgggcactccttttgcaggccatgtttctacctaaattggcaggacatcccattcttggtgcagtgttccgagtgcacgaaaagcaccgaacagatcaatctgaaaactaatatccatctgaagaaaatggcgagtctggcccgaaaggtatctctttggctgttcctctcaagcgaagagcagatgtgcgggacccaccgagagacgaaaaagatattttgcgaggttgacagatcacttctgtgtctgctctgcagttcatctcaggaacacagatatcacaggcatagacccatagaatgggctgcagaagagcacagagagaaactgctccagaagatgcagagtctatgggaaaaagcatgtgagaaccaccgcaatctcaatgtggagaccacaaggactagatgctggaaggactatgtgaacctgagactggaggctattagagccgaataccagaagatgcctgcttttcatcacgaagaggagaaacataacctcgagatgctgaagaagaagggaaaggagatcttccatcgtctgcacctgagcaaggcaaaaatggctcatcggatggaaatcctgaggggaatgtatgaggagctcaatgagatgtgccacaagcctgatgtggagctcctccaggcttttggggacatactgcatcgatcggagagtgtgctcctgcatatgcctcaacctctgaatcctgagcttagtgcaggccccatcacaggcctgagggacaggttaaaccagtttagggttcacattacactgcatcacgaagaagctaataacgatatatttctgtacgaaatcctgcgcagtatgtgcatcggttgcgatcatcaggatgtcccctacttcacggccacccctaggtcttttctggcttggggagtacagacgtttacgagtggcaagtactattgggaggtgcatgtgggcgacagctggaactgggcatttggcgtgtgcaatatgtacagaaaggagaagaatcaaaatgaaaaaatcgacgggaaggcaggcctgttccttctcggctgtgtgaaaaacgacatacagtgtagtctcttcactacctccccgttgatgctgcagtatataccaaagccaactagtagagtcggactgttcctcgattgtgaagcaaagacagtgagttttgtggacgtgaaccagtcgagtctcatctatactatccctaactgctccttcagccctcccctaagacctattttctgttgtattcacttctag

SEQ ID NO: 34176 - DNA, 1341 bp, Artificial Sequence
  Description of Artificial Sequence: Synthetic coding sequence
atgaactctgggatccttcaggtgttccagggagagctcatctgtccgttatgtatgaattacttcatcgacccagtgaccatcgactgtggtcacagtttctgtcgaccttgcttttacctaaattggcaggatatcccatttctggtgcagtgttcggaatgtacaaagagtaccgaacagattaatctgaagacaaacatccacctgaagaagatggcttccctggcccggaaggtaagcctgtggttattcctgtcctccgaagagcagatgtgcggcacacacagggagacaaaaaagattttctgcgaggtcgatagatccttgctctgtctgttgtgctcctcctcccaggagcatagataccatcgccaccgacccatcgaatgggctgcagaggagcacagggagaagctcctgcaaaagatgcaatctttatgggaaaaagcctgcgagaatcataggaacctcaatgttgaaaccacccgcacaaggtgctggaaggattatgtgaacctgcggttggaggcaatccgtgctgaataccagaagatgcctgcatttcaccacgaggaggagaagcataatctggagatgcttaaaaagaaggggaaagaaatttttcatcggctccatttgtctaaggccaagatggctcatcggatggaaatattaagggggatgtacgaggagctcaatgagatgtgtcacaagcctgacgttgagttactgcaggacctgggcgacatggtcgcacggtcggagtccgtgctccttcacatgctgcaacccgttaacccagagctgcccacaggtccgatcaccggacctgtagatcgactaaaccacttccgtgtagagataagcttcacttgggagggaaccaactacaatattggcctgttcgaagatgtgcgatctcttatgtttcgtagagggagcctgaattctgaccggtccgattattttgccgcttggggggcctgggtgttttcttcaggcaaacactactgggagctggacgtggataatagctgggattgggctctcggggtttgtaaggatagctggatcagaaaaaactctactatgttcaactccaaggacatcttcctgctgttgtgtgtgaaagtggataaccatttctctctgcttactacatccccaatgttcccacattatgtagaaaagccgcttgttagggtcggggtgtttttgaacttcgaatcgggctccgtgtcttttctcaacgtgaccaagaacagcctgatctggaattatcccgcgggctccctgaacttccctgtgaggtcctttttctacacggggcacagatag

SEQ ID NO: 34177 - DNA, 1359 bp, Artificial Sequence
  Description of Artificial Sequence: Synthetic coding sequence
atgaatagcggcattctgcaagtgtttcaaggcgagctcatctgccccttgtgtatgaattatttcatagacccggttaccatcgactgtggccactcattctgcaggccgtgcttctacctaaactggcaggatattccattcttagtgcagtgctcggaatgcaccaagagcactgaacagatcaatctcaagacaaacatccacctcaaaaagatggcgtccctcgcacggaaggtgtccttgtggctgtttctctcctctgaggaacagatgtgcggtactcaccgagaaaccaaaaagattttttgtgaggtggatagatcactgttgtgcctgttatgtagttcttctcaagaacaccgttatcatagacatcgtccaattgaatgggccgcagaagagcacagggagaagctgttgcaaaaaatgcagtctctttgggagaaggcgtgcgagaatcacagaaacttgaacgttgaaacaactcgcaccaggtgttggaaagactacgtgaacttgcggttggaggctatccgggccgaatatcagaagatgcccgcttttcaccatgaagaagagaaacacaacctggaaatgctgaaaaagaaaggcaaagagatcttccatagactgcacttatccaaagccaaaatggcccacaggatggagatcctccgggggatgtatgaagaactcaacgaaatgtgtcataaacccgacgtcgaactcctgcaggctttcggcgatatcctgcaccggtctgagagtgtgctgctacacatgccacagccccttaaccccgagttaagcgcaggcccaatcaccggcctaagagacaggctgaaccaatttagggtccatataactcttcaccacgaggaagcaaactcagacatctttctctatgagatcttaaggtcaatgtgcatcggctgcgaccaccaggacgtgccttactttaccgctaccccaagatccttcctcgcctggggagtccagacattcacttcaggcaagtattattgggaagttcatgttggggattcctggaactgggcctttggtgtgtgcaatatgtatcgtaaggaaaaaaaccagaacgagaagatcgacgggaaagaaggattatttttgctcgggtgtatcaagaatgacatccagtgcagcctgtttactacaagtccactcatgctccagtatattccaaaaccgacctcccgggttggcctctttttggattgcgaagcgaagacagtcagtttcgtggacgtgaaccagtcctcactaatttatacgatccccaactgctcctttagtcctcctctgcgacctatattttgttgtattcatttttag

SEQ ID NO: 34178 - DNA, 894 bp, Artificial Sequence
  Description of Artificial Sequence: Synthetic coding sequence
atggctggttatgctactaccccaagcccaatgcagaccctgcaggaggaagcagtgtgcgcgatctgcctggactacttcaaggacccggtaagcatctcctgcggtcataatttttgtcggggttgtgtcactcaactttggtctaaagaagatgaagaagaccagaacgaggaagaagatgaatgggaagaggaagaagacgaggaagcggtaggtgcaatggatggctgggacgggtcaatcagggaagtgctgtatcgaggaaacgcagacgaagagctcttccaggaccaagacgacgatgagctctggctcggcgattcaggaataactaattgggacaacgtggactacatgtgggacgaggaggaggaggaggaggaagaggatcaagattactacttaggagggctgcggccagacttgcgtattgatgtgtaccgggaggaggaaatcttagaggcctacgatgaagatgaagacgaggagctgtaccctgacatacaccctcctccttccttaccgctgccagggcagttcacatgtccacaatgcagaaaaagctttacgcgtcgtagttttcgcccgaacctgcagctggccaacatggtccagatcattcgccagatgtgcccaaccccatatcgaggtaatcggtctaatgaccaaggtatgtgttttaaacaccaggaagctctgaagctgttttgtgaggtagataaggaggctatttgcgttgtgtgtagggagtcacggtcccataagcagcactccgttctgcctctggaggaggttgtccaggagtatcaagagatcaaactggagactacgctggtgggcattctgcagatcgaacaggaaagcattcactctaaggcttacaaccagtag

SEQ ID NO: 34179 - DNA, 1461 bp, Artificial Sequence
  Description of Artificial Sequence: Synthetic coding sequence
atggcctgggcaccccctggggaaagactccgggaagacgcccgctgcccagtgtgtctcgattttctgcaagaaccggtctctgtcgattgcgggcacagcttttgtttaaggtgcatcagcgaattttgtgaaaagagtgacggggcccaaggtggtgtatacgcatgccctcaatgcaggggcccgtttaggccttcaggatttcggccgaaccgacagttagcaggtctggtcgagtcagtcaggcgacttggcttgggagctggaccaggggcaaggcggtgtgccaggcacggagaggacctgtctagattctgcgaggaagatgaagccgcactgtgctgggtgtgcgatgctggaccggaacatagaactcaccgcactgcccccctgcaggaagcggccgggtcatatcaggttaaattacagatggctctcgagctcatgcgcaaggagctggaggacgctttaactcaggaggctaatgtcgggaagaagaccgtgatctggaaagaaaaggtggaaatgcagcgtcagagatttaggttggaatttgagaagcacaggggtttccttgcgcaggaagagcagagacagctacgacgcctagaggccgaagaaagagcaactctacaaagacttagggagtccaagtctcgccttgtccagcagtcaaaggctctcaaggagttggcggacgaactgcaggagagatgtcagcgcccggccttgggactccttgaaggtgtgcgcggagtgctgagcagatccaaggcagtcaccagattagaagctgagaatatccctatggagttgaagaccgcttgttgcatacctggtcgcagggagctgctcagaaaatttcaagtagatgttaagctagatcctgcgactgcacacccctccctcctactgactgctgacctgcggtcggtacaagacggcgagccctggcgggacgtccccaataacccggagcggtttgacacatggccctgtatcttagggctgcagtcttttagcagtggacgtcattactgggaggtcctcgttggagagggagccgagtggggcctcggggtatgccaggatacactcccccgcaagggggaaactacccctagtcccgaaaacggggtgtgggccttatggttgttgaaaggaaacgaatacatggtcttggcctccccatcagtcccactgttgcagctggagagtccccggtgcattggtatatttcttgactacgaagctggtgaaatcagcttctataatgtgaccgatggaagttacatctacactttcaaccagttattcagcggtctcctacgcccgtacttctttatctgcgatgcaactccattaatactccccccaacaactattgccgggtcaggaaattgggccagccgggatcacctagaccccgcctctgatgtgagagatgatcatctctag

SEQ ID NO: 34180 - DNA, 1416 bp, Artificial Sequence
  Description of Artificial Sequence: Synthetic coding sequence
atggaattcgtgactgcccttgtcaacctccaggaagagtcgtcatgtcccatatgcctagagtacctgaaggatcctgtcacaattaattgtggccacaacttttgtagaagctgtctgtcagtcagttggaaagacctagatgatactttcccctgccctgtgtgccggttctgtttcccttacaagtcatttcgacggaacccccagctgagaaacctaacagagatagctaagcagctccaaattcgcagaagtaagcgtaaaagacagaaggagaatgccatgtgtgagaaacataatcagtttttgacattattttgcgtcaaggatctcgaaatactgtgtacccagtgttcctttagcacaaaacaccagaagcactacatctgcccgatcaaaaaagcagcatcttatcacagagagatcctggagggctccctcgagccattacggaacaacatcgagcgcgttgagaaagtgattattctgcagggttctaagtccgtcgaactgaaaaagaaagtggaatacaaaagggaagaaatcaattcagaattcgaacagatcagacttttcctgcagaacgagcaggagatgatcctgagacagatccaggatgaggagatgaacatactggccaagcttaacgagaatctggtagagctttccgattatgtctctaccctaaaacatcttctgcgagaggttgaaggcaagtctgtgcaatccaatcttgagctgctcactcaggcgaagtctatgcatcacaaatatcagaatctgaagtgtccagagctcttctctttccgcttgaccaagtatggatttagcctgcctccccagtactctgggctggaccggatcatcaaacctttccaggttgatgtaatcttggacctgaataccgcacatcctcaattgttagtgagcgaggaccgaaaggccgtgaggtacgagcgcaagaaacgcaacatctgctatgatcctagacggttttacgtttgtccagcggtcttgggcagccagcgattctcttccggtcgccactactgggaggtagaggtgggcaataagccaaagtggatcttgggtgtttgtcaggattgccttcttcgaaactggcaggatcagcccagcgttctgggcggcttttgggcaatagggaggtacatgaagagcgggtacgtggcctctggtcccaagaccactcaactgctccccgttgtgaaaccgtctaaaatcggaatttttctggattacgaattaggggatctgagtttctataatatgaacgatcggtccatcctttatacctttaatgactgttttacagaagccgtttggccttacttttataccggcaccgatagtgagcctcttaagatttgcagtgtcagcgatagcgagagatag

SEQ ID NO: 34181 - DNA, 273 bp, Artificial Sequence
  Description of Artificial Sequence: Synthetic coding sequence
atggagtttgttacagccctcgttaatctgcaggaggagtcaagctgtcctatatgtctagagtacctcaaggacccagttacaattaattgtgggcataacttttgcaggagttgtcttagtgtcagctggaaggatttggatgatacctttccctgtccagtttgtagattttgcttcccatacaagtctttccgtaggaatccgcagcttcggaatttgacggagatcgcgaagcaattgcagatacggaggagcaagcggaaacgatag

SEQ ID NO: 34182 - DNA, 1416 bp, Artificial Sequence
  Description of Artificial Sequence: Synthetic coding sequence
atggaattcgtgaccgcgttagtgaatctccaggaagagagttcttgcccaatttgtctggaatatctgaaggatcctgtgaccatcaattgcggacacaatttctgccgatcatgcctgtcagtgtcttggaaggaccttgatgacacattcccatgtccagtgtgccggttctgcttcccctacaagagctttcgacgaaatccccaactgcgtaaccttacggagattgctaagcagctgcagatccgacgatccaagcggaagaggcagaaggagaacgccatgtgcgaaaaacacaaccagttcctgacacttttctgtgtgaaggatctcgaaattctgtgtacgcagtgtagtttttccactaaacaccagaagcattacatttgcccaataaaaaaggctgccagttaccatagagagattctggagggaagcctggagcctctgcgcaataacatagaaagggttgaaaaagtaatcattctgcagggctctaagtctgtggagctaaagaagaaagtggagtacaagcgggaggaaataaattctgagttcgaacagatccgtctctttctgcagaatgaacaggagatgatactcaggcagatccaggatgaggaaatgaacattctggcaaaactaaacgagaatctcgtggaattgtccgattacgtgagcactctcaagcatttgctgcgcgaggttgagggaaaaagcgtgcagagtaacctggagttgctcacccaggcaaaatcgatgcatcacaaataccagaacctgaaatgtccggagttgttctcttttcgccttacaaaatacgggttttcattgccacctcagtattccggcttggaccgtatcatcaaaccatttcaggttgacgtgatcctggatctgaacactgcacatccccaactgctggttagcgaggaccggaaggccgtgagatacgaacgaaaaaagcggaatatctgttacgacccacggcggttctatgtgtgccctgctgtgcttggatctcaacgtttctcctccggcagacactattgggaagtcgaggtgggaaacaaaccaaagtggattctgggagtttgtcaagactgcctcctccgcaattggcaagaccagccttctgtgctgggagggttctgggcaatcggaaggtatatgaagtccggctatgtagcctccggtccgaagaccactcagctcctgcccgtggtcaagccctccaagatcgggatctttctggattatgaacttggcgacctaagcttttacaatatgaatgatcggtcaatactctatacctttaatgattgcttcacagaagcggtgtggccttatttctacacggggacagactcagaaccactgaagatctgtagcgttagcgactctgagcgctag

SEQ ID NO: 34183 - DNA, 1416 bp, Artificial Sequence
  Description of Artificial Sequence: Synthetic coding sequence
atggaatttgttacagccctggtaaacctgcaggaagaatcctcatgccctatatgtcttgagtacctgaaagatcccgtgactataaactgcggacacaacttttgcagatcttgcctgtccgtaagctggaaagatctcgacgacaccttcccttgtcccgtctgcaggttttgcttcccatacaagtcattccgccggaaccctcagctgcgtaatctgactgaaattgccaaacagctccagattcggcggtctaaacgtaagcgacagaaggagaatgccatgtgtgagaaacataatcagtttctcactctgttttgcgtgaaggacctggagatcctttgcacgcagtgtagttttagtacaaaacaccaaaagcattatatttgtcctattaagaaagcagcctcttaccatcgtgaaattctggagggtagcctcgagcctctcaggaacaatatcgagcgcgttgagaaggtgattattctgcagggatctaaatctgtggaactgaaaaaaaaagtggagtacaaaagagaagagatcaacagtgaattcgagcagattagactttttctgcagaatgaacaggagatgatcctccggcagattcaagatgaggagatgaacatcctggccaaactcaacgaaaacctggtggaactttccgattacgtgagcactctgaaacacctcctcagagaggttgaaggtaagtcagtacagtctaatttggagctcctgacacaggctaaatcaatgcaccacaagtaccaaaacctgaaatgcccggaactcttttcctttcgactgaccaaatacggattcagcttgccgccacagtactctggtctggaccggattattaagccgtttcaggtggacgttattctcgaccttaatacagctcatccacagttacttgtgagcgaggaccgaaaagccgtccgctatgagagaaagaagcgcaacatctgctacgaccctaggcggttttatgtgtgtccagccgttctcggtagccaacggttctccagtgggagacactactgggaagtagaagtcggcaacaagcccaaatggatcctcggagtctgccaggactgcctgctgaggaactggcaggatcaaccgtctgtgctggggggtttttgggctatcggacgctatatgaagagcggctacgtggcgtctgggccgaaaaccacacagcttctcccagtagtgaagccctccaagatcggcatctttctcgactacgagcttggagacctgagcttttacaacatgaacgatcggtcaatcctgtacacgtttaatgactgttttaccgaggccgtgtggccgtatttctatacgggcactgactcagaaccattaaagatttgctctgtcagtgattccgagagatag

SEQ ID NO: 34184 - DNA, 630 bp, Artificial Sequence
  Description of Artificial Sequence: Synthetic coding sequence
atggagttcgttaccgccctggcggatctgcgcgcagaggcttcatgtccaatttgtctggattatttgaaggatccagtcactatttcatgtgggcacaacttttgcctctcctgcataattatgtcttggaaagaccttcatgattcattcccgtgtccattttgtcacttttgttgtcctgagaggaaatttatatctaatcctcaattgggctcactgaccgagatcgccaaacaactccagatcagatctaagaaacgcaagcggcaagaggaaaagcatgtgtgtaaaaaacacaaccaggttctgacatttttttgtcagaaggatttggagttgctgtgcccccgatgctccctatccaccgaccaccagcaccattgtgtgtggccaatcaagaaggctgcgagctaccacaggaagaaactggaagagtataacgccccgtggaaagagcgggtggagttgatcgaaaaggtgatcactatgcagaccaggaaatcgctagagctcaaaaaaaaaatggagagtccaagcgtcactcgactggagtgctcctgcactattagcgcgcatttcaatttgaggctgccaggaagtagtgattcaagtgcgtccggatcttag

SEQ ID NO: 34185 - DNA, 1428 bp, Artificial Sequence
  Description of Artificial Sequence: Synthetic coding sequence
atggcatgtagtctgaaagacgaacttctctgtagtatctgcctctctatctaccaggatcccgtgagtctgggctgcgagcattatttttgcaggcgatgtattacagagcactgggtacgccaggaggcccagggcgctagagattgccccgaatgcagaagaacctttgccgaaccggccttagctccctcgctgaagctggctaacatagtcgaaagatatagcagttttccgctcgatgcgatcctgaacgctaggcgcgctgctaggccatgtcaggcgcatgacaaggtcaagctattctgccttacggacagggcactcctgtgctttttctgtgacgagcctgccctacatgaacagcaccaggttaccgggattgacgacgcttttgacgaattgcagcgtgaactgaaggaccagctccaggccttgcaggattccgagagagaacacaccgaggctctccagcttctcaaacgccagctggctgagacaaaaagttctaccaagtctttgaggaccaccattggggaagcgttcgaacgcctccataggctgctgcgcgagaggcagaaagccatgctcgaggaactcgaagctgacacagcacgaactcttaccgacatcgagcagaaggtgcaaaggtattctcaacagcttcggaaggtgcaggagggtgcccagatcttgcaggaaaggctagccgagaccgataggcacacctttctcgccggggtggcatcactgtccgaaaggctcaagggcaagatccatgagacgaacctgacttatgaggatttcccaacttctaagtacaccgggcctttgcagtatacaatctggaaatcccttttccaggatatccaccctgtccctgccgctctgaccctggacccaggaactgcccaccagagactgattttgagcgacgactgcactatagttgcctacggcaatctgcaccctcagcccctccaggactccccaaaacggtttgacgttgaagtgtcagttctgggttcagaggcctttagcagcggcgtgcactactgggaagtggttgtagcagagaaaacacagtgggttatcggtctggcacatgaggctgcttcacgcaaaggcagcatacagatccaaccatcgaggggcttctactgcatcgtgatgcatgacggaaaccaatattctgcgtgcaccgagccctggacccggctgaacgtccgcgataagctggacaaggtgggggtgttcctggactatgaccaagggctgcttattttttacaatgccgatgacatgtcttggttatatacttttcgagagaaattcccgggaaagctgtgttcctacttctctccgggtcagagtcatgccaacgggaagaatgtgcaacccctaaggataaacacagttaggatatag

SEQ ID NO: 34186 - DNA, 1185 bp, Artificial Sequence
  Description of Artificial Sequence: Synthetic coding sequence
atggcctgctctcttaaagacgagctgctgtgcagcatctgcctgagtatttatcaggatcctgtgtccctcgggtgcgagcattatttctgcagacgctgtattaccgagcactgggtaagacaggaagctcagggcgcaagagactgcccggaatgccgacggaccttcgccgagcctgctctagcacctagcctcaagcttgcgaacattgttgagcggtattcctccttccccctagacgcaatcctgaatgctagacgggcggcacggccctgccaagcccacgataaggtgaagttgttttgtctgacagatagagcactgctttgttttttctgcgatgaaccagccttgcacgaacagcaccaggtgactggaatcgacgacgccttcgatgaactgcagcgggagctcaaggatcagcttcaagccctccaggattcagaacgggagcacacagaagccctgcagctgcttaaacggcagttggcggaaacaaagtcaagtaccaagagccttcggacaacgatcggtgaagcctttgagcggctccaccgtctgctgagggagcggcagaaggccatgctggaggagctggaagctgatacagcacggacgttgacggacattgagcagaaggtccagaggtattctcagcaactgaggaaggtccaggaaggcgcccaaatcctgcaggaaaggctggccgaaacagatcgacacacgtttttggcgggggttgcaagcctctcagaacggctgaagggaaagattcatgagaccaatctgacgtacgaggactttcccacaagcaaatacacagggcccttacagtacaccatatggaagagcctctttcaggacatccaccccgtgcccgctgctctcacactggaccctggtacagcccatcaacgactgattctgagtgacgattgtacaattgtggcttacggaaacctacacccccagccgctccaagacagtccaaagcggttcgatgtagaagtatctgtcttgggaagtgaggcgttttcaagcggtgtgcactattgggaggtggtcgtggccgaaaaaacacagtgggtgataggcctggcccatgaagcagcttcacgcaagggatcaatccagatccagaacctgggctgtaagggggtttgggaaatgagctttccatag

SEQ ID NO: 34187 - DNA, 1185 bp, Artificial Sequence
  Description of Artificial Sequence: Synthetic coding sequence
atggcctgtagcctgaaagatgagctgctctgttccatttgcctctctatctaccaagatccagtttcactaggctgcgagcactatttttgcaggagatgtataaccgaacactgggtccgacaggaagcccagggggcccgggactgccccgaatgtcggagaaccttcgcggagccagccctagcgccatccctaaagctggcgaacatcgtggagcggtatagctcttttccccttgacgccattctgaacgcaagacgggccgcacgcccctgtcaggcacacgacaaagtgaagttattctgtcttaccgatcgcgcattgttgtgtttcttctgtgacgagcctgccctgcacgagcaacaccaggttacgggcatagacgatgcctttgatgagctccagcgcgaattaaaggaccaactgcaggcgctacaagactccgaacgggaacatacagaggcactgcagctgctgaaacgtcagctggctgagaccaaaagttccaccaaatctctaaggaccaccatcggagaggcctttgagcggctacaccggcttctccgcgagcgccagaaggctatgctggaagagctggaggcggataccgcccgcacactgaccgacatcgagcaaaaagtgcagagatactcccaacagctgcgtaaggtgcaggagggtgctcagatcctacaggaacggcttgccgagactgatagacacactttcctggccggggtcgccagcctgagcgaacgactcaagggtaaaatccacgagactaatctgacctatgaagatttcccgacatctaagtacacgggcccactgcagtacaccatctggaagtcactctttcaggacattcatcccgtacctgccgccctgacccttgaccctggaacagcccaccagcggctgattctaagcgatgattgtaccatagtggcttatggcaacctacatccccaacccctgcaggactcacctaagcggtttgacgtggaagtcagtgtattgggatcagaagcctttagctcaggcgtccactattgggaggttgtcgtcgcggaaaagacccagtgggttatcggactggctcatgaggctgcaagtagaaaaggttccatccagattcagaatcttggatgcaagggagtgtgggagatgagtttcccctag

SEQ ID NO: 34188 - DNA, 1428 bp, Artificial Sequence
  Description of Artificial Sequence: Synthetic coding sequence
atggcctgttcactgaaggacgagctgctgtgttccatttgcctgagcatataccaggatccagtttcgttgggctgcgagcactacttttgccgaagatgtatcacggaacactgggtccgccaagaagcccagggcgcaagggattgcccagagtgtaggcggacctttgctgagccagctctagccccttccctcaaactcgcgaacatcgttgaacggtactcatcttttccgctcgacgccattctgaacgcgcgaagggcagctcggccatgccaagcccatgataaggtgaaactcttctgtcttaccgaccgcgcgttgctttgctttttctgtgacgagccagccctccacgaacaacatcaagttaccggaatcgatgatgcctttgacgaactgcagcgtgagcttaaggatcagctgcaggccctgcaggatagcgaaagggagcacaccgaggctttacagctgctcaagcgccaactcgctgagacaaagtcttccacaaaaagcctgaggacgaccatcggcgaggcattcgaacgcttgcaccgcctgctgcgagagcgacagaaggctatgctggaagagttggaggccgacaccgcccgcaccctgactgatatcgagcagaaagtgcagcggtacagccagcaactgcgtaaggtccaggagggagcccagatcctgcaggagcgcctggcagagacagatcgccacaccttcttagcaggggtggcgagtctgtccgagagattgaaaggaaagatccacgagactaacctgacctacgaagacttccctacctcaaagtacacgggcccgctgcagtatactatctggaagtcgctatttcaggatatacaccccgtccccgctgcactgaccctggaccccgggaccgcacatcagaggctgatcctctcagatgactgcaccatcgtcgcctacggtaacctgcatccacagcctcttcaagactcgccaaagcgctttgacgttgaagtaagtgtgctgggatctgaggctttcagctcaggtgttcactactgggaagtggtggtcgcagaaaagacccagtgggtgatagggctggcacatgaggcagcgagtagaaaaggctctattcagatccagcctagccgtggattctattgtattgtgatgcacgatgggaaccagtactcggcatgcaccgaaccatggacgcgtttaaacgtaagagataagctcgacaaagtaggagtgtttctcgactacgaccagggacttctcattttctataatgccgatgacatgtcttggttgtacacctttagagagaaatttccgggaaaactgtgttcctatttttctccaggtcagtctcatgctaatggtaaaaacgtgcagcctttgcggatcaacacggtgagaatttag

SEQ ID NO: 34189 - DNA, 1065 bp, Artificial Sequence
  Description of Artificial Sequence: Synthetic coding sequence
atgccagaaaaaacagctgtggaccagccttggacacaagctctgcgtgagttaaaggaccagcttcaggctttgcaggattccgaaagagaacatacagaagcactgcagctcctcaagcgccagctagcggagaccaaatccagcaccaagagtctgcggaccactattggtgaagcctttgaacgcctgcatcgcctgctgagggaaaggcagaaggctatgttagaagagttagaagcagacaccgcccggaccctcacggacatcgaacagaaagtgcagcgatactcacagcaactgcggaaggtgcaggaaggtgcacagatcctccaggaacggctcgctgagaccgatcgccataccttcctggcaggcgtcgcatccctatcagagcggctcaagggcaagatccacgaaaccaacctgacatatgaggatttcccaacttccaagtataccggccctctccagtacactatctggaagtcgctgtttcaggacattcaccccgtcccagctgctttaacccttgaccctggaaccgctcaccagaggttgatcctgagcgatgactgtactatcgttgcttacggcaatctgcatcctcagccccttcaagacagtcctaagcgcttcgatgttgaagttagtgtgcttggatctgaggcctttagcagcggggtgcactattgggaggtcgttgtggctgaaaaaacccagtgggtgatcggtctcgcgcacgaggcggcctcgcgaaaaggctccatccaaatacagccttctaggggcttctactgcatcgtaatgcatgatggcaaccagtactctgcatgtactgagccttggacccggctgaacgtgcgggataaactggacaaagttggggtcttcctcgattacgatcaaggcctccttatcttctataacgcagatgacatgagttggctgtatacattccgagagaagtttccagggaagctgtgtagctacttctcgcccggccagagccatgcaaacgggaagaatgtgcagcctctacgtatcaatactgtccgaatttag

SEQ ID NO: 34190 - DNA, 1350 bp, Artificial Sequence
  Description of Artificial Sequence: Synthetic coding sequence
atggactccgacgatctgcaggtcttccaaaacgaactgatatgttgcatatgtgtgaattactttattgatccagttacaatcgattgtgggcattcgttttgtagaccttgcctttgcctgtgcagcgaggagggccgcgcccctatgcggtgccccagctgccggaaaacaagcgaaaaacctaacttcaatacaaacctagttttgaaaaagctcagttctctggcacgtcagacacgccctcaaaatatcaattcatctgataatatctgcgtgcttcatgaagaaactaaagagctgttctgtgaagccgacaagcggttgttgtgcggtccatgtagcgagagccccgaacatatggcgcactcccactccccgatcggctgggctgctgaagagtgtagggagaagctgattaaggagatggactatctgtgggaaatcaaccaggagacccggaataacctgaatcaagaaaccagtaccttccactccctcaaggattacgtgtctgttcgcaagagaattatcacaattcaataccaaaaaatgccaatcttcctcgacgaggaagaacagagacatctgcaggctctggaaagagaagcagaagagctctttcagcagctgcaagattctcaggtgcggatgacccagcatctggagcgtatgaaggacatgtaccgtgagttgtgggagacttgtcacatgccggacgtggtcctgctgcaggacgtccgaaatgtttccgctcggaccgatctcgcccagatgcagaagccgcagccagtaaatcccgaacttacttcgtggtgcatcaccggtgtcctggatatgctcaacaacttcagagtggattcagcccttagtaccgaaatgatcccatgttatatttcgctgagcgaggacgtgcggtatgtcatctttggcgatgatcatttgtctgctcccacagatcctcagggcgtcgatagctttgccgtctggggcgcccaggcattcacaagcgggaagcattattgggaggtggatgtaacgttgtcatcaaactggatcctgggagtttgccgcgactcccggactgccgacgcaaatttcgtgatcgactctgacgaacgttttttcctgatatctagtaaacgatcaaaccattattccctgtccacaaactctccaccgctgattcagtacgtccagcggccccttggaagggtgggggtcttcctagattacgataacggaagcgtgtcgttttttgatgtgtcgaaaggcagtctcatctacggcttcccccccagcagcttctcgagccctctgcggcccttcttctgtttcggatgtacttag

SEQ ID NO: 34191 - DNA, 1344 bp, Artificial Sequence
  Description of Artificial Sequence: Synthetic coding sequence
atggactcagataccctgagagtgttccagaacgaactgatttgttgcatttgcgtgaactacttcatcgatcctgtaaccactgattgcgtgcattccttttgtcgaccctgtctatgcctatgttctgaggaaggtagggcaccaatgcgatgccccctgtgcagaaagatctcagaaaaaccgaatttcaatactaacgtcgccctgaagaaattggcctcgctggccaggcaaacccggcctcaaaacatcaactcaagtgacaatatttgtgtactgcacgaagaaacgaaggaacttttctgtgaggcggataagcgactactgtgcggtccctgcagcgagagcccagaacatatggcccactcccacagcccaatcggatgggccgccgaggaatgtcgtgtgcagaagttgatcaaggagatggattatctgtggaagattaaccaagagacacaaaacaacctgaatcaggagacttcaaaattttgttctcttgtggaagacaagcgcaaccgcattgtataccggtatcagaaaatgcacatttttttagatgaagaggagcagagacacctccaggctctggagcgcgaggcgaaggaactgtttcagcaattacaggactcgcaagttagaatgacccagcatttggaagggatgaaggacatgtacagagagttgtgggagacttaccatatgccagacgtcgagctgctgcaagatgtcgggaacattagcgctcgcacggacttagcccagatgccgaaaccccaaccagtaaatcctgaactcacctcctggtgcattacaggtgtcctggacatgctgaataacttccgagttgacaacgcactcagcacagaaatgacaccctgttacatttctttgagtgaagacgttcgcagggttatcttcggagatgatcatcggagtgcacctatggacccacagggggtcgaatcttttgccgtgtggtgcgcccaggccttcacttccggtaaacactattgggaggttgatgtcacccattcctctaactggatcctgggcgtttgtagagactccaggacggccgacaccaatatcgtgatcgatagcgacaagacgttcttcagcattagttccaaaacaagcaatcattactccctatccaccaacagccctccccttatacagtacgtgcagcgacccctaggatgggtcggagtctttctcgactacgacaacgggagtgtctccttcttcgacgtcagtaaaggatctctgatctacggttttccaccgagctcatttagctcacccctacggccttttttttgttttggctgcacttag

SEQ ID NO: 34192 - DNA, 1554 bp, Artificial Sequence
  Description of Artificial Sequence: Synthetic coding sequence
atggccgcgcagcttcttgaggagaaacttacctgcgcaatttgcctcggcctgtaccaggatcctgtgacactgccatgcggtcataacttctgtggggcatgtattcgcgattggtgggacaggtgtggcaaggcctgccccgagtgccgcgagccctttccagacggggccgagctgaggagaaatgtggccctctctggtgttctggaagttgtgagagcgggtcccgcccgggatccaggcccagatcccggtccaggtccagatcctgccgcgcgttgcccccgccacggcaggcccttggaactgttttgcaggactgaggggagatgcgtatgttcagtttgtaccgtcagagaatgtcgtcttcatgagagggccctgctggatgctgagcggctgaagcgcgaagcccagctccgcgcctcactggaggtcacacagcagcaggcaacgcaagccgaagggcaattgcttgagctccggaaacagtcgtcacagatccagaatagcgcttgcattcttgcctcctgggtatctggaaaatttagttctctcctccaggccttggagattcagcatactactgccctccgcagtatagaggtcgcaaaaactcaagctttagctcaggctcgagacgaggagcagcggctgcgggtccaccttgaggcagtggctagacacggttgccgcatccgagagttgttagagcaggtggatgagcagacctttctgcaggagtctcaattgctccagccgccaggcccactggggcccctcacccccttgcaatgggatgaggaccagcagctgggggacctgaagcaactgctgtccaggctgtgcggattgctcctggaagaagggtctcaccccggtgcacctgccaaacctgttgacctggccccggtggaagctcccggtccactggcccctgtgccttctaccgtgtgtcccctccgtagaaagttgtggcagaattaccgaaatctaacgttcgaccctgtgagtgcaaatcggcacttttacctcagcagacaggaccagcaagtgaagcactgcagacaatctaggggaccgggaggacccggctcatttgagctctggcaggtccagtgcgctcaaagcttccaggccgggcatcactactgggaagtccgggcatccgaccacagcgtcaccttaggtgtgagttacccacagctacccaggtgccgcttggggcctcacaccgacaatatcggccgtggcccctgtagttggggattgtgtgtccaggaggattctcttcaggcgtggcataacggagaagcccagagactgccaggggtatcaggtaggcttcttgggatggacctggacctggcatccggttgcctgactttctattccctggaaccccagacacagcccctctacactttccacgccctgttcaaccaacccttgacgcccgtgttttggctcttggagggaagaacactaacactttgccatcagccaggggctgtctttcccttgggcccgcaagaggaggtcctcagttag

SEQ ID NO: 34193 - DNA, 1407 bp, Artificial Sequence
  Description of Artificial Sequence: Synthetic coding sequence
atgtcaaccgcagaccttatggagaaccttcgggaagaattgacttgctttatttgccttgactactttagtagtccggttacaaccgagtgtggacactctttttgtctggtatgcctcctgaggagctgggaggagcacaatacccccctgtcttgtcctgaatgttggcgcacactggaagggccacattttcagtccaatgagcggctgggccggcttgcatctatagcaaggcaactgcgctcacaggttctccagagcgaagatgaacagggctcttatggccggatgccaactactgccaaagccctgtctgatgacgagcagggagggagcgcctttgtcgctcagtcccatggggcaaatcgagttcacctcagttccgaggctgaggagcaccaccgggaaaaactgcaggagatccttaatttgctgcgtgtgcgtcgaaaggaagctcaggcagtcctgacacacgaaaaagagagggtgaagctttgccaagaggagacaaagacatgcaagcaggtggtggtctccgaatatatgaagatgcaccagtttctcaaggaagaagaacagctgcagctgcagcttttggaacaggaggagaaagagaacatgcggaagctcagaaataacgaaataaagctcacccagcagattagaagcctaagcaagatgattgctcagattgaaagttccagccagagtagcgcgttcgaatcactcgaggaggtccgtggagctctcgaacgtagcgagcccttgctgctgcaatgtccggaggcaaccaccacagaactctcactttgccgcattacaggcatgaaggagatgcttaggaaattttcaacagagattacactcgatccagcaactgccaatgcttacttggtgctgtctgaggacctgaagagcgtgaaatacggcggtagccgccagcagcttcccgataatcccgaacggttcgaccagtcggccacagtgctaggcacacaaattttcacatccggtcgacactattgggaggtcgaagtggggaataaaacggagtgggaggtgggtatttgtaaggactcagttagtagaaaggggaaccttcctaagccaccaggggacttgttcagcttgatcggcttaaaaatcggtgatgactatagtctgtgggtgtcatcccctctcaagggacagcacgtgagagaacccgtctgtaaggtgggagtgtttctggactatgagtccggacatatcgccttctataatgggactgatgagtcacttatatatagcttcccccaagcctcatttcaggaggccctccgcccaatattcagcccatgtctccccaacgaggggactaatactgatcctctcaccatctgttcgttaaactcacacgtgtag

SEQ ID NO: 34194 - DNA, 1164 bp, Artificial Sequence
  Description of Artificial Sequence: Synthetic coding sequence
atggtttgtggcatccaggaggctgccgaaaattataggaaactgttccaggagatcctgaatacgtcaagagagaaacttgaggcggctaaatccatcctgactgacgagcaggagcgcatggccatgatccaggaggaagagcagaacttcaagaaaatgattgaaagcgaatattcaatgaggcttagactccttaatgaggagtgcgaacagaatctgcaaagacagcaggaatgcattagcgacttaaatctgcgggagaccctgttgaaccaggctattaagctggccaccgagctcgaggaaatgttccaggaaatgctccagagacttggcagggttgggagggaaaacatggagaagctgaaagagtctgaagcacgtgcctctgaacaggtgcgttcactgctcaagctcatagtcgaattagaaaaaaaatgtggggaaggcactctcgccctccttaagaacgcgaaatactcgctggagaggagcaagtccttactactggagcacctggaacccgcccatatcacagatttgtcactgtgtcacatacgggggttgtcttccatgttcagggtcctccagcgccaccttacgctcgaccctgagacggcccatccttgcctcgctctctctgaagacttgcgcacgatgaggctccgtcacggccaacaagacggggcggggaatccagaaaggctggacttcagcgctatggtgcttgcggcggaatcattcaccagtgggaggcactactgggaggttgacgtggagaaagccacaaggtggcaagtcggaatataccacggctctgccgatgctaaaggttcaaccgcccgtgcttctggggagaaggtgcttctcacgggaagcgttatggggactgagtggactctctgggtgtttccacctctcaaacgactctttctcgagaagaagctagatacagtgggggtcttccttgattgtgaacatgggcaaatctccttctataatgtcacagaaatgtctctgatttacaacttcagccactgcgcttttcagggagcccttcggcctgttttctctctgtgtatccccaatggggatactagtccggattccttaacaattctccaacacggcccttcctgcgacgccactgtgagtccctag

SEQ ID NO: 34195 - DNA, 666 bp, Artificial Sequence
  Description of Artificial Sequence: Synthetic coding sequence
atgtccaaacggctcagtcctcaactccagcataacatcacggaagacgcatattgtgagacccacctcgaaccaaccaggctcttttgcgatgtcgatcagatcacattatgcagtaaatgttttcaaagccaggagcataagcaccatatggtgtgcggaatacaggaggctgccgagaattacaggaagttatttcaggagatactcaacactagtcgggagaaattggaggccgctaaaagcattctcacagatgagcaggaaaggatggccatgatacaggaagaggagcaaaattttaaaaaaatgatcgagagtgagtactcgatgagactgcgcctcctcaatgaagagtgtgaacagaacctccaacggcagcaggagtgtatatcagatttgaacctgcgggaaactctgctgaaccaggctatcaagcttgctacagagctcgaggaaatgttccaggagatgctacaacgcttgggtcgagtcggacgcgaaaacatggagaagctgaaggaaagcgaggcccgcgccagtgagcaggtgaggtcactgcttaaactgattgtggagttggagaagaaatgtggtgaggggacattagctttgctcaaggtcagatgttgggaaaaagaaaacaagatccactctagtatatag

SEQ ID NO: 34196 - DNA, 1173 bp, Artificial Sequence
  Description of Artificial Sequence: Synthetic coding sequence
atgtgtatttgtcatctcccgtgtaggccagtgaaaccaaacatcatcggcgaacaaataactagcaaaatgggcgctcactaccactgtataatctgctctgccactataacaagaagaaccgatatgctggggcacgtaagacggcacatgaataaaggcgaaaccaaaagctcatatatcgcggcgtcaaccgccaaaccgcccaaagagatactgaaggaggctgatacggacgttcaggtgtgccccaactacagcatcccacagaaaactgatagttatttcaaccccaaaatgaagctgaacaggcagttgatattctgtactctcgccgcactcgctgaagagcggaagccactggaatgtctggatgcctttggagccacgggaatcatgggtctccaatgggctaaacacctgggcaacgccgtgaaagtgacgatcaacgatttgaacgagaattcagtgaccctcatacaggagaactgtcacttgaacaagctgaaagtcgtggtggatagcaaggagaaggaaaaatcagatgacattctggaagaaggagaaaagaacctcgggaatatcaaggtgactaagatggatgccaacgttctcatgcacctgagatccttcgactttatccaccttgaccccttcgggacgtcagtcaattatttggacagcgcctttcggaatatccgcaacctggggatcgttagcgtgacctcaaccgatatttcttcattatacgcaaaggcccagcacgtggccagacgccattatggttgcaacattgttagaactgaatattacaaggagctagccgccagaattgtggtcgctgctgtcgctagggctgccgccaggtgcaacaagggaatcgaggtgctgtttgccgtagctcttgagcatttcgtgctggtcgtggtcagggtcctgcgaggccctactagcgccgacgaaactgcaaaaaagatccaataccttatccattgtcaatggtgcgaagaaaggattttccagaaagacggaaacatggtggaggactatagcgcaaatttcgttattagctataccggcttcccctttgtcaaccggcaggatatcaggaaaactcacatcgatagttgcctcgtgacggtcatggaggcttgtctcgagagacagcagtag

SEQ ID NO: 34197 - DNA, 2202 bp, Artificial Sequence
  Description of Artificial Sequence: Synthetic coding sequence
atggagaatatggctgaggaggaacttctcccactggagaaagaagaggtggaagtggcccaagttcaagtgccaacacctgctcgagattccgccggagtgcctgccccggcaccagactcagccttggattcagcccctacccctgcctccgcaccagcccctgcccccgctcttgcacaggcccctgccctgtctccgtcactcgcctccgcaccggaagaagccaaaagtaagagacacatttctatccagcgccagctagccgatctggagaacctggcttttgttactgatggcaatttcgatagcgcctcctccctgaactcggacaacctggatgccggaaatcgacaggcctgtcctctgtgtccgaaagaaaaatttcgcgcttgcaattctcacaaattaagaagacatctccagaacctgcactggaaagtttccgtggagttcgagggctatcggatgtgcatttgccacctcccctgcagacccgtgaaaccgaacatcattggcgagcagattacaagcaagatgggagcccattatcattgcatcatatgttccgcaactattaccaggagaacagatatgctgggtcacgttcgccgacatatgaataagggggagaccaagtcctcatatattgcagcctctaccgccaaacctcccaaagaaattttaaaggaggccgataccgatgtccaggtgtgccctaactattcaataccacagaaaaccgactcttattttaatcccaaaatgaagctgaaccgccagttgatcttttgtacactagccgctctggcagaagagaggaagcccctggaatgcctggacgcctttggggctacaggcatcatggggctccagtgggctaagcacctgggaaacgccgtgaaggtcaccattaacgaccttaatgaaaattccgtgaccctgattcaggagaattgtcacctcaacaagcttaaagtggtggttgactctaaagagaaggagaagtcagatgacattctggaagaaggggagaaaaatttaggaaatattaaagtgactaagatggatgcaaatgtgctcatgcacttgaggtctttcgactttattcacttagatccgttcggtacttcagtgaactatctggacagcgcgttccgcaacattagaaatttgggcattgtatctgtgacgtccacagatatttcatccttatacgccaaagcccagcatgtggccagaagacactatgggtgcaacattgtcagaacagagtactacaaggagttagccgcccgaattgtcgttgcggctgttgcccgcgcagccgcacgttgcaacaaaggaatcgaggtcctcttcgcagtggcacttgagcatttcgtgctggtggttgtgagggtgctgcgggggccaaccagtgcggatgagaccgccaagaagattcaatacctgatacactgccagtggtgcgaagagagaatattccagaaggacggaaatatggtggaggaaaatccatatcggcagctgccttgtaattgtcatggcagcatgccagggaagactgctatcgagctgggacccctgtggtcatcttccctgtttaataccggttttttgaagagaatgctgtttgagtcattgcaccatgggttggacgacatccagaccctgataaagactctgatattcgagtcggagtgtactccccagtcccagttctctatacatgcatctagcaacgtcaacaagcaggaggagaacggcgtcttcattaaaacgacagacgataccactactgataactacatcgcccagggaaagaggaaatcaaatgagatgattaccaacctgggcaagaagcaaaagaccgacgtcagtaccgagcacccccctttttactataacattcacaggcattctatcaaaggaatgaacatgcctaagctgaagaagttcctgtgttatctgagccaggcaggatttcgagttagtcgcacacatttcgaccctatgggagtgcgcaccgacgccccattaatgcagttcaagtcaatcctcctgaagtattccacccctacttacaccggtgggcagagcgagtcccacgtgcaatccgcaagtgaggatactgtgacggagcgcgtggaaatgtccgtgaatgataaagccgaggcatcagggtgccgccggtggtag

SEQ ID NO: 34198 - DNA, 639 bp, Artificial Sequence
  Description of Artificial Sequence: Synthetic coding sequence
acaagtgtgaactatcttgacagcgcatttcggaacattaggaatctgggtattgtttcggttactagtactgatattagcagtctgtatgccaaggcacagcatgtcgcccggcgtcattatggctgcaatattgtaagaaccgaatattacaaagaacttgcagctagaatcgtagtagctgcagtggcacgagccgctgctagatgcaataagggcatagaggtgctgttcgccgttgcgttagaacatttcgtgctggtcgtggttagggttcttcggggcccgaccagtgccgacgagacggctaaaaaaattcaatacctgatacattgccaatggtgcgaggagcggatcttccaaaaagacggcaatatggttgaggaaaatccctacaggcagctcccgtgtaactgccatggatccatgcccggcaagacagccatcgaactgggtccgctttggtcttcctctttatttaacacagggtttctgaagcgtatgctcttcgagagcctgcaccatggcctcgacgacatacagaccctgataaagaccctcatctttgaaagcgagtgcacaccccagtctcaattcagtatccacgccagcagcaatgtcaataagcagggcgactag

SEQ ID NO: 34199 - DNA, 1392 bp, Artificial Sequence
  Description of Artificial Sequence: Synthetic coding sequence
atggccctctcatgcacccttaatcgttacctccttcttatggcccaggagcatctggaatttagactaccagaaataaaatccttactgctgctgtttggcggccaattcgcgagctcccaagaaacctacggcaagagccccttttggatcctatctattccgagcgaggacatcgcaaggaacctgatgaagagaactgtgtgtgcaaaatccatcttcgaactgtgggggcatggccaaagccccgaggagctttactccagcctcaaaaactacccagtggaaaagatggtgcctttcctgcatagcgattccacttataagataaaaattcacactttcaacaaaacgttaacacaggaggagaagataaagcggatcgatgcactggaatttctcccattcgaaggcaaagtgaacctcaaaaagcctcagcacgttttttcagtgctggaggactatggactcgaccccaattgtatacctgaaaacccacataatatatactttggtcggtggatagcagacggtcagcgcgaactaatagagtcttatagtgttaagaagcgccatttcattgggaatacctccatggatgcgggtttaagcttcatcatggctaaccatggcaaggttaaagagaatgacatcgtgtttgatcccttcgtagggactggtgggctgctgatcgcctgcgcccattttggcgcatacgtttatggcaccgatattgactacaataccgtgcatggattagggaaggcgaccaggaagaatcagaagtggcgcggcccagatgagaacatcagggctaacctgcggcagtacggcctcgaaaagtactatcttgatgtgctcgtgtccgatgcctccaagccatcctggagaaagggcacctattttgatgcaatcatcacggacccaccctacggaatccgtgaaagcacgcggagaaccggcagccagaaagagatcccgaaaggcatcgaaaaatgggagaagtgtcctgagtcacacgtgccagtcagcctgagttaccacctgtcagatatgtttctggacctcctgaacttcgccgcggagaccctggtgctggggggccgcctggtgtattggctgcccgtgtatactcccgaatacacagaggagatggtcccctggcacccttgcttggagttagtcagcaactgtgagcagaagctgtcaagtcacaccagtagaaggctgattactatggagaaggttaaaaaattcgagaatcgggatcaatatagccaccttctaagtgaccacttcttaccttatcaaggccacaacagctttcgggagaagtacttttccggggtgactaaaaggatcgctaaggaagagaaatcgacccaagagtag

SEQ ID NO: 34200 - DNA, 1377 bp, Artificial Sequence
  Description of Artificial Sequence: Synthetic coding sequence
atggccttgtcttgcactctcaaccggtacctattgctaatggcccaggaacatctcgaattcaggctgcccgaaatcaagtctctcctgctgctattcggaggccagtttgcttcctcacaggagacctacggtaagagccctttctggatcctgagcattccgagcgaggacatagcaaggaatctgatgaagaggactgtttgcgcgaaatccatcttcgagctctggggccacggacagagccccgaagagctgtactcaagccttaagaactacccagtcgagaaaatggttcccttcttgcattcagacagtacctataaaatcaaaattcatactttcaacaagacactcactcaggaggagaagattaagcgcattgacgcactggagttcctgccttttgagggtaaggtaaacttaaagaagccccagcatgtgttctcagtcctcgaggactacggtcttgatcccaactgtattccagagaacccccacaatatatactttggaaggtggatcgcagacgggcagagagagttaatcgagagctactctgtaaagaagagacacttcattggcaacaccagcatggatgctgggttgtccttcatcatggccaaccatgggaaagtgaaagagaatgacattgtgttcgatccattcgtggggacaggcggcttgctgatagcctgcgctcattttggtgcctatgtctatggcacagacatcgactataacaccgtacatggcctgggcaaggctacccgaaagaaccagaagtggcgcggaccagacgagaatatccgcgcaaatttgagacagtacggattggaaaagtactacctggatgtgctcgtctccgatgcgtccaaaccctcttggagaaaaggaacctattttgatgcaatcatcaccgatcccccttatggtattcgcgagtctaccaggcgcacaggctcacaaaaagagatccctaagggaatcgagaagtgggagaagtgccctgaaagccatgtccctgtttccttgtcttaccatcttagcgacatgttcctggatctgctgaactttgctgctgaaacgttagtgctggggggtcgacttgtttactggctgcccgtgtacactcctgaatacaccgaagagatggtgccctggcacccttgtttggagctcgttagcaattgcgagcagaaactcagcagccacacgtcccgccggctgatcacaatggaaaagaacagagaccaatatagccatctactctccgatcacttcctgccataccaaggacacaactcattcagagaaaaatatttctcaggcgtaacgaagaggatagccaaagaagagaagtccactcaggaatag

SEQ ID NO: 34201 - DNA, 282 bp, Artificial Sequence
  Description of Artificial Sequence: Synthetic coding sequence
atgaagcggaccgtgtgtgctaagtctatttttgagctgtgggggcatgggcagagccccgaggagctctattcctcgttgaagaattatccagttgaaaaaatggtcccattcctccatagcgacagtacctacaagatcaaaatacacacgtttaacaagactctcacccaggaagaaaagattaaacgtatagacgccctggagtttctgcccttcgagggcaaggtgaatcttaaaaaacctcaacacgttttcagcgtgctggaggattatgggtag

SEQ ID NO: 34202 - DNA, 405 bp, Artificial Sequence
  Description of Artificial Sequence: Synthetic coding sequence
atgaagaggacggtgtgcgccaagtcgatctttgaactctgggggcatggccagagcccggaagaattgtattcatcactgaagaattatcccgtggagaagatggtgccatttctgcactcagactccacatacaaaatcaaaatccacaccttcaacaagacactcacgcaggaggaaaaaattaaacgtatcgatgctctggagttcctccccttcgagggcaaagtgaatcttaagaagccccagcatgtgtttagcgtactggaggactatggactcgatcctaattgtatccccgagaatccacacaatatatattttgggcgttggattgccgatggacagcgggagcttatcgaatcatactcggtcaagaaacggcattttatcggcaacacctag

SEQ ID NO: 34203 - DNA, 774 bp, Artificial Sequence
  Description of Artificial Sequence: Synthetic coding sequence
atggcactgagctgcacactgaatagatacctcctgctgatggcccaggaacatctggagtttcgcttgccggaaatcaagtctctgctgttactattcggaggtcaatttgcctccagccaggagacatatggaaagtcccctttttggatcctcagcatcccttccgaggacattgctcgaaatttgatgaaaagaactgtgtgtgctaagtctatcttcgaattgtggggccatggccagagccctgaggagttatacagctccttgaagaattaccctgtggagaaaatggtgcccttcttacactccgatagtacttacaagattaagatccacacattcaacaaaaccctaacacaggaggagaagattaagagaatcgatgcccttgagtttctcccattcgaagggaaggtgaacctcaaaaaaccgcagcatgttttctcagtgttggaggactacggactggaccccaactgcatcccggaaaacccccacaatatatactttggccgatggatcgctgacgggcagcgggagcttattgagtcttattcggtaaagaaaagacattttattggaaacacaagcatggacgcagggttaagttttatcatggccaaccacggaaaggtcaaggagaatgacattgtctttgacccctttgtcggcaccgggggcctcctgatcgcctgtgctcatttcggagcatatgtttatggcaccgacatagattacaatacagtgcacgggctggcgtgttctacctag

SEQ ID NO: 34204 - DNA, 513 bp, Artificial Sequence
  Description of Artificial Sequence: Synthetic coding sequence
tgactatcttttataatggccaatcacgggaaagttaaagagaacgacatcgtgttcgatcccttcgttgggaccggcggcttgttgattgcttgtgcccacttcggtgcctacgtgtacggaaccgatattgattacaacacggttcatggtctcggcaaagccactagaaagaaccagaaatggcggggccctgatgaaaatattcgggccaatctgcgccagtatggcctcgaaaagtactacctcgacgttctagtcagtgatgcctcaaagccaagctggcggaagggcacttactttgacgccatcattactgaccccccttacggtattcgcgaaagcacaagacggaccgggagtcagaaggagattccaaagggcattgagaagtgtcctgaatctcacgtcccagttagtttatcatatcatttaagtgatatgttcctggacctactaaatttcgccgccgagactctggtgctcgggggcaggctggtgtactggctctag

SEQ ID NO: 34205 - DNA, 378 bp, Artificial Sequence
  Description of Artificial Sequence: Synthetic coding sequence
atgaaactgttaacacacaacctcctgagcagtcatgttcgaggcgttggcagtcgcggcttcccattgcgcctacaggccactgaggtgcggatttgcccggtcgagtttaatccgaactttgtcgcaaggatgattcccaaggtggagtggtctgccttcctggaggccgccgacaatttgcgtctgatccaggtgcctaaaggcccagtggagggatatgaagagaatgaggagtttctgcggaccatgcatcatctactcctggaggtggaggtcattgaaggcacattacaatgtcctgagtccgggaggatgtttcccatctctcgaggcatccccaacatgctgctaagcgaagaggagaccgagagctag

SEQ ID NO: 34206 - DNA, 1347 bp, Artificial Sequence
  Description of Artificial Sequence: Synthetic coding sequence
atgagggaaaacgtggttgtgtcaaatatggagcgagaatccggcaagcctgttgctgttgtggctgtggtcacggaaccatggtttactcagaggtacagagagtatctccaaaggcaaaagctttttgacacccagcacagagtggagaagatgcctgatgggtctgtggccctcccggtattaggagagacgcttcctgaacaacacctgcaggaacttcgcaatcgtgttgcccccggcagcccttgcatgctgactcagcttccagaccccgttccatcaaaacgtgctcagggttgcagcccagcccagaaactctgtttagaggtttcccgatgggtcgagggacggggcgtcaagtggtccgcggaactcgaagctgatcttccccgcagttggcaaaggcacggaaatctactcctcctttccgaggattgtttccaagctaaacagtggaaaaacctcgggcccgaactctgggagaccgtggcactagcattgggagttcagagattggccaagagaggacgggtgtctcccgacggaactcggactccggccgtaactctgctgctcggcgaccacggttgggttgaacacgtcgacaatggcatcagatacaagtttgatgtcacccagtgtatgttttctttcgggaatatcaccgagaagcttagagtggctagtctgagttgtgccggcgaagttttagttgacctttatgccgggattggctattttactctcccgttcctagtgcatgcaggggccgcatttgtgcacgcttgtgaatggaacccgcacgccgtggtcgccctgcggaacaatctggagattaatggggtggccgaccgatgccagatacactttggggacaaccggaagctcaagctgagcaacatagcagaccgcgtcatcctgggcctgattccaagctccgaagaaggatggccgatcgcttgccaggtcctgcgccaggatgccgggggcattcttcatatccaccagaatgtggagagtttcccggggaaaaacttgcaagccctgggagtgagcaaggtcgagaaggagcactggctgtatccgcagcagatcacaaccaaccagtggaagaatggcgcgaccagagatagtagaggaaaaatgctatcccccgctacaaaacccgagtggcagcggtgggccgagagcgcggagacacgaatcgccaccctgctgcaacaagtgcacggcaagccctggaaaacgcagatcctgcacatacaaccagtgaaaagctatgctccccacgtagaccatattgttctcgatcttgagtgttgcccttgccctagcgtgggatag

SEQ ID NO: 34207 - DNA, 1434 bp, Artificial Sequence
  Description of Artificial Sequence: Synthetic coding sequence
atgctgatggcttggtgtaggggccctgtacttctttgtttgcggcaaggactgggcactaatagcttcctgcatggactgggacaggaaccttttgaaggggcacggagtctctgctgtagatccagccctcgcgacctgcgggacggggaaagagagcatgaggccgcccagcggaaagcgccaggggctgagtcctgtccgagccttccattgtctattagcgacatcggtactgggtgccttagctccctcgaaaacctacggctccccacactccgggaggaatcttctcctcgcgagcttgaggactccagcggtgatcagggaagatgcggacccacacatcaaggcagtgaagacccatctatgctgtcccaggctcagagcgcgacagaagtcgaggaaagacacgttagccctagttgttctacgagtagagagaggccattccaggccggcgagctcatcctggccgaaactggagagggcgaaactaagttcaagaagcttttcagactcaataattttgggctgctgaactcaaactggggcgccgttccattcggaaaaatcgtcgggaagttcccagggcagattctgaggtcaagctttggaaaacaatacatgcttagacggccagctctggaagattatgtcgtactcatgaaaagaggcaccgccataacgtttccaaaggatatcaacatgattctgtcgatgatggatattaatcccggcgatacagttctggaggctggatcaggttctggtggtatgagtcttttcctctccaaggctgtagggagtcagggtagggtgatctcttttgaggtgagaaaagaccatcacgatctggcaaagaaaaattacaagcattggcgggactcatggaagctgtcccacgtggaggagtggcccgacaatgtcgactttatccacaaggacatcagcggagctactgaggacattaaaagcctaacgttcgatgccgtggccttggacatgcttaatccccacgtgaccctgccagtgttttacccacacctcaaacacggcggagtgtgtgcggtgtacgtcgtgaatattactcaggtgattgaacttttggacggtatacgcacctgtgaactcgctctcagctgcgagaagatctcagaggtcatcgtgcgtgattggttggtgtgtctcgctaagcagaaaaacggtattttggctcaaaaggtggagtccaagattaacactgacgtccagctggacagccaggaaaagatcggcgtgaagggagagttgttccaagaggatgaccatgaggaatcccatagtgatttcccctatggatcctttccttacgttgcccgaccggtacactggcagccagggcatacagcttttttggttaagctgcgcaaggtcaaaccgcaactgaactag

SEQ ID NO: 34208 - DNA, 933 bp, Artificial Sequence
  Description of Artificial Sequence: Synthetic coding sequence
atgctggtcgtggaggtggccaatgggcgcagtctcgtgtggggcgctgaggccgtgcaagccctcagagaaaggctgggtgtgggaggtagaacggtgggtgcgttgccacgcggtcctcgacaaaacagcaggctcggactccccctcctgctgatgcccgaggaagccagattactcgctgaaatcggtgccgtgacgctcgtgagtgcaccaagaccagactcaaggcaccattctctggcactgacctcttttaagcgacagcaggaggagagtttccaggagcagtctgccttagccgccgaggcaagagaaacgcggcgccaggagcttctggagaagatcacggagggtcaggcagccaagaagcagaaattggagcaggcctccggcgcatccagttcacaggaagccgggagcagccaggccgcaaaagaggacgaaaccagtgacggccaggcttctggcgaacaggaagaggctgggccttccagctcacaggcaggcccatccaacggagtcgcacccttgcctcggagtgccttgttggtccagctggccacggctcgtccccgccccgtgaaagcacggccccttgactggcgagtgcagtcaaaagactggccccatgcgggaagacccgcgcatgaactccggtactctatttatagggatctatgggagcgaggcttttttctttccgccgcaggcaaatttggaggtgatttcctggtgtatcctggcgatccacttcggtttcatgcccattatatcgctcagtgttgggctcctgaagacaccattcctctgcaggacctggtggcagcagggcgcttaggcacttcggtgagaaagaccctgttgctctgtagcccgcaaccagacggaaaagtagtatacacctctctacagtgggcaagcttacagtag

SEQ ID NO: 34209 - DNA, 933 bp, Artificial Sequence
  Description of Artificial Sequence: Synthetic coding sequence
atgctggttgtcgaggtggcaaacggccgctcactggtgtggggcgctgaagcggtgcaggctctccgcgagcggctaggggtcggcgggcggacagtcggagctctcccacgcgggccacggcaaaatagccgcctaggactccctctgttgctgatgccagaggaagctagactgcttgctgaaatcggggccgtgactttggtctcagcaccaagacctgacagccggcaccacagtctagccctgacttcattcaagcgccagcaagaagaatctttccaggaacagtccgcactggccgcagaggcccgagagactcgccgccaagaacttcttgaaaagataaccgaggggcaggccgcaaagaaacagaaactcgagcaggcctctggggcgtcctcatctcaggaagccgggtcatcacaggcagctaaagaagacgaaacctctgacggccaagcaagtggggagcaggaagaagccggaccgtcaagtagccaggccggacccagcaatggcgtggcccccctgccccgcagtgccctgctggtgcagcttgctacagcccgacctcggccagtaaaggctcgtccgctcgattggcgagtgcagagtaaagattggccacatgccggcaggcctgctcacgagctgaggtatagcatctatcgagacctgtgggagaggggatttttcctgagcgcagccggtaaatttggtggggactttctggtgtatcctggcgacccattgagattccacgctcactacatcgcccagtgctgggcccccgaggacacgattcccttgcaggacctcgtcgcagccgggcgtttagggacaagtgtgaggaaaaccctgttgctgtgttccccacagccagacggaaaggtagtatacacttctctgcagtgggcaagtctgcagtag

SEQ ID NO: 34210 - DNA, 933 bp, Artificial Sequence
  Description of Artificial Sequence: Synthetic coding sequence
atgctggtggtagaagtggccaacggccggagtctggtctggggcgctgaggctgtgcaagccctaagggagcgactcggagtgggaggaagaactgttggtgctctcccacgcggcccccggcagaactcgaggcttggcctaccacttctgctaatgccagaggaggcccgacttctggcagagatcggcgcagtgaccctagtgtcggccccgcggcccgattcaagacatcactcactggcgctaacctcattcaagcgccaacaagaagaaagctttcaagagcaatctgcattagcggccgaagctagggaaactaggcgtcaggagctgctcgagaaaattaccgagggccaggcagcaaaaaagcagaagctggaacaggctagcggagcatcctcttcccaagaagcaggatcgtcacaggccgccaaggaggatgagaccagcgacggccaggccagcggggaacaggaggaagccggaccctccagctcccaagccgggcccagcaacggtgtcgccccgctgccacgctctgctcttctcgtacagctggccaccgccagaccccggcctgtaaaggctagacctctcgattggagggtgcagtcaaaggattggccacacgcagggagaccagcacacgagctcagatactccatctacagagatctatgggaacggggtttcttcctgagcgccgctggaaagttcggcggcgattttctggtatacccgggggacccactgcgattccatgcacattacatcgcgcagtgttgggcccctgaagatactatcccactgcaggacctggtcgccgctggccgtttgggtacgtctgtgcggaaaaccttacttttgtgcagcccccagcctgatggtaaagtagtttacacctctctgcagtgggcatccctccagtag

SEQ ID NO: 34211 - DNA, 933 bp, Artificial Sequence
  Description of Artificial Sequence: Synthetic coding sequence
atgttggttgtcgaagtcgctaacggtcgctctcttgtctggggagccgaagccgtgcaggccctgcgggagaggctcggcgtggggggtagaaccgtcggagctttgccaagagggcccaggcagaatagccggctgggcctcccactgctgctgatgcccgaggaagccaggttgttagccgaaatcggagcagttacattggtgagtgccccacggcctgactctaggcaccacagtctcgccctgacaagcttcaaaagacagcaagaagaaagctttcaggaacagtcagctctggccgccgaggcccgagaaacaaggcgccaggaactgcttgagaaaattactgaggggcaggccgctaagaagcagaaactcgagcaggcttccggcgccagcagctctcaggaggccggttcctcccaggcagcaaaagaagacgagacgagcgatgggcaggcttcgggtgagcaagaggaggctgggcctagctcctcccaggctggtccttcaaatggggtggcaccactgcctcggagcgccctgctagtccagttagccacagcacggcctagacccgtcaaggctagacccctcgattggagggtgcaaagtaaggactggccacacgccgggcgccccgcgcatgagcttcggtactctatttaccgggatctgtgggaacgcggcttttttctgagcgctgcaggtaaatttgggggggattttctagtgtatcctggagatcccttgagatttcacgcccattacatagcacagtgctgggcgcccgaagacaccattccactgcaagacctggtggcggccgggcgcctgggaactagcgtgagaaagaccctgctgctctgcagcccccagccagatggtaaagtggtgtatactagcctacagtgggcatctctacagtag

SEQ ID NO: 34212 - DNA, 933 bp, Artificial Sequence
  Description of Artificial Sequence: Synthetic coding sequence
atgctcgtcgtggaggtcgccaacggccggtcattagtgtggggggccgaagccgtgcaggccctccgggagcgattaggagttggcggaagaacagtcggagccctcccccggggacccaggcaaaattctcggcttggattgcccctcctgctgatgcctgaagaagcccggctgctggccgagattggcgccgtgacgttggtatccgccccgcgaccagactctcgacaccacagtttagccctcaccagctttaagcgccagcaggaagaatcctttcaggagcagtccgcccttgccgccgaggcacgcgagactcggagacaggaactactggagaaaatcactgagggccaggcagctaagaagcagaaattagagcaggcatccggcgcttcttctagccaggaagctgggagcagtcaggccgccaaagaggacgaaacatccgacggacaggctagtggtgaacaggaagaagccggcccgagctcatcacaggcgggaccctctaatggggtggcgccgctgccgcgatccgctctcttggtgcagctggctaccgcccggccccgcccggttaaagccagacccttggattggagggtccagtccaaagattggccccatgccgggagaccagcgcatgagctacgttattcaatttaccgggacctgtgggagcgaggcttctttctgtccgcagctggcaaattcgggggggacttcctggtgtatcctggggaccccctgcgtttccacgcccattacatcgcccagtgttgggccccggaggacactataccactgcaggatctggtcgcagccggtagactgggaacctcagtcagaaaaaccttgttactctgttcaccccagccagacggcaaggttgtgtacacctccctccaatgggcaagtctccagtag

SEQ ID NO: 34213 - DNA, 933 bp, Artificial Sequence
  Description of Artificial Sequence: Synthetic coding sequence
atgttggtcgtggaggtagccaatggaagaagcctggtgtggggcgccgaggcagtgcaggccctgagagaacgcttgggagtggggggtaggacggtaggtgccctgccacgggggcctaggcaaaacagccgtcttgggctgccgttgcttctgatgcccgaggaagctcgactcctagctgagatcggggctgtcacactggtctctgcaccgcggccagatagtaggcatcactcgctggctcttacctcatttaaaaggcagcaagaagagtcgtttcaggaacagtctgcgctggctgctgaggcaagagagactagacgtcaggaattactcgagaagatcacagagggacaagccgcaaagaaacagaagttggaacaggcttccggagctagttcgagtcaggaggccgggtcatcccaggccgctaaagaggatgagaccagcgatggacaggcaagcggcgaacaagaggaagccggtcccagcagctcccaggctggaccaagtaatggcgtggcccctcttccacgcagtgccctgcttgtgcaactcgctacggcacgccctagacctgtaaaagcgcggcctctggactggcgggtgcagtctaaagactggccacatgcgggccgcccagctcacgaactacggtacagtatctaccgcgatttgtgggagagaggattctttttgagtgccgccggcaaattcggaggggatttcctggtgtaccctggtgacccccttcggttccatgctcattacatagctcagtgctgggctcccgaggacactattcccttacaggatctcgtcgctgctggaaggctgggcacgagtgtgcggaaaaccttgctgctgtgctcccctcaaccagatggcaaagtggtctatacctccttgcaatgggcttcacttcagtag

SEQ ID NO: 34214 - DNA, 933 bp, Artificial Sequence
  Description of Artificial Sequence: Synthetic coding sequence
atgcttgtggtagaggtggctaacggtaggagtctggtgtggggagcggaagccgtccaggcactcagggaaagactgggcgtgggcggccgcactgtgggcgctctccccagagggcctcggcagaactctaggctcggccttccactgctcctgatgcccgaggaggctcgtctgctggccgagataggagccgtgactcttgtgtctgctcctcgccccgactcccgccaccactcgctcgcgctgactagttttaaacggcagcaagaagagtcttttcaagaacagagtgcgctcgctgccgaagcaagggaaaccaggagacaggagctgcttgagaaaattactgaaggccaggccgccaagaagcagaagctcgagcaggcaagcggcgcatcctcgagccaggaggctgggtcctcccaggcagcaaaggaggacgagacgtctgatggccaggcctccggtgagcaggaggaagctggtccttctagttcacaggccggaccttcaaatggtgtagctccactccctcggagtgcgctgcttgttcagctcgcgacggctagacctcgcccagtgaaggcgcgtcctcttgattggcgagtgcaatcaaaagactggcctcacgctgggcggcccgcccatgaactcaggtattcgatctaccgtgacctgtgggaacgaggtttctttctgtctgctgctggcaaatttggcggggattttttagtatatcccggagatcctctcaggtttcacgctcattatatcgcgcagtgctgggcaccggaggataccatccctctccaggatcttgtcgcggccggaagacttgggaccagtgtgcgtaaaacactgctcttgtgtagcccgcagccagacggaaaggttgtgtatacatccctacagtgggcctctttacagtag

SEQ ID NO: 34215 - DNA, 933 bp, Artificial Sequence
  Description of Artificial Sequence: Synthetic coding sequence
atgctggtagtcgaagtggcaaatggacgttcgctcgtgtggggggcagaggcagtgcaggccctccgtgaacgcctcggcgtcggaggtaggacagtgggggctttaccccggggccccagacagaacagccgtctgggactccctcttctgctgatgcctgaggaagccaggctcctggcagaaatcggagctgtaactctggtgagcgctccccggccagacagccgacatcattccctcgccttgacaagcttcaagcgccagcaggaagagtccttccaagagcaatctgcgttggccgccgaggcccgcgaaacccggaggcaggaactactggagaaaataactgaaggtcaggccgctaaaaaacagaaactggaacaggcctctggggcttcttcctctcaggaggcaggcagtagccaagcagcaaaagaagatgaaacctccgacgggcaggcatctggggaacaggaagaggccggcccttcttccagtcaggctgggccttctaacggtgtcgccccccttccacgctctgctcttttggtccagcttgccactgcccggcccaggcctgttaaagcgcgacctctggattggcgggtgcagtccaaggactggccacacgcaggccggcccgctcatgagttgagatattccatttacagagacttgtgggaacgaggattttttctgtcggcggcgggcaagttcggaggtgatttcctggtgtaccctggggaccccctgcgctttcatgcccactatatagctcaatgctgggcccccgaggataccatacccctccaggacctggtggccgccgggaggctgggcactagtgtacggaaaacactgctgctttgcagtccccagcccgatgggaaagttgtgtatacgtctctacagtgggcgagcctccaatag

SEQ ID NO: 34216 - DNA, 933 bp, Artificial Sequence
  Description of Artificial Sequence: Synthetic coding sequence
atgctggtggtagaagtggcaaatgggagatccctggtgtggggagcagaggccgtgcaggctctgcgagagagattgggagtcggcggtcggacagtcggcgcactccctaggggtccaaggcagaattcacgactcggcctgccacttctactcatgccggaggaagctcgtcttctcgctgagatcggagctgttacactggtgtccgccccaaggccggattcccgtcaccacagcctggcactgacttcattcaaacggcagcaagaggagtcttttcaggagcaatccgccttggctgcagaagcaagggagacaagaagacaagaactgctagagaagatcaccgaaggtcaggctgcaaaaaagcagaaattggagcaggcttccggggccagcagctcacaggaagccgggtcctctcaagcagccaaagaggacgaaacatctgacggtcaagcttccggcgagcaggaggaggcgggtcccagcagctcccaggctgggccctctaatggcgtcgctcctcttcctagatccgctctgctggttcagcttgccacagcccggcccaggcctgtcaaggcccggccactggattggcgggtgcagtcgaaagactggccacacgcaggtcgccccgcgcacgagttgcggtattccatttatagagacttatgggagagaggatttttcctgtcggccgctggaaagttcggcggagatttcctggtgtaccccggagaccctctgcggtttcatgcccactacatcgcccaatgctgggctccagaagacaccattcctttgcaggacctagtggctgctggtagactcggaacgtcggtccgcaagacattgctcctttgctctccgcaacctgatggaaaagtggtgtacacaagtctgcagtgggcttctctgcagtag

SEQ ID NO: 34217 - DNA, 933 bp, Artificial Sequence
  Description of Artificial Sequence: Synthetic coding sequence
atgctggtcgtcgaagtagctaacggtagatcgctggtgtggggagcagaagctgtgcaagctttgcgggaacgcctgggggtgggcggtaggactgtcggagcgctgccacgagggcctcgccaaaacagtcggctgggccttcctctgttgttaatgccggaggaggctcgattgctggcggagatcggtgccgttactctggtctctgccccacggcctgattcacggcaccacagcttggctctgacctcgttcaaacgccagcaggaggagagtttccaggaacagtcggctttagctgccgaggcaagagaaactaggcgtcaagaactcctggaaaagatcaccgagggacaggcagcaaagaagcagaagctggagcaggcttctggggccagttcatcccaagaggcagggtcctcccaagcagcaaaggaggatgaaacgtctgacgggcaggcgtcaggtgagcaggaagaggccggaccctcgagttcccaagcgggaccatctaacggcgtcgcaccattacccaggtctgccttgctggttcaactggctactgcccgcccgcggcccgtcaaagctcgtccgctggattggagggtacagtcgaaggactggccacatgctggaagacccgctcatgagctgcgctacagtatatacagggatctgtgggaaaggggcttcttcttatccgccgcagggaaatttggaggagatttccttgtctatcctggagatccgctgaggtttcacgcccactacatagcacagtgttgggcgccggaagatactattcccttgcaggacctggttgcggccggcaggctgggtacgtcagtgagaaagacactattgctctgttcaccgcagcctgatgggaaagtcgtgtacacatctctgcagtgggcatctcttcagtag

SEQ ID NO: 34218 - DNA, 933 bp, Artificial Sequence
  Description of Artificial Sequence: Synthetic coding sequence
atgttggtggtcgaagtggctaatgggcggtcccttgtgtggggtgccgaggccgtgcaggcactcagagaaaggctcggagtgggaggtcgaactgttggcgcactgcccagagggccaagacagaactctcgactgggcttgccacttctcctcatgccggaggaggctagactgctcgcagagattggtgcagtgaccctggtgtccgctccccgcccagattctcggcatcattccctcgctctcacaagcttcaagcggcaacaggaggagagtttccaagagcagtccgcgctcgccgccgaggcccgtgaaacaaggagacaggagctgctcgaaaaaatcaccgagggtcaggccgctaagaagcagaaactggagcaggcatccggagcatcgtcctcccaggaagctggttcatcacaggcagccaaagaggacgagacctctgatggccaggccagcggcgaacaggaggaagccgggccgagctcttctcaagcaggtccgtccaatggggtggctcctctcccccgcagcgcgcttttggttcagctcgctaccgccagaccccggccggtgaaagctcgacccttggactggcgtgtccaatctaaagattggccacacgcagggagacccgctcacgagctgagatattccatctaccgtgacctgtgggagcgcggcttcttcctgagcgcagccgggaagtttggaggggacttcctggtctaccccggagaccccctccggttccacgctcactacatagcacaatgctgggctccagaggacactatccccctccaagatctggtggccgcgggcaggctgggcacatctgtgcggaagacactgctgctatgcagcccccagcccgatggcaaggttgtctatacgtcattgcaatgggcatctctccaatag

SEQ ID NO: 34219 - DNA, 933 bp, Artificial Sequence
  Description of Artificial Sequence: Synthetic coding sequence
atgttggtagtcgaagtggccaacggcagaagcctggtttggggtgcagaagcagtgcaggccctgagagaacgcctcggcgtgggtggacgcactgtgggtgcgctcccccgggggccgcgccagaatagtcgtctgggcctgccactgcttttgatgcctgaggaggcgaggctcctagccgaaattggtgcggtcacattggtgagcgcacccaggcccgatagtagacatcacagtttggccctgacatccttcaagcgtcagcaggaggaatcctttcaggagcaatctgcccttgcagcagaagctcgggaaactcgaaggcaggaactgctggagaagattaccgagggacaagcggccaagaagcagaaattagaacaggctagcggcgcctcctcttctcaggaagccggctctagccaagccgccaaggaggatgaaaccagcgatggccaggcgtccggtgagcaggaagaagcagggccatccagctctcaggctggaccatctaacggggtggccccccttcctcgctccgccctcctcgtgcagctggccaccgcccgacctaggccagtgaaagctcgacctctcgattggagggtgcaatctaaagactggcctcatgcaggacggcccgcacatgaattgaggtactctatttatcgggatctgtgggaacggggcttcttcctcagtgcagccggtaaattcggtggcgattttctggtgtatcctggagatcccctgcgttttcacgcccattatatcgcccagtgctgggctcctgaggatactatcccactacaggacctggtagccgccggacgtctgggtacatcagtgcggaaaaccctcttgctgtgttcacctcagcccgacggcaaggttgtgtacaccagtctccaatgggcttcactgcaatag

SEQ ID NO: 34220 - DNA, 2199 bp, Artificial Sequence
  Description of Artificial Sequence: Synthetic coding sequence
atggacccgtctgcagacacctgggacctcttctcgccccttattagtttgtggatcaaccggttttacatctatttagggtttgcagtgtccatctcgctgtggatttgcgtccaaattgtgattaagactcagggcaaaaatctacaggaaaaaagtgtgccaaaggctgcccaggatttgatgactaacgggtacgtgagcctgcaagagaaagacattttcgtctcaggggtgaagattttttatggttcccagaccggtactgctaagggctttgctaccgtgcttgccgaggccgtgacatctttggatttgccagtggctattattaatcttaaggagtatgaccctgatgaccatctcatcgaagaggtgacctctaaaaacgtgtgcgtgttcctggtggcaacttacaccgatggtctgcctacggaatcagctgagtggttttgtaaatggctggaagaagcttcgatcgattttagattcggtaagacttacctcaagggaatgcggtacgccgtcttcggcttggggaacagcgcctacgcttcccactttaataaggtcggcaaaaatgttgacaaatggctgtggatgcttggggctcatagagtgatgtctcggggggagggcgattgcgacgttgtaaaatccaaacacggatcaattgaagccgacttccgagcctggaagacaaaatttatttctcagcttcaggccctgcaaaagggagaacgaaagaaatcttgcggcggtcattgcaagaagggcaaatgcgagtcacatcagcacggatctgaagaacgtgaagaaggatcccatgaacaggacgagctgcatcatcgggacactgaggaggaagaacctttcgagagtagcagcgaggaggagtttggcggcgaggaccaccaaagcctgaactccattgtagacgtcgaagacctgggaaagatcatggatcacgtgaaaaaggagaagagagagaaagagcagcaagaagaaaaaagtggcctctttaggaacatgggcagaaacgaggatggcgaacggagagcaatgatcactccagctctaagggaggctctgactaaacaaggataccagctgatcggcagtcacagcggcgtcaaactttgtagatggactaaatcaatgctgaggggtaggggggggtgctataaacatactttttatggcatcgagtctcacagatgtatggaaactaccccttccctcgcctgcgccaataagtgtgtcttttgttggaggcaccacaccaatccagtgggcaccgaatggcgttggaagatggaccagccggaaatgattctaaaggaggcaatcgaaaaccaccagaatatgattaaacagttcaaaggcgtgcctggcgtcaaggccgagcggttcgaggagggtatgacagtgaagcactgtgcactgagccttgtgggcgagccaatcatgtatcctgagataaacagattcctcaagctgctccaccagtgcaaaatatcttcttttctggtcacgaacgcacagttcccagcggagatcagaaatctcgaacccgtgactcagctgtacgtctctgtggatgcttccaccaaggatagtcttaaaaaaatcgacagacctctgttcaaggacttttggcagcgctttttagactcgctaaaagcacttgctgtgaaacagcaaaggactgtgtaccgacttacccttgtcaaggcttggaacgtggacgaactgcaggcctacgcccagttggtaagcctgggcaatccagattttatagaggtgaagggtgtaacgtactgcggcgagtcttcagcctccagcttgaccatggcacacgtgccatggcacgaggaggtggtgcagttcgttcacgagcttgtggatctgatccccgaatatgagatcgcctgtgagcatgaacatagtaactgtctgctgatcgcacatcgcaagtttaagattgggggggagtggtggacttggatagactataatcgtttccaggaactgatccaggaatatgaggacagcggaggatccaagaccttttcagctaaggattatatggcccggacacctcactgggctctattcggggcatccgaaaggggatttgatcccaaagatacgaggcaccagcggaagaataaatcaaaagccatctcggggtgttag

SEQ ID NO: 34221 - DNA, 1017 bp, Artificial Sequence
  Description of Artificial Sequence: Synthetic coding sequence
atggatccaagtgcagatacatgggacctgttctcacctttgatttccttatggattaaccgcttttatatttaccttggcttcgctgtgtctatctctctctggatttgtgttcagattgtcataaaaacccagggctttgctacagtcctggccgaggcagtgacgtccttagatttgcctgtcgccataatcaatcttaaggagtatgatcccgatgatcacctgatagaagaggtgacatcaaaaaacgtgtgcgtgtttctggtggcgacctacactgatggcctgcctacggaatccgccgaatggttttgtaaatggctcgaagaggcctcaatcgactttaggttcggtaagacttatctgaagggtatgagatacgcggtgttcggcttggggaatagcgcttatgcgtctcattttaataaagtgggcaagaatgtcgacaagtggctgtggatgcttggcgctcatagggttatgagtagaggtgaaggtgattgcgatgttgtgaagtccaagcatggatccatcgaggctgactttagagcatggaagacaaaattcatctctcaactccaggctctccaaaagggcgagaggaagaaatcctgtggtggccactgcaagaaaggtaagtgcgaatcccatcagcacgggagcgaagagcgagaggagggctcgcacgaacaggacgagctgcatcatagagatacagaagaggaggagcctttcgaaagctccagtgaggaggaatttggaggcgaagaccaccagagtttaaactcaatcgttgatgtagaggatctgggaaaaatcatggatcatgtgaaaaaggaaaagcgagaaaaggaacaacaggaggagaagtccggactgtttagaaacatggggcgaaacgaagatggagagcgccgagctatgatcacgcccgctttgcgtgaggccctgaccaaacaagtccacgcccctagggaacgccggctgctccaaacgcatatcctctggaactag

SEQ ID NO: 34222 - DNA, 531 bp, Artificial Sequence
  Description of Artificial Sequence: Synthetic coding sequence
atggacccgagcgccgacacttgggatttgtttagcccactgatatccttgtggataaaccgcttttacatctacttggggttcgcagttagcatatctttatggatctgcgttcagatcgtgattaaaacgcagggcttcgcgacggtcctagctgaggccgtgacctcactcgatctgccagtcgccataatcaacctgaaagagtatgacccagatgaccacctcattgaggaagaagaagagccatttgaatctagcagcgaagaggaattcgggggtgaggaccaccagtctctgaactctatagttgacgtggaggacttaggaaagattatggaccatgtgaaaaaagaaaagcgggagaaagagcagcaggaagaaaagtctggccttttccgcaacatggggagaaacgaggatggagagcgccgtgccatgatcacaccggccctcagagaagcgctcactaagcaggtccacgccccgagggagcgccggctcctccagacccacatcttatggaattag

SEQ ID NO: 34223 - DNA, 780 bp, Artificial Sequence
  Description of Artificial Sequence: Synthetic coding sequence
atggaccgatcggcagagttcagaaaatggaaggcacagtgcctgagcaaagctgacctgtcccggaaaggctcggtggatgaggacgtcgtggagttggtccagttcctaaatatgagagatcagtttttcacgaccagcagctgcgccggtcgcatcctgcttcttgacagagggatcaatgggtttgaggtccaaaaacagaactgttgctggcttctggtgactcacaagctgtgcgtgaaggatgacgtcattgtggcattgaagaaggcgaatggagacgcaacgttaaagtttgaacctttcgtgctgcacgtgcagtgccggcagctccaggatgctcaaatcttacactcaatggcaatcgactcaggctttaggaacagcggtatcacagtcgggaagcggggcaaaacaatgctcgccgtgcggtctacacacggtctcgaggttccgctgtctcacaagggcaaacttatggtcacggaggagtatattgactttcttctgaatgtagctaatcagaaaatggaggagaacaagaaacggatcgagaggttttataattgcttacagcacgccttggagagagaaacaatgaccaacctacacccgaagataaaagagaagaacaattccagctacattcataagaaaaagagaaacccagaaaagacccgagcgcagtgtatcactaaagagtccgacgaggagctcgagaacgacgatgacgatgatttgggtatcaatgtcacaatttttccagaggattattag

SEQ ID NO: 34224 - DNA, 528 bp, Artificial Sequence
  Description of Artificial Sequence: Synthetic coding sequence
atggatcggagcgctgagttccggaaatggaaggcccagtgcctgagtaaggcagatctctccaggaaaggcagtgtagatgaagacgttgttgagttggtgcagtttctgaacatgagagatcagtttttcaccacgtcatcatgtgcaggcaggatactcttgctggaccgggcagtaagaagtactcacgggctcgaggtgcccttaagccacaagggtaaactgatggtcaccgaagagtacatcgacttcctgctcaacgttgctaatcagaagatggaagagaacaagaaacggattgagaggttctataattgtctacaacacgccctggagcgagaaaccatgacaaaccttcacccaaagatcaaggagaaaaacaacagctcatacatccacaagaagaaacgaaacccagagaagaccagagcccaatgcattacaaaggaatcggatgaagaactggagaacgatgatgatgatgatctcggcatcaatgtgacaatcttcccagaagactactag

SEQ ID NO: 34225 - DNA, 681 bp, Artificial Sequence
  Description of Artificial Sequence: Synthetic coding sequence
atggatagatcagccgaattccgcaagtggaaggctcagtgtttgtccaaagcagacttgtcgaggaaggggagtgtcgacgaggacgtagtggaattggtacaatttctgaacatgagagaccagttttttacgactagttcctgcgcaggcagaattctcctactggatagaggcatcaacgggttcgaggtgcagaagcagaactgctgctggctgctggtgacacacaagttgtgcgtaaaagatgatgtgcacagcatggctatagattcagggtttcggaactcaggaataaccgtgggcaaacggggcaaaaccatgctcgccgtgcgttcaactcacgggctggaggtgcctttatcccacaagggaaaactaatggtaacagaagaatatatcgacttccttctgaatgtcgcaaatcagaagatggaggaaaacaaaaagcgaatcgagaggttttacaactgtctacaacatgccctggaacgggagactatgacaaatctgcaccctaagatcaaggagaagaacaatagctcctacatacacaaaaaaaaacgcaaccctgaaaaaacccgcgcccagtgtatcaccaaggaatcagacgaggagctggagaatgatgacgatgacgaccttggaatcaatgtaactatttttcccgaagattattag

SEQ ID NO: 34226 - DNA, 948 bp, Artificial Sequence
  Description of Artificial Sequence: Synthetic coding sequence
atggcaggccagcacctgcccgttccgaggctggaaggcgtctcccgcgagcagtttatgcagcatctgtacccacaacgcaaaccccttgtccttgaaggcatcgacttgggaccctgtacttctaagtggactgtggactatctgtcccaggtgggaggaaagaaggaggtgaaaatccacgtggcggcagttgctcagatggatttcatcagcaaaaatttcgtttacaggaccctcccattcgatcaattagttcagcgggccgcggaggagaagcataaagaattttttgtgtcagaagatgagaagtactatttacggtcactcggagaagatccacgcaaggatgtagcggacattaggaaacagttccccttactaaagggggacataaagttccccgagttctttaaagaggagcagtttttttcgagcgtttttaggattagttctcccggactacagctatggactcattatgatgtgatggacaatctgctgatccaagtaacaggcaagaagagggttgtcctcttcagcccgcgagacgcgcaatacctctacctgaaagggaccaagagcgaagtcctgaacattgacaaccccgatctcgcaaagtaccccttgttttcgaaggctaggagatacgagtgttccctggaggctggcgatgtactgtttatccccgctttgtggtttcataatgtcatctctgaggagtttggggttggtgtcaacattttttggaaacacctacccagcgaatgctatgacaaaaccgacacatatggcaacaaggaccctacagctgcatcaagggcagcgcagatcttggatcgggccctcaaaacactggcagaactccccgaggaatatcgggatttttacgctaggcgaatggtgctgcatatccaggacaaagcctattcaaagaatagcgaatag

SEQ ID NO: 34227 - DNA, 825 bp, Artificial Sequence
  Description of Artificial Sequence: Synthetic coding sequence
atgttgaatctgctgctgttggctcttcctgttttggcttccagagcctatgccgcccccgcccctggccaggcgctacagcgagtcgggattgtcggggggcaggaagccccacgatcaaagtggccctggcaagtgagcctgcgggtccgagaccgctattggatgcatttctgtggcgggtccctgattcacccccagtgggtgctaaccgctgcacattgtgtcgggccagatgtcaaggacctggccgccctgcgagtgcagctgagggaacaacatctgtactatcaggaccagctgctgcccgtttccaggatcatcgttcatcctcagttttacaccgcacagatcggggcagatatcgctcttctggagctggaagaacctgtgaatgtgtcttcacacgtccacacggtcactctgccacctgcaagcgaaacttttccccccatgccctgttgggtgaccgggtggggcgatgtcgacaacgacgaacgtctccccccgccatttcctctgaagcaggtgaaggtccctattatggagaaccatatatgtgacgctaagtaccaccttggcgcttataccggcgacgacgtcagaatcgtgagggatgacatgctctgtgcaggaaatactagacgcgactcctgtcaaggtgacagcggcgggccactggtgtgcaaggtgaacgggacttggcttcaggcaggtgtagtcagctggggcgagggttgcgcccagcctaacagacctggcatctatactcgggtgacctattacttggattggatccaccattatgtgccaaagaagccttag

SEQ ID NO: 34228 - DNA, 2271 bp, Artificial Sequence
  Description of Artificial Sequence: Synthetic coding sequence
atgagcaaaatgcccgccaaaaagaagagctgctttcagatcacctctgttactactgcccaagtggctaccagcatcacagaggacactgaatcactggatgaccctgacgagagccgcactgaagacgtaagcagtgaaattttcgacgtgtctagagccacagattacgggccagaggaggtgtgcgagcgcagctcttcggaggagaccctgaacaacgtcggagacgccgagactcctgggaccgtctctccgaatctgttgctggacgggcagctggcagcagcggctgccgcacctgcgaatggcggcggggttgtttccgctagaagcgttagtggagcgctggcaagcactctggcggccgccgccacgtcagctcccgctcccggcgctcccggaggtccacagctcgcaggctcttctgcgggtccggtgacagcagctccctctcaacccccaaccacatgctcaagtagatttagagttattaagctggaccacggaagtggtgaaccctatagaaggggccgttggacatgtatggagtactatgagcgggactcagacagttcagtgctgacaagaagtggcgactgcatacgacacagcagcacatttgaccagacagccgaacgggactctggcctcggagcaaccggaggctcagtggttgtcgtggttgccagcatgcaaggggcgcacggcccagagagcggcaccgatagcagcttgacagcagtgagtcagctgcctccgtctgagaaaatgtcccaaccaacaccagcacagccacagtctttctcagtggggcagcctcagcctcctccgccgcccgtgggtggagcagtggcacaatcttccgcacctttgccaccgtttcccggcgcggcaaccggaccacagcccatgatggctgcagctcagccaagtcagcctcagggggcgggccctggtggccagaccctgccaccaactaatgtcactctcgcccagccggcgatgagcctcccaccgcagcctgggcccgcggtcggagcgccagccgcccagcagccacagcagtttgcttatccccagcctcagatccccccaggccatctcttgccagtacagccgtccggacaatcagagtacttgcaacagcacgtggctggcctacagcctccctcacctgcgcagccatctagtacgggcgccgcagccagtcctgctactgctgcgactctgcctgtcggtacaggccagaatgcctcttcagtcggtgcccagctgatgggtgcctcctctcagccaagtgaagctatggctcctcgtactggcccagctcagggtggccaggttgccccgtgtcaacctaccggagtgccgccggcgaccgtgggtggggtcgtccagccttgtcttggccccgccggcgccggacagccccaaagcgttccgccccctcagatgggtgggagcggacctttaagcgcagtgccgggcggtcctcatgccgtggtccctggagtcccaaatgtgcctgccgccgtccctgcgccgtctgtacctagcgtttctacaacgtctgttactatgcccaatgtgcccgctcccctcgcccaatctcagcagctcagctcccacacacccgtgtcacggagtagcagcattattcaacacgtgggtctcccattagcaccgggtacccactccgccccaacctccttaccccaaagcgacctgtcccaattccagacacagacccaacccttggtcggacaggtcgacgatactagacgaaagagtgagcccctgccacagcctcctctgtcccttattgccgaaaacaagccggtggtgaaacccccagtagccgactcactggcaaacccactccaattaacaccaatgaacagtctcgccacttctgtattttcaatagccatacccgtggatggggacgaggactcggctagcggtggaggagtagtggctatcgataacaagatcgagcaagcaatggaccttgtgaagtcccacctcatgtacgcagttcgggaggaagtggaagtactgaaggagcagatcaaggaactggtcgaacggaatagcctgcttgaacgcgagaatgcgcttcttaagtcactctcatcaaacgaccagctgtcccagctgccaacccaacaagcgaaccctggctcaacttcccagcagcaggccgtgattgcccagccccctcagcccactcagccgcctcagcaaccaaatgtttcatcagcttag

SEQ ID NO: 34229 - DNA, 2343 bp, Artificial Sequence
  Description of Artificial Sequence: Synthetic coding sequence
atgagcaaaatgcccgctaaaaagaagagttgtttccagatcaccagcgtgacgaccgctcaagtggccacatccattaccgaggatactgagtccctggacgacccagacgagagtcgcaccgaggacgtaagctccgagattttcgacgtttccagggcaaccgactatgggcccgaagaagtctgcgagaggagtagcagcgaggagacgctcaacaacgtgggggacgcagaaacgcccgggacggtttctccaaacctgctcctcgacggtcagctggcagccgccgcagctgcccccgcgaacggcgggggcgtggtgagcgctaggtctgtgagtggcgcccttgctagtacactggcggcagccgcaacctccgcgccagctcctggcgctcccggtggcccacagctcgctggttccagtgcaggacctgtcacagctgctccttctcagccgcccacgacatgttcaagccggtttcgagtcatcaaactcgaccacggtagtggcgagccctataggcggggcagatggacatgtatggagtattacgaaagagacagcgattcctccgtactgacaagatctggggactgtattcggcatagttccacttttgaccaaacggcagagcgcgattcgggcctcggggcaaccgggggatcagtagtggtcgtggtggcaagtatgcagggcgcccatggcccagaaagtggtacagattcatccctcacggctgtttcccagttgcccccctcggagaagatgagccaacccactcccgcgcagccccagagtttttctgtgggacagccccagcctcccccccctcctgtcggcggagcggtcgcccaatcctcagcccctctccccccgtttcccggcgccgccaccggcccacagccgatgatggctgctgcgcagccctcccaaccccagggcgccgggccaggaggacagactttaccaccaactaacgtgaccctcgctcaacctgccatgtccctgccacctcagcccggccctgcggtgggggccccagctgcccaacagccccaacagtttgcatatccgcaaccccagataccccccgggcacttgctgcctgtgcagccaagcggccagtccgagtatctgcaacaacacgttgcaggactgcagccacccagtcccgcccaaccttctagcaccggagcagccgcctcccccgccaccgcagcaactctaccagttggcacgggtcagaatgccagctcagtgggagcccaactcatgggtgcaagcagtcagcctagcgaggcaatggcgccaaggaccggccctgcccaagggggtcaggtggcgccgtgccagcctactggagtcccccctgccacagtggggggggtagtgcaaccctgtctcgggccagcaggcgctggccaaccacagtctgtccctcctcctcagatgggcgggtcaggacctctgtcagccgtccctggaggcccgcatgctgtcgtccccggggttccgaacgtccccgcagcagtgcccgccccctctgtcccatcggttagtacaactagtgtcacaatgccaaacgtcccagcgcccttagcgcagtctcagcaattgtcctcccatacaccagtgtcaagaagttcttctattatacagcacgtggggctgcctctggccccaggcacgcatagtgcccctacttctctcccccaatctgaccttagccaatttcagactcagacccaacccctggtggggcaggtggacgataccaggagaaagtcagagcccctgccacagccgccactttctctgattgccgagaacaaacccgttgtgaagcctcctgttgccgacagtctagccaacccactacagctcactcctatgaactctcttgcaacttctgtgttcagcattgcaatacctgtcgatggtgatgaggaccggaatccctccacggctttttaccaagcatttcacctaaacacactcaaggagagcaagtcgctctgggattctgcctcgggcggaggcgtggtggctatcgataacaaaatagaacaggcgatggacctggtgaagtctcacctgatgtatgctgtgcgagaagaagtggaagtcctgaaagagcagattaaagagctcgttgaacggaattccttacttgagagggagaatgccctcctcaagtccttaagcagcaatgatcagctgagtcaactcccaacacagcaggcaaacccaggttccacaagccagcagcaggccgtgatagcccagccgccccagccgactcagcccccccagcagcccaatgtgagctctgcatag

SEQ ID NO: 34230 - DNA, 690 bp, Artificial Sequence
  Description of Artificial Sequence: Synthetic coding sequence
atgccgaacgtgccggctcctctggcccagtcccagcagctgagttctcatactccagtgtcccgcagttctagtattattcagcacgtgggtctgcccctggctcccgggacccacagcgcaccaacctcacttccccagtcagatctcagccaatttcagacacagactcagccattagtggggcaggtggatgacacccgccggaagtcagaaccattaccacaacccccgttgtcactcattgctgagaacaaaccggtggtgaaaccacctgtggccgatagtctagcgaatcctctgcagctgacccccatgaatagtctggccacctctgtgttcagcattgccatacctgtggatggggacgaggacagtgcaagcggcggcggagtggtggcaatcgacaacaagatcgagcaagccatggacttagtgaagtcgcacctaatgtacgcagtacgagaagaggtggaagtcctcaaggagcagattaaagagctcgtcgaacgcaacagcctactggagcgggagaatgcactcttgaagagtctgtccagcaatgatcaactctcccaattgcctacacagcaggcaaatcccggctctaccagccagcagcaagccgtcatcgctcagcctccccagccaacacaacccccccaacagccgaatgtttcttcagcttag

SEQ ID NO: 34231 - DNA, 576 bp, Artificial Sequence
  Description of Artificial Sequence: Synthetic coding sequence
atggccggggctgctgaggatgcaagagctctgttcagggcaggcgtctgcgcagcactggaagcatggcctgccctccagattgccgtggagaatggttttggcggcgtacactctcaagagaaggccaagtggctcggcggagctgttgaggattacttcatgcgcaacgctgacctcgagctcgacgaggttgaagattttttgggcgagcttctgacaaacgagttcgatactgttgtggaggacggttctcttccgcaggtttcacagcagctgcaaaccatgtttcaccactttcagcgcggggacggagcagcactgcgagagatggccagctgcatcactcagcggaagtgcaaagtgacagctacagcactgaagacagcaagggagacagatgaggacgaggacgacgttgatagcgtggaggaaatggaggtaacagctactaacgacggcgcagcaacagatggagtctgtccccagcctgaaccaagtgacccagatgctcaaactatcaaggaggaggatattgtagaagacggctggaccatcgtgcgccgtaaaaaatag

SEQ ID NO: 34232 - DNA, 801 bp, Artificial Sequence
  Description of Artificial Sequence: Synthetic coding sequence
atgatgaagactctgagctcaggcaactgtaccctgtccgtcccagctaaaaattcgtaccggatggtagtgttaggcgcaagccgggttgggaagagtagcattgtatcccgtttcctcaacggaaggttcgaagatcagtatacccccactatcgaagattttcataggaaagtgtataacatccgaggggatatgtatcagttggacatcctagacaccagcggcaaccatccctttcctgctatgcggaggttgagtatccttaccggggacgtgttcatactggtgttttccctggacaaccgggagtcttttgacgaggtaaaacggctgcagaaacagattttagaggtcaaaagctgcctgaaaaacaaaacaaaggaagcagccgaactgccaatggtcatttgcggaaacaagaacgatcatggcgaactgtgtcgtcaggtacctaccaccgaggccgagctactggtcagtggggatgagaattgcgcgtattttgaagtcagcgcaaaaaagaacacaaatgtagatgagatgttctatgtgcttttctccatggccaaacttccccatgaaatgagtcctgctttacatcgtaagatttctgtgcaatacggtgacgcttttcatcctaggccattctgcatgaggcgagtcaaggagatggatgcttatggcatggtctcccccttcgcaaggcggccatccgtcaacagtgacttgaagtatatcaaagctaaggttctccgggaggggcaggcaagagagcgtgacaaatgcaccatacagtag

SEQ ID NO: 34233 - DNA, 636 bp, Artificial Sequence
  Description of Artificial Sequence: Synthetic coding sequence
atggaggcagaaaggggacccgagaggaggcccgcagagaggtcgagtcccggtcagacccctgaagagggagcacaagcactggcagagttcgctgccttgcacggccccgccctgcgagcctctggagtgccagaaagatattgggggcggttgctgcataaactggagcacgaagtttttgacgcgggtgaggtattcggaattatgcaggtggaggaggtggaggaagaagaggatgaggcagcccgggaggtgcggaagcagcaaccaaatcctggcaatgagctgtgctataaggttatcgtaacgagagagtccggtctacaggcagctcaccccaacagcatatttcttatcgatcatgcctggacctgtcgggtcgaacatgctcgccagcaattacagcaggtgcccggcctgctccaccgtatggccaatcttatgggtattgagttccacggcgaactgcctagtaccgaagcagtcgccctagtgctcgaggagatgtggaagtttaaccagacgtacaggcatgtttgccggaggcctcacgccgaagtgggacagcgaccccgttggaaagccggcgatgccgctgcagatccaggaggcgagcttcagccacggctctag

SEQ ID NO: 34234 - DNA, 1380 bp, Artificial Sequence
  Description of Artificial Sequence: Synthetic coding sequence
atggagccctcgacatgcaggaccatggaatccgaggaggactatgtagaggagaaggagtcagagaaatgtgtgaaagagggggtaacaaacccaagcaacagctcccagcaagcactgctgaaagccgactataaagctttgaagaacggcgtaccttcgcctatcatggccaccaagattccaaaaaaggtcattgcaccggttgacaccggagacctagaagccggaaggagaaaacgccgtcgcaagcgccgctccttggccattaatctcaccaactgcaaatatgaatcggtgcgcagggccgcgcaaatgtgcggacttaaagaggtcggagaggatgaagaatggaccctgtactggacggattgtgcagtctccctcgagcgcgtaatggacatgaagaggtttcaaaagatcaaccactttcccggaatgacggaaatttgccgcaaggacctcctcgctcgaaacctaaaccggatgtataagctgtacccctccgagtacaatatttttccgcggacttggtgtctgccggcggattacggggattttcagagctatgggcggcagcgtaaagcgagaacctacatctgtaaacccgacagcggatgtcagggcagaggcatctttattaccagaaaccctcgtgaaatcaagccaggcgagcatatgatctgccagcagtatatttcaaagcctctgctaattgacggcttcaaattcgacatgagagtctacgtcctgattacctcatgcgatcccttacggatcttcacatatgaggaaggcctggcccgattcgccactacgccttatatggaaccgtcccacaataacttggacaacgtgtgcatgcatttgaccaattatgcaataaacaagcataatgaaaattttgtgcgggacggagctgtggggtctaaaagaaaactctctacactgaatatctggttacaggaacacagctacaatcctggggagttatggggcgatatcgaagatatcataattaagactattatttctgctcattctgtcctccggcacaactatcggacctgctttcctcaatacctgaacggtggcacctgcgcatgttttgagattctcggcttcgacattctactcgaccacaaattgaaaccatggctgttagaggtgaatcactcaccttcctttaccacggactcatgtctcgaccaggaagtcaaagatgctttactgtgcgatgctatgactttagttaaccttcgaggctgtgataagaggaaggtaatggaggaggacaaacggagggttaaggaacgcctgtttcagtgctacaggcagcctagggaatccaggtgtgcacgatgtctagcatgtgtttag

SEQ ID NO: 34235 - DNA, 2448 bp, Artificial Sequence
  Description of Artificial Sequence: Synthetic coding sequence
atggaacctagcacttgccgcactatggagagtgaggaggactacgtcgaggagaaagaatctgaaaaatgcgttaaggaaggagtaaccaatccttctaatagttcacaacaggccctgctgaaagccgactacaaagcactcaagaacggggtgccatctccaatcatggccactaagatcccgaaaaaagtgattgcccctgtggatacaggagacctcgaggccggtcggagaaagaggaggcgaaaacggcgttcgttggctatcaacctcactaattgtaagtacgagtccgtcaggcgggccgcacagatgtgcggcttgaaggaggttggcgaagacgaggagtggacattatactggacagattgcgcggtcagcctcgagagagttatggatatgaagcgcttccagaagattaaccattttccaggcatgaccgaaatttgcaggaaggacttgttagcacgcaacttgaacaggatgtacaaactctacccaagtgagtataacatattccctcgcacttggtgcctgcctgctgattacggagatttccagtcatatggaagacagaggaaggctcggacttatatctgcaagccggatagcgggtgtcagggtcgcggcatctttataactcgcaaccctcgcgaaatcaagccaggagagcatatgatttgccagcagtacatcagcaaacctcttcttattgatggcttcaagtttgatatgagagtttatgtacttatcacatcatgcgatcccttgaggatctttacctacgaggaaggactggcgcggttcgccactacaccttatatggagccctctcacaataacctggacaatgtgtgcatgcatctcacaaactacgcgatcaacaagcataatgaaaattttgtcagggacggcgccgtgggatccaagaggaagctatcaaccctgaatatttggctgcaggaacacagctacaaccctggggaactgtggggcgatatcgaggacattatcatcaagaccatcatcagtgcccatagtgttctgcgtcataattacaggacctgttttccgcagtacctgaatggagggacctgcgcctgctttgaaattctgggatttgacatcctgctggaccataagctgaagccttggctgctcgaggtgaaccattctcctagctttaccacagatagctgtctcgaccaagaggtcaaagatgcgctgctctgtgatgccatgactctagtgaacctgcgaggatgtgataagagaaaggttatggaagaggataaacgaagagtgaaagaacgactgtttcagtgctacagacagccaagagaatcgagaaaggaaaaaactgagtccagccacgtggccatgttagatcaggagcgttacgaagactcacacctcggtaagtatagacgcatttatcccggtcccgacacagagaaatacgcacgattctttaagcataacggaagcttatttcaggagaccgccgcctccaaggccagagaagagtgcgcccggcaacaactagaggagattcgacttaaacaagagcagcaggaaacttccggaaccaaaaggcagaaggcaagggatcaaaatcagggagaaagtgcaggcgaaaagtcacgacctcgcgccggcctacaatccctctcaacccatctggcttaccggaacaggaattgggaaaaagaactgcttcctggacagctggacaccatgagaccccaagagattgtcgaggaagaggaactggagcgcatgaaggctttgcttcagcgagaaactctgatccgcagtctcgggatcgtagaacagctgactagactgcagcatcccggccctcagggacagaaaaagctccatgagtctagggacagactcggaagtcaggagctcaagtccatgtccctcgttcttctggtgctgctgaggggggcggccacagaacagggcgctccacacttcctgcacccggtcctgcctcacgagtcaattcccaggatcctgggggccctgccgtccatgaacgccgctattcctcacgtgccccgataccacctgcagccgaagaacttcaactggacaggtgaacctgccgccattaattcttgctccctctccatgaagaaggccggccggtgctatttttccagcgcccgaatcaggctcacaagccagggtcaggcatcaaggcggctggaggccattaacagggtgctcgctggaagcgtgcctcccacgctgactcccaaacagggctactttttacaacccgagagggtggctagtgattcttggaccgagtgtacccttccatcaatggtgaatagtgagcacagagcggccaaggtgcctctctgtccagctagcgctcctatgctgcagcgaagcagggcacttttgaatatcaaccagtttcgctag

SEQ ID NO: 34236 - DNA, 1779 bp, Artificial Sequence
  Description of Artificial Sequence: Synthetic coding sequence
atgagaggtagagacttgtgctcaagcacacagtctcaggcccttggttcactcagaactaccacacccgcttttacgctgaacatccctagcgaggcgaaccatacagagcaaccgccagcgggcctgggagcccgcctgcaagaggccggcgtttctatccctccgaggcggggtagacccactcccaccctcgagaagaagaagaagccacaccttatggctgaggatgaaccgtccggagccctgctgaagcccctcgtgtttcgggtggacgaaactacccccgcggtggtgcaaagcgtcctgctcgaacgcggttggaataaattcgacaagcaggagcagaacgctgaggactggaacttatattggaggacctcatcctttcgcatgaccgagcacaatagcgtaaaaccttggcagcagcttaaccaccaccccggcacaaccaagctcacccgtaaagattgcctggctaagcatctcaaacacatgaggcgaatgtatggtacgtcattatatcagttcataccactgacattcgttatgccaaacgattacactaagttcgttgctgagtattttcaagagcgacagatgctgggtacgaaacactcctactggatttgcaaacccgcagagctctcacgtggccggggaatcctgatcttttccgacttcaaggatttcatcttcgacgatatgtatatcgtacagaagtacatcagcaatcctctgctgattggtcgttacaaatgcgatctcagaatatatgtttgcgttaccggattcaagcccctcactatctatgtttatcaggagggactggtgcgattcgctactgagaagtttgatctctctaacttgcagaacaattacgcccaccttaccaatagtagcatcaataaaagtggagccagctatgaaaagataaaggaagtcattggtcatggctgcaagtggaccctgagtcgcttctttagttatctgcgctcatgggacgtggatgacctcctcctgtggaagaagattcaccgcatggttatacttacaatccttgccattgccccttcggtaccattcgctgctaattgctttgagctattcggtttcgatatcttgattgatgataatctgaaaccttggctccttgaggtaaactacagtcccgcactaactctagattgtagcactgatgttctagtcaaaagaaagctcgtgcacgatattatcgacttgatatacctcaacggcctacgcaatgaaggtcgtgaggcaagcaatgccacccatggaaattctaacattgacgccgccaagagcgaccgtggaggccttgatgctcccgactgtcttccctacgattccctgtcattcacatccaggatgtataatgaggatgacagcgtcgtcgaaaaggctgtaagtgtcagaccagaggcagctcctgcaagccagctcgagggagaaatgagcggtcaggattttcacttatcaacacgtgagatgccccagtcgaagcctaagttaaggtccagacacaccccacataagaccctaatgccttatgcctctcttttccaatcccacagttgtaaaactaaaacgtccccctgcgtcctcagtgacagaggcaaggccccagatccgcaagctgggaactttgtccttgtgttcccctttaacgaggcgacactgggagctagccgaaacgggctcaatgtcaaacggatcatacaggagcttcaaaaactaatgaacaagcagcacagctag

SEQ ID NO: 34237 - DNA, 1560 bp, Artificial Sequence
  Description of Artificial Sequence: Synthetic coding sequence
atggcagaagacgagccctccggcgccctcctgaaaccgctggtcttccgcgttgacgagaccactcccgcagtagtccaatccgtgttgctcgaaaggggatggaataagttcgacaaacaggagcaaaatgcagaagactggaacttatactggaggaccagttcttttcgcatgaccgagcacaatagtgtgaaaccatggcagcagctgaatcatcaccccggcactacaaagttaacaagaaaggattgcctcgctaagcacctgaagcacatgcgtcgcatgtacggaactagcttgtaccagttcatacctcttacattcgtcatgccgaatgattacactaagttcgtggccgaatactttcaggagagacagatgcttggcaccaagcatagctattggatctgtaagccggcggaactttcccgcggtaggggtattttgatcttttctgactttaaggattttatttttgacgatatgtacatcgtccagaaatacatcagtaaccctctgttgatcggaaggtacaagtgtgacctgcgaatctatgtctgcgtgacagggttcaaacccctcacaatctacgtctatcaggagggattagtgagattcgctactgaaaagttcgatttgtccaacttgcaaaataattacgcgcacctgaccaattcatccatcaataagtctggcgcctcctacgaaaagatcaaagaagtaattggccatggatgtaaatggactctgtctcggttcttcagttacctgcggagttgggacgtcgacgatctgctcctgtggaaaaagatccacagaatggtcattctaaccatattagctattgcccctagcgtgcccttcgccgcgaactgctttgagcttttcggctttgacatactgattgatgacaatctgaaaccctggctactggaagttaattactctccggctctgaccttggattgtagcaccgacgtgcttgtcaaaaggaaattggtacacgacatcattgacctgatttatctgaatggccttcgaaacgagggacgggaggcatccaatgcaacccatggcaactctaatatagacgccgctaaatcagatcggggaggcttggatgcaccggactgcctgccatacgactccttgtcattcacctcccgcatgtataatgaagacgatagcgtggtggaaaaggcagtcagtgtgcggcctgaagccgccccagctagccagctggagggtgaaatgtctggccaggattttcacctgagcactcgcgagatgccccagtccaaacccaagctgagatcccgccacacccctcataaaactctcatgccttatgctagtttgtttcagtctcatagctgcaaaactaaaacgagcccatgtgtcttatcagaccgcggaaaggctcctgatccgcaggccggaaactttgtgctcgtctttcccttcaatgaggccacactgggcgccagcagaaatggccttaatgttaagcggatcatccaggagctgcagaagctcatgaacaaacagcactcttag

SEQ ID NO: 34238 - DNA, 2013 bp, Artificial Sequence
  Description of Artificial Sequence: Synthetic coding sequence
atgccgtcccttccacaggaaggggtgatacaggggcctagccccctggacctcaacacagagttaccataccagtcaactatgaagcggaaggtgaggaagaaaaagaagaagggtacgatcaccgccaatgtggcaggtactaagttcgagatagtcaggttagtgatcgatgaaatggggtttatgaagacaccagacgaagacgaaacctctaatctcatctggtgcgactccgctgtgcagcaggagaagataagcgagctgcaaaactatcagcgcattaaccactttcccggtatgggcgaaatctgccgcaaggatttcttagccagaaacatgacgaaaatgatcaaatcccggcctctcgattacacctttgtgcctagaacgtggatcttccctgctgaatacacacagttccagaattatgtaaaggagttaaagaaaaaacgcaagcaaaagacatttatcgttaaaccagcaaatggggctatgggccacggcatttctctcatccgtaacggagacaagctgccaagccaggatcatctgattgtacaggagtatattgagaagccattcctcatggagggatacaagtttgaccttagaatctatatcctggttacaagctgcgatcccctaaagatctttctgtatcatgatggtctggtacgcatgggcacagagaaatacattcccccgaatgagtcgaatctgacacagctctacatgcacttgacgaactatagcgttaacaagcacaacgagcactttgagcgggacgagactgagaataagggttcaaagcggtctattaaatggtttacagagtttctgcaggcgaaccaacacgacgtcgctaagttctggtccgacatcagcgaattggtcgtgaagaccttgatagtcgccgagccccacgtgctccacgcatacagaatgtgtaggcccggccagccccctggctctgagtctgtgtgctttgaggttctgggttttgacattctcctggatcggaagcttaaaccttggctgctggaaatcaaccgcgccccttcatttggtacagatcagaagatcgattacgatgtaaaacgaggggtgctgctgaatgccttgaagttactcaacattagaacctccgacaaacgccgcaacctagcgaagcagaaggctgaggcgcagcggaggttgtatgggcagaattcaattaagagactgttgcccggctcctctgactgggaacagcaaagacaccaactggagcgcaggaaagaagagttaaaagaacgtctggcccaagtgcgcaagcagataagccgggaggaacatgaaaatagacatatgggaaattaccgccggatttatccgcccgaggacaaagctttacttgaaaagtacgagaatttgctggcagtcgcgtttcagacgtttctgagcgggagggcagcatctttccaacgggaattgaacaatccactgaagagaatgaaggaagaggatattctggacttgctggagcagtgcgaaatagatgatgaaaaactgatgggaaaaactacgaagacacgaggccctaagccactctgctcaatgccggagtctaccgaaattatgaaacgccctaagtactgctccagcgattcttcttacgatagtagctccagcagctcagaatcggatgagaatgagaaagaggaataccaaaataaaaagcgagagaaacaagtgacatataatcttaaaccatctaaccattacaaattgatccaacagccatctagcatcagacggagcgtatcatgtcctcgcagcatcagtgcccagtctcccagtagcggcgatactaggccattttctgcccagcagatgatctctgtttcccgtcccaccagcgcttcccggagtcattcactcaatcgagcgtccagctacatgcggcacctgccacatagcaacgatgcttgtagcaccaactctcaggtggtggccataattcggcagtag

SEQ ID NO: 34239 - DNA, 1710 bp, Artificial Sequence
  Description of Artificial Sequence: Synthetic coding sequence
ctgggacaacgccagctgtttcaggccctgagagtggagcacaggtctcccgagccttggttgcctagggctgttggcggacgacgcagagcgcccgatcatcagtgcagattaccaagccgtggcgggagaccccggggaagttgcgaggcccgtgagcacctcggcgataggttgcagcggggcagagaagaccctggctgggccttcctgaccagggagcttgttgtgaaaacactgatagtcgccgagccgcatgttttgcacgcatacagaatgtgcagacccggccagccgccagggtccgaatctgtctgctttgaggtgttgggatttgacatcttgcttgatcggaagctcaagccctggctgctggagattaacagagccccttcgttcggaaccgaccagaagattgactacgacgtgaaacgcggagtactcctgaatgctttaaaactgctaaatatcagaactagtgacaagcgccgcaatttggccaagcaaaaagcggaagcacaacgaagattgtatgggcagaactcgataaagcgtttgcttcctgggtcttcagactgggagcagcagcgccaccagctggagcgaaggaaggaagaactgaaagaacggcttgcccaggtaagaaagcaaatctccagggaggagcacgaaaaccgccacatgggtaactacagacgcatctaccctccagaggataaggccttactggaaaaatacgaaaacctcctggccgttgcttttcagacattcctgagcggcagagctgccagcttccagcgcgagctgaataatccgctcaagaggatgaaggaggaggatatcttagaccttctggagcagtgtgaaatagacgatgagaaattaatgggcaagaccacaaagactcggggaccaaagcccctgtgctcaatgccagagtcgaccgagatcatgaaacggcccaaatactgtagctctgatagcagctacgattcaagtagttcttcttcagaatcagacgagaacgaaaaggaagaatatcagaataaaaaacgcgagaagcaagtcacttacaatctgaaaccatctaatcactataagcttattcagcagcctagctctatccgacgctccgtcagctgtcctcggagcatcagtgcgcagtctccaagctcaggggacaccagacctttttcagctcagcagatgatctctgttagtcgccctacatctgccagccggagccactctctcaatcgcgcaagcagttatatgagacatctgcctcacagcaacgacgcttgctctacaaactctcaggtgtctgagtcactccggcagcttaaaacaaaggaacaggaggacgaccttacatcccagactctgtttgttttaaaggacatgaaaatcaggttccctggaaaatcggatgccgagtctgaactgctgatcgaggacataatcgacaactggaagtatcacaagactaaggtcgctagttattggttaattaagctcgattccgtgaaacagcgtaaggttctcgacatcgtcaaaacctctattcgtacagtacttcctcgtatctggaaagtgcccgacgtcgaggaggtgaatctgtatcgcatctttaaccgggtctttaatcggcttctgtggtctcgaggccaaggactgtggaactgcttctgtgactcaggctacctctag

SEQ ID NO: 34240 - DNA, 1101 bp, Artificial Sequence
  Description of Artificial Sequence: Synthetic coding sequence
atgtcctggaatatctcacacccacagcttagtgataagctgttcggcaaaaatggggtgctggaggaacagaagagcccaggattcaagaaacgcgaaactgaagtctacgtgggtaacttaccacttgacatatctaaagaagagatcctgtatttgcttaaggatttcaatccattagatgttcacaaaatacagaacgggtgcaagtgttttgcatttgtcgatctgggctcaatgcagaaagttaccctcgccatccaggaactgaacggtaaactgttccacaagagaaagctgttcgtgaacaccagtaagcggcctcctaagcggacgcccgacatgatccagcagcctcgagcgcccctcgtgctggagaaagcatctggagaggggtttgggaagactgcggccatcatccagctggcaccaaaagctcccgtcgacctatgcgagaccgaaaaactcagagcagctttttttgccgtgccactggaaatgcggggctccttcctggtcctgcttttaagggagtgtttccgggacctgtcctggttagcactaattcacagcgtgcggggggaagctgggctgctggtgacatctatcgttcctaagaccccctttttttgggccatgcacgtcactgaggctctgcatcagaatatgcaggccctgttctcaacgttggcacaagccgaggagcagcagccataccttgagggcagtactgtgatgcgtggaacccgttgcctggccgagtatcacctgggcgactatggacatgcctggaaccgatgctgggtattggacagggtagatacttgggccgtcgtgatgttcatcgacttcggtcagcttgctacgatccccgtacaaagcttacggtccttggacagcgacgatttttggaccattcctcccctcacgcagccattcatgctagaaaaggatattctctcttcatacgaagtggtgcatcggatactgaagggcaaaatcacgggggcattaaacagcgcagttaccgctcccgcttcaaatctagccgtagtgccacctcttctgcccttgggttgcctgcaacaagctgccgcatag

SEQ ID NO: 34241 - DNA, 1056 bp, Artificial Sequence
  Description of Artificial Sequence: Synthetic coding sequence
atgagctggaacatatctcacccacagctctctgataaactcttcggaaaaaatggcgtgctggaggaacagaaatccccagggttcaagaagagagagacagaggtatatgtcggaaaccttcccctcgatattagcaaagaagagattctttacttactgaaagatttcaacccgctcgatgtacataagatccagaatgggtgtaaatgtttcgcttttgtcgacttgggaagtatgcaaaaggtaacactggcaatccaagaacttaacggaaagctatttcacaagcgaaagctcttcgttaacacctctaaacgccccccaaagcgcacacctgacatgatccagcagcctagagcaccactggtgctcgaaaaggcttccggcgagggtttcggcaagacagcggccataattcagctggccccgaaggccccagtggacctgtgtgagaccgagaagctgcgagcagcatttttcgccgtgcccctggaaatgagaggctcatttttagtattgctgctgagagagtgcttccgcgatctgtcctggctcgcattaattcactccgtgcgcggagaggcaggtctgctggtgaccagtatcgttccaaagactcccttcttttgggccatgcatgtcaccgaagccctccatcagaacatgcaggccctgttttctacccttgcccaggctgaagagcagcagccctaccttgagggctccaccgtgatgcgagggaccaggtgtctcgcagaataccacctcggagattatggccacgcgtggaatagatgttgggtacttgatcgcgtcgacacgtgggccgtggtcatgtttatcgattttggccagcttgctactatcccagtgcagtctctgaggtctctggattcagatgatttctggactattcccccgttaacacagccatttatgcttgaaaaggatatcttgtcctcctacgaggtggtacatcggattttgaaggggaagatcacaggagctctgaacagcgctctgcatattttgaagtttgaggagtccaagtag

SEQ ID NO: 34242 - DNA, 1188 bp, Artificial Sequence
  Description of Artificial Sequence: Synthetic coding sequence
atgttgcagcttctggtcctcaaaatcgaggaccccgggtgtttctgggttattattaaggggtgttcgccgtttctggaccacgacgttgattatcagaaactgaattctgccatgaacgatttctacaactcgacatgccaggacatcgaaatcaaacctctaacacttgaggaggggcaagtttgcgtggtctattgcgaagagcttaaatgctggtgtcgggcgatcgtaaaaagtatcacatcgagcgccgatcagtatctcgccgagtgctttcttgtcgatttcgcaaaaaacatacccgtaaaatccaagaacattagggtggtcgtggaatcattcatgcagttgccatatagggcaaagaaattctcactctattgtaccaaacctgtgacactgcacatagatttttgtagggattcaacagatattgtccctgcgaagaagtgggacaacgccgctatccagtactttcagaacctacttaaggcaaccacccaggtggaggcccggctctgtgctgtggaagaggatacattcgaggtttatctatatgttactatcaaggacgagaaagtctgcgtcaacgacgatctagtggccaaaaactacgcctgctacatgtcacccaccaagaacaagaacctggactatctggagaaacctaggcttaacattaagtctgccccttctttcaacaaacttaaccctgcactgaccctttggcccatgttcctgcaaggaaaagacgtacaagggatggaggactcccatggggtgaacttccctgcacagtcgctccagcatacttggtgcaaagggatcgtgggagacctcaggcctacggctacggctcaggacaaggcggtgaaatgcaatatggatagcttaagagattcccccaaagataaatcagagaagaaacaccactgtatctccctgaaggacaccaacaaacgagtggagagcagcgtgtattggccggccaaacgcgggataaccatatacgcggacccagatgttcctgaagctagcgcactatctcagaaaagtaacgaaaagccactgcgtttaacagaaaagaaagagtacgatgaaaagaactcgtgcgtgaagcttctgcaatttctgaaccccgaccccttacgcgccgatgggataagcgacctacagcagacctag

SEQ ID NO: 34243 - DNA, 3534 bp, Artificial Sequence
  Description of Artificial Sequence: Synthetic coding sequence
atgctacaattgctcgttctgaagatcgaggatcctgggtgcttttgggttatcatcaaggggtgctctcccttcctggaccatgacgtggattaccagaagctcaattctgccatgaacgacttttacaattctacctgtcaagacatcgaaatcaagcccctcaccctggaggagggacaggtttgtgtagtgtactgtgaagagttgaagtgctggtgtcgcgctatagtgaagtcgattactagctccgccgaccaataccttgccgagtgttttctggtggatttcgctaaaaatattcctgttaagtccaaaaatattcgcgtggtggtggagagctttatgcagctgccgtaccgggccaaaaaattctcactgtattgcacaaaaccagtcaccctccacatagacttttgtcgtgactccactgacatagtgcccgcaaagaaatgggataatgctgccatccaatacttccagaaccttctgaaagccactacccaggtcgaagctaggttgtgtgcggtcgaggaagacacattcgaagtctacctttatgtgacgatcaaagatgaaaaggtttgtgtgaatgacgatctggtcgctaaaaactacgcttgttacatgagtcccactaagaacaaaaatctcgactacctagaaaaaccacgccttaatattaagtcagcgccctccttcaacaagctgaacccggcactgactctgtggcccatgttcctgcaaggcaaagatgtgcagggaatggaagatagtcacggagttaacttccccgctcagtctttgcaacatacctggtgcaaaggaatagtcggagatctacggccgactgccacggcccaagataaggcagttaagtgtaatatggacagcctccgtgactcccccaaagataagtctgagaagaaacaccattgcatatcgctcaaggatactaataagagagttgagtccagtgtgtattggcccgctaagagggggatcactatatatgccgaccccgatgttcctgaagctagcgcattatcacagaaaagcaatgagaagccactgaggctcacggagaagaaggagtacgatgaaaagaattcttgtgtgaaacttctgcagtttcttaatccagatccgctcagggccgatggcataagcgatttacagcagttgcaaaagctgaagggtttgcagccacctgtggtggtcctcaggaataaaattaagccctgcctcacaatagacagttctcctcttagcgccgatttaaagaaggccctccagcgaaataagtttccaggtccgtcacacacagagagctactcttggccgccaatagcgcgtggatgtgacgtcgtcgttatctcccactgtgagagcaacccactactgtacctcctgccagtactcactgtacttcagaccggtgcctgctacaagtccctcccaagtaggaatggacccttggcagtgatcgtctgcccggggtggaagaaagcccagtttatctttgaactgcttggcgaatactcgatgagcagcaggccactgcatcccgtactgctgaccatcggcttgcataaggaggaggctaagaacaccaaattgccacgcgggtgcgatgtgatcgtcaccaccccttactccctgctgcgcctcctggcttgtcaaagtctgctgtttttgcgtctatgccacctgatcttggatgaggtagaagtattgttcttagaggccaacgaacagatgttcgccatcctcgataattttaagaagaatatagaagttgaggagcgcgaatctgcgcctcaccagattgttgccgtaggtgtgcattggaacaaacatatcgagcacctgattaaggagttcatgaatgatccatacatcgtaatcaccgccatggaagaggccgcactgtacggtaatgtccagcaggtggtccatctgtgtttagagtgcgaaaagacatccagtctgttgcaggccttggactttatcccctctcaggcccagaagacactcatattcacctgcagcgttgcagaaaccgaaatcgtgtgtaaggtcgtagaatccagttccatattctgcctgaagatgcacaaagagatgatctttaatctgcagaatgtgttggagcagtggaaaaagaagctgagctccgggagccaaattattctggcattgacagacgactgcgtgcccttgttggctatcactgatgcaacttgtgtaattcacttcagtttccctgctagccccaaagtgttcgggggtcggctgtattgcatgtccgatcattttcatgccgagcaaggaagccccgccgagcagggggacaaaaaagcaaagtcggttctccttctcaccgagaaagacgcttcccatgcagtgggcgtactgagatacctggagcgggcggatgcaaaagtcccggctgagctgtacgagttcacagcaggcgtactggaggcaaaggaggataagaaggccgggcgcccactatgcccctatttgaaggcttttgggttttgtaaggataagcgtatctgccctgacagacaccgtatcaaccccgagaccgatctaccgcggaagctctctagccaagccttaccttccttcggatatatcaagattatcccattttatattctcaacgccacgaactactttggaagaattgtcgacaaacacatggatctctatgctacactgaacgctgaaatgaacgagtatttcaaggactcgaataagaccacagtagagaaagtcgaaaaattcgggctttacggactcgctgaaaagacactcttccatcgcgtgcaggtattggaggttaatcaaaaagaggatgcatgggctctggatgatatactggtcgagttcatcgatgaggggcggaccgggttggtgacaagggatcaactgctgcacttaccggagcactttcacacactcccaccacaggctgtagagttcattgtgtgtcgggtcaaacctgctgataacgaaattgagtggaacccaaaggtgacacggtatattcatcataaaatcgttggcaaactgcacgatgccaaggtcatattagccctgggcaacaccgtgtggatcgatcccatggtgcatattacgaatctcagctctctcaaaacttctgtaatcgactataatgttcgtgccgagatcctctctatgggtatgggtatcgacaatccagaacatatcgaacagttgaagaaactgcgcgaggacgccaaaattcctgcctgcgaggaatctctgagccaaaccccccctagggtaaccggcacttcaccagcacaggatcaggaccacccatccgaggagcagggggggcagggtacgcctccagcagaagacgctgcatgcctgcagtcaccccagccagaggacaccggagccgagggaggggcggaatcaaagacaagtagcgagaatcaaaagcccggagggtacttggtgttcaaaaggtggcttagcagcaataggtag

SEQ ID NO: 34244 - DNA, 561 bp, Artificial Sequence
  Description of Artificial Sequence: Synthetic coding sequence
atggatacctttagcactaagagcctcgcactgcaggcccaaaagaaactgctgtcgaaaatggcctctaaagccgtggtcgcagtgttagtagacgatacctcgagcgaagtgctggacgaattatatagggctactagggagtttaccaggagccgcaaggaagcccagaagatgctcaagaacctagtcaaagttgcgctcaaactcggattactgttgaggggcgatcagctgggcggagaagaactggcactgctgcgtcgattcaggcatcgcgcccgatgcctggcaatgacggcagttagcttccaccaggtagacttcacgtttgacaggagggtgttggccgcagggctgctggagtgccgggatctgctacaccaagctgtgggcccgcatctgaccgccaaatctcacggacgaataaaccacgtgttcggacatctcgctgattgtgatttcttggccgctctgtacgggcctgcagagccttatcgaagtcacctgcgaaggatatgcgaaggcttggggcgaatgctcgatgagggatccctctag

SEQ ID NO: 34245 - DNA, 561 bp, Artificial Sequence
  Description of Artificial Sequence: Synthetic coding sequence
atggataccttctcaaccaaaagcctggccttgcaggcacagaaaaaacttctgagtaagatggcaagtaaagccgtcgtggctgtgctcgtggacgatacaagctcggaagtcctcgatgagctctacagagccactagagagttcaccaggtcgcgaaaagaggctcagaagatgttgaaaaacctcgtgaaagtggccttgaaactgggactgctgctgagaggcgatcagttaggcggagaagaacttgcactgctaagaaggtttagacacagggcccgatgcctggctatgactgccgtgtcattccatcaggtggactttacgtttgatcgtcgcgtattggccgctggcttgctggaatgcagagatctgctccatcaggcagtcggcccacacctcacggcaaagagccacggtagaattaatcacgtgtttggacacttagcagactgtgacttcctggccgcactgtacgggccagcggagccatacaggtcccacctgcggagaatttgcgagggattggggaggatgctggacgaggggtctctgtag

SEQ ID NO: 34246 - DNA, 879 bp, Artificial Sequence
  Description of Artificial Sequence: Synthetic coding sequence
atggggaagccccgtcaaaacccttctacattggtcagtactttatgcgaggccgaacccaagggcaaactatgggtgaatggctacgccgggacgcaggggaccagggatgcaaccttgcagaccagactcatcccactcagcttccaccttcagcgaggcaagggcctggcagcccctctgtcagccctcagtgctccaagactgcccgaaaggcccgctgacggtagggttgccgtggatgcccagccagccgcgcggagcatggattcagacagtggggagcagtcggagggggagcctgtgacggcggcgggacccgatgtcttcagtagcaaatcccttgctctccaggcccaaaaaaaaatcctgagtaaaatcgccagcaagaccgtggctaatatgctgatcgacgatacctcttctgagatcttcgacgagctctataaggtcaccaaggagcacacccacaacaagaaagaggcgcacaagatcatgaaagacctcatcaaggttgctatcaagatcggaattctttaccgtaacaaccagttcagccaggaggagctggtgattgttgaaaagtttcggaagaagctgaaccagaccgcaatgacaatcgtctccttttacgaggtcgaatataccttcgaccgcaatgtcctgtcaaacctcttgcatgagtgcaaagacctggtccatgagctggtgcagcgccacttgactccccgcactcatggaaggatcaaccacgttttcaaccatttcgctgacgtggaatttctgtccaccctatattccctagacggcgactgtcgcccgaatttgaagagaatttgcgaaggcatcaacaaactgcttgacgagaaagtgctctag

SEQ ID NO: 34247 - DNA, 411 bp, Artificial Sequence
  Description of Artificial Sequence: Synthetic coding sequence
atgccacatgctcgcactgaaacaagtgttggcacctacgagtcccacagtacctctgagctggaagatctcacagagcccgagcaacgagaacttaagaccaagctcacaaaacttgaggccgaaatcgtgaccctgcgacatgtattggccgccaaggagcgccgctgcggagagctcaaacggaagttgggccttaccgccttggttgggttaagacagaacctgagcaagagctggttggacgtccaggtgagcaacacttacgtgaaacagaagacttccgctgccctgagtactatgggcactttgatctgccgcaaattaggaggagtgaaaaagtctgccactttccgctccttcgaagggcttatcttcaataaatatacccttaaccagggccgcaactag

SEQ ID NO: 34248 - DNA, 423 bp, Artificial Sequence
  Description of Artificial Sequence: Synthetic coding sequence
atgccacacgctaggaccgagaccagtgtgggcacctacgaatctcactctacttccgagttggaggacctgaccgagcccgaacagcgggaactgaagaccaagttaacaaagctggaggcagagatcgtcactttaagacacgtcctggccgctaaggagaggaggtgcggagagctgaaacggaagctggggctgaccgctctcgtgggcctccgccaaaatctgagcaagtcttggctggatgtccaggtgtccaatacctacgtcaaacagaagacttctgcagccctcagcactatgggcaccctgatctgtcgtaagctcggaggggtgaagaaatcagccacctttagatccttcgaaggcctgatgggaacgatcaaatccaaggtttctggcgggaagcgagcctggccgtag

SEQ ID NO: 34249 - DNA, 399 bp, Artificial Sequence
  Description of Artificial Sequence: Synthetic coding sequence
atgcctcacgcaagaaccgaaacgagcgttggaacttatgaatcccacagcacctccgagttagaggatctgacagagcctgaacagagagagctcaagactaagcttactaagctagaggcagagatcgtcactttacggcatgtgttggccgccaaggagcggagatgtggagaactgaaaagaaaactaggactgacggcattagtaggtctgaggcagaacctgtccaagtcatggttggacgtgcaagtatcgaacacctacgtgaagcaaaagacttccgccgcgttgagcaccatggggacgctgatctgccgaaagctgggcggagtgaaaaaaagcgcaacgtttagaagtttcgagggaaatccgaaaggtgaagggtccaggatttag

SEQ ID NO: 34250 - DNA, 999 bp, Artificial Sequence
  Description of Artificial Sequence: Synthetic coding sequence
atgctggctgtgcattttgataaacctgggggacctgaaaatctctacgtgaaggaggttgctaaaccgtcgcctggagagggcgaagtgctcttgaaggttgcagcgtcggctctcaatcgggccgatctgatgcagcggcagggccagtatgaccccccacccggagcgtcaaacatcttgggactggaggcctcagggcacgtcgctgagctgggtccaggctgccaaggacattggaagatcggcgacacagcaatggccctgttgccaggggggggtcaggctcagtacgtaactgttcccgaaggtttgctcatgcccatacctgaaggattgactctgactcaggccgcagctattcccgaagcttggctcacagccttccagttgttgcatttggtcggaaatgtccaggccggggattacgtgctaatccacgcaggactgagcggtgtcggtacggctgccatccagctgactcggatggccggggccatccctctcgtcaccgctggctcgcagaaaaaattgcagatggccgagaagctgggggccgcggccgggtttaattataagaaggaggactttagcgaggccactctaaagtttaccaagggcgcgggcgtcaacttaatcttggattgcatcggcggctcctactgggagaaaaacgtgaactgcctggcccttgatggcagatgggtgctatacggtctgatgggagggggggacatcaatgggcctctgttttccaagctgctgttcaaaaggggctccctgattacgtccctacttagaagtcgagataataagtacaagcagatgctggtgaacgcttttactgagcaaatcttgccccattttagcacggagggtccccaaagactattaccagtcctcgacaggatctatccagtgaccgaaattcaggaggcacacaaatacatggaggccaataaaaatatcggcaagatcgtactggaactgccccagtag

SEQ ID NO: 34251 - DNA, 747 bp, Artificial Sequence
  Description of Artificial Sequence: Synthetic coding sequence
atgctggcagtccactttgataagccgggcggccctgagaacctctacgtcaaagaagtggcaaagccttccccaggtgagggcgaagtgctcctgaaagtcgcggccagcgctctcaatagagctgatctcatgcagcgccagggacaatatgaccctcctccgggagctagtaacatcctaggcctggaggcctccggacacgtggccgaacttggacctggatgccagggccactggaaaatcggcgacaccgccatggccctgttacccggggggggtcaagctcaatatgtgactgtgcctgaaggactgctaatgcccattcccgagggattgaccctgactcaggctgccgccataccagaggcgtggctcacagcattccaactgctgcatctggtcgggaatgttcaagccggtgattacgttctaattcacgccgggctgtccggcgttggtacggctgccattcagctcacacggatggctggggctatccctcttgtcactgccggttcccagaagaagctgcaaatggccgaaaagcttggcgccgcggcaggcttcaattacaagaaggaagacttctctgaggccacccttaagttcacgaaagtgcaggctaatgcaggcgagtgcttccatggcgcaaatagcgcttcacttctgcatgggggcccgccaactagcgccgcgggaagtgggcagaacctgccatccgacagaaacccaggcgggccatag

SEQ ID NO: 34252 - DNA, 999 bp, Artificial Sequence
  Description of Artificial Sequence: Synthetic coding sequence
atgcttgccgtccactttgacaagccaggtggccccgaaaacctctatgtcaaggaagtggctaagcccagtccaggagaaggggaggtgcttctgaaagtggccgccagcgctttgaatcgagctgatttgatgcagagacagggtcagtatgaccctcctccgggggcttcgaacattctgggcctggaggcctccggccacgtggcagagttggggccgggctgccagggccattggaaaattggcgacactgccatggccctcttgcctggaggagggcaggcgcagtacgttacagttcccgaggggctgctgatgccaatcccagagggactgacactcactcaggcagctgccatcccggaagcttggctcacggcattccagctgttgcacctcgtgggaaacgttcaggcaggggactacgtgttaatacatgcgggcttgtctggtgtggggacagccgccattcagctcacacggatggctggagccattcctcttgtaactgctggatctcagaagaagttgcagatggccgagaaactgggagccgccgccggcttcaattataaaaaggaggacttcagcgaggcaactctgaagttcaccaagggggcgggagtgaatctcattctcgattgtattgggggcagttattgggagaagaacgttaactgtctagccctggatggtaggtgggtgctgtacgggctgatgggtggcggagatattaacgggcccctgttcagcaaactcttatttaagcggggctctttaattacttccctgctgagatctcgcgataataagtataagcagatgctggttaacgcctttaccgagcaaatcctcccacatttttcgaccgaaggaccacagcgcctgctgcccgtactcgatcggatctatcctgtgactgaaattcaggaggcacataagtacatggaggcgaataagaatatagggaaaatcgttctggagcttccccaatag

SEQ ID NO: 34253 - DNA, 651 bp, Artificial Sequence
  Description of Artificial Sequence: Synthetic coding sequence
ttcgataagccgggtgggcctgagaatctgtatgtcaaggaagtggccaaaccaagcccaggtgaaggggaggtactcctgaaggtggctgcctcagccctgaaccgcgccgaccttatgcagcgtcagggtcagtacgacccacctcctggcgcctccaatatcctgggcctcgaggcatctggccacgtggctgaactggggcccggctgtcagggtcactggaaaataggagacaccgctatggctttgctcccaggaggaggccaggcccagtacgtgaccgttcccgagggcctgctgatgccaattcccgagggactgacgctaacgcaagctgccgcaattcccgaagcatggcttaccgccttccagctacttcatttggtgggcaacgtgcaagcgggagattacgtactgattcatgctgggctgtccggcgtggggactgcggcaattcagctgaccaggatggctggcgcaataccgctcgtcaccgctgggagccagaagaaactacagatggccgaaaaactgggtgccgccgctggttttaattacaagaaggaagacttctcagaggcaactctcaaattcaccaaggggaaacagctgttgctgcaatttagccgtaatttacgagatgactag

SEQ ID NO: 34254 - DNA, 261 bp, Artificial Sequence
  Description of Artificial Sequence: Synthetic coding sequence
atggggtcttcttccgaagcctcatttcggtctgcacaagcctcctgttccggcgctagacggcagggtctgggacggggagaccagaatttgtctgtgatgccacctaatggcagggcccagacccacacgccagggtgggtttctgacccactcgtcttaggggctcaggtacacgggggatgtcggggcattgaagccctttctgtctctagcggatcctggagctccgcaaccgtatggatcctcacggtccaatag

SEQ ID NO: 34255 - DNA, 363 bp, Artificial Sequence
  Description of Artificial Sequence: Synthetic coding sequence
atgggttcatcaagcgaggcctcatttcgaagtgcccaagccagttgctcaggagctaggcgccagggcctcggaaggggcgaccaaaatttatccgtaatgccacctaatggccgtgcccagacccacaccccagggtgggtgtctgacccccttgttttaggggctcaggttcacggcgggtgccgcgggattgaagcactgtcagtgtcaagtggctcttggagctctgctactgtctggatacttactgggctctcacgcccttttcttcctggagccaccgtgctccgagacagaccattaggtagcgcctttgagctgtcttacgaccagaaaaaagcccctctgagactgcagtag

SEQ ID NO: 34256 - DNA, 837 bp, Artificial Sequence
  Description of Artificial Sequence: Synthetic coding sequence
  Description of Combined DNA/RNA Molecule: Synthetic coding sequence
atgctcaggtctttattgttgcactcccttcgcctgtgcgcacagaccgcatcttgtctggtgctgttcccacggtttttgggaacggcgttcatgctctggctcctagattttctctgtatcagaaagcattttttggggagacggcgcagagggcagccagaaccagaggtggagctgaactctgagggcgaagaagttcctcccgatgacccgcccatttgtgtctctgacgacaacagactgtgtactttggcgtcactgaaggcagtatggcacggccagaaattggattttttcaagcaggcgcacgagggtgggcccgcgccaaattctgaggtcgtcctgccggacgggtttcagtcccagcacatcctggactacgcacagggaaatcgaccgctcgtcctgaacttcggtagctgtacaugaccacctttcatggcccgcatgtctgcattccagcgcctggtgactaaataccaacgggatgttgattttctcattatctacatcgaagaggcccacccttccgatggatgggtaactacagactctccatatataatccctcagcacagatcactagaagatagggtttcggcagcccgggtcctgcagcagggagctccagggtgtgccctcgtattggatacaatggccaactcaagtagcagcgcatatggagcctacttcgagaggctgtacgtcatacagtcaggaaccattatgtaccagggcgggaggggaccagacgggtaccaagtttccgaactgcgcacgtggttagaacgctacgacgaacagctgcacggcgctcggccgaggagggtatag

SEQ ID NO: 34257 - DNA, 4209 bp, Artificial Sequence
  Description of Artificial Sequence: Synthetic coding sequence
atgcaccagaccctgtgtcttaacccagaatctctgaagatgtccgcatgcagtgacttcgtcgagcacatatggaagccaggaagctgcaagaactgtttttgccttcggagcgaccatcagctggtggctggacccccccagccacgcgccgggagcctgccccccccgcctagactccctcctcgaccggagaattgcaggctagaggacgaaggggtcaattcttctccctactccaaaccaacaatcgcagtgaaaccaacaatgatgagctctgaggcatctgatgtctggactgaggccaacctctcagctgaagtttcccaagtcatctggcgaagagcgcccggaaagctgccactgccaaaacaagaagacgcaccggtggtctacctgggcagctttaggggtgtgcagaagccagcggggcccagtacctccccagacggtaattcccgatgtcctcccgcctacacaatggtgggccttcacaatctcgagccccgcggggaacgcaatattgccttccacccagtctcttttcccgaggagaaagccgttcacaaagaaaagcccagcttcccttatcaggaccgtccctcaacccaagaatctttccgtcagaagctggctgcctttgctgggacaacttctggctgccaccaggggcctgggcccttgcgcgagtctttaccctctgaggacgattctgatcagcggtgttcgccctcgggcgatagcgaagggggcgaatactgcagtattctcgactgttgtcccggctcacctgtagccaaggccgcttctcagacagccgggtctcgcggtaggcacggcggccgcgactgtagtcctacatgttgggaacagggcaagtgcagcggtccagctgagcaggagaaacgtggcccatctttccccaaggagtgttgctcacaagggccaactgctcatccctcatgtctggggcctaagaaactgagcttgacttccgaggccgcgatatcctctgatggcctgagctgtgggtcaggctctggcagcggcgcctcgagtcctttcgttccccatcttgagagtgattattgctctctgatgaaggaacctgccccggagaagcagcaagatcctggctgtccgggggtaacccctagtaggtgccttgggctgacaggagaaccacagcctccagcgcaccctcgagaagccacacagccagagccaatctatgcagaaagtacaaagagaaaaaaggcagcccctgtaccatcaaaatcacaggctaagattgaacacgcggcagctgcacagggccaaggccaagtctgcaccgggaacgcctgggctcagaaagccgcttctggctggggccgggactcccctgacccaacaccgcaagtctcagcaactattacagttatggccgcgcacccggaagaggaccacaggactatctatcttagtagtccagactcagccgtgggcgtacagtggccgcgggggccagtttcgcagaatagcgaggtcggagaggaggagacatctgctggacagggactcagttctcgggagagccatgcccactctgcttcggaatccaagccaaaagaacgacccgctatcccccctaagctcagcaaaagctcacccgtgggaagtccagtctctcctagcgccggcggtcctcctgtttctcctctggccgatctaagcgacgggtcttcaggagggtcaagtataggtcctcagccaccatctcagggtccagccgatcccgccccaagctgccgcacaaatggcgtggccattagcgacccatctcgatgtccacagcccgcagcgtctagtgccagtgagcagcggcgtcctcgatttcaggcaggcacttggtcacggcaatgcaggatagaggaagaagaggaggtggagcaggagttgctctcccattcttggggacgggaaacaaagaacggacctaccgatcatagtaactcaactacttggcacaggctccaccccacggatggcagctccggtcagaattccaaagtagggacgggaatgtccaagtcggcaagctttgcctttgagtttcccaaggaccgttcaggcatcgagacattttcacccccaccacccccaccaaagtctagacacctcctgaagatgaacaagtcaagctctgatctagagaaggttagccagggatctgccgagtcacttagcccaagcttcaggggtgtccacgtatcttttacaacaggtagcactgacagcctagctagtgatagtcggacctgctctgacggtgggccctcctctgaacttgcacactcacccaccaattcgggaaaaaaactcttcgccccagtgcctttcccttctggcagtaccgaggacgtaagtccaagtggtccacagcagccccccccactccctcagaagaaaatagtttctcgggcagcttctagccctgatggatttttctggacgcaaggctctcctaaacctgggacagcctcacctaagcttaacctttcacacagtgagactaacgtgcacgacgaaagccacttcagctactcactcagccctggcaacaggcaccatcccgtttttagcagcagtgatcctctggaaaaggctttcaagggctcagggcactggctgcctgcagctggtctggcaggtaatagaggggggtgtggaagtcctgggctccagtgtaagggcgcgccctcagcttcttccagccagctcagtgtgtcatcacaggcctccacagggtcaacacagctgcagctacatggtctcttgagtaatattagttccaaggaagggacgtatgcgaagctggggggcttatatacccaatcacttgcacgcctagtggcgaagtgcgaggatttgttcatggggggacagaaaaaggaactgcactttaacgagaacaattggtccctctttaagctgacctgcaataagccatgctgcgatagcggcgacgctatttactactgtgccacatgtagcgaggatcccgggagcacttatgcagtgaaaatttgcaaagctccggaacccaagacggtgtcttactgctccccctccgtgccagtgcacttcaatattcagcaggactgtgggcacttcgtggccagcgtcccatcttctatgctgtctagcccagatgcacccaaggatcctgtccccgcgctgcctacacacccgccagcgcaggaacaggactgcgtagttgttattactcgcgaggtaccgcaccagactgcctcagacttcgtgcgcgatagtgctgcttctcaccaggctgagcccgaagcatacgagcgtcgagtttgtttcctcctgctgcagctttgtaatggcctggaacacctgaaagaacacggcataatccatcgtgacctgtgtctcgagaacctgcttctcgtacactgcactctgcaggccggcccaggccctgcacccgctccagcccccgcacccgccgccgccgcacctccatgtagctctgctgctccaccagctggcggaactctgagtccagcggccggccctgctagtcccgaagggccacgcgagaaacagctgccaagactgattatctcaaatttccttaaggctaagcagaagccaggcgggacccctaatcttcagcagaagaagtcccaggcaaggctagctccagagatcgtgtcagcttctcagtaccggaagttcgacgagtttcagacaggtattctgatttacgagctgctccaccagccaaatccattcgaggtgagggcacagctgagagaacgcgactatcgccaggaagacctcccacctctgcctgccttgagcctctatagcccggggctgcagcagttagcacatctcctgcttgaagctgacccaataaagcgcatcagaatcggcgaggcaaagcgtgtgctgcagtgcctactgtggggcccaaggcgcgagctcgtgcagcagccaggaaccagcgaagaagccctctgtggcacgctgcataattggatcgatatgaagcgcgccctgatgatgatgaagtttgccgagaaggcagtcgacagaagacgcggcgtcgagctggaagactggttatgctgccagtacttagcaagtgcagagccaggagccttgcttcagtccctcaaactgttacagctcctatag

SEQ ID NO: 34258 - DNA, 4209 bp, Artificial Sequence
  Description of Artificial Sequence: Synthetic coding sequence
atgcatcaaactttgtgcttaaaccccgaatcccttaaaatgtctgcttgctccgatttcgtcgaacacatctggaaaccagggagctgtaagaattgcttctgtctcaggtctgaccatcagctggttgcgggtcccccccaaccgagggccggatcactgccccccccacctagactccctccacgccccgagaactgcaggcttgaggatgagggtgtgaactcaagcccttattcgaagcccactatcgcagttaaaccaactatgatgtcttcagaggcatccgacgtttggacagaagccaatctttcagcggaagtgtcacaggtcatctggagacgggcgccaggcaaattaccactgcctaagcaggaggatgctcctgtggtctacctggggtccttcaggggggtccaaaagccagctggcccttcaacatctcccgatggcaattcacgctgcccaccggcttacaccatggttggcctacataatctggaacctagaggggagaggaatatcgcctttcacccggtgtccttccccgaggaaaaagcggtgcacaaggagaaaccttctttcccctatcaggaccggccatccactcaagagagctttcgccagaagctcgctgccttcgctggaacaacctccggctgtcatcagggacctggcccattgagagaatctttgcccagtgaggatgactcggaccagaggtgctctccaagcggggattccgagggaggcgagtattgcagcatcctggactgctgtcccggttctcccgtcgcaaaagcggcctctcagacggccggcagccgagggaggcatggcgggcgtgattgctccccaacgtgttgggaacaggggaaatgttctggaccagcagagcaggagaagcgggggccctcctttcccaaagagtgttgctcacaaggaccaaccgctcatccgagctgtctcggccctaagaaactctccttgacaagtgaagccgccatatcttctgacggattgtcatgcggatctggctcaggatctggcgccagtagtccctttgtgccccacctcgaaagcgattactgctctctcatgaaagagccggctcccgaaaaacagcaggacccgggatgcccaggcgtgactcccagcaggtgtctcggcctcacaggtgagcctcagccaccggcccatccgcgtgaggccacacagcctgaacccatctatgctgagagtactaaaagaaaaaaggctgctccagtcccctcaaaatcccaggccaagatagagcatgccgcggccgcgcaggggcagggtcaggtgtgcacgggcaacgcctgggctcaaaaagcagcttctggctggggaagagactcccctgatccgacaccacaggtctccgccacaattacagttatggctgcacatcctgaggaggaccatcggaccatctacctctcttctccagattcggccgtgggcgtccagtggcctcgggggcctgtgtctcagaatagcgaggtcggcgaagaagaaacttctgcaggccagggcttgtcgagcagggaatcccacgctcactccgcatccgaatccaagcccaaggaacgccctgcgatccctcccaagctctctaaaagttccccagtcgggtcacctgttagtccatccgccggtgggcccccggtgagtccattggctgatctgagcgacgggagtagcggaggatctagcatcgggccccagcctccgtcccaaggtcccgctgatcctgctccgtcttgcagaactaatggcgtagcaatcagtgatccctcacgttgtccacagcctgctgctagctcagctagcgaacaacggagaccgcggttccaagccggaacatggagtagacagtgcagaattgaggaagaagaagaggtcgaacaagagctcctcagccactcgtggggacgcgagactaaaaacggaccaacagatcactcaaactctaccacctggcacagactacacccgacggacggctcctcagggcagaactcaaaggtgggcacgggtatgagcaagagtgccagctttgcttttgagtttcctaaagatcgctctggaatcgagacattttcccctccccccccaccccccaagtccagacatcttctcaagatgaacaagagttccagtgatctggaaaaagtgtcacagggcagcgctgaaagcctgtcaccatcattccgcggggtccacgtgtcgttcactacgggcagtacagactccctggccagcgatagccgaacctgctcagatggtgggccttcctctgaacttgcccacagccctactaatagcgggaagaaactcttcgcccctgtcccctttccatccgggtccacggaggacgtgtcccctagcggacctcaacagccccccccactcccccagaaaaagatagtctcgagggcggcttcctcccccgacggattcttctggactcaggggtcccccaagcccgggaccgcctccccaaaattaaatttgtctcactctgaaacgaacgtgcatgatgaaagtcacttctcatattccctgagccccggcaatcggcaccacccagtgttcagttcctcagatccactcgaaaaggccttcaagggctcaggccactggctaccggccgctgggctggccggaaaccggggtggatgcggaagtccgggattgcagtgcaaaggggcgccttcagccagtagtagccagctcagtgtcagtagccaggccagcacaggctccacgcagctgcaactgcatggcctgttgtccaatattagcagcaaggagggaacatacgccaagctgggaggattatatactcaaagccttgcacggctggttgcaaagtgcgaggacctgttcatgggcgggcaaaaaaaagagctgcatttcaatgaaaacaactggagtctctttaagctgacgtgcaacaaaccatgctgcgattcaggggacgcaatctactactgcgccacctgctctgaagatccgggatccacctacgccgtgaagatctgtaaggctcccgagcctaagaccgtgtcgtattgtagtccttcagtccccgtccacttcaatatacagcaggattgtggccatttcgtcgcttctgtcccatctagtatgctaagctccccagatgcccctaaggatccagtccccgctcttcctacccacccacctgcccaggaacaggattgtgtggttgttatcacaagggaggtcccacaccagaccgcaagcgactttgtccgcgactccgccgcatctcatcaagcggagcccgaggcatacgagaggcgggtgtgctttctgctcttgcaactgtgtaacggtctggaacacctgaaagagcacgggattatccatcgggatctatgcctggagaacctcctgctggtacactgtaccttgcaagcagggcccggccccgcccccgcacctgcccctgcacctgctgctgcagcacccccttgctcaagtgccgcacctcccgccggaggaacattgtctcccgccgcaggccctgcaagtccagaagggccacgggaaaaacagctgcccagactcatcatctccaatttcctcaaggctaaacaaaagcccgggggcacaccgaatctgcaacagaaaaagagccaggcacggctggctccagaaatcgtcagcgcctcacagtaccggaaatttgatgagttccagactggcatattgatttatgagttgctgcaccaacctaacccattcgaggtccgggcacagcttcgggagcgcgactatcgacaagaggatctgcctccccttcccgctttgtccctctattccccagggcttcagcaattagcacatctccttttggaagctgaccctattaagagaatccgaataggcgaagccaagagagtcctccagtgcctcctgtggggacctcggcgcgagctcgtccagcagcctggaacatccgaggaagccctctgcgggacactccacaactggattgacatgaagcgtgctttgatgatgatgaagtttgccgagaaggccgtagaccggcgccggggagtggaattagaggactggctgtgttgtcagtacctcgcaagtgccgagcccggagcgctcctgcagagcctcaaacttttgcagctgctctag

SEQ ID NO: 34259 - DNA, 1416 bp, Artificial Sequence
  Description of Artificial Sequence: Synthetic coding sequence
atgagtgattttgacgagttcgagcgccagttgaatgaaaataaacaggagagggataaggagaacagacaccggaaaagatcccattcccgctccaggtcaagagatcggaagaggcgtagtcggtccagagaccgcagaaatagagatcaacggtccgctagcagggacaggcggcgcaggagcaaaccccttactcgcggtgcaaaggaggaacacggtggacttatacgaagcccccggcacgaaaaaaagaagaaagtcagaaagtattgggatgtacctccgcccggattcgagcacattacaccaatgcaatacaaggccatgcaggccgccgggcagatccccgccacagccctacttcctaccatgacaccagatgggctcgcagtcacacccacccccgtccccgtggtaggttcacagatgactcggcaggcgaggaggctgtacgtgggcaacataccctttgggatcaccgaggaagccatgatggacttcttcaacgctcagatgcgtctgggcggactcactcaagcacctggaaaccccgtgctggccgtccagataaatcaagacaagaactttgcatttctggagtttagatcagtggacgagacaactcaggccatggcatttgacggaatcatttttcagggccagagtcttaagatacgtcggccacacgactaccagcctctgcctggaatgagtgaaaatccctcggtctatgtgcccggtgtcgtgagcactgtagtcccagattccgctcacaagcttttcatagggggcctacccaactacttaaatgacgaccaggtgaaagagctgctgacgagctttggaccgctaaaggctttcaatctggtcaaagacagcgctacagggttgtccaaggggtacgccttctgtgagtacgtggatattaacgttactgatcaggcgattgccgggctgaatggaatgcagcttggagacaaaaaattgctggttcagcgagcgtccgttggcgccaagaatgctactctctctaccataaaccaaacacctgtgacactgcaggtgcctgggctcatgtctagccaggtccaaatgggaggtcatcctactgaggtcttgtgcctcatgaacatggtgctgccagaggagctgcttgatgacgaggagtacgaagagatcgtggaagacgttcgtgacgagtgctcaaaatacggtctggtgaagtctatcgagatacccaggcccgtggatggagtcgaggtgcctggttgcggaaagatattcgtggagtttacaagtgtgtttgactgtcagaaggccatgcagggcttgaccggccggaaatttgctaatcgcgtggtggtgactaaatactgtgatcccgactcataccaccggcgggatttctggtag

SEQ ID NO: 34260 - DNA, 783 bp, Artificial Sequence
  Description of Artificial Sequence: Synthetic coding sequence
atgtggcacgcgatttctagaacgtcccgtatgtcccaatcaggatgcccctctggtctgctggcagataaaaatatctcctcctcggctacccgggtaattgtcaaaactgcaggcaatcaaaaggacttcatggtggccgacgacatctctgtaaggcagtttaaggaaatgctgctggctcatttccaatgccaaatggatcagctggttctcgtgtttatgggatgcttgttaaaggatcacgataccttatctcagcgaggaatcatggatggacacacgatttatttggtgatcaagtctaaacagggaagtcgaagtctggctcactccttcagagatctgcccactaatgatccctgtcacagggacagaaataccaaagctaatgatacacttaacaaggttaatcacacgtctaaagcaaatacagccatgatcagcaccaaggggcagtctcacatctgtgccacgcggcaacctgcgtggattcccgctctcccttcgatcgagcttacccagcaactccaagaagagtacaaagatgctacggtatccctcagctctagcagacagaccctgaagggcgacttgcaactgtcggacgagcagagtagtagccaaattacaggcggaatgatgcagttgcttatgaacaatccttatctagccgcccaaataatgctttttaccagtatgcctcagttatccgagcaatggcggcagcagctgcctacctttctgcagcagacccagatcagtgacctgctatccgcatag

SEQ ID NO: 34261 - DNA, 1428 bp, Artificial Sequence
  Description of Artificial Sequence: Synthetic coding sequence
atgtggcacgccataagccggacttctcgcatgtcccagagtggctgtccaagcggccttctcgcggataagaacatctctagctctgcgactagagttatcgtaaaaacggctggtaatcaaaaggactttatggtggccgatgacatcagcgtacggcagttcaaagaaatgctgctcgctcacttccagtgtcaaatggaccagctggtcctcgtgtttatgggttgtctactgaaagatcacgacacactgagtcagagaggtataatggatggtcacacgatttacttggtgatcaagtccaaacagggctcgcgcagtctggcccactccttccgcgacctccctaccaacgacccatgtcatcgggatcggaacacaaaggggaatagttcccgggtccaccagccgacaggcatgaatcaggccccagttgagttagcccactttgtagggtctgacgcgcccaaggtgcatacccagaatctggaggtgagccatcccgaatgcaaagcccagatgctcgaaaatccctcaatccagaggttactgtcaaacatggagtttatgtggcagttcattagcgagcacttggacacacaacagcttatgcaacagaatccggaggtgtcaagactcctgctggacaattccgaaatcctattgcagactttggaattggcccgaaacctcgcaatgattcaggagatcatgcagattcagcagcctagccagaatctggagtaccccttgaatcctcagccgtatctggggcttgaaaccatgcctgggggcaacaacgcattgggacagaactacgctgacatcaacgaccagatgctcaactccatgcaggatccctttggcggtaaccccttcactgcgctactagccggccaggtgctggaacaggtgcagagttccccccccccaccccctccctcacaggaacagcaggaccagctgacacagcacccggctactcgagttatttataactcctcgggcggcttttcatccaacacttctgcaaacgatacattaaataaggtgaatcatacgtcaaaagccaatacagcaatgatctctactaaaggccagagccacatttgcgcaacaaggcagcccgcctggataccggctctcccctccatcgaacttacccagcagctccaggaggaatacaaagacgccaccgtctctctttcttcaagccgtcagaccctgaaaggtgacttgcagctgtctgacgaacagagttcttcccaaatcacaggcggaatgatgcagctgcttatgaacaatccctacttggcagcccaaataatgctgttcacatccatgcctcagttgtcagaacaatggcgccagcagttacccacattcctacaacaaacacagatttccgatctcctgtctgcctag

SEQ ID NO: 34262 - DNA, 1146 bp, Artificial Sequence
  Description of Artificial Sequence: Synthetic coding sequence
atgaatgctctggacggagtgcccttcaagctccctaagggcttcgtcattggcaccgaaccactgcccggaccagagctgagtgtgcccgcatgcggagaagtactgctggggtcaatgcacgatttttcgcttgaacgaaccgctttgttctgggtggaggccgccgggcaaggtccttctccataccagtgcggagaccccgggaccgctagtgcccccccggcctggctgctcctcgtgtcaccagagcatggcttggccccagccccaaccaccattcgtgaccccgaggcggggcaccaggaacgaccagaagaagaaggggaggacgaggcagaagcttcctcaggttccgaagaggaaccggcaccctcctccttgcagcccggcagtcctgcatcccctggaccaggcagacgattatgcagccttgacgtgctgcggggcgtgcggttggagctggcgggcgctagaaggagactaagtgaggggaaactcgtgtcccggcctagagccctcctccacggactgcggggccatcgagcgttgagcttgtgtccatcccccgctcagtcccccagaagcgcttcgcctccaggaccggcgccgcagcaccctgcagcccccgcatctccgcctcgacctagtaccgccggcgcaatcccacccctaagatcacacaagcctaccgtcgcatctttgtcaccctatacctgcctgccgccactggggggagccccccagcctctcaatccgcacaagagccacccagataccgctgcagacctgcttagcgcactgagccaggaggagcaggatctgatagggcctgtggtggcgctcggctatcctttaaggagggctataattgcccttcagaagaccggacgccagagtctctcccagttcctgtcctatctcagcgcttgtgaccgattgttgagacagggatacgaagaagggctggtagatgaggcaatggagatgttccaattcagtgagagccaggcaggagagtttctgcgcttgtgggagcagttcagcgatatgggctttcagcaagataggatcaaagaagttttgttggttcatggcaatcgccgcgaacaggccctggaagagctggtagcatgtgcccaatag

SEQ ID NO: 34263 - DNA, 1146 bp, Artificial Sequence
  Description of Artificial Sequence: Synthetic coding sequence
atgaacgccctggatggcgtgcccttcaaactgcctaaaggatttgtcataggcacggagcccttgcccggccctgagctgtccgtccccgcatgtggcgaagtgcttctgggcagcatgcacgattttagcctcgaacgtaccgccctgttctgggttgaggccgcagggcagggcccgagcccctaccaatgcggggaccctggcaccgcaagtgcccctcctgcctggcttctcttggtgtccccagagcacggcctcgcccctgcccctaccacgatcagagatcccgaagctggacaccaggagcggcccgaagaggagggcgaggatgaagccgaggccagttccggcagcgaggaagagcccgcccccagctcactgcagccgggctctccagcctcaccgggcccgggacgtcggctatgctccctcgatgtgctcagaggagtcagactggaactggcaggggctagacggcggctgtctgaaggtaagctggttagtcgccctcgggcacttctgcatgggctgaggggacatagagcactgtctttgtgtccatctccagcccagtctccgcggagtgcgtcgcctcccggcccggccccgcaacaccctgcagcacccgcctcaccaccaagaccatcaacagccggcgctatccccccactacggagccataagccaaccgtcgcatctcttagtccctatacctgtctgccacctctgggtggtgcaccccagcctctgaatccccataagagccaccctgatactgcagccgacctgttgtcagcactgtcccaggaagagcaagatctcatcgggccagtcgtcgcactcgggtaccctctgcggagagctataattgctctgcagaaaactggaagacagagtctcagtcagttcctgagctatttgtctgcttgcgaccggctgctccgacagggatatgaggaggggctcgttgatgaggcaatggagatgtttcagttttccgaatcacaggctggcgaatttttgcgcctttgggagcagttttccgatatgggatttcaacaggataggatcaaagaagttttgctagttcatggcaaccgaagagaacaggccctggaagaactcgtggcctgcgcacagtag

SEQ ID NO: 34264 - DNA, 1746 bp, Artificial Sequence
  Description of Artificial Sequence: Synthetic coding sequence
atgatgacatcagtcagttcagatcactgtcggggggcccgagagaaacctcaaataagcgccgctcaatccacacagccccagaagcaagttgtgcaggctacagcagagcagatgaggctggctcaggtcatctttgacaaaaacgattctgatttcgaagcaaaggtcaagcagctgatggaggtcacagggaaaaaccaagatgaatgtatcgtggccctgcatgattgtaacggcgatgtcaataaagctattaatatactacttgagggaaattctgacacaacgagctgggagacagtaggatgtaagaaaaagaactttgctaaggagaactctgaaaacaaggaaaaccgggagaaaaaaaaacataccggggacttgacatcctcaccattatctcaactgagttcctctcttagctcccaccagtccagtctgtccgcgcacgcagcactgtcctcctcgacaagtcacacgcacgcgtctgtagaatctgcgtcgtcgcatcagtcttccgcaacattctctaccgccgcaacttcggtgtccagctcagcttctagtggggcttcactgtcatcctcaatgaataccgctaattctctgtgcctgggaggaaccccagcctccgccagtagtagcagcagccgagcagcccctcttgtgacgagtgggaaggctccacccaatctcccgcagggagtgccgccactcttgcacaaccagtacctcgtcggtccaggcggtctgttgccagcttatccaatctacggttacgacgagctccagatgctgcaatctcgtctacctgtggactactatggaattcccttcgctgccccgactgcattggcatccagggatggatctctggccaacaatccatatcccggcgatgtgaccaaatttggtaggggagacagtgctagccccgccccagcgacaactagcagtgctacagccgagcctataacagatcccccgcactccccagccgccctaagagaaagctgtaccgccacctggagctacacaggattgccatattacacagggatgcccagcgccttccaatacggacccacaatgttcgtcccgcctgcttctgccaagcagcatggagtcaacttgtctactcccacacctccgtttcagcaggcttctgggtacgggcagcacggttattcaacaggttatgacgacctgacccagggtacggctgctggcgattacagtaagggagggtacgccggatcaagtcaggctcccaataaatctgcaggaagtggcccagggaagggtgtgtcggtcagttcatccaccacgggcctgcctgacatgacaggctcagtgtacaataagacacagaccttcgataagcagggtttccatgctggcacaccccccccattctctctaccctcggtcctcggctccaccggccccttggccagtggcgccgccccgggatacgcaccgcctccattcttgcacattttacccgcgcaccagcagccgcattctcaactgctgcatcaccacctacctcaagacgcacagagcggaagcgggcaacgatcaccagctccgtgttccccatcattaaaacctcccaacctccccaccctttccatattggataagctgaaccctgaggaacgcggcggactggggcagggacttagttgggccggcgagaatacccgggcacgtatttgggagccatccgcattgagctag

SEQ ID NO: 34265 - DNA, 3360 bp, Artificial Sequence
  Description of Artificial Sequence: Synthetic coding sequence
atgatgacctcggttagcagcgatcactgccggggcgccagggaaaaaccccagatttctgctgcgcagagtacccagccacaaaagcaggtggtgcaggccaccgccgagcagatgcgcctagctcaggtgatctttgataagaatgatagcgactttgaggccaaagttaagcagctgatggaggttacgggcaaaaaccaggacgagtgcattgtggctttacatgattgcaatggtgatgttaacaaggcaatcaacatcctcctggaaggtaatagtgacactacatcctgggagactgtgggctgtaagaaaaagaacttcgctaaggagaattcagagaacaaggaaaacagggaaaaaaaaagcgagaaggagagcagccgaggcagggggaacaacaaccgcaaaggaaggggcggaaaccgaggtcgcgaattccgtggggaggagaatggaatagactgtaatcaagtggataaaccaagcgaccgcggaaaacgcgcacgagggagagggttcggacgcggccggggaagaggtgccggtaggttcagcacacaggggatgggaacattcaacccagccgattactctgattctaccagtacagatgtctgcggaacaaaactcgtcgtctgggaagcagcccaaaatggtgccgacgaggggacagagttggctagcaatacccacaatattgcacaagatttgtctaacaaatcaagttacggactgaagggcgcctggaaaaatagtgtcgaagagtggactactgaggactggacagaagacctgtcagagaccaaggtcttcacggcttcctccgcgcccgcagaaaatcacattctgccaggtcagtcaatagacttggtggcccttctgcagaaacccgtgcctcatagccaggctagtgaagcaaactcttttgaaaccagccagcaacagggctttggccaggcactcgtgtttacaaacagccaacacaacaaccagatggctccagggactgggtctagcactgctgtaaatagctgcagccctcagtctttgagcagcgtgctcggatcaggcttcggagagcttgcacctcctaagatggccaatattacttccagccagattcttgatcagttgaaagcaccctcgctgggccagtttaccaccacaccctcgacacaacagaactcaacatcacatcctactacgaccacgagctgggacctgaaaccgcctacctcacaaagttccgtgctttctcatttggacttcaagtcacagcctgagcctagtccagtcctgtcacagttgtcacagagacaacaacaccagtcgcaggcagttactgtgcctcctcccggcctggagtccttccccagccaagcaaaattgagagaatctacaccgggtgactcgccatccacggtaaacaagctgctccagctgccttcgaccaccatcgagaacatttctgtgtctgtccaccagcctcagcctaagcatattaagctcgccaagcgtaggataccgcctgcctcgaagatcccagctagcgctgtggaaatgccaggctcagcagatgtgactggcctcaacgtacaattcggagccctggagttcggctcagaaccttcactgtctgaatttggctccgctccatcctcggagaactccaatcagatccccattagcctgtacagtaagtcactcagtgagccacttaatacatcgctgagtatgacttctgcggtgcagaatagtacatacacaactagtgtcatcacaagctgttctctgacctcgtccagtctgaactcagccagccccgtggctatgtcctctagttatgaccagagtagcgtacacaatcggataccttatcagagtccggtgtcttcctcagagtcggcgccggggactatcatgaatggtcatggtggaggcaggtctcaacagacattggacaccccaaagacaactggccccccaagtgctctcccttccgtgtcatctctcccaagcacgaccagttgtactgcactgttgccaagcacctcgcagcatacaggagacctcacctcatcgcctctctcacagctcagttcttccctcagttcacatcagagttctttgtcagcgcacgccgcactgtccagctccacttcacacactcacgcttccgtcgaatcagcatcaagccatcagtcttccgcaactttttccacggctgcaacctctgtttcttcttctgcttcttctggcgcctcactcagcagcagcatgaatactgccaatagtctgtgcctcggcggtacacccgcaagcgctagcagcagctcaagtcgtgcagcacctttagtcaccagcgggaaggccccaccaaacctgccccagggcgtcccccctctcctccacaaccagtatctggtggggccagggggcctcctgccggcctacccaatctatgggtatgacgaacttcagatgctgcagtctagactaccggtcgactactatgggatacccttcgcagcacctactgccctcgcgtctagagatggttctctcgccaacaatccttatcccggggatgttacgaaatttggccgcggggactctgcctcgcccgcacctgctaccacccctgctcagccgcagcagtcacagtctcagactcatcatacagcacaacagccttttgtaaatcctgccctgccccccggctatagctataccggattaccatattatacaggcatgccaagtgcgtttcagtatggccccacgatgtttgtgccgccggcctcggccaagcaacacggagtgaatctgtctactccaactcccccgttccagcaagcatccggatatggacagcacggatattcaaccgggtatgacgatctgacacagggaacagctgcaggcgattacagcaaaggggggtatgccgggagcagtcaggcccctaacaagagcgccggatccggaccagggaaaggcgtgtccgtgagttcctcaaccacaggcctccccgacatgacagggtctgtgtacaataaaacccagaccttcgacaaacaggggttccacgccggcacccctccacctttctcacttccctccgtcctcggaagcacggggcccctggccagcggagcagctcctggatacgcccctcccccatttctgcatatcctcccggcccaccagcagccacactcccagctgctccaccaccacttaccgcaggacgcccaaagcggtagcggtcagagatctcagccttcttcattacagcctaagtcccaggctagcaagccggcctatggaaactcaccatactggaccaactag

SEQ ID NO: 34266 - DNA, 978 bp, Artificial Sequence
  Description of Artificial Sequence: Synthetic coding sequence
atggctaatataacatcaagtcagatcctggatcaattaaaggcaccaagcctgggccagttcacaactacgccatctactcagcagaactccacctcacaccccaccacaactacaagctgggatctcaagcctccgacaagccagagcagcgtgctttcacacttagacttcaagagccagccagagccaagccccgtgctgagtcaactcagccagcgacaacagcatcagtcacaggctgtgactgttcctcctcccgggctggagagcttccctagccaggccaagctgcgagagagtaccccaggcgacagtcctagtaccgtaaacaaacttctgcagttacctagtactacgattgagaacatttccgtatccgtgcatcagccccagccaaagcacattaaactggctaagcgccggattcctccggcatcaaagattccagccagcgccgtcgaaatgcccggatccgcagatgtgacggggcttaacgtgcagtttggggcgctcgagttcgggtctgagcccagcttgtcagagtttgggtccgccccttcctccgagaactcaaaccaaatccccatatccctctatagcaaatccttaagcgaaccccttaatacatcactgtcgatgacgtctgccgtacagaacagtacctataccactagtgtcatcacatcatgttccttgacctccagctcccttaacagtgcctctcctgtggcaatgtcgagcagctacgaccagtcttccgtgcacaaccgcattccataccagtctcctgtgtcctctagcgaaagcgcccccggaacaatcatgaacggccacggcggcgggaggagccaacagaccctggactcgaaatacagcagcaagcttctgctctcctggctggtgcctactaagcagcggaaaaggatagctcatgtcatgtggaagacccccgtgggacagtggctgattagatag

SEQ ID NO: 34267 - DNA, 1077 bp, Artificial Sequence
  Description of Artificial Sequence: Synthetic coding sequence
atgaacacggctaattctttgtgtctgggcggaactcctgccagtgcaagctcttcgagttcccgcgcagccccactggttacttcaggaaaggctccacctaacctcccacagggcgtgcctcccttgttgcacaaccaatacttggttggtccgggggggctgctccctgcatatcctatctatgggtacgatgagctccagatgctgcagtctcggctgccagtggactactacgggatccctttcgctgctccgaccgccctcgctagtagggacgggagtttggctaataacccataccccggcgatgttacaaaatttgggcgaggagacagtgcttccccagctcctgccacaacacctgcccaaccccagcagagtcaatcccagactcaccataccgcacagcagcctttcgttaatccagctcttccaccgggctactcctatacaggtctgccatattacactggcatgcccagcgccttccaatacgggcccaccatgttcgtgccaccagccagtgctaagcaacatggggttaacctaagcacgccgactccaccttttcagcaggccagcgggtacggtcagcatggctactctactgggtatgatgacctcactcagggaaccgcagccggcgattacagtaaaggcggatacgctggcagttcccaggcacccaacaagtccgccgggtccggccctggaaagggagtctccgtgtcaagtagtacgactggcctccccgatatgaccgggagtgtgtataataaaacccagacatttgacaaacagggattccatgcaggcacacctccccctttctcgctgccatctgtgctgggaagcactggaccgctagccagtggtgctgctccaggatacgcaccccccccatttctccacatcctcccagcgcatcaacaaccccactcccagttactgcaccaccatctgccccaagacgctcagtccggcagtggccagaggagtcaaccttcttctcttcagcctaagtcccaagcatccaaacccgcatacggcaattctccgtactggaccaactag

SEQ ID NO: 34268 - DNA, 3360 bp, Artificial Sequence
  Description of Artificial Sequence: Synthetic coding sequence
atgatgacttccgtgtccagtgatcactgtcgcggggcaagagagaaaccacagattagcgctgcacagagtacacaacctcagaagcaggtggtacaggcgactgctgagcaaatgcgccttgcgcaggtgatctttgacaagaacgattcagatttcgaagccaaagtcaaacagctgatggaggtcacaggaaaaaaccaagatgagtgcatcgtagcactgcacgattgcaacggtgatgtaaataaggcgatcaacattcttctcgagggcaatagcgatacaacctcctgggagacagttggctgtaagaaaaagaatttcgccaaagagaatagcgagaacaaagagaacagagagaaaaaaagcgaaaaggagtcctcccgcggtaggggtaataataatcgcaagggaaggggggggaatcgcggtcgggagtttagaggcgaagagaatggcatcgattgcaatcaggttgacaagccatcagatagaggcaaacgcgccaggggacgcggattcggccgcggacggggacgcggagctggaaggttcagcacccaaggcatgggaacatttaaccccgctgactactccgactccacctccacagacgtgtgcggcactaaactggtagtgtgggaagcagcccagaatggcgccgatgagggtaccgagttggcctctaacacacataacattgcacaggacctgagcaataagagttcttatggactcaaaggcgcctggaaaaattcagtggaggagtggaccacagaggactggacggaggacctcagcgagacaaaggtcttcaccgcttcctccgcccctgctgagaaccatatccttcccggtcaatcaattgacctagtggctctgctgcagaaaccggtgccccattcccaggcctcggaagctaattcttttgagacaagccagcagcaagggttcggacaagccttagtctttaccaatagtcagcacaataaccagatggccccaggcacggggtcaagtacagcggtcaattcttgctcccctcagtccttgtcatcggtgctcggatcagggttcggtgagctcgccccacccaagatggcaaacataacctctagtcagatcctagatcaactgaaggcccctagtttaggccagtttaccaccacaccttccacacaacagaattcaacatcacaccctacaaccacaacctcatgggacctcaagccgcccacctctcagtcctccgttctgagccatctggatttcaagtctcaacctgagccgtcacctgtgctctcccagttatcccaaaggcagcagcatcagagtcaggccgtgactgtgcccccacctgggctggaatctttcccttctcaggcgaaactgcgcgaatcaactccaggcgactcaccctctaccgtcaacaagctgctgcagctgccttcgaccacaattgaaaatatatccgtgagtgtccaccagccccaacctaagcacataaagctggcaaaacgtaggatcccccctgcaagcaaaatccccgccagcgccgtggaaatgccgggttctgccgacgtgactgggctcaacgtccaattcggcgcccttgagttcggcagcgaacccagtttatctgagttcggctccgcgccatcttccgagaactccaatcagattcctatcagcctttattctaaaagtttgagcgaaccccttaacactagcctgtcgatgacatcagccgtccaaaacagcacatatactacatccgtaatcaccagttgcagcttaacatcctctagcctcaattctgcgtctcctgtcgccatgagcagctcttatgaccagtccagcgtccataacaggattccctaccaatctcccgtgagctcctcggaatctgcccccggcactatcatgaacggtcatggaggaggccgctctcagcaaacactggacacccctaaaaccactggaccgcccagcgccctgccaagtgtgagcagtctgccttccaccacatcctgtacagcactcttgcccagcactagccagcacaccggcgacttgaccagttcgcctctgtcccaactctcatcctccctttcatctcaccagtccagcttgtctgcccacgcagccctcagctcttccacatcgcacacccacgcttcagtggagtcagcatccagccatcaatcctctgctacattcagtaccgccgcgacttccgtatcttcatccgcatctagcggcgccagtttgtcatcgagcatgaataccgccaactccctgtgtttgggtggcacgcctgcctctgctagctctagttcttctagagcagcgcccctggtgacttccggtaaagcacctcctaatcttccgcagggagttcctcccctgctccataatcagtatctggttggtcccggcgggctactacctgcttacccaatctatgggtacgacgaactgcaaatgctgcaatcgaggctgcctgtcgattactatgggattcccttcgccgcgcccaccgctttggcctctagagatggaagcttggccaataatccctaccctggggatgtgacaaagttcggaaggggggattcagctagtccagcaccagccaccacccccgcccaacctcagcagtctcaatctcaaacccatcatacagcccagcagccgttcgtgaatccagccctcccaccaggctactcatatactggcctgccctactacaccggcatgccctcagcctttcagtacggaccgactatgtttgtaccaccagcgagtgcgaaacagcatggtgttaatctgtccaccccaacgcctccatttcagcaggcttccggttacggtcagcatggctactccacaggatatgatgaccttacacagggcacagctgctggggattattctaaggggggctatgctgggtctagccaggctcccaacaagagtgcaggcagcggcccaggtaagggggtctccgtgtcaagttctactacaggcctcccggatatgacgggttccgtttacaacaaaactcagacatttgacaagcaaggcttccatgcagggactccccctccatttagcctgcccagcgtgctgggctcaacaggtcccttagcttcaggggcagctcctggttacgcacctcctccattcctgcacatactcccagcccaccagcaacctcacagccagctgctacaccaccacctgcctcaggacgcccagtctggctccggtcaacggagccaaccttctagcctacagccaaaatcccaagcctctaagcccgcctatggaaactcaccctattggactaattag

SEQ ID NO: 34269 - DNA, 2559 bp, Artificial Sequence
  Description of Artificial Sequence: Synthetic coding sequence
atggacagtaagggcctcgggcgcattctctggaaaagcggacagcagaagacaggcttaaaaataattgatttggttgcgctgctgcagaaacccgtgccacacagtcaggcctcggaagctaactcttttgagacgtctcagcagcaggggtttggccaggccctcgtcttcactaactcccagcacaataatcaaatggcacctggaacgggctcttcaaccgcagtgaattcatgcagtcctcagagcctgagctccgtgctcgggagtggattcggggagcttgcaccacccaaaatggcgaacatcacatctagccagatcctcgatcagttgaaagcaccaagtctgggacaattcaccacaacaccatcgacacagcagaactcaacgagccacccgaccaccaccaccagctgggatttgaagccccctacgtcccagagttctgttctctctcatctggatttcaagagtcagcccgaacccagtcccgtgttgtctcagctgtcccagagacagcagcatcagagtcaggcggtgacggtgcctcctcccgggctggaaagttttccatcccaggcgaagttgcgggagagcacccctggcgatagcccctctactgtgaataaactccttcaacttccctccaccactattgagaacatttcagtgagcgttcaccagcctcagccaaagcatattaaattggcaaagcgacggattcccccagcgagtaaaattccagccagtgccgtggagatgccaggttccgcagacgtgactggcctaaatgtccagttcggcgccctcgagttcggtagcgagccttcccttagcgaattcggctctgctcccagcagcgaaaactccaatcagatccctatctcgttgtattcaaagtctttaagcgaacccttgaatacaagcctcagcatgacttccgccgtacagaacagtacatacactacttctgtcatcacaagttgttcacttacatcaagctctctgaacagcgcatcccctgtggctatgtcctcctcctacgatcaatcatcagtgcacaatcggatcccgtatcagagcccagtgtcctcctcagaaagtgctccaggcacaatcatgaatggccatggtgggggtcgctcccaacagacattggacaccccaaagacgactggccccccaagcgccctgccgagtgtgtcctctctaccctctaccacgagctgcacggccctcctccctagcaccagccagcacacaggagacctgacaagtagcccgttgtctcaacttagtagcagtctgtcctcacaccagtcttcactgtccgcacacgctgcattaagttctagtactagtcatactcatgccagcgtagagagtgcttcgtcgcaccagagcagcgcaactttttccactgccgctacgagcgtgtcctcctctgcttcatccggagcgagcttgtcgtcgtctatgaatactgctaatagcctgtgccttggaggcacccccgcatccgcatccagctctagtagtagagccgcaccactcgtaacaagcgggaaagctccccccaatctcccacagggtgtgcctccactcctgcacaaccagtaccttgtcggacctggaggtctcctcccggcttatccaatctacgggtatgatgagctacagatgctgcagtctcgactccccgtggactactacggcatcccgttcgctgcacctaccgccctggcctcgcgcgatggctctctagcaaataacccctaccctggggatgttactaaatttggccgtggggattccgcttcccctgcaccagcaactacacctgctcaaccacagcagtcccaatcacagacgcatcacaccgcgcaacagccgtttgttaacccggcactgcctcctggatatagttatacaggcctcccgtactacactgggatgccatcagccttccaatatggccctaccatgttcgtccctccagctagtgcaaagcagcatggcgttaatttaagtacacccacgcccccatttcagcaggcgtcaggatacggacaacatggctactcgaccggctacgatgacctcacccagggcaccgcagctggtgattactctaagggtggctacgccggatccagccaagctcccaacaagtccgctggtagcggccccggcaaaggagtttctgtgagctcaagtaccacaggattgcccgatatgactggcagcgtctacaacaaaactcagactttcgataagcagggattccatgccggaaccccgccacctttttcactcccatccgtactgggatctacagggcctctcgcgagtggcgctgctcctggttacgcccctccacctttcctccacatccttcccgcacaccaacagccccattctcaattgctgcatcatcacctgccacaggatgcccagagcggaagtgggcagaggagccagccaagttctctgcagccaaagtctcaggcctctaaaccggcatatggaaacagtccctactggactaactag

SEQ ID NO: 34270 - DNA, 1023 bp, Artificial Sequence
  Description of Artificial Sequence: Synthetic coding sequence
atggaggtgactggaaagaatcaggacgagtgcattgtagctctgcacgactgtaatggggacgtgaataaggcgattaacatcttgttggaaggtaatagcgacacaactagttgggaaaccgttggatgcaaaaagaaaaactttgctaaagagaatagcgagaataaggagaacagagagaagaaaagcgaaaaggagagctccaggggaagaggcaataataacagaaaaggcaggggcggaaaccgaggtagagaatttagaggcgaggagaacggaatcgactgtaatcaagtggataagccatctgatcgagggaaacgtgcaagaggtagagggtttggccgaggcaggggccgcggggctgggagatttagtactcaggggatgggcacatttaacccagcggactattcagattctacatccaccgatgtgtgcgggactaagctggttgtgtgggaagccgcccaaaatggcgctgatgaagggacaggcgcatggaagaacagcgtggaagagtggaccacagaggactggacggaggacctgagcgagaccaaagtctttacagcttctagcgccccggcagaaaatcacattctgcccggccagtctatcgacctggtagcactgctccagaagccagtgccccacagccaggcctctgaggccaactctttcgagacttcccagcaacagggatttgggcaggcgcttgtctttactaacagccagcataacaatcagatggcccctgggaccggaagttctaccgcagttaattcttgttccccacagtccctcagctcagtcctgggctctggattcggagagctggcgccccccaagatggccaatattacctcttcacagatcctggaccagctcaaagcgcctagcttgggccagtttaccactactccttccacccagcagaatagcaccagccatcccacaacaacaacttcgtgggatctgaagcccccaacgagccagagttccgtgctgtcccactag

SEQ ID NO: 34271 - DNA, 1239 bp, Artificial Sequence
  Description of Artificial Sequence: Synthetic coding sequence
atgatgacctccgtttcaagtgaccattgtaggggcgctagggagaaaccacaaatctcagccgcccagtccacacagccccagaaacaggtggtgcaggcaaccgccgagcagatgcggctggcccaggtgatcttcgacaagaatgatagtgactttgaagccaaagtaaaacagcttatggaggtgactggaaagaaccaggacgaatgtatagtggcacttcatgattgtaacggcgatgttaataaggcgattaacatcctgctggaaggaaactctgacacaacctcttgggagacggtgggctgcaagaagaagaatttcgctaaggagaacagcgagaataaggaaaatagggaaaaaaaatccgaaaaggagtcttcaagagggaggggaaataacaacaggaaagggcggggcggtaatcgaggacgcgagttcaggggagaggaaaatggcatcgactgtaaccaggttgataagccatccgaccgcggtaagagggcacggggcagggaactagcctccaacactcacaacatagctcaggatctttccaacaagtcttcatacggcctgaaaggcgcgtggaaaaacagcgtagaggaatggacgacagaagactggactgaggatttatccgagaccaaggtctttacagcatcaagcgctcctgctgaaaatcatatcctcccaggccagagtattgacctcgtggcccttcttcagaaacctgtccctcactcacaggctagtgaagcaaacagttttgagacatcacagcagcaggggttcggccaagcactcgtgttcacaaatagccagcataacaatcagatggcaccaggcacaggtagctcaacagccgtgaacagttgctcaccacaatcgttatcttctgtgcttggctcaggattcggagagctggccccgccaaagatggctaacatcacctcctctcagattttggatcagcttaaagctccttccctcggacaattcaccacgactccctccacgcagcaaaacagtacatcacatcccaccacaaccacgagttgggatctgaagccccccacatcacaatcttccgtgctatcacacctggattttaagtctcagcctgagccctcacctgtcctgagtcagctatctcagagacaacaacatcagtctcaggcagtgaccgtgcctcctccgggcctggagtcattcccttctcaggcaaaactatag

SEQ ID NO: 34272 - DNA, 2061 bp, Artificial Sequence
  Description of Artificial Sequence: Synthetic coding sequence
atgatgaccagtgtaagcagcgaccattgccggggggctcgcgaaaagccccaaatcagcgctgcacagagtacacagccacaaaaacaggtggtccaggcgactgcagaacaaatgcggctggcacaggttatttttgataagaatgactccgactttgaagccaaagtgaaacaactcatggaggtgactggcaaaaaccaggacgaatgtattgtggccctccatgactgcaatggcgacgtcaataaagccatcaatatcttgttggagggcaactcagacactacttcttgggagaccgtaggttgtaagaagaagaattttgctaaggaaaactcagagaacaaggaaaatcgcgagaagaaatcagagaaggaatccagccgtggcaggggaaataacaataggaagggaagaggcgggaacagggggcgggagttccgcggcgaagaaaacggcatagattgtaatcaggtggacaaaccttctgacaggggcaagagggcccgcggccgagaattagcttcaaatacacataacattgcccaagacctgagtaacaagagttcttacgggctgaaaggggcttggaagaatagcgttgaagagtggactactgaggactggacagaggatctcagcgaaaccaaggttttcaccgcgagctccgcccccgcagagaatcacatattacctgggcagtctatcgacctcgtcgcgttgcttcaaaagcctgtgccgcatagccaagcctcagaagctaattccttcgagacctcacagcaacaaggattcgggcaagcacttgtctttactaacagtcagcacaataatcagatggcaccaggaacaggatcatccaccgctgtgaattcctgcagcccacagagcttatcctccgtgctcggatcggggtttggcgaattagcccccccaaaaatggcaaacatcacgagctcacagatcttggaccagttaaaggcgccttcactcggccagttcactacaacaccaagcacccagcagaacagtaccagtcaccccacgaccacaactagttgggatcttaagccaccaacgtctcagagcagtgtgctctctcatttggacttcaagtcgcaacccgaaccgtccccagtcctgagtcaactctcccagagacaacagcatcagtcgcaggccgtgacagtgcccccgccagggctggaatcgtttcccagtcaggccaaactgagggagagcacacctggagatagcccctcaactgtgaataagttgctccagctgcccagtacaactattgaaaatattagcgtgtcggttcatcagccccagccgaaacatatcaaactagctaaacgtcggattccccctgccagcaagatccctgcgagcgccgtcgagatgcctggatctgccgatgtaactggcttaaatgtccaattcggggcacttgaattcggctccgaacccagtctctcagagtttggcagcgcgccctcctccgaaaactctaaccagatcccaatctccctgtattcaaagtcactgtccgaaccgctaaacacttccctttcaatgacttctgcagttcagaattcaacctacactactagtgttattacttcgtgctctctgacttcttcatctttgaatagtgcatcaccagtggctatgagctcctcatacgaccaatcctcagtccacaaccgtattccttaccaaagcccagtgtccagctctgagtcagctcccggcacaattatgaacggtcacggcggtggcagatcccaacagacactcgatactccaaagactacgggaccaccatcagctttgccatcggtttctagtctgccatcaacgacgagttgcacagccctattgccttcgacatcacagcacactggcgacctcacctcctcaccgctgtcacagctttcttctatgcccgtgtggagagcaccactgccgacctcccctcagccaccctcccccagacagaggcctccttcacaggtgccccacccacaagccccagcctgccctgtcgcttag

SEQ ID NO: 34273 - DNA, 831 bp, Artificial Sequence
  Description of Artificial Sequence: Synthetic coding sequence
gaaaaagaaagttcgcgagggcgcgggaataacaatagaaaaggacgaggcggtaataggggacgcgagttccgcggcgaagaaaacggaatcgactgcaatcaggtcgacaagccctctgaccgagggaagcgggcccgcggccgcggctttgggcgagggaggggccgtggggctggaagatttagtactcaagggatgggaacatttaacccagctgattacagcgactccaccagcacagacgtttgcgggaccaagctggtcgtgtgggaggctgcccagaacggggctgacgagggaactggcgcttggaaaaactccgttgaagagtggactaccgaagactggaccgaggatctcagcgagactaaagtgtttacagcctcgagtgctcccgccgagaatcacatcctgccagggcagagcattgacctggtggcactgttacaaaagccagtccctcatagtcaagccagcgaggccaattcattcgagaccagccagcagcaggggttcggccaggccttagtgttcacaaatagccagcataataaccagatggctcctggcaccggctctagcaccgcagtaaacagctgctcaccacagagcctgagcagtgtactgggcagtggcttcggggaactagctccaccaaaaatggctaacatcacatcatcacaaatactggaccagttaaaggccccgtctctgggccagtttactaccaccccgagcacgcaacagaactccacatcacaccctacgacaacaaccagctgggatctcaaacccccaacttcccagtcaagcgttctgagtcattag

SEQ ID NO: 34274 - DNA, 3087 bp, Artificial Sequence
  Description of Artificial Sequence: Synthetic coding sequence
atgcgactcgctcaggtaatctttgacaaaaacgattctgacttcgaagccaaggtgaaacagctcatggaagtgacagggaaaaatcaagacgaatgtattgtggcactgcacgactgcaacggcgatgtaaacaaagccataaacatccttctggaaggcaattccgatacgaccagctgggagacggtgggctgcaaaaagaagaatttcgccaaggaaaacagcgagaacaaggaaaaccgcgagaagaagtccgaaaaggaatccagccgcggccgtggcaacaacaatcgaaagggacgcggtgggaatcgaggacgagagtttaggggagaagaaaacgggattgactgtaaccaggtagataaaccatccgaccgcggtaagagggctcgcggtcgggagcttgcttcaaatacccataatattgctcaggacttgtctaacaagagcagctatggcctgaagggcgcatggaaaaatagtgtcgaagaatggactacagaggactggacggaagatttgagcgagactaaggtgtttaccgcttcctcagcacctgcagagaaccacattctgccgggtcaaagcattgacctcgtagcactgctgcagaaaccggtgccgcactctcaggcctctgaagcaaattccttcgaaactagccagcagcaaggatttggccaggctctggttttcacgaacagccaacacaataaccaaatggcccctggtacgggttcttcaactgctgtgaattcctgtagccctcaatctctcagtagtgtgctgggctcagggttcggtgaactggcaccccccaagatggctaacatcacatcttcccagatcctggatcagctaaaagcaccctctctaggtcagttcaccacaaccccttctacgcaacagaatagcacatcccaccccactaccaccacctcttgggacctgaaacctcccacttcccagagcagcgtcctctcacacctggacttcaagtctcagccagaaccctcacctgtactcagccagctttctcaacggcagcagcaccagtctcaggccgtgacagtgcccccccctggtctggagtcttttccatcacaggcgaaattgcgcgaaagcacacccggcgatagtccatctaccgtgaacaagctgctccagctgccaagcactaccatcgaaaacattagtgtgtctgtgcatcagcctcagcccaagcatattaaactagccaagaggcgcataccacctgctagcaaaattccggcctccgccgtcgagatgccgggctcggctgacgtgaccggattaaacgtgcagtttggggccctggagttcggctcggagccatcactgagtgagttcgggagtgcgccttcttcggaaaacagtaaccagatacccatttccctgtactcaaagtctctctccgagccattgaacacgtccctcagtatgacttcagccgtccagaacagtacatataccaccagcgtgataaccagctgttccctgaccagtagctcgctcaattcagcttccccggttgccatgagctcaagttacgaccaatcctccgttcacaatcggattccataccagtcgcccgtctcctccagtgaatccgcacccggcaccatcatgaatgggcacggtggaggtcgctcacagcagacactagacacgcctaagacaacgggcccgccctctgctctgcctagcgtttcttccttgccgagcaccacgagctgcaccgcattgctcccaagcacctcacaacatactggcgacctcaccagctcacctctatctcaactcagttccagtctgagctcacatcagtcttccctttcagcccatgccgcactcagttctagcacatctcacacccatgcatctgtggaaagcgcaagtagtcaccagtcaagcgccacattcagtactgcagctacgtcggtgtcaagttctgcctcatccggagcttcgctgagtagcagcatgaacacagccaattcgttgtgtttaggcggaacaccagcgagtgccagttcctcctccagcagagccgcccctttggtaacaagcggaaaagctccgccaaacctgccccagggcgtgcccccccttctccacaatcaatatctcgtggggcctggagggctgctgcccgcctaccccatctatggctatgatgagttgcagatgttacagagtaggctgcccgttgattattacggaatcccattcgcagctcctactgcgctcgcctctcgggatggaagcctggctaataacccttacccgggggatgtgactaaatttggtcgcggcgatagcgcctccccggcccccgctacaacgcccgctcaaccacagcagtcccagtcacagactcatcacaccgcacagcagcccttcgttaaccccgcgctgccgcccgggtactcttataccggactgccttactataccggcatgccctccgcattccagtacggacccacaatgttcgtgcccccagccagcgcgaaacagcacggggtcaacttaagtactccgaccccaccatttcagcaagcctcggggtatggacagcacggctattctacgggatacgatgatctgacccaggggaccgccgccggtgactactctaaaggcggatatgccggcagcagccaggctcctaacaagagtgccggctctgggcccggcaagggcgtctcagtatccagctccacaaccggcctgcctgatatgaccggcagtgtgtacaataagacccaaaccttcgataagcaggggttccatgcaggtacacccccacccttctcactgccctccgtgctggggtctaccggccctctggctagtggagccgccccaggctatgcgccacctcctttcctgcacatcctgcctgcacatcagcagccacactctcaattgttacatcatcacctcccccaagacgcccagagtggctccgggcagagaagtcaaccatcgtccctccagccaaagtctcaggcaagcaaacccgcctacggaaactctccgtattggacaaactag

SEQ ID NO: 34275 - DNA, 3360 bp, Artificial Sequence
  Description of Artificial Sequence: Synthetic coding sequence
atgatgacctctgtaagtagcgaccattgccgcggcgcccgggaaaagcctcaaattagcgccgcccaatcaacccaacctcagaagcaggtggtccaggctaccgccgaacagatgaggttagcccaggtgatcttcgacaagaatgactccgactttgaggccaaagtgaagcagctcatggaagtgactggaaaaaaccaggacgaatgtatcgtggctctacatgactgtaatggagatgtgaataaggctatcaacatccttttagaaggaaattccgatacaacttcatgggaaaccgtggggtgtaagaaaaagaactttgctaaagaaaacagtgaaaataaggagaatagagaaaaaaagagcgagaaggagtcctcacgtggaagaggaaataataaccgtaaaggacgcggcggtaatcgaggtagagagtttcggggcgaggagaatgggatagactgtaaccaggtggataaaccaagtgacagaggcaaaagggctagaggtcgagggttcgggagaggtaggggaagaggcgctgggcgcttctcaacacagggcatgggaactttcaatcctgccgattatagtgattctacgtccactgatgtctgcggcactaagcttgtggtctgggaagctgcccagaatggggctgatgaaggtacagagctcgctagcaatacgcacaacatagctcaggatctctctaacaagtcttcatatggcctgaagggggcttggaaaaatagcgttgaagaatggaccactgaagattggacagaggatctcagcgagactaaggtctttactgcctcttccgctccggcagagaaccacattctgccggggcagtccatagacctggtggcactacttcagaagcctgtgccccactctcaggcctccgaagccaacagctttgagacatcacagcaacaggggtttggccaagctttagtattcactaactctcagcacaataaccaaatggcgcccgggacaggcagttccaccgccgtcaactcttgtagtccccaaagcctgagtagcgtcctgggctcaggctttggcgagctagctccccccaaaatggccaacatcacctccagccagattctcgaccagttgaaagccccatccctcggacaattcacaacaacaccatctacccagcagaacagcacctcccatccaacgaccaccacatcatgggatctgaaaccccccacttcccagtcctccgtgctcagccatctggattttaagagccagcccgaacctagccccgtgctttcccagctgtctcaaaggcagcagcatcagtcacaggctgttactgtgccccctcctggcttagagagttttccgtctcaagccaaactgagggagtctactccaggtgatagtccaagcaccgtgaacaagctgctccagctgcctagtacgaccattgaaaacatttccgttagtgtgcatcagccacagcccaagcacatcaaacttgccaagcggcgaattccccctgcctccaagatccctgccagcgccgttgaaatgcctggatccgcagacgttactgggttgaacgttcagtttggggccctcgagttcggctctgagccttccctgtccgaattcgggtcagcacctagctctgagaattctaaccaaattcccatctcgttgtatagcaaaagtctgtccgagcctctaaatacttcactcagtatgacctccgcagtgcagaattccacatatactacatctgttatcacctcatgttctttgacttcttcaagcctgaactccgccagccccgtggcaatgtcgtctagttacgatcagtcctctgtccataacagaattccttaccagtccccggtctcttcctcggagagcgcacctggcaccataatgaacggccacggtgggggacgctctcagcagacgctggatacaccaaaaactaccggccccccctctgcactcccatcagtatcttccctgcctagcacaacttcatgcaccgcactgctcccgtcaacatcacagcacactggagacttgacatcgtcccctctctcgcagttgtcttcaagtctgtcttcccatcaatcttctttaagcgcacatgccgcactcagttcttccacaagccatactcatgcctccgtggagagtgcttcatctcaccagtcatcagcaaccttctctaccgcagcaaccagtgtcagctccagcgcctcctctggtgcttcactctcttccagtatgaatacagccaatagcttatgccttggggggacccccgcgagcgcctcgagctcctcttctcgtgccgctcccctggtgacatccgggaaggctcccccaaacttaccccagggggtgcccccgctcttgcataatcagtacctcgtcggaccaggagggctcttacccgcctatcccatatacggctacgacgaattacaaatgctccaaagcaggctcccggttgattattatggaatccccttcgcagctcccaccgcattggcatcacgggatggttctctcgccaacaacccgtatcccggcgacgtaacaaagttcggaaggggggattctgcctctccagcgcccgctaccacgccagctcagcctcagcagagtcaatcccagacgcaccacactgcacagcaacccttcgttaatccagctttgccccctggttacagctacacaggactgccctattataccggtatgccctctgcatttcagtatggtccaaccatgtttgtaccacccgcgtcagccaagcagcacggcgtgaacctcagtacacctacaccccccttccagcaagccagcggttacgggcagcatggctactcaactggctacgacgaccttacacaaggcacggccgctggagactactccaagggcggctatgctgggagcagccaggctcccaacaaatccgccggtagtggccccgggaagggggtttcagtttcgtccagcacaaccgggcttcctgatatgacgggctcagtgtataataagactcagacatttgataagcagggctttcatgctggaaccccccccccgttttccctaccaagcgtcctgggcagtactggacccctggcttctggcgcggccccaggttacgcgccccctccattcctgcatatactgccagcccatcagcagccgcatagccagctgcttcaccaccacctgccgcaggatgcccaatcaggatcgggccaacgttctcaaccaagcagcctgcagcctaaatctcaggcgtccaagccagcttacggcaactcgccttactggaccaattag

SEQ ID NO: 34276 - DNA, 2625 bp, Artificial Sequence
  Description of Artificial Sequence: Synthetic coding sequence
atgaggctagcacaagttatctttgacaaaaacgattcggactttgaggccaaagtgaaacaattgagcgaaaccaaagtctttacggccagcagcgccccagctgagaatcacatcttgccggggcagtccattgatttggtagccctcctgcaaaagcctgtgccacattcgcaggcatccgaggccaactccttcgagacctcccagcagcagggattcgggcaggccctggtgtttacgaacagccagcataacaaccaaatggcgcctggcactggtagttctaccgccgtgaatagctgctcgccacaatccttatcgagtgttcttggatctggcttcggggaactggcccctcccaaaatggctaacattacatcaagccagattctagatcagctcaaagctccttcgctggggcagtttacaacaacgccctcaactcagcagaattccacttcccatcccacaacaaccacttcttgggacctcaagccacctacaagtcaatccagcgtgctgagtcacctggattttaaatcccaaccggaaccgagtccagtcctgtcacagctcagccagagacagcaacaccagtcgcaggccgtgaccgtcccccctccagggctggagtcatttcccagccaggccaaattgcgagagagtacccctggcgactcgccttctacagtaaataaactgcttcaactcccttcaacgaccatcgaaaacatttcggtaagcgtccatcagcctcagcccaagcatattaagctggccaaacgccgtataccacctgcaagtaagatccccgcgagcgccgtagagatgcccgggagcgcagatgtcacagggctgaatgtgcagtttggggccttggagttcgggagtgagccctctctctccgagtttggatctgccccatccagcgagaacagcaaccagattccaatctccctgtattccaagtctctttctgagcccctgaacacaagcctctcaatgactagcgccgtgcagaacagcacttataccacctccgtgataacaagctgctcacttacatcatcctcattgaacagtgcttcccctgtagctatgtcttccagctacgaccagagctccgtccacaaccgtatcccatatcagtcccccgtgtcatctagtgagagtgccccggggacaataatgaatggccatgggggcggcagatcacaacagacactcgacacaccgaaaaccacaggaccccctagtgctttgccttctgtgtcttccctgccgagtactacatcatgtacagccttactgccatcaacttctcagcacactggcgacctcacaagctccccgcttagccaacttagctccagtctgagttctcatcagagctcattgtctgcgcacgccgccctgtcctcctcgacgtcacacactcacgcatcagtggagtccgcctcctctcaccagtcaagcgcaacctttagcaccgccgcgacctcagtaagcagctccgcctcctcaggagcttcactatccagcagcatgaacaccgcaaactccctttgcttgggcgggacaccggccagcgcttcctcctctagctcaagagctgcccctctggttacttcagggaaggccccaccaaacttgcctcagggagtccctcctctgctgcataaccagtacctggtaggccccggagggctgctgccagcttacccaatctatggttatgacgaactgcaaatgctacaatccagactgcccgtcgactattacggaataccgttcgccgctccaacagcgctcgccagtcgtgatgggtccctcgcaaacaatccatatccaggggatgttactaagtttggacgcggagacagcgcttcaccagctccagccaccactcccgcgcagccacagcagtctcagtcacagactcaccacacagcccagcagcctttcgtgaaccctgcactccccccagggtactcctatacgggtctaccatactacacaggcatgccaagtgcttttcaatatggccctacaatgttcgtgccccctgcgagcgcaaaacagcacggggtgaatctcagtacccccaccccaccattccaacaagcgtctgggtacggccaacacgggtattctacaggttacgatgaccttactcagggcactgcggcaggagactatagtaaagggggctacgccggcagtagccaggccccaaacaagtctgccggcagcggtccagggaaaggcgtgtctgtttcctcatcaacaaccggcttgcccgatatgaccgggtcagtgtataataagactcaaacctttgacaaacaaggcttccatgctgggacacccccaccattcagtctgccatcagtgcttggctcgacagggccactggcttccggggcagctcctggttatgctccacctccctttctgcacattttgcctgctcatcagcagccacactcccagttgctccatcatcatcttcctcaggacgcacaatcaggatctggccagcgctcacagccaagcagcctgcagccgaaatcccaagcaagcaaaccagcttacgggaattccccatactggaccaattag

SEQ ID NO: 34277 - DNA, 1593 bp, Artificial Sequence
  Description of Artificial Sequence: Synthetic coding sequence
atggaggatgatagcctgtacctcggtggagaatggcagtttaaccacttttctaagctcacctccagccgtcctgatgctgctttcgccgagattcagagaactagccttcccgagaaaagcccactgagttgtgagaccagagttgacctctgtgatgatctggctccggttgcaagacaactggctccccgcgaaaaactgcctctgtcaagccgacgccctgctgcagttggggcaggactgcaaaatatggggaacacttgttatgtaaacgcaagtctgcagtgtctcacatatactccccccctagccaactatatgctgtcaagggaacattcgcagacgtgtcataggcacaaggggtgcatgttatgtacaatgcaggcacacatcacacgcgccttgcacaaccctggccacgtcatacaaccatcccaggccttggcggcagggttccaccgcggaaagcaagaagatgctcacgagttcttaatgtttaccgtggatgctatgaaaaaagcgtgcctgcctggccacaaacaggtggaccatccatcaaaggacaccactctgattcatcagatctttggcggttactggagatctcagatcaagtgcctccactgccatggaatctctgatacttttgatccttacctggacattgcactggatatacaggccgcccagtcagtgcagcaagccctcgagcagctagtcaagcccgaggagctgaacggagagaacgcatatcattgtggcgtgtgtctgcagagagcgcctgcttctaaaactttgacccttcacactagtgccaaggtgctgatcctcgttcttaagaggtttagtgacgtgactggtaacaagattgccaagaacgtacaatacccggaatgtttggacatgcagccttacatgtcgcaacaaaataccggccctctcgtttacgtactgtatgccgtgctggtacatgccggctggtcctgccacaacggacactactttagctatgtgaaagcccaagagggccaatggtacaaaatggacgatgccgaggtgactgctgcaagtatcacttcagtcctttcccagcaggcatatgttctgttttatatccaaaaaagcgagtgggagaggcactccgaaagtgtcagtcgcggacgcgagcccagggccctaggagccgaggacaccgatcgccgggctacccagggtgagctgaaaagggatcatccctgcctgcaggctcccgagctggatgagcacctcgtcgaacgagccacccaggagtctactcttgaccggtggaaattcctgcaggagcagaataagacaaaacccgagtttaatgtgaggaaggtggagggcaccctaccacccgatgtgctggtgatacaccagtcaaaatataagtgtggtatgaaaaaccaccaccccgagcagcagtcaagccttctgaacctgtcttcaagcaccccaacccaccaggagtcaatgaacactgggaccctcgcaagtctacgaggaagagcgcggaggagcaaaggcaaaaataaacattcaaaacgagcacttctggtatgccagtag

SEQ ID NO: 34278 - DNA, 684 bp, Artificial Sequence
  Description of Artificial Sequence: Synthetic coding sequence
atggggaactgcgttgggcggcagcgccgggagagacccgccgctcctgggcaccccagaaagagagccgggcgcaatgagcctctgaaaaaagagcgactcaagtggaaaagtgactacccaatgacggacgggcagctgcgctctaaacgagatgagttctgggacaccgctcctgccttcgagggaaggaaagagatttgggatgccttaaaagctgcagcctacgcagctgaggccaacgatcacgaactggcgcaagccatccttgatggcgcctccatcacgctccctcacggcacactctgcgagtgttacgatgaattaggtaacaggtaccaactacccatctattgcctctccccgccggtgaatctcctgctggaacacaccgaagaggagtcactggaaccgcccgagccacccccaagcgtgcggagagaatttccactgaaagtaaggctatcaaccggcaaagatgtacgactgagcgctagtctgcccgataccgtgggacagctcaagcggcagcttcacgcacaggagggcatcgaaccctcgtggcagagatggtttttctccggtaaacttctcacagatcggacgcgactgcaggaaacgaagatacagaaggattttgtcatccaggttattattaaccagccgccacccccccaagactag

SEQ ID NO: 34279 - DNA, 3261 bp, Artificial Sequence
  Description of Artificial Sequence: Synthetic coding sequence
atggccaccgtgggggaatggagctgcgtgaggtgcactttcctgaacccggccggacagcgacaatgcagcatttgcgaagctccccggcacaagcccgatctgaatcacattctacggctcagcgtggaggagcaaaagtggccttgcgcacgatgtacatttcgaaacttcctcgggaaagaagcctgcgaggtttgtgggttcaccccagagccagcccctggcgcagcttttctgcctgtgctcaacggcgtattgcccaagccacccgcaatactgggcgagccaaaaggctcctgccaggaggaggccggaccggtgcggacggccggtttggttgcaaccgaacccgcacggggccagtgtgaagacaaggatgaggaggaaaaggaagagcaggaagaggaagaaggtgctgccgaaccacgaggcggatgggcttgccccagatgtaccctccataatacacccgttgctagcagctgctccgtctgtggcggtcccaggcgcctgagtttaccgcgaattccaccagaggcactcgtggtgcctgaagtggtagctcccgcgggcttccatgtggtgccagctgcccccccgccaggcctgcccggcgagggggcagaagctaatcctccagcaacgagccagggaccagcagccgaaccggagcctccacgggtccctcccttcagtccatttagcagtacacttcagaacaaccccgttcctcggtccagacgcgaagttccgccccagctccaaccacctgtgcccgaagctgcccagcccagtccctctgccggttgtcgtggcgccccacagggttccggttgggccggcgccagcaggttggcagagctgctgagtggaaagagactctccgtcttagaagaagaggctactgagggaggaacatcccgcgtcgaggcagggtccagtacgtcgggcagcgacatcatcgatttagcaggagatacagtgaggtatactcccgcttcacccagctccccagactttaccacctggagttgcgccaaatgtaccttgaggaaccccactgtggcgcctagatgttccgcgtgtggctgttcaaaactgcacggcttccaagagcacggcgagcccccaactcattgtcctgattgtggcgctgataagccgagtccttgtgggcgctcgtgtggacgtgtttcatctgcacagaaggcggcccgagtgttgccagagaggcctggccaatgggcatgcccagcctgcactcttctgaacgccctgcgagcaaaacactgtgctgcctgccacactcctcagctgctagtagcccaacgccgcggagcagccccactccgtagaagagaatccatgcacgtcgagcagaggcgccagaccgatgaaggggaggccaaagctttgtgggaaaacatagttgccttctgccgggaaaataacgttagtttcgtagacgattcattcccacccggacctgagagtgtgggcttccccgctggcgatagcgtgcagcagagagtccggcagtggctcagaccccaggagatcaactgctcggtcttccgcgatcatcgggcaacttggtccgtgtttcacactctaagaccgtctgacattctccagggcttgttagggaattgctggtttctttccgccctcgctgttctcgcagaaagacctgacctcgtggagcgagtaatggttactcgctctctgtgcgccgagggggcttaccaagtgaggctgtgtaaggacgggacatggaccactgtattagtcgatgatatgctcccgtgcgacgaagccggctgcctcctgttttctcaggcgcagcgcaagcagctgtgggtggctctaatcgagaaggcactagcaaaacttcacggctcctacttcgctctacaggcaggaagggctatcgagggtctcgccactctcactggagcaccttgtgagagcctggcactgcagctctcctcaactaatccaagagaggagccagtggacacggacctcatctgggcaaagatgcttagttcaaaagaagctgggtttctgatgggtgcctcctgcggtggcggaaacatgaaggtcgatgatagtgcgtacgagtcattggggctaaggccgcggcatgcatacagcatcctcgacgttagggatgtgcagggaaccaggctgctgcggttgagaaacccttgggggcggttctcctggaacggcagttggtctgatgaatggccacactggcccgggcacctgcgcggagaacttatgccccatggatccagcgagggcgtattttggatggaatacggggatttcgtgcgatacttcgacagcgttgacatctgtaaggtgcactcagattggcaggaggctagagttcagggatgctttccctcctccgcgagcgcacccgtgggagtcacagcactcactgtgttggagcgagcaagcctggaattcgccctgttccaagagggctctaggcgcagtgacgccgttgacagccacctcctggatctgtgtattctggtattcagagcaactttcggctccggtggccacctgagcttgggacgtcttctggctcacagtaagcgcgcggttaagaagtttgtgtcctgcgacgttatgttggagcccggggagtacgccgtggtttgttgtgcgtttaatcactgggggccgcccctgcctggcacccccgcacctcaagcctccagtccttcagccggtgtgcctcgtgcatctcccgagccccctgggcatgtgctagccgtgtattcatcccggcttgttatggtcgagccagtggaggcccaacctacaactttggcagatgccattatccttctgactgaatcacgcggagagcgacacgagggtcgcgagggaatgacttgctactacttgacccacggctgggccggacttatcgttgtggtggaaaataggcaccccaaagcttatctgcatgttcagtgcgattgcactgactcctttaacgtggtctcaacccggggctcactgcggactcaggattcagtaccgcctctgcatcggcaggtgctcgttatccttagccaactcgagggaaatgccggattcagcatcacccataggctggcccataggaaagcagctcaggctttcctgagtgactggaccgctagcaaagggacccattctccaccgcttacaccagaggtggcgggactccatggacctaggcccctgtag

SEQ ID NO: 34280 - DNA, 930 bp, Artificial Sequence
  Description of Artificial Sequence: Synthetic coding sequence
atggccgctgccggcgcccctgacggtatggaggagcctggcatggatactgaagcagagactgtggcaaccgaggctcccgcaaggcccgttaactgcctggaagcagaggccgcagcgggtgccgccgctgaggattcgggagcagcccgcggctcattgcagcccgccccagcgcagcctccgggggatccggcagcccaggcatccgtaagtaatggagaggatgccggcggtggggccggccgagagctggtggatctgaagataatctggaataagactaagcacgatgtaaagtttccactcgattcaactgggagcgaattaaagcagaaaatccacagtattacaggactgcccccagcaatgcagaaggttatgtacaaaggtctcgtacccgaggataaaaccctgagggaaattaaggtcaccagcggcgccaaaataatggtggtaggatccacaattaacgacgtgctggctgtgaacacacccaaagatgccgcccagcaggacgcaaaagctgaagagaataagaaggagcctttgtgccggcaaaaacagcacagaaaggttctggacaaggggaaacccgaagacgtcatgccttcagttaaaggcgcccaagagcgcctcccaaccgttcccctttccgggatgtacaacaaatctggtgggaaagtccgtctaacgttcaagctggagcaggatcagctatggatcggcacaaaagagcgcaccgagaaacttccgatgggaagcatcaaaaatgtggttagtgagcctatcgagggccacgaggactatcatatgatggcatttcagttgggacctacagaggcaagctactactgggtgtactgggtccccacccagtacgtggacgccatcaaagacacagtgctggggaaatggcagtacttttag

SEQ ID NO: 34281 - DNA, 561 bp, Artificial Sequence
  Description of Artificial Sequence: Synthetic coding sequence
atgcagaaagtcatgtataaggggctcgtgccagaagacaagaccctccgcgagataaaagtgaccagtggagccaaaatcatggttgtggggtcaaccattaacgacgttcttgctgtcaacacaccaaaagatgccgcccagcaggacgcgaaagcagaggagaataaaaaagaacccttgtgccgccagaagcagcaccgcaaagttcttgataaaggcaagccagaggacgtgatgccctccgtaaaaggggctcaggagcgcctgcctacagtgccgctgtcagggatgtacaacaaatctggcggcaaggttagactgacctttaagctggagcaggatcagttgtggatcgggacaaaagaaagaaccgaaaagctgcccatgggctctattaaaaacgttgtgagcgagcccatcgagggacacgaagactaccacatgatggcctttcagctgggtcccacagaggcctcttactactgggtgtattgggtccccacgcagtatgtggacgccatcaaagatactgtcttaggcaagtggcaatacttttag

SEQ ID NO: 34282 - DNA, 2127 bp, Artificial Sequence
  Description of Artificial Sequence: Synthetic coding sequence
atgttcacactatctcaaacaagtcgggcttggttcattgacagggcacgccaggcccgggaggagcgtctcgtgcagaaagagcgcgaacgagctgcagtggtgatccaagctcacgtgcgctccttcctttgcagatctaggctgcagagggatatccgccgcgaaatagacgatttttttaaggctgacgatccagagtccacaaagcgttccgccttatgtatttttaaaatcgctcggaagctgctgtttttgtttcgcattaaagaagacaatgaaaggttcgaaaagttgtgcaggtccatcctctccagcatggacgctgagaatgagcctaaagtctggtacgtgtcattggcctgcagtaaggacctgacactgctgtggatacaacagattaagaacatactgtggtattgctgtgatttcctcaagcaactgaaacctgagatccttcaggattcgaggttgattaccctctacctgacaatgctcgtcacttttacggacacaagtacatggaaaattcttcggggcaaaggcgaaagcctcagaccggctatgaatcatatttgcgccaacataatgggacatcttaatcagcacggattttatagcgtgcttcagatactcctgaccagaggacttgcccgtccccgcccatgcctaagtaagggcacattaacagcggccttttccttggccctccggcctgtgatagcagcacagttctccgataacttaatccgtccgttcctcattcacataatgtcagtgcccgcccttgtcactcacctgtccactgtaacccctgaaaggctgaccgtgctggagtcccacgatatgctgaggaaatttatcatcttcctgcgcgatcaagacagatgtcgagacgtttgcgagtctcttgaggggtgccacaccctgtgcttgatggggaatttactgcatctgggcagtctgtctcccagggtgttagaagaggagaccgacggattcgtgtccctcctgacccagactctgtgttattgtcgaaagtatgtgtcccaaaaaaagtccaatctgacacattggcaccccgtcctgggctggttttcccaatctgtcgactacgggctaaacgagagtatgcatctaattacaaaacagctccagttcctctggggggtgccgctgattagaatttttttctgcgatattctatccaaaaagctacttgagagtcaggagccagctcacgcccagcctgccagtcctcagaacgtcctcccagtgaaatcattgcttaagcgggcctttcagaagtctgcatctgtgagaaatatcttaaggccagtaggcggaaaacgggtggatagtgccgaagttcaaaaggtctgtaacatttgcgtgctgtaccagacttcgctgacaacccttacacagattcgactgcagatactgaccgggctgacttacctggatgacctgctgcccaaactgtgggcttttatctgtgagctcggacctcatgggggactgaaactgttcctggagtgtctgaataacgacactgaagaatcaaagcagctgctggccatgttaatgctcttttgtgattgcagtaggcacttaatcacaatactggatgacatcgaagtgtacgaggagcagatctccttcaagctcgaagaactggttaccatctctagctttctgaattcattcgtctttaagatgatctgggatggcatcgtagaaaacgcaaaaggcgaaacgctggaacttttccagtccgtgcatggatggctgatggttctctacgaaagggattgcagaagacggttcactccagaggaccactggctgagaaaggacctgaagccctcagtattattccaggagctcgaccgcgatcggaagcgtgcccagcttattctgcagtatatcccgcatgtgatcccccacaaaaatagagtgctgctgttcagaaccatggtgacgaaagaaaaagaaaaattgggattagtagagacctcatcagcttcaccacacgttacccacattacaatccgccgctcccggatgctcgaatctctgttcgagtgcccctggcccttggtcatcaatgctgagtcttgttag

SEQ ID NO: 34283 - DNA, 735 bp, Artificial Sequence
  Description of Artificial Sequence: Synthetic coding sequence
atgttcacccttagtcaaacaagtcgggcatggttcatcgaccgggcccggcaggctagggaagaacggctcgtgcaaaaagaacgtgaacgtgcagccgtggtgatccaggcccacgttaggtcctttctatgccgatcccggctgcagcgtgatatccggcgggaaatcgacgacttcttcaaagcggatgacccagagagtacaaaacgctcagccctgtgtatttttaagattgcgagaaagctcttattcctgtttcgaattaaagaagacaacgaaagatttgagaaactgtgccgatctatactgagttctatggatgccgagaacgagccgaaagtgtggtatgttagcctggcctgcagcaaggatttgactctgttgtggattcagcagattaaaaatatcctctggtattgttgcgacttcttaaaacagctgaaaccggagattctgcaggacagccggttaattacactgtatttgaccatgctcgtgacgttcacagacacttcaacgtggaagatcttgcgtggcaaaggtgaatccctcaggcccgcgatgaaccacatatgcgccaatattatgggccatctgaaccagcatggcttctactctgtgttgcaatgctgcgacggtctctttcccgacctcgtgtcttatgcccctcataacaatcccgtgcggtggagcgtagggcgtagctggtacgactggcagctaagtcggtag

SEQ ID NO: 34284 - DNA, 3207 bp, Artificial Sequence
  Description of Artificial Sequence: Synthetic coding sequence
atgttcactcttagtcaaacttccagggcctggtttatcgatcgggcccgccaggctagagaggaaagactggtgcagaaagaacgagagagggccgcagtcgtgatccaggctcatgtgagaagttttctctgcaggtccaggctgcaacgggacattcggcgcgaaatagacgatttttttaaggccgatgaccccgaaagtactaagcggagtgccctgtgtatcttcaagatagcccgaaagctcctgtttctatttaggatcaaggaagacaatgagaggttcgagaaactatgtcgctccattctgtcgtccatggatgccgagaacgaaccaaaggtgtggtacgtgtcgttagcatgctctaaagatttgactctgctatggattcagcagatcaagaacattttgtggtattgctgcgattttctcaaacagttgaagcccgaaatcctgcaggacagtagactgatcacattatacctcaccatgctcgtcaccttcactgacacaagcacttggaaaatacttcgagggaagggcgaaagcctaaggcccgcaatgaatcatatctgcgctaacattatgggacatcttaatcagcacgggttctatagcgttctccagattctcctcaccagggggctcgcacgcccccgaccctgtctctctaaaggtacgctgactgcagcatttagcttggcactaagaccggtcattgctgcacaattttccgataacctgatccggcctttcctgattcacatcatgtccgtgccagctctggtgacccacctgtcaactgtcactccagaaaggctcacagtacttgagagccacgatatgctgcgcaagttcatcatctttctaagggaccaggacaggtgccgagacgtatgcgagagtctggagggatgtcacacactgtgcctgatgggtaacctcctccacttgggatcattatcacctagagtccttgaggaggaaactgacgggtttgtcagcttactgacacagactctgtgctattgccggaagtacgtgtctcagaagaaaagcaacctgacgcactggcacccagtactcggatggttctcacagtcagtggactacggactgaatgaaagcatgcacctaatcactaagcagctgcagtttctgtggggcgtgcctctaatccggattttcttctgcgatatcctgtctaagaagctcctcgaaagccaagagccagcccatgcacagcccgccagcccacagaatgttctccctgtgaagtcccttctgaagcgtgcctttcaaaagagcgctagtgtacgtaatattcttagacccgtgggtggtaaacgggtggatagcgcagaagtgcagaaagtttgtaacatctgtgtgctctaccaaacatctttgactacattaactcaaattaggctccagatccttactggactcacttacctggatgacctccttccgaaactctgggccttcatctgtgagctcgggccccatggtggactgaaactgttcctggaatgcctaaataacgataccgaagagtctaagcaactcctcgctatgttgatgttgttctgcgactgtagccggcatctgataaccattctggatgatatcgaagtatatgaggaacaaataagtttcaagctggaggagctggtaaccatatcttcttttttaaatagctttgtattcaaaatgatatgggacgggatcgtggagaatgcaaaaggtgagacattggagctgttccagagcgtgcatggatggcttatggtactgtacgagcgggactgccgacgtagatttactcctgaagaccattggttgcgcaaggatctgaagccatcggtgctctttcaggaactggatcgagacagaaagagagctcagctgatccttcagtacatcccccacgtcattcctcacaagaatcgggtgttactatttcgtaccatggtcaccaaagaaaaagaaaagctgggcttggtcgagaccagctccgcttcaccacatgttacccacattaccatcaggcgctcccgcatgctggaggacgggtatgagcaactgcgacagctttcacagcacgctatgaagggggtgatacgggtgaaattcgtaaacgaccttggagtcgatgaggcaggaatcgatcaggatggggtgtttaaggagttcctggaagagattattaaaagggtgttcgaccctgcactcaacttatttaagacaacgagtggggacgaacggctgtacccttcacccacatcttacatacatgaaaactatcttcagctgttcgaatttgtaggaaagatgcttggcaaagctgtctacgaaggcattgtggtagatgtacctttcgccagctttttcctgtcccagcttctcggccaccaccatagcgttttttattcctctgtggatgaactgccctctttggactcagaattctataagaatttgacatcaattaaaagatacgacggggatataacagacttgggtttaactctaagttacgatgaagatgtgatggggcagttggtctgccatgaactgatcccggggggcaagacaataccagttactaacgaaaataagatttcttatatccatctgatggctcattttcggatgcatacgcaaattaaaaaccagactgctgccctgatcagcggattccggtccattatcaagccagagtggatcaggatgttctcaacacccgagctgcaacgcctaatctccggagacaatgcggagatcgacctcgaggatctcaagaaacacactgtgtactacggaggctttcacggttcacatcgggttattatctggctgtgggacattctagcctctgatttcacaccagacgaaagagcaatgttcctcaagttcgtgacctcatgtagtagacctcctttgttaggatttgcttatctgaagcctccgttcagcatccgctgcgtggaagtctccgatgatcaggataccggagacactcttggctctgtactcagaggcttttttactatcagaaagcgcgaacccgggggaagactgcctacatcatcaacttgtttcaatctgttaaagctgccgaactattctaagaaatctgttctgagggagaagttacggtacgccatttctatgaacacaggctttgaactttcctag

SEQ ID NO: 34285 - DNA, 3207 bp, Artificial Sequence
  Description of Artificial Sequence: Synthetic coding sequence
atgttcacgctctcacagacgagccgggcctggttcattgaccgcgcacgccaggcaagagaggagagactcgtccagaaagaacgcgagagggcagccgtggtgatccaggcacatgttcgtagcttcttgtgcaggtccagactccagagagatattagaagggagattgatgactttttcaaagctgatgatccagaatcaacaaaacgaagcgcactgtgcatcttcaagatcgccagaaaactgctctttctgttcaggattaaagaggataacgaacgcttcgaaaagctttgcagaagcatcctgtcttcaatggacgctgagaacgagcccaaggtgtggtatgtttctttggcctgcagtaaggacttaactctcctatggatccagcagattaaaaatattctctggtactgctgcgactttctcaagcaattgaaaccagagattctgcaagactcccggctgatcactctctatctgactatgctggttacgtttacagataccagcacctggaagatcctgcggggaaagggggaatctcttagacctgctatgaatcatatctgtgccaacataatgggacatttaaatcaacatggcttttatagtgtgctgcagatcctcctgaccagaggcctggcgagacctaggccctgtctcagtaaaggaaccctgaccgctgcctttagtttagctctgagaccagttatcgcggcacaattttcagacaacctgatccgcccctttctgatccacattatgtctgtccccgccctcgtgactcacctatctacagttaccccggagagactgacagtgctcgaatctcatgacatgttgaggaagttcatcatcttcctgcgtgatcaagacagatgccgcgatgtatgcgaatctcttgaaggctgccatacactgtgtctaatgggcaacttactccatctcggatctctgtcaccacgtgtacttgaagaggaaactgacggctttgtgtcactgctgacccagaccctgtgttattgtaggaagtacgtttctcaaaaaaagtccaatctaacccactggcatcctgtgctggggtggttcagtcaaagcgtggattatggattgaacgaaagtatgcatctaataaccaaacagctccagtttctgtggggagtccccttgatacgcatattcttctgcgatatactttccaagaagttactggagtcacaggagccggcccatgcacaaccagcttctccccagaatgttctccccgtaaaatcccttttgaagagggcctttcagaagtctgcttccgtgagaaatatacttcgccctgtgggcggcaagagggtggactcagccgaggttcagaaggtttgcaatatctgcgtgctctaccagacatccctcaccacactgactcagatccggcttcagatcttaactggcttgacttacctcgatgatctactgcctaagctgtgggccttcatatgcgaactcggccctcacggcggactgaaactgttcctggagtgtctgaacaatgacacggaggagagtaagcagctcctggcgatgttgatgctgttttgtgattgtagcagacacctgatcacaattctggatgacatcgaagtgtacgaagaacaaatcagcttcaaactggaggagttggtaacaatttcctcttttctgaactcctttgtgttcaagatgatttgggacggtattgtcgaaaacgcaaagggagagacgctagagctttttcagagcgtccatggatggctgatggtcctctacgaaagggattgcaggaggaggtttacccccgaagatcactggctccgaaaggacctaaagccgtcggtcctgttccaggagctggacagagaccggaaaagagcccagctgattctgcaatatatcccccatgtcatcccccacaaaaaccgcgtgttgttgtttaggactatggtgacgaaagagaaggagaagttgggactggtggagacatcttcagcttctccccacgtgactcacatcaccatccggcggagtaggatgctggaagacggctacgaacagctccggcagctgtcacaacatgccatgaaaggtgtcattagagtcaaatttgttaacgatctgggggttgacgaggccgggatcgatcaggatggagtgtttaaggagttccttgaggaaatcataaagcgagtgtttgatcctgcactgaatctttttaaaacaacgagtggcgatgagagactctaccccagccccacctcctacattcacgagaattatcttcaattgtttgagttcgtgggaaaaatgctcgggaaggccgtgtacgagggcattgtggtggatgtgcccttcgcctcctttttcctgagccaactcctgggccaccaccatagtgtcttctactcctctgtggatgaactcccctccctggacagcgagttctataagaatttgacttctatcaaaagatacgatggagacatcactgatcttggcctgacgctgagctacgatgaagatgttatggggcagcttgtgtgccacgagttaatcccgggaggcaaaacaatcccagtaacgaatgagaataaaatttcctacatacatcttatggcccacttcagaatgcatacacaaatcaaaaaccagacagctgctctgatctccggatttcggtccattatcaaacccgagtggatccgcatgttcagtacccccgagctgcagcgtctgatctcaggcgacaacgctgagattgacttggaagacttgaagaaacataccgtttactatggggggttccacggatcccaccgcgtgattatctggctttgggacattctcgcctccgattttacgccagacgagagggctatgttcttaaaattcgtcactagttgtagtaggccccccctgctcgggtttgcatacctgaagccccctttttctattagatgtgtggaggtttctgatgaccaggatacaggtgacacactgggttccgtgcttcgtggcttttttactatacgcaaacgtgagcccggtggaagactgcccacctcatccacatgcttcaacctcctgaagctgccaaactacagcaaaaagagtgtcctccgcgaaaaactgcgttacgccatttctatgaatacagggtttgagctttcctag

SEQ ID NO: 34286 - DNA, 456 bp, Artificial Sequence
  Description of Artificial Sequence: Synthetic coding sequence
atgttttcaactccagaactgcagcggctgattagtggcgataacgctgagatcgacctggaggatctgaaaaagcacacagtgtactatggaggtttccacggaagtcatagggtgatcatttggttgtgggatatactagcaagtgactttacgcccgatgagagggctatgttcctgaaattcgttacgagttgtagtcgcccacctctcctcgggttcgcctacctcaagccgcccttttcaattaggtgtgtggaagtgagcgatgaccaacagggaaggcagctggatccaagtgaaccctccgaagaggggcctacggtgttgaccgcaggggagcctgcctctccgcgagagacggcgcacggcctgtcccccctgtccgccgctcctttttcatttctgcctcagggtcgagttcctggcgttggagtgggaacctgttgcttttag

SEQ ID NO: 34287 - DNA, 735 bp, Artificial Sequence
  Description of Artificial Sequence: Synthetic coding sequence
atgttcaccctgtcccagacgtctagagcatggtttattgaccgagcacgccaggcccgagaagagaggttggtccagaaggagcgtgaaagggcagcagttgtgattcaggcccacgtcagaagtttcctgtgtcgctctaggctgcagagggatataagacgcgagatagacgatttcttcaaagccgacgatcctgaatccaccaagcgctctgctctgtgtatcttcaaaattgcccgaaagctccttttcctgttcagaattaaagaagataatgagcgattcgaaaaactttgccgaagcatcctgtcctcgatggatgctgaaaacgaaccaaaagtatggtatgtctcgcttgcctgctcaaaggacctgacactgctttggattcaacagattaagaacattttgtggtattgttgtgactttctgaagcagctaaagcctgagattttgcaggattctagattaatcactctttatctcactatgctggtgacattcacagatacctctacctggaagatcttgaggggcaagggagaaagtctgcggcccgccatgaaccatatctgcgccaatatcatggggcacctgaatcaacatggattctactccgtattgcaatgttgcgatggccttttccctgatctggtttcatacgctccgcataacaaccctgtgagatggagtgtgggccgttcttggtatgattggcagctttcccgatag

SEQ ID NO: 34288 - DNA, 1017 bp, Artificial Sequence
  Description of Artificial Sequence: Synthetic coding sequence
atgaagggtgtaatcagagtaaagtttgtgaatgatctgggcgtagacgaagcaggcattgaccaagacggagtgtttaaagaatttcttgaagaaattattaaacgcgttttcgacccagccctcaacctgtttaagactacttcgggcgacgaacgactgtacccaagtccgaccagttatattcacgaaaattatctacagctcttcgagtttgtcggcaagatgctgggcaaagccgtgtatgagggtatcgtggtcgacgtgcctttcgccagctttttcctgagccaactgttgggacatcaccattccgtcttttactccagtgtggacgagcttcctagccttgactccgagttctataagaatctgactagtataaaaagatacgacggagacatcacagatctcggattgaccctcagctatgacgaggatgtaatgggccagctggtttgtcatgagcttatccctggtggcaagacaattccggtcactaatgaaaataagatcagctacatccatctaatggcccacttcaggatgcatacccagataaaaaatcagaccgctgctctgatatcaggttttagaagcatcattaaaccggagtggataaggatgttttcgacccctgaactgcagcgtctcatttcaggtgataacgcagaaattgatctggaagacctgaaaaagcatacggtatattatggcgggttccatggctcacaccgagtgattatctggctgtgggatatcctggcctccgacttcacgccggatgagagggccatgtttctcaaattcgtgacctcatgttcgagacccccactattgggttttgcttacttgaaacccccattttccattaggtgcgtggaggtgtccgatgatcaggctgttcacgtgcaggcccgctgtttcatctcttctctcgcaaagggcgaagggaagccaagcggactgagaagttccgtgtgcttaaagccaggtcccctatgggtgctgaaatag

SEQ ID NO: 34289 - DNA, 2619 bp, Artificial Sequence
  Description of Artificial Sequence: Synthetic coding sequence
atgttcacgttatcccagactagcagagcttggtttattgaccgggcaagacaggcgagagaagaacgacttgtgcagaaggaacgcgaacgcgctgcagtcgtgattcaggcccatgtgagatcctttctatgcaggtcccgcctgcaaagagacattcgtcgggaaatcgatgatttttttaaggccgacgaccccgagtcgaccaagcgcagcgctttatgcatctttaaaatcgctcgcaaattactgtttctgttccggataaaagaggataacgaacggttcgagaagctgtgtcggagtattctgtcgtccatggatgcggagaacgagcctaaggtatggtatgtgtctctggcttgcagtaaagatttgaccctgctttggattcagcagataaagaacattctgtggtattgttgcgattttttaaaacagctgaaacccgagattctgcaggatagtcgactgataaccttgtacctcacaatgctagtcacctttactgatacgtccacatggaaaattctgagaggcaagggcgagtctctcagaccggcaatgaaccacatctgcgctaacataatggggcatctgaaccagcatggcttttacagcgtgctacagatccttctgacaagaggtctggcccgccctcgcccatgcctttccaagggcaccttgactgcggccttttcactggccctccggcccgtgattgcagcacagttcagtgataatttaattagaccctttctgatacatatcatgtccgtgccagcacttgtgacccacctgagcaccgtgacacccgagcgcctgactgttctcgagtcccatgacatgctgaggaagtttatcatattcctccgggatcaggacaggtgccgcgacgtttgcgagtctctggagggttgccatacactgtgtctgatgggcaaccttctgcaccttgggtctctgagccctagggtactggaggaggaaaccgacggattcgtgagcttattgacccagaccctctgctactgtcgtaagtatgtttcgcagaagaagagtaaccttacacactggcaccctgtgctgggctggttctcccagtcagttgattatggactcaatgagtcaatgcatctcattaccaaacaacttcagttcctctggggagtgccacttatcaggatcttcttttgcgatatcctgtctaagaaactcctagagagtcaggaacctgcacatgctcagcctgcgtccccacagaacgtcctgcccgtgaagtccctcctgaagcgggccttccagaagagtgcctccgtgaggaacatactccgcccagtaggaggaaagcgagtggactctgcagaggtccagaaagtgtgtaatatttgcgtgttgtaccagactagtctgaccacattgacgcagattcggctacagatattaacaggtttgacctacctcgacgatctgctgcccaaattgtgggcatttatctgtgaacttggaccccatgggggcctgaaactattcctcgagtgtcttaataacgacaccgaagagagtaagcaactgctcgccatgttaatgctgttctgtgactgctccaggcacctaataaccatcctagatgatatcgaggtgtacgaagagcaaatcagtttcaagctggaagagctggttacgatctccagttttttaaatagctttgtctttaaaatgatttgggatggcatcgtcgagaatgctaagggcgagaccctggagctgttccagtccgttcacgggtggctcatggtgttatatgagagagattgcaggcgaagatttactcccgaagatcattggcttaggaaggacctgaaaccctcagtactctttcaggagctcgatcgcgatcggaaaagggcccagctcatcttgcaatacatcccgcacgtgattcctcataaaaacagggtcttgttgttccgcaccatggtgactaaagagaaagaaaaactgggcctggtagagacttccagcgcaagcccacacgtaacccacatcacgatcagacgttcccggatgctggaagacggttatgaacagttgcgacagctctcacagcacgccatgaaaggagtgattcgagtcaaatttgtaaacgacttgggggtggacgaagctggaatcgaccaagacggtgtttttaaggagttcctcgaggagataatcaagagggtctttgatcctgccctgaacctgttcaagactactagtggagacgaacggctttatcctagcccaacgagttacatccatgagaattacctccagttgttcgagtttgttgggaagatgttaggaaaggcagtgtacgaaggaatcgtggtggacgtgccgttcgctagtttctttctttcgcagctgcttggccaccatcacagcgtgttctactctagcgttgatgagctgcctagtctcgacagtgagttctataagaatttgacctcaattaagagatatgacggggacattactgaccttggattgaccctgtcctatgatgaagatgtgatgggtcagctggtgtgccacgaattgattccggggggaaaaaccattcccgtgacatag

SEQ ID NO: 34290 - DNA, 735 bp, Artificial Sequence
  Description of Artificial Sequence: Synthetic coding sequence
atgtttacactgagccagacgagtcgagcgtggtttattgacagggctcgacaagctagggaggagaggctggtgcaaaaggagcgggaacgtgcggcggtcgtgattcaggctcatgtacgttcttttctttgcagatcaaggctgcagcgcgatattcgcagagaaatagacgacttttttaaggccgacgacccagagtccaccaagaggagtgcactatgtatttttaagattgccaggaaactgctgttcctcttcagaattaaggaagataacgagcgcttcgagaaattatgccgctccattctatccagtatggatgccgagaacgagccaaaagtctggtatgtgtcactggcctgcagcaaagacctcacgcttttatggatccagcagatcaagaacatcctgtggtactgctgcgactttctcaagcagctcaaacccgagatcctccaagacagtcgcctgatcactttatacctgacaatgctggttaccttcactgacacatctacgtggaagatcctgcgaggcaagggcgaatccctgcggcccgcgatgaatcatatatgcgcaaatatcatggggcaccttaatcaacacggcttctatagtgtgctacagtgctgtgacggactcttcccagacttggtgtcttacgcaccacataataaccccgtgagatggtcggtgggcagatcttggtacgattggcaattgtcacgatag

SEQ ID NO: 34291 - DNA, 2946 bp, Artificial Sequence
  Description of Artificial Sequence: Synthetic coding sequence
atggccgaggggggtgcagctgatcttgacacacagaggagcgacatcgccacactcttaaagacctctctgcgcaagggggacacatggtatttggtcgactccagatggtttaagcagtggaaaaaatatgtcgggtttgactcttgggacaagtatcagatgggggatcagaacgtatacccaggacccatcgacaatagtggtcttctgaaggatggcgatgcacagagtctcaaagagcatctgattgacgagctcgactatattttgctccccaccgaggggtggaataagttggtctcctggtataccctaatggagggccaagagcctattgccaggaaggtcgtcgaacagggaatgtttgtgaagcactgcaaagtcgaagtgtatttgaccgaattgaaattgtgcgaaaatggtaatatgaacaatgttgtgactcgtaggttttctaaagctgatacaattgacaccattgaaaaggaaattaggaagattttttccatccctgatgagaaagagacccggctttggaataagtatatgtctaatacttttgagcccctcaacaaacctgatagcacaattcaggatgcaggcctctaccagggacaggtgctggtgattgagcagaaaaatgaggatggcacgtggccacggggcccttcaactccgaagtctcccggcgcttccaacttttccaccctgcccaagatttccccttcctcgctgagcaacaattataacaacatgaataataggaatgtgaaaaacagcaactattgcctaccttcatacaccgcctacaagaactacgactacagtgagccaggacgaaataacgaacagcctgggctgtgcggcttgagtaatcttggaaatacctgtttcatgaatagcgccattcagtgcctctcaaacactcccccactaacagaatacttcctgaacgacaaatatcaggaagagttgaatttcgataaccccctgggcatgcgcggagagattgccaaaagttacgctgagttaatcaagcaaatgtggagcgggaagttctcctacgtcacgcctcgtgccttcaagacccaggtgggcaggtttgccccacagtttagcggctatcagcagcaagattgtcaggagctattagcattcctccttgatgggttgcatgaggatctcaaccggatccggaaaaagccatatattcagcttaaagatgcagatggacggcccgataaggtcgttgcagaagaggcttgggagaaccacctgaaaaggaatgattccattatcgtggacatctttcatgggctgttcaaaagtacgttggtgtgccccgagtgtgcaaagattagtgtgacatttgatcccttctgctatctgacattacccctgccaatgaaaaaagagagaacattggaagtgtatttggtgagaatggacccactgaccaagccaatgcagtataaggtggtggtgccaaagatcgggaacattctggacctgtgcacagcactctctgctttatccggaattcctgccgataaaatgatagtgactgacatttacaaccatcgtttccacagaatatttgccatggacgagaatctgtcatccattatggaacgcgatgatatctacgtgtttgagatcaatatcaatcgcacagaagacaccgaacatgtgataatccctgtctgcctccgagaaaaatttcgccatagttcatacacccaccacaccgggtcctccctattcggccagccctttcttatggctgtgccaaggaataacaccgaggataagctttataatctgcttctgcttcgcatgtgccgttacgttaagatatcaacagagactgaagagacggagggatcactgcattgctgtaaagaccagaatatcaatggcaacggccctaacggcatccatgaggaaggatcgccatccgaaatggaaactgacgagccggatgatgagtcttctcaggaccaagaacttccgtccgagaatgagaactcacagtccgaagattcagttggaggggataatgacagtgagaatgggttgtgtactgaggatacatgtaaggggcagttaaccggtcataagaagaggctgtttacctttcagttcaataatctggggaataccgacatcaactatatcaaagatgatacgagacacattcgatttgacgaccgacagcttagactcgatgagcggtcattcctcgcgctggattgggacccagacctgaagaagagatatttcgatgaaaacgccgccgaagactttgagaagcatgaatccgtcgagtacaaaccacctaagaagccttttgtgaaactgaaagactgtatcgaactctttactaccaaggagaaactgggcgcagaagacccctggtattgccctaattgtaaagagcaccaacaagccactaagaagttagacttgtggtcactgcctccagtcctggtcgtgcatctgaagcgattttcctactcaaggtatatgagagataaactggacaccctggtggatttcccaattaatgatcttgatatgtcagaattcctgatcaaccctaacgccgggccatgccgctacaacttgatcgctgtcagtaaccattatggaggaatgggtggcgggcactacaccgcgtttgccaaaaacaaagacgatgggaaatggtactacttcgacgacagttctgtgtcgaccgcaagcgaggaccaaattgtgagtaaagccgcttacgtgcttttctaccagcgccaagacaccttttcaggtacagggttttttcctctggacagagaaaccaagggtgccagcgccgccacggggattcctctggagtcagacgaagatagcaatgataatgataatgatatcgaaaatgaaaactgcatgcacacaaactag

SEQ ID NO: 34292 - DNA, 2859 bp, Artificial Sequence
  Description of Artificial Sequence: Synthetic coding sequence
atggctgagggcggagctgcagacttagacacccagcgctccgacatcgccacactactgaagacatcactccggaaaggggatacatggtatttggtggattctaggtggtttaaacagtggaaaaaatacgtgggttttgattcgtgggataagtaccagatgggagaccagaacgtttatccaggtccaattgataactccggcctgcttaaggatggagatgcccagagtctaaaagagcaccttattgatgagctggactatatcctgctccccacagagggttggaacaaacttgtcagttggtacacactgatggagggccaggagccgattgctaggaaggtggttgagcagggcatgttcgtgaagcactgcaaagtggaggtgtatctcactgagcttaagctgtgcgaaaatgggaacatgaacaacgttgtgactcggcggttctccaaagccgatacaatcgatactattgagaaagaaatccggaagatcttttctatcccagatgagaaagagactaggctctggaacaagtatatgagtaatacatttgagcctctcaataaaccggatagcactatccaggatgcagggctgtaccagggacaggtgctggtcattgaacagaagaatgaagatggaacatggcctcggggcccaagtaccccaaacgtgaaaaactccaactactgtctgccatcttacacagcttataagaactatgattactccgagccgggcaggaacaatgagcaacctgggctctgcggattgtctaacctgggcaacacctgcttcatgaatagtgcaatccaatgcctatctaacacgcctccactgaccgaatattttctgaacgataaatatcaagaggaactgaacttcgacaatcctctcgggatgaggggggagattgccaaatcatatgctgaactcatcaagcaaatgtggagcggaaagttcagctacgttacaccccgcgcatttaagactcaagtcggacggttcgcccctcagttttcgggctaccaacagcaggattgtcaggagctgctggcttttctcctcgatggtctgcatgaggatcttaatcggattcgcaagaaaccctatattcagcttaaggacgcagacggccggcctgacaaggtagtagctgaagaggcctgggagaatcatctgaagagaaacgattcaatcattgtcgacatttttcacggtcttttcaaatccacgcttgtctgtcccgagtgtgccaaaatctccgtgactttcgatcctttctgctacttaaccctgccgctgcctatgaaaaaggagcgcacactggaagtgtacttagtgaggatggaccctcttacaaaacctatgcaatacaaagtggtcgtgccaaaaatcggcaacatcttggatctttgcactgccctttccgccctgtccggaatcccagccgacaaaatgatcgttacggacatatacaaccatcggttccaccgaatcttcgctatggatgaaaatttatcatcaatcatggaacgcgatgacatatacgttttcgagatcaatataaacaggacggaagacaccgagcacgttatcatccccgtttgcttacgggagaaattccggcactcctcctatacccaccataccggtagctcactattcggccaaccattccttatggctgtgccacgaaataatactgaagacaaattgtataatctgctgcttctgagaatgtgccggtacgtcaagatctccactgaaaccgaagagactgagggaagtctgcactgctgcaaggatcagaacatcaacgggaacggacctaacgggattcacgaagaggggagtccaagcgaaatggagactgacgagccagatgatgagtccagtcaggaccaggagcttccaagcgaaaatgaaaactcccaatcggaagacagcgtcgggggcgataatgactcagagaacgggctgtgtaccgaggacacttgcaagggtcagctgaccggccataagaagcggctgtttacctttcagtttaacaatctaggcaataccgacataaattacattaaagatgatactaggcacatccgatttgacgacaggcagctgcggctcgatgagcgtagttttcttgcactagactgggatcccgatcttaagaaaagatacttcgacgagaacgctgccgaggattttgagaaacacgagtccgtggaatacaaacctcctaagaagcccttcgtgaaacttaaggactgcatcgaactgtttaccacaaaggagaagctgggagccgaggacccttggtattgccctaactgcaaggagcaccaacaggccactaaaaagcttgacctgtggtcactccctccagtgctagtcgtccacctcaagcgcttttcttacagtagatatatgcgagacaaattggacaccttggtcgactttcctataaatgatctggatatgagcgagtttcttataaaccccaatgccggcccttgccggtataatctgatcgcagtcagtaatcactacggtggcatggggggcggccactatacagcgtttgcaaaaaacaaggatgacggaaaatggtattatttcgacgatagttctgtgagcaccgcaagcgaggaccagatcgtgagtaaggcagcatacgtcctgttctaccagcgccaggacaccttttcaggcacgggctttttcccgctggacagagagactaagggggcctcagccgccacagggattccgctggagtcagacgaggattctaatgataatgacaacgacatcgaaaatgagaactgtatgcacaccaattag

SEQ ID NO: 34293 - DNA, 2871 bp, Artificial Sequence
  Description of Artificial Sequence: Synthetic coding sequence
atggcagaaggaggagccgccgacctggacactcagcggagcgacatcgccaccctcctcaagaccagccttagaaagggcgatacctggtacctggtagactcacgatggtttaaacagtggaaaaagtatgtcggcttcgatagctgggacaagtatcagatgggggaccagaacgtgtatcccggacctattgacaactcaggactgcttaaggacggggacgcccagagcttgaaagagcatcttatcgacgaattagactacatccttctgccaacagagggttggaacaagctggtttcctggtacaccctcatggagggtcaagagcccattgctagaaaggtggtagaacaggggatgtttgtgaaacactgtaaagtggaggtatacctaacggaactaaagctgtgcgagaatgggaacatgaacaacgttgtcaccaggcggtttagcaaagcagataccattgatacaatagaaaaggaaataagaaaaattttttcgatccccgacgagaaagagactagactttggaacaaatatatgagcaacacgtttgaaccccttaacaagcctgactcgaccattcaagacgcaggcctgtatcagggccaggtgctgttcatcgttctcgtgattgagcagaagaatgaggatgggacttggcccagggggccctccacgcccaacgttaagaattctaactattgcctgccatcctatactgcttataagaattatgactacagtgaaccaggaaggaacaatgagcagccgggcctgtgcgggctgtcaaatcttggtaatacctgtttcatgaactccgccatccagtgtctgagcaacacccccccactcaccgaatattttttgaacgataagtaccaggaagagctcaatttcgataacccactgggaatgcgtggagaaattgctaagagctatgcagaactgatcaaacagatgtggagtggtaaattcagctacgtgacaccacgcgccttcaaaacccaggtgggacgtttcgcaccacagttttctggctaccagcaacaggactgtcaggagctcttggcgtttctgctggatgggcttcatgaagatctcaatcggatacgcaagaaaccatacatccagttgaaagacgcagatgggagacctgacaaggttgtcgcggaagaggcctgggaaaaccatctaaaaaggaacgattcgataatcgtcgatattttccatggcctgttcaagtctactttggtttgtccagaatgtgccaagatcagtgtgacatttgatcccttctgttatctcacgctgcctctgccgatgaagaaggagcggactctcgaagtttatctagtaaggatggatcccctcaccaaacctatgcagtacaaagtggtggtcccaaagataggaaatatcctagatctttgtaccgcactttcagccctcagtggcattccggctgataaaatgattgtcacggacatttacaaccatcgattccacagaatattcgctatggacgagaacctctctagtatcatggaaagagacgatatctatgtcttcgagatcaatatcaaccgcacagaggacactgagcatgtgatcattcccgtatgtctgcgcgaaaagttccggcacagtagttacacccaccacactggatcctcactgtttggccagccattcctcatggccgttccccgcaataatacagaggacaaactctataacctgctcttgcttcgaatgtgtaggtacgtgaagatctctactgagaccgaagaaacagaaggatctttgcactgctgcaaggaccagaacatcaatggcaacggcccaaacggcatacacgaagagggctcaccctccgaaatggaaacagacgagccagatgatgaaagctctcaggaccaggagttgccaagcgagaatgaaaacagccagtccgaggattctgtgggcggcgacaatgactcagaaaatggcctttgtacagaggatacgtgcaaggggcagctgaccggccataaaaaaaggctgtttaccttccaatttaataacctcggcaatacagatataaattacatcaaagacgatacccggcatattaggttcgacgaccgccagttaaggcttgatgagcggagtttcctggccctggattgggatcctgacctcaagaagcgctattttgatgaaaatgcagcagaggactttgaaaagcatgagagcgtcgagtacaagcccccgaagaagccatttgtgaagctgaaggattgcatcgagctgttcacgaccaaagagaaactgggcgccgaggatccctggtactgccctaactgcaaggagcatcagcaagctaccaaaaagctcgacctgtggagcttgccccctgtattagtggtgcatctcaaaaggttttcctattctagatacatgagagataaacttgatactctcgtcgattttcccattaacgacctggacatgtcagagtttcttatcaatcctaacgcgggcccgtgccgatataacttgattgctgtctccaatcactatggcgggatggggggcggtcattacactgccttcgccaaaaataaagatgacgggaagtggtattattttgatgattctagcgtgagtacggcaagcgaggaccagattgtgtctaaagccgcctatgtattgttctatcagaggcaggacaccttctccgggactggattctttcctctagatcgtgaaacaaaaggtgcctccgcagcaactgggatcccgctggaaagtgatgaggactcgaacgataatgataacgacattgagaacgaaaactgcatgcacaccaattag

SEQ ID NO: 34294 - DNA, 708 bp, Artificial Sequence
  Description of Artificial Sequence: Synthetic coding sequence
atggccgaaggaggcgccgccgacctggacacgcaacggtccgatatagctacactgctgaaaaccagcctcagaaagggggatacctggtacctggtcgatagtagatggttcaagcagtggaagaaatacgtggggtttgatagctgggataagtatcagatgggagatcagaatgtgtaccctggccccatcgacaattcaggcttacttaaggatggtgacgcccagtccctgaaggagcatctgatcgacgagctggattatatccttctgcccaccgagggatggaacaaactggtcagctggtacactttgatggaagggcaggaacctatcgcccgtaaggtggtagagcaggggatgtttgtgaagcattgtaaggtggaggtttacttaacagagctgaagttgtgcgagaatggaaacatgaacaacgttgtgactaggagattttccaaagccgacaccattgatactattgaaaaagaaattcgcaaaatcttcagcattcccgatgagaaagaaacccgcctttggaataagtacatgtctaatacatttgagcctctgaataaacccgattctactatccaggatgccggcctataccagggacaggtcctcgtaattgagcagaagaacgaggacgggacctggccgcgtggacctagcactcctaagaagcctctggagcaatcttgctag

SEQ ID NO: 34295 - DNA, 2769 bp, Artificial Sequence
  Description of Artificial Sequence: Synthetic coding sequence
atgatcagcctgaaggtgtgcggcttcatccagatttggagccaaaagacgggtatgaccaagctgaaggaagcgctgatcgaaaccgtccaacgccaaaaagaaataaaactggtggtgaccttcaagtctggcaagtttattcgcatttttcagctctccaacaatatcaggtctgtcgtcctgcggcactgcaagaagaggcagtctcatctgcggctgactctgaagaataacgttttcctcttcatagacaagctgtcctacagggacgctaagcagctaaatatgttcctggacatcattcaccagaacaaatcccagcagccaatgaaatctgacgatgactggtcagtctttgagtcacgcaacatgctcaaagaaatagacaagactagcttttatagtatatgtaataaaccttcttaccaaaagatgcctctgtttatgagcaagagcccgacgcatgtaaagaagggaattttagaaaatcagggcgggaagggccagaacacactgtcatcagacgtccagaccaacgaagatattctgaaagaagataaccccgtaccaaacaagaagtacaagaccgactccctcaaatatattcaaagtaatcgcaaaaatccatcgtctctggaagatctcgagaaggatagggatctgaagttaggcccatccttcaacacaaattgcaatgggaaccctaacctcgatgaaaccgtgcttgctactcagacactgaacgccaaaaatggcctgacaagccccctagaaccagagcatagccaaggggacccgcgctgcaacaaggcacaggtgccgcttgacagccactcccagcagcttcagcagggtttccctaacctggggaacacttgttatatgaacgcagtgcttcagagtctgtttgccattccttcttttgcagacgacctcctgacccagggagtcccttgggagtacatcccttttgaggcacttattatgactctaacgcagctacttgctctcaaggatttctgctccactaagataaagcgggagttgctgggcaatgtgaagaaagtgatatcagctgtggccgaaatttttagcggcaacatgcagaatgacgcacacgagtttctgggtcagtgcctggatcagcttaaggaagatatggaaaagctcaatgccacgctcaacaccggtaaagagtgtggtgacgagaatagttcaccccagatgcatgtcggatccgcggccactaaagtgtttgtctgccccgtggtagcaaattttgagttcgagcttcaacttagcctgatctgcaaggcttgcgggcacgcagtgctcaaggtggagcccaataactacctgtcaataaatcttcaccaggaaacaaagccattgccattgagtattcagaactccctggacttattctttaaagaggaggagctggaatataactgtcagatgtgtaagcaaaaatcctgcgtcgcgagacacactttttcccggctgtctagagtactgatcatccacctgaaacggtacagtttcaacaatgcttggctgcttgttaaaaataatgagcaggtttatatccccaagtctctgtccctgagctcatactgtaatgaaagcaccaagccccctctccctctcagtagtagcgccccagtcggtaagtgtgaggtgctggaggtctcacaggagatgataagtgaaatcaattccccactgacacccagcatgaagctaacttcagaatcctccgactccctggttttgccggtggagccagacaagaacgcagacctgcagcgctttcagagggactgcggcgatgcaagtcaagagcagcaccaacgcgacctggagaatggttctgccctagagagtgagcttgtccattttagggaccgggcaattggggagaaggaattacccgtggctgactctctgatggatcagggggacatcagcctgccagtgatgtatgaagacggtggtaaacttatttcatcaccagatacccgccttgtggaggtgcatctgcaggaggttccccaacacccagagctccaaaagtacgaaaaaactaacaccttcgttgaattcaactttgattccgtcaccgaaagcactaatgggttttacgactgtaaagaaaataggatccccgaaggcagtcaaggcatggctgagcagttacagcagtgcattgaggagtcaatcattgacgaattcttacagcaagcaccacctcctggagttagaaagctcgatgcccaagaacacacagaagagaccctaaaccaatccacggaactacgtctgcagaaggccgatttgaaccaccttggcgctctgggttccgacaatcctggaaacaaaaacatcttggacgcagagaacaccaggggcgaagccaaggagctgactcgcaatgtgaagatgggggaccccctgcaggcatatcgactgattagcgtggtaagccacatcggctcatcacctaattcgggccactatatctccgacgtgtacgattttcagaagcaggcgtggttcacctacaatgacctctgtgtatccgagatttctgaaactaagatgcaggaggcgaggcttcacagtgggtatatatttttctacatgcataacggcatctttgaggagctgctccggaaggcagaaaactcaaggcttccttccacccaggcgggggttatcccacaaggggaatatgaaggtgattccctgtatcggccagcctag

SEQ ID NO: 34296 - DNA, 786 bp, Artificial Sequence
  Description of Artificial Sequence: Synthetic coding sequence
atgtcaggagaaatcgccatgtgcgagccggaattcggcaatgataaagcaagagagccatctgtgggggggagatggagggtgagttggtatgaacggttcgtgcagccctgcctggttgaactgctcggcagtgccttgttcattttcatcgggtgtttatctgtcatagagaacggtaccgataccggacttttgcagccggctcttgctcacggcttggctttgggactggtcattgccacgcttggcaatatcagcggtggccacttcaatcctgcagtcagtctggccgctatgcttatcgggggtctgaatctcgtgatgctgctcccctactgggtaagtcagctgttgggcggtatgttgggggcggccctggctaaggctgtctccccggaggagcggttttggaatgccagcggtgccgcttttgtgactgtgcaggagcagggccaagttgcaggcgctttagtagctgaaatcattctcaccaccctccttgccttagccgtttgtatgggagctattaacgagaaaacaaaaggccctctcgcaccattttctattggattcgctgtgactgtggacattcttgccggaggaccggtctcgggggggtgcatgaatcctgctcgggcctttggccccgccgtggtagctaatcactggaatttccattggatctattggcttgggcctctactggccgggctactggtcgggctgctgattcggtgctttatcggcgacggaaagactaggctgattctgaaggcacgctag

SEQ ID NO: 34297 - DNA, 1332 bp, Artificial Sequence
  Description of Artificial Sequence: Synthetic coding sequence
atgtcccagcgagacggcgtatgcggttcccatgaagtggcaggagctgcctcgccaggtgccgatggtgggctgagcctggccgcatactgcaagaattctgtggatggcctatggtattgtttcgacgacagcgatgtgcagcagctgtcagaggatgaagtttgcactcagaccgcatacatcctgttttatcagagacgcacagccatccctagttggagcgcaaatagcagcgtggctggttcgacatccagctctctgtgtgaacactgggtgagccgccttcccgggtcaaagcctgccagtgtcactagcgctgcttcctctcgcagaacctccctcgcctcactgtccgagtccgtagaaatgaccggggaacgtagcgaagacgacgggggcttctctacaaggcctttcgtgcgcagcgtccagcgtcagtcgctgagctcacgatcttccgtcacttccccactggccgtgaacgagaactgcatgcgtccctcatggtctctgtcagcaaaactccagatgcggtctaactcgcctagcagattttctggcgattcaccaatccattcatcggcctccactctggaaaaaattggtgaggcggcggacgacaaggtctctatctcctgtttcggcagtctacggaacctcagcagttcctatcaggaaccttcagactctcacagccggagagagcacaaggccgtggggcgcgctccccttgccgtcatggaaggagtgtttaaagatgaatcagatacgaggagactgaactccagcgtcgtggatacccagtcaaagcattctgcccagggagatcggctcccacccttgtccggacctttcgacaacaataatcagatcgcatatgttgaccaatcagatagcgtggatagctcacccgttaaagaggttaaagctccaagccaccccggaagtttagcaaaaaaaccagagagcaccaccaagcggagcccaagctcaaagggcacatctgagccggaaaagtctcttaggaagggcagacctgctcttgcctcacaggagtcatcactttctagcacttccccttccagtccactgccagtgaaagtcagcctgaagccgtctaggagccgcagcaaggccgattcttcaagccggggcagtgggaggcactctagtccagctcccgcgcagactcaattcccctctggagaaccaggtcccagcaggggcggccagggtggcagggaggctcgggctgagttgttgcatgggcagccagcactcccccaacacaagcaccaagtctggtttgaagaaggccagcaggtatag

SEQ ID NO: 34298 - DNA, 10185 bp, Artificial Sequence
  Description of Artificial Sequence: Synthetic coding sequence
atgcgccggaagaactcctactacgtttggcaaattttccaaatccaattcccactctacactgcttacaagcataacactcacccaaccatcgaggatatatcgactcaggaaagtaatatcctcggagctttctgtgacatgaatgacgtggaggtgcctctgcacctgttaagatacgtttgcctattctgtggcaagaatggtctctccttgatgaaagattgcttcgagtacggcacacctgagaccctgccctttctcattgcccacgcatttatcacagtcgtgtcaaatatccgcatctggctgcacatcccagccgttatgcagcacattattcccttccgcacttacgtgatacgctacctgtgtaaacttagtgatcaggagctgagacaatctgcagcaaggaatatggctgacctgatgtggagtaccgtaaaggagcccttggatacgacgttgtgtttcgataaggaaagcttagatttagcctttaaatactttatgtcccccacattgactatgagacttgccggcctgagccagataacgaatcagctccacacattcaacgacgtatgcaacaatgagtccctggtgtcagatacagagaccagcattgctaaggagctagcagactggttgatctccaacaatgtggtggagcatatattcggacctaatttgcacattgagatcattaagcagtgccaggttatactgaattttttggcagccgaaggccgcctaagcactcagcacatagattgcatttgggccgcagctcagttgaagcactgttctcggtacatacacgacctcttccccagtctgattaaaaacctggaccctgtgccgttaagacacctcctgaatttagtttcggccctggaaccatccgtccatacagagcagacgctgtacctggcaagcatgctgatcaaagcgctgtggaacaacgctctggctgccaaagctcagctctccaaacagagctccttcgcatccctgctgaatacaaacatacccataggcaataagaaggaggaggaggagctacggcggactgccccatcgccatggtccccggccgcgtccccacaatctagtgacaacagcgatactcaccaatccgggggatcggacatagagatggatgaacagttgatcaaccggacgaaacacgtccaacaaaggctaagcgacacagaagaatcaatgcagggctcctccgacgagaccgctaacagtggagaagacggtagcagcggccccggaagttcctccggacattccgatgggagctccaacgaggtgaactctagccacgcgtcgcaatccgccggatcacctgggtcggaagttcagtccgaggatattgctgatattgaggcgttgaaagaggaggacgaggacgacgatcacggacacaaccctccgaagtcctcttgtggtaccgatctccgcaatcggaaactcgagtctcaggccggcatctgcctgggcgactcacagggcatgagcgagcgaaacggaacgagctctgggaccgggaaggacctcgtcttcaataccgagagcctgccatcagtagataaccgaatgcgtatgctggacgcctgttcacattccgaggaccccgaacacgatatctctggagaaatgaacgctacccatatcgcacaaggctcccaagaaagctgcatcacgagaactggcgacttcctgggagagacaataggaaacgagctgttcaattgccgacaattcatcggcccccagcatcaccaccaccatcatcaccaccaccaccaccatgacggccacatggtggatgacatgttaagcgcagacgacgtttcttgttcctctagccaggtgtctgctaagtccgaaaagaacatggccgatttcgatggtgaggagtcaggctgtgaggaggagttagtgcagataaatagccacgctgagctgacatcacatttacagcaacacctgccgaacctggcgtcaatttaccacgaacatctgtctcaggggcccgtcgtgcacaagcaccagttcaactcaaacgctgtaacagacatcaatttagacaatgtatgtaaaaagggtaacactcttctctgggacattgtgcaggacgaggacgccgtgaatctgtccgaagggctcattaatgaagccgagaagttactctgctccctggtgtgttggttcaccgaccgacagatccgcatgcgcttcatcgaaggctgtcttgaaaatctgggcaacaacagatctgtggtaattagtctaaggcttctccccaaactgtttggcaccttccagcaatttgggagctcctacgatactcattggattactatgtgggccgaaaaagaattgaacatgatgaagctcttcttcgataacctggtgtattatattcagacggtacgagaaggcagacagaaacacgctctttactcccacagcgcagaagtgcaagtgcggttacaattcctgacctgtgttttctcaacactgggcagtcctgaccattttcgtctcagtctggagcaggtggacatcttatggcactgcctggtcgaggactcagaatgctacgatgatgccctgcactggttcctgaatcaggtaaggtcaaaggaccaacatgcaatgggtatggaaacttacaaacatctgtttctggaaaagatgccacaacttaaacccgagactatttccatgaccggcctcaacttgttccaacacctgtgtaatctcgctcggctcgctacttccgcatacgatggctgctccaactctgagctgtgcggcatggaccagttctggggcattgctctgcgcgcccagagcggcgacgtaagcagggctgcaatccagtatattaattcttattatattaatggaaagactggacttgagaaggaacaggagttcatatccaaatgcatggagagcctaatgatagcctcaagcagcctcgagcaagaatctcacagctccctgatggttatcgaacgcggtctcctgatgcttaaaacacatctggaggccttcagacgccgatttgcataccatctgcgtcaatggcagattgagggcacgggtatcagctcgcacctcaaggctctttccgataagcaatctctgcctctgcgagtggtttgtcagccagcagggttacctgacaagatgactattgagatgtacccttcagaccaggtcgctgacttgcgggccgaggtgacccactggtatgaaaatctccaaaaggagcaaatcaatcagcaggctcagctccaggagttcggccagtccaatcgtaaaggagagttcccagggggcctgatggggcctgtgagaatgatttcgtcgggccatgaactgaccaccgactatgacgaaaaagctttacatgaacttgggttcaaagacatgcagatggtgtttgtctccctcggtgcgcctcggcgggaacgcaagggcgagggagtccaattgcctgcttcctgtcttccccccccccaaaaagataatatccctatgcttctcctgcttcaagagcctcatctcaccactctgtttgatctcttagagatgctcgcctcttttaagccaccgtcgggaaaggtggctgtcgatgacagcgaaagcctgcggtgtgaggaattacaccttcacgcagagaacctgtctcgccgcgtatgggagctcctgatgctgctgcccacttgtccgaacatgctaatggccttccagaacatttcagatgaacagtccaacgacggattcaattggaaggaattgctcaaaatcaaatctgcacataagctgctgtatgcgctggagataatagaagccctaggcaaacccaacaggaggattagacgcgaatccactggctcttactctgacttgtacccggattccgatgattcttcagaggatcaggtcgagaatagtaaaaacagttggtcgtgtaagttcgtcgccgcaggcggactccaacagctgctggaaatcttcaattccggaattttagagccaaaggagcaagagtcctggactgtgtggcaactggattgtctcgcatgtctgctgaagttgatttgccagttcgccgtcgaccccagcgatttggacttggcataccatgacgtcttcgcctggtccggaatcgccgaaagtcaccgaaagcgtacatggccggggaaatcgcgcaaagcggctggcgaccacgctaagggtttacacatccccaggctaacagaggtctttttggtcttggtgcagggaacctcattgattcagcggctgatgtccgtggcctatacttacgacaatctcgcccctagggtgctgaaggcccaaagtgaccacaggagtaggcatgaagtatctcactacagcatgtggcttttggtgagctgggctcactgctgtagcctggtcaaatccagtcttgcggacagtgatcacctccaggattggcttaaaaaactgacgctgctgatccccgaaacagctgtaagacatgaatcttgttcaggtttatataagctgagcctctccggcttggacggaggggacagtatcaatcggagtttcctcttgctggctgccagcacattgttaaagttcctgcccgacgctcaggcgctgaagccaatccgcattgacgactacgaggaagagccaatactgaagccaggatgtaaggaatatttctggctactgtgcaagctcgttgacaatatccatatcaaagacgctagccagacgacacttctcgatcttgatgcactggcaagacacctggcagattgtatccgctcccgagagatcctggatcatcaggatgggaatgtggaagacgacggtctaacaggtttgcttagactggcgacgagcgtggtcaaacataaacccccattcaaattcagccgcgaagggcaggagtttctgcgagacatttttaacctgctgttcctgctcccatctctgaaagatcggcagcagcccaagtgtaaaagccactcatctagagccgcagcctatgacttgctggtggagatggtgaaaggctcagtggaaaactacaggttaatccacaattgggtgatggcgcagcacatgcaaagtcacgcaccttacaaatgggactactggccacacgaggacgtgagagcagagtgtagattcgtaggattaacaaacctgggagctacctgttatctggcttcgaccatccagcagctgtacatgatccccgaagcccgacaagcggtctttacagccaagtatagcgaggatatgaaacacaagacgactcttctcgagctccagaagatgttcacctacctgatggagagcgaatgcaaggcctacaaccccagaccattttgcaaaacctacacgatggataagcagccactaaacacaggtgaacagaaggatatgaccgaattctttacggacctcatcacaaaaattgaagagatgtctccagagctcaagaatactgtgaagtccctgtttggcggggtaattactaataatgtcgttagtctggactgtgagcacgtgagccagactgcggaagagttttatacagtgagatgccaagtggctgatatgaagaatatctatgagtcccttgacgaggtgactattaaagatacccttgagggggataacatgtatacctgctcacattgtggcaagaaagttcgggctgaaaaaagagcttgctttaaaaaattgccgagaattctcagctttaacacgatgcgctacacctttaacatggtcacaatgatgaaggagaaggtgaacacccatttcagcttccccctccggttggatatgacaccttacacagaggacttcctgatgggcaaatccgagcgcaaagaaggttttaaggaggtgagtgaccatagcaaggacagcgaaagctacgagtacgatttgatcggggttaccgtgcacactgggactgctgacgggggccactattactcattcataagagatatagtaaatcctcatgcctataaaaataacaagtggtacctatttaacgacgctgaggttaaacccttcgacagcgcccaactagcctctgaatgtttcgggggcgaaatgactacaaagacttacgactcagtgaccgacaagttcatggattttagttttgagaagacccactccgcatacatgttgttctacaagcgcatggaacctgaggaagaaaacggtcgagagtacaagtttgatgtgtccagtgaacttctcgagtggatctggcacgataacatgcaattcctgcaggataaaaacatatttgaacacacatactttggctttatgtggcagttgtgttcttgtatcccatccacgttgccagaccctaaagctgtctcgcttatgactgccaagctctccacgagctttgtattggagacctttatacacagtaaggagaagccaactatgctgcagtggatagagttattaacaaagcagttcaataacagtcaggcagcctgcgagtggttcctcgataggatggctgatgatgactggtggcctatgcagatcctcatcaaatgccccaaccagatagtccgccaaatgtttcagcgcctctgtatccatgttattcagcgcctgagaccagttcacgctcacctgtatctgcagcccggtatggaggacgggagtgacgacatggacacttctgtagaagatattggaggccggtcatgtgtgacacggttcgtgcgtacattgctcttgattatggagcacggcgtgaaaccacatagcaaacacttgaccgaatacttcgcctttttgtatgagttcgccaaaatgggagaggaagagagccagttcctgctgtcgctgcaggccattagtactatggtacatttctacatgggaactaaagggccagagaatccacaggttgaggtactgagtgaggaagaaggcgaggaggaggaggaagaggaagatattttatcactagccgaagagaagtataggcccgccgcgctggaaaaaatgattgcgctggtcgccctgcttgtggagcagtcgaggagtgaacgccatctgacactttctcagaccgatatggcagcactgacaggggggaagggatttcctttcttgttccagcatatcagggacggcattaatattcggcaaacttgcaatctgattttctccctatgtcgatataacaataggctagcagaacacattgtttctatgctgtttacctccattgccaagctgaccccagaggctgctaacccattcttcaaacttcttaccatgctgatggaattcgccggagggccaccaggcatgcccccctttgcatcctatatcctgcaaagaatctgggaggttattgaatacaatccaagccagtgcctcgactggctggccgtgcagacaccccgcaacaaattagcccatagctgggttttgcagaatatggagaactgggttgaacggtttctgttggcccataactaccctcgggtccgtactagcgcagcctacttactggtatctctgataccctctaatagctttaggcagatgttccgaagcaccaggtccctgcatatccctaccagggacttgcccctgagccccgacactaccgtggttctgcaccaagtgtataatgtcctgcttggtcttctgtcacgcgccaaactgtacgtggatgctgccgtacacggcaccaccaagcttgtaccatacttctccttcatgacctattgccttatctcaaagacagaaaagctcatgtttagcacctacttcatggatttatggaatctcttccaaccaaagctgtctgaacctgctatcgctacgaatcacaacaaacaagcactgctctctttttggtataacgtgtgtgccgattgtcctgagaatatccgcctgatcgtccagaacccagtggtcaccaaaaatatcgccttcaactacattctggccgaccacgatgatcaggacgtcgtgctgtttaaccgaggaatgcttccagcatattatgggatcctccggttgtgctgtgaacagtcgcctgcattcactaggcagctcgcaagtcaccagaacatccagtgggcctttaagaatctgactccccatgcgtcacagtaccctggcgctgttgaagaactgtttaatcttatgcagctgttcatcgcacagagaccggacatgagggaagaggaattagaagatatcaagcaatttaaaaaaaccaccatctcttgctatctgagatgtctggatggacgttcttgttggaccacccttatctccgcattccgtatcctgctggaaagtgacgaagatcgtctcctagttgtgtttaaccgcggtcttattttgatgacagagtcttttaatactttgcacatgatgtatcacgaagccacggcttgccacgtaaccggtgatctggtggaactgttgagcatctttctgtcagtgctgaagtctaccagaccctatctgcagagaaaggacgtaaaacaggccctgatccagtggcaggaacgcatagaatttgcacacaagctcttaactctgcttaactcatactcccctcccgagctgaggaacgcatgcatagacgtcttgaaagaacttgtgttgctgtcaccccacgatttcctgcacacactcgtgcctttcttgcagcataatcactgtacctaccaccatagtaatatccccatgtcccttggaccctatttcccatgtcgggagaacatcaaacttatcgggggcaaaagtaatatcaggcctccgcgccctgagttgaatatgtgcctgctcccaacgatggtggagacatcgaagggcaaggacgacgtgtacgaccgtatgttgctggactactttttctcctaccaccagttcatccacctactctgcagggtggccatcaattgcgagaaatttacggagacccttgtcaaactgtctgtgctggtggcgtatgaggggctccccctccacctggccttgtttccaaagctctggacagagttgtgccaaactcagtccgcaatgagtaagaactgcataaagctactctgcgaggaccccgtgtttgcagaatacatcaagtgtattctgatggatgaaagaacctttcttaataacaatattgtgtacaccttcatgacacacttcttattgaaagtgcagtcacaggtgttcagtgaggccaattgcgcgaaccttatcagcactctcatcaccaaccttattagtcagtaccaaaaccttcagtcagatttttcgaaccgtgtggagattagcaaggccagtgctagtttgaatggcgacttaagagcacttgctctgctgttgtctgtccacacgcccaagcagttgaatcctgcgctgattccgactttgcaggaactcttatcgaaatgtcggacctgtttgcagcaacgaaactcattacaggagcaggaagccaaggaacggaagaccaaggacgacgaaggagccacaccaataaaaagacgacgtgtctcctcagatgaagagcacaccgtggatagttgtatctccgacatgaaaactgagaccagggaagtattgacccccaccagcactagtgataatgaaaccagagactcctccatcatcgatcccggtacagaacaagacctcccttcgcctgaaaattcttctgttaaggagtatagaatggaagtccctagcagctttagcgaagatatgtctaacatccggtctcagcacgcagaagagcagagtaataatggtagatacgacgattgtaaggagtttaaggatttacactgctcgaaggactccactctcgccgaggaagagtctgaattcccatccacaagtatttcggcagtgttgtctgatctcgctgatctcaggtcttgcgatggccaggcgcttccgagtcaggaccccgaggtcgctctttctcttagctgcggccattcccgagggctcttcagccatatgcaacagcatgacatactcgacacactctgtagaaccatcgaaagcactatacacgttgtgactcggatcagcggaaagggtaaccaggccgcaagttag

SEQ ID NO: 34299 - DNA, 9936 bp, Artificial Sequence
  Description of Artificial Sequence: Synthetic coding sequence
atgcgtcgaaagaacagttactacgtgtggcaaatttttcagattcagttccccctgtacacagcctataaacataacacccatcctactattgaggatatttccacgcaggaaagtaacattctcggagccttctgtgacatgaacgacgtcgaggtgcccttgcatctgttgaggtacgtctgcttgttttgcgggaaaaatggattgtccctcatgaaggattgctttgagtacgggactcctgagacactgccattcctgattgcacacgcctttataacagtcgtgagcaatattaggatttggctgcatatcccagcagtgatgcagcacattatccccttccgcacttacgtcatccgatatctatgtaaactctctgaccaggaactcaggcagtccgccgcgcggaacatggcagatctgatgtggtccacagtaaaggagcccctggatacaaccctatgctttgataaagaaagcctggaccttgccttcaaatacttcatgagccctactctgacaatgagactcgccggactgagtcagatcacaaaccagcttcatacctttaatgatgtgtgcaacaatgaatcgctggttagtgacaccgagaccagcatagccaaggagttggccgactggctgatatccaacaacgtcgtcgagcacatttttggacctaacttacacatcgagatcataaagcagtgccaggtgattctgaatttccttgcagccgaagggcggctgagtacacagcacattgattgtatctgggcggcagcgcaacttaagcactgtagtagatacattcacgacctcttccccagcctcattaagaacctagacccagtaccccttaggcacctgctcaaccttgtcagcgccttggaaccaagtgtgcataccgagcagacattgtacctggcatcaatgctcataaaggctctatggaataacgccctggccgccaaggcccagctttccaagcagtcgagcttcgcttcactgttgaataccaatatccctatcggaaataaaaaagaggaggaggaacttaggcgcaccgccccatccccgtggtcacccgccgcctctccgcagtcctccgacaactctgacactcaccagagcgggggttctgacatcgagatggacgagcagttgatcaaccgcaccaagcacgtgcagcagcggctcagtgatacagaggagtctatgcagggctcgtccgacgagacggctaatagcggcgaggatggctcatccgggccaggatcctcctctggccactccgacgggagctccaacgaggtaaattcctcccatgcctcacagagtgccggaagcccgggaagcgaggtgcagagtgaagatattgccgacatagaggcgctaaaggaggaggatgaggatgacgaccacggtcataacccccccaaatccagttgtggaacagacttgaggaaccgcaagcttgaaagtcaggccggaatctgcttgggagactcacagggcatgagtgagcgcaacggtacatcatccggcactggcaaagacctggtatttaatacagagtcgcttccaagcgtggataaccggatgcgaatgcttgacgcttgctcccactccgaggatcctgaacacgacattagcggagagatgaacgctacacacatagcccagggctcccaagaatcatgtatcactcgcactggggactttctgggcgagaccattggtaacgagctgttcaactgcaggcaattcatcgggccacagcatcaccatcaccaccatcaccaccaccaccatcatgatggccacatggtggacgatatgctcagtgcggatgacgtgtcttgcagctcaagccaggtttctgctaagagcgagaagaatatggccgatttcgacggtgaggaaagtgggtgcgaggaggaactcgtgcagatcaacagccacgccgaactaacaagtcacttacagcagcacctgccaaacttggccagcatctaccacgaacatctcagccaaggtcccgttgtccacaagcatcagtttaactcgaacgctgtgactgatattaacctggacaatgtctgcaaaaagggcaataccctcctctgggacatcgtgcaagatgaggatgcagtcaatcttagcgagggcctcatcaatgaagccgaaaagctgctgtgctctcttgtatgttggttcactgatcggcagatccgcatgcgctttatagagggctgtcttgagaatttggggaacaaccggtccgtcgttataagtcttcggctgctgcctaagctatttgggaccttccagcagtttgggtcatcctacgacacacactggattactatgtgggcagagaaggaactcaacatgatgaaactgttttttgacaatcttgtttattacattcaaaccgtgagagagggccggcagaagcatgctttgtacagtcactcagccgaggtccaggtgagactgcaattccttacatgtgtgtttagtactcttgggtcgcccgatcatttcaggttgagtttagagcaggtcgatatactgtggcactgtcttgtcgaagactccgaatgctacgacgacgcattgcactggtttctgaatcaggtcaggagtaaagaccagcacgccatgggaatggaaacctataaacacctctttctggagaaaatgcctcaactaaagccggagaccatctctatgacaggccttaatctgtttcagcacctttgtaatctggcccgcctggcaactagtgcttacgacggatgtagtaactccgagctgtgcggcatggaccagttctggggaatagcactccgggcccagtccggcgatgtgagtcgcgccgccatccagtacattaatagctattacataaatgggaaaacaggattggaaaaagagcaggaattcatttctaaatgtatggagtcattgatgatcgcatcatccagtcttgagcaggagagccattcctccctcatggtcatcgagagagggttgctcatgctgaagacacacctggaggctttccggcgccgctttgcataccacctccgacagtggcagatcgagggaaccggaatttccagccacttaaaagccctgtctgataagcagtccttacctttacgggtggtatgtcagcctgccggactgcccgacaagatgacaatcgagatgtatccatccgaccaggttgctgacttacgagccgaggtaacccactggtatgaaaacctccagaaagagcagatcaaccagcaagctcaactccaggagttcggccaatcaaaccgtaaaggagagttccccggcgggctaatgggtccggtacgtatgatctccagcggccacgaactcacaaccgattacgatgagaaagccctccacgaacttggtttcaaagacatgcagatggtcttcgtctcactgggagccccccgacgcgaacggaaaggggaaggtgtacagctacccgctagctgtctgccaccacctcagaaggacaatatccctatgctcctgctgctgcaggagcctcacctgaccactctttttgaccttctcgaaatgctggcatccttcaagcctccttcagggaaggtagccgtcgacgattcagaaagcctgaggtgtgaggagctgcatctgcacgctgagaacctgtcccgccgcgtctgggagctcttgatgctgttgcccacttgtcctaatatgctgatggccttccagaacatctctgatgagcagtcgaacgacggatttaattggaaggaattattgaaaatcaaatccgcccacaagcttctttacgcactcgagattatcgaagctttgggaaagcctaatcgtagaatcaggagagagtctacaggttcatattcggatctttatcctgattctgatgattcaagtgaggaccaggtcgagaactctaaaaacagttggtcatgcaagttcgttgcggccggagggctgcaacagctgctcgagatttttaactctggtatcttagaacccaaagagcaggagagctggacagtgtggcagctcgactgtctagcttgcctcctgaagctaatttgccagttcgccgtggatccctcggatcttgatctggcataccacgacgtgtttgcatggagcggcatcgctgaatctcacagaaaaagaacctggcctggaaagagcagaaaggcagccggcgatcatgcaaagggactccacatacccaggctcaccgaggtgttcctagtgctggtgcagggaacctcactgatccagcggcttatgtctgtggcctacacttacgacaacctggcacccagggtactaaaggcccaaagtgaccaccggtcccgacacgaagtctcccattattcgatgtggctccttgtgagttgggctcattgctgtagcctggtcaagtctagtctggctgacagcgaccacctgcaggattggctgaagaagcttaccttgttgatccccgagactgccgtgcggcatgagtcgtgctccggtctctacaagctgtccctgtctggtcttgacgggggagactcaattaatagaagctttttactactggccgcttccacactcctcaagtttctgccggacgctcaggcgctcaaacccatcagaattgacgactatgaagaagagccgatcctgaagccaggatgcaaggagtatttctggctcttgtgtaaactcgtggataacatccacattaaggatgcgtctcagacaacactcctggacctggatgccttggcaagacacctggccgattgcatcaggagcagggagatactggatcaccaagatggcaatgtggaggacgacgggctcactggcctgctgcgacttgctacttcagtggttaaacacaaacccccatttaaattctccagggaaggccaagagtttcttcgcgacatctttaacctgctgttccttctcccttccctgaaagacagacagcagcccaagtgcaagagtcattctagtcgcgcggccgcttatgacctcctcgtcgaaatggtcaaggggtcggtggagaattatcgcctaattcacaactgggtgatggcccagcacatgcagagccatgctccttataagtgggactattggcctcatgaagacgtgcgagccgaatgtagatttgtcggactcacgaatctcggtgcaacttgttacctggccagcactattcagcagctgtacatgatccccgaggcacgccaggctgtcttcacagcgaagtattcagaggacatgaaacacaaaactactttgttggaactgcagaagatgttcacctacctgatggaaagcgaatgcaaggcctacaatccgcgcccattttgcaaaacctatacaatggataaacagcccctgaatacaggggagcagaaagacatgacagaattctttactgaccttattacaaagattgaggagatgtcaccagagctgaaaaacacagtcaagtcactcttcggtggagtgattaccaataatgtagtcagtttggattgtgagcatgtaagtcagaccgccgaagagttttacaccgtcaggtgtcaggtcgctgacatgaagaacatttatgaatccctcgacgaagtgaccataaaggataccctggagggggataacatgtacacctgcagtcactgtggcaagaaagttcgcgccgagaaaagagcttgtttcaaaaaactgccacgcattctgtccttcaataccatgcggtacacattcaacatggtaacaatgatgaaggagaaggtgaatacacacttcagttttcccctgcggctcgatatgactccatacaccgaggatttcttaatggggaaatcagagcggaaggaggggtttaaagaggtttctgatcatagtaaggattccgagagttatgaatatgatctgattggggtgaccgtgcataccggtaccgccgacggcgggcactattactcctttataagagacatagtaaacccacatgcttacaaaaacaataagtggtatctctttaacgatgccgaagtcaaaccattcgattcagcacaactggcaagcgagtgctttgggggcgagatgacaacaaaaacctatgactccgtgacggataaatttatggatttctccttcgagaagacccactctgcgtatatgcttttttacaaacggatggagcccgaggaagagaatggaagggaatacaaatttgatgtttccagcgaactgcttgaatggatctggcacgacaatatgcaatttctccaagacaagaacatttttgagcatacatacttcggctttatgtggcagctctgttcctgtattccgagtaccctgccagacccgaaagctgtgtcgctcatgaccgcgaagctcagcacaagttttgtgcttgaaacctttattcactctaaggagaagccaacgatgctgcagtggattgagctgctgacaaagcagttcaacaacagccaggcagcgtgcgaatggttcttggacagaatggccgatgacgactggtggcccatgcagatcttaatcaaatgtccaaaccagattgtgagacagatgttccagcgtctttgcatccacgtcatccagcggctgagaccagtccacgcccacctgtacttacagccagggatggaagacggctctgacgatatggacacaagcgttgaggacattggaggccgttcttgcgtgaccaggttcgtccgaacactgctgctaatcatggaacacggagttaagcctcactcaaagcatctgacggagtatttcgcctttttgtatgaattcgctaagatgggcgaagaggaatcacagttcctgttgagcctgcaggccatttcaaccatggtgcatttctatatgggtactaagggacctgagaacccccaagtagaggtgctttcagaggaggaaggggaggaagaagaggaagaagaggacatcttatctctcgcagaagagaagtatcgtcccgccgctttggagaagatgatcgcccttgtggcattacttgttgagcagtcacgcagcgagcggcacttaactctcagccagacagacatggcagcacttacaggagggaagggttttcctttccttttccagcacattcgggacggcataaacatcaggcagacatgcaacctgatcttttctctatgccggtataacaaccgccttgcagagcatatcgtcagcatgctttttacgagtatcgcgaagctgactcctgaggctgcaaaccctttttttaaactgctgaccatgctgatggaatttgcaggtggaccccccggaatgccaccgtttgccagctatatcctgcagagaatttgggaagttattgaatataacccctcacaatgtctcgactggcttgccgtgcaaaccccccgcaataagctggctcatagctgggtgctgcagaatatggagaactgggtcgagcggttcttactcgctcataactacccaagagtgcgaacttcagcggcttaccttcttgtgagcctaattccctccaattcctttagacaaatgttcagaagtactagatctctgcatattcccacaagggatctgccactcagccctgacaccaccgtggtcctgcaccaggtctataatgtactgctgggcttgttgagcagagccaaactgtacgtcgacgctgccgtgcacggtaccacgaaattggtcccttatttcagtttcatgacctattgccttatctccaaaacagagaaactgatgttctctacctattttatggatctctggaacctgttccagccaaaactgagcgagcccgccattgccaccaaccacaacaagcaggctcttttgagcttttggtataatgtgtgcgcggactgccccgagaacatcaggctaattgtgcagaatcccgtcgtcaccaaaaatatcgcattcaattatatactggcggaccacgacgatcaggacgtcgtcctcttcaatcggggtatgttgccagcatattacggtatcctccgtctatgctgtgagcagagcccagctttcactagacaattagcaagccaccagaacattcagtgggccttcaaaaatttaaccccccatgcgtcccagtatcccggcgctgtggaagagctctttaacctaatgcagcttttcatcgcccagagacccgatatgcgagaagaggagctcgaagacattaagcaattcaagaaaacaactatttcatgttatctgcggtgtcaggcactaattcagtggcaggaaagaattgagtttgcccacaaacttctcaccctcctcaatagttactctccccccgaactccgcaacgcatgtatagacgttcttaaagagctcgtcctgctgtcaccccatgactttctccacaccctggtaccattcctgcaacacaaccattgcacttatcaccatagcaatattcctatgtcgttaggtccctacttcccgtgcagagaaaatattaagctgattggcggcaaatccaacatccgtcccccacgtcctgagctcaacatgtgtttgctcccaactatggtcgagacaagcaagggtaaggacgatgtgtacgacaggatgctgctggattactttttttcttatcaccaatttatccatcttctttgtagggtcgctataaactgcgaaaaattcacggaaactctcgtaaagctttctgtgctcgttgcgtacgaggggttgcctctccatctggctcttttccctaagctctggacggagctttgccagactcagtccgccatgtcaaaaaattgcattaaattgctgtgcgaagaccctgtcttcgctgaatacattaagtgcattctgatggacgagaggacgttcctgaacaacaatattgtatatacatttatgactcactttctgctgaaagtccaatcccaggtgttttctgaagcaaactgtgctaacctgattagcacgctgatcacaaatcttattagccagtaccagaatctgcagtctgacttcagtaatagagtggaaattagcaaggcttcagcgagtttgaatggggacttgagggctctagccctattactctcagtccacacccccaaacaattaaatcccgctctcatccccactctgcaggaattgctgtctaaatgcagaacttgccttcaacaaagaaatagccttcaggagcaggaagcaaaagagcgaaaaacgaaggacgacgagggggccacccctatcaaaagacgccgtgtgtcttctgacgaagaacacacggttgatagctgcattagcgacatgaaaactgagacgcgggaggtcctgacccccacaagcacttctgacaatgagacccgggactcatccatcatagacccagggactgagcaggatttgccaagcccagaaaacagcagcgtgaaggagtaccgcatggaggtgccctcctcgtttagcgaggacatgtctaacattcggtctcagcatgcggaggaacagtctaacaatggacgttacgatgactgcaaggaattcaaggatctccactgctctaaggatagtaccctggccgaggaagaaagcgagtttcccagcaccagcatcagtgcagtcctcagcgacctcgcggatctgaggtcttgtgacggtcaggcgctcccatcccaggatcccgaagtcgctctgagcctctcctgcgggcattctcgtggcctctttagtcacatgcaacagcatgatatccttgataccctctgtcgaaccatcgagtctactatacacgtggtgacccggatatctggcaaagggaaccaggccgccagttag

SEQ ID NO: 34300 - DNA, 10641 bp, Artificial Sequence
  Description of Artificial Sequence: Synthetic coding sequence
atgtgtgaaaactgcgctgatctggttgaggtgctcaacgagatttccgatgtagaaggaggtgacggattgcagctgaggaaggaacacacactgaagattttcacctacattaattcatggacacagcggcagtgcctgtgttgtttcaaagaatataagcacctggaaattttcaatcaagttgtttgtgcattaatcaaccttgttattgcgcaggtgcaggtcctgcgggatcagctgtgtaagcattgtacaactatcaacatcgactcaacttggcaggacgagtccaatcaggcggaagagcctctgaacattgacagagagtgtaatgaggggagtactgagagacaaaagtcaattgagaaaaagagcaacagtacccgaatctgtaacctgactgaagaagagagctcaaagtctagtgatcccttctccttgtggagtactgatgaaaaggaaaaactcctgctgtgcgtggccaaaatttttcagatccagttcccactgtatacggcctacaagcacaacacccatcctacaatcgaggacatttctacccaagaatccaacattctcggcgctttttgtgatatgaacgatgtagaagttcctctgcacctgctgcggtatgtctgtctcttttgcggcaaaaacggcctctctctgatgaaagattgtttcgaatatggtacaccggaaactctgccctttctgattgcgcacgcttttataacagtggtctccaatattcgaatatggctccacatacctgccgtcatgcagcacattatcccgttccgcacttatgtgatacggtacctttgtaagttgagtgaccaagagctgcgacagtcagccgcgagaaacatggccgacctcatgtggagcacagttaaagaacctctagataccactttgtgctttgataaagagtctctcgacttagctttcaaatactttatgagcccaacactcaccatgcgtttggccgggctttcacaaatcacaaaccagcttcacacttttaatgatgtctgcaataacgaatctctagtgtccgacacagaaacatccatcgccaaggaacttgccgactggcttatcagcaataatgtagtcgaacatatattcggacccaatcttcatattgaaatcattaaacaatgccaggtgatactgaattttctggccgccgaaggcagactgagcactcagcatatcgactgtatttgggcggccgcccagttgaagcattgttctcgatacatccacgatctgtttcccagcttaattaagaatctcgatcccgtgccgctgcggcacctgctgaatctcgtcagtgctttagaaccaagcgtacataccgagcagacactgtatctggctagtatgttaatcaaagctctgtggaacaatgccttagccgccaaggcacagctcagcaaacagagttcattcgcatcccttctcaacacaaacattcctatcgggaacaaaaaggaggaggaagaactgcgtcgaacagccccttccccatggagcccagctgcctctcctcagtcttctgataatagtgatacacaccaaagcggaggaagtgacatagagatggacgaacagctgatcaacagaactaagcacgtacagcaacgcctctctgatactgaggaatcaatgcagggatcgtccgacgaaaccgccaattctggggaagacgggtccagcggtcctggctcctcgtccggacattcagacgggtcatctaatgaagtgaactcatcacatgcttcccagagcgccgggtcgccggggagtgaagtgcagtccgaggacattgcggacatcgaggcactgaaggaagaggacgaggacgatgaccacgggcataacccccctaagtccagttgtggcactgacctgagaaacaggaagctggagtcgcaagccggaatttgcctgggcgattcccaaggtatgagcgaaaggaatggcacgtcttccggcactgggaaggatctggtgtttaataccgagtccctgccaagcgttgacaatcgcatgaggatgctggatgcctgctcccacagcgaggacccagagcatgatatctctggtgagatgaacgcaacccacatcgcccagggtagccaggagagttgtatcactcgcacgggtgacttcctgggcgagacaattgggaatgagttattcaactgtagacaattcattgggccccaacaccatcaccatcatcatcaccatcatcaccaccatgacggacacatggttgatgatatgctttctgccgacgacgtttcatgcagtagctcgcaggtgtctgccaaaagcgagaaaaatatggcagacttcgacggagaggagtctggttgcgaagaggaactggtccagatcaacagccacgcagagctcacctcccatcttcagcagcacctacccaacctcgcgagtatctaccatgagcacctgagccagggacccgtggtccacaaacatcagtttaatagcaacgcagtgaccgatatcaatcttgataatgtgtgcaagaaaggaaacacgctcctgtgggacatagtgcaggatgaagatgctgtcaacctcagtgaaggtctaataaatgaagctgagaagctgttgtgcagtctggtctgctggtttactgatcgccaaatacgcatgcgcttcatagaggggtgtctagaaaatctgggcaacaaccgctctgtggtgatctctctgaggctcctgccgaagctattcgggacattccagcaattcgggagcagctatgacacgcattggataactatgtgggctgagaaggagcttaacatgatgaaactattctttgataacttggtgtactacatccagacagtgcgggagggacggcagaaacacgccttgtatagccactccgccgaggtgcaagtgcgtctccagtttcttacatgtgttttctccactctgggaagccctgaccatttcaggctgtcactggagcaggtggacattctgtggcattgcttagtggaagacagcgagtgctacgatgacgccctgcactggttcctgaaccaggtcaggagcaaagatcagcacgcgatgggcatggagacatataaacatcttttcctggagaaaatgccgcaactcaagcctgaaaccattagtatgacgggcctaaatctcttccagcatctttgtaatctggccagactggccactagtgcctacgacggttgcagtaatagtgagctgtgtggcatggaccagttttgggggattgcactgcgggcccagtccggcgacgtatctcgcgccgccattcagtatatcaactcttattacattaatgggaagacggggctggagaaggagcaggagtttatctcgaagtgcatggagtccctgatgattgcctctagttctctggaacaagaatcccacagttctcttatggtgattgagaggggcctactcatgctcaaaactcacttggaagcttttcgccgcaggttcgcttatcatcttaggcagtggcagattgagggtacagggatctcctcccatctcaaggccttaagtgataaacagagcctacctctgcgcgtagtctgccagcccgccggtctgccggacaagatgaccatcgagatgtacccatcagatcaggttgcagacctgagagcagaggtgacacattggtacgaaaatctacagaaggaacaaatcaatcagcaggctcagttgcaggagttcggtcaaagtaaccggaaaggggagttccctggcgggctgatgggacccgtgaggatgattagtagcggccacgaattaacaacagactatgatgagaaagccttacacgagctgggcttcaaagacatgcaaatggtattcgttagtcttggggccccacgccgggagagaaaaggcgaaggcgtgcagctccctgcctcctgcctgcctcccccccagaaagataatattcccatgctcctgcttctgcaagagccacatctgaccaccttgttcgatctgctcgagatgctggccagcttcaagcctcctagcggaaaggtcgcagtggatgatagtgagagtctgcgatgcgaggaactacacctgcacgcagagaatctctctagacgggtctgggagcttctcatgctgctgcctacatgtcctaatatgctgatggctttccagaacatttccgacgaacagagtaatgacgggttcaattggaaagaactgcttaaaattaaatccgcgcataaattgctgtatgccctcgagattatagaggctcttggaaagcctaacagacgcatccgcagagagagcactgggtcttatagtgacttatatccagattctgatgattcatctgaagaccaggtcgaaaacagcaagaactcttggagctgcaagtttgtggctgcgggagggctccaacagctccttgagatcttcaacagtggcatccttgagcctaaggagcaggagagttggacagtttggcagctcgactgcctggcctgtctgctcaaattaatttgccagtttgcagtggacccctctgatctggatctcgcttatcacgatgtgtttgcgtggagcggcatcgcagagtcgcatcgaaaaagaacatggccaggcaaaagccggaaggcggccggcgaccatgccaaaggcctgcacatcccgagattgactgaagtgttcctcgtgttggtgcagggaacttcgcttattcagcgcctgatgtccgtggcctacacatacgacaatcttgcccccagggttctcaaggctcagtccgaccacagatctagacatgaggtatcccactactctatgtggctcctggtgagctgggctcattgctgtagtttggttaaatcttccctggccgactccgatcatttgcaggattggctgaaaaagctgacactgctcatacccgagactgcagtgagacatgagtcatgtagcgggctgtacaaactatcactctccggccttgatggcggggacagtattaaccgttcctttctgctgctggctgctagcaccctcctgaagttccttcccgatgcacaggcactcaaacccattcggatagatgactacgaggaggagccaatacttaaacccggatgcaaggaatatttttggctgctgtgcaagttggtggataacatacacatcaaagacgccagtcagacaaccctgctcgatctggacgcactagcccggcacctcgccgactgtattaggtcaagggagattctggatcatcaggatggtaacgtagaagacgatgggctcacaggcctgttacggctcgcaacttccgtggtcaagcacaagccccctttcaagtttagcagagaggggcaagagttcttaagagacatatttaacttgctgtttctgttaccctcactgaaggatcggcagcagcccaagtgtaaatctcatagcagtcgggcagcggcgtacgaccttctcgtggaaatggttaagggttccgtggagaactaccggctgatccacaattgggttatggcacagcacatgcaatcccatgcaccgtacaagtgggattactggcctcacgaagacgtgcgggctgagtgtcggtttgtaggactgaccaatctgggcgccacgtgttaccttgcatccactattcagcagctatacatgattccggaagcaaggcaggcagtgttcaccgctaaatacagtgaagacatgaaacataagactaccctgttagaactccagaagatgttcacatatctaatggaaagcgaatgcaaagcctacaaccctagacccttctgcaagacctacactatggacaaacaacccttgaacaccggcgagcagaaggatatgacagagttcttcactgacctgatcaccaaaattgaagaaatgtctcccgagctgaaaaatacggtgaaatcactgttcgggggtgtgataacaaacaatgtggtgtccttagattgtgaacacgtcagccaaacagcagaagaattctacaccgtaagatgccaggtggcggacatgaagaatatttacgaatccctcgatgaggtcactatcaaggacacactggagggggataacatgtacacttgcagccactgcgggaaaaaggtgagagccgagaaacgggcctgcttcaagaaattgcctcgaattttatcattcaataccatgaggtacacattcaatatggtgacaatgatgaaggagaaggtgaatacacacttcagttttcctttacggctggacatgacaccatacactgaggactttctgatgggcaaaagcgagcgtaaggagggatttaaagaagtctcagatcacagcaaggactcggaatcctacgagtatgaccttatcggtgtgaccgtgcacaccggcacagcagacggtggtcactactattccttcatccgggacatcgtgaacccacacgcctataaaaacaacaaatggtatttatttaatgatgcggaagtcaagcctttcgactcagctcagctcgcatccgaatgctttggaggagaaatgactaccaaaacctacgactcggtgacagacaagttcatggacttcagttttgagaaaacacattccgcctacatgttattctacaagcgaatggagccagaggaagaaaacggccgggaatacaaattcgacgtttcttcggagctgttagagtggatctggcacgacaatatgcaattcctccaggacaagaacatctttgagcacacatacttcggcttcatgtggcaactgtgctcttgcatcccgtctaccttacctgaccctaaggctgtttctctaatgaccgcaaagctgagcacgtcatttgtgctggagacatttatccattctaaggagaaacccactatgctccagtggatcgaattactgacaaaacaatttaataactcacaggccgcgtgcgagtggttcctggataggatggcagatgacgactggtggcccatgcagatcctcattaaatgccctaatcagatcgtgaggcagatgtttcaaagactgtgcatacacgtaatccagaggcttaggccagtacatgctcatctctacctccaacccggtatggaagacggaagtgacgatatggacacttcagtggaagatattggcgggcggagctgcgtcacccgctttgtgcgtactctgctcttaatcatggaacacggagtgaagccgcactcaaaacaccttactgagtatttcgcctttttgtacgagtttgccaagatgggcgaggaagagtctcaattccttttaagtttgcaggccatttctactatggtccatttctatatgggcacgaaggggcccgagaatccacaggtggaagtgctgtcggaggaagagggtgaggaggaggaggaggaagaggacatcctctcattagcggaggagaagtaccggcccgccgctctggaaaaaatgattgccctcgtcgcccttctggtagagcagagcaggagcgagaggcacttgaccttgtcccagacagatatggctgctctaacagggggtaaggggtttcccttcctgtttcagcatatacgggacggtatcaatatcagacagacctgcaatctgattttttccctgtgtcggtataacaacagactcgcagaacacatcgtgagcatgctttttactagcattgcgaagctaactcctgaggccgctaatcctttctttaagcttttaactatgctcatggaatttgcaggaggcccccccggaatgcctccatttgcctcttatatcctgcagcgcatctgggaggtgattgaatataatccctcccaatgcctggactggctcgctgtgcagacccctcggaataaactggcacactcatgggttcttcagaacatggagaattgggtggaacgatttcttctggcccataactatccccgggtgcggacttcagctgcatatttactcgtcagtctgatcccatcaaactcatttaggcagatgttccggtccacacggtccttgcatataccgactcgtgacctccctctctctccagacacgacggttgtcttacatcaggtgtacaatgtcctgctgggcctgctgagtcgcgcaaagttgtacgtggatgctgctgtccacgggacaaccaaattggtaccgtacttctcctttatgacctactgtctcattagcaagactgaaaaactcatgttctctacatattttatggatctttggaacctcttccagcccaagttgtcagagcccgcaattgcaacaaaccataataagcaggccttgcttagtttctggtataacgtgtgcgctgactgccccgagaatatacgcctgatcgtacagaacccagttgtgactaaaaatatcgcatttaattacattttggcagaccatgatgatcaagatgtagtcttatttaaccgaggaatgctccccgcctactatgggatccttaggctctgctgcgagcagtctccagcgttcacgcgccagctagcctcccaccagaacattcaatgggcattcaaaaatttaactccccatgctagccagtatccaggagctgtagaagagctattcaatctgatgcagttgttcatcgctcagagaccagacatgcgcgaggaggaactcgaagatatcaagcagttcaaaaagaccacaattagttgttacttgcgatgtctagatggtcgctcctgctggaccaccttaatttccgcatttagaatcctgttggaaagcgacgaggacaggcttctcgtggtgttcaatcgaggattgattctgatgacggagtcgttcaacacattacacatgatgtatcacgaggccactgcatgtcacgtgacaggggatctggtcgagctcctgagtattttcctgtccgtgctgaaatcaacccgcccttacttgcagaggaaagatgtaaagcaggcgctgattcaatggcaagaaaggatcgagttcgctcacaaactcctgactctgttaaattcctattcacccccggaactgagaaacgcttgcatcgacgtgttgaaagaactagtattgctgtccccccacgatttccttcacaccctagtgccattcttgcagcacaaccactgtacataccatcactctaacatccccatgagcttgggaccctacttcccctgccgggagaatatcaaactgattgggggcaaatcaaacatcaggccaccgcggcctgaactgaatatgtgtcttctgccaaccatggtggagactagcaaaggtaaagacgatgtttacgacaggatgttgctcgactacttcttttcttaccaccaatttatccacctgctatgccgggtggcaattaattgcgaaaaattcacagaaacccttgtgaagctctctgttcttgtggcctacgagggtctgccgttacatctggcactctttcctaagctctggactgagctctgccagactcagagcgctatgagtaagaattgtatcaaactgctctgtgaggaccccgtgttcgcagaatacatcaagtgcatactaatggatgaaagaacctttcttaataacaatatcgtgtacaccttcatgactcatttcctgctgaaagtgcagagccaagtcttctctgaggctaattgtgccaatctcataagcactctgataactaacttgatttcacaataccagaacttgcagagtgatttctccaacagggtcgagattagtaaggcaagtgcctcactaaacggcgacctgcgcgccctggccctgcttctttctgtgcataccccaaagcaattaaatccggcactgatccctaccctgcaggagttgttgtcaaagtgccgcacctgtctacagcaacgtaattcactgcaggagcaggaggcaaaagagcgaaaaactaaggacgatgagggagctacccccattaagagaaggcgagtgagtagtgatgaggaacacactgttgatagttgcatcagcgatatgaagacagaaacccgtgaggttttaacgcctactagcacatctgacaatgaaacaagggactcctccattattgacccaggcacagaacaggacctccccagtcctgagaattcatccgtcaaagaataccgcatggaggtccctagcagcttttctgaagatatgtctaacattagatcacaacacgcggaggagcaaagtaacaatggccggtacgacgactgtaaagaatttaaggaccttcattgttcgaaggactccaccctggccgaggaggagagtgagttcccctccacctcaatttcagcggtactcagcgacctcgccgatctgcggagttgcgatgggcaggccctccccagtcaggaccccgaggtcgctctgtctctctcttgtggccatagcagagggctgttctcacacatgcagcagcatgacatcctcgacaccctctgtaggacgatagagtcgaccattcatgtggtcacccgcatttcaggaaaggggaaccaggctgcgagctag

SEQ ID NO: 34301 - DNA, 1815 bp, Artificial Sequence
  Description of Artificial Sequence: Synthetic coding sequence
atgcctggtctcaggcgccgtgcctcttggcgtgtttctattccaggtagctggcccagtcagacacgggcccgattagtgtcttcgacctgggcaacccacgctatgagtaccgcttcctttcgtccttacagctggaggctgtcaagttttcgccactgtgtgctgcgactgactgagaataattcacaacctctgatgactaaactacagtggttgtttggattcctcgaacactcccagcggcccgcgatctccccggagaacttcctgtccgcctcttggaccccatggttctcccccggcactcagcaggactgttccgagtacttgaagtacctgctggacagactgcatgaagaggagaagacaggtaccagaatctgccagaagcttaagcagtcctcgtcaccaagccctcctgaggagcctccggccccgtcttcgacttccgtggaaaagatgtttggtggtaaaattgtgacaaggatttgttgtctttgttgcctgaatgtctcatctagagaggaagcgttcaccgatctttcactcgccttcccgccaccggagcgctgtagacgacgccgactgggctcagtgatgagacccaccgaagacatcaccgcgagggagctgcctccacccacatccgcccaggggccaggacgagttggaccccgcaggcagcgcaagcactgtattacagaagatacaccccctacaagcctctacatcgagggactagactcaaaggaagcaggggggcagtctagccaggaagagagaatcgagcgtgaggaagagggtaaggaagagcggacagagaaggaggaggttggcgaggaggaagagtctacaagaggtgaaggggagcgcgaaaaggaagaggaagttgaggaagaggaggagaaggtcgagaaagagaccgagaaagaggcggaacaagagaaagaagaagacagcctaggcgctggaactcaccctgacgctgccatcccgtctggcgaacggacttgcgggtctgagggcagccggtcagtcctcgacctggtaaattacttcctgagtcccgaaaagttaaccgctgagaataggtattactgtgagagttgtgcatcactacaagatgcagagaaggttgtggagctctcacagggcccctgctaccttatactaacattgctgagattttcttttgatctgagaaccatgaggaggaggaaaattctggatgacgtctcaatccccctcctgctccgattacccctcgcaggagggcgtggacaagcctacgatctgtgcagtgtggtcgtacactccggtgtgtcctcggagtccggtcattattattgttacgcccgcgagggtgctgcccgaccggctgcgtcccttggaaccgccgatagaccagaacccgaaaaccagtggtacctctttaacgatacacgggtgagcttcagtagctttgagtctgtatccaatgtcacgtccttcttccctaaagacaccgcctatgtcctgttttaccgacagcgtcctagggagggccctgaggccgaacttggcagcagtcgggtgcgcaccgagccaacactgcacaaagatctcatggaagccataagcaaagacaacatcttatatctgcaggaacaggaaaaggaagctcgaagcagggctgcctacattagcgctctgcctacctctccccattggggaaggggatttgatgaggataaggatgaggacgagggctcacccggcggttgcaatcctgccggagggaatggaggtgacttccatcgtctggtcttctag

SEQ ID NO: 34302 - DNA, 3057 bp, Artificial Sequence
  Description of Artificial Sequence: Synthetic coding sequence
atggacaaaatactcgaagctgtcgtgacctccagctatccggtgagcgtgaagcaagggctcgtgcggcgcgtactggaagccgcaaggcagccccttgagagagagcaatgcctcgcgttgttggctttgggcgctcgcctgtacgtgggaggagctgaagaattgccacgacgagttgggtgccagctactccatgttgctggccgccatcaccccgacgtattcgcagagttcttttccgctcgtcgggtcctacgcctgttgcaagggggggcaggtccacccggcccccgggccttggcatgcgtgcaattgggcttacagctcctcccggaaggtcctgccgcagatgaggttttcgccctccttcgtcgcgaggtgctccgcacagtctgtgaacgcccaggacccgcagcctgcgctcaagtagctcgcctacttgctagacatccaaggtgcgtgcccgacggtccgcatcgactgttattttgccagcagcttgtcagatgcttggggcgcttcaggtgccccgccgagggggaagagggagccgtagaatttcttgaacaagcccaacaggtgagtggactgctggcacagctttggagggcccagccagctgcgattctgccttgcttgaaggagttgttcgctgtcatttcctgcgctgaagaggagccgcccagcagtgccttggccagcgtcgtgcagcacctccccctagaattaatggacggcgtagtacgcaatctgtccaatgacgatagcgtgaccgattctcagatgctgactgccattagtaggatgattgactgggtctcatggcccctgggaaaaaatatcgataaatggatcattgctttgcttaagggactcgcagccgttaagaaattctcaattttaatcgaggtgagcctgactaaaattgaaaaggtattctcaaagttgctctatccgattgtgcggggtgccgctctgtcagtactcaagtatatgttgctgactttccaacacagccacgaggcatttcatttgctcttgccgcacattccccccatggtggcgtcgctcgtgaaggaggattccaatagtggaacgtcctgcctggagcagttagctgagctcgtgcattgtatggtgttcaggtttcccgggttccccgacctttatgaacccgttatggaggctattaaagatctacacgtgcccaatgaagaccggatcaagcagctgcttggacaggatgcctggacttcacaaaagtccgaactggctgggttctacccaaggttgatggccaaatctgacacaggtaagattggactcatcaatttgggaaatacctgctatgtcaactcgatacttcaggcgcttttcatggctagcgattttcgtcactgcgtactgaggctgacagaaaacaattctcaacctttaatgactaaacttcagtggttgtttggattcctcgaacactctcaacgcccggccatctctccagaaaacttcctgtcagcatcctggacgccatggttttctcctggaacacagcaggactgcagcgaataccttaaatatcttttagacagactacacgaagaggaaaagaccggcacccgcatatgccagaagctcaaacaatccagttctccaagccctcctgaggagcctccagccccgtcctcaacttccgtggaaaaaatgtttggaggaaagattgtgacccggatttgttgcttgtgctgcctgaacgtttcctcccgtgaagaagcctttaccgatttatctctggcgtttcccccacccgagagatgtcggcgacgacgcctagggagtgttatgcgcccaaccgaggatatcacagcacgggaactgccgccccccacaagcgcacaaggtcctggcagggtgggtccacgccgtcagagaaaacattgcatcactgaggacacccctcccacctcattgtatattgagggcctggatagcaaagaggcgggtggccaaagttctcaagaggagcgtatcgaacgagaggaagaggggaaggaggagcggaccgagaaggaggaggtgggagaggaggaggaatctactcgcggggagggtgaaagggagaaggaagaagaagttgaggaggaagaagagaaagtcgagaaggagaccgaaaaggaggcggagcaggagaaggaagaagattccttgggtgcaggaacacatccggacgccgccattccgtcaggcgagaggacatgtggctcagaaggcagtcgttccgttctcgacctggttaattacttcctgtctccagagaaactcactgccgagaaccggtattactgcgagtcatgcgcgtcacttcaggatgctgagaaagtggtagagttatcccaggggccatgttacctaatattaaccctgctccggttttcctttgacctgaggaccatgcggagacggaagattctggacgatgtttccatcccactgctgcttcgcctccctctggctggcggcaggggacaggcatacgacctgtgctctgtcgttgttcactcaggggtgagctccgagagtggacactattactgttacgctagagaaggagccgcccgccccgctgcatcgcttggcaccgccgatcggccggagccagaaaaccagtggtacctgtttaacgacacccgggtctcattcagctccttcgagtcagtgtctaacgtcactagctttttcccgaaggatacggcctatgtgctgttctacagacagcgaccaagagaagggccagaagccgagctgggatcatcccgggtgaggactgagcccaccctccacaaagatctgatggaggccattagcaaggacaacatactgtaccttcaggagcaggagaaagaggctcggagccgggcagcctacatatccgccctacccacttcacctcattgggggcggggattcgatgaggacaaggacgaggacgaaggctctcctggcggctgcaatccagccgggggcaatgggggcgatttccaccgcctcgtcttctag

SEQ ID NO: 34303 - DNA, 3129 bp, Artificial Sequence
  Description of Artificial Sequence: Synthetic coding sequence
atggacaagatcttggagggattggtgagctccagtcaccccctaccactgaagagagtaatcgtgagaaaagtggtggaatctgcagagcactggttagacgaagctcagtgtgaggccatgttcgacttaacaacccgcctcattcttgaggggcaagaccccttccaacggcaggtggggcaccaggttctggaagcatacgcccgctaccaccgcccagaatttgagtcgttcttcaacaagaccttcgtcttgggcctgctgcaccagggttaccacagccttgataggaaagacgtggctattcttgattatattcataacggcctcaagctgattatgtcatgtccatctgtgttggatctgttttccctgctccaggtcgaagtacttcggatggtttgtgagcgaccagaaccccagctgtgcgcccgcttaagcgacctactgacagactttgttcaatgcatccctaagggcaaactctcaatcacattctgtcagcagttggtgcgtacaatcgggcatttccagtgcgtcagcactcaggagcgcgagctgcgcgaatatgtgtctcaggtcaccaaggtgtctaacttactgcaaaatatttggaaagccgagcccgccaccctgttgccttcactgcaggaagttttcgccagcatttcctccacggacgccagcttcgagccctctgtggcactcgcctcactggtgcaacacatacctcttcagatgattactgtgctgatccgcagtctaaccactgacccgaatgtgaaggacgcctctatgactcaagcactgtgcaggatgatcgactggctgtcatggcctctggctcaacacgttgacacgtgggtgatcgctctgctcaaaggtttggctgccgtccagaaattcaccatcctgattgatgtgaccctcctcaagatagaacttgtgttcaatcggctttggttccccctagtgaggcctggggccctggccgtactttctcatatgcttctctcattccagcacagtccagaagcctttcacttgattgtgcctcacgttgtgaacctggttcatagtttcaagaatgacgggttgcccagctctaccgcttttttagtgcagctgaccgagctgatccactgtatgatgtaccactatagcggattccccgacctttacgaacctattctcgaggctatcaaagactttcctaagccgtcagaagaaaagatcaaattgattctaaaccagtctgcatggacgtctcaaagcaactctctggcctcttgcctgtcccgcttgtccggaaaatctgaaacgggcaagacaggactcataaacctcggtaacacttgttacatgaattccgtcatccaagcattgttcatggcaacggactttagacgccaggtgctctcacttaatttaaacggctgcaattctctgatgaagaaactgcagcacctgttcgcgtttctcgcccacactcagagagaagcgtatgctcccagaattttctttgaagcctcacgcccaccttggtttaccccgcgaagtcagcaggactgctcggaataccttcgatttctccttgatagacttcacgaggaagaaaagatcttaaaggtacaggcatcccataagccatctgaaatcctggagtgttcagagactagtttacaagaggtcgcctctaaggcagcggttctgaccgagacacctcgcacttccgatggcgagaagaccttaatagaaaagatgtttggaggcaaactcagaacccatataaggtgtctgaactgcagaagcacaagccaaaaggtggaggctttcacagacctgtcacttgccttctgcccatctagcagccttgaaaatatgtcagtacaagacccagcttcatctccaagtatccaagacggaggtctgatgcaagcatctgtgccagggccatctgaagaaccggtggtttataaccctactactgcagcttttatttgcgattctctcgtgaatgaaaagactatcggtagcccccccaatgagttttactgttctgaaaatacatccgtccccaacgaatcgaataaaattctcgtgaacaaagatgtaccgcagaaaccgggcggcgagactactccatcagttaccgatcttctcaattatttccttgccccagaaattctgactggcgacaaccagtattattgtgagaactgtgcaagcctgcaaaatgcagagaagacgatgcagattaccgaggagcccgaatacctgattctgactctgttgcggttctcatatgatcagaagtatcatgttaggagaaaaatattagataatgtgtccctaccactggtgttggagcttcccgtgaaaaggatcacatccttcagttccctcagcgagtcctggtctgtggacgtggattttaccgacctttctgagaacttggcaaagaagctcaaaccttctggtaccgatgaggcaagctgcacgaagctggtgccttacctgctgtcctccgttgtggtccactccggtatctcttcagaaagcggtcattactacagctatgctcgtaacattacctcaactgattcatcctaccagatgtaccatcagtcagaggccctggccctagccagcagccagagccacctgcttggtagggatagcccttccgctgtgtttgaacaggatctcgagaacaaagagatgagtaaggaatggttcctttttaacgatagtcgggtaacgtttacctcatttcagtccgtacagaagattacatcccgattccccaaggatactgcctacgtacttctatacaagaaacagcacagcactaacgggctctctggcaacaacccgacatccggcttgtggattaacggagacccccctctgcagaaggagctcatggatgccataacgaaggataacaagctttatcttcaggaacaggaattgaacgcaagagctcgtgccttacaagccgcatctgccagctgcagtttccggcctaatggcttcgatgataacgacccaccaggttcttgtggaccaactggcggtgggggcggcgggggtttcaacaccgtgggccgccttgtgttttag

SEQ ID NO: 34304 - DNA, 3708 bp, Artificial Sequence
  Description of Artificial Sequence: Synthetic coding sequence
atgtttggcgacctgtttgaagaagagtattccactgtgagcaacaatcagtacggcaagggaaaaaaactgaagacaaaagcgctagagcctcccgcacctagagagtttacaaatctatctggcatacgaaaccagggaggcacctgttatctcaattccctgctgcagacactgcacttcacccctgaatttcgcgaggcactgtttagcctcggccctgaggaactgggactgttcgaagataaggacaagcccgatgctaaggttaggatcattcccctccagctgcagaggctgttcgcccagctgttgctgcttgaccaggaggccgcctcaaccgcagacctgaccgacagcttcgggtggacttccaacgaagagatgcgtcagcacgatgtgcaggaactgaacaggattctgttcagtgcgctcgaaacatctctggtagggacttcaggtcacgacctgatttaccggttgtaccacgggacaatagtgaaccaaattgtttgcaaggagtgcaagaacgtttcggaacggcaggaggattttctggacctgactgtagccgtcaagaatgtgtctggactcgaagacgcactgtggaatatgtatgtggaggaggaggtctttgattgtgacaatctgtaccactgtgggacatgcgataggctggttaaagccgccaaaagtgcaaaactgcggaagctgccccctttcttaacagtgagcctgctgaggtttaacttcgacttcgtcaagtgcgagaggtacaaagaaactagttgttatacttttccccttaggattaacctgaagcccttctgtgagcagtctgagttggacgacctggaatatatttatgatctgttcagtgtcatcatccacaaaggcggctgctatggtggccactaccacgtttacataaaagatgttgaccacttgggaaactggcagttccaggaggaaaagtccaaaccggacgtgaatctaaaggacttgcagtctgaggaggagattgaccatcctttaatgatcctgaaggcaatactgcttgaggaaaataacttaattcccgttgaccaattgggacaaaagctgctcaaaaagatcggcatttcctggaacaagaaatatcgtaaacagcacggtcctctgcgcaagttcctgcagctgcattctcagatcttcctcttgtcaagtgatgagtctaccgtgcggctgcttaaaaatagtagtctgcaggccgagtctgacttccagcggaacgaccaacagatcttcaagatgctgccccctgagtctcctggcttgaataacagcatcagctgcccccactggttcgacattaatgactccaaggtgcaaccgattagggagaaagacattgagcagcagtttcagggcaaggaaagcgcatatatgctgttctatcgaaagagtcagcttcagcggccccccgaggcaagggccaatcccagatacggcgtgccctgtcacctgctcaacgagatggacgccgccaatatcgagctacaaactaaaagagctgagtgcgattcggctaataacaccttcgaactgcatctacatttgggcccacagtaccacttcttcaacggggcccttcaccctgtggtgtctcagacagaatcagtttgggatctgacatttgacaaaaggaagacgttaggagatttgcggcagagtatctttcaactcttagaattctgggaaggcgacatggtgctgtccgtagctaagctggtgccggccgggttgcacatctatcaaagtctgggcggggacgagctaacactgtgcgagacagagatcgccgacggcgaagatatattcgtgtggaacggggttgaggttggcggggtgcatatccaaactggcatcgattgcgaacctctgttgttaaacgtgctccatctggacaccagtagcgatggagagaagtgttgccaagtgattgagtcacctcacgttttccccgccaacgccgaagtgggtactgtgctgacagccctggccatacccgccggagtcattttcattaattctgctggttgtcctggaggcgagggctggaccgctatcccgaaagaagacatgcgcaaaacattccgagaacagggtctgaggaatgggagctctatcctcatccaggattcccatgatgataactcacttctgacaaaagaagagaagtgggtgacttccatgaatgagatagattggctacacgttaaaaatttatgccagctggagtctgaggaaaaacaggttaaaatttccgctacagtgaacactatggtgtttgacatccggatcaaagcaatcaaggagctgaagctcatgaaagaactcgctgataatagttgcctgaggccgatcgacagaaacggtaagctactttgtcctgtgcctgatagctacacccttaaggaggccgaactgaagatgggcagcagtcttgggctgtgtctgggtaaggcacccagctcatcccagctattcctatttttcgctatgggaagcgacgtccaacccgggaccgagatggagattgttgtggaggagacgatttctgtcagggactgccttaaattgatgctaaaaaaaagtggcttgcagggtgatgcatggcatcttagaaaaatggactggtgctatgaagccggcgagcctctctgcgaggaagacgccaccctaaaagaacttcttatctgttctggcgacaccctcctgttgattgagggccagttacctccactgggtttcctcaaagtgcctatctggtggtaccagctgcaaggacccagcggtcactgggagagtcaccaggatcaaactaactgtacctcaagctggggcagagtgtggcgcgctacctcgagccagggggcatccggcaacgagcctgcccaggtgtccctgctatacttgggggacatcgagatcagcgaggatgcgacactcgcagagctgaaatcccaggcaatgaccctgccaccctttctggaattcggtgtgccatctcctgcgcatttgagagcctggaccgtagaacggaagcggcccggccggttgctgagaacggaccgccagcctttgcgtgagtataaactcggcagacggattgagatctgtctggagcctctccaaaagggcgaaaacctcgggcctcaagacgtacttctgagaactcaggtacgcataccaggggaacggacctacgccccagccctagatttagtctggaatgctgctcagggtggcaccgccggttcccttcgtcaaagggttgccgacttctatcggctgccagtcgagaaaattgagatcgccaagtattttcccgagaagttcgaatggttacctatctccagctggaatcagcaaattactaagagaaagaagaaaaagaagcaggattacctgcagggagccccatactacctgaaagacggcgatacaatcggtgttaaaaatcttctcatcgacgatgatgacgacttcagcaccatcagagacgatacaggcaaagaaaagcagaagcagcgagctttgggccggagaaagtcccaggaggccctccacgagcaatcatcatatatccttagttccgcagagacgcctgcgagacctagggcccctgagacttccctctcaatccacgttggttcatttagatag

SEQ ID NO: 34305 - DNA, 492 bp, Artificial Sequence
  Description of Artificial Sequence: Synthetic coding sequence
atgggatcttctctagggctctgcctaggcaaagcgccaagctcgagtcagctcttccttttctttgccatgggctcagacgtccagccaggcactgagatggaaatcgtggtggaggaaactatctccgtacgggactgtcttaagctaatgctgaagaagagcggacttcagggcgacgcatggcacctcagaaagatggattggtgttacgaggctggtgagcccctgtgtgaggaagacgctacactgaaagagctgttgatctgctctggggacaccctgcttttaattgagggccagttgccccccctcgggttcctaaaagtcccaatatggtggtatcaactccagggacccagtgggcactgggaatctcaccaggatcaaacaaactgcactagctcatggggcagagtgtggagggcaacgagtagccagggggaaaacaggatggggttccagcagccagtgcatcataaggagaaatag

SEQ ID NO: 34306 - DNA, 3708 bp, Artificial Sequence
  Description of Artificial Sequence: Synthetic coding sequence
atgttcggagacctgttcgaggaggagtactctaccgtgtccaataaccaatacggaaagggcaagaaactgaagactaaggccctagaacctcctgcgcccagagagtttacaaacttgtccgggatcagaaatcaggggggcacgtgttatttaaattctctattacagaccttacactttacgcctgaatttagagaggcactgttctctctggggccagaggaactcggtctgtttgaagacaaggataagccggacgcaaaagttaggattattcccttgcagctccagcgcctctttgcccagctcctgctgcttgaccaagaggcagcttccaccgccgacctcacagattccttcggctggaccagcaacgaagaaatgcggcagcatgacgtgcaagagctgaataggattttgttttcagcgctggaaacatcattggtagggacaagcggccacgacctcatttatcgactatatcacggaactatcgtgaaccagattgtgtgtaaagaatgtaaaaatgtctcagagagacaagaagacttcctggaccttacggtcgccgtgaaaaacgttagtggcctggaggacgctctttggaacatgtatgtggaggaagaagtttttgactgcgacaacctttatcattgcggaacatgtgatagacttgtcaaagccgctaagagtgctaagcttcgaaagctgccacctttcctgacagtctccctgttaaggtttaatttcgacttcgtcaagtgcgagcgctataaggagacaagctgttatacctttccactgaggattaatctgaagcccttttgcgaacagagcgagctggacgacttagagtatatttacgacctgtttagcgtcattattcacaaggggggctgttacggtggacactaccacgtgtacattaaagatgtcgaccatttgggcaactggcagttccaggaggagaaatctaagcccgacgttaacctgaaagatctgcagtccgaagaggagatcgaccacccacttatgatcttaaaggcaattttacttgaggaaaacaatttaatccctgttgatcagctcgggcaaaagcttttaaaaaaaatcgggatctcttggaacaagaaatacagaaagcagcatggccctcttagaaagtttctgcagctacactcacaaatttttcttttgagctccgacgagtcaacggttagactgcttaagaatagtagtctccaggcggaatccgacttccagcggaacgatcaacagattttcaagatgttgccacctgaatccccgggcctcaacaattcaatttcatgccctcactggtttgacatcaatgattccaaagtacagcccatccgagagaaagacatagagcagcaatttcagggcaaggaatccgcctacatgctgttctataggaagtctcagttacagaggcccccagaggctagggccaaccccaggtacggggtgccctgtcatttactgaatgagatggacgcagcgaacattgaactccagacaaagcgcgctgaatgcgacagtgccaacaatacttttgaacttcatctccacttaggccctcagtatcattttttcaacggcgctctgcaccccgtggtttcccagactgaatcagtgtgggacctgacttttgacaagagaaagaccctgggagatctgcgacagagcatttttcaactcctggagttttgggagggagacatggtactctcagtggccaagttagtgcctgccggcctgcacatctatcagagcctggggggggacgagctgactctatgcgagactgagattgccgatggagaggacattttcgtatggaatggcgtggaggtgggtggagtacacattcaaacgggtatcgattgcgagccccttctgttaaatgtgcttcacctcgacacaagttcggacggcgagaaatgttgccaagtgattgagagtccgcacgtgtttcccgccaacgcagaggtgggaacagtgctcacagccctcgccatccctgccggagtcatcttcataaattcagctggatgtcctggtggagaggggtggacagcaatcccgaaagaggatatgaggaaaacattccgcgaacagggcctccgtaacgggagttcgatcctgattcaggacagtcatgacgataactctctccttactaaggaggagaagtgggtaacgtctatgaacgagattgattggttgcacgtgaagaacctgtgtcaactcgagtcggaagagaagcaagtgaagattagcgcgacagttaatacgatggtctttgatatcaggattaaggccatcaaggaactcaagcttatgaaggaactggcggacaattcttgcctgagaccgatcgataggaacggtaagttactgtgcccagtgccagattcctataccctcaaagaagccgagctcaaaatgggctctagcctcggactctgtctcgggaaggccccttcatcctctcagttattcctgttcttcgccatggggtccgatgtgcagcccggcaccgaaatggagatcgtggtggaggagacaatttccgtgcgcgattgtctcaaattgatgttgaaaaaatcaggacttcagggcgatgcgtggcatctgcggaagatggattggtgttatgaagcaggcgagcccctgtgcgaagaggacgcgacactcaaagagctcctgatatgttcaggtgacacactgctgctgattgaaggccagttgccaccgctgggattcctcaaagtgccgatatggtggtaccagctccagggaccctccggacactgggaatctcaccaggaccagacaaactgcacctctagctggggccgcgtctggagagccacaagcagccagggtgcttccggaaatgagccggcccaggtttccctgctgtatcttggcgacattgaaatcagcgaggacgcgaccctagcggagcttaaaagccaagccatgaccctgccacccttcctggaatttggcgtgccgagccccgcgcacttgagagcctggactgtggaaaggaaacgacccgggcggcttctgcggacggacaggcaacctctgcgtgagtacaagcttgggcggcgtatcgagatatgtcttgaacccttgcaaaagggcgagaatcttggcccacaggacgttctcctacgtactcaggttagaataccaggtgagcgcacctatgccccagcacttgatctggtgtggaatgctgcccaaggggggaccgccggctccctgcgtcagagggtcgcagatttttatcgcctcccagtcgaaaagatcgagatagccaagtactttcctgagaaatttgagtggctccccattagcagctggaaccagcagatcacaaaaagaaagaaaaagaagaaacaagactacttacagggtgccccttattatctgaaggacggggacaccatcggcgtgaaaaaccttttgatagacgacgatgatgattttagtacaatccgcgacgacacgggcaaggagaagcagaagcagcgggccctgggccgaagaaagtcacaggaagctttacatgagcagtcaagctacattctgtcgtctgctgaaacaccggctcgccccagggctccagaaacaagtctgagcatacatgtggggtcattcaggtag

SEQ ID NO: 34307 - DNA, 987 bp, Artificial Sequence
  Description of Artificial Sequence: Synthetic coding sequence
atgttcggcgacttatttgaggaagagtacagcacagtcagcaacaaccagtacggtaagggtaaaaagctgaaaacaaaagctcttgagccacccgcaccaagggagttcacgaatcttagcggaatcagaaatcagggaggaacatgttacctgaatagtctcttgcagactttacatttcacgcctgagtttagggaggcattattcagccttggccccgaggagctgggcttgtttgaggacaaggacaagcccgacgctaaggtacgtatcattccgctccaactgcagcggttatttgcccagctcctgctcctagatcaggaggcggccagtacagcagacctgacagacagttttggatggacgtctaatgaggaaatgcgacaacacgatgtgcaagaactaaacaggattcttttctctgccctcgaaacttccctagttggtaccagcgggcacgatttgatttaccgcctataccacggaacgatcgtcaatcaaatcgtttgtaaggagtgcaagaacgtttccgagaggcaggaagactttttggatctaaccgtcgctgtgaaaaatgtgtcagggctggaggatgccctgtggaacatgtacgtggaggaagaggtctttgactgcgataatctataccactgcggcacgtgtgaccgcctcgtgaaggccgctaaaagtgccaagctgcgcaaactgccgccttttctgaccgtgagcttgctgagattcaatttcgatttcgtgaaatgcgaaagatacaaggaaaccagctgttatactttcccactgcgcattaacctcaagcccttttgcgagcagtccgagctagacgacctggagtacatgacatcctcacagctgttgtacaccaaggtggccgctaccgaggctattaccatgtatatcttgaaaatgctgattatctgggaaactgggtcatttaaaaggaaaaaagtgaatcaaatgtag

SEQ ID NO: 34308 - DNA, 3744 bp, Artificial Sequence
  Description of Artificial Sequence: Synthetic coding sequence
atgagtctttttcttagagtggtgtttagctttactatgttcggtgatctttttgaagaagagtacagtaccgtgtctaacaatcagtacggaaaagggaaaaagctcaaaaccaaggcattggagccccccgcgcctagggagttcacgaatctgtcaggtatccgtaatcaaggaggaacctgctatctgaactcactcctgcagactctgcactttacgcctgaattccgtgaagcacttttctctctcggccctgaagagctgggcttattcgaagacaaagacaaacctgacgcaaaggtcaggatcatacctctacagttgcagagactgttcgcacagcttctgctccttgatcaggaggccgcctcgaccgcagacctgacagattcttttggctggacctctaacgaggaaatgagacagcatgacgtccaggagcttaatcgaatactcttttccgctctggagacatcactcgtgggaacatccggacacgacctaatctaccggctttatcacggcaccatcgtgaatcagattgtgtgcaaagaatgcaagaacgtatcagagcgacaagaagattttctggacctgactgtcgcggtgaaaaacgtgtcagggctagaagatgcactctggaacatgtacgtcgaggaggaagtattcgattgcgacaacctttatcactgtggcacctgtgaccgcctcgtgaaagccgcaaaatctgcaaagctgagaaaactgcccccgtttttgaccgtctccctgctccggtttaacttcgacttcgtaaagtgcgagagatacaaagagacaagttgttatacctttcctctcagaatcaacttaaaaccattttgtgagcagtccgaacttgatgacctggaatatatttacgatttgttctcagtgatcattcacaagggggggtgctatggaggccactaccacgtgtacattaaagacgtggatcacctgggcaactggcagtttcaggaggaaaaatcaaagccagacgtgaatctgaaagacttgcaatcagaagaggagattgaccacccacttatgatccttaaggcaattctgctcgaggagaataatctcattccggtagatcagctgggtcagaaactgcttaagaaaattggtatctcatggaataagaagtacagaaaacaacacggccctctcagaaagttcttgcagcttcactctcagatttttctcctctcatctgatgaatcaaccgttaggctcctaaagaattcctccctccaagccgaaagcgatttccagcggaacgaccagcagatcttcaagatgttaccacctgaaagcccaggactgaacaatagtatctcttgtccccactggtttgatatcaatgacagcaaggttcaaccaatccgcgagaaagatattgaacagcagtttcagggcaaggagagtgcttatatgttgttctacaggaaaagccagcttcagagaccaccagaggccagagctaatcctcgttacggggttccatgccatctactgaacgagatggacgcagctaatatcgaacttcagaccaagcgggccgaatgcgactcagccaacaatacctttgaactacaccttcacctgggtcctcagtaccattttttcaacggcgctttacatccagttgtctcacagacagaaagcgtgtgggacctcacattcgacaaaagaaaaaccctaggcgacttgcgacagtctatctttcagttactggaattttgggagggagatatggtgctcagcgtggccaagctggtcccagccggactccacatctaccagtccctggggggcgacgagctcaccctttgcgaaacagagatcgccgacggcgaggatatcttcgtgtggaatggggtagaggtgggtggcgttcacattcaaactggcatcgactgcgaaccgctgttgctgaatgttctacatctcgacacgtcgagcgatggggagaagtgctgtcaggttattgagagcccgcatgtgtttcccgccaatgcagaggttggaactgtgcttacagccttagcgattcctgctggagttattttcatcaatagcgctgggtgtccaggaggagaggggtggaccgcaatccccaaggaagacatgagaaagacttttagagagcagggcctgagaaatggcagcagcattctgattcaggatagtcacgatgacaattctctcctgaccaaggaggaaaaatgggtgacatctatgaatgaaatagactggttgcacgtcaagaatctgtgccaactcgagagtgaagagaagcaggtgaagatctccgccactgtaaacaccatggtttttgatatccggattaaagcaatcaaggaacttaagctgatgaaggagctcgccgataatagttgtctcagacctatcgacagaaacgggaaactgctgtgtcctgtacctgattcttacactttgaaagaggcagaattgaaaatgggcagcagtctcggtttgtgcctgggcaaagcaccgagttcttcccaactatttctgttttttgccatgggcagtgatgtgcagccaggaaccgaaatggaaattgtggtggaagaaaccatctctgtgagggactgcctgaagctgatgttgaagaagagcggcctgcaaggggacgcctggcacctgcgaaaaatggactggtgctatgaagccggagaacctctgtgtgaagaggacgcaaccctaaaagagctgctgatatgctccggcgacaccctgcttctcatcgaaggacaacttcctccactgggtttcttgaaggtccccatatggtggtaccagctccaaggcccaagtggccactgggaaagccaccaagatcaaacaaactgtacatccagttgggggcgggtatggagggctacttcatctcaaggcgcgtctgggaatgagcctgctcaggtgtctttgctctacctgggcgacattgaaatctccgaggacgctaccctcgccgagcttaaatcgcaggcaatgacattgcctccttttctggagtttggagtgccctccccggctcacctgcgggcttggacagttgaacgaaaaagaccgggaagacttctccgtacagaccgacagcctctgagagaatacaagctgggcagaaggatagagatatgtctggaaccgctccaaaaaggagaaaacttgggacctcaggatgtcctgttaagaacacaggtgagaattcccggagagcggacttatgcccctgccctggacctggtgtggaatgccgcacaagggggaactgccggcagcctccgacagcgggtagctgacttctaccgcctgcccgtcgaaaaaatcgaaatcgccaaatattttcccgaaaagtttgaatggttacctattagctcctggaatcagcagatcactaagcgcaaaaaaaagaaaaaacaggactacctccagggcgctccatactatttaaaggacggcgacaccatcggcgtgaaaaatttgctcattgatgacgacgacgatttctcaactatccgagacgatacaggtaaggagaagcagaagcagagagccctgggcaggcgtaagtcacaggaggctctgcatgagcaaagctcctatatccttagttccgccgaaactccagcaagaccccgcgccccagaaactagtctgtccattcacgtgggatccttccgctag

SEQ ID NO: 34309 - DNA, 1074 bp, Artificial Sequence
  Description of Artificial Sequence: Synthetic coding sequence
atggatggagtcctgtttagggcccatcaatgccagtacgtgcacccttgtgtgcatgtgtacgtgacggtgggcctcatggatcccctgtgtcttcagcggcacaaggaacacgccaaaggccgagaacccccatgtcctgcccttagcacatctgggctggtgggactgcataacattggtcagacctgttgtctcaacagtttgattcaagtgttcgttatgaatgtggactttgctcgtatcttaaagcgcattacagtaccgaggggagccgacgaacaacgcagaagcgtgccctttcagatgctgcttttgctggaaaaaatgcaggatagccggcaaaaggccgtctggccccttgagcttgcctactgcctgcaaaaatataatgtcccgctgtttgtgcagcacgacgctgcgcaactatacctgaaactgtggaatttaattaaagatcagattgcagacgtgcacttggtagagcggctccaagccctgtacatgattcgaatgaaggatagcctgatttgtctggactgcgcgatggagagctcaaggaactcatctatgcttacactgcggttgagcttttttgacgttgactctaaacccttgaaaaccctggaggacgctctccactgcttcttccagcctcgggagctctctagcaaatcaaagtgcttctgcgaaaattgcggtaaaaaaaccagaggtaagcaggttttgaagcttacccacctgccgcagaccctcaccatccaccttatgcggtttagcatccgtaacagtcagacccgaaaaatttgtcactccctgtacttcccacagagcctcgacttctctcagattctgccaatgaaacgagagagttgtgatgccgaagagcagtccggtgggcagtacgagctgttcgccgtgatcgcacacgtggggatggcagacagcggacactactgcgtgtacataagaaacgcggttgatggtaagtggttctgttttaacgactccaatatttgcttggtatcttgggaggatattcaatgtacttacggcaatccgaactatcactag

SEQ ID NO: 34310 - DNA, 3951 bp, Artificial Sequence
  Description of Artificial Sequence: Synthetic coding sequence
atgactatcgtggacaaggcctcagagtcctccgatcccagcgcctaccagaatcagcctggttcttcagaagcagtctcgcctggagacatggacgcaggctcagcctcttggggggccgtgagctcactcaacgatgtcagtaatcatactttgtccctgggtcccgtgccaggggccgtggtgtactcgtcctcatccgtgcctgataagtccaagcctagcccgcagaaggaccaagctctgggcgacggcattgcaccccctcaaaaggtcctgttcccatccgaaaagatttgtctgaagtggcagcaaactcatcgcgtcggcgccggcctgcaaaacctgggcaacacttgcttcgctaacgcggcactccaatgcttgacctatactccaccactcgcgaactatatgctctctcacgagcactcgaaaacgtgccacgccgaaggcttttgtatgatgtgcacgatgcaggcacatattacccaggccctttctaatcctggtgatgtgatcaaacctatgttcgttattaacgagatgagaaggattgctagacattttaggttcggcaaccaggaagacgcccacgagttccttcagtacactgtcgatgccatgcaaaaggcctgcctgaatgggtccaacaaactcgatcgccatacccaagctactacacttgtctgtcagattttcggaggataccttagaagccgtgtgaaatgccttaattgtaaaggcgtgagtgacactttcgacccttacttagacatcacacttgaaataaaggcagcacaaagcgtgaataaggctctggagcagttcgtgaaacccgagcagttagatggagaaaacagctacaaatgcagtaaatgcaagaaaatggtccccgcctcaaagcgatttactatccacaggagttcaaatgtcctaacactctctctgaagcgttttgccaatttcacagggggtaaaattgcaaaggatgtgaagtaccctgaatacctcgacatccgcccctacatgtctcaaccgaatggagagcccatcgtctacgtgctctacgctgttctcgtgcacacggggtttaattgtcatgcaggccactatttttgttatattaaggccagtaatgggttgtggtaccagatgaacgattcaattgtgtccacaagtgacatccgaagcgtgctctcacagcaagcgtacgttctcttttacattcggtcacatgacgttaagaacggtggagagctaacccaccccactcactccccgggtcagtcctccccgagaccagttatctcacagcgagttgtgacaaataagcaggctgctccagggtttatcggcccgcagctgccttctcacatgataaaaaacccgccccacttaaatggcactggtccattaaaagacactccctcctcctctatgtcctccccgaatggcaatagcagtgttaatagggcatctccagtgaatgctagtgcgtctgtgcaaaattggtctgttaaccggtccagcgttattcccgagcatccaaagaagcagaagatcactatctctatacacaacaagctcccagtgagacagtgtcagagccagccaaatctccattctaatagcttagaaaatccgactaagcctgtaccctcgtccacgattacaaattcagcagtccaatcgacaagtaacgctagcacgatgtctgtgtcctcgaaagtgactaaacccatccctagatcagagagctgtagtcagcccgtaatgaatggcaaatctaaactgaacagtagcgtcctcgtgccctatggagctgaaagctctgaagactccgacgaggagtccaagggcttggggaaggagaacggcatcgggactatcgtgtcgtcccattcacccggtcaggacgcagaggatgaagaggccactccgcatgagcttcaggaacccatgaccttaaacggcgctaactccgcggactctgactcagacccaaaagaaaatgggctggctcccgacggtgccagctgccagggccagcctgctctgcattctgagaatcctttcgcaaaagccaacggcctcccgggcaagctgatgccggctccgctcctgagcctccctgaagacaaaatccttgagacttttcgactgtctaataagttgaagggaagcacggacgagatgtccgccccaggggctgagcggggcccgcccgaagacagggacgccgagccacaaccgggatctccagctgctgagtccctggaggagcccgacgccgccgccggtttgtccagcaccaaaaaagctcccccacctcgcgatccaggaacacccgccacaaaggaaggagcctgggaagcaatggccgtggctcccgaagagcccccgccatcagcaggagaagacatcgtcggggacaccgcaccgccagatctgtgtgatcctggcagtctcactggggacgccagcccactgagccaggatgctaaaggtatgatcgccgagggacctcgagattccgctctggctgaggcccccgaaggactgtcacccgccccgcctgcacgatccgaagaaccctgcgaacaacctcttctggttcatccctctggtgaccacgctcgagacgcgcaggatccatctcaatccctgggcgcacctgaagctgctgaaaggccccccgctcccgtccttgacatggccccggccggacaccccgagggagacgccgagcctagccctggagagcgtgtggaggatgccgccgctccaaaggcacctggccccagtcccgccaaagagaagattggttcattgcgaaaagtggacaggggccattataggagtcgcagagaaagaagctcctctggagagccagctagggaatcccggtccaagaccgaaggtcatagacatcgacggcggcgcacttgccccagggagagggaccgccaggacaggcacgcccccgagcaccacccaggtcacggggaccgtttatcccctggcgagaggcgtagcttgggcagatgcagtcaccaccactcccggcataggtctggtgtagagctagactgggttcgccatcactatactgaaggagagaggggctggggaagagagaagttctatcctgatcgcccaagatgggatcgctgcagatactaccatgataggtacgctctgtatgcagccagggattggaagccatttcacgggggccgggaacacgagagggccggcctccacgagcgcccgcacaaagaccataacaggggtaggcgcggctgcgagcccgcaagggagcgggagcgccacaggccatcatcaccacgcgccggcgctccacacgcactggctcctcatcccgatcgctttagccatgatcggactgcgctggtagccggggacaactgcaatctgtccgaccgctttcatgaacacgaaaatggcaagtctcgtaagcgcagacatgatagcgttgaaaattcggattcccacgtcgaaaagaaagcgaggcggtcggaacagaaggacccattagaggaacctaaggcaaagaagcataaaaaatcaaaaaagaagaagaagagcaaagacaaacaccgggacagggactccagacaccagcaggattcagacttgtctgcagcatgtagcgatgcagatctgcaccggcacaaaaagaaaaagaaaaaaaaaaagagacattcaagaaaatccgaagactttgtgaaggatagcgagttacacctccccagggtgacttccttagagaccgttgctcagtttcgccgtgcccagggcggattcccactgtcaggaggacctcctctcgagggagtcgggcccttccgcgagaagaccaagcacttgagaatggagtcccgggatgatcgctgccggcttttcgagtatggacagggggactag

SEQ ID NO: 34311 - DNA, 3372 bp, Artificial Sequence
  Description of Artificial Sequence: Synthetic coding sequence
atggacttggggccaggggatgccgcaggcggcggccccctcgccccccgacccagaagaaggagatcgctacgaaggctgttctccaggtttctactcgcgctcggctcacgctcaaggcctggggatagcccacctcgtcctcagccaggacactgtgacggcgatggggagggcggcttcgcttgcgccccaggtcctgtcccagcagccccaggatcgcccggagaggagcgaccgccagggccgcagccacagctgcaattgccagcaggtgacggcgcccgaccacccggtgctcaaggcctcaagaatcacgggaacacttgcttcatgaacgcagtggtgcaatgcctgtccaacacagacctgctagcagagttcctcgccctaggacgctatcgggccgctccaggcagagccgaggtgacggaacagcttgctgccttggtacgagctctttggactcgggagtatacacctcagctctccgcggagtttaagaatgcagtgtcaaaatacgggagtcagtttcaaggaaacagtcaacacgacgcccttgagttcttgctctggctcttggacagggtccatgaagacctggagggaagctctagagggccagtctcagagaaactccctcccgaggcaactaagacgtctgaaaattgcctgtcgccatccgcacagctgcctctgggccagtcttttgttcaatcccactttcaggctcagtacagatcctctctgacttgcccccattgtctgaaacaatccaacaccttcgacccctttctctgtgtctctttgccaatacccctgcgccagacaaggttccttagtgtcacccttgtgtttccctcgaagtcccagcggtttttacgcgtgggtctcgctgtacccatattgtccactgtggcagctttacgaaagatggtggccgaggagggcggggttccagcagacgaagtcatcctagtggaactgtacccttctggcttccagcggagctttttcgacgaagaagacctgaacactatcgccgagggggataacgtttatgcctttcaagtgcccccctctccttcccagggtactctctccgcacatccgcttgggctgagtgccagtcctcgcctcgctgctagagaaggccagagattctcgctgtccctgcacagcgagagcaaggtcctgatccttttctgcaacctggtcggttcaggacaacaagcatcccgctttggccctccatttctgatccgggaggacagagccgtgtcttgggcacagttgcagcaaagcatcttgtccaaggtgaggcatttgatgaaatctgaagctccagttcagaatcttgggtccctgttctcaatcagggtagtagggcttagtgtggcatgcagttacctgtcccccaaagacagtaggcccctgtgtcattgggccgtcgatcgggtgttgcatctcagaaggcctggcggacccccgcacgttaagctggcggttgaatgggattcctccgtgaaggaaaggctattcggatccctacaggaggagcgggctcaggatgccgactccgtttggcagcagcagcaagctcaccaacagcacagctgtacgcttgatgaatgttttcaattttacaccaaggaggagcagctagctcaggatgatgcttggaaatgtcctcattgccaggtgcttcaacagggcatggtgaaactgagtctctggaccctgccagacatcctcattattcacctcaaacgcttttgtcaagttggcgaaaggcggaataaattgagtactctggtcaagtttcctctttctgggctcaacatggcacctcacgtcgcccagcgaagcacgtcacccgaggcagggctgggcccctggccaagctggaagcaacccgattgtctgccaaccagttaccccctagactttctgtatgatttgtatgccgtgtgcaatcatcacggcaacctgcagggagggcactataccgcctattgcagaaattccttggacggacaatggtattcatacgacgacagcacggtagagcctctgagggaggatgaagtgaacactaggggtgcatatatcctcttttaccagaaacggaactctattccgccgtggtcagcatctagttccatgagagggtcgacctcctcttcgctgagcgaccactggcttctgcggttgggatcccacgctggatccacgcgcggatctctgctgagctggagctcagccccctgcccatcccttccccaagttcccgattcccctatcttcacaaactccctatgcaatcaggagaaaggaggactggagcctaggcggcttgtgagaggggtcaaaggacgaagtatcagcatgaaggcccctactaccagtcgcgccaagcaagggcctttcaagacaatgcctctccgctggagctttggatctaaggaaaagccccccggcgcctctgttgagttagttgaatatctcgaatccagacgccggccccgtagtaccagccagagtatcgtgagtctgcttacgggaactgcaggggaagatgaaaagtcagctagccccagaagcaacgtggcccttcccgcgaatagtgaagatggcggtcgcgccatagagcgtggtcctgcaggagtgccctgtccttccgcccagcccaatcattgtcttgcccctggtaactccgacggtccgaacactgctcggaagctgaaggaaaatgccggacaggatataaagttgccacgcaaattcgacctaccactgaccgtcatgccgtctgttgaacacgaaaagccagcacgtcccgagggccaaaaggctatgaattggaaagagtcgttccagatgggtagcaaaagcagtccaccctcaccctatatgggctttagcggcaattccaaggactcccgacggggcaccagcgagctggatcgcccgcttcaaggaaccctgaccttactaaggtccgtcttcaggaagaaggagaatcgccgcaacgaaagggccgaggtctccccacaggtgccacctgtcagcctggtgtccggtggactgtcacctgctatggatggccaggcccctggttctcccccggccctgcggattcctgaaggactcgcgcggggtctgggctcacgactcgaaagggatgtgtggtcagctccatcgtcattgaggctccctagaaaagccagcagagctccacgggggtctgcccttggaatgagccagaggacagtgcccggagaacaggcttcttacggtacgttccagcgggtgaaatatcacacactgtctctaggacgaaagaaaaccttgcccgagtcttccttttag

SEQ ID NO: 34312 - DNA, 3357 bp, Artificial Sequence
  Description of Artificial Sequence: Synthetic coding sequence
atggacttgggtccaggagatgccgccggaggaggtccattagcgccccgcccacggagacgccgatccctacggcgcctcttcagtaggttcctcctggcactgggaagtaggtctaggcccggtgactcgccgcctcgcccgcagcctggtcattgcgacggggacggcgagggggggtttgcttgtgccccgggcccagtgcctgccgcacccggaagccccggggaagagaggccccctgggccacaaccacaactccagctgcccgcaggcgacggggctagaccacccggtgcgcagggactgaagaaccacgggaatacgtgttttatgaatgcagttgtgcagtgcctgagtaacactgatctgttagctgagtttctcgctcttggccgttatagagcggcccccggtcgggctgaggtgacagagcagcttgccgccctcgtccgggccctctggactcgcgagtataccccccagctttcagcagaattcaagaatgctgtctcaaagtacggaagtcagtttcagggaaattcccagcatgatgccctggaatttcttctgtggttgctggatcgggtgcacgaagatctcgagggtagtagccggggacctgtttcagagaagttgccgccagaggcaacgaaaacgtcggagaactgcctatctccttcagcacagttgcctctggggcagagcttcgtgcagagtcatttccaggctcagtatcgaagcagtctcacgtgcccacattgcctgaaacagtccaacacttttgatcccttcctctgcgtgagcctgcccatcccactgagacagacccgcttcctctctgttactttggtgtttccaagtaagtcacagagatttctgcgggtaggccttgccgtgcctattctaagcacagttgccgccctgcggaaaatggtggcggaagaaggtggtgtaccggctgacgaagtgatcctggtggagctctatccatccgggtttcagaggtctttcttcgacgaggaagacctgaatacgattgccgaaggcgataacgtgtacgcattccaggtgcctccaagtccctcccaagggacactgagcgcccatcctttgggtttgtcagcctccccccggttggctgctcgggaaggtcagcgattctctctgtccttgcacagtgagtcaaaggtgcttattcttttctgcaacctggtgggcagtggacagcaggcctctagattcgggccaccattccttatcagagaggacagggccgtttcatgggctcagctgcagcaaagtatcctcagcaaggtgcgtcacctaatgaagtccgaggcaccagtgcagaacctggggtccctgttctctatacgggtcgtcggcctcagcgtagcctgttcctacctctctcctaaggacagccgacctctgtgccactgggcagtcgacagggttcttcacctacggcgtcccgggggacccccccacgtgaagcttgccgtcgagtgggacagcagcgtgaaagagcggctcttcggctctttgcaggaagagagagcgcaggatgccgactcagtttggcagcagcagcaggcccaccaacaacactcctgcaccttagacgaatgtttccaattttatacaaaagaggagcagctcgcccaggacgatgcgtggaaatgtccacattgtcaggtgttgcagcagggaatggtcaagttgtcactctggacactgcccgatattttgattattcacttgaaaaggttctgtcaggtcggcgagcggcggaataagctcagcacgctggtgaaattcccactgagtgggttgaacatggccccccacgtggcccagaggtcaacaagtcctgaagccggccttgggccgtggccttcttggaagcaacctgactgcctgcccacctcatatcccctcgactttctttacgatctgtacgccgtttgcaatcatcatggcaatttgcaggcctactgccgcaattcacttgatgggcagtggtatagctatgacgatagcactgtcgaaccactgcgcgaagacgaggtcaatactagaggagcatacatcctgttctaccaaaagcgcaattcaattccaccatggtcagcctcctcctccatgagaggatcaacctcatccagtctctcagaccattggctgcttagactgggaagccacgccgggtccacaaggggatccctcctgagctggtcatccgctccatgtccttctctgccccaggtacccgattcaccaatttttactaacagcctttgcaaccaagaaaaggggggattggaaccccgcagattggtcagaggcgtgaaaggccgcagtatctccatgaaggctccgacaacctcacgcgctaagcaaggccccttcaagactatgccgctcagatggtcatttggatcaaaggaaaagcctcccggcgcctcagtggaacttgtggaatacctcgagtcccggagaaggccccgttctacatctcagtcgatagtgagcctgctgacaggcactgcaggcgaggatgaaaaatctgccagccctcgctcgaatgtcgcattgcccgccaactccgaggacggcggtagagccatcgagcgcggaccagccggcgtcccctgtccaagtgcccagcctaaccactgcctcgcccctggcaacagcgacggacccaatacagctagaaaacttaaagagaatgcaggccaggatatcaagctgccaagaaagttcgatctgccgttaaccgtgatgccctcagtggagcacgagaaaccagctaggccagaaggccaaaaggccatgaattggaaagagagctttcagatgggctctaagtcgtcaccgcccagcccctacatggggttctccggaaatagcaaagattccagaaggggaacatctgaactggatcggcctcttcagggaaccttaacgctgctgcgttcagtcttcagaaaaaaggaaaatcgccgcaacgagcgcgcggaggtatctcctcaggtaccccctgtatcgctagtttcaggggggttatcgcccgccatggatggtcaggctccggggtctcctcccgcactccggatcccggaaggcctggccaggggcctgggatccagattggagcgggatgtgtggtctgccccaagcagcctgaggctgcctcgaaaggcgtcacgggcccccagagggagcgcactggggatgagtcagcgcaccgtgcccggcgagcaagcgtcatatggcacttttcagcgggtcaaatatcacaccctctctttggggaggaagaagacacttcctgaaagctccttctag

SEQ ID NO: 34313 - DNA, 2445 bp, Artificial Sequence
  Description of Artificial Sequence: Synthetic coding sequence
atgagggtcaaagatcctacgaaggccctgcctgagaaggccaaacggagtaagcgccctacagtaccacacgatgaagactcttccgatgatatcgcggtggggctgacctgccaacacgtttcacacgccatctccgtcaatcatgtgaaaagggctatagctgagaacctatggtctgtttgttccgagtgcctcaaagaaagacgattctacgacggccaattagttctcacatccgacatctggttgtgcctgaaatgcggattccagggttgcgggaagaactcggaatcgcagcacagcctgaagcacttcaaatcttcccgcactgagccacactgtatcatcatcaatctgtccacctggattatatggtgttatgaatgtgacgaaaagttgtccacccattgcaacaaaaaggtcctggcacagatagttgactttttgcagaagcacgccagtaaaacccagaccagcgctttcagtaggattatgaagctgtgtgaggaaaagtgtgaaacagatgagattcagaaaggaggtaagtgccggaatctgagtgtgaggggcatcacaaacctgggaaacacttgcttcttcaacgctgtgatgcaaaatctcgcccagacttacacgctcaccgacctgatgaatgaaattaaggagtctagcacaaaactaaagatcttcccttctagcgacagtcaactcgaccctctcgtcgtagaactatcgcggccgggtccactcaccagtgccctcttcctgttcctgcactcgatgaaggaaacggagaaggggccattgtctcctaaggtgctctttaatcaactatgtcaaaaggcacccagattcaaggattttcagcagcaagacagtcaggagctgctccactacctcttggacgccgttagaaccgaggagacaaagagaatacaggcgtcgattctaaaggccttcaataaccccacgaccaaaacggcagacgatgagactcgcaagaaagtgaaagcctacggcaaggaaggagtgaaaatgaacttcattgaccgaattttcatcggcgagctgacatccaccgtgatgtgtgaggagtgcgccaatatttccactgtaaaggacccgttcatcgacataagcttgcccataatcgaagaacgagtgtcgaaaccgctcttatggggtcgcatgaataagtatagaagcttgagagaaacagatcatgacagatacagcggcaatgtgacgattgagaacattcaccagcccagggccgccaaaaaacatagttcctccaaagacaagagccaactcattcatgaccgcaagtgtattcggaaactgtcgtccggtgagacggtgacatatcagaagaatgaaaatcttgagatgaatggggacagccttatgttcgcaagcctgatgaacagtgagtcacggcttaacgagagtcccaccgatgactccgaaaaagaggcatcccactcagaatccaatgttgatgcagattccgaaccctcggaatcagagtcagcatccaaacagactgggttgtttaggagcagcagcggtagcggagtacagccagatggacccctttacccgctgtcagcaggtaagctgctatacactaaggaaacagactcgggggacaaggagatggcggaggcaattagtgagcttagattgagtagcaccgttaccggtgaccaagacttcgaccgagaaaatcagcctctgaatatttctaataatctgtgctttctcgaggggaagcacctgcgttcgtactcccctcagaacgcctttcagacattgtcccaatcttacattaccacttccaaagagtgcagcatccagagttgtctgtaccagttcacctctatggaactgctgatgggaaacaataagctgctctgcgaaaactgcacaaagaataaacagaaatatcaagaagagacgtcgttcgctgagaaaaaagtggaaggagtgtatactaacgctcggaagcagctgctgataagtgctgtgcccgctgtcctgatcctgcatctcaagaggttccaccaggctggtctgagcttgcgtaaagttaatagacatgtggacttccctctgatgttggatctcgccccattttgctccgccacctgcaagaacgcatccgtgggcgacaaagtgctgtacggtctctatggtatagtagaacactcgggctccatgagggagggacattatacggcctacgtcaaggtcagaacgccttctcgcaaactgagtgagcataatacgaaaaaaaaaaatgtgcctggtctaaaagccgctgataatgagtccgcaggacaatgggtgcatgtttctgacacctacttgcaggtggtgcctgagtcccgcgcactatccgcccaggcttacctcttattctatgaacgagtcctgtag

SEQ ID NO: 34314 - DNA, 870 bp, Artificial Sequence
  Description of Artificial Sequence: Synthetic coding sequence
atgagggttaaggatccgacaaaggctctccccgaaaaggcaaaacgcagtaaaagaccaaccgtccctcacgatgaggacagcagtgacgatatagcagtgggactcacttgccaacatgtgtcacatgccatctctgttaaccatgtaaaacgagccatcgcagagaacttgtggtcagtgtgtagtgagtgtctcaaggagagaagattctatgatggccagctggtgttgactagcgatatctggctgtgtctcaagtgcgggttccagggttgtggaaaaaattccgagagtcagcactcactgaagcactttaagtccagcaggacagaaccgcactgcataataatcaacctgtccacatggatcatatggtgttacgagtgtgacgagaaactgagcacacattgcaataagaaagtgctcgcacaaatcgtcgacttcctccagaagcatgcatccaagacacagacctccgcatttagtcgtatcatgaaattatgtgaagagaaatgcgagactgatgaaatccagaaggggggcaagtgccgcaatctttctgtcagaggaattacgaatctggggaatacttgcttcttcaatgccgttatgcaaaatttagcacagacttacacactgacagacctgatgaatgagatcaaagaaagcagcacaaagctgaagatttttcccagcagcgattctcaactcgatcctctcgttgtggaactgtcccggcccggacccctgacttcagccctttttctattccttcacagtatgaaagaaacagaaaagggccctctgagccctaaagtgctgtttaaccaattatgccagaagtgggttcacttacacctgatctag

SEQ ID NO: 34315 - DNA, 549 bp, Artificial Sequence
  Description of Artificial Sequence: Synthetic coding sequence
atgcgcgtgaaggaccctaccaaggcactgccggaaaaggcaaaaagaagtaaacgtccaaccgtacctcacgatgaggattcaagcgacgatattgccgtcggtctgacctgccagcacgtctcccatgccatcagcgttaatcacgtgaagcgcgccatagctgagaacttgtggagtgtgtgctcggagtgtctgaaggaacggcgcttctatgatggacagctcgtgctgacatcagacatttggttgtgcctgaagtgcggttttcagggatgtggtaaaaattccgagtcccaacactcactcaaacacttcaagtctagtaggaccgaaccacattgcattatcattaatctgagcacatggatcatttggtgctacgagtgtgatgagaagctgtccactcactgtaataagaaagtcctggctcagatcgtggacttcctacaaaagcacgcctctaaaacccagacccgcccggggccaattttgattcacctcttcagcattaactgccttggggctcattccgagtcggtgtgctag

SEQ ID NO: 34316 - DNA, 1485 bp, Artificial Sequence
  Description of Artificial Sequence: Synthetic coding sequence
atgaggagcaagaaggtggtgcagaatagccggttctttctgcctcaaactctcagttgggcaccccgtttcaaggactttcaacaacaggactcccaggagcttctccattatctgctcgacgctgtgagaaccgaggagaccaagatctccacggtgaaagatccttttatcgacatcagccttcctataatcgaagaaagagtgagcaaacctctcctctggggccgcatgaataagtacaggagccttcgggagacagaccatgacaggtattctggtaacgtcaccattgagaacatacatcagcctagagcggccaagaagcacagttccagtaaagacaagagccagctcattcatgaccgaaaatgtatccggaagctctcctctggtgagaccgtgacataccagaagaacgagaatctggaaatgaatggagattccctcatgtttgctagcttaatgaacagcgaatcacggctcaacgagagcccaaccgatgattcagaaaaggaagccagccactcggagagcaacgtggatgccgactctgagcccagcgaatccgagtcggcaagtaagcagaccggactctttcgcagctcatcaggcagcggagtccaaccggacgggcccctgtacccgttgtccgctgggaagctcctctacactaaagagacagattctggagacaaggaaatggccgaagccattagtgagttgagattgtcctcaaccgtcacaggcgaccaggactttgaccgtgaaaaccagccactgaacataagcaataatctgtgcttcctcgagggcaaacatctgcgatcttattccccacagaacgcctttcagacgctgagccaatcttatatcactacgagtaaggaatgcagtatccagagctgcctgtatcagttcacctccatggagctgctaatgggaaataataagctgctatgcgagaactgcactaaaaataagcagaagtaccaagaggaaaccagttttgccgaaaagaaggtggagggcgtgtacaccaatgccagaaagcagctactcattagtgccgtgcccgcggtgctgatcctccacttgaaaagattccatcaggctggtctctccctgaggaaagtgaacaggcacgtggattttcctctgatgctggacttggctcctttttgcagcgctacctgcaagaacgccagtgttggcgataaggtgctgtacggcctctacggtatcgttgaacattccggcagtatgagagagggccactatactgcctacgtaaaggtaaggaccccctctcgcaaactgagcgaacataatactaagaagaagaatgtgcctgggctgaaggccgctgacaacgagtctgccgggcagtgggtgcacgtgagcgacacatatcttcaggttgttccggaatcccgagcgctttccgctcaagcctacctgctgttttacgaacgcgtgctctag

SEQ ID NO: 34317 - DNA, 870 bp, Artificial Sequence
  Description of Artificial Sequence: Synthetic coding sequence
atgagagttaaagatcctactaaggctctgcccgaaaaggcgaagcggtctaagagacctacagtccctcacgacgaagatagcagtgacgatattgctgtgggcctgacatgtcagcatgtcagccatgccatcagcgtgaaccacgtgaaacgggctatcgccgaaaacctgtggtccgtttgctcagaatgtttaaaggaacgaagattttacgatggccagttagttctgacctccgatatctggctctgcctgaaatgcggattccagggatgtggcaagaactctgagtcccagcactctctgaaacattttaagagcagtaggacagagccgcattgcatcattattaatctgagcacctggatcatttggtgctacgaatgtgatgagaagttatcgacgcactgcaataagaaggttctggcacagatcgttgacttcctgcagaaacacgcttccaagacacagacttcagcgttctcgcgtatcatgaagctatgcgaggaaaagtgcgaaaccgacgagattcagaaaggaggaaagtgtaggaacctgtccgtgagggggataacaaatctcggcaatacttgtttttttaacgcagtgatgcagaatctggctcagacctatacgctcactgatctgatgaacgaaatcaaggaaagttccactaaattgaagatctttccaagctccgattcacaactggatccgctggttgtagaactatcaagacctggtcccctcacctccgccctgtttctattcctccattccatgaaggaaactgagaaagggcctctgtcgcccaaagtcctgttcaatcagctgtgtcaaaagtgggtgcatctgcatctcatttag

SEQ ID NO: 34318 - DNA, 2445 bp, Artificial Sequence
  Description of Artificial Sequence: Synthetic coding sequence
atgcgtgtgaaagacccaaccaaggcactccccgagaaggccaagaggtcaaagcgtccaactgtgccacatgatgaagacagctctgacgatatcgccgtgggcctgacttgccagcatgtttctcatgctatctccgtgaatcacgtgaaaagggcaatagccgagaacctgtggtcagtttgcagtgagtgtttgaaggagcgcaggttctatgatggccaactcgtgctgacctccgacatttggctttgcctgaaatgtgggttccaggggtgcggaaagaattcagaaagccagcactccctaaagcacttcaagtcttctcgcacagaaccacactgtattatcataaacttgtcaacttggataatctggtgttatgaatgcgatgagaagctcagtacgcactgcaacaagaaagtgctggcgcaaattgtagacttcttgcagaagcacgcaagcaaaactcaaacgagcgcctttagccggatcatgaaactgtgcgaagaaaagtgtgagacggatgagatccagaagggagggaagtgtagaaacctgtccgtccgcggcatcaccaatttgggaaatacatgttttttcaatgccgtcatgcaaaatttagcccaaacgtacacattgacagatcttatgaatgagattaaagagagctctacgaagctgaaaatcttcccgtcatccgactcccagctggaccctctcgtggtcgagctgagcaggcccggccctctgaccagcgctttgtttcttttcctccatagcatgaaagagactgaaaagggaccattaagccccaaggtcctttttaaccagctttgccagaaggccccccgatttaaggattttcagcagcaggattcacaggagctgctgcattatttgctggacgccgtacgaactgaggaaactaagcgcattcaggccagcatattgaaagcttttaataatcccacaactaaaaccgcagatgatgagacgcgaaagaaagttaaggcttacggcaaggagggtgtcaaaatgaacttcattgatcgaatatttatcggggaactaacatccacggtgatgtgcgaagaatgtgccaatataagcaccgttaaggatccgtttatcgacatcagcctgcccattatcgaggagcgggtgagcaaacctttgctgtggggaaggatgaataaatataggagcctgcgagaaactgaccacgacaggtattctggtaacgtcactatcgagaatatccaccaaccaagagccgctaaaaagcacagtagtagcaaggacaagtcgcagctgatacatgaccgtaaatgcatcaggaagctctcctccggcgaaaccgtgacctatcagaaaaatgagaacctcgagatgaacggagacagtcttatgttcgccagcctgatgaactccgaatccaggctgaatgaatcaccgacggacgactcggaaaaggaggccagtcacagtgagtccaacgtcgacgccgatagtgaaccaagcgagagcgagagcgcctcaaaacagaccggtctgtttagatcctccagcgggtccggcgtccagcccgatggtcccctgtatccgctgagcgccggaaagctgctttacaccaaagagaccgattctggggacaaggagatggctgaggctatctccgaattgcgcctatccagcaccgtaactggagatcaagacttcgaccgagagaaccagcccctgaatatttctaacaacctgtgctttctggagggcaaacatctcagaagttacagtccgcagaatgcattccagacgttgtcgcaatcctacattaccacatcgaaagagtgttcaattcagtcatgtctttaccagttcaccagcatggaactgctaatggggaataacaagctgctgtgcgagaattgcacgaagaataagcagaaataccaggaagagacctcttttgccgagaagaaggtcgagggggtgtatactaatgcccggaagcagcttctgatctccgccgtgccggcagtgctaatccttcacttgaagagattccatcaggctggcctgtcacttcggaaggtaaaccgccatgtggatttccctcttatgctcgacctggcccccttctgcagcgccacctgtaagaacgcatctgtgggtgacaaagtcctctacggtctgtacggaatcgtggaacatagcggatccatgagggagggccactatacagcctatgtgaaggtgcgaacccctagtaggaagctgtcagagcacaacacaaagaagaagaacgtaccagggctgaaagcagctgacaacgagtccgctgggcagtgggtacatgtttcggatacatacttacaggttgtgcctgagtcaagggctctatctgcccaggcttacctgttgttttacgagagagtgctatag

SEQ ID NO: 34319 - DNA, 159 bp, Artificial Sequence
  Description of Artificial Sequence: Synthetic coding sequence
atgcgcgtgaaggacccaactaaggccttgcccgaaaaagctaagcgatccaaacggcccactgttcctcacgatgaagacagttccgatgacattgccgttggcctgacctgccagcacgtgagccatgcaatcagtgtgaatcatgtgaaaaggtag

SEQ ID NO: 34320 - DNA, 324 bp, Artificial Sequence
  Description of Artificial Sequence: Synthetic coding sequence
atgttggacctggctccattttgttctgcaacatgtaaaaacgcctcagtgggagacaaggtgctctacggactgtatggcattgtagagcactcgggctccatgagagagggacactacacagcttacgtgaaagtgcgaactccttcacgtaaattgagtgaacataacacaaagaaaaagaatgtccccggcctgaaggccgcggacaacgagagcgctggacaatgggttcatgtaagcgacacatacctccaagtggtaccagagtcgagggctctctccgcacaagcttatctactgttctatgagcgggtgctctag

SEQ ID NO: 34321 - DNA, 1923 bp, Artificial Sequence
  Description of Artificial Sequence: Synthetic coding sequence
atggataggtgcaaacacgtgggaagacttaggcttgctcaggaccactctattttgaacccacaaaaatggtgttgtctggaatgcgccacaacagaatcagtgtgggcctgtctaaagtgtagtcacgttgcctgcgggaggtatatagaagatcatgcgctcaagcactttgaagagaccggacatccgttagcgatggaggttcgcgacttatatgtgttctgttacctgtgtaaggattatgttcttaatgataaccccgagggggatctgaagctgttacgtagctctctgctagccgtaagaggtcagaagcaggatactccagtgcgccgggggcggacactgcggagcatggcctccggcgaagatgtagtgctgccacagagagcccctcaggggcagcctcagatgttaacagccctgtggtaccgccgccagcgattgttggcaaggaccctcagactttggtttgagaaatctagcagggggcaggctaagctggagcagcggcgtcaggaggaagcacttgaaagaaagaaggaagaggctagacgcagacggagagaagtgaagaggaggctactggaagaattggcctcaactcccccacggaagagcgcccggctgctccttcacactccccgggacgctggcccagccgcctccaggccagcagctctcccaacctcgcgcagagtgccagccgccaccctgaaactccgacgacagcctgcaatggcccctggggtcactggcctacgcaacctaggcaatacctgttatatgaactccatcctgcaagttctctctcatctgcagaagtttcgtgagtgtttccttaacttagatccctccaaaaccgagcacctgttccccaaggcaacaaacggtaaaacacaattgtcaggaaaacccaccaacagcagcgctaccgagctgtctttaagaaacgatcgcgctgaggcgtgcgaacgtgagggattttgttggaatggccgggcctcgatatcacgttctttagaactgattcagaataaggagcccagctccaaacacattagcctatgtagggaactgcataccctgttccgggtgatgtggagtggaaagtgggccctggtgagccccttcgctatgctgcactccgtgtggagccttatccccgcttttaggggatatgatcagcaggatgcccaggaattcctgtgtgagctgcttcacaaggtgcagcaggaactggagagcgagggtacaacacggcggattctgataccattcagccaaagaaagctgacgaagcaggtgctgaaggtcgtgaatacaatcttccatgggcagctgctcagccaagtaacatgtatatcctgcaactacaagagtaacacaatcgaacctttctgggatctgtctttggagtttccggagcgttatcattgcattgaaaagggattcgtgcctttgaaccaaaccgaatgtctattgactgagatgttggcgaaattcaccgagaccgaggccctcgagggtcgtatttacgcttgtgatcaatgtaactccaagcggcggaaatcgaatccgaagcctcttgtactgtccgaagctcgcaagcagctcatgatctacagattgcctcaggtcctgagactgcacttaaagcgttttcggtggtcaggccgaaatcacagagagaagattggtgtacacgtcgtgttcgatcaggttctcacaatggaaccatattgttgtagggatatgctctcttccttggataaggaaaccttcgcatacgacttatccgccgtcgtgatgcaccatggcaaagggtttggaagcggacattacacagcttactgttacaacacagaggggggtgcatgtgctctgctgtgcggcgtgggcgacacggaacgtggctag

SEQ ID NO: 34322 - DNA, 1923 bp, Artificial Sequence
  Description of Artificial Sequence: Synthetic coding sequence
atggataggtgcaagcatgtgggcagactgcggctggcacaggaccactctattctgaaccctcaaaagtggtgctgtttggagtgcgctactaccgagagcgtgtgggcctgtcttaaatgttcccacgtggcttgcggccggtacatcgaggaccatgctctcaaacattttgaagagactggccaccccttagccatggaggtccgagatctgtacgtcttctgttacctgtgcaaagactatgtactgaacgataaccccgagggggaccttaagttgttgcgatcaagccttttggccgtcagaggacaaaaacaagatacaccagtgcgcaggggaagaacactgagaagcatggcaagtggcgaagacgtggtcctgccccagcgcgcgcctcagggtcaaccccagatgctcaccgccctgtggtatcggagacagagattgctcgcccgtaccctgcgcttatggtttgaaaaatctagccgcggacaggccaaactggagcaaaggcgacaggaggaagctctggaaaggaaaaaagaagaggccagaagacggcgacgtgaggtgaaaagacgtctgcttgaagagctcgcatctacacctccccgaaaatcggcacgcctgctccttcatacccccagagacgcagggcctgctgcatcccgccccgctgccctgccaacctccagacgcgtgcccgccgctacgctcaaactgcggaggcaacccgccatggctcctggggtaactgggttgcgcaacctgggcaacacgtgttatatgaacagcattctacaggtgctgtcacacctgcaaaaattcagggagtgtttccttaatctagatccgtcgaaaaccgagcatctcttcccaaaagccaccaatgggaagactcagctgagtggaaagccaaccaattcatcagcaactgagttatctctgaggaatgatcgtgccgaggcctgcgagagagagggtttctgctggaatggcagagctagcataagcagatctcttgagcttattcagaataaggagccaagcagcaaacacatcagcctgtgcagagaactgcatacccttttcagagtcatgtggtccggcaaatgggcgctcgtaagccctttcgctatgttacactcggtctggagtctcatccctgccttccgcggatacgatcagcaggacgcccaggagtttctctgtgagctgctgcacaaagtgcagcaggagctagaaagtgagggcaccaccagaagaatcctcattcccttctctcagaggaagctgaccaaacaggtgttgaaagtggtgaacacaatctttcacggacagctcctaagccaggtgacatgcataagttgtaattataaatcaaacaccatcgagcctttctgggacctctctttagaatttcctgaacggtaccactgtatagaaaaaggatttgtaccactgaatcagacggagtgtctcctgacggagatgctcgccaagttcaccgagacagaagcgctggaagggaggatctatgcctgcgatcaatgtaattccaaaaggcgaaagagcaatcctaaaccactggttcttagcgaagctcgaaaacaacttatgatataccgtttgccgcaagtgttacgccttcatctgaaacggttcagatggtccggtcgaaatcatagggagaagattggcgtgcatgttgtgttcgaccaagtcttgactatggagccttattgctgtcgagacatgctttcaagtctggacaaggagacttttgcatacgatctctctgcggtggttatgcatcacggcaagggcttcgggtcgggacactacaccgcctactgttacaatactgagggtggcgcctgtgccctgttatgtggtgtgggagacaccgagcgtggctag

SEQ ID NO: 34323 - DNA, 2067 bp, Artificial Sequence
  Description of Artificial Sequence: Synthetic coding sequence
atggaccgatgcaagcatgtgggccgacttcggctagcacaggaccattctattcttaatccccagaagtggtgttgtcttgagtgtgctactaccgagtccgtgtgggcatgtctgaaatgctctcatgtggcgtgcggccggtatatcgaagatcatgcattgaagcattttgaagagacaggacaccccctggcaatggaggttcgcgacctgtacgtgttttgctatctctgtaaggactacgtcttaaatgacaaccctgaaggagacctgaagctgttgcggagttctctccttgcggtgcggggacagaaacaagacaccccagttagacgcggccgcacgctccgaagcatggcttcaggggaggatgtcgtgctcccacaacgcgcaccccagggacagccgcaaatgctgacagctctatggtatcgacgacaaagactcctggccagaaccctgagactctggtttgagaagtcaagccggggacaggctaagttggaacaacgcagacaggaggaggccctggagagaaaaaaagaagaggcacgacgcagaagacgcgaggtgaaacggcgccttctcgaagaactggcttccacacctccccgaaagtcagctaggttgcttcttcacaccccccgcgacgccggcccagccgccagccggccagctgccttaccaacaagcaggagagtgcccgcagccactctgaagctccggaggcaacctgccatggccccaggcgttactggactgagaaatctcggaaatacatgctatatgaacagcatattacaggtccttagccatctgcaaaaatttcgcgaatgtttcctaaacttggatccatccaaaaccgagcatcttttccctaaggctaccaatgggaaaacgcagttaagtggcaagcctactaatagctcagccaccgaactcagcctgcggaatgacagagccgaggcctgcgaacgagaaggcttctgctggaatggcagggctagcatttcacgctcgctggagctgatccagaacaaagagcccagctcaaagcacatcagtctgtgccgggagctacacaccctcttcagggtgatgtggtcaggcaagtgggctctggtgtctcctttcgctatgctacatagcgtgtggtctctcatccctgcgtttcgcggctatgatcagcaggatgcccaggagttcctttgcgagcttctgcacaaggtgcaacaggaactggagagcgaggggacgacacgcagaatcctgatacctttttcccagagaaagctgactaaacaggtcctcaaagtcgtgaatacaatattccacggacaacttttatcccaagtgacatgcatctcgtgcaactacaagagtaacactatcgaaccattttgggatttatccttggagttcccagaaagatatcattgcatcgaaaagggtttcgtgccactcaaccaaacggagtgtcttctgacagaaatgctagcaaagttcactgagaccgaggccctggagggccgaatatatgcatgtgatcagtgcaacagcaaacggaggaaaagcaatcctaagcccctggtgctcagcgaagcccgaaagcagcttatgatctacaggcttccacaggtgttgaggctgcatcttaaacggttcagatggagtggccggaatcaccgcgagaaaataggagtacatgtggtttttgaccaggtgctgactatggaaccctattgctgcagggacatgttgtcatccctcgacaaggagaccttcgcctacgacctgagtgccgtggtcatgcaccacggaaaaggatttggttccggacattacaccgcctattgctacaacaccgagggtggattctgggtgcattgcaatgattcaaagttgaatgtgtgctccgtcgaggaggtttgcaagacccaggcctacattctgttctatacgcaacgaactgtgcagggaaacgcccggatctctgagacacatctgcaggcacaagttcagtcctctaataatgatgaaggcaggccacagacgttctcctag

SEQ ID NO: 34324 - DNA, 2067 bp, Artificial Sequence
  Description of Artificial Sequence: Synthetic coding sequence
atggaccgctgcaaacacgtaggccgcctccgattggcccaggaccattccatactgaatccacagaaatggtgttgcctggagtgtgcgacaacggaatctgtatgggcgtgtttaaaatgctcgcacgtcgcctgcggccgctacattgaagaccatgctctgaagcacttcgaggaaactggccaccctctcgccatggaggtcagagacctgtatgtgttctgctatctgtgcaaggattatgtgttaaatgataacccggagggggacctgaaactgctgcggtcaagccttctagcagttcgtggtcagaaacaggacactcccgtcagaagaggacggacacttagatccatggccagtggggaggacgtggttctgccgcagagagcgccacagggacagccccagatgttgactgccttatggtaccgccgacagagattgctcgccaggaccttgcgcctctggttcgaaaagtcttcaaggggccaggccaagttggagcagcgtcgccaagaggaggcactggagcgcaagaaagaggaggcccgtaggaggagacgggaggtgaagagaagactgctcgaggaactggcttctacaccaccacgaaaaagcgcgaggttgttgcttcatactccgagagatgcaggtcctgccgcttcacgacccgcagcgctgcctacctctcggagggtacccgcggctacccttaagttacgacgtcagcctgccatggcccccggtgtgacgggactgaggaacctgggaaacacatgttacatgaactccattctgcaagtactaagtcacttacagaaatttcgcgaatgttttctcaacctcgatcccagcaaaaccgagcacctgttccccaaagccaccaatggaaagacccagctgagtggcaagcctaccaattctagcgccacagaactgagcctccgtaatgaccgagctgaggcctgtgagagagaggggttttgttggaacggaagggcctcgattagcaggtctctggagctcatccaaaacaaggagcctagctcgaaacacatctccctttgccgtgagcttcacaccctgtttagagtgatgtggtccggaaagtgggctctcgtctcaccgtttgctatgctgcacagcgtctggtctttgatccccgcattcagaggttatgaccagcaggatgctcaggagttcctttgtgaattgctccataaggtacagcaggaactagaatcagaggggacgacccggcgtatcctgatccccttcagtcagcggaagctcacaaagcaggttcttaaagtggtgaatacaatattccacgggcagctgttaagtcaggtgacttgcattagttgtaactacaagagcaacactatcgagccgttttgggacctgtccctggagttcccagaacggtatcactgtatcgagaaaggatttgtcccattgaatcagacagagtgcctgttaacggagatgctggccaaatttacagagacagaggctctcgaaggtagaatttatgcttgtgaccagtgtaacagtaaacgccgtaaatccaatcccaagccacttgtgctgtctgaagccagaaagcaattgatgatttacaggttgccccaggtgctacggctgcacctcaagcgatttaggtggagcggacgcaatcacagggaaaagataggcgtgcacgttgtgtttgaccaggttctcaccatggagccctattgctgcagagatatgctcagttcgctggacaaggaaaccttcgcatatgacctgtcggctgttgtgatgcatcatggaaaaggcttcggatcagggcactatactgcctattgttataataccgagggtggattttgggtgcactgcaacgactccaaactcaacgtttgttctgtggaagaggtgtgcaagacccaggcctatatactgttctacactcagcgtactgtccagggcaatgcccggatctctgagactcatctgcaggcacaagtccagtcatcaaacaacgacgagggtaggccccaaaccttcagttag

SEQ ID NO: 34325 - DNA, 48 bp, Artificial Sequence
  Description of Artificial Sequence: Synthetic coding sequence
atggatagatgcaaacacgtgggaaggttaagactcgctcaggattag

SEQ ID NO: 34326 - DNA, 114 bp, Artificial Sequence
  Description of Artificial Sequence: Synthetic coding sequence
atggatagatgtaagcatgttggccgcttgcgtctggcacaggaccactctattctcaacccccagaaatggtgttgcttggaatgtgccacaaccgaatccgtgtgggcctag

SEQ ID NO: 34327 - DNA, 1005 bp, Artificial Sequence
  Description of Artificial Sequence: Synthetic coding sequence
atgactagccagccgtcgctgccagccgacgatttcgacatctaccacgtcttggcagagtgtacagactactacgataccttgcccgtgaaagaagcagacgggaatcagccacacttccagggcgtgacaggtctgtggaacctggggaatacttgctgcgtcaacgccattagccagtgtctgtgttcaattctacccttagtggagtatttcttaaccgggaaatacataacggcccttcagaacgactgcagcgaggtcgctacagcttttgcctatctgatgacagacatgtggctgggcgattccgactgcgtgtctcccgagattttttggtcggcattagggaacctgtaccctgcattcacaaagaagatgcagcaggacgcgcaggaatttctgatctgtgtccttaatgaactgcatgaggcccttaaaaagtatcactacagtcggcgaagatcatatgagaaaggtagcacgcaaaggtgttgcaggaaatggatcacaaccgagacatctattattacccaactgtttgaggagcagctcaactatagcattgtctgcctcaaatgcgaaaagtgcacatacaaaaacgaggtcttcaccgtttttagcctgcccatcccgtctaaatatgagtgcagcctgagggattgtctccaatgcttctttcagcaggatgccctgacgtggaataacgaaattcattgcagcttctgcgagacgaagcaagagaccgctgtccgcgcttctatcagtaaagccccaaaaataataatctttcaccttaagcggttcgatatccagggtactacgaaacgcaagctgaggaccgatatccactacccactcacaaacctcgatctgactccatacatctgtagcattttcaggaagtaccctaaatataacctctgtgctgtcgtcaaccacttcggcgacctcgatgggggccactacacagcattttgcaaaaacagcgtaacgcaggcatag

SEQ ID NO: 34328 - DNA, 2136 bp, Artificial Sequence
  Description of Artificial Sequence: Synthetic coding sequence
atggcacaggtgagggaaacttctttaccatcgggcagcggagtgagatggatctctgggggcggtggtggagcttccccagaagaagccgtagaaaaggctggcaagatggaggaagctgccgccggggcaactaaggcttcttcccggagggaagctgaggaaatgaagcttgagcctttacaagagagagaacctgcccctgaggagaatctcacatggtcttcctctggtggggatgagaaggtcttgccatccatccctctgcgctgtcactcatccagctcgcctgtctgcccgcgtaggaaaccaaggccgcgaccgcaaccgagagcgaggagccggtctcagccaggactcagtgcccctccacccccacccgcccggcctcccccacccccaccaccaccccctcctccagctccccggcctcgcgcttggcgcggaagccgccggcggtcgcggccaggttctcggcctcagactcgccgatcatgctccggcgaccttgacgggagtggcgaccctggcggcctcggggattggctgctggaggtcgaatttggtcaaggccccacaggatgctcccacgtggagtcgttcaaagttgggaaaaactggcagaaaaacctcaggctaatttaccaacgctttgtgtggagcggcacccccgagacacgtaagcggaaagcgaaaagttgcatctgccatgtgtgcagcacgcatatgaataggttgcattcatgcctgtcatgcgtattctttgggtgtttcactgagaagcacatacacaagcacgccgaaacaaaacagcatcatctcgctgtggatttataccatggggtcatctattgtttcatgtgcaaggactatgtttatgacaaagacattgagcaaattgcaaaggagacaaaggaaaagatccttcgcctcttaactagcacatctacagatgtgtcccaccagcagtttatgacaagtggtttcgaagataagcagtccacgtgcgaaacaaaggagcaagaacccaaactcgttaaacctaaaaaaaaaagacgaaagaagtcagtttacaccgtgggcttacgcggactgatcaatctggggaacacttgtttcatgaattgcatcgtccaggctcttacccacattccactactcaaagatttctttctgagtgataagcacaaatgtattatgacttccccctcattgtgtctggtctgtgagatgtctagcctattccacgccatgtactctggtagccgcactcctcacattccctacaaactacttcacttgatctggatacatgccgaacacctcgctggttatcgtcagcaagatgcccacgagtttctgattgcaatcctagatgtgcttcaccgccactccaaagacgatagtggtggccaagaggcgaataatccaaactgctgcaattgcatcattgatcagattttcaccggaggtctacagtctgatgttacctgccaggcatgccactctgtttccaccaccatagatccttgttgggacattagcctggatctgcctggttcttgtgctactttcgacagtcaaaaccctgaaagggcagattctactgtgtcacgcgatgaccatatcccaggaattcctagtctgaccgactgtctccagtggtttacgagacctgaacacttagggagttctgccaaaattaagtgtaacagctgccagagctaccaggaatctactaagcagctgacaatgaagaaactgccaatcgtggcctgcttccacctgaagcggtttgagcacgtaggcaaacagcggaggaaaatcaatactttcatttcctttcccctagagttagatatgacaccttttctagccagcaccaaggagagtcggatgaaggagggacagcctcctactgactgtgtgcctaatgaaaataaatactctctcttcgcagtcataaaccaccacggaaccctggaaagtggccattacacctcctttatccggcagcagaaggaccagtggttctcctgtgatgacgccattatcaccaaagcaaccattgaggacctgttatatagcgaggggtacctgctcttttaccacaagcagggcctggaaaaagactag

SEQ ID NO: 34329 - DNA, 3222 bp, Artificial Sequence
  Description of Artificial Sequence: Synthetic coding sequence
atggcctgggtcaaatttctcaggaagccaggaggaaatttgggaaaggtgtaccaaccaggaagcatgctctccctagcacctacgaagggcctcctcaatgagccagggcagaacagctgctttctgaacagcgccgtgcaagtcctttggcagctggatatttttcgaagaagcttgagggtcctgaccggtcatgtctgtcaaggggatgcttgcatcttttgtgcgctgaagacgatctttgctcaatttcaacattcacgcgaaaaggccctaccaagcgacaatatccggcatgctctggctgaatcattcaaggacgaacagcggtttcagttaggactcatggatgatgccgcagagtgttttgaaaacatgctggaaaggatccacttccatattgtcccttcacgagacgcggatatgtgtacaagtaaaagttgcatcactcaccagaagttcgcaatgacattgtacgagcagtgcgtatgtcggtcgtgtggggcaagcagtgaccctttaccgttcacggaatttgtgaggtatattagcaccactgccttgtgcaacgaagttgaaaggatgctcgaaagacacgaacgcttcaaacccgagatgttcgctgaacttttgcaggccgccaatacaaccgacgattacagaaaatgtccatccaattgcggccaaaaaatcaagattaggagagtgttaatgaactgtcccgaaatcgtgaccatcggcctggtctgggactcagagcacagtgacctgacagaagccgtagtgaggaacctggccacgcatctatatcttccaggactgttttatagggtcactgatgagaacgccaaaaactctgaactgaacctggtagggatgatttgctatacgagccagcactactgcgccttcgcattccatactaaatcctctaaatgggtgttttttgacgatgccaatgttaaggaaatcggcacacgttggaaagacgtcgtaagtaagtgtatccgctgtcattttcagccgcttctgctgttctatgcaaatccagacggtaccgcggtgagcaccgaagacgctctacgtcaggtgatctcctggtcccactacaaatctgtcgccgagaatatggggtgcgagaagcctgtcattcataagtctgacaatctcaaggaaaatggatttggtgaccaggcgaaacagagagaaaatcagaaatttccaactgacaatatcagcagtagcaaccgatcacacagccataccggcgtgggcaagggtcctgccaagctttcacacatcgaccagcgcgagaaaattaaggatataagcagagagtgtgctcttaaagccatcgagcaaaagaatcttttatcctctcagcgcaaagacctagaaaagggacagcgcaaagatctgggccggcatagggaccttgtcgacgaagacctgagccacttccagagtggcagccctccagctccgaatgggtttaaacagcacggtaacccacacctgtaccattctcagggaaagggctcatataagcacgacagagttgtcccgcagtctagagcaagtgcgcagataatctcctcttccaaaagtcagattcttgcccccggcgagaagatcaccggtaaagtgaagagcgataacggcactggctatgacacagactctagtcaggatagccgggatcgcggcaattcatgtgactcctcatcaaagagcagaaatagaggatggaagcctatgcgcgaaaccctcaatgtcgattccattttcagtgaatcagaaaagcgacagcactctccgcgccacaaaccaaacatctccaataaacccaaaagcagcaaggacccttctttttcgaactggcccaaagagaatccaaagcaaaagggacttatgactatctatgaagatgaaatgaagcaggagatcgggagcaggagcagtctggaatccaacggaaaaggagcagaaaagaataaaggcctagtggagggaaaggtacacggtgacaattggcagatgcaacgaacagagtcaggttatgaaagcagtgatcacattagcaatgggagcactaatttggattctcccgtaatcgacggtaacggcacagtgatggacatcagcggggtgaaggagactgtctgtttctcagaccaaattactacatcgaacctgaataaagaacgaggcgattgtaccagcctccagagtcaacaccacctggaggggttccgcaaggagctcagaaatctggaagctgggtataagagtcatgagttccaccctgaaagccacctacagattaagaatcacttaatcaaaaggtcccatgttcatgaagacaatggaaaactttttcctagctccagcctgcagattcctaaagatcacaacgccagagaacacatacatcagtcagacgaacagaaactcgagaagcctaatgagtgcaaattttccgaatggctcaatattgaaaattctgaacgcacaggacttccattccacgtagacaactcagccagcggcaagcgagtgaacagcaacgaaccatcttccctgtggagttcccatctacgcacagttggacttaaaccagagactgcacctctcatccagcagcagaatataatggaccagtgttactttgagaattccctctcaaccgaatgcattatccgcagcgcttccagatccgacggctgccagatgccaaaactgttctgtcagaatctgccacccccattacctcccaagaaatacgccattactagcgtgcctcagtcagagaagagcgagtccacacctgacgttaagctgaccgaagtctttaaagcaaccagtcacctccccaagcactctttgagtacggcgagcgaacctagccttgaagtgagcacccacatgaacgatgagagacataaggaaacgtttcaggtcagggagtgtttcggcaatactccaaattgcccctcttcgtctagtacaaatgacttccaggctaatagcggtgcaattgacgccttttgccaacccgagcttgactctataagcacctgccctaatgagactgtttcgcttactacctactttagtgtggacagctgtatgaccgacacctaccgactgaagtaccatcagagaccgaaactgagcttcccagagagttctggattctgcaacaacagcctgtcttag

SEQ ID NO: 34330 - DNA, 3222 bp, Artificial Sequence
  Description of Artificial Sequence: Synthetic coding sequence
atggcttgggtgaaatttcttcggaagcccggtggcaatcttggaaaagtgtatcagcctggaagtatgctaagtctggctcccacgaaaggtctcctcaacgagcccggtcagaacagttgcttcctcaattctgcagttcaggtgttgtggcaactggacattttccgccgctcgctgcgagtgttgaccggtcacgtttgccagggggacgcctgcatattttgcgcgttgaaaaccatcttcgcacagtttcaacatagtcgcgaaaaagcactgccatccgataatatacgccacgcgttagccgaatcattcaaagacgagcagagattccagctgggcctgatggatgatgccgcggagtgttttgagaacatgttggaacgcatccacttccacattgttcctagccgcgatgccgacatgtgtacgtctaagagctgcattactcaccagaaatttgccatgactctctatgagcaatgcgtgtgtcgtagttgcggcgcctcctcagacccattgccattcaccgaattcgtgagatacatctcaactacagctctctgcaatgaagttgagcggatgttagagagacatgagcgctttaaacctgaaatgtttgctgagctgttgcaagctgcaaacaccacagacgactacaggaaatgtccttcgaattgtgggcagaaaattaagatacggcgagttctgatgaactgtcctgagatcgtgaccattggactcgtgtgggattctgagcattctgaccttacagaggctgtagtaaggaacttggctacccacttgtacctgcctggactgttctaccgggttacagatgaaaacgccaagaatagcgaactaaatttggtcggaatgatctgttacacctcccagcactactgtgctttcgcctttcataccaagtccagtaaatgggtctttttcgatgacgccaatgtcaaagagattggtacccggtggaaagatgttgtttctaagtgcattcgctgccatttccaacccctgctactgttctatgccaatcccgacggtaccgccgtgtcgaccgaagatgctttgcgccaggtgatatcttggtctcactacaagagcgtcgcggagaatatgggctgcgaaaagccagttatacataaatccgataatctgaaagaaaacggtttcggagatcaggccaagcaacgagagaatcaaaagttccccactgataacatctcctccagtaatagatctcatagtcatacaggagtgggcaagggaccagcaaagctatctcacatagatcaaagggaaaagattaaggatatctcccgcgaatgcgccctgaaagcaatcgagcagaaaaatctgctcagctcccagagaaaggacctggagaagggccaacggaaggatcttggccgtcatcgcgacttagttgacgaggatttatcacacttccagagcggttccccgcctgctccaaacggttttaagcaacatgggaaccctcacctttatcattcccagggcaaaggctcctacaagcatgacagagtcgtaccccaatcgcgcgcctctgcgcagatcatctctagttcaaaatcgcaaattctagccccaggcgagaagattacaggcaaagtaaagtccgataacgggacgggatacgacacagacagcagccaggactcccgcgaccgggggaattcctgcgactcatcaagtaaatcacgcaatagggggtggaagcctatgcgcgagactctgaatgtagactcaatctttagcgaaagtgagaaaagacagcacagtccaaggcacaaacccaatatcagtaacaaacccaagagctcaaaagacccatcattctctaattggcctaaagaaaaccccaaacaaaagggcctcatgacgatatacgaagacgagatgaagcaggagattggatccaggtcctcgctagagtccaacggaaagggcgctgaaaaaaataaggggctggtggaaggtaaggtgcacggcgataactggcagatgcagagaactgagagtggatacgaaagtagcgatcatatcagtaatggtagtactaatctggactcacccgtcattgacggaaatggcacagtcatggacatatcaggtgttaaagagactgtgtgtttcagtgaccaaattacgacctcgaatcttaacaaggagcggggtgactgcacctccctccaaagtcaacatcacctggagggcttccggaaggagctgcggaatctggaggctggatacaagtctcatgaattccaccccgaaagtcatctgcagatcaaaaatcatctcataaaaaggtcgcacgtgcatgaagacaacgggaagctttttccttcctccagcctgcagattccaaaggaccacaacgctcgggagcacattcatcagagtgacgagcagaagttagagaaaccaaacgaatgtaagttctctgaatggctgaacattgagaatagtgaacggacaggactcccatttcatgtagacaatagtgcctcaggcaaacgcgtcaacagtaatgagccatctagcctgtggtctagccacttgcggaccgtgggcctaaaaccagaaaccgccccactgatccagcagcagaacattatggaccagtgctactttgagaacagcttgtccaccgagtgcattattaggtccgcctcccggagcgacggctgccagatgcctaaactcttttgccaaaatctacccccaccccttcctccgaaaaagtatgctattacctccgttcctcagagtgagaagagcgagtctacacccgatgtcaaactgaccgaggtgttcaaggcgacctcacatctccccaagcattccttatccacagcctccgaacctagtcttgaagtgagcacccacatgaacgacgagaggcacaaagaaaccttccaggtccgcgaatgtttcggcaacacacctaactgtccgtcatcctcgagtacaaacgatttccaggccaacagcggggctattgatgccttctgtcagcccgaactggattccatcagcacatgccctaacgagactgtgagcctcaccacgtacttcagcgtagactcctgcatgacagacacatatcgcctgaaatatcatcaaagaccaaagctaagtttccccgagtcctccggcttctgcaataactccctatcttag

SEQ ID NO: 34331 - DNA, 2235 bp, Artificial Sequence
  Description of Artificial Sequence: Synthetic coding sequence
atgtcttggaagcgcaattattttagtggcgggcggggctcagtacaaggaatgtttgccccccggagctctacctctatagctcctagtaaggggctgagcaatgaaccaggtcagaactcatgttttctgaacagtgctctccaggtgttatggcatctcgatatatttcggagatcctttcggcaattgactactcacaaatgtatgggcgactcatgtatattttgcgcattgaaggggatattcaaccaattccagtgttccagcgaaaaggtattgcccagcgataccctgcggagtgccttggccaaaacgtttcaggatgagcagaggttccagctgggtataatggatgacgccgcagaatgctttgaaaatctactcatgagaattcattttcatattgctgatgaaaccaaggaagacatctgtactgctcagcactgcatatcccatcagaagttcgctatgaccctttttgagcagtgcgtatgcacttcatgcggggcgacctcagacccactgccattcatccagatggttcactacatctccactacgtccctttgtaaccaagcaatttgtatgctagagcgcagagaaaaacccagcccatccatgttcggagaattactgcagaatgctagcacaatgggtgacttgcggaattgccctagcaactgcggagagaggatcaggattaggcgggtcttaatgaacgcaccacagataatcacaatcgggctagtgtgggactccgaccattctgatctggccgaagacgtgatccattccctgggaacatgcctgaaattaggcgacctgttcttcagggttaccgacgacagagctaaacaaagcgagttgtacctcgttggtatgatctgttattacggcaagcactactctaccttcttctttcagaccaagatccgcaagtggatgtacttcgacgatgcacatgttaaagaaatcggacccaagtggaaggatgtggtaaccaagtgcattaaaggccactatcagcctctgctccttctgtacgcagacccccagggaactcccgtcagcacacaggatctgcccccacaagcggaattccagtcttattctagaacatgttatgattccgaggactctggacgcgagccctccatctctagtgatacgaggaccgacagcagcaccgagtcatatccatacaaacatagtcatcacgaaagcgtcgttagccacttctcttccgactcacaaggtacagtgatatacaatgttgagaacgattctatgtctcaaagttcacgggacaccgggcacctcacagattccgagtgtaaccagaagcacacctccaagaagggttccctgatcgagagaaagcgctcgtcaggtagagtgaggcgcaagggggacgagccccaagcttctggttaccactcagagggcgaaacccttaaagaaaagcaggctccaagaaacgcatctaaaccttcatcctccacaaacaggttgcgggatttcaaagagaccgtgagtaatatgattcacaataggccgagcctagccagtcagacaaacgtggggtcccactgcagaggtcgcggcggtgaccagcctgataagaaacctccacgcacactgcccctgcatagccgggattgggaaatcgagtcaacctcgtcagagagcaaatcttccagtagcagcaagtacagacccacctggcgccccaaaagagagtccttgaatatcgatagcattttttctaaagacaagaggaaacactgtggctatacccaactctccccttttagcgaagattctgcaaaagagtttatccctgacgaaccttctaagcccccctcatatgatatcaagtttgggggaccaagcccccagtacaagcgatggggaccggcgcggcctgggtcacacctcctggagcagcacccacgtttgattcaaaggatggaaagtggttacgagagttccgaacggaatagctcatcgcctgtgagcctcgacgccgctttaccagaatcgtccaacgtttataggtattgcctggcattcgaacagcagcattgtctgctccagcagtgcgagccccccacttggggctttcaggcatggctgagacaagtcgaaggctggccactgctgctcagcctgtgtgcgctgagcacaagttacaacaattcaaccctgtgctggaagaaccggggaacttag

SEQ ID NO: 34332 - DNA, 5055 bp, Artificial Sequence
  Description of Artificial Sequence: Synthetic coding sequence
atgtcttggaaaaggaactattttagtggtgggcgcggtagcgtgcagggtatgttcgctcctagatcatctacctcgattgccccctctaaggggctgtctaatgagcccggtcaaaattcctgttttttgaactcagccctacaggtgttatggcatcttgatatcttccgtcgcagtttcaggcaactcacaacccacaaatgcatgggggattcttgtatcttctgtgctttgaagggaatcttcaatcagtttcagtgctcctctgaaaaggtattgccaagcgacacgctgcggagtgcacttgctaaaacgttccaagatgaacagaggttccagctgggcatcatggacgatgccgcggaatgcttcgagaacctgttgatgaggatccacttccacattgcagacgagaccaaagaggacatttgtaccgcccagcattgtatttcacaccagaagttcgcaatgaccttatttgagcagtgcgtgtgcacatcctgtggcgccacaagcgaccctttacccttcatacagatggtgcattacattagcactacctcactgtgcaaccaggcaatctgcatgctcgaacggagggaaaagccttctccctctatgtttggcgaactgttgcagaatgcatctaccatgggcgatctgaggaattgcccttcaaattgtggggagagaatccgcatccggagggtcctgatgaacgcaccccagatcatcacaatagggctggtgtgggattccgaccactcagatctggctgaggacgtgatccactctctggggacttgtctgaagctcggggatctctttttcagagtgacagacgaccgagccaagcagagtgaactgtacctcgtcggcatgatttgctactacgggaagcattactcgaccttcttttttcagacgaagatcaggaagtggatgtatttcgacgacgctcatgttaaagagatcggccccaagtggaaagatgtggtgacaaagtgcattaaaggacactatcagcctctgctgctcctgtatgccgacccccaggggacacctgtgtcaacccaggacttgcctccacaagctgaatttcagtcttactcccgcacctgctacgattcggaggactccggccgagagcccagcatttccagtgacaccaggaccgattcatcgaccgaatcttacccatacaaacactcacatcatgagagcgtagtctcgcacttctcatctgattcgcaggggactgtgatctataatgtggagaacgattctatgagccagtcaagccgcgacacgggccatttgacagactctgaatgcaaccagaagcacacgtcaaaaaaggggagcctgattgagaggaagagaagctcgggtagagtgaggcggaagggcgacgagccccaggcatcaggataccactccgagggggagaccctgaaagaaaagcaggcgcctcgcaacgcatccaaaccgagctcatctactaatagactgcgcgatttcaaggagactgtgtcaaatatgatccacaatcgcccatccctcgcttcacagactaacgtgggttcacactgccgcggacgaggtggcgaccagccggataaaaagccgccacggactttgccacttcattcaagagactgggaaatcgagtctacatcttctgagtccaagtcttcatcctcaagcaaatatagacccacatggcggcccaagcgggagtccctgaacatcgatagtattttttcgaaggacaagagaaaacactgcggttacacccagctgtccccattttcagaggacagcgccaaggaattcattcctgacgagccttcaaagcccccttcttatgacatcaagtttggcggtccgagcccgcagtacaaacggtggggacctgctagaccaggttcccatctcttagaacaacacccccgcctgattcaaaggatggagtcaggctacgaatcctctgagaggaatagttcttcacccgtgagcctcgatgctgctttgcctgagtcttccaatgtgtacagggatccatccgctaaacggagtgcgggactggttccatcatggcggcatattcccaaatcccattcatcctccattctagaggtggattcaaccgcttctatgggaggttggaccaagtcccagccattttcaggcgaagagatatccagcaaaagcgaactggacgaattacaggaggaggtagcgagacgtgcccaggaacaggaactacgtaggaaacgagagaaagagttggaggccgccaagggattcaaccctcacccttcaagatttatggatttggatgagctccagaatcaggggagatccgacggtttcgaaaggagcctccaggaggccgaatcagtctttgaggagtcccttcatttggaacagaaaggcgactgcgccgccgccttggctctatgcaatgaggccatatctaagcttcgcctcgcccttcatggggcatcttgcagcacccatagccgagctctggttgataaaaagctccagatttcaatacggaaagctcggagtttgcaagacagaatgcagcagcaacagagcccacagcagccatctcagccgagcgcatgcttgccgactcaagccggcactcttagccagccgacctccgaacagccaattcctctccaagtgctcctctcccaagaagcccagctggaatcaggcatggacaccgagttcggggcctcatcattctttcactctccggcaagttgccacgaatcacactcctctctctcccccgagagtagtgcaccccagcacagtagcccatcacgcagcgctcttaaactgttaacatctgtcgaggtggacaatatcgagcccagcgcctttcatcgccaaggcttgcctaaagcgccagggtggaccgagaagaactctcaccactcatgggagcccctggacgctcctgagggtaaattgcagggatcaagatgtgataattcttcatgcagcaagctccccccgcaggaaggtcgaggaatcgcccaagaacagctattccaggaaaagaaagacccagctaatccaagtccagttatgccaggcatcgctacctccgagcgcggtgatgagcacagcctgggctgttccccgagcaactcctctgcccaacctagtctaccgttgtaccgcacttgccatcccattatgccagtggctagcagcttcgtgctccattgtcctgacccagtccagaagacaaatcagtgcttacaaggacagtcattaaaaactagcctgactctgaaggttgaccgagggagcgaagaaacatacagaccggagttccccagcacaaagggcctggtaagatcactcgccgagcagttccagaggatgcagggagtgagcatgagagactcaaccgggttcaaagatagaagcctgtcagggtccttacggaagaattcttctccctcagactcaaaacctccattctctcagggtcaagagaaaggccattggccatgggccaagcagcagtcctcattggaagggggtgatagacccctgtcctgggaagaaagcacggagcactcctctttagcgctgaatagtggcttaccaaatggcgagacttcttctgggggacagcccagattggccgagccagacatttaccaagaaaagctgtcccaggtgagggacgtgcgcagcaaagatctagggtctagcacggacctcggcacatcactcccactggattcctgggttaatatcacaagattttgcgactctcagctgaagcacggcgcccctaggcctggaatgaagtctagcccccatgattcccacacctgcgtgacctaccctgagcgtaatcatattctcctgcatcctcattggaaccaggatactgagcaagagacctcagagctcgagagcctgtatcaggccagccttcaagcttcccaggccgggtgctcaggctggggccagcaggatacagcctggcatcctttgagccagacaggcagcgccgatggcatgggccggaggctacatagcgctcatgatccgggcctgagcaagacctccactgcagagatggaacacggcctgcatgaagcacgaacagtgcgaacatctcaggcaacaccttgtcgaggactcagccgcgaatgcggcgaggacgagcaatactcggctgaaaacttgaggcggatttcacggtccctttctggcaccgtggtctccgaacgggaagaagcacctgtcagctcccattcatttgattctagtaatgtgcggaagccccttgagactggtcatcgctgttcttcttcatcctcattaccagtgatccatgatccaagtgtctttctcctcggaccgcagctgtacctcccccagccacagtttttatcccctgacgtgcttatgcccacaatggcaggggagccaaaccgcttaccagggaccagtcgctcagtccagcaattcctggctatgtgtgacagaggagagacctcacagggggccaaatatactgggcgtactctcaattaccagagtctgccacaccgtagccgaaccgataacagctgggctccctggtccgaaactaatcagcacataggaacacgctttctgactaccccgggatgtaacccccagttaacttacacagccaccctccccgaacgctctaagggcctgcaagtaccccatacacagagctggagcgatctcttccatagcccctcccatccgcccattgttcatcccgtgtacccgccttcaagctctttacatgtgccactgcggagcgcttggaattcagaccctgttcccggatcacgaaccccagggccacgccgggtcgacatgcctcccgacgatgactggcgtcagtctagctacgccagccattctggtcatcgtaggacagtgggcgaggggttcctgttcgtgctttcagacgccccccgacgcgaacagatcagagcccgggtcctacagcacagccagtggtag

SEQ ID NO: 34333 - DNA, 2178 bp, Artificial Sequence
  Description of Artificial Sequence: Synthetic coding sequence
atggacactgagttcggtgccagctccttttttcattccccggcgagctgccatgagtcgcatagctcgctctctcccgaaagctccgccccacaacattcctcccccagcagatcggccctgaaactgttaacctcagtagaagttgacaatattgagccatcggccttccatcgccagggactgcccaaagcgcccgggtggaccgagaagaattcgcaccacagctgggagccgctcgatgcaccagagggaaagctccaaggatcccggtgcgataacagtagttgtagcaaattgccgccacaagaaggacgaggcatcgcccaggagcagctgttccaggagaagaaggaccccgctaaccccagtcccgtgatgcccgggatcgccacgtctgaacgaggggatgagcattcactggggtgttcacccagcaatagctctgcccaaccgtccctcccattataccggacttgtcatcccatcatgcccgttgcttcatcgttcgtgctgcattgccctgatcccgtgcaaaagacgaaccagtgtctgcagggacagtctctgaagaccagtctcaccctcaaggtggataggggcagcgaagaaacctataggcccgagttcccttctaccaaaggtcttgtccgctctctggccgaacaatttcaaagaatgcagggagtgagcatgcgtgacagcactggcttcaaggacaggtccttgagtggttctctccgaaagaactcttcccccagtgattccaaaccgccattttctcaggggcaggaaaaggggcactggccctgggccaagcaacagagctcattggaaggcggcgatcgccccctctcgtgggaggagtctaccgagcatagctctctcgcattgaactccggactgccgaacggggagacttcctcaggaggacagccgcgacttgccgagcctgacatctaccaggaaaagctgtctcaggtgagagacgtacgaagcaaggaccttggaagtagtaccgacctgggaacttcgctcccactggactcctgggtgaatatcaccaggttttgtgattctcagctgaaacatggggccccaaggccagggatgaagagtagtccccacgatagtcatacctgtgtaacctatccagaacggaaccacatactcctgcacccacactggaatcaggatactgaacaggaaacatcggaacttgaatcactttaccaagcttccctgcaggcctcccaggcaggctgttctggctggggccagcaagacacggcgtggcacccgctatcccagacgggcagcgcagacggtatgggtcgtagactccatagcgcccatgaccccggcttgagcaaaaccagcaccgcggagatggaacacggtcttcacgaggccagaaccgtcaggactagtcaggactctagcaacgttaggaaacctttggaaaccgggcatcgatgctcatcttcatcgtccttacccgtgatacatgatccgtccgtcttcctgctgggcccccagctgtacctgccccagccacaattccttagcccggacgtgctcatgcctacaatggcaggagagcccaatcgcttgccaggcacatcaagaagcgtgcagcagttccttgccatgtgcgataggggggagacaagccagggagccaaatataccggacgcaccctgaattaccagagtttgccacacaggtcccgaacagataatagttgggccccttggtctgagactaaccagcacattggcacgcggtttcttacgacccctgggtgcaatccccagcttacctacactgcaacgctgcccgagaggagtaagggtcttcaagtgccacatacacagtcctggagcgacctattccattccccatctcaccccccaattgttcaccctgtctatcctccgtccagtagcctccatgtcccacttcgctctgcttggaactcagatccggtgccaggcagtcggactccgggcccacggcgggttgacatgccccctgatgacgattggcgacagtctagctacgcctcccacagcggacaccgcaggaccgtcggagaaggcttcctgttcgtgttgagtgatgccccccggcgcgagcagattagggcccgtgtgttgcaacattcacagtggtag

SEQ ID NO: 34334 - DNA, 5055 bp, Artificial Sequence
  Description of Artificial Sequence: Synthetic coding sequence
atgtcctggaaacgcaattacttcagcggcggccgcggtagcgtgcagggaatgttcgcccccagaagcagcacctcgatagccccctccaagggcctctccaacgagccgggacaaaattcttgtttcttgaatagtgctttgcaggtcctgtggcatttggatatctttcgtcggagttttcgacagctgaccacccacaagtgcatgggcgatagctgcattttctgcgcccttaagggcatcttcaatcagtttcaatgcagtagtgaaaaggtgctccctagcgacaccctcagatctgccctggccaagactttccaggacgagcagagatttcagctgggtattatggacgatgctgcggaatgtttcgaaaacctgctgatgcggattcatttccacatcgccgatgaaactaaggaagacatctgcactgcacagcactgcatcagccaccagaagtttgccatgaccctcttcgagcagtgcgtgtgcacatcttgcggggccaccagcgatcctttgccttttatccagatggttcattacataagtactacatcgctgtgcaatcaagccatctgtatgttagagcggcgcgagaagccttctccatccatgttcggcgaattattacagaatgcctctactatgggagacttgcggaactgccctagcaactgcggagaacgtattcgaatccggcgagttctcatgaacgctccgcagattataacgattggactggtctgggattccgaccattcagacctagcggaagacgtcatacatagcctcggcacctgcctcaagcttggcgacctgttttttagggtcaccgacgaccgggctaagcagtcagagctgtatctggttggtatgatctgttactacggaaaacactatagtactttcttttttcaaacaaagataagaaaatggatgtacttcgatgacgcccacgtaaaggaaataggacctaaatggaaagatgtagtgacgaagtgtatcaaggggcattatcagccacttttgctcttatacgcggaccctcagggaacaccagtgtccacccaggacttgccaccccaagccgaattccaaagctactccaggacctgttacgactccgaagactccggaagagaacccagcatctcttctgatacaaggaccgattccagtaccgaatcctatccctacaaacattcacaccatgagagcgtcgttagtcacttttccagtgacagtcaaggaaccgtcatctacaacgttgagaacgattccatgagtcagtcctctcgggacactggacatttgacggattctgaatgcaaccagaagcatacgtccaagaaaggcagcctcattgagaggaaaagatcatcgggtcgggttagacgcaagggcgacgagccgcaggcatctgggtatcactcagagggagagactctcaaagaaaagcaggcacctcgaaacgccagcaagccgagctcaagtaccaacaggctgcgggatttcaaggagactgtgtccaacatgatccataatagaccttctctcgccagtcagacaaacgtcgggtcccactgtcggggcaggggcggcgatcagccagataagaaaccaccacgaactctacctcttcattccagggattgggaaatagagagtacttcttccgagtccaagtcgtcttcttccagcaaataccgccctacgtggaggcctaaaagagagagtctgaatatagattcaattttttctaaggataagcggaaacattgtgggtacacacaattaagtccgttttctgaagatagtgcaaaggagtttattccagacgaaccatctaagcctccatcttacgatattaagttcggtgggccctctcctcagtacaaacggtggggacccgccagacctggtagtcatttgttagaacagcatccccggctcatccagcggatggaatccggctacgaatcttctgagagaaactcctcatcgccagtctccctcgatgcagctctgcctgagtcttcaaacgtctaccgagatccctccgctaagcggtccgctggattggtgccgtcctggcggcacataccaaagagccacagctcgtccatactcgaggtggactccactgcatcaatgggcggctggacgaaaagccagcccttcagtggcgaggagataagctcaaaaagcgaactggacgaacttcaggaggaagtggctagaagagcgcaggagcaggaattacgcagaaaaagagagaaggagcttgaagccgccaaagggtttaatccgcacccaagcagatttatggatctagatgagcttcagaaccagggccgctccgacgggttcgagcgctccctgcaagaagcggaatcagtgtttgaggagtccctgcacttggagcagaagggcgactgtgctgcagccctggccttatgtaacgaggccattagcaagcttagactcgcgttacatggagcaagctgttcgacacacagccgtgcattagtagataaaaagctgcaaattagcattagaaaggccagatcactgcaggacaggatgcagcagcaacagagtccacagcagccttcccaacccagcgcctgcctgccaacccaggccggtactctgtcgcagcctacatccgaacagcccattcctttgcaggttctcctgagccaggaggcccagttagaatccgggatggacaccgaattcggagcctcttccttcttccactctccagcaagttgtcacgaaagtcattctagcttgagcccagaatctagtgctccccagcacagttctcccagccgatcagcattgaaattattgacctccgtagaggttgacaatatcgagccctcagcctttcaccgccaaggactccccaaggcccccggttggaccgaaaagaattcccaccactcatgggagcccctggatgcccctgaggggaaacttcagggcagccggtgcgacaattcctcgtgtagcaagctgcctcctcaagaaggccgggggatcgcgcaagagcagctgtttcaggaaaagaaagacccagcgaacccatcccccgttatgccaggcatagcaaccagtgaaagaggagatgagcactccctgggctgttccccttctaattcaagcgcacaaccctccctgccactatatagaacctgtcacccaattatgcccgtggcctcatccttcgtgctgcattgccccgatccggtccagaaaaccaaccagtgcttacagggacagagtttgaagacgagcctgaccctgaaggttgatagaggtagcgaggagacgtaccgtccagaatttcccagtactaagggtctcgtgaggtctctcgccgagcagtttcagcgcatgcagggggtttcgatgagagactccaccggtttcaaggacaggtccctgagcgggtcgctcaggaaaaactcttccccatccgatagcaagcctcccttcagtcagggccaggagaaaggccactggccctgggctaagcagcaatcctctctcgaagggggagatcggcccctttcttgggaagagtctacggagcattcaagcctggcgctgaattcgggtcttcccaacggcgagacatcttctggaggacagcctcgactggctgagccggatatttatcaggagaaattaagtcaagttagagatgttcgctctaaggatttgggctcatctacggacttaggcacatcacttccactggactcttgggtcaacattacgcggttctgtgactcacagctgaagcatggggccccccgccccggtatgaagtcttccccccatgattcccatacttgtgtcacatatcctgaacgaaatcacattctgcttcatcctcattggaaccaagataccgagcaggagacttctgagctggaaagcctgtatcaggcaagcctacaggcatcccaggccggttgtagtggctgggggcaacaagacacagcttggcaccccctgtctcaaacgggaagtgcagatgggatgggacgccgattgcactctgctcacgaccccgggctcagcaagacaagtacagccgagatggagcacggactgcacgaggccagaacggtgagaacttcgcaggcgaccccctgtcgcggtctctctcgggaatgcggcgaggacgagcagtatagcgccgagaatcttcgcaggatttcgcgttcactttcaggcactgtggtgtccgagcgcgaggaggccccagtaagttcacactcctttgacagttctaatgttcgcaaacccctggagactgggcataggtgttcaagtagttcctcattacctgtcatccacgatcccagtgtgtttctgctgggaccccaactttatctgccacagccccagttcctcagtccagacgtgctgatgccgaccatggctggcgaacctaatagacttcccgggacttctagatcagttcagcaattcttggcaatgtgcgaccgaggggaaacttctcagggcgcgaagtataccggacgaacgttgaattaccagagtctgccacatagaagtaggaccgacaactcttgggcaccttggtcagaaacaaatcagcacatcggcacccgttttttgaccacaccaggttgtaatccccagctgacctacaccgcaacactgcctgagaggagtaagggtctgcaggtcccacatacacagagctggagtgaccttttccacagcccgtcgcatccacccattgtgcatcccgtgtacccaccctcctcaagtcttcacgtgcctttacggtccgcttggaattcggatccggtccctggatctcgaacccctggaccacgccgtgtggacatgcctccggatgacgactggaggcaatcctcgtacgcttctcattctgggcacaggcggacagttggagaggggtttttgtttgtcttgtctgacgctccccgcagggaacagatccgtgcacgggtgctccaacacagccagtggtag

SEQ ID NO: 34335 - DNA, 462 bp, Artificial Sequence
  Description of Artificial Sequence: Synthetic coding sequence
atgtcatggaagcgaaactacttctcaggggggagaggtagcgtgcaggggatgttcgccccacgcagctcaacctctatcgcaccctctaaaggcctctcaaacgagccaggtcagaacagttgtttcctgaatagcgccttgcaggttctctggcacttagacattttcagacgcagcttccgccagctcacaacccacaaatgcatgggggattcttgtatcttttgtgccctgaaagggattttcaatcagtttcagtgcagctctgaaaaagtgctcccatctgacactctaagatcggctttggcaaagaccttccaggacgagcaaaggttccagttgggcatcatggacgatgcggctgaatgcttcgagaaccttctgatgaggatccattttcatatcgcagatgaaactaaagaggatatctgtactgcacagcactgtattagccactag

SEQ ID NO: 34336 - DNA, 2460 bp, Artificial Sequence
  Description of Artificial Sequence: Synthetic coding sequence
atggacctggacgaactgcaaaaccaggcgaaactgaggcttgctttgcacggcgcgtcttgctccactcattcccgtgccctcgtggacaaaaaactgcagatatcaatccgcaaggcaagatccctgcaggaccgcatgcagcagcagcagtctccacagcagcccagccagcccagcgcttgtctgccgacacaggccggcacactgtcccaacctacatcagagcagcccataccacttcaggtgttgttgtcacaggaagctcagcttgagtcgggtatggacaccgaatttggcgcctcttcattctttcactccccggcctcctgccacgaatcccattcaagcctgagcccggagtcgtctgcaccccagcactcttcaccgtccagaagcgctcttaagctgttaacttccgtcgaagtcgacaatattgaaccttctgcattccaccgtcaggggcttcctaaagctcctggctggaccgagaaaaattctcatcactcatgggagcccctagatgcaccggagggaaagctgcaaggcagcagatgcgacaactcttcttgttctaaactacccccccaggaggggaggggaattgcacaggagcagctgttccaggaaaaaaaagaccctgcaaatccatcacccgtaatgcccgggattgcaacgtccgagcggggagacgagcattcgctgggatgctctccttctaactccagtgctcagcctagtttgcccttatatcggacatgccaccccatcatgcctgtggccagcagctttgttcttcactgccctgatccggtgcagaagaccaatcagtgtctgcaagggcaaagcctcaaaacatctttgactctgaaggtcgatcgaggtagtgaggaaacctaccgccccgaatttccaagtaccaagggacttgtgcgatctctggcagaacagttccaaaggatgcaaggcgtgagtatgagggatagcacagggtttaaggacaggagcctgagcgggtcccttcggaaaaattctagcccttccgactctaagccaccattcagccaggggcaagaaaagggccactggccttgggcgaaacagcagagctcactagagggtggtgatcgtcccctgtcctgggaggagagtaccgagcacagctcactggctttgaacagcgggcttcctaatggcgagactagcagtggtggacagcctcgtctcgccgagccggacatctatcaggagaagctgagtcaggtaagggacgtgaggagcaaggacctggggagctccacagatctcggaacatccctgcccctcgactcttgggttaacattacaagattttgcgattcccaactcaagcatggtgcaccacggccagggatgaaatcctccccccatgattcccatacatgcgttacttacccagaaaggaaccatattctcctgcaccctcattggaaccaggatacggagcaggagacctctgagctagagtctttataccaggcttcgctccaggcctcacaggctgggtgctccggttgggggcagcaggacacggcctggcacccgctgtcccagaccggcagtgctgacggcatgggccggagactccacagcgcacatgatcctggcctgtcaaaaactagtactgccgagatggagcacggtttgcacgaggcgcgcactgtgcgtacttcacaagacagttctaatgtgcggaagcctttggaaactggacacaggtgttcaagcagcagtagtctgccagtgatccatgatccctccgttttcttgcttgggccacagctctacctaccacaaccgcaattcctatcaccagatgtcttgatgccaacaatggcaggggaaccgaatagactgccaggcacgtctcgatccgtccagcagttcctggctatgtgtgacagaggagagactagtcagggtgcgaagtataccggcaggaccctgaattatcagtccctcccacaccgttcgagaaccgataattcttgggccccgtggagcgagaccaaccagcacatcggaacccgcttcttaacaacccctgggtgcaacccacagttaacctatacggccaccttgccagaacgcagcaaaggcctccaggtgcctcatacacaatcttggagcgatctgttccacagtcctagtcaccctccaattgtccaccctgtgtatcctcccagctcatcacttcacgtgccgctcagatctgcctggaattctgatccggtccccggtagccgcaccccaggcccgcggagagtggacatgcccccagatgatgattggcgccaatcaagctatgccagccacagcggccaccgcaggactgtcggtgaaggattcctatttgtcctgagtgatgctccaagaagggagcagatccgagccagggtattgcaacactcccaatggtag

SEQ ID NO: 34337 - DNA, 4605 bp, Artificial Sequence
  Description of Artificial Sequence: Synthetic coding sequence
atgagctggaaacggaattattttagcggtggccgcggaagcgtgcagggtatgttcgcccctcgaagtagtacgtccattgctcctagcaaaggtctgtccaatgagccaggccagaacagttgtttcctgaactctgctctgcaggtactctggcatttagatatattccgcagaagttttagacaactgactacgcacaagtgcatgggcgattcctgtattttctgtgccctaaagggcatcttcaatcaatttcagtgctcctcagagaaggtacttcccagtgacacacttaggtcagcgctggctaaaacctttcaggatgaacagagatttcagttgggaatcatggacgatgctgctgagtgcttcctgttcttcagagtgacagatgatcgcgccaaacaatccgagctgtatctcgtgggaatgatttgctattatggcaagcattactctactttcttttttcagacaaaaatccggaagtggatgtacttcgacgacgctcatgtcaaggaaattggccctaaatggaaggacgtcgtaacaaagtgtatcaaaggacactaccagcccctcctcctgctgtatgctgaccctcagggcactccagtttcaacacaggacctcccaccccaggctgagttccagagttattccaggacttgttatgatagcgaggattcggggagagaaccctctatttcctcagacacgaggactgattccagtacagaatcctatccttacaagcactcgcaccatgaaagtgtagtgtcacatttttcgagcgattcccagggtacagtcatctataatgtggagaatgattccatgagccagtccagccgtgatacagggcacctgacggatagcgagtgcaatcaaaaacacacaagcaaaaaaggctccctcattgaacgcaagcgctccagcgggcgtgttaggcggaaaggcgatgaaccgcaagccagtggttatcacagtgaaggggaaaccctcaaggaaaaacaggcaccacgcaacgcttcgaagccctcttccagtacgaatcggctgagggactttaaagagaccgtgagtaatatgatccataaccgaccatctttggcttcacagacaaacgtaggatcccattgcagaggccgtggaggtgaccagccagacaagaagccaccccggacacttccgctgcattcgcgggattgggaaatcgagagtaccagttccgagtccaaatcctccagttcgagcaaatataggcctacatggcgtccaaagcgggaatctttaaatattgattctattttcagtaaagataaaaggaagcattgtggctatacacagctcagcccttttagcgaagactctgccaaagaattcatacctgatgagccgagcaaaccgccgagttacgatataaaattcggaggcccgtcaccccaatataaacgatggggacctgcccgacctggatcacacctattggaacagcaccctaggctgatccaaagaatggaatctgggtacgaaagctcggaaagaaactccagtagtcctgtttctctggatgctgccttgcccgaatctagcaatgtgtaccgggatccgtcagctaaacgaagcgccggcttggtaccatcttggcggcacattcctaagagtcacagcagttccattctcgaggtggactcaaccgccagcatggggggatggacaaagagccaaccattctctggcgaggagatctcttccaagtctgagctggatgaactgcaggaggaggtggctcggagagcgcaagagcaagagttaaggagaaaacgcgagaaagaactcgaggctgctaagggattcaatcctcacccatctagattcatggacctggacgaattgcaaaaccaggggcgttccgacggctttgaacggagtcttcaggaagcggaaagcgtattcgaagagtccctgcacctggagcaaaagggagattgcgcagcggcccttgccctttgtaatgaggcgatctctaaacttcgactagccctgcacggcgcttcgtgttccacacactcacgggcattggtcgataaaaagctgcaaatttcaattcgaaaagcacgaagcttacaagaccgtatgcaacagcaacagagcccccagcagccatctcagccaagtgcctgtctgccaacacaggctggcacgctgtcccaaccaaccagtgaacagccaataccactgcaagtgttgctgagccaggaggctcagctggagtccgggatggacactgaattcggcgcctcctcattcttccactctcccgcctcttgccacgagagtcactctagcctgagcccagagtcaagtgctccgcagcacagcagccccagccgctctgccctgaagcttttgacttctgtcgaggtggataacatcgagccatcggcattccacaggcaaggacttcccaaggctcctggttggaccgagaagaactcacaccattcatgggagcccctggatgcaccagaaggaaagctgcagggctctcgatgcgacaactcaagttgttcaaagctgcctcctcaagaggggagagggattgcccaggaacaacttttccaagagaagaaggatccagctaatccgtcccccgtgatgcccggcattgcaacatctgaacgaggtgatgagcacagcctaggctgttctcccagtaacagcagcgcacagcccagccttcccctgtatagaacatgtcacccaataatgcccgttgcgtcgtccttcgtgctgcattgccctgacccagtgcagaagacgaatcaatgtctgcaaggacagtcgctgaaaacatcattaaccctgaaggtggaccggggaagtgaggagacataccgccccgaattcccttccacgaaggggttggtcagaagtctcgctgagcagttccaacgcatgcagggggtaagcatgagagattcaacaggttttaaagatcgaagtctgtctggttccctgcgcaagaatagtagcccatctgactctaagcccccttttagtcagggtcaagaaaaggggcactggccctgggccaagcagcagtcatcactcgaaggcggggaccgtcccctctcttgggaggagtcgacagaacactctagcttggccctcaacagcggtcttcccaacggggagacgagctcaggtggacagccccggctggccgaacctgacatctaccaggaaaagctgagtcaagttagggacgtgagatcaaaagatcttggttcctcgactgatttgggaacgagcttgccgctagacagctgggtaaacatcactcggttctgtgactctcagcttaaacacggcgctcctaggcctggaatgaaatctagcccgcacgattcccatacctgtgtgacctatccagaacgaaatcacattctgttacacccacactggaatcaggacactgaacaggagacaagtgagctcgaaagtctataccaagcttctctgcaagcttcacaagccggttgttccgggtggggtcagcaagacactgcatggcatccattgtcacaaacgggctccgccgacggcatgggaagacgcttgcattccgcccatgatcctgggctgtcaaagacttcaacagccgaaatggagcatggactccatgaggctaggaccgtgcgaacttcacaggcaacgccttgcagaggactgtctagagagtgcggcgaagatgaacagtatagcgcagaaaacctaagacgtatatctaggagcctgagcgggaccgtcgtctcagaaagagaggaggcacctgtgtcgtcccactctttcgacagcagcaatgtgaggaaaccccttgagactggccatcgttgctctagctccagcagtcttccagttattcatgatccgtctgtatttctacttggaccacagctgtatctgccccagccgcagtttttgtcacctgacgtcttgatgccgaccatggccggggaaccaaataggctcccaggaacatctcgctctgtccagcaatttctcgccatgtgcgaccggggcgagaccagtcaaggtgcaaaatatacggggaggaccctgaattatcagagcctcccccaccgcagccggacagataatagctgggctccctggagtgagaccaaccagcacatcggaacccgctttctgaccactcctggatgtaaccctcagctgacatatactgcaacattacccgaaaggtctaaaggcttgcaggtcccccatacacagtcttggtctgacctgtttcactctccgtctcacccccccattgtccaccctgtctatccaccatcatcgtcattacacgtccccctccgtagcgcatggaactctgacccagtacctggcagtcgtactccgggaccgagaagagtggatatgccgcctgacgatgactggcgccagagtagctacgcaagccattctgggcatcgcaggactgtgggcgaggggttcctcttcgtgctgagtgatgctccaagacgcgagcaaatccgcgcacgtgtcctgcaacatagccagtggtag

SEQ ID NO: 34338 - DNA, 243 bp, Artificial Sequence
  Description of Artificial Sequence: Synthetic coding sequence
atgtcctggaaacgtaactattttagtgggggccgcggttccgtccagggcatgtttgctccgcggagctccacctccattgcaccctcgaaaggtctatcaaacgaaccaggacagaattcgtgcttcctcaatagtgccctgcaggtcctctggcatcttgatatattccgcagatcttttaggcaattgacaacgcacaagtgtatgggcgattcctgtatattttgcgccctgaagtag

SEQ ID NO: 34339 - DNA, 3279 bp, Artificial Sequence
  Description of Artificial Sequence: Synthetic coding sequence
atgatggatagtcctaaaatcggcaacggcctacccgtaatcggcccgggtactgatatcggaatctcatctctccatatggtaggttacctgggaaagaacttcgactccgcaaaagtgccatccgatgaatactgccccgcatgtagagaaaaagggaaattaaaggctctgaagacatatcgaatctcgtttcaggaatccatctttttgtgcgaagatctccaatgtatctatcctcttgggagtaaaagtctcaataacctcatttcacccgatctggaagaatgtcacaccccacataaaccccagaaaagaaaatccctggaaagctcttacaaagattctctactgctggccaacagtaaaaagacacgaaactacatcgccattgacggtggaaaagtgctgaacagcaagcataatggggaagtgtatgacgaaacctctagcaatttgccagattcctccgggcagcagaatccgattcggactgcggattctttggaacggaatgagatcctcgaggcagataccgtcgatatggcgaccaccaaagaccctgccaccgtcgatgttagtggcaccggtcgccctagtccccagaacgaggggtgtacatctaaattagagatgccgttggagtctaaatgtacatctttcccccaggctctctgtgtacagtggaaaaacgcctatgctctgtgttggctggactgcattctctcagccctggtacatagtgaggagttaaaaaataccgttaccggcctgtgttctaaggaagagagcatattctggaggctgctgacgaaatacaaccaggccaataccctgttgtatacctctcagctgagtggcgtcaaggacggggactgcaagaagctaacctcagagatattcgctgagattgagacatgcctcaatgaagtaagagacgaaatttttatctcactccagccacaattaagatgtactttaggggatatggagtcccctgttttcgcattccctctcttgcttaagttggagacccatatcgagaagctgtttctctattccttttcttgggatttcgaatgcagccagtgtggacaccaataccagaaccggcatatgaaatccctcgtgaccttcactaacgtgattccagagtggcaccccctcaatgcggctcactttgggccctgcaacaactgcaacagcaagtctcagatcagaaaaatggtgttggaaaaggtatcacctattttcatgctacacttcgtcgaaggcctcccccaaaatgacttgcagcattatgccttccactttgaaggatgtctctaccagatcacctcagtgatccaatatcgagcgaataatcattttataacctggatcctcgacgccgatggctcctggcttgagtgtgacgatctgaagggaccctgtagcgagaggcataagaagtttgaggtgcccgcatcagagatacatattgtgatatgggagcgcaagatatctcaagtcaccgacaaggaggccgcatgcttgccccttaaaaagacgaatgatcagcacgccctaagcaacgaaaaacctgtatctctcacatcttgtagcgttggtgatgccgcctctgccgagactgctagcgtcacacatccgaaggatatttccgtcgcaccaaggactttgagtcaagatactgccgtcacacacggcgaccacttgctttcaggacccaaaggcctagtagacaatatcctgccgctcacccttgaggaaacaatccaaaagactgcctccgtcagtcagcttaactccgaggctttcctgctggaaaacaagcccgtcgctgaaaatactggcattctgaagactaatacgttactttcccaggagtcgctgatggcaagctccgtgtccgcaccatgcaatgagaaattaattcaggatcagtttgttgatatttcgttcccctcgcaggtggtcaataccaatatgcagagtgtgcagctgaacaccgaagacacagtgaatactaagtctgtgaacaacactgatgccacgggcttgattcagggcgtaaagagcgttgagattgagaaggatgcccagcttaagcagtttttaaccccaaagaccgaacagcttaaacctgagagagtgactagtcaggtgtcaaacctgaaaaagaaggagactacagctgactctcagaccacaacttccaagagtctccaaaatcagtctctgaaggaaaatcagaaaaagccattcgtgggcagctgggtcaagggtctgatctcacgcggggcctcttttatgccgttatgcgttagtgcgcataaccgcaataccataacagaccttcagccttctgtcaagggtgtcaacaacttcggtggctttaagacaaagggaatcaaccagaaggcctcacacgtgtccaagaaagccaggaagagcgccagtaagccaccccccattagcaagcctccagccggccccccttcaagtaatggaactgccgcccacccacacgctcacgccgcctctgaagttctagagaaaagcggatccacctcatgcggcgcgcaactgaatcactcgtcttacgggaatggcatttcctctgccaaccatgaggatctggtggaaggccagatccataagctgagactgaagctgcgcaagaaactgaaggccgagaaaaaaaagctggcagctctgatgagttctccacagtcaagaaccgtgagatctgagaaccttgagcaagtcccgcaggacggatccccaaacgactgcgaaagtatagaagatctgctcaatgagcttccctatccaatcgacatcgcatccgaatccgcctgtactactgtccccggcgtcagtctgtattctagccagactcatgaagagatcctggcagagcttctgtcgcccacacccgtctctacagagctgtcggagaatggagagggcgattttcggtacctgggaatgggcgatagtcatattcccccccccgtcccctcagaatttaatgatgtcagtcagaatactcacttgaggcaagaccacaactattgctctcccaccaagaagaacccgtgtgaagtgcaacctgattcgctgacaaataatgcgtgcgtaaggaccttgaacctcgaatcccccatgaaaaccgatatcttcgacgagttctttagcagttcagcactcaatgcactcgcaaatgacacactggatctccctcacttcgacgaatatctcttcgagaattattag

SEQ ID NO: 34340 - DNA, 357 bp, Artificial Sequence
  Description of Artificial Sequence: Synthetic coding sequence
atgttccactggcaagcgactataatgggcccgaatgacagcccataccagggaggggtcttctttcttactatacacttccccactgactaccctttcaaacctcctaaggtggcttttactactcgcatctaccatccgaacattaactcaaacggctccatctgcctggacatcctgcggagccagtggagtccagcactcaccataagtaaggtccttctgtctatttgttccttactttgcgatcccaacccggatgatccacttgtgccggagattgccagaatctacaaaacagatcgggaaaagtataacaggattgctagagagtggacgcaaaaatatgcgatgtag

SEQ ID NO: 34341 - DNA, 444 bp, Artificial Sequence
  Description of Artificial Sequence: Synthetic coding sequence
atggctctgaagcggattcacaaagagctgaatgatctcgccagagacccaccagctcagtgctctgccggtcccgtaggcgatgatatgttccattggcaggctaccatcatgggaccaaatgattccccttatcaaggcggagtcttcttcctgactattcattttccgaccgattacccatttaaaccccctaaagtagccttcacgacccggatttatcacccaaacattaactcaaacgggtcaatatgcctggacatacttcgctcacagtggagccccgcgcttacgatctcgaaggtcttgctgtccatttgcagcctgctctgtgaccctaatcccgacgatccgctggtgccggaaatcgcaaggatttataagaccgatcgcgagaaatacaatcgtatcgcccgcgagtggacccagaaatacgcaatgtag

SEQ ID NO: 34342 - DNA, 444 bp, Artificial Sequence
  Description of Artificial Sequence: Synthetic coding sequence
atggcacttaagcgtatacacaaggaactcaacgacctcgcgcgggaccccccggcacagtgcagtgccggtcccgtaggtgatgatatgttccattggcaggcgactatcatgggacccaacgactccccttatcaggggggggtgttctttctgaccattcacttccccaccgattacccctttaagcctcctaaagtggctttcacaacaaggatatatcatcccaatattaactccaatggatccatttgtctcgatatcctcaggtcccagtggtctcctgccttaaccataagtaaagtgctgctgtcaatatgttccctactgtgcgatcccaatcccgatgatcctcttgtcccggaaatagctcggatctacaagacagatagggagaagtataatcgtattgccagagaatggacacaaaaatatgctatgtag

SEQ ID NO: 34343 - DNA, 357 bp, Artificial Sequence
  Description of Artificial Sequence: Synthetic coding sequence
atgtttcattggcaggccaccatcatgggcccaaacgactcaccttatcagggcggtgtgttttttctgactatacacttccctacagactacccatttaaaccacctaaagtcgcttttacaactaggatttatcatcccaacattaactctaacgggagcatctgtctagatatcctgagaagccaatggagtcctgccctgacgattagtaaagttctactgtctatatgctccctgctttgtgaccctaatccggacgaccctctggtcccagaaatcgcccgtatatataagaccgatagagagaagtacaatcgcatcgctcgagaatggacacagaagtacgcgatgtag

SEQ ID NO: 34344 - DNA, 5361 bp, Artificial Sequence
  Description of Artificial Sequence: Synthetic coding sequence
atgggactgctccagctgctggcattctcctttcttgccctgtgtcgcgcgcgtgtgagagcccaggagccagagttttcatacgggtgcgcggaaggctcgtgttaccccgccacaggcgatctcctcataggtagggcacagaaactgtccgtcacctccacttgtggtctgcataagcctgagccatattgtatcgtgtcccacctacaggaagacaagaaatgctttatttgcaatagccaagacccttaccatgagaccctgaatccagattcacacctcattgagaatgttgtgaccacttttgcccccaatagactcaaaatttggtggcagagtgaaaacggggtggagaatgttaccattcaactggaccttgaggccgagttccatttcacccaccttatcatgacatttaaaacctttaggccagcagcaatgttgattgagcggagcagcgacttcggtaaaacctggggcgtatataggtactttgcttacgattgcgaggcctccttcccaggtatttccaccggcccgatgaagaaagtagatgacatcatatgcgattctcgatatagtgatatcgaaccgtctactgagggggaggtgatctttagagcgctggacccagcctttaaaatcgaagatccctacagtccccgcatccagaatctactgaagataaccaacctcagaataaaattcgtcaagctgcacacacttggcgacaacctgttggactccaggatggaaattagagaaaagtattactacgccgtgtatgatatggtggtccggggaaactgcttttgttatgggcatgcaagtgaatgcgctcctgtggatgggttcaacgaggaggtggagggcatggtccatggccactgtatgtgccgtcataacacaaagggcctaaactgcgaattgtgtatggacttttatcatgacctgccatggaggcctgccgagggacggaatagcaatgcttgcaagaaatgcaattgcaacgaacatagcatctcctgtcactttgatatggcagtttatctcgccaccgggaacgtttcaggcggagtatgcgatgactgccaacataataccatgggtcgcaattgtgaacagtgcaagcccttctactaccagcatccagaacgggatataagggatcctaatttctgcgagaggtgtacctgtgaccctgctggttcccagaacgagggaatttgtgactcctacacagatttttccactggcctgattgccggacaatgcagatgcaagctgaacgtcgagggggaacattgtgacgtctgcaaagaagggttttacgatttatcttccgaggatccttttggctgcaaatcatgcgcatgtaacccattgggcacgattcccggcggcaacccatgtgactccgagacaggtcattgctactgtaagaggctggtcactggccagcattgcgaccaatgtctccccgagcactggggcctgagtaacgacttggatggctgccggccttgtgattgcgacttgggcggcgcgctgaataatagctgttttgcagaatctggacagtgttcgtgccggcctcacatgatcggaagacaatgtaacgaagttgaaccgggttattacttcgccaccctggatcactatctttatgaggctgaagaagccaatctgggacccggagtcagcatcgtggagcgtcagtacattcaggatagaatcccgtcctggaccggagcaggatttgtgcgggttccagagggagcctacctggaattcttcattgataatattccttattcgatggagtatgatatactaataaggtacgagccccagcttccagaccattgggagaaggcagtgatcactgtccagaggcctggtcggatcccaacaagctcgcgatgcggcaacactatccccgacgacgataatcaagttgtcagtttgtcaccaggctcgcgatacgtggtgttgccccgacctgtgtgctttgagaaggggacaaactacacagtgaggctggagcttcctcagtacacatcaagcgacagcgacgtagaaagcccctatacactgatagactccctcgttctgatgccttattgcaagagcctggatatctttaccgtggggggcagcggggacggcgtggtgaccaattcggcttgggagacctttcagagatatcggtgtttggagaactcacgcagtgtggtgaagactcccatgaccgacgtgtgcaggaatattatcttctctattagcgcgctcctccaccagaccggacttgcctgtgaatgtgatccccagggtagtctgtcatccgtgtgtgaccctaatggcggacagtgccagtgtagaccaaatgttgttggaaggacttgcaatcgatgcgctcctgggacatttggcttcgggccatccggctgcaaaccttgtgaatgccatttacagggcagcgttaacgccttctgcaatcccgttacggggcagtgtcattgctttcagggagtatacgccaggcaatgtgacaggtgtctgcccggtcactggggcttcccctcttgtcagccatgtcaatgtaacggccatgcagatgattgcgatcctgtgactggagagtgccttaactgccaggattataccatgggacacaattgtgagagatgcctggcaggctattatggagacccaatcatcggtagtggagatcattgtcgcccatgcccatgccccgatggaccagattctgggcgccagtttgcccgcagctgttatcaggaccctgtcacactgcaattggcatgcgtctgtgaccctggttatatcggctccaggtgcgacgactgcgcctcaggctatttcgggaacccctcagaagtcggcggctcctgtcagccatgtcaatgccataacaacattgataccacagaccctgaggcctgtgataaagaaaccggccgctgtcttaaatgcttgtaccacacagaaggagagcattgccaattctgccgctttggatactatggagacgccctccagcaagactgtcggaaatgtgtctgcaattacctgggaacagtacaggagcactgcaacgggtcagactgccaatgcgacaaagccactgggcagtgtctctgtttacccaacgtgatcggacagaactgtgacaggtgcgcccctaatacctggcagctggcttcagggacggggtgtgatccgtgcaactgcaacgcagcacactcctttgggccatcttgcaatgagtttacaggacaatgtcaatgcatgcctggattcggcggccggacttgctctgaatgccaggagctgttttggggagacccggacgtagagtgccgtgcctgcgattgcgatcccaggggcatcgagacaccgcaatgtgatcagtcaaccgggcaatgtgtgtgtgtggagggcgttgagggccctagatgcgataagtgtacccgggggtactcaggggtgtttcccgattgtacaccatgtcaccagtgctttgcactctgggatgtcatcatcgccgagcttaccaatagaacacaccggttcttagagaaggccaaggccctgaagatttcaggagtgataggcccctatcgagagaccgtggactccgttgagagaaaagttagcgaaattaaggacatcctcgcacagtcacccgccgcagagccccttaagaacatcggaaatctgttcgaagaggcggagaaactaatcaaagacgttaccgagatgatggcccaggtggaggtcaaactgagcgataccaccagccagtccaattctaccgctaaagagctcgattcactccagactgaggctgaaagtttggacaatacagtgaaagaactggctgaacaactggaatttattaagaacagtgatattaggggggcccttgatagcataaccaaatatttccagatgagtctcgaggctgaggagagagtcaatgctagcaccacggaaccaaactcgacagtcgaacaatctgctctgatgcgtgatagggttgaggacgtgatgatggagcgcgaaagccagtttaaagaaaagcaggaggaacaggcgcggctcctcgacgagctcgccggcaagctgcagagcctcgatctttcagcagcggccgagatgacctgcgggaccccacctggggcatcttgcagcgaaaccgaatgtggcggacccaactgtagaaccgatgagggcgagagaaagtgtgggggaccaggatgtggagggctggtcacagtggcacacaatgcctggcaaaaggccatggacctggaccaagatgtgttgtcggcattggctgaggtcgagcagctgtccaaaatggtttccgaggcgaaactgcgggccgatgaggcaaagcagtccgcggaggatattctcctgaagaccaacgctacaaaagagaagatggacaaaagtaatgaggagctgagaaacctgattaagcagattaggaactttctcactcaggactctgcagacctcgatagcattgaggcggtcgcgaatgaagtcttgaaaatggagatgccctcaactccgcagcagctgcagaatctgaccgaggacattcgcgagcgtgtcgagtcactgtcgcaggttgaagtgattctccagcacagtgccgctgacatcgctagagccgagatgttattggaggaagccaagcgggcctctaagtccgccacagatgtaaaggtgaccgcagacatggtgaaagaagcactggaggaagctgagaaagcacaggtggcagctgagaaagctatcaagcaggctgacgaagacattcaggggacacaaaatctcctgactagcattgagtcggagacagccgcgtcggaagagacattgtttaatgcttcgcagagaatttcagagctagagaggaacgtggaggaattgaagagaaaggctgcgcaaaattctggagaggccgaatatatagaaaaggtagtctatacagttaagcaaagcgctgaggatgtgaaaaagacactggatggtgagctggacgaaaagtataagaaggtggaaaatctgatcgcaaagaaaaccgaggagtctgccgacgcccggaggaaagccgagatgctgcagaatgaagcaaagaccctcttggctcaggcgaactcgaagttgcaattacttaaggacctcgagcgaaagtacgaggacaatcagcgctacctggaggacaaggcccaggaactggctcgactggaaggagaggtgcggtccctgctcaaagacatctcccagaaggtggcggtgtactctacttgcctctag

SEQ ID NO: 34345 - DNA, 330 bp, Artificial Sequence
  Description of Artificial Sequence: Synthetic coding sequence
atgaccaacgactcaccctatcagggcggtgtcttcttcctgaccatccactttcctacggactaccctttcaaaccacccaaggtggcattcacgaccaagatctaccaccctaatatcaattccaatggtagcatatgccttgatattttacgttcccagtggtccccagcgctaactgtatcgaaggtgcttctaagcatttgctcactgttgtgtgatcctaatcccgacgaccccctcgtaccggagatcgcacacacttacaaagcagatcgagagaagtataatagattggcacgggagtggacacagaaatatgctatgtag

SEQ ID NO: 34346 - DNA, 558 bp, Artificial Sequence
  Description of Artificial Sequence: Synthetic coding sequence
atgcttaccctggcgagcaaactcaaaagagatgacggtctgaagggatcccgcactgccgctactgcatctgactctacgagaagagtgagcgtcagggataagctcctcgtcaaggaagttgcagaattggaagcgaatctcccttgtacttgcaaggtccacttcccggaccccaataaactgcactgtttccaactcactgttacacccgatgaaggatattaccagggagggaaatttcagtttgagacagaggtgcccgacgcttacaacatggtccctccaaaggtgaagtgcctgacaaaaatatggcatcccaacataactgagactggagagatctgcctcagtctgcttagagaacacagtatagacggcacggggtgggcacctacgcggaccctgaaggacgtggtctgggggctgaactctttgttcaccgacctgctcaactttgacgatcctctgaacatagaggcagctgaacaccatctccgagataaagaagattttcgtaataaagtggatgactacatcaaacgatacgcaaggtag

SEQ ID NO: 34347 - DNA, 462 bp, Artificial Sequence
  Description of Artificial Sequence: Synthetic coding sequence
atgctcaccctggctagcaaactcaaacgggatgacggtttaaaaggcagccggacagccgctactgcaagcgacagcacaaggcgcgtgtcagttcgggataagctgcttgtaaaggacgaaggttactaccagggggggaaattccagttcgaaactgaagtgccagatgcctacaatatggtgccccccaaagtgaagtgcctaaccaagatctggcaccctaatatcactgagacaggtgagatctgcctgtcccttctcagggaacatagcatcgatgggaccggatgggcacctacacgcacgctcaaagacgtcgtctggggtttaaactccctctttactgacctgctcaattttgacgatcctctgaacatagaggccgccgaacaccacttgagggataaggaggactttcgtaataaagttgatgactacatcaagagatacgcccggtag

SEQ ID NO: 34348 - DNA, 516 bp, Artificial Sequence
  Description of Artificial Sequence: Synthetic coding sequence
atgctcaccctggcctccaaattaaagcgggatgatggtctgaagggctcccgcacagcagcaacagcctctgactctacccgtagagtgagcgtccgggataaattgttagtgaaggaagttgccgagcttgaagccaacctcccttgcacctgtaaagtacacttccctgacccaaacaagcttcactgttttcagctgacagtaacgcccgacgaaggttactaccagggagggaagttccaattcgagaccgaagtgcccgatgcttataacatggtgccccccaaagtgaagtgtcttacaaagatttggcacccaaacatcactgagacaggggaaatctgtctgagcctgctacgcgaacactccatcgatggcactggctgggctccaaccagaacactcaaggacgtggtttgggggctcaattcactctttaccgacctgctgaacttcgacgatccgcttaacattgaagcagccgagcatcacctgcgtgataaggaggactag

SEQ ID NO: 34349 - DNA, 513 bp, Artificial Sequence
  Description of Artificial Sequence: Synthetic coding sequence
atgacagagctgcagtctgccttgctgctccgcaggcagctcgcagaactgaacaagaatccagtagagggtttcagtgccggactcatcgacgataatgatctctatcgctgggaggttcttattattggcccacctgacaccctctacgaaggtggggtgttcaaggcacatctcacttttccaaaggattaccccctaaggccaccaaagatgaaatttataaccgagatctggcaccccaatgtcgataagaatggggacgtgtgtatcagcattttgcacgaacccggagaggacaaatacggatatgagaagcccgaggagaggtggctccccatccacaccgtcgagaccatcatgatcagtgtaatcagcatgctggctgaccctaatggagattccccagccaacgtcgacgcagctaaggaatggagagaagatcgcaacggagagttcaaacgcaaagtcgctcggtgtgtaaggaagagccaggagacagctttcgagtag

SEQ ID NO: 34350 - DNA, 552 bp, Artificial Sequence
  Description of Artificial Sequence: Synthetic coding sequence
atgatcaaactgttctcactgaagcagcagaaaaaagaagaggagagcgctggggggacaaagggctctagcaagaaggcctctgccgcacaactccggattcagaaagatattaatgagctgaaccttcccaagacttgtgacatctctttctctgacccagacgacctgctcaatttcaaacttgtgatttgccctgacgagggcttttataagtccggcaaatttgttttcagttttaaggtgggacagggatatccccacgatccccccaaggtgaagtgcgaaacaatggtctatcatcccaacatcgaccttgagggcaatgtgtgcctgaatattctgcgcgaggactggaagcccgtgctgacaattaattcaataatctatggcctgcaatacctctttctggagccgaatcccgaggatcctttaaacaaggaggccgcagaggtgcttcagaacaaccgcagacttttcgaacagaacgtccaacgctcaatgaggggtggatacattggatccacgtacttcgagagatgcctcaaatag

SEQ ID NO: 34351 - DNA, 3879 bp, Artificial Sequence
  Description of Artificial Sequence: Synthetic coding sequence
atggcggatccagcggcaccgacacccgcagccccagctcccgcccaggctccggcacccgcccctgaagccgtcccagctccagccgccgctcccgtgccggcacccgcccctgcctcagacagcgccagcgggccttctagtgattcagggccggaagccgggagccagaggttgctgttttctcacgacctggtgtctggtagatacagggggtcggtgcattttgggctggtgcggctgatacacggggaagactctgactccgaaggcgaggaagaaggaaggggtagcagcggctgcagcgaggcaggcggggcaggccacgaggaagggcgtgccagccctttgcgaaggggatacgtgcgggtgcaatggtatcctgagggtgtgaaacaacatgtgaaagaaaccaagttgaagctcgaggacaggtccgtcgtgcctagagacgtggtgagacacatgcgtagtaccgattctcagtgcggtaccgtgatagacgtgaacattgactgcgctgtgaagctaatcgggacaaactgcattatctaccctgtgaacagtaaagacctccagcacatttggcccttcatgtatggcgactacatagcttacgactgttggctcgggaaggtttacgacctcaaaaatcagatcatcctcaagctgagcaacggtgccagatgcagtatgaataccgaggacggagccaagctctacgacgtctgccctcacgtctccgacagcggcctcttcttcgacgactcctatggcttttatccagggcaggttttaatcgggcctgccaaaatatttagttctgtacagtggctttccggtgtgaagccggtgctctccacaaagagcaagtttcgggttgtcgtcgaggaggtgcaggtggtcgagctgaaagttacctggattaccaaatccttctgtcccggcggtacagatagtgtctcacctcctccgagcgtcatcacacaggagaatctcggccgagttaaaagactcggttgcttcgaccatgcccagagacaattgggagaaaggtgtttatacgtgttcccagctaaagtagaacctgccaagattgcttgggaatgtcccgaaaagaattgcgcccagggcgaggggtccatggccaagaaggtcaaaaggctgctgaaaaaacaggtggttagaatcatgagctgcagccccgatacccagtgttccagagatcacagcatggaggacccggataaaaaaggtgagagtaaaacgaagagcgaagctgagagtgcctcacccgaagagacccccgatgggtctgcctctccggtggaaatgcaagatgagggagctgaagaaccgcatgaagctggcgaacagctgccaccctttctgctgaaggaaggccgggacgaccgacttcactccgctgagcaggacgccgacgacgaagccgcagatgacaccgatgatacctcatccgttacgtcttctgcctcctcaacaactagcagtcagagtgggtccggcactagccggaagaaatcaattcctctcagcatcaagaacctgaagaggaagcacaaaagaaaaaaaaataaaatcactcgtgattttaagccaggagatagagtggccgtagaggtggtgaccaccatgacaagtgctgacgtgatgtggcaagatgggtccgtggagtgcaacatcagatccaacgacttatttcctgttcaccatctcgataacaatgagttttgtccaggcgactttgtggtggacaagagggtgcagtcatgccctgatcccgcggtatatggcgtcgttcagtccggagatcacattggacggacttgtatggtgaagtggtttaaacttagaccaagcggagacgacgtagagttaatcggggaggaagaggacgtttcagtttacgatattgctgatcatcccgactttagattcagaacgacagatattgttatccgaatcggtaacactgaggatggagcaccccataaagaggacgagccttctgtcgggcaggtggcccgcgttgatgtgtcttctaaggtggaagttgtctgggctgataactcaaagaccatcattctgccccagcatctctacaacatcgagtccgagatcgaagaaagcgactatgacagtgtagaggggagtacttctggggcatcttcagatgagtgggaagacgactcagatagctgggaaactgacaacggcctcgtggaggacgaacacccaaaaatcgaggaaccccccattcctccactcgagcaacctgtggcccccgaagacaaaggcgttgtcatctcagaggaggctgctacagcggccgtgcagggagcggtagccatggctgcaccaatggctgggcttatggagaaagccgggaaagacgggccaccaaagagcttcagggaactgaaagaggcgatcaaaattttagagtcattaaagaatatgaccgtagaacagctgctcaccggcagcccgacatcacccaccgtcgaaccagaaaagccaacaagggagaaaaagtttctggacgacattaaaaagctgcaagagaatctcaaaaagaccctggataacgtggccatcgtagaagaggagaaaatggaggcagtgcccgacgtggagcggaaggaggacaagccagaaggacagagtccagtgaaagccgaatggccatcagagactcctgttctgtgtcagcagtgtgggggtaagcctggtgtcacttttacctcagctaaaggtgaggtgttctccgttctggaattcgcccctagcaatcacagcttcaaaaaaatagaatttcagcctccagaggccaagaagtttttcagcactgtgcgaaaagagatggcactgctggccacctcactgccagagggcataatggtgaaaacttttgaagatagaatggacttattcagcgccctgattaagggcccgacacgaaccccctatgaggatggactgtacctatttgacattcagctcccgaatatctatcccgctgtgcctccacacttctgctatctgtctcagtgtagcgggcggctgaaccctaacctgtacgataatggcaaggtgtgtgtctcacttctgggtacatggataggaaagggcacggagagatggacctcgaaaagttccctgcttcaagtcctcatcagcatccagggtttaatcctggtgaacgagccatactacaacgaagctgggttcgattctgacagggggttgcaagagggatacgaaaacagccgctgctacaatgagatggctttaataagagtggttcagagcatgacccagttagtgaggcggccacctgaagtgtttgagcaagagattagacagcactttagcaccggaggatggcggctcgtgaatagaatagagtcttggctcgagactcacgcgcttttggagaaagctcaggccttgcccaatggggtccccaaagcttcctcgtcacctgagcctcccgcggtggcggaactttccgacagtgggcaacaggaacctgaggacggaggacctgctccaggggaggcgagtcaggggagtgattccgagggcggcgcccaagggctggcgtccgctagcagggatcacaccgatcagacaagtgagaccgccccggacgccagcgtgcctccgagcgtgaagcccaagaagcggcgaaagagctataggtccttcttgccggaaaaatctggataccccgacatcggattcccattattccctctttctaagggcttcatcaagagtattagaggagttctgacccagttcagggcagcgctgcttgaggccgggatgcctgagtgcacagaggataagtag

SEQ ID NO: 34352 - DNA, 1269 bp, Artificial Sequence
  Description of Artificial Sequence: Synthetic coding sequence
atgcaacagccacaaccccagggtcagcagcagcctggtcctgggcaacagctcggggggcagggggccgctcctggcgccggcgggggtccaggtgggggtcctgggccggggccctgtctgcggagagagctgaagctgttggagagcatctttcacaggggccatgagcggttccgcatcgcaagcgcttgtctcgatgaactttcctgcgaatttctgctcgctggagctggaggggccggagccggcgcggcccccgggcctcatctgccaccacgaggatctgtcccaggcgacccggtgagaattcattgtaatataacagaaagttatccagcagtgccccctatctggtctgttgagtctgacgaccctaatttagcagcagtgctggagcggctcgtggacataaaaaaaggcaatactctccttttacaacaccttaagagaattatatctgacttgtgcaagttgtacaatttaccgcagcatcccgacgtggaaatgctcgaccaaccactgcccgcggagcagtgtacccaggaggacgttagctctgaggatgaagatgaggaaatgcccgaagatactgaggatctggatcactatgaaatgaaagaagaagagcccgcggaaggcaagaagagcgaggacgacggcattggaaaggaaaacctggccatcctggagaagattaaaaagaaccagcggcaggactatctaaatggagctgtaagtggcagtgtgcaggccacggaccgcttgatgaaagagttacgtgatatctacaggagtcaaagtttcaaggggggaaactatgccgtagagcttgtaaacgattcactatacgactggaatgtcaagctgctcaaagttgaccaagactctgctctccacaacgacctgcagattttgaaggagaaggagggggcggattttatcctgctcaacttctcattcaaggacaacttccccttcgatcctcctttcgtgcgcgtagtttctcctgtgctaagcgggggatatgtgttgggaggaggggccatctgtatggagctgttaaccaagcaaggatggagcagtgcctattccatcgaatctgtcataatgcaaattagcgctaccctggtgaagggcaaggctagggttcagtttggcgccaacaagtcccagtactctttgacaagggcccagcaatcctacaagagcctcgtgcagatacatgagaagaacggatggtatacgccaccgaaggaagacggttag

SEQ ID NO: 34353 - DNA, 486 bp, Artificial Sequence
  Description of Artificial Sequence: Synthetic coding sequence
atgaaagaactgcaggacattgccagactcagtgataggttcatctcagttgaactcgtcgacgaatctctgtttgattggaacgtaaagctccaccaagtggacaaggacagcgtcctctggcaagacatgaaggaaacaaataccgaattcattctgctgaacctaaccttccccgacaactttcctttctctccaccgtttatgcgcgtgcttagccctcggctggagaacggatacgttctcgacggcggcgctatttgcatggaactcctgacaccacgcggctggagttctgcgtacactgtggaggccgttatgagacagtttgccgcctctctcgtcaaagggcaagggcgtatatgtagaaaggctggcaagagtaagaagtcattctctcgcaaggaggccgaggcaacatttaaatctttggtaaagacccacgagaagtatggctgggtcaccccaccagtgagtgacggctag

SEQ ID NO: 34354 - DNA, 681 bp, Artificial Sequence
  Description of Artificial Sequence: Synthetic coding sequence
atgcacgggagggcttatctactgctgcaccgagacttttgcgacttgaaagaaaacaattacaaggggattaccgctaaacctgtgtccgaagatatgatggaatgggaggtggagatcgaaggccttcagaacagcgtctggcagggtctagtgttccaactcacgatccatttcacatctgagtacaattatgcccccccggtagttaagtttatcactatcccatttcatccgaacgtggatcctcacaccgggcagccctgcattgatttccttgacaatccggagaagtggaataccaattataccttatcaagcatcctactggcgcttcaggtgatgctcagcaatcctgtgttagaaaaccctgtgaacctggaggcagctaggatactagtgaaggatgagtccctgtaccgcactattctccggttgttcaatagacccctacaaatgaaagacgatagtcaggagttgccgaaggatccacgcaaatgcatccgacctattaaaactaccagcttcagtgactactaccagacctggtccaggatcgccacaagtaaagcaactgagtactataggactcctctcctcaaggtgccaaacttcattgggcaatactacaaatggaagaaaatggatcttcagcatcagaaagaatggaatcttaaatag

SEQ ID NO: 34355 - DNA, 966 bp, Artificial Sequence
  Description of Artificial Sequence: Synthetic coding sequence
atgcacggccgggcttacctgttgttacatcgggacttctgcgatctcaaggagaacaactataagggaatcaccgccaagcccgtaagcgaagacatgatggagtgggaggtagagatcgagggacttcagaacagcgtctggcagggcctggtgttccagttgacaattcatttcacctccgagtacaattacgcacccccagtggttaaattcattactatacccttccatccgaacgtggatcctcacacaggccagccctgcatcgacttcctggataatccagagaagtggaatacaaattacaccctgagcagcattctgctcgcactgcaggttatgttgtccaacccggtgttagaaaatcccgtaaacttggaagcagctaggattctagtaaaagatgagagcctttataggacaatactccgcctatttaaccggcctctccaaatgaaagatgattctcaggaactgcccaaggacccacgtaaatgtatccggcctatcaagaccaccagcttctctgactactaccagacttggtcccggattgcgactagcaaggcaacagaatattaccgcaccccactcctgaaggtgccaaattttattggacagtactataaatggaaaaagatggacctgcagcatcagaaggaatggaatctaaagtatagcgtcattaagtgctggctcgcacgcaagagaatgcctcatgaagtgacccactctatggaagagattaagctctgccctaccctgatccctacgacggacgagatcttcctggaatctcccactgcaatcaattcgatcactgatatttacgagaccgaggaggaaggctggaagagtgatacctccctctatgagaatgatactgacgaaccccgtgaggaagaagttgaggacctcatttcctggacaaacactctgaataccaatacaagtgaggattag

SEQ ID NO: 34356 - DNA, 504 bp, Artificial Sequence
  Description of Artificial Sequence: Synthetic coding sequence
atggcagacgaggctacaagaagggtcgtgtctgaaatccccgtcctcaaaaccaacgccgggccgagggatcgagaactgtgggtgcaaaggcttaaggaggaatatcaatccttaatcagatacgttgaaaacaataaaaatgccgacaacgattggttccgcctcgagtccaataaggaggggactaggtggttcggtaagtgttggtatattcacgaccttctgaaatatgagtttgacatcgagtttgacattcccattacatatcccacaacagctccagagattgccgtgccagaactagatggtaaaaccgccaaaatgtatcggggcgggaagatttgtctgactgaccactttaaaccactttgggctaggaatgttccaaaattcggccttgcccacctgatggcgttaggtctcggcccctggttggctgtcgagattccagacttgatccaaaagggagttatacaacacaaagagaagtgtaaccagtag

SEQ ID NO: 34357 - DNA, 3177 bp, Artificial Sequence
  Description of Artificial Sequence: Synthetic coding sequence
atgtcatccagccctctaagtaagaaacggagggtcagcggccccgaccccaagcccgggtcaaactgttcacccgcccagtctgtcctctcagaggttccatctgtcccgaccaacgggatggcgaagaatggctccgaagctgatatcgatgaaggcttgtacagcagacaactgtacgtgttgggtcacgaggccatgaagaggctccagacctcttccgtgcttgtgagcggactgcgggggctgggcgtagagatagccaagaatatcatcctgggaggggtgaaagctgtcaccctgcacgatcagggcaccgcccagtgggctgatctttcgagccagttctacttgagagaagaggatatcgggaagaatagagccgaagtgtcgcagccaaggctagccgaactgaattcgtatgtgcccgtgacagcctatacgggacccctcgttgaagatttcttgtccggtttccaggtagtcgtgttgactaacacccccctcgaagaccagttgagggttggagaattttgtcacaatcgtggcatcaagcttgtagtggcagatactcgcggattgttcggtcagttgttctgcgattttggcgaagagatgatcttgacagatagtaacggcgaacagcccctgagcgccatggtcagcatggtaacaaaggataatccaggggtggtgacatgtttggatgaggccagacacggattcgaatctggcgactttgtttcattctctgaggtccaggggatggtggaattaaacggaaaccaaccgatggaaattaaagtgcttggcccctacacattcagtatatgtgacacctctaatttttccgattatattcgtggcggaattgtttctcaggtgaaagtcccaaaaaagatctcttttaagagcctggtcgcgtcactggcagagcccgattttgtggtgacagattttgctaagttcagtcgccctgcacaacttcacatcggcttccaggcgttgcaccagttttgtgcacagcacggacgaccaccacggccacgaaacgaagaggacgcagcagaactggtggcgttggcgcaagctgtcaacgcacgcgctctgcctgcagtacagcaaaacaatttggacgaagaccttattcgtaaactggcttatgtggctgcaggtgacctggcccccatcaacgcttttattggagggctggccgcccaggaagtgatgaaggcctgctctggaaaattcatgccaattatgcaatggctgtattttgacgctctggagtgcctccccgaggacaaagaggtcctgacagaggataagtgcctgcaaagacagaaccgctacgatgggcaggttgccgtgtttggcagtgatctccaggagaaattgggtaaacaaaagtattttctggttggagccggagcaattggatgtgagctgctaaagaactttgcaatgattggcttgggttgcggggaaggaggtgagattattgttactgatatggatactattgagaaatcaaatctaaataggcagtttctgtttagaccatgggatgtcactaagctgaagagtgataccgccgcagccgccgtcaggcagatgaatccacatatccgcgtgacaagccaccagaatagggtcggaccagacaccgaaaggatctatgacgacgacttcttccagaatcttgatggagtggctaatgcattggataacgtcgacgctagaatgtacatggaccggcgatgtgtctattatcggaagccactactggaatctggaaccctggggactaagggaaacgtccaggtggtgatccctttcctaaccgaatcttattcctcatcccaggaccccccagaaaagagtatccccatctgtaccctgaaaaacttccccaacgctatcgaacacaccttgcagtgggccagagatgagttcgagggattgttcaaacagcccgcagaaaatgtcaatcaatatttaacggatcccaagtttgtggagaggaccctgcggcttgccgggacgcagccactcgaagttctggaggcagtgcagcgcagcctcgtgctgcagcggccccaaacctgggcagactgtgtgacctgggcctgccatcactggcacactcagtactccaacaacattaggcagctactgcacaattttccgcccgaccaactaacttcctcaggtgcccctttttggagcgggcccaagcgttgcccacaccctctcacctttgacgtgaataacccacttcacctcgattatgtcatggccgccgcaaacctgtttgcccaaacatacggtctcacagggtcacaggatcgtgccgccgtcgccactttcctgcagtcagtccaggtgcctgaattcacacctaaatcaggcgtgaaaattcacgtgtcagatcaggaattgcagagcgctaacgcatcagttgatgactcccgtctcgaagagctgaaggctaccctgccatctcccgacaaactacctgggttcaagatgtatccaattgacttcgaaaaagacgatgactccaacttccacatggatttcattgtggctgcatcaaatctgcgtgcggaaaattacgatatcccttccgccgaccgacataagagcaagctgatcgctggtaagatcattcccgcgatcgcaacaaccacggccgcagttgttgggcttgtgtgcctcgaactatacaaggttgtccaggggcatcgtcagcttgatagctataaaaacggattcttgaatttagcactgcccttcttcggtttctctgaaccacttgcggcccctaggcaccagtactacaaccaagagtggactctgtgggaccgcttcgaggtccagggcctccagcccaacggcgaggagatgacgctgaaacagtttctggattactttaagactgagcacaaactggagattactatgttaagccaaggagtgagtatgctctattctttctttatgcctgctgccaagttaaaagagcggttggaccagcccatgaccgagatcgtttctcgtgttagcaaacgcaagcttggtcggcacgtacgggcacttgttttagaactttgctgcaatgatgaatcaggagaagatgtcgaggtgccgtatgtgcgctatactatcagatag

SEQ ID NO: 34358 - DNA, 1521 bp, Artificial Sequence
  Description of Artificial Sequence: Synthetic coding sequence
atggggtttcatcatgtaggacaggcaggtctcgagccactgacctccggcgaccctagtgctctcgcaagtcaatcagcaggaatcactggagttagctattgtgcctggcctggcttcagtattgaagtcggtgagtgggggaggctcgaaggcttccccaccagtcgggtagcggtgaggctagtcctggctctgttcaccgacggcccctcaaacaatgcctgtgggaaccccttctgccagctgtggcctcacgttatctgtctgctttgtctccagtgggcccgagatgaattcgagggattatttaagcagccagccgagaatgttaaccaatatctcactgacccaaaattcgtcgagagaactctgcgattggcagggacccagccactggaggtcttagaagccgtgcagcgaagcctcgtgctgcagaggccgcagacctgggcagactgcgtgacatgggcctgccaccactggcacacacagtactccaacaacatcagacagcttctgcataacttccccccagaccagctcacctcatccggggcacccttttggagcggccctaagagatgcccccacccccttacattcgatgtcaacaaccccctgcacctggactacgtaatggcggccgccaacttgttcgcccagacatatgggttgaccggctcacaagatcgggccgctgtcgcaaccttccttcaatccgtccaggttcccgagttcactccaaagtcaggagtgaaaatacatgttagtgaccaggagttgcagtccgcgaacgcttctgtggacgactcacgcctcgaagagctgaaagctaccctgccatcaccggataaacttcctggttttaagatgtaccccattgactttgaaaaggacgatgactcaaactttcatatggactttattgtcgcggcttccaacctgcgtgcagagaactacgatatcccttctgccgatagacacaagtctaaactcatcgccggtaagatcattcccgcaatcgctactacaaccgctgctgtcgtgggcctggtctgtctggaactctataaggtggtgcaggggcatagacagctcgatagctacaaaaacggttttcttaatctggcattacctttttttgggttctctgaacccttggccgctccccgccaccagtactataatcaggaatggactctctgggatcgatttgaggtccagggcctgcagcccaatggcgaggagatgactcttaaacagttccttgattattttaagacagagcacaagttggaaatcaccatgctgtcccaaggagtgtccatgctgtattccttcttcatgcctgccgccaagctgaaggaacgactggaccagccaatgacggaaattgtgtcaagggtgagtaaacggaagttgggtcggcacgtgcgcgccctcgttctggaactgtgttgcaacgatgaatcaggcgaagacgtggaagtgccttatgttagatacaccatccgttag

SEQ ID NO: 34359 - DNA, 3177 bp, Artificial Sequence
  Description of Artificial Sequence: Synthetic coding sequence
atgtctagttcccccttaagcaaaaagcggcgcgttagcggaccagatcccaaacccggcagtaactgcagtcctgctcagtccgtgctttctgaagtgcccagcgtgcccaccaatggaatggcaaaaaatggttctgaggcagacattgatgagggcctctactctagacagctgtatgtgcttgggcatgaggctatgaagcgactccagacctcatcagtcctggtgtccggactgcgggggctgggagtggagattgccaagaatatcatcctgggcggggtgaaagctgtgactctgcatgatcagggcaccgcccagtgggccgacttgtcctcacaattttacctgcgggaggaggacattggcaaaaaccgagccgaagtgtctcagccccggcttgccgagctgaactcctatgtccctgtaactgcctacactggccctttggtcgaggactttctgtcaggcttccaagtagtagtgttaactaacacacccctggaggatcaactccgcgtgggcgaattctgtcacaatagaggcatcaagctcgtggttgctgatactcgcggtctctttggacagctattctgtgacttcggtgaggagatgattctcacggattccaacggtgaacaaccgctgtctgcgatggtgagtatggtcacaaaagataacccgggagtggtaacatgcttggacgaagcacggcatgggttcgagagcggtgatttcgtgtccttctcagaggtgcaagggatggtggagttgaatgggaatcagccaatggagatcaaggtccttggtccttacacatttagcatttgcgataccagcaatttcagcgattacatccggggcggcattgtttcacaggtgaaggttcccaagaaaattagttttaaaagcctggtggcaagcctggccgaacccgattttgttgtgactgactttgcaaagttcagtaggccagcacagctgcacatagggtttcaggcgcttcatcagttctgtgcccagcacggacgaccacctcggccccggaacgaggaagatgccgccgagcttgtggcactggctcaggctgtgaatgctcgcgccctgcccgccgtgcagcaaaataacctcgacgaagacctgattcggaagctggcctatgtcgccgctggtgacctcgccccgatcaacgcctttattggtggtctcgctgcacaggaggtgatgaaggcatgtagcggaaagttcatgccgattatgcagtggctgtacttcgacgcactagagtgtctccccgaggacaaagaggtgctcaccgaggacaagtgtttacaaagacagaatcgctatgacgggcaagtggccgtctttgggtctgatctccaggaaaagttgggtaaacagaaatattttctggtcggcgccggggccatcggctgcgagctattgaaaaacttcgccatgatcggactggggtgcggggagggaggagagattatagtgaccgacatggataccatcgaaaagagcaacctaaacagacaattcctcttcagaccgtgggatgtcacgaagctgaaatctgacaccgccgccgctgcagtccgccagatgaatcctcatatcagagtgacatctcaccagaatcgggtgggtcccgacacggaacgaatctatgatgatgattttttccagaatctcgatggagttgctaatgccctcgacaatgtggacgctaggatgtatatggatcgcaggtgcgtgtattaccggaaaccgttgctggaaagtgggaccctgggcaccaagggcaacgttcaggtggtaatccccttcctgacagagagctacagttccagccaggacccccctgagaagagtatccctatttgcacacttaagaacttcccaaacgccatagaacacaccttacagtgggcacgcgatgaatttgagggattgttcaagcaaccagccgaaaatgttaaccaatatctaaccgacccgaaatttgtagagcgcacgctgcggcttgctgggacacagccattggaggtgctagaggctgtgcagcggtcactggtgctgcagcgcccacagacttgggcagactgtgtcacctgggcctgccatcactggcacacacagtattcgaacaatattcgccaactgcttcacaattttccccccgatcagcttacgagctcgggagcccccttctggtctggacctaaaagatgcccgcatccactgaccttcgacgtcaacaacccactccacctcgactatgtcatggccgccgccaacctgtttgcgcagacctatgggctgacaggttctcaagatcgtgccgccgtcgccacattcctgcagagtgttcaggtgcccgaattcactcccaagagcggggtgaaaatccatgtgtcagaccaggagctgcaaagtgccaacgcgtcagtagacgactctcggctggaggagctcaaagccacattaccatcccccgacaaactgcccgggttcaagatgtatccgatagattttgagaaagacgatgactccaacttccatatggatttcatagtcgctgcctcgaatctcagagcagagaactacgatatcccttccgctgatcgacacaagtcaaaactgatcgccgggaagatcattccggcaatcgctaccacaacagccgcggtcgttggactggtctgtctggagctatacaaggtggtccaggggcaccgtcaactggacagctacaagaacggcttcctgaatctggcattgccgttcttcgggttcagtgaaccccttgccgccccgagacatcagtattacaatcaggagtggaccctttgggacagattcgaagtgcagggtttgcagccaaatggtgaagaaatgacgctgaagcaattcctggactatttcaaaactgaacataaactggagatcacgatgctcagccagggagtgagcatgctgtactccttcttcatgcccgcggccaagttaaaggagaggctcgatcaacctatgacagagattgtgagcagggtgtccaaacggaagttgggacgtcacgtgagggccctcgtgttggagctttgttgcaacgacgaatctggcgaggacgtggaagttccgtatgtcaggtatacaattaggtag

SEQ ID NO: 34360 - DNA, 816 bp, Artificial Sequence
  Description of Artificial Sequence: Synthetic coding sequence
atgtcaagttcgccattgtcaaagaaaagaagagtctctgggcccgacccaaaacccggaagcaattgctctcccgcacagagcgttctgtctgaagtccccagtgttcctactaacgggatggctaagaatggatcggaggctgacattgatgagggactgtatagtagacagctgtacgtgcttggccatgaggcaatgaaacggctgcagacatcatctgttctggtttccggcctcaggggtctaggagttgaaatcgccaagaacattattctaggcggtgtaaaagctgtgacccttcacgaccaggggacagcacagtgggccgacctgtcctcgcaattctacctgcgcgaggaagacatcggcaagaatagggctgaagtgtcccagccacggctggccgaactgaactcttacgtccccgtgacagcctatacgggacctctcgtggaggactttctctccggcttccaggtggtggtgctcacaaacacgccgctggaagatcaattgcgcgtgggggaattttgccataaccggggaatcaaattggtggtcgctgacactcgcgggcttttcggacagttattctgcgacttcggcgaggaaatgatcctaacagacagtaacggggaacagcctctttcagccatggtgtctatggtgaccaaagataatccaggggtggtaacgtgtcttgacgaagcaagacacgggtttgagagcggagatttcgtatccttctccgaggtccagggaatggtcgagttgaacggcaatcaaccgatggagataaaggttctgggctag

SEQ ID NO: 34361 - DNA, 522 bp, Artificial Sequence
  Description of Artificial Sequence: Synthetic coding sequence
atgctgtgtgtgatatatcacctcgacaatccagtcggaaagatgtcgtcgagcccactctctaagaagagacgcgtgtctggccctgatccgaagcctggatccaattgctcccccgctcagtcagtcctgagcgaggtccccagtgtacctaccaatgggatggcaaagaatgggtccgaagccgatattgatgagggcctgtacagccgccagctgtatgtattgggacacgaagccatgaagcggttgcagacttcttccgtactggtgagtggcttgagaggattgggcgtagagatcgccaaaaatataattctgggaggcgtgaaagccgtcacccttcacgaccagggtactgcccaatgggccgacttgtcaagccagttctacctgagggaggaagacattggcaagaatagagctgaagtttctcagcctagacttgcagagctgaactcttacgtgcccgtgaccgcatataccgggcctctagtggaggactttctatccggtttctag

SEQ ID NO: 34362 - DNA, 855 bp, Artificial Sequence
  Description of Artificial Sequence: Synthetic coding sequence
atgctttgcgtgatctaccacctagacaatcccgttggtaagatgtcaagcagtcccctgagtaaaaaacgccgggtgagtggtccggaccctaaaccaggcagcaattgttcccccgcgcaaagtgtgctgtccgaggtcccaagcgttcccacgaatgggatggctaagaatggctcggaggctgatatcgacgagggcctttattccagacagctgtatgttttgggccacgaggccatgaagagactgcaaactagttccgttttggtttcaggacttcgcggcctgggagtagaaatcgctaagaatattatcttgggcggagtaaaggccgtgacgctgcacgatcagggaaccgctcaatgggctgacctgtcctcccagttttacttacgggaagaagacattggtaaaaatcgcgccgaagtgtctcaaccacggctcgcagagttgaacagctacgttcctgttactgcctacactgggccattagtggaggactttctgagtggattccaggtggtcgtacttaccaacacgcccttagaggaccaacttcgggtgggcgagttctgtcacaacagaggtatcaagctggtagtagccgatacgaggggtctctttggccagttattctgcgactttggggaggagatgatactgaccgacagcaacggcgagcagcctctttccgcaatggtgtcgatggtgactaaagacaatcccggggtggtgacatgtctggatgaggctcgtcacggctttgagtcaggggacttcgtctccttttctgaggtgcaggggatggtggaactgaacggaaatcagcctatggagatcaaggtcctatag

SEQ ID NO: 34363 - DNA, 705 bp, Artificial Sequence
  Description of Artificial Sequence: Synthetic coding sequence
atgtctaaaccacattttccgccggccctccctgcccccgccgccatccccggaattaagggggaggagaatggctgcctgctgctgccaacctactccgtgccaggctccatgctgtgtgtgatctaccatctggataatcccgtggggaaaatgtcgtccagcccattatccaaaaaaagacgcgtgagtggcccggatcccaagcccggctctaactgtagtccagcccagagcgttctgagtgaggtcccctcagtacccacgaacggaatggctaagaatggcagcgaagcagacatcgacgaaggtttgtacagtcggcagttatatgtactcggacacgaggccatgaaaagattacaaacttctagtgtgctggtgtcaggtctgagggggctgggggtcgaaattgcaaaaaacataattttgggcggcgtcaaggctgtcactcttcatgatcaaggtaccgcacaatgggctgatttgtcatctcagttctacctccgggaagaggacataggcaaaaatcgcgccgaggtctcacagcccaggttggccgagttaaatagttatgtgcctgtcactgcctacacaggacccctggtcgaggatttcctgagcggattccaggttgtagttctgacaaacaccccacttgaagatcagctgcgggtcggggaattttgccacaacaggggatag

SEQ ID NO: 34364 - DNA, 588 bp, Artificial Sequence
  Description of Artificial Sequence: Synthetic coding sequence
atgagtaaaccacacttcccccccgcactccccgccccagccgctattcctgggatcaaaggggaggaaaacggatgtttgctgctgccaacttattcggtgcctggcagtatgctctgtgttatctatcatctggacaacccagtaggaaaaatgtcctcttctccgctgtcaaagaaacgacgagtgtctgggcccgacccaaagcccggtagtaactgcagcccagcccaaagcgtgctcagcgaggtgccgtctgttccgacaaacggcatggcaaaaaacggcagtgaagctgacatcgacgaggggctgtacagccgtcagctgtatgttctcggacatgaggccatgaagcgcttgcagacatcgtccgtactggtgtcgggcctgcgcgggctcggggtagagatcgccaagaacatcattttgggtggggtaaaagcagtcactctgcatgaccaggggaccgcccagtgggctgacctttctagtcagttctacctgagggaagaggatataggtaagaaccgggccgaagtgtcgcaaccgcgtctggctgagctgaacagctacgttccagtgtag

SEQ ID NO: 34365 - DNA, 843 bp, Artificial Sequence
  Description of Artificial Sequence: Synthetic coding sequence
atggctactgaggctcctgtgaacattgccccccctgagtgcagtaccgttgtgtcaacagctgtggactccctcatctggcaacctaactctctgaacatgcacatgatccggccgaagtccgcaaagggacgcaccagacctagcttacagaagagccaaggagtggaggtgtgcgcgcaccatattccaagccctcctcctgctatcccttatgaactgcccagttcccaaaaacccggcgcttgcgccccaaaaagtcccaatcagggcgcctcggacgagattcctgagctgcagcaacaggtgccgaccggggcttctagttcgctgaacaagtatcccgtattacccagtatcaatcgcaagaaccttgaagaggaggccgtagaaactgtcgctaaaaaagccagctccctgcaactatcgagcatccgcgcattatatcaagacgagacggggaccatgaaaacctctgaggaagatagcagggcacgggcttgcgcggtcgagaggaagtttatcgtgaggactaaaaaacaaggcagctcgcgagcaggtaacttggaggagcctagcgatcaggagccgagactgctcctagccgtgagaagtccgacaggccagaggtttgttaggcactttcgcccgaccgacgatctccagacaatcgtcgccgttgcggagcagaagaacaaaacgtcgtaccgccattgttccatcgaaacaatggaagtgccccgaaggaggttctccgacctgaccaaaagtctgcaggagtgtcgaattcctcacaagagcgtgctggggatctcattggaggacggggaagggtggccctag

SEQ ID NO: 34366 - DNA, 1155 bp, Artificial Sequence
  Description of Artificial Sequence: Synthetic coding sequence
atggccttcccatgccgacgctctcttaccgctaaaacgctcgcctgtctactcgtgggtgtatccttccttgccttgcagcagtggttcctgcaggccccacggtccccaagggaggaaagatcaccccaggaagagacgccggaagggcctaccgatgcccccgccgctgacgagcccccaagtgaactggtgcctggacccccctgcgtggccaatgcatcagccaacgctacagccgatttcgagcagctgccagccaggatccaggattttctccgttaccgacactgtcgccattttcccctgctctgggacgccccggctaagtgcgccgggggaagaggggtcttcctgttgctggctgtcaagagcgcacctgaacactatgagaggcgagagttgattcgccggacttggggccaagaaagatcttacggcgggcgccccgttcggcggctcttcctgcttggcacccctggccctgaagacgaggcacgggccgagcgtctggccgaactggtcgcacttgaagctcgcgaacacggagatgttttacaatgggcattcgctgatacatttcttaatctgactctgaagcatctgcacttattggactggcttgctgccaggtgcccacatgcccggttcctgcttagtggagacgacgatgttttcgtgcacaccgccaacgtagtcagatttctgcaggcgcagccacccggaaggcacctattttcaggacagttgatggaggggagtgtgcccatcagggattcttggagcaaatatttcgttccgccccagctgttccctggatcagcctaccctgtctattgtagcggtggcgggttccttctctctggccctactgcccgagctctgcgggctgccgcgaggcatacccccctttttcccatagatgatgcttatatggggatgtgtctggagcgtgcagggctagcccccagcggacatgagggaatttggcccttcggagttcagctgcctggagcacagcaaagctccttcgacccctgtatgtacagggaactgctcttggtgcacaggtttgccccttatgaaatgttgctcatgtggaaagcgctgcactctccagcacttagttgtgacaggggccacagagtctcttag

SEQ ID NO: 34367 - DNA, 792 bp, Artificial Sequence
  Description of Artificial Sequence: Synthetic coding sequence
atggctttcccgtgcagaagaagcctgaccgctaaaacgctggcatgtcttcttgttggggtttccttcctggccctgcagcaacggcggcgacagcgggtacccccgaccttgcctcgcccagccagagcgcatccgggactgcctgcggtaccgcaggaacgcagctacggcggaagaccagtgcggcggctttttttactgggtacacctggacccgaggacgaggcccgggccgagagactggcagagctcgttgccctggaggcccgagagcacggagatgtcctccagtgggcgttcgccgataccttcctcaacctaaccctgaaacatctgcatctgcttgactggctcgccgcccgctgcccccacgcacggttcctgctgtcaggtgacgacgacgtgtttgtccacaccgccaatgtggtaagattcctgcaagcccagccgcccggaagacatctgttttccggacagctcatggagggctccgtgccaatccgtgactcttggagcaagtatttcgtaccaccccaactttttcccggctctgcctatcccgtctattgctctggtgggggctttttactgagcggcctcgcgccatccggccatgagggcatcccatctgcatgttcacttcccggggcgcagcagagcagctttgacccttgtatgtaccgtgaactccttctcgtgcaccggtttgcgccctatgagatgcttttgatgtggaaggccctgcattcaccagctttaagctgtgatcgcggccatagagtatcatag

SEQ ID NO: 34368 - DNA, 366 bp, Artificial Sequence
  Description of Artificial Sequence: Synthetic coding sequence
atggccttcccctgtcgacggtcactaactgccaaaacactggcatgtctgcttgtgggggtctcctttctcgcccttcagcaatggttcttgcaggccccccggtcccctcgcgaggaacgttctccccaggaggagacccccgagggacccacggacgcaccggccgccgacgaacccccaagcgagctggtgcctggcccaccatgtgttgcaaacgcaagcgcgaacgcaactgccgatttcgaacagctcccggcgaggatccaggacttcctacggtaccgacattgccgacacttcccacttctttgggatgcacccgctaagtgcgccggtgggcgtggagtgttcctcttattgtag

SEQ ID NO: 34369 - DNA, 1158 bp, Artificial Sequence
  Description of Artificial Sequence: Synthetic coding sequence
atggcttttccgtgtagaagaagcctgaccgccaaaacactcgcctgcctactggtgggtgtgagcttcctcgcactgcagcagtggtttctgcaggcacccagatcaccgagagaggaaagatctccccaggaggagacacctgaaggacccacagatgctcctgctgcagatgaaccacctagtgagctggtgccaggtcccccatgcgtggcaaacgcttcagctaatgcgaccgctgattttgagcaactcccggcccgaatccaggactttcttcggtacaggcactgtagacacttccccctgctgtgggacgcccccgcaaagtgtgctggtggtcgcggggtttttttacttctggccgtgaagtccgcacctgagcattacgaacggagagagctgattcgccgcacatggggccaagaaagaagctacggagggagacctgtgaggcggttatttctgctgggaacgcccggaccagaggatgaagctagggcagaaagactagctgaattggtggcactcgaagctcgagaacacggcgacgtgctccagtgggcatttgccgacaccttcttaaatttgacactcaaacacttgcatttgctggattggctcgctgcaaggtgcccacacgctaggtttttacttagcggggatgacgacgtgtttgttcacaccgcaaatgtagtgcgttttttacaggcccagccacccggccgccatctgttttctgggcagttgatggagggcagtgtccctattcgggactcttggtcaaaatatttcgtcccacctcagctttttccaggttccgcataccctgtttattgctcaggcggggggttcttgctatccggacctacagcgcgggctctgcgggctgcggcccggcacactcccctgttccccatagacgatgcctatatgggcatgtgtctgggagcccggcggcctggggcacagaggccaagaggacatccaggaccctccgcgtgcagcctacccggggcgcagcagtcatcattcgacccctgcatgtatagagaattactgttagtacacaggtttgcgccctatgaaatgctcctgatgtggaaggccttacactcccctgcgttatcttgtgatcgtggacacagggtgtcctag

SEQ ID NO: 34370 - DNA, 1086 bp, Artificial Sequence
  Description of Artificial Sequence: Synthetic coding sequence
atgtccggggccggcgtcggaggagcatcagaggagagccaggccatgcaagcccatgtatccattatcctgccagtccacaatgccgaaccctggctcgacgagtgtctgcgatctgtgctccagcaggacttcgaggggacgatggagctctcagtattcaacgatgcgtctaaggataagagcggggcgattatcgagaaatggagggtaaagcttgaggactcaggagttcatgtgattatcggagggcacgatagtccctccccccgcggagtgggatacgcgaagaaccaggccgtggcacagagctctggtagctacttgtgctttctcgattccgacgatgtcatgatgccgcaacgcgtgcggctgcaacatgaggccgctgtgcagcacccgtcttcaattataggctgccgagtcaggagggaccctcccaattctaccgagaggtacactaggtggataaatcagctgactcctgagcaactccttactcaggtattcacatcaaacggccccaccgtcatcatgcctacttggttttgctcccgtgcatggttctctcatgtgggcccttttaatgaaggcggccagggcgttcccgaggatctgctgtttttctacgagcacctgaggaagggcggcggtgtgatccgcgtggatcagagcctgctgctctataggcaccacccacaagccgctacacattgtgtcctagagaccactatctggacccatcgagttaggttcctcgaggaacaggcccttcccagatgggccgcattcacaatatggaacgccgggaaacagggaaggcgattgtatcgctcacttacagcaggctcccagcgtaaggtggtcgccttctgtgacgtcgacgaaaataaaattcgaaagggattttactgccatgaggattctcaggaacgcccaaaacctcgaattccaatcctgcactttagagctgccaggccgcctttcgtaatctgcgtgaagctggacttgacaggaggggcattcgaagataacttgcgatcccttcatctgcaggagggtcaggattttctccatttttcatag

SEQ ID NO: 34371 - DNA, 1812 bp, Artificial Sequence
  Description of Artificial Sequence: Synthetic coding sequence
atggcagtggctcgcaagatccgaacacttctgacggtcaatatactggtctttgttggtatagtcctcttcagtgtgtactgccgcctacaagggagatcccaggagctcgttcgtattgtctccggagatcgccgggtccgcagcagacacgcaaaggttggtacactgggtgatagggaggcaattctgcagagactggatcacttggaagaggtggtctataaccagctcaatggactcgctaaaccaattggactggtagagggccccggtggtttagggcaaggtgggctcgcagccaccctgagagatgatggacaggaggcagagggtaagtacgaggaatatggctacaatgcacagttgtcagatcgcatcagtctcgatagaagtattccagattataggcctcggaaatgccgacagatgagttatgcgcaggacctacctcaggtgagtgtcgtgttcatcttcgtcaacgaggctttgagcgtcatcttgagatccgtgcattccgtcgtgaatcataccccatctcagctcctgaaggaagtcatattagtggatgacaattctgataatgttgagttgaagtttaatctggaccagtacgttaataagcgatatccaggactggtaaaaattgtccgaaatagtcggagagagggattaatcagagctagactgcagggatggaaggccgccacagccccggttgtgggctttttcgacgcccacgttgaattcaatactggctgggctgagccagcattgagtcgcatccgggaggaccgtcggaggatcgtcctccccgccatagataacatcaaatactccacttttgaggtccaacaatacgctaatgcggcgcatggttataactggggcttatggtgtatgtacattatcccgcctcaggactggctggatagaggtgatgaatctgcgccaattcggacccctgctatgattggctgcagctttgtcgtcgaccgtgaatactttggcgatattgggttgctggaccccggcatggaagtttatgggggcgagaatgttgaactcggcatgagagtttggcagtgcggagggtcaatggaggtgttgccctgctctagagttgcgcacatcgagcgcacgcgcaaaccttataataatgatattgattactacgctaagaggaacgcactcagggccgccgaggtctggatggatgattttaaatcccatgtttatatggcctggaatatacctatgtccaatcccggtgtggacttcggcgacgtttctgagagattagcattaagacagcggttgaagtgtagaagcttcaagtggtatctggagaatgtgtatcctgaaatgcgggtgtacaacaacacactgacttacggcgaggtgcggaactctaaagcatctgcctactgcctggaccagggagcggaagatggagacagggcaatcctatatccttgtcatgggatgtcttcccagctggtcagatactctgctgatggactgttgcagctcggacctctgggatctactgccttcctgcccgacagcaaatgtctggtggacgacggtacagggcgtatgcccacgttaaaaaagtgcgaggacgtcgcacgcccaacccaaaggctctgggatttcactcagtccggtcctattgtgtctagagctaccgggcggtgtctggaagtcgagatgagtaaggacgcgaattttgggttgcgactggttgttcagagatgtagtggacaaaaatggatgatccggaactggattaaacacgcaaggcactag

SEQ ID NO: 34372 - DNA, 714 bp, Artificial Sequence
  Description of Artificial Sequence: Synthetic coding sequence
atggaggtgttgccttgttcaagagtcgcccacatcgagcgtacaaggaaaccgtataataacgacatagattattacgctaaaaggaacgccttgcgcgcagccgaggtctggatggacgatttcaaaagccatgtttacatggcctggaatatcccaatgtccaatcctggcgtggattttggtgacgtgtcagaacgtcttgccctgagacaaagactcaaatgccgatcttttaaatggtatctcgaaaacgtgtatccagaaatgagggtctataataacaccctcacttatggggaagtgagaaactcgaaagctagcgcgtactgcttggaccagggtgccgaggatggtgatcgggccattttatacccatgtcacggcatgagttcccagctggtgcggtacagtgcagatgggttgctccagctgggcccactcggctccaccgctttcctccccgactcgaagtgtcttgtggatgacggcactgggcgaatgcctaccttaaaaaagtgtgaagacgtagctcgcccaacgcaacggctttgggacttcacgcagtctggtccaattgtcagtcgggccactggaaggtgtctggaagttgagatgagcaaggacgcgaacttcggactgcggctcgtcgtgcaacgatgttcaggccaaaagtggatgatacgaaactggataaagcacgctcgacattag

SEQ ID NO: 34373 - DNA, 1065 bp, Artificial Sequence
  Description of Artificial Sequence: Synthetic coding sequence
atgatcgggtgctctttcgtggtggatagagaatatttcggcgatatagggctgttggaccctggtatggaggtctacgggggggagaatgtcgaactaggaatgagggagacagaagggttccagcaggataaggtgaactacaagcagaataagcggggtagaaaaactcgccaacgcgtgaagcgctccaggagcgaggcccatcgcgcccagccctccccaggggctacccatggcgcccattctcgtgcccctgggcctagaacagaacccacggccgaaccttggggacatgctaggcctacagccgcgttacctgccactggcgtctggcagtgcggcggctcaatggaggtactaccatgttcccgcgtggcgcatatcgagcgtacacgtaaaccttacaacaatgacattgactactacgctaagcgcaacgcactgcgtgccgcggaagtatggatggatgatttcaagtcccacgtttatatggcatggaacatcccaatgagcaacccgggagtcgactttggcgacgttagtgagcggctggccttgcgacagcggctaaaatgccgttcctttaaatggtatctggagaatgtgtatccagagatgagagtatataacaacacacttacgtatggggaggtccgcaattcaaaagctagtgcttactgtttagaccagggagcagaagatggggatagggccatcctgtatccatgtcacggcatgtcaagtcaactggtgcggtacagtgccgatggtctgctgcagctcggacccctagggtccactgctttccttcccgattctaagtgtttggtggacgacgggacgggcaggatgccaaccctcaaaaagtgcgaggacgtggccagacccacccagagactctgggattttacgcagtctgggcccattgtgagcagggccaccggccgctgtctggaagtcgagatgagcaaggatgcgaacttcggactgcgcctggtcgtccagaggtgttcaggacagaaatggatgatacggaactggattaagcacgccagacactag

SEQ ID NO: 34374 - DNA, 294 bp, Artificial Sequence
  Description of Artificial Sequence: Synthetic coding sequence
atggaggttctcccctgtagccgtgtcgcccacattgagaggacaagaaaaccctacaataacgacatcgactactatgcaaagcgtaatgccctgcgggctgccgaagtctggatggatgatttcaaaagtcacgtatacatggcctggaacatcccaatgtccaatcccggcgtggatttcggagacgtgagtgagagattggcactgcgccagcgcttgaaatgccggtcctttaaatggtacttagagaatgtttacccagagatgcgcgtgtacaacaacaccctgtag

SEQ ID NO: 34375 - DNA, 714 bp, Artificial Sequence
  Description of Artificial Sequence: Synthetic coding sequence
atggaagttctgccatgttctcgggtcgcgcatatagaacgaaccagaaagccctataataacgacatcgactattacgctaaacggaatgccctcagagctgctgaggtttggatggacgactttaaatcgcatgtttacatggcatggaatataccgatgagcaatccaggtgtggactttggggacgtttccgagcggctggcactgcgacaaagactgaaatgtcggtcattcaagtggtatttggagaatgtatacccagagatgcgggtttacaacaatactctgacttatggggaggttagaaattccaaggcatctgcatattgcttagaccagggggccgaggatggtgatagagcaattctgtacccctgccatggtatgagcagccagttggtgagatattcagccgacggactgttgcagcttgggcccctgggttctactgcttttcttcctgattctaaatgtctggttgacgacggcaccggcaggatgcccaccctgaaaaagtgtgaggacgtcgctaggcccactcagaggctctgggactttactcagagcggacccatcgtgtctcgtgcaactggccggtgcctggaggtcgaaatgagcaaggatgccaattttgggttgcggcttgtggtgcagcgctgctcgggacagaaatggatgattagaaattggatcaagcacgcccggcattag

SEQ ID NO: 34376 - DNA, 165 bp, Artificial Sequence
  Description of Artificial Sequence: Synthetic coding sequence
atggaggtattgccatgttccagggtggctcatattgaaagaactaggaaaccttacaataatgacattgactactatgccaaaaggaacgcgctgagagcggccgaggtgtggatggatgacttcaaatcccacgtttacatggcgtggaatatacctatgtag

SEQ ID NO: 34377 - DNA, 714 bp, Artificial Sequence
  Description of Artificial Sequence: Synthetic coding sequence
atggaggtcttaccctgtagccgagtggcgcatatcgaacggacgagaaaaccctacaataatgacatcgactactatgcaaagaggaacgccctccgggccgctgaagtctggatggatgacttcaagtcccacgtgtacatggcatggaacataccaatgagcaacccgggcgtggattttggagatgtgagcgaacggctggccttacgccagagactgaaatgccggagttttaaatggtatctggagaacgtttaccccgaaatgcgcgtttataacaacactttgacatacggcgaggtgagaaattctaaggcatctgcgtattgtctcgatcagggtgccgaggacggggaccgagccattttgtacccttgccatgggatgtcatctcagttagtccggtatagtgctgacgggcttctccagctgggccctttgggcagcacggcctttctgccagattcaaagtgcttggtggacgatggaactggacgcatgcctacacttaagaagtgtgaagacgtggcccgacccacacagcgcttgtgggatttcacccagagtgggcccatagtctctcgagccactgggaggtgtttggaggtagagatgtctaaggacgccaactttggactccggctggtcgtacaacgttgcagcggacagaagtggatgattcgaaactggattaagcatgcaagacactag

SEQ ID NO: 34378 - DNA, 1812 bp, Artificial Sequence
  Description of Artificial Sequence: Synthetic coding sequence
atggctgtcgcacgcaagattaggacattactgacagttaatattttggttttcgtgggcatcgtgctcttctcagtgtactgcaggctacaggggcgctcgcaggaacttgtgcggatagtctctggcgatcgccgggtgcgttcaaggcacgctaaagttggaacactaggagaccgcgaagccatactacaaaggctggaccacctcgaggaggtggtgtataaccagctcaacggactggcgaaaccaatcggattggttgaaggccctggaggcctgggccagggtggtctggcagctaccttacgcgacgacggacaggaagccgagggaaagtacgaggagtacggctataacgcccaactgtcagaccgcataagcctggaccgctctattccagactataggccacgaaagtgcagacagatgagctacgctcaagacctgccgcaagtgtccgtagtcttcatctttgtgaatgaggcgctgagcgtgatactcagatcagtgcattccgtggtgaatcacacacccagccagcttctcaaggaggtcattctggtagatgataattctgacaatgtggagttgaagttcaatttggaccaatacgtcaacaaaagatatccgggcctggtcaaaatcgttcgaaatagccgcagggaggggctgattcgcgccagacttcaagggtggaaggcagcaactgctcccgtggtgggctttttcgacgcccacgtagaatttaacacaggatgggcggagccagccctcagtcgcattagggaggataggcgtaggattgtgctgcccgccattgataacattaagtacagcacctttgaggtccagcagtatgccaacgctgcacacggatacaactgggggctgtggtgcatgtatatcatcccccctcaagattggctggataggggtgacgaatctgccccaatcagaaccccagccatgattggctgtagctttgtagttgaccgcgagtactttggcgatattgggctcctggaccccgggatggaagtttacggcggagagaatgtggaactgggaatgagagtgtggcaatgcggagggtccatggaggttctaccctgctccagggtggctcacatagaaagaaccaggaagccttacaataacgacatcgactactacgcgaagcggaacgccctgagagcagcagaagtgtggatggatgacttcaaaagccacgtgtatatggcgtggaacatccccatgtccaaccccggggttgacttcggcgacgtttctgagaggctcgcgctcaggcagagactgaagtgtagatctttcaagtggtatcttgagaacgtctacccagaaatgagagtgtataataataccctgacatatggggaggtccggaactccaaggcatccgcttattgtcttgatcagggagctgaagatggggacagagccatcctgtacccctgccacggtatgtctagccagctggtccggtacagtgccgacggcctgttacaactcggtcctctgggcagtaccgcgttcctcccagattctaagtgtcttgtggacgacggtacgggccggatgccaactctgaagaagtgcgaggatgtggctagacctacccagcgtctatgggatttcacgcagtccggccctatagtgagcagagccaccggccgatgtttggaagtggagatgtcgaaggacgctaacttcggtctgagactggtggtgcagcgctgcagcggccagaagtggatgataaggaactggatcaagcatgcgagacactag

SEQ ID NO: 34379 - DNA, 1155 bp, Artificial Sequence
  Description of Artificial Sequence: Synthetic coding sequence
atgggccctgggccttctcccaactggacactggatcctgagccccgctgcagactttggtcagagccacgcctgcccgctggaccgggtgtactagcagcgggctcacctcggctaccttgtcggtacgtgatgacctccgaatttacactgggtcccacagccgaatttttccgtgaacacaactttttccatttggatccagccaacgtggtgatgtttgagcagagattactgcctgccgtgacttttgacggaaaggtgatccttgagagaaaagacaaagttgcaatggcaccagacggcaatggtgggctgtactgtgccttggaagatcacaaaatccttgaagatatggagcggaggggcgtcgagttcgtccacgtgtattgcgtcgacaatatcctagtgcggctcgccgaccctgtcttcatcgggttttgcgttctgcagggcgctgattgtggagccaaggtggttgaaaaggcctaccccgaagagcctgtcggagtggtatgtcaagtggacggagtgccacaggtcgtcgagtactcagagatctcccccgagaccgcacaactgcgcgcttctgacgggagtctgctgtataacgctggcaatatatgtaatcatttcttcacgcggggctttctcaaagcggttactagagagttcgagccgctcctaaagcctcatgtggccgtgaaaaaggtcccctacgtggacgaggaaggcaacctggtcaaacccctaaagccaaacggaatcaagatggagaagttcgtgttcgacgtcttccgctttgctaaaaacttcgcggccctcgaggtgctgcgagaagaagagttcagtccactgaagaacgccgagcccgccgatcgggactcccctcggactgctcgtcaggctttactgactcaacactacagatgggcacttcgagctggtgctcggtttctagacgctcatggtgcatggttacccgaactcccttccctgccacccaatggggatccccccgcgatatgcgaaatttcccccctggtgagctactcgggcgaggggctggaggtctacttgcagggtcgtgagtttcagtccccactgatcctggatgaagaccaagcccgggaaccgcagctgcaggaatcatag

SEQ ID NO: 34380 - DNA, 1524 bp, Artificial Sequence
  Description of Artificial Sequence: Synthetic coding sequence
atggcctctgagcaggatgtaagagcccgcctccagcgcgcaggacaggaacacctgctgcgattttgggctgagctcgctcccgaacctagggccgccctcctggccgagttggccctcctcgagccagaggcattaagggagcactgccgtcgcgcagctgaagcgtgcgctcggccgcacggtccaccacctgaccttgcagcccgtttgcgccctctgccccctgagagagttggacgtgcaagccgctctgacccagagaccagacgccgatgggaagaagaaggcttccgacagatcagcttgaacaaagtggcggtgcttctcctggctgggggtcagggtacacgattgggcgtcacatatcccaagggaatgtaccgagttggactgcccagcaggaagaccctgtaccaactgcaagcggagagaattcgccgcgttgagcagctcgccggtgaacgacatggaaccagatgcactgtcccctggtacgtgatgacaagcgagttcacactgggtcccacagctgagttcttcagggagcacaacttttttcaccttgacccggcaaatgttgtgatgttcgagcaacggctgcttcccgcagttacttttgatgggaaagtgatcctcgaacgaaaggataaggtagctatggccccagacggcaacggaggactgtattgcgctctcgaggaccacaagattcttgaggatatggaacggcggggcgtggaatttgtccatgtatattgtgtggacaacatcctcgtgcggcttgcagaccccgtttttattggcttttgtgtcctgcagggagccgattgtggggccaaggtcgtagagaaggcctatccagaagagcctgtcggggttgtctgccaggtggatggagtgccacaagttgtggagtatagcgagatttcacctgaaacagcacaacttcgggcgagcgatggatccttgctttacaacgctggcaatatctgcaatcactttttcacccgggggttcctcaaagccgtcacgcgcgagttcgagccattactgaagccacacgtggcagtgaagaaggtgccgtacgtggacgaggagggaaatctcgtgaaacccctgaaaccgaacggaattaaaatggaaaaatttgtgtttgacgtgtttcgttttgcaaagaactttgcagccctcgaagtcctccgagaggaggaattctctccccttaagaacgctgaacccgcggaccgcgattctcctcgaaccgcccgccaagcacttctgacccagcactaccggtgggccctgcgagcgggagcccgctttctcgacgctcatggagcttggttgcccgagctgccaagcttgcctcccaatggggacccccccgcgatatgcgaaatatccccactcgtatcctattccggggaaggattggaggtataccttcaggggcgcgagtttcaaagcccattgatactagacgaggaccaggcccgcgagcctcagctacaagagtcgtag

SEQ ID NO: 34381 - DNA, 4323 bp, Artificial Sequence
  Description of Artificial Sequence: Synthetic coding sequence
atggctgggattattaaaaagcaaatactcaagcatctcagtagattcacaaagaatctgagccctgacaaaatcaatctgagtaccctgaagggagaaggacagttgaccaacctggaattagatgaggaagtgctccagaacgtcctggagctgcccacgtggttggcaatcactcgcgtctactgtaaccgcgcttctatccggatccagtggacgaagctgaaaacccatcctatctgcctttgtcttgataaagtggaggttgagatgaagacatgcgaagacccccggcccccaaatggccaaagtccaatcgccctggcttcaggacagagcgagtacggcttcgctgaaaaggtggtggagggtatgtttatcatcgtcaactcaatcactattaaaatccattcgaaggcgtttcatgcatccttcgagctgtggcaactacaaggctactccgtcaacccgaactggcaacaatccgatctgaggcttacccgcattaccgacccttgccgaggcgaagtgctcacttttaaagagataacctggcagacactgaggatcgaggctgacgctactgacaatggggaccaggacccagtgacaaccccactgagactaattacaaaccagggaaggatacaaatagctttaaaaaggaggacaaaggattgtaatgtgatcagcagtaaactgatgttcttgttagatgacttattgtgggtgctgaccgacagtcaactcaaagccatgatgaaatacgctgaatcattatctgaggcaatggaaaagtcagctcatcagcgtaaaagcctggcaccagagcctgtacagattactccacccgcccccagcgcccagcagtcttgggctcaggcatttggcggctcccagggaaattctaactcaagcagcagtaggctgagtcaatattttgagaaatttgatgtaaaggaatcgagctaccacctcctcatttctcgactggacttgcatatatgtgatgacagccaaagtcgggaaccaggggttagtgccaatcgactgatgggtggtgccatgcagctgacattcagaaagatggcgtttgattattacccatttcactgggccggcgactcatgcaaacattgggtcagacactgtgaggcaatggaaacccgcggccagtgggctcagaagctcgtgatggaattccagtcaaaaatggaaaagtggcacgaagagacaggtctgaagcctccttggcatctaggagtcgactcactgttccgcaggaaagccgattctctgtcttcaccccgcaaaaatcctctggaacgctcacccagtcagggaagacagcctgcgtttcagccaccggcctggaaccgccttcgcagcagctgtatggtggttagagttgacgatctcgatattcaccaggtgtcaacagctgggcagccaagtaaaaagcctagcacattgctgtcctgctcccggaaacttcacaacctgcctactcaagtgtctgcaattcatattgaattcactgaatactatttccctgataatcaggaactgccagttccatgcccgaacctgtatattcagctcaatggacttactttcaccatggaccccgtgtccctcctctggggcaacttgttctgcctagacctgtatagaagtttggaacagtttaaagcgatctacaaactcgaggacagcagtcagaaggacgagcacctggacattcggcttgatgcattctggttaaaggtgtctttcccactggagaagcgcgaacgagcggaactccaccgtcctcaggctctggtattcagcgcctccgggatgattgctaccaatactaggcacgcacctcactgcagctgttccgacctacagagcctgtttagaggcttcgctgccgccgagttctttcacagtaactacgaccattttcccaaggtgcccggcggttttagcctactgcatatgctttttttacaccacgcgttccaaatggactcttgtctgccccagcctaacacactgcccccgcagcgccccaaggccagttgggacctgtggtccgtccatttcacacagatttccttagacttcgaaggaacagagaactttaagggtcacacattgaacttcgtggcccccttccctttaagtatctgggcatgtctccctctgcgctggcaacaagcacaggctcggaaactgctgctcgcctccgaaggccggttgaagccctcagctagttttgggtcaccagtccagagcgaggctcttgctcctgactcaatgtctcaccctcggtcaaagaccgagcatgatctgaaatcgctgagcgggctaacagaagtcatggagatcctcaaggagggcagttctggcatggacaacaaggggcccctgacagaattggaagacgtcgccgacgtacacatgcttgtgcactcacccgcacacgtccgcgtgcggcttgaccattatcagtatcttgccttgttacggttgaaggaggtcctccagcgcctgcaggagcagttgaccaaagatacagaaagcatgactggatcaccccttcagaaccagacggcttgcatcggggtgctctttccctccgctgaagttgctttgctgatgcacccagcgccaggcgctgttgacgctgactctgctggatccgactctactagtctggtggacagcgagctgtcaccgagcgaagaccgcgaactgaaatccgatgcatcttccgatcagggacctgcttcacctgaaaaggtcttggaggagtcctccattgagaatcaggatgtgagtcaagagcgcccccattccaacggcgagcttcaggactcgggaccacttgcccagcaattggccggcaagggacacgaggcagtggaaagcctacaagccaagaagctctcaagaacacaggcctcctcatctcccgctgcactgaagcctcccgctgggagagagactgcggttaacggccagggtgagctgataccactgaagaacattgagggtgagttatcaagcgctatccatatgactaaggatgcgactaaggaagcattgcacgcaacaatggatctgacaaaggaggctgtctcattaaccaaggatgccttttctctcgggcgggacaggatgacgtctacaatgcataagatgctgtccctgccacccgccaaagagccgatggctaagactgacgagggggtggccgcacctgtgagtgggggtgctgcgcgcctcaggtttttctcaatgaagcgcacagttagccagcagtctttcgatggcgtatctctcgatagctctggccctgaagataggatttccgttgactctgatggaagtgatagtttcgtgatgctcctggaaagcgagtcggggcccgagtctgtgccacccggaagcctgagtaatgtaagcgataacgccggtgtgcaaggaagcccccttgttaacaattacgggcagggaagcccagccgcaaattcttcagtgtctccatccggcgaggacttgatatttcaccctgtttctgtattagtgctgaaggtgaacgaggtgagttttgggattgaggtgcggggcgaagacctcacagtcgccttacaagctgaggaactgaccctgcagcagctcgggacggtggggctatggcagttcctgcacggccagtgccccggaacttgcttccaggaatcaagcacattgaagaccgggcacattcggccagccgtgggcttacggtttgaagtgggccccggggccgcggtacactccccgctggcctcacagaacggcttcttgcacctactacttcacggctgtgatctcgagttactgacctcagttctttcgggcctgggtccgttcctggaagatgaagaaatcccagtagtggttcccatgcagatcgagctcttgaactcctccatcaccctcaaagatgacattccccctatctatccaacctctcccggtcctatccccatcaccctggctatggagcacgtcgtgttgaaacgatcagatgatggagttttccatataggcgccgcagctcaggacaaaccttctgccgaggttctgaaatctgagaaacggcaaccccccaaagagcaggtgttcctggttccaactggggaggttttcgagcagcaagtgaaggaactccccatcctacagaaagagctgatagaaacaaagcaagccctggccaacgcgaaccaagacaaagagaagcttctccaggaaattcggaaatacaatccatttttcgagctttag

SEQ ID NO: 34382 - DNA, 4203 bp, Artificial Sequence
  Description of Artificial Sequence: Synthetic coding sequence
atggctgggattatcaaaaagcagatcctgaagcatctgtcccggtttaccaaaaatctttctccggataaaataaacctttccaccctcaaaggcgagggtcaattgaccaacctggaattagacgaggaagtcctacagaacgttttggaacttccgacttggctggccattacaagagtgtattgtaacagagcttctatcagaatccaatggactaaattaaaaacccacccaatttgcctgtgcctagacaaagtcgaagtggagatgaaaacatgtgaggatcccaggccccctaacggacagagcccaattgccctcgcgtccggccaatccgaatacggatttgcagagaaagtcgttgagggtatgttcatcattgtcaatagcatcacgataaagattcacagcaaggccttccatgcatcttttgagctttggcagcttcagggatactcggttaaccccaactggcaacaaagtgatctgcggctcacccggattaccgatccttgcaggggcgaggttctgacgttcaaggagattacctggcagacactgaggatcgaagcagacgccacagacaacggcgaccaggatccagtcacaacacctctgcgactaatcaccaatcagggtcggatacaaattgcactgaaaagaaggacaaaagattgcaatgtcatctcttcaaaactgatgtttctgctggatgatctgctgtgggtgctgaccgattctcaactcaaggccatgatgaagtacgctgaatctctcagtgaagccatggaaaaaagtgctcaccagagaaaaagcctagcacctgaaccagtacagatcacccctccagccccctcagcacagcaatcttgggctcaggctttcggcggcagccagggtaactcaaatagctcatcctccaggttgagccaatattttgaaaagttcgacgttaaggagtctagttaccacctgctgataagtagacttgatctgcacatctgtgacgatagccagtctcgggagcccggcgtgtcagccaaccgcctcatgggcggcgccatgcagcttacttttcgcaaaatggcatttgattactacccatttcattgggctggcgattcctgcaagcattgggttcgccattgcgaagccatggagaccaggggacagtgggcccagaagcttgttatggagtttcagtcgaaaatggagaagtggcatgaggaaaccggattaaaacctccatggcatctgggggttgactctctcttcaggcggaaggctgactccctctcctcccctcgaaagaatccgcttgagcgttccccctcacaaggccggcagcctgcctttcaaccacccgcctggaaccgcctcagatcttcatgcatggtggtacgggtcgatgatctcgatattcatcaggtatctacagcaggtcagccttcaaaaaagccttcaacgttgctctcatgctcccgcaagctacacaacttgccaactcaggtgtccgcgattcacatcgaatttacagaatactacttcccggacaaccaggagcttcccgtcccctgcccaaatctctacattcaactgaacggcttgactttcaccatggacccagtcagtttattgtggggcaacttattctgccttgacctttatagaagcctcgagcagttcaaagcgatttacaagctcgaggatagttctcaaaaggacgagcacctggacatccgactggacgctttctggcttaaagtgtctttccctctggaaaagcgggagcgtgccgaactccacaggccacaagcattggtattctcagcctccggcatgatcgccacaaacaccagacacgcaccacattgttcttgtagcgacctgcaatctctgtttagggggtttgcggccgccgagttttttcattccaactacgatcatttcccaaaggttcctggggggttctctttgctgcatatgctttttctccaccacgcattccaaatggactcttgcttgccgcaacccaataccctgccccctcagcgtccaaaagccagttgggacctgtggtccgttcattttacccaaatttctctggacttcgagggaactgagaactttaagggacacaccttaaatttcgtggcacccttcccactctctatttgggcatgtcttcctttgagatggcagcaggctcaagccaggaagctgctgctggctagcgagggccgccttaagccttcagcttccttcggatcaccagtgcagtcagaagccttagcacccgactccatgagtcatccacgttccaagactgaacacgatctgaaaagcctgtccggcttgacagaggtaatggagatcctcaaagaaggctcatccggtatggacaataaggggcccttgacagaacttgaggacgtggccgatgttcacatgctcgtgcattcacctgcccatgtgagggttaggctggaccattatcagtacctggcactcttgagacttaaggaagtactacaacgcttacaggaacagctgaccaaagacaccgaaagcatgactggatctccgctccagaatcagaccgcctgcattggggttctttttccaagtgccgaggtggccttgctgatgcaccccgctcctggagccgtcgacgccgatagtgcaggctccgactctacaagcctggttgattcagagctgtccccatcggaagatcgcgaattgaaatcagacgcatcctcagatcaggggcccgccagcccagaaaaggtcttggaagagtcctccattgagaaccaggacgtctcccaggaaagaccgcacagcaacggggaactgcaggactcgggccctttagcccaacagcttgccggcaaaggccacgaagcagtggagtcgcttcaggctaaaaaactgtcaagaacacaagcatcttcttctcctgccgctctcaaaccacctgccggccgcgagactgctgtgaacggacagggtgagctcattcctctcaaaaatatcgaaggagagctcagctcggcaatccacatgaccaaggacgcaacaaaggaggcactgcatgcaactatggacctgacaaaggaagcagtgagtctgactaaggacgccttctcactgggccgggacaggatgacctcgacaatgcacaagatgctgtctttgcctcccgccaaggagccaatggcaaagaccgacgaaggtgtggctgcaccggtcagtgggggtgccgccaggcttagattcttctctatgaagagaacggtatcccagcaaagcttcgacggagtgtccctggatagctccggacccgaggacagaatttctgtggactccgacggatcagactcttttgtgatgttgctggaaagcgagagcggacccgagagtgtcccccctggcagcctgagtaatgtgtccgataatgctggcgttcagggttcaccactcgttaacaactatgggcagggaagccccgccgctaacagcagcgtatctccttctggcgaggacctgattttccatcctgtcagcgtactcgtgctcaaagttaatgaggtgtcctttggaatcgaggtacggggcgaggacctgaccgtggcattacaagcggaggagctaacattgcaacagttgggtacagttgggctgtggcaatttctccacgggcagtgcccagggacctgctttcaggagtcctctaccctaaagactgggcatattagacctgctgtaggcttgcgcttcgaggtaggacctggtgcagcagtgcacagccctctcgcgagccagaacggctttctgcatcttttgttacacggctgcgacttggagctgttgaccagcgtcctgtcggggctggggccgtttctcgaggatgaagaaatcccggtggttgtccccatgcaaatcgagctactaaattcctccataaccctgaaagatgatattccccccatctatccaaccagcccgggcccaatcccgatcacactcgccatggaacacgtagttcttaagcggtcagacgacggtgtatttcacatcggagccgctgcccaagataagccgagtgccgaagtgctcaaaagcgaaaagcggcaaccaccaaaggagcaagtgttcctagtgcccacaggtgaggttttcgagcagcagacgtag

SEQ ID NO: 34383 - DNA, 4395 bp, Artificial Sequence
  Description of Artificial Sequence: Synthetic coding sequence
atggctgggattattaaaaagcagatcctgaagcacttgtcgaggtttacgaaaaacctaagtcctgataaaattaacctctccactttgaagggcgagggggagttgaagaacctggaactcgacgaagaggtcttacagaacatgctggaccttcctacttggctggctatcaacaaagtgttctgtaacaaggcctctatcagaattccatggaccaaactcaaaacgcatcccatctgcttaagtttggataaggttatcatggaaatgtccacgtgtgaagagccacgttcgcctaacggaccctcccccatagctaccgccagtggccagtcagagtacggtttcgcagagaaggtagtggaaggtatcagtgtctccgttaattctattgtgatccgcattggcgccaaagcttttaacgcctcttttgagttaagccagctgaggatctacagcgtcaacgctcattgggaacacggcgacttaaggttcactagaatacaagatcctcagaggggtgaagtgcttacttttaaagagattaactggcagatgattagaattgaggctgacgctactcaaagctcacatctcgagatcatgtgcgcccccgtccgactgattaccaatcagtcaaagattagagtgactctaaaacgacggctgaaggattgcaatgttattgctaccaagttagtgctcatccttgacgatctcttgtgggtactgacagatagccagttaaaagctatggtgcagtacgccaaaagtctgtccgaagctatcgagaaatccaccgagcagcggaagagtatggcgcccgagcccacccagagttcaaccgtcgtcgcatccgctcaacaagtcaaaaccacacagactagtaacgccccggatgtgaacgacgccatcgttaagcttttcaacgactttgacgtcaaggagacctcccatcatttggtgatctcccatctggacctccacatatgtgatgatatacacgctaaagagaaggaatcgaaccggcggatcacaggaggagctatgcaacttagtttcactcagcttaccatcgactactacccataccacaaagccggggactcttgtaatcattggatgtacttttctgatgctaccaagacgaaaaacggctgggctaacgaactcctgcacgaattcgaatgtaatgtagaaatgctgaaacaagctgtaaaggaccataacgtcggctcaccacctaaatctcccacccatgctagcccccaacacacccagacagaaaaggactatcctctgaagggaacctgcaggaccccctcggtgctgtctcagcagtccaaagccaagttaatgtcaagttccgtcgttgtaaggttagcggatttcaacatttatcaagtgtcaactgccgaacagtgtagatcatcgcctaaaagcatgatatgctgcaacaagaaatccctgtatctgccacaggagatgtctgctgtatatatcgagtttaccgagtactattatcccgatggtaaggactttccaatccctagtccgaatctgtactcacaactcaatgccctgcagtttaccgttgacgaacgatccatactgtggctgaatcaatttctcctcgacttgaaacaatctctgaaccagttcatggctgtgtacaagctgaacgacaactctaagtccgacgagcacgttgacgtgcgggtagatggcctgatgcttaaatttgtgatcccctcagaagtcaaatccgagtgccaccaagatcagcctagagcgattagcatccagtcctccgagatgatcgctactaacacccgccactgtcccaattgtcggcactccgacttggaggctttgttccaagatttcaaggactgcgattttttctccaagacatacacatcatttccaaagtcttgtgataacttcaatcttctgcatcctatcttccagaggcacgctcacgagcaagatactaagatgcacgaaatctacaaggggaacattacccctcagctcaacaagaacacgttgaagaccagcgctgccactgacgtgtgggctgtgtacttctcccagttctggattgattacgaaggaatgaagtcaggcaagggaaggccgatctcttttgtcgattcctttcccttgtcgatctggatttgccagcccacccgctatgccgagtcccagaaggaaccacagacctgtaaccaggtgtcactcaacacttctcaatctgagtctagcgacctcgccggaagactgaagaggaagaagttgctaaaagaatactatagcactgagtctgagcccctgactaacggaggccagaaacctagctccagtgacacgtttttccgcttctctccatcttcttcggaagccgacatccacctgctggtgcatgtccacaagcacgtctcgatgcagatcaaccactaccagtacctgctgcttcttttcctccacgaaagtttaatcctgctgtccgaaaacctgcgcaaggatgtagaggccgtaactgggtcgcccgcgagtcaaactagcatctgtattggcattctccttagatctgcagaactcgcactgttgctgcaccccgtggaccaggccaacactctcaagtctcccgtgtcagagagcgtttctcctgtggtacccgactatctgccaactgaaaatggtgactttctcagctcaaagcggaaacagatatcccgtgacattaaccggatccggtcagtgaccgtgaaccatatgagcgacaaccggtctatgtccgtagatttgagtcatattccccttaaggatcctttactttttaaatctgcctccgacaccaacttgcagaaaggtatcagctttatggattacttaagcgacaagcacctgggaaagatatccgaagacgagtcgtctggtctggtctacaagtcgggatcaggggagatcggatctgagacttctgacaaaaaagatagcttctatacggattcatcctctatcctaaactatcgagaagactcaaacatcctgtccttcgatagcgacggaaaccaaaatatactgagctcaacactaacctctaaaggaaatgaaaccatcgaaagcatcttcaaagccgaggatttgctaccagaggccgcctccctctcggagaacctggacatcagtaaagaagaaaccccccccgtacgcacgctgaaatctcaaagctctttaagtggcaagcccaaggagcgatgcccccccaatctggccccactgtgcgtgagttataaaaatatgaagcggagctcttctcagatgtccctcgacaccatcagcctggattcgatgatccttgaagagcagctgctcgagagtgacggcagcgattctcacatgtttctggagaaaggaaataaaaaaaattccaccacgaattatagaggaacagcagaaagcgtgaatgccggggctaacttgcaaaactacggagagacaagccccgatgccattagcacaaacagcgaaggagctcaggagaatcacgacgacctgatgtctgttgtcgtttttaagatcaccggggtgaatggggaaatagatatccgcggagaagacacagagatttgcctacaggttaaccaggttacccctgatcagctgggtaatattagtctgagacactacctgtgcaaccggcccgtcggctctgatcagaaagcggtgattcatagcaagagttcacctgagatctcactaagatttgaaagcggccccggcgcagtcatccatagtctgctggcagaaaagaacggcttccttcaatgtcacatcgagaatttttcaaccgaatttctcacttcttccctgatgaacatccaacacttcctagaggacgagaccgttgccacagtcatgccaatgaaaattcaggtgtccaacacaaaaatcaatctgaaggatgactctccacggagcagtaccgtctctctggagcctgccccagtcacagtgcacatcgaccaccttgtcgttgagagatctgacgatggctcgtttcatatacgtgacagccacatgctcaatacaggtaatgaccttaaagagaatgtaaagtcagattcagtcctcctaacctcgggcaagtacgacctgaagaagcagcgatctgtgactcaagcaacgcagactagccctggcgtgccttggcccagtcagtccgccaactttcctgaattttcattcgacttcactagggagcaactgatggaggagaacgaaagcctcaaacaagagcttgccaaagcgaaaatggccctcgcagaggctcatcttgagaaggatgcgctgctgcatcacatcaaaaaaatgaccgtggaatag

SEQ ID NO: 34384 - DNA, 1569 bp, Artificial Sequence
  Description of Artificial Sequence: Synthetic coding sequence
atggccgggatcattaaaaaacaaatcctgaaacatctgagccgcttcaccaagaatcttagccctgataaaattaacctgagcactctgaagggggagggtgagctaaagaatcttgagttagatgaggaggtcctccagaacatgctcgatctgcctacctggctggccatcaataaggtcttctgcaataaggcaagcatacgcattccctggacaaagctcaagacccaccccatttgtctctccctcgacaaagtgataatggaaatgtctacatgtgaagaaccccgttccccaaatggcccttccccaattgcgaccgctagcggtcagagcgaatatgggttcgcagagaaagtggtggagggcatcagcgtctccgttaactctatcgttatccgcatcggggcaaaagccttcaatgcttctttcgagctgtcccaattgcgtatctactcggtgaatgcccactgggagcacggggatctgagattcactcgtatccaggatccccagcgcggtgaggtcctcacctttaaggagatcaactggcaaatgattagaatcgaggcagatgcgacccagtcgagccacctggagattatgtgtgcccccgtgcggcttattactaatcaatctaaaattagagtaacactcaaaagaaggctgaaagattgtaatgtaattgcaactaaactcgtgctaatactggatgatctgctgtgggtgctaactgacagccaactgaaggcaatggtgcagtacgccaagagtctgtccgaggccattgaaaagagtactgagcagaggaagagtatggctccggaacctacgcagagtagcaccgtggttgctagcgcccagcaggtcaagactactcagactagtaatgctcccgacgtgaacgatgcgattgtcaagctgtttaacgactttgacgtgaaggagacttcccaccatctggtaatatcccatttggacctacacatttgcgacgatatacatgcaaaagaaaaagaatccaatcgcagaataacaggtggtgcaatgcagctgagttttacacagctgaccatcgactactatccctaccacaaagcgggcgactcatgcaatcactggatgtatttctctgacgctactaaaacaaagaatggctgggctaatgaactgctgcacgaatttgagtgtaacgtcgaaatgcttaagcaggcggtgaaagatcataacgtcgggtctcctcccaaaagccccacccatgcctccccacagcacacacagaccgagaaggactatcctctcaagggaacttgccggacaccctccgtcttaagccaacaaagtaaagccaagctgatgtcgtcctctgtagtcgtgcggcttgcagacttcaatatttaccaggtaagcaccgccgagcaatgtcgctcatccccgaagtcaatgatctgctgtaacaagaaaagcttgtacctgccacaggagatgagcgccgtatacattgagttcactgagtactactacccagacggaaaggacttcccgacagcgttcctgtctcgctag

SEQ ID NO: 34385 - DNA, 756 bp, Artificial Sequence
  Description of Artificial Sequence: Synthetic coding sequence
atgtctgggtctaaccctaaggctgctgctgccgcgtcagcagccggtccaggtgggttggtggcggggaaagaggagaagaaaaaagcaggggggggagtgctcaaccgcctgaaggccaggaggcaagcgccccaccacgccgccgatgacggggtgggcgctgctgtcactgaacaggagctgttggcattagacacaatccgaccagagcatgtgctcaggctgtccagggtgacagagaactatttgtgcaagcccgaagataatatctatagcatcgattttacgcgctttaaaataagggacctggagacgggcacagtcctgttcgaaatcgccaaaccatgtgtgagcgatcaggaggaagacgaggaagagggcggaggcgatgttgacatcagcgctgggcgcttcgtgcgttatcagttcactccagcatttttaaggcttcgtacagtcggagccacagtagagtttactgtgggagacaagccggtcagcaatttccgcatgattgagaggcattactttagggaacacttactgaaaaacttcgatttcgatttcggattttgtatccccagtagtaggaacacttgtgaacatatctacgagttcccacagttgtccgaggatgtcatcaggctaatgatcgaaaacccctatgaaacaagaagcgactccttctacttcgtggacaataagttgatcatgcataacaaggccgactacgcttataacggaggtcaatag

SEQ ID NO: 34386 - DNA, 756 bp, Artificial Sequence
  Description of Artificial Sequence: Synthetic coding sequence
atgtccgggtccaatcctaaagcggcagctgccgctagcgccgctggcccaggcggcctggtggccggcaaggaggaaaagaagaaagcgggtggcggggtgctgaatcgcttaaaggctcggcggcaggccccgcaccacgctgccgacgacggcgtaggagctgccgtgacagagcaagaactgctggccttagacaccatccggccggaacatgtcctgagacttagcagagtgaccgaaaattatctgtgtaaaccggaggataatatttacagcattgacttcacacgctttaagatacgcgacctcgagacgggcacggtgctgttcgaaattgcaaaaccctgtgtctccgatcaggaagaagacgaggaagaggggggaggtgatgtggacatatctgctgggcgctttgtccgctatcagtttactccagcgttcctgcgtctccgaacagtcggagcaaccgtagagtttactgtgggtgacaaaccagtgtcaaatttccgaatgattgagcggcattattttcgagagcacctgctcaaaaacttcgatttcgatttcggcttctgtatccccagttcacggaatacatgtgagcatatctacgaatttcctcaactgtcagaggatgtaatcagactaatgatcgagaatccttatgagaccaggtcagatagcttttattttgtggacaataagttgatcatgcataataaggctgactacgcctacaatggaggccagtag

SEQ ID NO: 34387 - DNA, 3828 bp, Artificial Sequence
  Description of Artificial Sequence: Synthetic coding sequence
atggagaacttcattttgtacgaggaaattggcaggggtagtaaaaccgtagtctataagggacgcaggaaaggtaccattaattttgtggcaattctctgtactgataagtgcaagcggccagagatcacgaattgggttagactcacacgcgagatcaagcacaaaaatattgttacctttcacgaatggtacgagacttccaaccacctgtggttagtcgtggagctttgtaccggcgggtccctgaagactgtaatagcacaggacgagaatctccccgaagacgtggtgagggagttcggcattgatttgatcagcggcctccaccatctgcataagctgggcatcctgttctgcgacatttctcctcggaagatacttttggaaggaccaggcaccttaaagtttagcaacttctgtctagccaaggtggaaggcgagaacctagaagagttctttgctctggtggcagcagaagagggcggcggcgataatggagagaatgtccttaagaagtccatgaagtcgcgggtgaaggggagtcccgtctacacagcacccgaggtggtgaggggggcggatttctccatttcatcagacttgtggtccctcggctgcctcctctacgaaatgttttctggtaagcccccttttttctcagaaagcatcagcgagctgacagagaagatactttgcgaggaccctctcccccccatcccaaaggattcatctcgccccaaggctagcagtgatttcattaatctgctggatggactgcttcagagggacccacagaaaagattgacttggacaaggttactccaacattctttctggaagaaagcctttgctggtgccgaccaagagagctccgttgaggatctctctctctcgcgcaacaccatggaatgttccggtccacaggatagtaaggagcttttgcagaacagccaatcgcgtcaggccaaaggccacaaaagcggccaacctctgggacatagcttccgactggaaaatcctacagaattccgccccaagagcacattagagggacagctaaatgagtctatgtttctattgtcgtcccgaccaaccccacgtacatccacggctgttgaagtgtccccaggggaggatatgactcactgcagcccccaaaaaacctcaccccttaccaagataacctccggacacctcagccagcaagacctggaatcccagatgcgggaattgatctatacagatagcgacctggtggtgactcctatcatcgataatccaaagataatgaaacaacctccagtcaaatttgatgcgaagatcctgcacctgccgacgtactcagtcgataaattactgtttctgaaggaccaagattggaatgacttcctgcagcaggtgtgcagccagattgactcaaccgaaaagagcatgggcgcatctcgggcaaagttgaacttgctctgttacctgtgcgtggtggccggccatcaggaagtcgccactcggttactccactcccccctgttccaactactcattcagcacctgcgtatcgcacccaactgggatataagggcaaaggttgcccacgttatcgggcttttagcttcacacacggcagagctccaggagaacactcccgtggttgaagctattgtattgctcacagagctaatccgagaaaactttcgtaatagtaaactcaaacagtgcctgctgcccacactaggagagttgatctatctggtggctacacaggaggaaaagaagaaaaacccccgggagtgctgggccgtccccctggccgcgtacaccgtgctaatgcgctgcctgcgagaaggcgaggaaagggtggttaatcatatggcagccaaaatcatagaaaacgtatgtaccaccttttcagcgcaatcccaaggattcatcacgggagagattggcccaatcctgtggtatctgtttagacactcaacagcggactccctgcggattaccgctgtgtctgccctgtgtaggattacacgacatagtcctactgcctttcagaacgttatcgaaaaggtgggattgaacagcgtgatcaatagtcttgctagtgcgatttgtaaggtgcagcagtacatgctcacactattcgcagcgatgttaagctgcgggatccacctgcagaggttaatccaggagaagggcttcgtttcaacaatcatccgactcctggattccccaagtacctgtattagggctaaggcattcctggttttgctttatatcctcatatataatcgggaaatgctgctcctgagctgtcaggcacggctggtcatgtacatcgagcgagattcccgcaaaaccacacccggaaaagagcagcaatctggaaatgaatacctgtcgaagtgccttgatcttctgatttgtcacatcgtacaagagctccctagaatcttaggagacatcctgaactccctggccaacgtatctggcagaaagcatccttctaccgtacaggttaaacagctcaagctgtgtttgcctttaatgcccgtagtgctgcacctggtgacatcacaagtcttccgtccacaggtggtcacagaagagtttctgtttagctacggtaccattctgtcacacatcaagagcgttgattcgggagagaccaacattgacggcgcgataggcctgactgccagcgaggagtttattaaaattacgctgtcagcctttgaggcaatcatacaatatcccatcctcctcaaagactataggagcacagtggtggactatatccttccccctctcgtcagcctggtgcagagccagaatgtcgagtggagactgttcagcctgaggctgctgtcagaaactacttccttgttggtaaatcaggaatttggtgatggcaaagaaaaggctagcgttgacagtgactcaaatttactcgctttgatccgcgacgtcctcctaccgcaatacgaacacatcctcctggaacctgatccagtgccagcctatgccctgaaattattggtcgcgatgactgaacacaaccctactttcacccgcctagtggaagagagtaagctgatccccctgatcttcgaggtaacactggaacatcaggagagtatcttaggcaacacaatgcagtccgtgatcgcgctgctgagcaacctggtagcgtgcaaggattctaatatggaactgttgtatgagcagggactggtgtcccatatttgcaacctgcttaccgaaaccgccactctgtgcctagatgtggataataaaaataacaatgagatggccgccccactcctgttctccctccttgacatcctccacagcatgctaacctatacatcaggaattgtgcgcttggctttacaggcccagaagtctggatccggcgaggatccacaagccgctgaggacctcttgctcttgaatcggcccttaactgacctgatctctttacttatccccctgctgcctaacgaagatccagaaatttttgacgtaagctcaaaatgcttatccattctggttcagttatatggaggcgaaaatcctgacagtttgtcccccgaaaatgtcgagatcttcgcccatttgctaactagcaaagaggatcctaaggaacagaaattgcttttgaggatactgagaaggatgatcacctcaaacgagaagcacctcgagtcattaaagaatgctggctccctgctccgagctctggaaagattggcgcccgggtctgggagcttcgcagacagtgccgtggctccactcgcccttgaaatcctccaagctgtggggcactag

SEQ ID NO: 34388 - DNA, 210 bp, Artificial Sequence
  Description of Artificial Sequence: Synthetic coding sequence
atgcaaaaatactgcatttatcagcattttcagttccagttgctgattcagcacctgtggatcgccgccaactgcgacatctgggctaaggtagcaagggtgataggtctcctggcttcacacaaaaccgatctgcaggagaacacacccgttgtggaagcattcccaaactcgcccaggacacctacactccccggagtgctgacatag

SEQ ID NO: 34389 - DNA, 210 bp, Artificial Sequence
  Description of Artificial Sequence: Synthetic coding sequence
atgcagaaatactgcatttatcaacacttccaatttcagcttttgatacagcacctttggatcgcagcaaattgcgacatttgggcaaaagtggcccgcgttatcggactgctggcctcccacaaaactgacctccaggagaatacgcccgtggtggaagccttcccaaatagcccccgcactccaaccctgcccggcgtgctgacgtag

SEQ ID NO: 34390 - DNA, 7377 bp, Artificial Sequence
  Description of Artificial Sequence: Synthetic coding sequence
atgatctccactctggctacttttccacccttcctgcataaggacattattgagtatctgtcgaccagctttctgcccatggccatattaggatctagtcggcgcgagggcgtcccagcgcacgtgaatctaagcgcgtcttctatgctgatgatcgctatgcaatatacttccaaccctgtttaccactgccagcttctcgagtgcctgatgaagtacaagcaggaggtatggaaagaccttctctatgtgattgcttacgggccctcacaggttaagccccccgccgtgcagatgctcttccattattggccaaacctcaaaccccctggggccatctccgaatatagaggcctgcagtacaccgcctggaatccgattcattgccagcacattgagtgtcacaacgccatcaacaaaccggcagtgaaaatgtgcatcgatcctagtctcagtgtcgccctgggggacaaacctcccccactgtatctgtgcgaagagtgctccgagcgcatagccggcgatcacagcgagtggcttattgatgtgctccttccccaggctgaaatatccgcaatttgtcaaaaaaaaaactgcagcagtcatgtgagaagagccgtggttacatgtttttcagcagggtgctgtgggcgccatggcaaccgccctgtccggtactgtaagcgatgccattccaaccatcactcgaacgaggtgggagcagctgccgagactcatttataccagacctccccacccccgattaacacgcgggagtgcggagctgaggagctggtatgcgcggtggaagctgtcatcagtctactgaaggaggccgagtttcacgctgagcagagggagcatgagctgaacagaaggcggcagctcggcctgagtagtagccaccactccctggacaacgccgacttcgataacaaagacgacgacaaacacgatcagagactgcttagccaattcgggatttggtttttagtgagcctctgcacccccagtgagaatacccccaccgagagcttagcaaggctggtcgctatggtctttcagtggttccatagcacagcctatatgatggatgatgaagttggctcgttggtcgagaaattaaaacctcagtttgtgaccaagtggctgaaaacagtctgcgacgtacgatttgacgtcatggtgatgtgtctgctgcctaaacctatggagtttgccagagtgggaggatactgggacaagagttgctcaacagttacacagctgaaggagggacttaataggatcctatgccttatcccgtacaacgtgatcaaccaaagcgtgtgggaatgtattatgcccgagtggctagaggccatacgaaccgaggtccccgataatcaactaaaggaattccgagaggtgctgagcaagatgttcgacattgagctttgtccactccccttctctatggaagagatgtttgggttcatcagttgccgctttaccggttatccttccagcgtgcaggagcaagctctgctgtggctgcacgtgttatctgaattggacatcatggtacctctgcagctgctgatctcgatgtttagcgatggtgtcaattctgttaaggaactggctaatcaaaggaagtcgagggtgtcagagcttgccggcaaccttgcgtcccgacgcgtgtctgttgcctcggatccaggccgacgggtgcaacataacatgctatcacctttccactccccgtttcagtcaccgtttaggtcacctctcagaagcccattccgttcaccattcaaaaacttcggacacccaggaggccggactatagacttcgattgcgaggatgacgagatgaacttgaactgcttcattcttatgttcgacctgttgctgaaacaaatggagctgcaggacgacggcattaccatgggcctagagcattcactttccaaggacatcatttccattattaataatgttttccaggcaccctggggggggtcccacacctgccagaaagatgaaaaggccatcgagtgtaacctgtgtcagagcagcattctgtgctatcaattagcctgtgaactcttggaacggctggcccccaaagaagagagtcgcctggtggaaccgactgactcactggaagattctcttctttcatcccgcccagaattcattatcgggcccgagggggaggaggaggagaatcctgcctcaaagcacggtgaaaaccctggaaactgcacagaacccgtagaacacgctgccgtaaagaatgacacggagcgtaagttttgctaccagcagctgccggtgactttgaggttaatctacacaatttttcaggaaatggcgaaatttgaggagcccgacatcctgtttaacatgctgaactgtctgaaaattctgtgtttgcacggcgagtgcctgtacatcgctagaaaggaccatcctcagttcttagcctatattcaagatcatatgcttatagcgtcactgtggcgggtggtaaaatccgaatttagccagctgagtagcctcgccgtacccttgttactgcatgccctgtctttgccccacggtgctgacatcttttggaccattatcaatggaaacttcaacagcaaggactggaagatgaggttcgaggcagttgaaaaggtggcggtgatttgtcgctttcttgacatacattcggtaactaagaaccatctgttgaaatacagcctggcacatgcattctgttgcttcctgacagcagtggaggatgtcaatccggctgtggccactcgtgctggtttactgctagacaccatcaaaaggcctgctctccagggcctgtgcctctgtctcgactttcagtttgatacagtggttaaggaccgtcctaccatcttgtccaagctgctgcttttgcacttcctgaagcaggacattccagctttgagctgggagttctttgtgaataggttcgagacactaagcctagaggcccaactccaccttgattgtaacaaagaattccctttccccactactataactgctgtccgcactaatgtggcaaacctgtctgacgccgcgctttggaaaattaaaagggccaggtttgcgagaaataggcagaaaagcgtgaggtccctgagggattccgtgaaaggtcccgtggagtctaaaagagcactgagtttaccagagacgttgaccagcaaaatccggcagcagtctcccgagaatgataataccattaaggatttgctgccggaggatgccggcattgatcatcagaccgttcaccagctgattaccgtgctcatgaaatttatggctaaggacgagtcaagtgctgaatctgacataagctccgctaaagcattcaacaccgtaaagcgtcacctctatgtgttgcttggatacgatcagcaggaaggatgctttatgatcgctccacagaagatgagactgtcaacctgtttcaacgcgttcatcgctggcatcgctcaggtcatggattataacatcaaccttggtaaacatctgcttccattagtggtgcaggtgttaaaatattgttcttgtcctcaacttagacactatttccagcagcctcctcggtgtagcctttggagcctgaagcctcacataagacaaatgtggttaaaagctttattggtgattttgtataaatacccatatagggattgcgatatcagtaaaatcctgctccatctcattcatattacggtgaatactttgaatgcccagtatcatagttgcaagccacacgccaccgccgggcctctgtactcggataatagcaacatctcccgatattctgaaaaggagaagggagagatagaactagcggaatatcgagaaacaggcgcgctccaggactcactgctgcactgcgtccgcgaggagagtattcccaagaagaagctgcggtcattcaaacagaagtctttagacatcgggaatgcagatagtctgctgttcacactggacgaacataggagaaagagctgcattgatagatgtgatatcgagaagccgccaacccaggctgcttatattgctcaacgtcctaacgatcctggacggtccagacagaattccgcaacgcggcccgacaattcagagattcctgagaatcctgcgatggaagggtttccggatgctcgacggccagtgattccggaggtgcgcctgaattgcatggaaacctttgaggtgaaagtagactcaccggtcaaaccagctcccaaagaggatctcgacctgattgatttatccagcgattccaccagcggacctgagaagcactccatactttccacgtcagattctgatagcttggtgttcgagccattgccaccactgaggatcgttgagagtgatgaggaggaagagacaatgaatcagggcgacgacggtccgagtggcaagaatgccgcctcatcccctagcgtccctagccatccgtccgtgttatcattaagtacagctccactcgtccaggtgtctgtggaggactgttccaaggacttctcttcaaaagactccggcaacaatcaaagcgctgggaatacagattctgcattgattaccctcgaagaccctatggacgccgagggatcttcaaaacccgaagaactccctgagttctcttgtggaagcccactgacattgaaacagaaaagagacttgttacagaaatcctttgccctgccagaaatgtcactggatgaccacccagatccaggcactgaaggcgaaaaacccggggagttaatgcccagttcaggcgctaagacagtgctcctgaaggtccctgaagacgccgagaatcccactgagtcagaaaagcccgacaccagcgccgaaagtgatacagagcagaatcccgagaggaaggtggaagaggatggagctgaagagagtgagtttaaaattcagattgtgcctcgacagaggaagcagaggaaaattgcagtgtcagcaatacagcgtgagtatctggacattagttttaacattctggacaaactcggagaacagaaggatccagaccctagtacgaagggtctatcaactctggaaatgcctcgcgagtcttcatccgcccctacactggacgcaggagtacccgagaccagctcccattcttcaatttccactcagtaccggcagatgaagcgcgggtctcttggcgtgttaactatgagccagctaatgaagagacagctagaacatcagagtagtgctccacacaacatcagtaattgggacactgaacagattcagccaggcaagcgacagtgcaacgttcccacatgcctaaaccccgatctggaaggccagcccctgcggatgcgaggagcaacgaaatcatccctcctgagcgcaccgtccattgtctcaatgttcgtccctgcacctgaggaatttactgacgaacagccgacagtgatgacagacaaatgtcacgactgcggagccatccttgaggagtacgatgaggagactttgggactagccatcgttgtactgtctacatttatacacttatcccccgacctggcggcgccactgctgctcgacatcatgcagagcgttggcagactagcttcctccacaacattctcaaatcaagccgagagcatgatggtccctggtaacgctgcaggggttgccaaacaatttttacgctgtatttttcaccaactggcgcccaatgggatcttcccccagctcttccagagtacaattaaggatggtactttcctgcgtacgcttgcttcaagccttatggactttaacgaactttcatctattgcagcactgtctcagctactggaaggattgaacaacaaaaagaacctgcccgccgggggagctatgattcggtgcctcgagaacatcgcaacctttatggaagccttgccaatggattctccttcttctctctggactaccatttcaaatcagtttcagacattttttgcaaaactgccatgtgtgctcccccttaaatgcagtcttgattcatccctgcgtataatgatttgcctcctgaagatcccatccacaaacgcgacacgaagcctgctggagcctttctcgaagctgctgtccttcgtgatccagaacgctgtgttcactctcgcttatctagttgaactgtgcggactttgctacagagccttcactaaagagagagacaaattttatttgtccagatccgtcgtgttagaactgctccaagctttaaagttgaaaagtccgttgccagacaccaatctgttactcctggttcagtttatatgcgcagatgcagggaccaaacttgctgaatccacgattttgtctaaacagatgatcgcttcggtccctgggtgcggtaccgcggctatggagtgtgtgaggcagtatatcaacgaggtactcgactttatggcagacatgcatactttaacaaaactgaagagccacatgaaaacttgttcgcagccattgcacgaggatacatttggcggccatttgaaagttggcttagcacaaatagctgccatggatatatcgcgtggcaaccaccgcgacaacaaggcagttatccgatatttaccatggctgtaccacccccccagcgcaatgcagcagggccctaaggaatttattgagtgcgtgagccacatccggctgctctcttggctgctgctgggttctcttacacacaacgccgtgtgtcccaacgccagctctccctgcctgcccattcctctagacgccggatcgcatgtagctgaccatctgatcgtaatcctgataggttttccggaacagagcaagacaagcgtgctgcacatgtgcagtctgtttcatgctttcatttttgcccagctatggacggtatactgcgagcagtccgcagtggccactaacctgcagaatcagaacgagttctcctttactgcaatcctgacagcacttgagttctggagccgtgtgaccccatcaatcctgcagctcatggcccataataaagttatggtagaaatggtgtgtctgcacgttatatctttaatggaagcattgcaggagtgtaacagcactattttcgttaagctcattccaatgtggcttccaatgatccagtcaaatataaaacacctctctgccggcttgcagttgcggctccaggcaattcaaaatcatgtgaaccaccactctttgcggaccctacccggatccggccagtccagcgccggacttgccgcactgcgtaaatggcttcagtgtactcagttcaaaatggcccaagtcgagatccagagcagcgaagctgcaagccagttttaccctctgtag

SEQ ID NO: 34391 - DNA, 7908 bp, Artificial Sequence
  Description of Artificial Sequence: Synthetic coding sequence
atgagtacaaaggctgagcaattcgcctcgaaaatccgatacttacaggagtaccataatcgggtactgcataacatctacccggtcccatctggtacagacatcgctaacacactgaagtatttctcccagacactgttatccattctgtcccggacagggaaaaaggaaaaccaggacgcctcaaatcttacagtgccgatgaccatgtgcctctttcccgtcccctttccattaaccccgagtctccgcccccaggtgtcttccattaatccgaccgtgacacgcagcttgctgtactctgtgctcagagatgctccgagcgagagagggccacaatcacgcgatgcacagctctccgattacccgtcgctggactaccagggactttatgtgacgctcgtaacactattggatctcgtgcctttgttgcagcatgggcaacatgacctgggtcagtccatattttatacaacaacttgcttactcccatttctgaatgacgacatcctttccacactgccgtacacgatgatcagtacactcgctacattcccacccttcttacacaaggatataattgaatatctgtccacttcattccttcctatggcgatcctgggctcctcacgcagggaaggggtccctgcccatgtcaatctgtcggcttcctcaatgctcatgattgcgatgcagtacacgtcaaatccagtgtatcactgtcaacttctcgagtgtctgatgaagtacaaacaggaagtctggaaagacttactgtacgttattgcttacggtccaagccaagtaaagccaccagctgtccaaatgctgttccattactggcccaacctgaaaccaccaggcgcaattagtgagtacaggggattgcagtatacagcctggaaccctattcactgccagcatattgaatgtcataacgccattaataagcccgcggtgaaaatgtgcatcgatcctagtttaagcgttgccctgggagacaaaccaccccccctgtatttgtgcgaggagtgctctgaacgcatagcaggcgatcacagcgagtggttgatcgatgtgctcctcccacaggcagagatttctgcaatctgccagaagaagaactgttcaagccatgttcggcgcgccgtcgtcacctgtttctccgccggatgttgtggacggcatgggaatcgcccagtccgctattgtaagagatgccacagcaatcaccactcgaacgaggtcggagccgccgctgagactcatctgtatcagacttccccccctcctatcaatactagagaatgcggagcagaagagctggtgtgtgctgtggaggccgtcatcagtcttctcaaggaagctgaattccacgctgaacagagggagcacgagctgaacaggcggaggcagcttggcctgtctagctcgcaccattctctggataatgccgacttcgataacaaagacgatgataagcacgaccagcgtttactctctcaatttggaatctggtttctggtctcactgtgtacaccgtcagaaaatacccccaccgagagtctcgcgcgactggtggccatggtgttccagtggtttcattcgactgcatatatgatggatgatgaggtgggtagcctcgtcgaaaaactcaaaccacagttcgtgactaagtggcttaaaacagtctgcgacgtccgttttgatgtcatggtgatgtgcttgctccccaagcccatggagttcgccagggtggggggttactgggacaagagttgctctactgtgacgcagctcaaggaaggcctcaaccggatcctgtgtctgatcccatacaacgtcataaatcagtccgtctgggaatgcattatgcccgagtggctggaggcgatccgaaccgaagtccccgacaatcagttgaaggagttccgtgaggttctctccaaaatgttcgacatcgagctgtgccctctgccattttcaatggaagagatgtttggttttattagctgtcgttttactgggtatccgtcatctgtccaggagcaggccctcctgtggcttcacgtgctgtcagagctcgatatcatggtacctttgcagctgctgatttctatgtttagtgacggggtaaattcagtgaaagagttggcaaatcagagaaagtcacgggtctcagagctggctgggaacctagcaagccgccgtgtgagcgtggcatcagaccctggccggcgggtgcaacacaacatgttgagccccttccattctcccttccagtcaccgttccggtcccccctgcggtccccatttaggtcccccttcaagaattttggacatccaggtgggcgaactatcgactttgactgcgaggacgacgaaatgaacctcaattgcttcattttaatgtttgacctgctgctgaaacaaatggagctccaggacgacgggataaccatgggactggagcacagtctctctaaggacattatctccatcattaataatgttttccaagctccatggggtgggtcgcatacatgtcaaaaagatgaaaaggctatcgaatgtaatctgtgccaatccagcattttgtgctaccagctggcatgtgaacttttagagcggctagcaccaaaggaagagtcgcgcctggttgaaccaactgattctctggaggattctctgctaagctctagacctgagtttatcatcggccctgagggcgaggaggaagaaaaccccgctagtaagcacggcgaaaaccccggcaattgcactgaacccgtagagcacgctgcggtgaaaaacgataccgaaaggaaattttgttaccagcagctcccagtaacattgcgcctaatctatacaatcttccaggaaatggccaaatttgaggaacccgatatcctgttcaacatgctgaattgtctgaagatcctctgtctgcacggcgaatgtctatatatcgcgcgcaaagaccaccctcagtttttggcttacatacaggatcatatgcttatcgcatcactttggagagtggtaaagtcggagttcagtcagttatctagcttggctgtccccttattgctgcacgccttgtcccttccacacggtgctgatattttttggacaattattaatgggaacttcaatagcaaggattggaagatgagattcgaagcagttgaaaaagtcgcagtgatttgtcgattcctcgatatacattcagttacgaaaaatcatctactcaagtactccctcgcgcacgctttttgttgctttctcacggcagtcgaggatgttaatcccgccgtggcaacccgggctggcttactgctcgatactatcaaaagacctgccctccagggtctgtgcttgtgcctggatttccagttcgataccgtggtgaaggatcgaccaactattttatccaaactgctactcctacatttcctcaagcaagacattccagccttatcatgggaattttttgtcaataggtttgagaccctgagtctggaggcacagttacacctggactgtaataaggagttcccctttccaaccacaatcaccgccgtgagaaccaatgtggccaacctgtccgacgccgccttatggaagattaagagagcccgcttcgctaggaaccgccagaagtctgtgcgcagtctgcgggatagcgtaaaaggtccagtggagtctaaacgagcgttgtcgttgccggaaactcttacgtctaaaatccgtcaacagtccccagaaaatgataatactatcaaagatctgctgcctgaagacgccggcattgaccatcaaaccgtgcatcagctgatcaccgtactgatgaaattcatggccaaagacgaatcaagcgccgagtcagatatatcatcagcgaaagcgttcaacactgtaaagagacacctgtatgtgttgctagggtatgaccaacaagaggggtgctttatgattgctccccagaaaatgcgcttaagcacctgctttaatgcatttatagccggaattgcgcaggtgatggattataatattaacttagggaaacatctgctcccactagtggttcaggtgctgaaatactgttcctgcccccagctccgtcactattttcagcagcccccgaggtgttcgctgtggagtctgaagccccatataagacagatgtggctgaaagctctgctggttatcctgtacaagtacccatatcgggactgcgatatttctaagatacttctccacctaatccacataaccgtgaacactctgaatgcccagtaccactcctgcaaaccccacgccaccgccggccccctttactcagacaactctaacatctccaggtattccgaaaaggagaaaggagaaattgagcttgcagaatacagggagactggagccctccaggatagcctactacactgtgtgagggaagagtctattccaaaaaagaaactgaggtcgtttaagcagaaatcactagacatagggaacgccgactcgctcctgttcacccttgacgaacatcgacgcaagtcatgtatagataggtgtgatatcgaaaagccacccacacaagcagcctacatagcacaacgccccaatgatcccggcagatcacggcagaattctgcaactaggcccgataattcagagatccccgagaatccagctatggagggcttccctgacgcgaggcggccggtcattccagaagtgcgcctcaattgcatggagacattcgaagtgaaggtggactctccggtcaagcccgcccccaaggaggacttggacttaattgacctgagctccgacagcacatcaggtccggaaaaacactcaattctttccactagcgatagtgatagtctggtttttgagccactccctcctttacggatcgtagagagtgacgaggaggaagagacaatgaaccaaggagatgacggaccttctggcaaaaacgctgcttcctcgcccagtgtgccaagccatccgtctgtcctgtctctgagtaccgccccactggtccaggtgtcagttgaggattgcagcaaagatttttcctcaaaggattctggtaacaaccagtcagctgggaataccgattccgccctcatcacacttgaagaccctatggatgccgaaggttcatctaaaccggaggagttgcccgaattctcatgcgggtccccactgactctgaaacaaaagcgagatctcctgcagaagagcttcgccctgccagagatgagtctggacgaccatccggatccagggaccgagggcgagaagccaggtgaacttatgccgtcgtcaggggccaaaactgtgttattgaaagtgccagaggacgccgagaacccaactgagtccgagaaacctgataccagtgccgagagcgacacggagcagaatcctgagcgaaaagtggaagaagatggcgccgaggaaagtgagtttaagattcagatcgtccccaggcagcgcaaacaaagaaaaatagcagtgtcagctatccagcgcgaatacctagacattagctttaacatcttggataaactgggcgaacaaaaggatccagacccttctacaaaaggcctgtcgacactggagatgcctagggagagcagcagcgcacctacgcttgatgctggggtcccagagaccagctcccactcatctatatcaacgcagtacagacagatgaaaaggggaagcctcggcgttctcacaatgtcccagctgatgaaaagacagctggagcaccaatcaagtgcacctcacaatatctctaactgggataccgaacagattcagcccggaaagcgtcagtgcaacgtgccaacatgtctgaatccagacctcgagggccagcccttgcgaatgcgtggtgccacaaagtccagccttctctcagctccttccatcgtgtctatgttcgtccctgcgccagaagagttcactgacgagcagccaaccgtgatgactgacaaatgccacgattgcggggctatcctggaggaatacgatgaggaaactctgggcctcgccattgtggtcttatcaacgtttatacacctgtcacccgacttggcagcccccttactgctggatatcatgcagagtgtgggccgcctggcctcttccaccacgtttagcaatcaggcggaaagcatgatggtgcctgggaatgctgccggcgtcgcaaaacagttcctacgctgcatttttcaccaattggcccccaacgggatctttccccagctcttccagagtaccataaaagacggtacattcctcagaaccttggcatcttctctgatggacttcaacgaattgtcctccattgccgccctgtctcagctgctggaaggacttaataacaaaaagaacctccccgcggggggcgccatgatccgatgcctcgagaatatcgcaaccttcatggaggcactgcctatggactcccccagttccctatggaccacaatctcaaatcagtttcaaaccttcttcgccaaactaccgtgcgtactgcccctaaaatgcagcttggactccagtcttagaataatgatatgtttgcttaagattccctccactaacgcgactcgcagtcttctggaaccttttagtaagctattgtctttcgtcatccagaacgcagtgttcacattagcttacttagtcgagctctgtggcctgtgctacagagccttcaccaaagaaagggataagttctacctgtcaaggagtgtggtgctggaactgctgcaggctctaaagcttaaatctcccctccctgacaccaatttgttgctgctcgtgcagttcatttgcgctgatgcaggcacaaagctagctgagtccactattctgagtaaacaaatgatagccagcgtgcctggatgcgggacggcagctatggaatgcgtaaggcagtatatcaacgaggtgttggacttcatggctgatatgcacacccttaccaagctcaagtcacacatgaagacttgcagccagccactgcacgaggatacctttggcggacatttgaaggttggtctggcccagattgctgcgatggacatctcccgaggaaaccacagagataataaggccgttataaggtatctgccatggctttatcacccgccctcggccatgcagcagggtcccaaggagtttatcgagtgcgtgtcccacatccgactgctgtcgtggctgctcttgggaagcttgacacataacgccgtctgcccaaacgcatccagcccgtgcctcccaataccgctagatgccggctcccacgtcgccgaccacctgatcgttatcttaatagggtttcccgagcagtctaaaacatccgtcctgcacatgtgctctctgttccatgcattcatttttgcccagctgtggactgtgtactgcgaacaatccgccgtggcaactaatttgcagaaccaaaatgaattctcattcaccgccatcctgacggcgctggagttctggtcccgagtgacgccatccattctgcaactgatggcccacaataaagtaatggttgagatggtgtgccttcatgtcattagtctgatggaagcactccaagagtgtaattcaacaatttttgtcaagctgataccaatgtggctgcctatgatccagagtaacatcaaacaccttagtgctgggctgcagctgcgactgcaagctatccagaaccacgtaaaccatcattctctgcgaacattgcccgggagcgggcagagctcggcaggactagccgcgctgcggaagtggctccagtgtactcagttcaaaatggcacaggtggaaattcagtccagtgaagctgcatcccagttttacccactgtag

SEQ ID NO: 34392 - DNA, 7974 bp, Artificial Sequence
  Description of Artificial Sequence: Synthetic coding sequence
atgaattctaagagacataagattgcatccaagatacggtacttgcaggaatatcataacagggtgctgcacaacatctaccccgttccctcagggactgatattgccaacacactgaagtacttctcacagacactcctgtctatcttaagccggaccggtaagaaagaaaaccaggacgccagtaacctgactgtccccatgaccatgtgcctttttcctgtgccttttccgctcacaccgtccctgcggccgcaggtgtccagcataaatccaacggtcacccgctcccttctgtacagcgttctgagagatgccccgtcagagcgagggccgcagtctcgcgatgctcagctgtccgactaccccagcctggattatcaaggattatacgtgactcttgtaaccctgctcgatttagtgccactgttgcagcacgggcagcacgatctaggacagtctatattctatacaactacttgcctgttgccctttcttaacgacgacattctgtcaacgctgccctacaccatgatctcgactctggccacctttccccccttcctccacaaggacattatcgagtatctgagtaccagctttctgccaatggccatcctaggatccagccgccgtgagggggtgcccgcgcacgtgaatctcagtgcatcctccatgttgatgatagcgatgcagtacacgtcaaaccccgtctatcactgccagctgctagagtgccttatgaaatataaacaggaagtgtggaaggacttgctctacgtaattgcctacggaccatctcaagttaagccacctgctgttcagatgctttttcactactggccaaacctgaagcccccaggcgccatcagcgaataccgaggattacagtacactgcctggaacccgatccactgtcagcacattgagtgtcacaacgccatcaataagcccgccgttaaaatgtgtatcgacccctctctgtctgtggcgctaggcgacaagccgccaccgctgtacttgtgcgaagagtgttccgagcggattgccggggaccactcagaatggcttatcgatgtactcctgccacaagctgagatctctgccatctgtcagaaaaaaaattgctcctcccatgttaggcgggcagtggtgacctgcttctcagccggatgctgtggaagacatggaaatcggcctgtgagatactgcaagcgttgtcatagtaaccaccatagcaatgaggtcggggctgcagcagagacccatctgtaccaaacctcaccaccccctatcaatacccgcgaatgcggagctgaggaactggtgtgcgcagtcgaagctgtaattagcctgcttaaagaagcggagttccatgccgaacagagggagcacgaacttaaccggcgccgtcagctgggcctctcctctagccaccactcactcgataacgcagatttcgataacaaggacgatgataaacatgatcagagactgctttctcagttcgggatctggtttctggtgtcactgtgtactcccagcgaaaacactcctaccgaaagcctcgctcggctcgtagctatggttttccagtggtttcacagtacagcgtacatgatggatgacgaggttggctctctcgtcgagaaactcaagcctcagtttgtgaccaagtggctcaaaacggtttgcgacgtgcggttcgacgtgatggtcatgtgtttgctgcccaagccaatggagttcgcccgagtcgggggttactgggataagtcatgctccactgtgactcagttgaaggaaggcctgaaccgcattctctgcttaatcccatataacgtgatcaatcagtcagtgtgggagtgcataatgcccgaatggctggaggctataaggaccgaagtgccagacaaccagctgaaggagtttagggaggtcctctcaaagatgttcgatattgagctgtgtccactgcctttctctatggaagaaatgttcggttttatttcttgtcggttcaccggctacccatcttctgtgcaggaacaggcactcctgtggctgcacgtcctgagcgagcttgacataatggtgcccctccagttactgattagtatgtttagcgatggcgtcaattctgtgaaagaattggccaatcagcgaaagtcaagagtcagcgagcttgccgggaatctagccagccggagagtgagcgtcgcctctgaccccgggcggcgagttcagcataacatgctctcccccttccactccccatttcagagtcctttcagaagcccgctaagatctccctttaggagtccatttaagaatttcggccatccagggggccgaacaattgattttgactgcgaagacgatgagatgaatctgaactgttttatcctgatgtttgatctcctcctgaagcagatggagctgcaggatgatggaattaccatgggcctagagcactctttgtcaaaggacataatatcgattataaacaacgtgttccaagccccttggggcgggtctcacacatgccagaaagatgaaaaagccattgaatgcaacctgtgccagagcagcatcctttgttaccagctcgcgtgtgaattactggaacgcctggctcctaaggaggagtccagacttgtggagcccacggatagcctggaagactcgcttctttcctctcgtcctgagttcatcataggtcccgagggggaggaagaagagaacccggcttctaaacatggcgaaaaccccggaaattgcactgaacccgtcgagcacgccgctgtgaagaacgataccgaacggaagttttgttatcagcagcttcccgtcacactgcgacttatctataccattttccaggagatggccaaattcgaggagcccgacatcttgtttaacatgctaaactgtctgaagattctgtgtcttcatggagaatgcctgtacatcgctagaaaggaccacccccagttcctggcatacattcaagaccacatgctgatcgctagcttgtggcgtgtcgttaaatcagagttctctcagttatcatctctggccgtgccactgctgctgcacgccctatccctcccacacggcgcagatatattctggacgatcatcaatggaaactttaactccaaagactggaagatgaggttcgaagccgttgaaaaggtggctgtcatctgtcgcttcctcgatattcacagcgtgactaaaaatcacctcttaaaatacagcttagcccatgctttctgttgtttccttacagccgtcgaggacgtgaatcctgctgtggccacaagggccggtctcctgttggatactatcaagcggcccgcactacagggcctgtgtttgtgtctggattttcaattcgacactgtcgtgaaagacagacctaccatcctctccaaactgctgctgctccacttcctgaagcaagacattcccgccctgagctgggagttctttgtcaacaggttcgagacactgagcttagaagcccagctgcacctcgactgcaataaagagtttccgtttccgactaccatcactgctgtgcggaccaacgtggccaacttgagcgatgctgctctgtggaagattaaaagagcacggttcgctcggaataggcagaagtcagtccggtcactacgcgacagtgtgaagggcccagtggaatccaaacgagccttgtcactgccagaaactttgacgagtaagatccctatgagattaactcgccacgagcagagcgcaccggcattaggaggcactccggaacaaactcctgggcagcaatctcccgagaacgataatactatcaaggaccttctgcccgaggatgcggggattgaccaccaaactgttcaccagctgataacggtccttatgaagtttatggcgaaggatgaaagttcagctgagtcagacatttcttcagctaaagcattcaacacagtcaagagacatctctacgtgctcctgggctacgaccagcaggagggttgcttcatgatcgcccctcagaaaatgagactgtcaacatgtttcaacgctttcattgcggggattgctcaggtaatggactataacatcaacctaggaaaacacctgctgcccctcgtggtgcaggtgctcaagtactgtagctgccctcagctcagacactatttccagcagcccccacggtgttccctctggtcactcaagccgcacatcaggcagatgtggctgaaagctctactcgtgattttatataaatatccatatcgagattgtgacattagtaaaatcttactgcatcttatccacattactgtgaacacactgaacgcgcaataccactcctgtaagcctcacgccacggcagggccactatactccgataactctaacatttcacggtactctgaaaaagagaagggagaaatcgagctggcagagtaccgggagaccggggctctgcaggactcattgctccattgtgtccgagaagaatcaataccaaaaaaaaagttacggagttttaagcagaaatctcttgatattggaaatgcagattctcttcttttcacgctggacgagcatagaagaaaatcttgcattgatcgatgcgatattgaaaagcctcctacgcaggctgcgtatattgcccaaagacctaacgacccggggcgtagccggcagaatagtgcaacccggccggacaattctgagattcctgagaacccggcaatggagggctttcctgacgctcgccgccccgttatcccagaagtgcgcctgaattgcatggagacctttgaggtcaaggttgactcccccgtgaaaccagcacccaaagaagacctggatttgatagatctttctagcgatagcacatctggtccggagaagcactcgatcttgtcaactagcgactcggattctctggtctttgaacccttgccacccctccgcattgtggaatccgacgaggaggaggaaaccatgaaccagggggacgacggacccagcggaaaaaatgcggcctcttctccttcagttcccagccacccttccgtgctctcattgtcaacagcacctcttgttcaggtgtctgtcgaggactgtagtaaagacttctcatccaaagattccggaaacaaccaatccgccggtaatacggattcagccctcatcactctcgaggaccctatggatgcagagggaagttcaaagccagaagagttacctgagttttcatgcggatccccattgactctgaagcaaaaaagagaccttttgcaaaagtcctttgctttgcctgaaatgtctctagacgatcatcctgaccccggaaccgaaggcgaaaagcctggtgaactgatgccttcaagtggagcaaaaactgttctcctgaaggttcccgaagatgctgagaaccctactgaaagcgaaaagcccgatacctcagccgagtcagacacggagcagaaccctgaacgcaaggtggaagaggatggagcagaggaatctgaatttaaaattcaaatcgttccaaggcaacgtaagcagagaaagattgcagttagcgccatccagcgggagtacttagatatatcttttaacatcctggacaaattaggagagcagaaggatcctgatccctccaccaagggtctttccacgctagagatgccacgtgagagctcctcagccccaacactggacgccggcgtccccgagacaagcagccactcatctatctccacgcagtatcgacagatgaagagggggagtctgggtgtgctgacaatgagccagttaatgaagagacagctcgagcaccaaagctcggccccgcacaatatcagcaattgggacaccgagcagatacagccgggcaaacggcagtgcaacgtacccacctgcctgaaccccgacctggagggccagccgctgcgtatgcggggtgctacaaagtcttccctgttgtctgccccaagcatcgtcagtatgtttgtgcctgcaccagaggaattcacagatgagcagcctacagtgatgaccgataaatgccatgattgcggcgccattctggaagagtatgatgaggaaactttgggcctggccatagtggttctgtcgacgtttatacacctgtcgccagaccttgctgcacctctcctgctcgacattatgcaatcagtggggagattggcatctagcacaacattctctaatcaagccgaatccatgatggtccccggcaatgctgctggtgtcgcgaaacagtttctacggtgcatttttcaccagctcgcccctaatggtatcttcccacagctgttccagtccacaattaaggatgggaccttcctgagaacattggcaagctctctcatggacttcaacgaactctcttccattgcagccctgagtcagttgctggaaggtctgaacaataagaaaaacttacccgccggaggggcaatgattagatgcttggaaaacattgctacattcatggaagcgctgccaatggactcaccaagcagcctgtggactaccatatctaaccaattccaaacattttttgccaaacttccatgtgtgttgcccttaaagtgttccctggattctagcctgcgaattatgatttgtcttttgaagatcccctcaacaaacgccacccggagtctgctcgaacccttctccaagctgctgtcattcgtcatccagaacgccgtcttcacccttgcatacttggtggagctctgtggactgtgttatcgcgcctttaccaaagagcgcgataaattttatctgtcccggtcagtggtgctggagcttctgcaggctttgaagcttaagagccctctccctgacacaaacctacttcttctggtgcagttcatctgtgccgatgcggggactaagctggccgaatcaactattttgagcaaacagatgatcgcttccgttcctggatgcggaacagctgcaatggagtgcgtgcggcaatatatcaatgaagtattagacttcatggcagacatgcatactttgacaaagctcaaatcccacatgaagacctgttcccagccccttcatgaggacactttcgggggccacctgaaagtgggcctggcacagatagccgcaatggatatcagcaggggcaaccaccgagacaacaaagccgttatccggtaccttccatggttataccacccccccagtgccatgcagcaagggccaaaagaatttatagaatgtgtctcccatattcgtctccttagctggctacttctgggctccctgacacataatgctgtgtgtcccaatgcctctagcccctgcttgcctatcccactggatgccggttcacacgttgcagatcacctgatagtcatcctcattggtttcccagagcagagcaagacgtccgtccttcatatgtgctccttatttcatgcctttatttttgcccaactgtggaccgtgtactgcgagcagagtgctgtggctacaaatctccaaaatcagaatgaatttagtttcactgccatccttacagctttggagttttggagccgagtgactccttcgatcctgcagctaatggcccataacaaggttatggttgaaatggtttgtttacacgtgatctccttgatggaggctttacaggagtgcaattcaacaatttttgtgaaactgattccaatgtggttgccaatgattcaaagcaatattaaacacctctccgcagggcttcagcttagactgcaggccatccagaaccacgttaaccatcatagcttgaggactctgcccggatccggacaaagttcagcagggcttgccgcccttaggaagtggctgcaatgtactcagtttaaaatggcccaagtcgagatccagtcaagcgaagccgccagccagttttacccgctatag

SEQ ID NO: 34393 - DNA, 7974 bp, Artificial Sequence
  Description of Artificial Sequence: Synthetic coding sequence
atgtcaacaaaggctgaacagtttgccagtaaaattagatacctccaggaataccacaatcgcgtactacacaacatttacccggtgccatctggcactgatattgcaaatactctgaagtacttctcgcagacacttctgtccatcctgagcaggacagggaaaaaggagaatcaggacgcttcaaatctgaccgttccaatgacaatgtgtctcttccccgtgccttttcccctaacaccatctctcaggccccaagttagctctatcaaccccaccgtcacaagaagcctactgtattctgtccttcgggatgccccctctgagaggggtccccagtctagggacgctcagctgtcggattatccaagcctcgactatcaaggcctgtacgtgaccttggtgactctgctggacctggtccccctgctccaacacggccagcatgatttgggacagtcaatcttttatactaccacatgcctgctacccttcctgaacgatgatatcctctctacactgccttacacaatgatttctacccttgcgaccttcccaccattcctacacaaagatatcatagagtaccttagcacatctttccttcctatggctattctgggctcctccaggagagaaggtgttccagcccatgtaaacttgtcagcatcatcaatgctaatgatcgctatgcaatataccagcaacccggtctaccactgtcagctcctggagtgtctgatgaaatacaaacaagaagtgtggaaggatctcctttacgttatcgcctatggcccttcgcaggtgaagcctcccgcagtgcagatgctatttcattattggccaaacctgaagccccccggggctatttctgagtaccgaggtcttcagtatacagcctggaacccaatccattgtcagcacattgagtgtcacaacgctatcaataaacccgctgtaaagatgtgtattgatccctcactgagcgtcgccctgggcgataagccacctcccctctatctgtgcgaagagtgttcggaaaggatcgctggcgatcatagcgaatggctaatcgatgtgttgctgccccaagcagagataagcgccatttgtcagaagaagaactgttccagccacgtgaggcgcgctgttgttacatgcttcagcgccggctgctgtggtcggcacggaaacagaccggtccgctactgcaagcggtgccatagcaatcaccattccaacgaggtcggagctgctgctgagacccatctttatcagacctctcctccacctatcaatacaagagaatgcggcgcggaagagctcgtctgcgctgtcgaggccgttatctccctcctgaaggaggccgagttccacgccgagcaacgcgaacacgaactgaaccgacggcggcagctcgggctctcctcaagccatcattcactggacaatgccgattttgacaataaagacgacgataagcacgaccagagactgcttagccagtttggtatctggtttttagtcagcctttgtaccccttctgagaacacacccaccgaaagcctggctaggttggtagcgatggtcttccagtggttccattcaactgcatacatgatggacgacgaggtgggtagcctggtcgaaaaactcaaaccccagttcgtgaccaagtggttaaagacagtctgcgacgtgcgcttcgacgtaatggtgatgtgcctgctgcctaagcccatggaattcgcgcgcgttggcggttactgggacaaaagctgctcaactgtcacacagctcaaggagggactcaacagaatcctgtgtctgatcccttacaatgtgatcaaccaaagcgtttgggagtgtattatgcctgaatggctggaggccatccgaactgaggtgcctgataatcagctgaaggagttccgggaggtcctttccaaaatgttcgacatcgaattgtgccctctgcctttcagcatggaggaaatgtttggctttatctcgtgccgctttacaggctaccctagttcagtgcaggaacaggcactgctgtggttgcatgtgctctccgagcttgacatcatggtccctctgcagctgcttatttcaatgttttccgatggagtaaatagtgttaaagagctggcaaatcagcgaaaaagtcgtgtgagcgaactagccgggaacctggcaagcagacgtgtgagcgtggcctccgaccctggccgaagagttcaacacaacatgctgtcgccattccacagcccatttcagtccccctttcggagcccgttacggtccccctttaggtcacccttcaaaaatttcggacaccccggaggaagaactatcgactttgactgtgaagacgacgagatgaacttgaactgctttattctgatgtttgacctcctgctgaaacagatggagctgcaggatgacgggattaccatgggtctggaacacagcctttctaaagacatcatcagcatcatcaataatgtgttccaggctccttggggcggatcacacacctgccaaaaagatgaaaaggcaatcgagtgcaatctctgccagagttccattttatgctaccagttggcctgcgagctcctcgagcggctagctcctaaagaggagagcaggctggtagaacccaccgacagcttggaggacagtcttctctccagccggcctgaattcatcatcggcccagaaggagaggaggaggagaacccagcctctaagcatggagagaaccccggaaactgtactgagcccgtggaacatgccgcagtgaaaaacgacacagagcgcaaattctgttaccagcagctgcctgttacacttaggctgatctatacaatctttcaggaaatggcaaaattcgaagaaccagacatcctgtttaacatgctaaactgccttaaaattctgtgtttacatggagagtgcttgtatatagctcgcaaagaccatcctcaatttcttgcttacatacaggaccacatgttaatcgccagcttatggagagtcgttaagtcggagttcagccaacttagctctctagccgtcccgctgttgctgcatgctctaagcctgcctcatggcgccgatatcttctggactattatcaatgggaactttaacagcaaggactggaaaatgcggtttgaggccgtggaaaaagtcgccgtaatctgcagattcctggatattcactctgtgaccaaaaatcacctcctgaagtactctctggctcacgccttctgttgttttctgactgcggtcgaggacgttaaccccgctgttgccacccgggcaggacttttgctcgataccatcaaacggccggctttgcagggcctctgtttgtgtctagactttcaattcgacacggttgtgaaggacaggcctacaattctaagtaaactactgctgttgcacttcctcaagcaggatatacctgcactttcttgggagttctttgtgaaccgctttgagaccttatctttggaggcccagctacaccttgattgcaataaagagttcccctttcccacaacaattacagccgttcgtactaacgttgcaaacctgtcagacgccgcattatggaagatcaagagggcccgttttgctagaaacagacagaaatcggtgcgttctctcagagattccgtgaaaggtccagtggaatctaagagggcgctttcgttgccagagaccctgactagtaagatcccgatgaggctgactcgccatgagcagagcgcgccagcgttgggagggacacccgaacaaacacccgggcagcagagcccggagaacgacaatactattaaggatcttctccctgaagatgcagggatcgaccaccagacagtgcatcagctgattacagtgctgatgaaattcatggctaaggacgaatcttccgccgagtctgacatttcctcagcaaaggcttttaacactgtgaaacggcacctgtacgttttacttggttatgaccagcaggagggctgctttatgattgctccgcaaaagatgcggctttccacatgtttcaatgcatttattgccggaatcgctcaggtcatggactataacattaatctcggtaaacatctgctgcccctcgttgtgcaggtgttaaagtattgttcttgtccccaactaagacactatttccaacaacctcctagatgttctctgtggtctctaaagcctcacatcaggcagatgtggctaaaggcactgcttgttatcctgtacaagtatccgtatcgggactgcgatatcagcaagatcctcctgcatctcattcacattaccgtcaacactttgaacgctcaataccatagctgcaaaccccacgcaaccgcagggcccctatattctgataattccaacatctctaggtatagtgaaaaagagaaaggagagatcgagctcgctgaataccgcgagaccggagctctccaggactcattattacattgtgtacgggaggagtccattccaaagaagaaattaagatctttcaagcaaaagtcccttgacatcggcaatgcggactctctgttgttcacccttgacgagcaccgccgaaaatcttgcattgaccggtgtgatattgaaaagccccctacccaggccgcttacatagcgcaacggccgaatgacccaggcagatcacgtcaaaactctgccacaagaccagataactcggaaataccagaaaacccggccatggagggttttcccgacgcccggcggcccgtaatccctgaggttagattaaactgtatggaaaccttcgaagtgaaagtggactccccggttaaaccggcaccaaaggaggacctcgacctgatcgacctcagttctgactcaacgagcggccctgagaaacactcaatactctcgacatccgactcggactcattggtatttgagcccctgcccccgctgcggatagtggagtccgacgaggaggaggaaaccatgaatcagggcgacgatggtccctccggaaagaacgccgctagtagcccctccgtgccttcccacccaagtgtgctgtcccttagcacagcacccctggtccaggtgtctgtggaagattgcagcaaggacttcagtagtaaggatagcggcaacaaccaatcagcagggaatactgactcagctttgatcacattggaggaccctatggacgctgaggggtcaagtaagcccgaggaattgccagaattttcgtgcggaagccccctaacattaaagcaaaagagggacttgctacagaagagtttcgcgctgcctgagatgtcgctggatgaccatcccgacccaggaaccgagggagaaaaaccaggcgagttgatgcctagcagcggcgccaagactgtgctgctcaaggttcctgaagacgcagaaaatcccactgaatccgagaaacccgatactagcgctgagagcgatacagaacaaaatcctgagcggaaagtcgaggaggatggcgcggaagaaagtgaattcaagatccaaatcgtcccaagacaacggaagcagcgtaagatcgccgttagcgcaatccagcgcgagtacttggacatttcattcaacatcttagacaaactcggcgagcagaaggacccagacccaagcaccaaggggctctctactctcgagatgcccagagaaagttctagcgcccctacactggacgccggagtccccgagacatccagccacagctctatttctacccaatatcggcagatgaagcggggatctctcggtgttcttaccatgtcccagctgatgaaaagacagctggagcaccagtccagcgctccccacaatatctcaaactgggacactgaacagatccagcccggcaagcggcagtgtaacgtcccaacatgcctgaacccagatcttgagggccaacctctgagaatgcgtggagcaacgaaaagcagcctgctgtccgctccaagcattgtgagtatgtttgtcccggcccctgaggaattcactgacgagcaacctacggtgatgaccgataagtgtcacgattgcggggctattctggaagaatatgatgaagagactctcggcttggcgattgtggtgctgtcaacctttatccatctgagccctgatctggccgcgcccttactcctcgatattatgcaaagtgttggaagattagccagtagcaccacattctctaatcaggctgaaagcatgatggtcccaggaaatgccgctggcgtagcaaaacagttcctccgctgtatttttcatcagctggctccaaacgggattttcccacaactgtttcagtcaactatcaaggacggtaccttcctgagaaccttggcatcgagcctcatggacttcaacgagctgtcttctattgctgcacttagtcaactacttgaaggtctgaataataagaaaaatttgcctgccgggggcgctatgataaggtgtttagagaacatcgccacttttatggaagctttgcctatggactcccccagttccttgtggaccaccattagtaatcagtttcagaccttctttgcgaagttaccctgcgtgcttcctctgaaatgcagcctggatagctcactaagaattatgatctgtttactcaagatcccttctacaaatgccacccggtcccttctggaacctttctctaaactgttgtccttcgttatccagaacgcagtgtttacgttggcatacctcgtggaattgtgtggtctgtgttatcgcgcctttacaaaggagagagataagttctatctgtcccgcagcgtggtcctagagcttttacaagctctgaagttaaaatctccgctccctgatacaaatctcctgctcctggttcagttcatttgtgccgacgctggaaccaagttagccgaatccaccatcttatctaagcagatgatcgcgagcgtcccaggatgcggtacagccgctatggagtgcgtccgacagtacatcaatgaggtccttgacttcatggcagacatgcacacgctgaccaaacttaagagtcacatgaagacatgttcgcaaccattgcatgaagacacattcggggggcacttgaaggtgggactcgcccaaatagctgcgatggatatttcacgcggaaaccacagggacaataaggctgtcatccgttacctgccatggctctatcatcctcctagcgccatgcagcaaggtcccaaggagtttatcgagtgtgtcagtcatattcgcctactttcatggctgttgttgggtagccttactcataacgcggtgtgtcctaacgcttcttccccttgccttccaatccccctggacgccgggagccacgtcgctgaccacttgatcgtgattctgatcggcttccctgaacagtctaagacctcggtgctacatatgtgctcactgttccatgccttcatcttcgcgcaactgtggacggtatattgcgaacagtctgccgttgcaacaaaccttcagaaccagaatgaattctccttcacggccattctcaccgcgctggaattctggagccgggtcactccttctatactgcaactaatggctcacaacaaagtcatggtcgagatggtttgcctccacgtcatctctctgatggaagcactgcaagagtgcaatagtaccatcttcgttaagcttatcccaatgtggctgccaatgatccagtcaaatataaagcacctgtcggctggacttcagcttcgcctccaagcaattcagaaccacgtgaaccatcatagtctgcggaccctcccaggtagcggacagagttctgccggcctggcagccttacggaaatggttgcagtgtacccagtttaagatggcccaagtcgagattcagtctagtgaggcggcttctcagttctaccccctctag

SEQ ID NO: 34394 - DNA, 399 bp, Artificial Sequence
  Description of Artificial Sequence: Synthetic coding sequence
atgcgcgaaggccaggaaatgggtccaacccccgtcccctctaatccattactgcataggtcatttccgtgctggcccagagggtggagtcatcccgtcccaacccgagagctgcttctcgagcccgcccaacccgctgatctgctccccccagctccgacggcaggcccctgttccctcgcgtcctggatgctgtcccaacctggccggggctcacaggtaaagaccggcggtactccaactgctacagctcaggacgccgaggcccccttacccgactgcgacctctgcctgagccctgccccagttggaacctggcaaccccgggccaaggcgggctgggccggggaccctagaaatcttagcgggaatactttttcccccgggtgggagcagtag

SEQ ID NO: 34395 - DNA, 1803 bp, Artificial Sequence
  Description of Artificial Sequence: Synthetic coding sequence
atgttcacactgagtttgctgtccagagggcatggtaagctcggccaggacaagcaaaagctggaagtgtattttgaaccggaagactatcttaactggcgctcccccgaggactacgtgccggtgtctaagccacaggataaaaataatgcgtcgcagcattcctggtcgctgttcctgcccaagacgttctctacccgcaaaggggctcttattctgtattctgaagggttcgccatatctgcctggactcccaaagaaagaagaaagggcccttattgcccgcgagggccttggcggaagttagacctcgaactgcacactctgcaggatttgaaagaagcaatcctcgcctatgggcggcagcagctgaaccttcctatgggggatgccggaaagaggttggaacgggaaaaaaagcggaaaacaaccgtgtttctcccgtcccacagtgcttcttctgaaaaaaaacatctgcattatctctgtgacaccgcactgaaccgtcaagcacactatgaccctcagctattacagggtgaacaggacagggcatggcagccttacctccattttcggtcccagctggagagccaggcccagcggcaaatccagcctggacactccgctaaacgttaccttcgaggattgttgagaacttggccaccagacgctatgtatcgcttgtggtgcgccggctatattaaggactcggtactcctccaggattcacagcttaatgtacccaagaaactgaggcctcagcaggacctatccggagtgccaccgaagtaccaccttctgccagtgttcccttcattctggatacagcagggcaagtcttttgagcagcggcaacaaggactggacgagggtgaggccggcgctgcaggacacgttgaccaggggccattggccaagaatcatggatcacagggtacgcggcttccacctaggcgcaagcagccctggcaggaggatgagactcaggcagaagacacaagcatcgagaaccacttatgtttgtatgcaagcaaggaatcatacaatgagaagactcagcagacctctagaaaggcgtttggccatggtcgcattgaccactcatggctgccctctgacaaatcccatattacattctgtgggggagcgttccccaataggaaggcagatttatccgataagcagcggaatgtgaaactacataaagccagatcaagccacctgctgcaagtacttccggccgagaggtctctgtttccacctgtggcttcagcaacagggtccagaattatcacacctggggaggtaaagaagaagaaagcaccaaaggcccttaagctccctcccatctccgaagaacccccccgggtgctggagcccctcaagtcgcagtttaaggccaacgagccgccaacagagctgttcattctacccgtggaaatccactatcatacgaaacagcctcctaaagaaaaagcacaccgcagaggcgctcctcacccagagtctgagcccgagagcagcgaggagtctacaccggtgtggcgcccccctttgaagcatgccagtctggaaacaccctgggagctaaccgttcacctaccagtggatgccagtcgggatacgctgagcccacaagggagttctagcctcccccccgcatccctcggaaatctcacactaaagggatcaaaagctcggcatactagagtacattcccagggtaaaggagtctggaagggcgatgacgatgcacccccacatgacgtggctccaccgctagatcttcttccgccatag

SEQ ID NO: 34396 - DNA, 360 bp, Artificial Sequence
  Description of Artificial Sequence: Synthetic coding sequence
atgagcggttccccccaggcttcgtatccacagacccactcattcacgctgaaacatcaggagatcaggacattctggaatctcaacatgcgcggactcgggggggagggaggaaccgaagaggagagctcgctcggacaagccgggggaaaactgaagactgcagcatggccaagttgggtcgcagaggtgggagctgctggtgctctggccgatcctggcggtcaaaaaagcgggagtttccttccatcgcagcagctgcagtgcatccccgggccagggttgtatgcaggcgaggcctccaaagacccagttctgcggaagctgccatttcagtgtggtaggacccacaatccctag

SEQ ID NO: 34397 - DNA, 405 bp, Artificial Sequence
  Description of Artificial Sequence: Synthetic coding sequence
atgctcgtagtaggagcaggtccccttggagccgctgcatggtcccagcgcctcgattgggggcgctgccagctgaagctcttgggacagcacggacaggacgtgctccacaccaacctcggagaagagaatgtatgtattgccggaccactactgctgccctgcccagacagtcagccatgtttgacacccccgcaccccgctcaggctctcgttcagctgtgggtgccctgtccgtgcctgtgtccccgcgtgggtgccagtaccgcatggctggaaggagacacaccggccttgccacagcatctagggccctcaattacaactacaggcaggtgggctacgccgaaaaagattcctggcctgactgtcccacctgagaacatggactctatgtgggggtag

SEQ ID NO: 34398 - DNA, 447 bp, Artificial Sequence
  Description of Artificial Sequence: Synthetic coding sequence
atggattgtgtccctccgatccagtgtagttgctccatgggagggcgctaccaccatccagccggcgaggctttctggacaggggagcggtgtgaacagttttgccattgtcaagcgagtacccatgcggtgtgttgtagcccatccagctgtggacccggccagcgctgcgagactcttagaggcatctttggttgccatccactaagtcctggcatctatcaagcgacaatgcacagccacgtggcaagtttcgataggaaaagcgtcgaattccctggcacctgcgcctctgcttttactaagagctgtgggtcttcctcctctctgcgactgttcaaggtggagatcggcaaggagaaacaggtgcagcaatcccactgcgtccactttaaagacgtggggtcctgggatccaggccttagcgcagagcgcgctcctacgtag

SEQ ID NO: 34399 - DNA, 615 bp, Artificial Sequence
  Description of Artificial Sequence: Synthetic coding sequence
atgggcccccagcatggcacggggcctgatcccccacccctgtgccattgccctcacaccgctggaggcggtgccggaggaaccggcgcccccgcattcgggctgcaggggatatgggtacctttggccgtgggggatcggagaggcccttgcggacagggtgcctctatgggagctcctggccagccccgtcaaggaggaagaggaaaaggacaggaagcatccgctcaaaccagatacggaggaaactccccccacggaaggggacagaacagactggaggggccgggcgtgcaggtttgctgtaaccgtgctaggagggcgcgcgggtgcccccacccaggccagcgccaccacgtcgtgttatcccagtggagtggcagtggcctggtgggcggaatagaggatacagctgacctggcaccaccccccggagcaggcttgtctcccctagctcactcgaagggccgggaccagaggggaggtgggcttcatccaccgtctcctcgctgttcaccccctccctatcacccagtccaacgatgcccccgccgatgggagtcatgcgagggccgtcctcatttagcttgctccggctgcccagcttcttgctag

SEQ ID NO: 34400 - DNA, 543 bp, Artificial Sequence
  Description of Artificial Sequence: Synthetic coding sequence
atgcagaggggcccactgtctccctcacccagcgacggccttggcgcgcttggcactacgtacccaggagtgcatcgcggtcagtcaatggctggcctgagggtgccggcattcaatgcaggactgagggctattacgccctctcgggccgagacccagcatcctgagaccacttcctctggaatgcaccgagaacccctgagttctacaccaatagcacactgggaaggcgcacaaagccctggagcacagagtgtacttgccatgctggttcatcgtactgcagcctatactttgcaagttcttgagcccaaaaaagatcccggacgtgagctgcctgcaaccccaagatcttgggcccctgcgcgacagccctcccccctacattcaatccggcaaactatgccagccaaaccttctctggttaaaagagagcgccgaaaccaggcccttgcacgtgaagcgccttggttcccacagcggacccagtggaaaacctccgaaggaccaggctcttcctccggacgccgcgggcgccggtag

SEQ ID NO: 34401 - DNA, 456 bp, Artificial Sequence
  Description of Artificial Sequence: Synthetic coding sequence
atgccttacgaaacaaggagttggattacccttctgaggacacagcggcgagaggaatgtggcctccattgcactagcctgcccagcctggcccgggacctgaagttccacactaccgaacctaatacatcacggccatcttctaacgatcttaggaataggaaactgtgtctggctgcggacaagctgtcacagtgcccatgggacttacaggacgtgtggaatgaagaaagacagctgtcacagtgcgagttatcaggcggccctcagaaaaacgtgggtagacgagttttccctataagacagactgtgcttcagccccggcctcctaaacggtccaatcccggcctcctgttttcagggacagaatgcggctgtattctgccattcctgtgcttccttagccgctacctgttgactgtccatatgcggggacttggaaaactgagtgtgtag

SEQ ID NO: 34402 - DNA, 369 bp, Artificial Sequence
  Description of Artificial Sequence: Synthetic coding sequence
atgacttggctggacaagggagtgtggacacaggaggacgagaatagttgttccttctctgagagcgacttcccaggatgtagggaccagatcaatccatcgatcccctcaatatggacagcggttagtggtatgatgataagcctggaggttcggtggtggattaagggaaaacagggatacgtaatttccctaggtcacgccctcagtccccgtctggagtgttcgggcactttctccgcccactgcatactgggtttgcccgggggaagctcttatccaccagcttccgtgagccaagttgtgggtaccaccgctctgtacctcgtggaggaagcatgggccgaagcaggaaaaatgcgtagctag

SEQ ID NO: 34403 - DNA, 660 bp, Artificial Sequence
  Description of Artificial Sequence: Synthetic coding sequence
atggctgccaggagcgtggatgacataagcataaagctgctgcacgagaagggacctgccaccgaccacggcgtgaatgtgcttccttctactgtccccgggagggaagaaggcatgactgatcggaaacattggtttagttttgggacgcagcctaatgtgccaggtttacaggaacccctcgattaccgcgccgccaatcaggcatggcaggctgtgttagctgaggtgcctagaggcggacctggctgtgccgcgctgagagatctggggcgttgcggcgggcccgatgtgtctaccagacgacagtggcggcctctgccattcagttgtccgctctcacacacaactcaacctcctttgggaggacattgcaggggtagctcagccggcaggttccacgggagggaccagacctcacctgggaccgtacagcagcttcccagtgctcacgtgttgaaacccggttgtacacaacacggtgatctctctccagggcaggcatcccctcctccagccgctgcgctcggaccctctcctaaggcttggacccatactttgggtagaccacagttgtgggcagggctcggcagccacagattcggcgtccccgggcccgggacacggaacactctcgctgcttgttgcgtgcaggaatag

SEQ ID NO: 34404 - DNA, 471 bp, Artificial Sequence
  Description of Artificial Sequence: Synthetic coding sequence
atggcaactccccctgcccctggcgcgggaacagccgcaccaagcgcacctaggccccctccaccgcgacccagttggctgcgcctggaccctgctgctagaggcgccaggctgcccttccccggatctccaggcacgacccggagggcccctcgtgagtccgcaccgctcgcccccgccctgcggtcagaccctgggcagccactggccgcttgcaatggcccgcctggcgagccaagggcggacccaggagtttccacccgttgcgctgctaccatgatcccccagggcaagcttactggtggaagaagctgcggctcgagacctcgtatgggcaggggggagcgtgccgaactttcgttcccggccgcggcacctcgattgaaaagggggcttggcttttggtttttcttttgcgggaatagctctgtagaaatccttcttgcttgtcatacaactcatcccttctag

SEQ ID NO: 34405 - DNA, 435 bp, Artificial Sequence
  Description of Artificial Sequence: Synthetic coding sequence
atgtcacttaaatcactgttctgtaacagcgaggccaaagataacaagtgctatcatacatacagcgaaagctcctggtctgagaccaaaaaaatagtgatcgctactaaaatacactcatttcagactttttcttcttgctacagtgactgtcatgggatcctcggtgtactgctgcatcagttagagacctcggttgccggaggcacattttgtctatccattgcgcacgcctggtgggccagattcgcccacagcagctggaaagccgcgttaggatcttgctaccaacctggtttccatacttgtcaaggtcaggcaaggctaggaagtgtgagaggagtgtgggctagtgagcatggcgtgcagccccagcggactggacggcacactggctgttgcggacgggtgggtagcttccgacactgtagctag

SEQ ID NO: 34406 - DNA, 750 bp, Artificial Sequence
  Description of Artificial Sequence: Synthetic coding sequence
atgcgcgtacggtggctgcgcttttggttgcttttctggctgctgctgggctttatttcacaccagcctacgccggtcattaatacacttgctgaccacaggcacagagagacagattttgggggttcgccgtggatcattatcatcattgtgttcctcggcagatataagtttactatcctcttctgtacaatctacttgtgcgtccccttcctgaaaactattttctggagcaggaatggccacgaccgtagccgtgacgttcagcagcgggccaggcgtagcaaccggagaaggcaggagggaatcaagataggccttgaagatatctgtactctctggaagcaggctgaaactaaggtgcaggctaagatccgcaagatgaaagtaacaaaaaaggttaaccaccactacaaaatcaatgggaagagaaaaaccgccaaggaacagaagatgtttcaacgggcacaggaattgcgatggcgggccgaagactatcataagtgcaaaataacccccagcgccaggaagcctctctgcaattgggtaagcttatttgtctttcttgcattcgggtcactgcctggacaggacatggataccttcttcagccttcagctgtgtgctcaagctcttcagcgggagatggcggagcggaaagcagcttacaaacatcattctcctattcctgtgggtaaccgtgtggttcagaaacatctgcacccacacccagttggtcctctgatatag

SEQ ID NO: 34407 - DNA, 402 bp, Artificial Sequence
  Description of Artificial Sequence: Synthetic coding sequence
atggcgtgcgccatccagctggccagttccgaagccagggatcgcgcccggccacgtgacagaacctttctccaaaaacgacagttaggggctggggtctggctcttaggtgagcgaacatccaacaccatgttgaattggaacggggagcgaggtcacccatgtctggtccttgttttcaaaagaaacattgaagcagactttaagagttctttcagctctgaacatttcttctttatacctttagacgattgtaactgcaaggaagaacttgccgtgatcagtgacgggaggaccatcgtgtgttaccatcatagcgtcgacattagttacgaacacaccaaacagacactgaaccagatcttgtgtatgattatgaagaagcatatgtttaagtgctag

SEQ ID NO: 34408 - DNA, 1851 bp, Artificial Sequence
  Description of Artificial Sequence: Synthetic coding sequence
atgccgcctctggaaacacagtcatccttggcacccccttctctgcaaactcctcccgcgtctctcaccactcccccactggagaacctgcccagcttggcaccccctcccctccagacagcttctgcccccttgaccacaccacaccttgaaacacccccttgcccagccccctgtcccctgcaagcgccccccagtcctctgacaacgcctcctcccgagacccctagcagtatcgccactcctccccctcaggcaccccccgcattggcaagtcccccactacagggtctccctagccccccgctatcccctctggccactcctccccctcaggcaccacctgccctggcacttcccccccttcaggctccaccgtctccccccgcctcccctcctctgtcgcccctcgccacaccatcaccacaggccccaaatgctctggccgtgcacctgttgcaggcgcccttttcccctccaccgtctcccccagtacaggccccattctcccctccagcctccccaccagtgtcgccaagcgccacgcctccgagccaggcccctccgagcctggccgcccccccactgcaggttcccccgtctccaccagcaagccctccaatgtcaccgtctgccaccccccccccccaggcacccccccctctggccgcccccccactgcaggtgccacccagtccccccgcttccccacccatgagccccagtgcaacccctcctccccgcgtgcccccgcttctcgcagcgcccccactccaagtaccccctagccctcccgcttccctgcccatgagcccgttggcaaagcctcccccacaggcccctcctgcgcttgccacgccacctctgcaggcattgccatcaccaccagcatcgttccctgggcaagccccgttctcacctagtgcttctctgccaatgtctccactggctacaccaccaccacaggccccaccagtactggcggctcccctgctgcaggtcccgcctagtcccccggcatcgccaaccctgcaggcccctagaagaccaccaactcccggcccagatacttcagtttccgggcctcgcctcactctggccttagcaccagggcctcctcctcccccttcccgtagcccatccagcaccttgtcaggccccgaccttgccgggcatagtagctcagccacaagtacacctgaagagctgcgcggatatgacagtggtcctgagggcggagcggccgccagcccccctcctgatgccgagctcgctgcctgtcaccccgcggcttggagtcggggtccggcgccgccccttgcatttaggggggcgccaggagcacccctcccttggcctccggcaactgggccgggaagcgcggacggcctttgcacaatctacgaaaccgaagggccagagtcagctacgccggcaccgggcgccctcgacccaggtcccagtcccgggacttctggtggcaaggcagccgctggcgctggtgccggtgcatcttctaggagtccaaagcaagcccggcttggagaactaccgttgggcgctctgcaggcctctgtcgtgcagcatctcctctctaggactctgctcctggcagctgccgaaggcgcagctggtggaagcggcggaggacccggcggagcagagggcggaggcgtgaccgggggcgctagagctgccttgagtgatgcggaactcggaaggtgggccgagctgctctcccccctggatgaatcacgggccagtatcacaagtgtgaccagtttctctccagatgacgtagcctcaccgcagggagactggacggttgtagaagtcgagaccttccactag

SEQ ID NO: 34409 - DNA, 549 bp, Artificial Sequence
  Description of Artificial Sequence: Synthetic coding sequence
atgttctgctgcctgggctacgagtggttgtctggcggatgcaagacttggcattccgcctgggtgatcaacaccttggctgatcatagacataggggcaccgatttcggggggtcaccctggctcctaattatcaccgtgtttctgagaagctataagttcgccatctcactttgcacgtcatatctatgtgtttctttcctaaagactatttttccatcccagaatggccatgatgggagcacggacgtgcagcaacgggctcggcgttctaatcggaggaggcaagagggcatcaaaatcgtgctggaagatatatttacactctggcgccaggtggagaccaaggtcagggctaagatctgcaaaatgaaagtaaccacaaaggtcaaccgccacgataaaatcaacgggaaacggaagactgcaaaagagcacctgagaaagctcagcatgaaagagcgagaacatggcgagaaggaaaggcaagtgtccgaggcagaagagaacggtaaattggacatgaaggaaatacatacttacatgtag

SEQ ID NO: 34410 - DNA, 1224 bp, Artificial Sequence
  Description of Artificial Sequence: Synthetic coding sequence
atgtataatgcattttggaaccatctcaaggaacagttgctatcaaccccccccgactttacgtgtgcactggaactgctcaaggacgtaaaggagaataggctcagaaatgaaattgaggaagctctggacactgacctcctaaagcaggaagctgagcatggagctctggacgtgcctcacctgagcaactacatcttaaatttgatggccctgttgtgtgcccccgtaagagatgaggcaatccagaaacttgaaaccattcgtgaccccgtccagttgctgcgcggcatactgcgtgtgttgggcctgatgaaaatggatatggtcaactacaccatccagagttttcgcccatatctccaagagcattcgattcaatatgagcaggctaagttccaggaactcctggacaagcagccgagcctgctggattacactacgaagtggctgacaaaggctgccacagacattactaccctttgcccaagtagcccagactcccctagcagttcttgttctatggcctgcagtctgcccagcggggcgggaaacaattctgagcctccctcccccacgatggtgctctatcaagggtatttaaatctcctgctctgggatctggaaaatgtagaattccccgaaaccctcttgatggatcgtatccgactccaggagttggccttccagctacaccagcttacggtgctagccagtgttttgctggtggcacgcagctttagcggcgaagtcctttttcgctcacctgaatttgtcgatcggctcaagtgcacaaccaaagccctgacagaggagtttatttcccgtcccgaggagacaatgctttcagtttcagaacaggtaagccaggaggtccaccaggggctcaaggacatgggcctgaccaccctctcaagcgaaaacacagcatcactgctgggccaattacaaaatataactaaaaaagagaattgtattcgcagcatcgtggaccagtggattcgcttcttcctgaagtgctgcctgttacatggcatgcaggagagtcttctgcattttccaggcggccttatcttaattgaaaaggagttggccgagttgggctggaaatttctgaatctcatgcatcataaccagcaagtatttggaccctactacgcggagatcctcaaacatattattcacccagctcaggcacaggagactgatgtcgaacccaattag

SEQ ID NO: 34411 - DNA, 432 bp, Artificial Sequence
  Description of Artificial Sequence: Synthetic coding sequence
atgttaagaaaaacatgcggtgggcagcaagaagactctcgaggaatgggccctcacctgccaagagtaccagatggtgtggttctcggtgtggaggaacctgagggcaaagcgcaggggagagtgaggggcgagctgtgtcccggggccctggcgagaatccacatggggcacagctgtactcgactgtccgctgagggaatagcaatgctgctgggcaccgctggcccctccagacttcccgccgcccctgatgctagccaggcaccacttcgctccccgtgggctctctctgtcgcggctgccctgtgctcgccggtgtcttgccacccctgtggccgccatgtggtaaccttcggacactgtcccgcacagggcccctggggactcgggaccttcggccattctttctttggctgtctgtgcaaatag

SEQ ID NO: 34412 - DNA, 486 bp, Artificial Sequence
  Description of Artificial Sequence: Synthetic coding sequence
atgggacatcgcccaaatctgggacaacccccgcatcccaatgcagtcgcggccgcattgcacgccagcctgtgccctgccaattggggaacctgtccccttggtaagcccgggtatcccggttgtctgtggttccagcccctgttactgttccccggctgtctgtgctctcccgacggaccctttcccagggcagttttcacctcagcaggaaaaggcccactgcagactgacctgggacgcggccgcgtaccacctagggaccaacaaacccctaaaagtagaccatgtccccgagctccagtggcctccaaccgccagtcgggcggctctgccgtgtccgctcctctgtctggtgcacgtcgcgcttggaagtcagccttcgccgctccaccacgttccaggctacgcccccagaagggcgtcccgtggactgaaaagagggcgagagggggggggagggccgggccctgccggcggacctag

SEQ ID NO: 34413 - DNA, 690 bp, Artificial Sequence
  Description of Artificial Sequence: Synthetic coding sequence
atggctgctgcccccgacgtgggaaacggcggaagcaagaacgtgcgcaagccgcgacctggcaaatgccagcctaagagcagacactcgctgcctcagacgcagaaacccgaagaagtcagaaagtgtggcggcatatgtcttcctgtgtgtttacaggatccgggggcgtgccctagttggctccccctggaagagggcctgcggcgtcccgcctttggacaccgcactgaagctggtccccggggaaagggctttgggagacaccgcggaaactcaggcctccgggcggcagaggtcactcacggcccttgctgggaggccgccgacgttccctgcctccgtcttactaagccacatggtcttagagtgacagccggatgttccgaatggcgacggaatgtggtcgcacgacaggtgccggaagccagtgctgaactgtgcagtcgcaatcaaccatgggcagcagccactcccggatccctccacccttccccccagccaggagtgttagaggggacccctactaacctgaaccggacactccccagtggcatccgaggaagccaacctttgcctcagggccagcctccactgcccggcagatccagctgggagacaaagactcgggaacctatacctccccccgtcaggctcgaagccagagaagtgggcggtgtgagcctgtag

SEQ ID NO: 34414 - DNA, 480 bp, Artificial Sequence
  Description of Artificial Sequence: Synthetic coding sequence
atggacgtggtggaggtcgcaggatcatggtgggctcaggagcgagaagatattattatgaagtatgaaaaagggcaccgggcaggcttgccagaagataaaggtcctaaaccgttcggttcttacaacaacaacatcgaccactttggcatgcaacatgagaccgagctgccacccctgactgcgagggaggttaaacagattcgccgggaaatctcaagaaagtctaaatgggtgaagatgctgggggaatgggacacatataagaactcccgcaaactgatcgatcgcgcctatcagggcataccaatgaacatccgaggacccatgtggtcagttctgctgaatattgaagagattaaattaaagaatcctggccgttatcagatcatgaaagagaagggcaaaagatcctcagaacacatacagcagatggacctagatgctgcaggcacgaccctgcacccccccggcgtttag

SEQ ID NO: 34415 - DNA, 462 bp, Artificial Sequence
  Description of Artificial Sequence: Synthetic coding sequence
atggccgccgtggagcacagacatagctccggcctcccctattggccttacctcacagccgagacactaaaaaaccgcatgggtcatcaaccaccaccacccacacaacagcatagcatcattgataattccttgagtctcaagaccccctcagagtgtgtgttgtatcctttgccgccatcagctgacgacaatttaaagaccccacccgaatgtctactgacacccctacccccaagcgctctgccatctgcagatgataacctcaaaacacctgccgagtgcctgctttacccactcccaccctcagcagacgacaatctgaagacgcctccagagtgcctacttacccccctaccacctagcgcgccaccctccgcagacgataacctaaagacaccgccagaatgtgtctgctctctgcctttccatccgcagagaatgatcatctcgagaaattag

SEQ ID NO: 34416 - DNA, 1116 bp, Artificial Sequence
  Description of Artificial Sequence: Synthetic coding sequence
atgggaggtccagtcctcggccactggtggcactcagggggaatgagcctggctgtgccttctctccctccacccggcaagtcttcagtcttcctgtttctgcaggagaagaaggcaaacaataaaaagcaaaaggcaaaacgtgtgcttgaagtgcaattgcagaccctgaacattcagaaggaggaactgaacacagatctctatcacatgaagcgcagcctgcggtattttgaagaaaagtccaaagatctggcggttagactgcagcattcactccagaggaagggtgagttagaatccgtcctctcagatgttatggccacccaaaagaagaaggctaatcagctgagctccccctccaaggccggcacagagtggaaactggaacagagcatgagagaggaggctctattgaaggtgcagctaacccagctgaaagaatccttccagcaggttcagttggagcgcgatgagtattcagagcacctgaaaggtgagcgcgcccgttggcagcaaaggatgcgcaagatgagtcaggagatttgtaccctgaaaaaagagaaacagcaggacatgaggcgggtagaaaaactcgaacgttccttgtcaaaactgaagaaccagatggccgagccattgccacctgagccacccgctgtgccttcggaagtcgagttgcagcatttacgcaaagaactggaacgtgtcgccggcgagctgcaagctcaggtcaagaataaccagcggatatccctgctcaatcagcggcaagaggagagaatccgggaacaggaggagcgactgcgcaagcaggaggaacggattcaagagcaacacaagagtctgcagcagctcgctaaaccacagagcgtattcgaagagcctaacaacgaaaacaaatctactctgcagctagaacaacaagtgaaggaactccaggagaaactgggagaggtgaaggagagcgagacttcaacgccgtcaaaaaagggttgggaagcaggctcttctctctggggcggcgaggtgcctggccaacggcagctgcctgcttggggtttagttactacagccccacccagagccgtgctcttcttagcctcctgcctatag

SEQ ID NO: 34417 - DNA, 384 bp, Artificial Sequence
  Description of Artificial Sequence: Synthetic coding sequence
atgggaaatctctgcggatgcatccagggagacagcaaaaagccatctaagaagcgagtcaaacggaaaccctactctacgactaaggtcacgtcaggtagcactttcaatgaaaatacacggcggtatgccgttcatacgaatcagtgtagacggccgcacggctctcgggtgaagaaaaagagatatccacaggaggatgatttccaccatacggtgttctctaatctggagcggttggataaacttcaaccaaccctggaagcctccgaggaatcactggtccacaaggaccgcggagacggagagagacccgttaacgtaagggtggtccaggtggccccgctgcgcagagaatccagagcaattgacacaggtgagtag

SEQ ID NO: 34418 - DNA, 2265 bp, Artificial Sequence
  Description of Artificial Sequence: Synthetic coding sequence
atgaaggtgatcgtgattcatcggaaaatgttccagcgagcccaggaactccggaggcgcgctgaagattaccacaagtgcaagatccctcctagtgcacgcaaagccctctgcaattgggtgagaatggcggctgcagaacaccgacactcttctggacttccctattggccttatctcaccgccgaaaccttgaaaaaccggatgggccaccaacccccgcctcctacgcagcagcactcgatcaccgacaattccctttcactcaagacgcctcccgagtgcgtgctgacacctctgccgccgtcagcggatgataatctcaaaactccacctgaatgtgttctcacccctctgccccctagcgctgatgacaatttgaaaacccctcccgagtgcctcctgactcccctgccccccagcgccgacgataacctgaagacgccccccgaatgtctgcttacgcctctgcctccctctgcagatgacaatttaaaaacaccccccgagtgcctgctaacacctcttcccccatctgcccccccaagcgcaccgcccagcgctgatgacaacctaaaaactcgcgcagaatgtctgctgcaccctctgcctccgagcgccgacgataacctcaaaaccccctcagagagacagctcactcccctgcccccatcggctccaccctctgcggatgacaacatcaagactcccgcagaaaggctccgtggtcccctaccccctagtgctgatgataatctaaaaacaccgtccgaaagacaattaacccccctccccccctccgcacccccctctgccgatgataatatcaagactcctgcctttcatcctcagagaatgattatatctaggcacctccccagcgttagttctctccctttccatccacagcttcattcccagcagatgataatttcccgctacctgctgagcgtgtgcgggtttagatttcaccaccaacccatgataatctcacgccatctacctagtgtgtcctcactaccttttcatccacagttgcaccctcaacaaatgattatctccagacacctaccctccgtatgcggcgggcgattccacccccagaggatgattataagccgccacctcccatccgtctcttccctcccgttccaccctcagttgcacccacagcaaatgattatcagtcgacacctgccctctgtatgtgggggacgttttcacccgcaaagaatgatcatttccagacacctacccagcgtctcttctctgccattccacccacaattgcacccgcagcagatgatcatttcccggcatctgccaagtgtgtgtggagggcgctttcacccccagcgaatgattatctcgaggcacctaccaagtgtgagttctctgccatttcatcctcagctccatccccagcaaatgattataagtcgacatctgcctagcgtttgcggtgaaaggctgcggggtccactgcccccctcggctgacgataacttaaagacaccctctgagcgccaattaactccactgcctcctagcgcccctcccagcgccgatgataatattaagacaccagctgagagactccggggcccattgccaccttccgctgatgacaatctcaagaccccaagtgagcgtcaattgactccgctgccgccatctgccccaccttctgccgatgacaacattaagaccccggctgagcgcttgagaggcccacttcccccatctgccgacgataatctcaagactcccagtgagaggcagctgacccccctccctccttcggcccctccgagtgctgatgacaacatcaaaacacccgctgagagactgcggggccccctaccacccagtgctgacgataatctgaagacacccccattagccacacaagaagctgaggccgaaaaacctcgtaagccgaagcgacagagggcggcagagatggagcccccccctgagcccaagaggcggagggtgggagacgtcgaaccctctagaaagccgaagcgaaggagagccgccgacgtggagccctcttcgccagaaccaaaacggcgcagggtgggagacgtggagccatccaggaaaccaaagcgtcggcgcgcagccgatgtggagccttcaagtcccgaacctaagcgcagaagagttggggacgtcgaaccctcgcgcaagcccaaaaggaggagagctgctgatgttgaaccttctctccccgagccgaagcggaggagattatcttag

SEQ ID NO: 34419 - DNA, 810 bp, Artificial Sequence
  Description of Artificial Sequence: Synthetic coding sequence
atggacgagattgaaaaatatcaggaggtcgaggaggatcaggaccccagctgcccaagactgtccagggagctgctggatgagaaggagcccgaagtattgcaagattccttggacaggtgctacagcacccctagcggctacctggagctgcccgatctcggccagccttacagcagcgcggtgtactcgttagaggagcagtacctgggccttgcactggacgtggaccgcaccaagaaagaccaggaggaggaggaggaccagggtcctccatgtcctcgcctttctagggaattactggaggtggtagagcccgaggtcttacaggattctcttgaccgctgctactctaccccctccagctgcctggagcagcccgactcttgtcagccttacgggagctcattctatgctttggaagaaaagcacgtggggttctccctggacgtcggagagatcgagaaaaaggggaagggtaagaagagacggggtcgcaggtctaaaaaggagagacggcgaggaaggaaagagggggaggaagaccagaatcccccatgcccccggctatcacgtgaactgctggatgaaaaggaacccgaagtcctacaggatagcctggaccggtgctattcaacaccatctggctatttagaactgccagacctgggccagccatattccagcgccgtgtactctcttgaggagcagtacctcggactggcgttggatgtagacagtgaatacttgacagtcaaagtcatctcgttgcatcttgtgtttcagattggcgttatattcctgcagtag

SEQ ID NO: 34420 - DNA, 570 bp, Artificial Sequence
  Description of Artificial Sequence: Synthetic coding sequence
atggtgcagggatcctctcggacagcccgaccgctccctgctcctgcttgcggactctcacctggaccggattgcaatgctagctggcaagacagggccgctgacttttgtcccgtgagggcagtgtgcaaggtggggccctgtccctgttgccaattgaagacagacccccggctgggcaaaagaacaggcctagacctgttttcagtctggagccggtcagcaatgctggcacctgctggttccgtgcttgctatgccgaccctccgcccacctagaaattctgtgggcgacagcggcgcatgctgcctgagaacaaccggtctggacatcagcaaggtgcttccagagtcttttctgtcctgtcctttgctcgaattgccctggcacctctcatcatgggtactaaacccaggtcttcccactcttcggactccacacgcctcctattcttgcttcgccgcccaagccagaagtcccgaacgagccgccggcggtgcctggcctctgacaggcaaaccctggccaaggaccggcattttgagtccaagtcacagtgagatcctgtag

SEQ ID NO: 34421 - DNA, 684 bp, Artificial Sequence
  Description of Artificial Sequence: Synthetic coding sequence
atgagccaccacacgagaacactaggcgtggtgttgagcccgcaacagggcgcccctgctggacccggtggtggtctcggcactccctaccactcacatccctgtaagccaaggcaggtccctgtctccgaaagccagcccccccctcacacgatgcaggttggccgctgggctgggctcggagtgggacaggccgaagccacatctgtgcggcttgggctgcacggtcttgaggcagttttcccttacctgggccacgatctgcagggccctgctgtcagtcacggagacgggctggctggcgtgggccgcgagctcgctctcctgctcggtggacccgagcaaaggggggctaagcatcgcgcaaaagtcgtgcaaggtcatttaattgactgcctgcttctctgtcatcccgtggaggaccgatctaggggttgctgcttcaatgccacaacacggagggaggcggaaggattgtgtcgggctcgagttctgcgggaaggcgttacaagcactctggctgtactgcaggcggatagctcgctgggtgtgtcatccacccgacgcacagcagccggcggggccgcaagggccgctgcccacggtcaaagctgcccaagagctaccccggctaccaccccaagtcccggctctccaaggcagggtcggttatcaatggagtag

SEQ ID NO: 34422 - DNA, 1023 bp, Artificial Sequence
  Description of Artificial Sequence: Synthetic coding sequence
cctgtgcctggccctactagctcagccacgaacgtcagtatggtcgtgtccgcggggcccctctcctccgagaaagccgagatgaatatactggaaatcaatgagaagctgcatccacagctggctgaaaagaagcaacagtttcggaatctgaaggagaggtgttttgtgacccaactggccggctttttggccaatcaacaaaaaaagtacaagtatgaggaatgtaaagacctgatcaagagcatgctgcgaaacgagcggcagtttaaggaggagaagctggctgagcagctgaagcaagcagaggagctcagacagtacaaagtgcttgtccacgcacaggagagagagcttacccagttaagagaaaagctccgcgagggtcgcgacgctagcaggtccctgaacgaacatttgcaagcccttctgacacctgatgaaccggataagagtcagggccaggatctgcaagagcaactcgccgaaggttgtagattggcccagcatctcgtccagaaactgtctcctgagaatgataacgatgacgatgaggacgtgcaggtggaattggcggagaaagtgcagaagagcagtgcccctagggaaatgcaaaaagcggaagagaaagaggtgccagaagactcacaggaagagtgcgcaatcacgtacagcaactcccacggaccgtatgattccaaccagccacataggaagactaagataacattcgaagaggacaaggtggacagcactttaatcggcagttcctctcatgtggagtgggaagacgctgtgcatatcatacccgaaaatgaatccgatgacgaagaggaggaagagaagggccccgtaagccccaggaatcttcaagagtccgaagaggaggaggtgcctcaggagtcttgggatgaaggctactctacactgtctatcccccctgaaatgacatctgtcgggtcaagtgaaaaaggcgggccaagggggaatagatcccaagcacagcagggagccgccgggtag

SEQ ID NO: 34423 - DNA, 11424 bp, Artificial Sequence
  Description of Artificial Sequence: Synthetic coding sequence
tagcctgggccaacctcgtccgctacgaatgtaagcatggtagtgtcagccggtccgctgtcgtctgagaaggccgagatgaatatattagaaatcaacgaaaaactgcatccccagctggctgagaagaaacagcaattccgcaaccttaaggagcggtgcttcgtgacccaactggccggcttcttggctaaccaacagaagaagtacaagtatgaggagtgcaaagatttaataaagagtatgctgaggaacgaacgccagtttaaagaggaaaagttggccgagcaactgaagcaggctgaggaactgaggcaatataaagtgctggtgcacgcacaagagcgggagctcacgcagcttcgcgagaaactgcgggaaggccgtgatgcctctcgaagccttaatgaacacttgcaagccttgctgacaccagatgagccagataaatcccaaggacaagaccttcaggaacagctcgccgaggggtgtcgcctggcgcagcacttagtgcagaaactgtctccagagaacgataatgatgacgacgaggatgtgcaggtggaactagccgagaaggtgcaaaaatcctcagcaccacgtgaaatgcagaaggcagaggaaaaggaggttcccgaagatagccaggaggaatgtgccatcacctattccaattcccacggcccatacgacagcaaccagccccacaggaagactaagatcacctttgaagaggataaggttgacagtacgctgattggaagttccagccacgtggaatgggaagatgccgtgcacatcattcccgagaacgaatctgatgacgaggaggaagaagagaaaggacccgtctccccacgcaatctccaggaatctgaagaggaggaggtgccgcaggagtcctgggatgagggctacagtacactttccataccacctgaaatgttggccagttaccagagttattccagcacctttcatagcttagaggagcaacaagtgtgtatggctgtcgatataggacgtcataggtgggaccaagtaaagaaagaggaccaggaggcgaccggtccaaggctttctagagaactgctggatgagaagggtcctgaggtgttgcaagactctcttgatcggtgctattcaactccctccgggtgcctggaactgacggactcatgtcaaccctaccgttcggcattctatgtgctcgagcaacaaagaatcggcttggccgtggatatggatgagattgaaaagtaccaggaggtcgaggaagatcaagacccgagctgcccaagattgagcagggaactgctcgacgagaaggaaccggaagtcttgcaggacagcctggatagatgttattcaacaccctccggatatttggaattgccagacctcgggcaaccatattcctcagctgtgtatagcttggaggaacagtaccttggtctggccctggatgtcgatcgtactaagaaggatcaagaggaggaagaagaccaggggccaccttgcccccgactgtcccgagaattgttagaagtcgtggaaccagaggtgctgcaggatagcctggacaggtgttattcgaccccatccagctgcctagagcagcccgactcatgccaaccttacggaagcagcttctatgcccttgaggaaaagcatgtcggcttctcacttgacgtcggcgagatcgagaagaagggcaaggggaagaagcgtcgggggcggagatcaaagaaagagcgtagaagaggccgcaaggagggggaggaggaccagaacccaccctgcccacggctgtcaagggagctgttagacgagaaggggcctgaagtgctgcaggatagtttagatcggtgttactccacaccctctggttgcctcgaattgaccgacagttgccagccgtacagatcagctttttacgttctcgaacaacagagggtcggtttggcagttgacatggacgaaatcgaaaaatatcaggaagttgaggaagaccaggacccatcatgtccccgcctttctcgcgagctgctcgacgaaaaggagcctgaggtgctgcaggactcgctggacagatgctacagcacaccatcaggatatctggagcttcctgatctgggccagccttattcctcagcagtgtacagtctagaagagcagtatcttggcttggctctggacgtcgacaggaccaagaaagaccaggaggaagaagaggatcagggcccaccttgtccccgcctgtctagagagcttctggaggtcgtggagccagaggtgctgcaggacagccttgaccgctgctattccacaccttccagctgtcttgagcagccagatagctgccagccctacggcagttccttttacgcactcgaagaaaaacacgtggggtttagcctcgacgttggggagatcgaaaagaaaggcaagggcaagaaacgccgcggacggcgctctaagaaagagcgtaggaggggacggaaggaaggagaggaagaccagaaccccccctgtccacgtctgtcgagagaactcctggatgaaaaggaacctgaagtgttacaggactctttagatcgatgttacagcaccccttctggttatttagagctgccagatctggggcagccctactccagtgccgtttacagtttggaagaacagtacctgggcctggccctggatgtcgacgagatcgaaaaatatcaagaagtcgaggaggaccaggacccttcctgccccagactgtcacgggaactgctagacgagaaggagcctgaggtgctgcaagactcccttgatcgctgttacagtaccccatccggctatcttgaattgcccgatctgggacagccttattcatcagccgtctattcactggaggaacaataccttgggctcgcgttggatgtagaccgcaccaagaaagaccaggaagaggaagaggatcaaggccctccctgcccaaggctctcccgcgaactgttggaggtggtcgagcctgaagtattacaggattccctcgaccgctgttactccaccccaagctcctgcctggaacagcctgattcgtgtcagccttacgggagctctttctacgcgctggaggagaaacatgtgggtttctcattagacgtcggtgaaatcgaaaaaaaaggtaagggaaagaagcgcaggggccggcgcagtaagaaagagcgtcggcgcgggagaaaggaaggggaggaagatcagaatccgccttgtccccggctgagcagagagctgctggacgaaaaagagcctgaagttcttcaggactctctggaccgatgctatagcaccccttccggttatcttgagctccccgatctggggcagccatactcatctgcagtgtatagtttggaggagcaatatctggggctggctctcgacgttgaccgtacaaagaaggatcaggaagaggaggaggatcagggccctccttgtccccgactgtccagagaactgctcgaagtggtagagcccgaggtgctacaggactcactggaccgctgctactcaacgcctagctcctgtctggagcagcccgattcttgtcagccatacgggtcatctttctacgctctggaggaaaaacacgttggtttcagcttggacgtgggggagatcgagaagaaagggaaaggtaagaagagacgggggcggagaagcaaaaaagagcggcgaaggggcaggaaagaaggagaggaagaccagaaccctccatgtccccggttgagtcgcgagctgctggatgagaaggagcccgaggttctgcaagactcccttgaccgatgctatagtaccccatcaggatatctcgagcttcctgatctgggccagccctacagtagtgctgtgtacagtctggaagaacaatacctgggtctggcgctggatgtcgaccgtacaaaaaaggaccaggaagaggaggaggaccagggtccaccctgtccccgcctgtcccgagaactgctcgaagtcgtggagcctgaagtgttacaggatagtttagaccggtgttacagcacaccttccagctgcttggaacagcccgatagctgtcagccttacgggagctctttttacgccttagaagagaagcacgtggggtttagcctggacgtaggagaaatcgagaagaaaggcaaaggaaagaagcgacggggccgcaggtcaaagaaggaacggaggagaggaaggaaagagggggaagaggaccagaatccaccttgccctagacttagccgggagttgttggacgaaaaagagccggaagttctacaggactcactggatcgttgctacagcaccccgtcagggtatttagaacttcccgatctgggccagccatactctagtgctgtgtatagtctggaggagcagtacttggggctcgccctggacgtggatcgcactaagaaggatcaagaggaagaagaggaccagggtcccccatgtccccgcctgtcacgtgagctgttagaggtcgtggaaccagaagtgttgcaggactcactggataggtgctactccacccccagcagctgtctggagcagccagacagttgtcagccatatgggagctccttctatgcattagaagagaaacacgtcgggttcagtttagatgtaggagagattgaaaaaaagggaaagggcaagaagcggagaggacgtcggagcaaaaaggagcgtaggcgcggcagaaaggaaggggaggaggatcagaatcctccttgccctaggctctccagagagctattagacgagaaggggccagaggtactgcaggattcgctggacaggtgctacagtacaccatctggctgcttggaactgaccgattcatgtcagccgtatagaagtgccttttacgttttagaacagcagagggtagggctggccgtggacatggacgaaattgagaaataccaggaggtagaggaggatcaggatcccagctgccccaggcttagccgagaactccttgacgagaaggaaccggaggtgctgcaggatagtctcgataggtgctacagcaccccatctggatacctggaactgcccgatctagggcagccttattcaagtgccgtctacagccttgaggaacagtacctcgggcttgcacttgacgtggatagaactaaaaaagatcaggaggaggaggaggatcagggacccccttgcccacgcttatccagagaactgcttgaggtggtggaacccgaagtgcttcaggacagccttgacaggtgctactcaaccccaagctcctgtctggaacaacccgacagctgtcagccttatggtagtagtttctatgctctggaggagaaacacgtcggattctctctcgatgtgggggagatcgagaaaaaagggaagggcaagaaacggagggggagacgttcaaagaaggagaggagaaggggtcgaaaagagggcgaagaggatcaaaatcctccctgtcctcggctcagtcgtgaacttctggacgagaaaggccctgaggtccttcaggatagcttggatagatgttactctactccaagcggatgcctcgagttaaccgactcttgtcagccttatcgctcggctttctacgtgcttgagcagcaaagagttggcttggctgtcgacatggacgaaatcgaaaagtaccaggaggtagaggaggaccaggaccccagctgccccagactgtcccgcgaactgctcgacgagaaggaacccgaagtgcttcaggattcccttgacaggtgttactctactcccagtggttatcttgagctgcctgatcttggacaaccctactcttctgcggtatacagtctcgaggaacaatatctgggactggctctggacgtcgataggactaaaaaggatcaggaggaggaggaagaccaaggtccaccctgtccacgattgagtcgagagctcctagaggtggtggagcccgaggtgctgcaggacagtctggaccgatgttattcaacgccaagcagttgtctggagcagcccgattcttgccagccttatgggtcgtcattctacgcactcgaggaaaagcatgtcggattcagcttggatgtcggagagatcgagaaaaagggcaaaggcaaaaagaggcgagggcgcagatctaaaaaggagcgtcgaaggggcagaaaggaaggagaagaagatcagaaccctccctgcccacgcctgtcccgcgagctgttagatgaaaagggccccgaggtgcttcaggattcattggatcgaagctactccaccccaagtggctgtctggaactgacagacagttgtcagccctatcggagcgctttttacgtattggagcagcagcgtgtgggactggccgtggacatggatgaaattgagaaatatcaggaggtggaggaggaccaggacccgtcctgccccaggttgtcacgggagctgcttgacgagaaagagccagaggtgcttcaggatagcctagatcggtgctattcaacccctagcgggtacttagaactgccagacctggggcagccctattcttcagccgtgtacagcctagaagagcagtatctcggcttagcgctggacgtggaccgtaccaaaaaagatcaggaggaggaggaggatcagggccctccctgccccagattaagccgagaactattagaggtcgtcgagcctgaggtccttcaggatagcttagataggtgttattcaactcccagcagctgtctggagcagcccgactcttgccagccgtacggttcaagtttctatgccttggaagaaaagcatgtgggtttcagcctggacgtcggagagatagaaaagaaaggcaaaggcaagaagcggcgtggccgacgtagcaaaaaggaacgaagacgagggcgaaaggaaggggaagaggaccaaaacccaccttgccctcgtctttcgcgtgaactgctcgatgagaaggggcctgaagtgctccaggactctttggatcgatgctactccactccgtcgggatgtctcgagttaaccgattcctgtcaaccctacaggagtgcgttttatgtgttagagcagcagcgcgtgggtttagctgttgacatggatgaaattgaaaaataccaggaagtggaagaggaccaggacccatcatgtcccagactatcgagggagctgctggacgaaaaagagcccgaggtcctgcaagactccttggacaggtgttactcgactccttccggctatcttgaactgccggacctaggacagccttacagttctgccgtgtattccctagaagaacagtatctgggcctcgctcttgatgtggacaggacgaagaaggatcaggaggaagaagaggaccagggacccccctgccctagattgagccgcgagctgttagaggtcgttgagcccgaagttttgcaggatagtcttgaccggtgttattccacccctagtagctgcctggaacaacccgacagctgccagccgtacggcagctcattttatgccctggaggagaagcacgtcggattctcattggacgtcggtgaaattgagaaaaaaggcaagggaaaaaagcgaagagggagacgcagtaagaaggagcgcaggcgcgggaggaaggagggcgaggaagatcaaaacccaccttgcccgaggctgtcccgtgagctcttagacgagaaggagcccgaagtgttgcaggacagcctggatagatgctactcaaccccttccggctacctggagctacccgacttaggccagccctattctagcgccgtgtactcactggaagaacagtacctcgggctcgcattagacgttgatcgcactaagaaggatcaggaggaagaagaggaccagggacccccatgccctcggctgagccgagagcttctagaggtcgtggagccagaggtattgcaagactccctcgatcgctgctattccacaccgtcttcatgtctggaacagcctgactcctgtcagccttacggctcatcgttctacgcactggaggagaagcatgtggggttttctctcgatgtcggcgagattgagaagaagggaaagggaaaaaagcgacgtggacgccgatccaaaaaggagcgcagaagaggccggaaggagggggaagaagaccagaaccccccctgtccacgcctgtcacgcgagttactcgacgagaaagggccagaagttctgcaggattcactggatcgctgttacagtacccctagcgggtgcctcgaactcacagacagctgccagccatataggtcggccttttacgtgctcgagcaacagagggtcggtctggccgtggatatggatgagatagagaaataccaggaagtcgaagaggaccaggatccaagttgcccccgtctctccagagagctcctggacgaaaaggaaccggaggtgctccaggatagcttggatcgatgttactcgaccccgtcaggatacctagaattgccagacctcgggcagccatatagctcagctgtgtatagtctggaggagcagtaccttggcttggcactagacgtggaccgaaccaaaaaggatcaggaggaagaagaagaccaaggaccaccatgcccacgtctgtcccgagagcttctggaagtcgttgaacctgaggtgctccaagacagcttagatcgctgttatagcacaccaagtagttgtctggaacagcccgattcctgccagccgtatggcagcagtttttacgcccttgaagagaaacatgttggcttcagcttggacgtgggcgagatagaaaagaaaggaaagggtaagaagaggcggggtcgtaggtccaaaaaggagcgccgtcgcgggcggaaggagggtgaagaagaccagaaccctccttgtccaaggttgtcaagagagctcctggacgagaaagaacccgaggtgctacaggactctctggatcgctgctacagcacaccatcggggtatttggagctgcctgatttggggcaaccatactccagtgccgtgtattctctggaggaacagtacctgggcctcgccttagacgtggatcggaccaagaaggaccaggaggaggaggaggaccaggggcctccctgcccccgcctcagccgagaactgcttgaggtcgtggaaccagaggtactgcaggattccctggaccgctgctactccacccctagctcctgcttggagcagcccgacagctgtcaaccctatggcagtagcttctatgcactcgaagaaaagcacgtcgggttctcactcgatgtgggcgaaatcgaaaagaaaggaaaaggtaagaagaggcgcgggcggcggtctaaaaaggagagacgcagagggcggaaagagggggaggaggaccagaaccctccttgtccccggctttcccgcgagctgttggatgaaaaggagcctgaggtacttcaggactccttggacaggtgctactccacgccttctggatatctagagcttcccgatctgggtcagccttactcttccgccgtttattctttggaagaacagtatctggggctcgccctcgatgtcgacagaactaagaaggaccaggaagaagaggaagaccaaggcccgccgtgcccaaggctctcaagagaattactggaggtagtcgagccagaggtcctgcaggattctctcgatcggtgctactctactccctcgagctgtctggagcaaccggattcctgtcaaccttatgggtctagcttctacgctctcgaggagaagcacgttggattctctctggacgtgggagagatcgaaaaaaagggtaaggggaaaaagcgcagggggaggaggtcaaagaaagaacggagaaggggaagaaaagaaggggaagaagatcaaaatcctccatgcccacgactgtccagggaactactggatgaaaaggagcccgaggtattgcaggatagcttggacagatgctattcgacaccatctggatatctggagctgcccgatctgggacaaccatacagtagcgctgtgtacagcctggaggagcagtatctaggactggcattggatgtagacagaactaagaaggaccaggaagaagaagaagaccaaggccctccatgccctcggctgtctcgcgagctgctggaggtggtcgagcctgaagtgttgcaggactcactggacagatgctatagcactccatcctcttgcctggagcaaccggatagctgtcaaccctatgggtcttctttctatgctttggaggaaaagcacgttggcttctctttggacgtcggagagattgagaagaaaggaaaaggaaaaaagaggcgcggcagaagaagcaagaaagagagaagacggggaaggaaggagggagaggaggaccaaaaccccccttgccctagattgtcacgcgagctgctggacgaaaaagggccagaggtcttacaggactctctcgacagaagttatagtacgccttccggctgcctggaactgaccgacagttgccagccatataggtctgccttttatgttctggagcaacaaagggtgggactggctgtagacatggacgagatcgaaaagtaccaagaggttgaagaggatcaggatccttcatgccccaggctcagcagggagcttctggacgagaaggagcctgaagtgctacaagattcgctcgacaggtgctattccacaccctccggatacctagaactgccagacctgggacagccttattcctctgcggtgtattcattggaggaacaatacctcgggcttgccctcgacgtcgaccgtacaaaaaaagatcaggaagaggaggaagaccaagggccaccgtgcccgcgcttgtctcgggagctgctggaggttgtggagccagaggtccttcaggattccttggacagatgttatagcacacccagctcgtgtctggagcagcccgactcatgccaaccatacggttcgtccttttatgcgctagaggagaagcacgttggcttcagcctggacgtgggggagatagagaaaaagggaaagggcaagaagcggcggggaaggagatctaagaaagagcgtcgaagaggccggaaggaaggtgaagaggaccagaaccccccttgcccgaggcttagccgcgagctacttgacgagaagggacctgaagtgctgcaggattcactggatcgctgctatagcacgccaagtgggtgcctcgagcttacagacagctgtcagccctacaggagtgctttttatgtcctggaacagcagcgtgtgggactcgctgtcgacatggatggcgagtacctttctatgaaggttattcgtatacactag

SEQ ID NO: 34424 - DNA, 258 bp, Artificial Sequence
  Description of Artificial Sequence: Synthetic coding sequence
gaaatgcaaaaagctgaagagaaggaggtacccgaggactcccaggaggaatgtgcaattacttactccaactcacacggaccttacgactcaaaccagcctcaccgcaaaacaaagatcacttttgaggaagacaaggtcgacagcactttgatcggttcctctagccatgtagagtgggaggacgcggtgcacattattcccgaaaacgagtctgatgatgaggaggaggaggaaaaaggccccgtgagcccttag

SEQ ID NO: 34425 - DNA, 753 bp, Artificial Sequence
  Description of Artificial Sequence: Synthetic coding sequence
gagatagagaagtaccaggaggtagaagaagatcaggacccctcttgcccgcgcttgtctagagagctgctggacgaaaaggaaccagaggtattacaggattcgttagatcggtgttactccacacccagtggctacctggaattgccagacctcggtcagccttattcatctgccgtgtattctctcgaagagcagtacctgggactcgcactggacgtggaccggaccaagaaagaccaggaagaagaagaggatcaaggtcctccctgccctcgcctctcaagggagttgcttgaagtggtggagcccgaggttctgcaggactcactagaccgctgctactccactccctctagctgcctcgaacagcctgatagttgccaaccctacggtagctccttctatgcactggaggaaaagcatgttggcttttccctcgacgttggggagattgaaaaaaaagggaagggtaagaaacggagagggaggcggtccaagaaggaaaggcgcaggggacggaaggagggtgaggaagaccagaaccccccctgccctcgcctatcacgggagctgctcgacgagaagggccccgaagtgcttcaggattcactggaccgatgctactcaacccccagtggctgcctggaactgacagactcatgtcagccctatcggagcgctttttatgtgctggagcagcagcgggtaggactggcggttgatatggatggcgagtatttgagcatgtag

SEQ ID NO: 34426 - DNA, 300 bp, Artificial Sequence
  Description of Artificial Sequence: Synthetic coding sequence
atgcgccccaaaacacttagaaactctgcagcacgaagtagaaaagaacccggtttcttaaatcaccacatggaagggtcctgcttgcaactaggcgagctctcttcagtgggttattggatggaatcccactccgttacccaggccggggtacaatggtgcagctttgggtcactgcagccccccccacctcggttcaagccgttctcgtgcctgagtcttccgtcttcatgggattaccgtcgtaagaagggaagctggcttggttcaaagctggaattcccaatgctatgcgggtag

SEQ ID NO: 34427 - DNA, 300 bp, Artificial Sequence
  Description of Artificial Sequence: Synthetic coding sequence
atgcgccctaaaacacttcgtaattccgcggcacgatccagaaaagagcccggcttcttgaaccaccacatggaaggatcttgtctgcagttgggtgagctctccagcgtgggatactggatggaaagccactcagtcacacaagcaggggtccaatggtgttcctttggaagcctgcagcctcccccacccaggttcaagcctttttcttgtctttccttgccatccagctgggactaccgtcgtaagaagggctcctggttgggttctaagctagagttccctatgctctgtggctag

SEQ ID NO: 34428 - DNA, 321 bp, Artificial Sequence
  Description of Artificial Sequence: Synthetic coding sequence
atgaggccgaaaacactcagaaattccgctgccaggtctcggaaggaaccgggattcttgaatcatcacatggaaggatcttgcctgcagctcggggaattatcctccgtagggtactggtggcccttcggtcatcctgggcctgcccagggacaccttccggtggctgtgtgggcttcttgggtggttgccggtatctccatcgccctgtacctcccgccccatccagaaggaagatacgaaggcccctttaagcggcataccaagacatttcggtcagctcagtgtgcggattgcctgacctgcgccctagaaccatag

SEQ ID NO: 34429 - DNA, 453 bp, Artificial Sequence
  Description of Artificial Sequence: Synthetic coding sequence
atggagaataacccctctcataatcccgtgagtccaagcccattccccaccaggatttcggctccacttaacatgtctcagtcccattttcgcgagaattggcttatgctgaagaagagcctcgagggcaagctctgcccaagtagttgcggatcactaaaatgtcgtgccagtcgctctccatcagtgggcacaggcccatccctccccattgaatgcttcctgtacatgaaaacctggagttccctccagatgacggtggcctcagaggaagacaagcgcagggaaaagacacaaaacgcggggctcccactttttttcgcatcgaccgtggggacggtgaccctgcctagctttcaccacttacagttgcatacacatacccacaccctggtgccacagtcattgttcgggacatgtttgaccgcgcatttggaaacccgctggtcatag

SEQ ID NO: 34430 - DNA, 486 bp, Artificial Sequence
  Description of Artificial Sequence: Synthetic coding sequence
atgggccataggccaaatctcgggcagcctccacaccctaacgcagtggcggccgccctgcatgcttcactgtgtccagccaatcgcggtacttgccctctcggcaagccaggatatcccggctgtttgtggttccagcccttgttgctgtttcctggatgtctgtgctcaccggatggccccttccccagggccgttttcacttctgctggcaagggcccattacagaccgacctggggaggggccgggtgccccctagagaccagcagaccccgaagagtaggccttgccctcgggcacccgtagcctcaaataggcaatccggcggttctgccgtttcagccccattgagtggcgcacggcgtgcctggaagtcggctttcgccgctccaccacggagtcggctgcggccacagaagggagtcccctggaccgaaaagcgggctagaggggggggaagagccggaccatgtaggaggacctag

SEQ ID NO: 34431 - DNA, 321 bp, Artificial Sequence
  Description of Artificial Sequence: Synthetic coding sequence
atgcatagtcgaccctgggcatggggggcatccgagatgtgtttttgcttctttgagatggggagcttctgctgtcccagcagaagtaccgtagccagatcccagttaactgcagcatcgacgtcctgggctcaggtaatcttacctcctcagcctccggagtgcctcctgttagtgttcatgatgacctggggaccaggcattctacatctatgctgctcaggagccagtccggccccaggcgcccatcaaccacagctcaggagggaggctcttatctgtcgagccaagcagctatgctttcatgtcgaccccgcttag

SEQ ID NO: 34432 - DNA, 246 bp, Artificial Sequence
  Description of Artificial Sequence: Synthetic coding sequence
atgtgttcttgggaggtgacaactccccaaggattgggaacgagcagcgctagtgaagaaagtcttaccgacgatcaccggctgctgaaagtgatctctcagggaagtttcgccgaagtgaaggccgccggacccgctcactcccattgggaccaggacggctgcgggggtcatcccaaccgagcagccggattgctgcagcctccaggcagcgtgctgcaggggccatatgacgagggcccgtag

SEQ ID NO: 34433 - DNA, 720 bp, Artificial Sequence
  Description of Artificial Sequence: Synthetic coding sequence
atgtcagaccctgaaggggaaacactacgctccaccttccccagttacatggccgaaggcgaaaggctgtatctgtgtggcgagttcagtaaggcagctcagtctttcagtaacgccctgtatctccaggacggagataaaaattgtctcgtggcccgctctaagtgttttctcaaaatgggagatctcgaacggtcgctaaaagatgcggaggctagtctacaaagcgatcctgcattttgcaaggggattttgcagaaggctgagacgctttacacaatgggagactttgagtttgctctggtgttctatcacagaggatacaagctgaggcccgatcgggagttccgagtgggtatccagaaagctcaggaagccatcaacaactcagttggttcacctagttccatcaaactggaaaacaagggtgacctctcctttctttctaagcaggctgaaaatatcaaagcccaacagaaaccccaacccatgaaacacctactgcatccgacaaagggtgaacccaaatggaaagccagcctcaaatccgaaaaaaccgtgaggcagctgctgggcgaactgtacgtggacaaggagtatctggagaagttgctgctggatgaagtaacctttctgatgcagaatagggaaccactgaccactctggccgaatttttaccagagctgggcaatagctccaaacctctgactagagaatag

SEQ ID NO: 34434 - DNA, 516 bp, Artificial Sequence
  Description of Artificial Sequence: Synthetic coding sequence
atgctgacaagtaaactccggagcacgctgcagacccttcaaggtctgggcctcactagttcttgtctgctggatatattttcatcagttagcacccacatcagaaatctcccctgcttgaatctcaccttggccagcagttgtctgcagagaatacagattatgcagggcgcaggcagaaaacgcaaccggggcagagctgaaaaacaaaaagcatgcgctatctccttccaggtagactttagtaaactgcacatcttgggcgccgggcgaggtcgtatactggaagaaaagcaaggaatcctggtgagacaggccaatgctgactgcttacgtgacctagggctgaagtccgcattcgagctcgcttttcggagatcatcactggtcttttccccccgtgccaaaggactcaaaagcagcgccgaggaccgacgttggccgttattttggcagaacatggtgtctattttcggcgcgcgatgtaaagcctcttctgcgcaaacaagttgttag

SEQ ID NO: 34435 - DNA, 1218 bp, Artificial Sequence
  Description of Artificial Sequence: Synthetic coding sequence
atgcacatcaactcccttcatatgcagctgaatagtcaccgaatctgcaactctacacatactgtgtatgctaatcagctggcactgcggatgcagctgaatagccattgcgtgtgtaactccacaaggaccgcctacgcaaacccactgaccgcgtatgcaacccagctcgccctgcgtatgcagttgagctcactttgcgtgtgtaacccagctcgatccgcgtacgccacacaggttgccctgcggatgcaactctcaagtctgtgtgtgtgtaatagtgccaggacagcctacgctactcagctagccctcaggatgcaggtgtccagtctctgcgtctgtaatagtgccagatccgcttacgcgacacagctcgccttaagaatgcagttaagctcgcactgtgtttgcaattccgcacgatccgcgtacgccactcagttggcgcttaggatgcagctctcgagtctctgcgtttgcaatagcgctagaaccgcctacgctactcggaccgcttatgctacccagctggctctcagaatgcaactcaactcccattgtgtctgtaacagtactaggacggcatgtgccacccagttgacattaagaatgcagctatcactgctttgtgtttgtaactctactcgaacagcctatgctaaccagctgacagcctacgctactcagctggccttacacatgcaaaggaactcaacacatactgcctatgctacacaacttaccctttacgccactcagttagctctccacatgcaattcaatagccactgcgtgtgcaagagtacgtactgcatatgtaacagcacccactgcgtatgtaatagtactaggactgcctacgccactcagctggcactgcgcatgcagctgaatagccattgcgtctgcaacagtgctcggacggcttacgcgactcaactgttacaggtgctgatcagcggacacttcctgtttctgactactacaccttcacagtacttctcttctttaaaaagcgctcaggatgaagccctagattcccgaacttgttgcatgccgttagggctgttggaggtgtgtcggctggcatccccccggctgcaccccgctcttagctgtctgtcatgcgagaatcccgtagcttccgcatcacccggttccgacttttgccttcttcctagctctgccgcccccttgggaccgtgtcttgagtag

SEQ ID NO: 34436 - DNA, 411 bp, Artificial Sequence
  Description of Artificial Sequence: Synthetic coding sequence
atgagacaggaggtcgaaggtcgggggcggggatctcacgagctgattatcaccgataaaagatgcggcgtgtgtggcggttccttgagttgtattgtttatctgtgtattagcctcaacttcagcaggatcaagaaactcaaaaagtatacttggcccggccctactagggattctcctaatgcatccctgcagcccgggcgggccaaatttgctttctcacatgcgtcgcatacccctctccattctcagctgggggccctgcagaccggcaaaccccaggctctgttagctagtgctaatcctctgtctcggtcaatggggccacctgatcaccaccttacgaccttgatactcatctccctggaaaccccattccccgggctcctttccagcggttgctttccttag

SEQ ID NO: 34437 - DNA, 1008 bp, Artificial Sequence
  Description of Artificial Sequence: Synthetic coding sequence
atgcagcttcttggccttctgggcctgctgtggatgcttaaagcatccccctgggctacaggtaccttgagcaccgccacttcaatcagccaagtacctttccccagagccgaagcagcctctgccgtgctgtcaaattccccacactccagagacctggcagggtggccactaggcgttccccagttggctagtcccgctccaggccaccgcgagaacgcaccaatgactcttactacctctccacatgacaccctaatctccgagaccctgcttaattccccagtatcttccaatacctccactacacccaccagcaaattcgctttcaaagttgaaacaacacccccgactgtgctggtctactctgccactactgaatgcgtctaccctacttccttcattatcacgatttcgcatccaacgagtatttgcgtaactaccactcaagtcgcattcactagttcatacaccagtactccagtgacccagaaacccgttacaactgttaccagcacctattctatgacaacaaccgaaaagggaacgtctgctatgaccagctccccaagcaccacaaccgcaagggaaacccctatagtcacggtgaccccctcctctgtgagtgcgactgacaccacatttcataccaccattagctccaccaccagaactacagaaagaacaccactgccaactggaagcatacacactaccacgtctcctactcccgtattcaccactcttaaaaccgcagtcacaagtacatctcccatcacttcgagcatcacttctacaaataccgtcaccagcatgactactactgcttcgcaacctacagcgacgaacaccctgtcctccccgacaaggacaatcctgagttcaacgccagtgttatccacggagacgataactagtggaatcacaaatactactcccctttcaacacttgtcacaacgctgcctacgaccatcagtcggtcaacccccacatctgaaacaacctag

SEQ ID NO: 34438 - DNA, 432 bp, Artificial Sequence
  Description of Artificial Sequence: Synthetic coding sequence
atgcggctgcaaaagacccggtgtggttcagcagccagtccaccaaacaagcagcagacagaactcccagcctttagcgtgatgcctcgaccagcaggccagcacgtgtggccgtggcgcggtgagcgaatgcgcttaccaggggcagcaagttccttgtttagtaattattttagtctcccctatgttatttaccttagcatctccgacctcaatgtggagtgcctgatcttctctgtgtttgactcccagcaagtgcatacgagttaccagtccaatggtctgcatcggaacggaatgtttcatgactgccttgaggtctcaaagcatccttttctcggcctgactctgacactgtggctttgtgatctctccagtagcggattttacatgtctggccacgagccactgtggaacttatcaccattgtag

SEQ ID NO: 34439 - DNA, 633 bp, Artificial Sequence
  Description of Artificial Sequence: Synthetic coding sequence
atgtccagagctgggtcccaccccaagcctgcaattccgggccgcgggggcgagaaactcgctctgctcctcgctatgcttggaggccggtgctgtccggcaggcggccccgagagtcatactcctcggaagccctggcctccaattcgaagagagaggcctggtcttaggtccccaaagcctcgcgaggaagccggcccacgcgcggactccaaagccgccagccccgcgttatttatggggcccgggagtcggggcagacgccggcccccaagctgggcgcggagacgcgctaggggaggtagggggtcctgtccagagccccacgtgagagccgggccaaggtttttcattgcactcgcggctcccgctgcccgaggactgcgggtatcaagccaaggccctggactgtggagaggtcctgcggcccgcaaggagggggtggcccgtgtcggggtagctgcgggcctgcgactgcgcccacggggcagaggtcgaaaaaccactcctgccctgagcggccatccagcaagattcccattgcagcccggcgatagcagagagcgcagtagaaatcacagggctctcgagctgacatggcagccccgcggcgccaaggcggggggcgcctag

SEQ ID NO: 34440 - DNA, 633 bp, Artificial Sequence
  Description of Artificial Sequence: Synthetic coding sequence
atgtcccgcgccggaagccatcccaaacctgccatacctggccggggaggagagaagctcgctttgttgttagctatgctgggagggagatgttgtccggcaggcggtcccgagtcccatacccctaggaaaccatggccccctattcggagagaacggcccggcttaagatcgccaaagccacgcgaagaggccggcccacgggcggactcaaaggccgcaagcccagcactgttcatgggaccagggagtcggggccgacgccgtccaccatcttgggctcggaggagagctaggggaggccggggctcttgcccagagcctcacgtccgcgccggtccacggttcttcatagctcttgccgcacaggcagccaggggattgcgggtatcatcccagggcccaggtttgtggcgtggcccagccgcaagaaaggagggcgtggccagggtgggcgtggccgccggcctccgcctgaggccgcgcggcagaggacgcaagaccactcccgccctgtctgggcaccctgcccggttcccactacagcccggcgacagcagagagaggagcagaaaccatcgtgccctagaacttacttggcaacctcggggcgcaaaggccggtggagcctag

SEQ ID NO: 34441 - DNA, 1881 bp, Artificial Sequence
  Description of Artificial Sequence: Synthetic coding sequence
atgaagatgcaaaagggcaacgttctgcttatgtttggcctactgctgcacttggaagccgccaccaatagcaatgagacgtccacctccgccaacactgggtcttctgtcatttccagtggtgcgtcaacggctacaaattcaggctcttctgttaccagctccggcgtctccaccgccaccattagtgggtctagcgtcacaagcaacggggtgagcatcgtgacaaactccgaattccacaccacatcctctggaatcagcacggcgaccaacagcgagtttagcaccgcttcttcaggcatttcgatcgcaaccaacagcgagagttcaacgacttctagcggcgcctcaaccgcaactaattctgagagtagtacacccagctccggagcttctaccgtgaccaacagtggctcatctgtgacatcatctggcgcttccaccgctacaaattctgaatcctctaccgtgagctcccgtgcaagcacggccaccaacagcgagtccagtactctttctagtggagcctcaacagccacgaattccgattcaagcactactagctctggtgcaagtactgccaccaattctgagtcgtccacgaccagcagtggcgcgtccacagctacaaacagcgaatcatcaacagtgtcatctagagcatctaccgcaacaaactcagagtcctccacgacgagtagcggtgcctcaaccgcaacaaactccgagtctcggacgacaagcaatggagcaggtaccgctactaactcggagtcctctacaacgtctagtggagcatcgacagctacaaatagcgatagtagtactgttagctccggtgccagcacggctacaaatagcgaaagcagcacaacctccagtggagcttccacagcaactaactctgattcctctaccacctcaagcggcgcaggtaccgccaccaattcagagtctagtactaccagctctggagctagtaccgccacaaatagtgagtcctctaccaccagctccggggcgtctacagccactaactccgattccagcacaacttcgagcggagctgggacggctaccaatagtgaatcgagtaccgtgagtagcggaatatctacggtgacaaactctgagagttccaccccttcttccggggcaaatacagccacaaactctgagagcagcacaactagcagtggcgcaaatacagccaccaatagcgagtcgtctactgtgtccagcggagcgtctacagcgacaaattccgagtcatctactacctcctccggagtatccacagctacgaactctgaatcgtcgaccacatcctccggcgcaagcactgctactaactctgactcttctactacatctagcgaggccagcacagctaccaactccgagagctctacggtttctagcggtatcagcaccgtgactaattctgaatcctccacaacttcctccggcgcgaacactgctactaactcaggaagctccgtcacctccgcaggaagtggaaccgcagccctgaccggaatgcatacaacctcgcattctgcctccactgcagtgtctgaagccaagccaggcggtagtcttgtgccatgggagatctttttgattacactagtctcagttgtggccgctgtgggattgttcgcaggtttatttttttgtgtccgcaactcgctttctctgaggaacacctttaacacggccgtctatcacccacatgggttgaaccatggcctgggacccggaccaggtgggaaccacggtgccccccatcgtccaaggtggagtcccaactggttttggcggcggcccgtctccagtattgcgatggagatgagcggcaggaactccggtccatag

SEQ ID NO: 34442 - DNA, 393 bp, Artificial Sequence
  Description of Artificial Sequence: Synthetic coding sequence
atggagggacgggaggtttacttgtggtactctgtggattcgcgaggtgatttcctggtatttttgtgcccaatcttttttagttttagctttagcgaggtggagtccctttccccaaggcttgagtgttctggtaccattagtgcccactgcaatttatgcttactcggcagctcgtattctccagcttctgcctcacgggttacaggaatcaccggaatgtgtcaccatgctcaacttatctttgttttcctcgttgagatggagttcaggcacgtaggacagacaagcttcgagctgttggcttccagctctccccccgcaagcgcctcacagagcgccggaatcacgggcgtcagtcactgcgcttggccgctggcccaatacttgtag

SEQ ID NO: 34443 - DNA, 459 bp, Artificial Sequence
  Description of Artificial Sequence: Synthetic coding sequence
atgcccgacctaaagatgcaggaagtgaagaaaatttgttatgagctagctctggcctactttcaccatggtcaggcggagatagaggccctcgccaccctgaaggtctgggaactatgccatacctacggcaaaccagagggtccacgagatgcgtggcgcgcagtggcacgtgatttttgggatactgtgggagaggaggagggcggcggggctggttctggtgggggatcagaggaaggaacacggggcgtcgaggtcgaagacctgcaggcacatatttgcaagttgatgggcatcctccagcaggtgaaactgcagaactcttctaaggactgggaactccaagccttgcaggatcgcatggtgtgtatggagaggatcattcccttagctcaggaccatgaggacgagaacgaggaaggcggcgagttccattgggcccccccagaggggtag

SEQ ID NO: 34444 - DNA, 498 bp, Artificial Sequence
  Description of Artificial Sequence: Synthetic coding sequence
atgagccatcctcaggccactagtaatcttcagcacaccgtatccaattccgacaacattgggtcttccgctggccggtggacctgggttcctctgacgtggacggatacaagcaaaatgtctatgcgaggcctgctggatttattcagtttccactcctgtattctgaaaaacggctctgagcccgaggaaccacaggattccgctaaaaccgatacccagctcagcccagctacacttgctctggagagggaggagcattctagccgtcacgtcccatccgtgctctctaaaacaatgagccgggcttctgccgagctgacatgtaccgccgggcgacagggacctggaccacccggcagccatagtcaagcacctcatatgcttccccagcccgagccgctcctggcctgtgccccggctatgtggtgtagaagggagccccagccaatcgggggtctgcagcctccccatctgcgtttacatttagaatcatag

SEQ ID NO: 34445 - DNA, 375 bp, Artificial Sequence
  Description of Artificial Sequence: Synthetic coding sequence
atgctgccttctaaggcatttgagttcgctaccgtaaagtcgatgcatggtatttttgggtgtgggctggccttgccgcccgtgtttgcagcggaactgctatacctgactagagcctgtgcgtccgatgagcagccctttattactgcactgaggcctcccccacgtcctcctcctagtgcactccagttcatctcacgtctggttcctattgccacttgcgggctcggcggccctcctgacatcctgtcattcggatcaccagtgacaccggagctgctccccttttggggcgcccatatttgtgacacccttgtatgtccggtccactttttgcatctggagttcctctcgtgcagccacataagcatctag

SEQ ID NO: 34446 - DNA, 267 bp, Artificial Sequence
  Description of Artificial Sequence: Synthetic coding sequence
atgcggtcccaggggcagggcggcccgggagcgtggcgaaggatggagtcctggtcggccgagcctgctggtccaggccagggcagactggggagtccgtgtgaggcagccgaacaagccagctttgagaaaaccgtgattggagtcgggcaggcgagggcagctctgtccgaagaagaacatagggtatgggaggcggcggccggcgtgggcggtcttgagcagtggggctgttgggaggccggcgtgacgagcgggtggggatag

SEQ ID NO: 34447 - DNA, 447 bp, Artificial Sequence
  Description of Artificial Sequence: Synthetic coding sequence
atgagtagttttgtcgtcgtcatggggttcctggtggaaatgacaagccgcaagaagaataatgtcaaggaggaagagatggagtgcgctgtgacgtatctccgtaagggaggggggatctgttctttttatttttacttttacctgtttttcattttcatctatctttttttcctgcgttggagcctggctctgagcccaagactggagtggagcggggctatcagcgcccactgcaatctgaggctgccaggcagctgccactcgtcagcaagcgcgagcagggtggccggcactaccggagctaggcaccacgctttacttattttctacatattctcaagggacggcgtgagcccctggtccaggagcccccatttggtggtgtgccctccctggccccccaaggtgctgggactgcaggccccagctacaacccctggctag

SEQ ID NO: 34448 - DNA, 375 bp, Artificial Sequence
  Description of Artificial Sequence: Synthetic coding sequence
atgaccctcaatgagcacgctgcttttaagcacttgttcaacaaggcacacctcgcacctccccttattcatctcacgctgagtggacattctacctgtttccgagaacacagggtcggaggaaaggtgaccgatcaacaggatcctaaggctgaagagttcttcctcgtacaaaataagatgaaatctctaccttgtctcctcctgtctactcagacccggcaaccctctgacttctctattttttcccccccctttcctcccgtctactctactaagcctcctctgagcagttggcccgtactgaatgagcttctcggaacgcctcccaggaggggcggtggccgtgctgagggcctgctgaccagtcaatag

SEQ ID NO: 34449 - DNA, 429 bp, Artificial Sequence
  Description of Artificial Sequence: Synthetic coding sequence
atgcggatcagaacttcattctttatgagtgccgctctcggcggccggccgccccccgctagaaccgaatggacccctctgacaagaagcacacacccaacggccccacctgctagcctttttgggcggaggggccccccccggagaccgctgtcctgttttcccgcacgagagccagggcagcgtcaactccggctcctgcgtccaagcggcttatggagaaggcgccgtcgcaggaggaggcggcgcaggcgacgccgaaggcgcgggcgacggcacgcagcacgtgatacgagattccggaatgccaacgcgttgtgcgctggcacggccctgccattgagtgggagaagatcagcagggcctggatctctagcacacccccctctaggcaccgccactcccgaaacactgggccctggtatttag

SEQ ID NO: 34450 - DNA, 1977 bp, Artificial Sequence
  Description of Artificial Sequence: Synthetic coding sequence
ttaaaaactccgcctgaatgcgtcttgacgccgctgcccccatccgctgatgacaacctgaagaccccaccggagtgtgttctgaccccgttgcccccttctgccgacgataacctcaaaactcctccggaatgtctgcttacccctctgcccccctccgccgatgacaatctgaagacccctccagagtgcctgcttaccccactcccgccaagtgctgacgacaatctgaaaacacccccagagtgcctacttacaccgcctccgccctccgcagatgacaacctgaaaacaagagctgagtgtctgctgcatccactcccgcctagcgccgatgacaatctcaaaacacccagtgagcgacagcttacccctctcccccccagcgcccctcccagcgccgatgacaatatcaagacccctgctgaacggctcagagggcccctgccaccttcagccgacgacaatcttaaaactccatctgaacgacagcttactccgctacctccatcagctcccccctccgcagacgacaacatcaaaacccccgctttccatccccagagaatgatcatctctagacatttaccaagcgtgtcctctctcccgttccacccgcaattgcactcacagcagatgataatttcacgttacctgctctccgtttgcgggttccgcttccaccaccagcccatgatcatatcacgccacctgccgagtgtttcaagcttgcccttccacccccagctgcacccacagcaaatgatcatcagccgacacctaccatccgtctgtggagggaggtttcatccccagaggatgattatcagtagacatcttccaagtgtgtcctcgttgccgttccatcctcagctgcatccacagcagatgatcatttcacgacaccttcctagtgtgtgtggcggaaggtttcatcctcagaggatgattatctctaggcacctgccctcagtgagctctctgccatttcacccacagctgcaccctcagcagatgataatctcccggcacctgcccagcgtttgcggcggccggttccacccccagcgaatgatcatcagccggcaccttcctagtgtttcttcactgccgttccatccccagctgcatcctcagcaaatgattattagccggcacttgccatccgtgtgcggtgagcggttacggggacccctgcccccttcagctgatgataatttgaaaacaccatccgagaggcagctgacccccctaccaccaagtgcccctcccagtgccgacgacaatatcaaaacaccggcggaacgcctgcggggtccacttccccccagcgcggacgacaacttgaaaactccctccgagaggcagctgacaccacttccccctagtgcgccgccgtcagcagacgataatatcaaaacacccgcagaacgactccggggtccactgcctcccagtgcggatgataacctcaagacgccatctgagagacagctcacgcccctgcccccttctgcccctcccagcgccgacgacaacatcaaaacacctgcagagaggctgaggggccctttgcctcctagcgcggacgacaatctgaaaactccgcccttagcaactcaagaagcagaggcagaaaaaccgcgcaagccgaaaaggcaaagggctgccgagatggagcctccacctgagcctaaaagaaggcgagtgggggacgtggagccaagccggaaacctaaaagacggcgcgctgccgacgtcgagccctcctctcctgaaccgaagaggcgtagggttggagacgttgagccatctcgtaagcctaagcgaaggagggctgcagacgtggaaccgagttctccagagccaaaaagacggagagtgggtgacgttgagcctagcagaaaaccaaaaaggcgtcgcgcagccgatgttgagccctccctgcccgagcccaagagacgccgtttgtcttag

SEQ ID NO: 34451 - DNA, 588 bp, Artificial Sequence
  Description of Artificial Sequence: Synthetic coding sequence
atgaatagcgtctttaggcagccaggttcaaatttctcatttcccatctaccagccatccgcatcagtgacacacggtctctcattcttttgtgaggttagccctcaaatgttgactcctcaagattatcgcgggaaacagcaaggtcataggggttgtcccggctgtatggtggctatggacacctggcctgcggtacttcccgaacttcctggtttctggggagaggggtcaggagggcaagcctggggagcaaggggggagccactgttgcagaaggccaattgtctgcttgaagctgtccgactgtttctcaactacaggcctctgggtgccgaggggggcgaactcacgttcggtaagaggcttctggtgccgacagctgtgtcttgcgcctacgattgcgtctcttctagtgctttcctgggcattcagctgctgggagatcctacccggtcacctggccactgttatcggcaagacttcaatggaactctccggctcagggaggggaagggcttggttcaaagccacactggtacattgtgggctggaccactccaggaaggtacccaggggcaaacatag

SEQ ID NO: 34452 - DNA, 453 bp, Artificial Sequence
  Description of Artificial Sequence: Synthetic coding sequence
atggctgtcagtagaatgagtaaatggcgcttatcccgggttggtggttcgcgcagcctgcctgccgagatggaagtactcggcgaagtgtggtgcgtgcgtgcagaggagcagcctatgaccggactggggatagtgtggcactcccctctcgataaagctttggagacctggagcttgcaacaacaaccggatttttctcttgggctgggtcacctgggcctgggaaccgacgcaacatggatgcaaagttttcctgggtccggaggcgacgcacaggccggcaccggagtgtctgggccactgcgactctacccgaatctgctgtgcgattttgggcccagacagggcccattgtgggccctccttctggaaaagaggcaaatggccggcaccggcgggtctcctgcactgcttgcatggcgctccgcatcatggcgcgctcttgggtag

SEQ ID NO: 34453 - DNA, 342 bp, Artificial Sequence
  Description of Artificial Sequence: Synthetic coding sequence
atggccgtgtcccggatgtccaagtggaggctgagtcgtgtaggggggtcacggtcccttccagccgagatggaggtattgggagaagtgtggtgtgtgagggcagaagaacagcccatgaccggactgggaatagtgtggcactcaccattagacaaggctctagaaacctggtctctgcagcagcagcccgacttctctctaggattggggcatctgggacttggattgtatattctagcttcttatctgctgtgcccacggcagcccccctctcagcccgatggtccctgtggctctcctaaccccgtgtcaggagcaaagaaaactaccgtggcttag

SEQ ID NO: 34454 - DNA, 228 bp, Artificial Sequence
  Description of Artificial Sequence: Synthetic coding sequence
atgcacatttatttcacagcagaacttttaaagaggcggaacgcgaagcctactttttccatgtctagcatgcaggcagctcgaagcattcccaagtctatgaacgtgcattccatgccaagctttctgtactcctcttgcagttcgaccaacatgtggtggctaaaaaactgctgcagcttttcactcgtcaaacttatgcattcctgctcgcggcttctgaactag

SEQ ID NO: 34455 - DNA, 561 bp, Artificial Sequence
  Description of Artificial Sequence: Synthetic coding sequence
atgtggaaccagcagggccgcccggggatccggaaccagttttccctgttttttttccttactcagtcccttgccctgagtttacgccttgagtgttcgggcgccattagcgatcactgtaatctgcgccttcttggcagctccgatagctcggcctccgctagccgcgtcgcggggatcatcgacgtgagacacatgcccggacagcacggggagacattgagtctgcttaagattcagaagttggcggggtgtggtggatcccacctctactcccaactgcttggaaggctaaagtgggaagacgggttgtctagcggaggcaggggatgcagcgagcttcgaggtcgtcactgtgccccagggtgggtcactgcacggctgtgcttgaagaaaaagaagaaacgcggaggcggtaagaccaagttatactctgttgggctggagttcaacatttggaaagtcgatatctggaatgccctcgtgcccctcgacctgtggttttccctgaaaggtgagtcccggactatagtcttggaatcctccgaggtcaggacttag

SEQ ID NO: 34456 - DNA, 459 bp, Artificial Sequence
  Description of Artificial Sequence: Synthetic coding sequence
atgccctcccaaccccacctgtccgcatgttcggttgagtccccaggtgccgcagcaaggctcacacagcgccacctcacaggggtcgcccgcggtggaggccagacaggcacctttcacatgggcctattgcccagccgtcaggagtgtgcccctgtgagcgcccttaccctcacgaccaccatgggtcggctgttctcagtccactggcagatctggggaccctgctccccctgtatcgtctatcccaagggagattcggagcagtccgcgagcaagtctaagcaggctttccctttattgcttaggaaaggcatggagtggcccctgagtgcatggctcgagtcttctagtcccgctccttgtatgccgttgtggcgcagaaactccttctgggaatctaggccctccccatgtcggatcaggggcctatgttctatgaggccccatggcctttag

SEQ ID NO: 34457 - DNA, 84 bp, Artificial Sequence
  Description of Artificial Sequence: Synthetic coding sequence
atgtcacccgcactgacctttccccgccgctggattgccgaaggcctcgtggagaatctcaatccgccaggcgcggatgcatag

SEQ ID NO: 34458 - DNA, 159 bp, Artificial Sequence
  Description of Artificial Sequence: Synthetic coding sequence
atggctgcgcggtctctggcaaggcgcgctctcagggtggccggcggcgacgctagatcgggcggccccgtagcaagggacacacaacttggggcccaatggcgctggattgcagagggcctggtggagaatctgaacccccccggcgctgacgcatag

SEQ ID NO: 34459 - DNA, 381 bp, Artificial Sequence
  Description of Artificial Sequence: Synthetic coding sequence
atgccgaattttgctaagtctctgttcattcaccctatcaactttttcctgctgtttagcaccgaattctgttccgtatcgcaggcgggtgtgcagtggcgagatctggggagcctgcagcccctaccgtcccggtttaacagggtgtcttgcctctctttgccttcttcctgggattatcggctgatgcctgtcattcctgctttgtgggaagccaaggcagggggcagtcctgaggtgcggggctcgagacttgcctggtcgaagtggcagaatcctgtcagcaccaagaatacgaaaaagccacagaattgcccgggcatggtagcccacgcttgttctccgaattacagtggaggcgggggccgcaggatcacctag

SEQ ID NO: 34460 - DNA, 501 bp, Artificial Sequence
  Description of Artificial Sequence: Synthetic coding sequence
atgacagctggtacagtggtaattaccggcggcatcttagcaactgtgattcttctgtgtatcatcgcagtactgtgctattgtaggctccagtactactgttgcaagaaagatgagtctgaagaagacgaggaggaacccgatttcgctgtccacagccacctcccacccctgcacagtaacaggaacctggttctcactaatggacccgccctgtacccgacagctagtacatctttctcacagaaaagcccgcaagccagagcgctgtgccggtcttgttcccattgcgaacccccgaccttcttccttcaagagcccccagaagaggaggaggacgtgctcaacgggggagagcgtgttctttacaagtccgtttcgcaggaagatgtggagctccctaggggagccttcggcggactgcaggctctgaatccaaacaggctctcagccatgagagaggcctttgctcgcagccggtctataagtaccgatgtgtag

SEQ ID NO: 34461 - DNA, 1164 bp, Artificial Sequence
  Description of Artificial Sequence: Synthetic coding sequence
atgtaccgctggaagctgtcctcccatgagccgtgctccgcaacatgtaccacaggggtcatgtccgcgtatgctatgtgtgtgagatacgacggggtggaagtggatgacagttactgcgatgccctgactcgcccagaaccggtccacgagttctgcgccggaagagaatgccagccaaggtgggaaacgtccagttggtctgaatgcagcaggacctgtggtgaaggttatcaatttagagtggtgcgatgctggaaaatgctcagtcccggcttcgacagctccgtgtactccgatctctgcgaggctgccgaggccgttcgccccgaggagagaaaaacatgcaggaatccggcctgtggccctcagtgggaaatgtcggagtggtccgaatgcacggctaagtgcggcgagagatctgtggtcactcgcgatatccgctgttccgaggacgagaagctttgtgacccaaatacccgtccagtaggggagaagaactgcacaggtcccccctgcgataggcagtggacagtctccgattggggcccctgtagcggctcctgcgggcaaggcagaacaatacgacatgtgtattgtaaaaccagcgatggccgagtggtgccagagtcacagtgtcaaatggaaactaaacccctggccatccatccctgcggggataaaaactgtcctgcccactggttggcccaggactgggagcgatgcaacaccacttgcggccgtggagtgaagaagaggctcgtcctgtgtatggagctggcaaatgggaagccacaaacacggtccggaccggaatgtgggctcgccaaaaaacctccagaggaaagtacatgcttcgagagaccatgcttcaagtggtatacaagcccctggagtgaatgtacgaaaacatgcggcgtgggggtgaggatgagagacgtcaagtgttatcagggaacggatattgtacggggctgcgaccctttggtaaaacctgtgggtcgtcaggcctgtgatctgcagccatgtcccacagagccgcccgatgactcgtgtcaggatcagccgggcaccaactgcgctcttgctattaaagtgaacctgtgcggacattggtattactccaaggcctgttgccggagttgtcggcctcctcatagctag

SEQ ID NO: 34462 - DNA, 672 bp, Artificial Sequence
  Description of Artificial Sequence: Synthetic coding sequence
atgttccccgtgtcatccggctgttttcaggagcagcaagagaccaacaagtcgctgccaaggagcgcctctacacctgaaaccagaactaaattcacacaggataacctgtgccacgcgcagcgcgaacgcctggattcagccaacctgtgggtgctggtggattgtatcctcagagatacttctgaggatttgggcctgcagtgcgacgccgtgaatttagcatttggtagaagatgtgaggaactggaagatgtgcgccacaagttgcagcaccacttgcacaagatgcttagagagattactgatcaggagcacaacgttgtggctctgaaggaggcgatcaaggataaagaagagcccctccacatcgcccaaacgcggctctacctcctgtcccatagaccaaacatgcagctctgccgcgaggcagcccagtttagcgcagtgggagaggcctctaggcgaggagctgttcccctgcaaccgagggggcacccccatgaaccaggcgaaggctgctacagacatgaccaacagtctctgcacagaccaccggaggtgcacggaccatcatatctcctacacccccacccagccgcaggatggctccccgtgagttccggtaccgtcctccctcccaaccccccaaacaagcagtgtatttcttag

SEQ ID NO: 34463 - DNA, 390 bp, Artificial Sequence
  Description of Artificial Sequence: Synthetic coding sequence
atgttcccagtgagctccggctgctttcaggaacagcaagagacaaataagtcccttccccggtctgccagtacccctgaaacccgaactaaatttactcaagataacttatgtcatgctcagcgcgaaaggctggatagcgcaaatctttgggttctggttgactgcattttgagagacacatctgaggacctggggctgcagtgtgacgctgttaatctggcttttgggcggcgatgtgaggaactggaagatgcccgccataaactgcagcatcacttgcacaaaatgcttcgggagatcacagatcaggagcataatgttgtggcgctgaaggaggctatcaaggataaagaagaacctcttcacattgctcagacaaggctgtag

SEQ ID NO: 34464 - DNA, 528 bp, Artificial Sequence
  Description of Artificial Sequence: Synthetic coding sequence
atgaggctcccaggcgctcctgctctgccggacgccgacttcctggtgcacctgcatttcctggttcagacctcctggttcatttgtaactttctggttcggatcccgtgggcctctgccctcccagacgctcctgcactcctagtcatcctggaaaagacttttccagaacacgcgacttgccgtggctgttgggtgtctggatacctgtgttggacggcaccggggaactgcatatgtagcgcaaatgtgggattcttgaaaattgagaacacgtacagacagattcaccatacgcatatgcacagacacacgcacacacatacagacaagtcaatcacccacacctgcaccgacacccatacccaaagccagcgacatcggctaacctcccgtgccctccgattgtttatcctgaatgccattaccgacacatcgaaattcggagccgctgtattcttctacgtctactgcctatttgccgactctgtgtacaagtttttcccctttctaccgccattcaggtag

SEQ ID NO: 34465 - DNA, 1941 bp, Artificial Sequence
  Description of Artificial Sequence: Synthetic coding sequence
atggaggtcattaatctgaccaccctgccaatgatcccagtagatgaacatctggccgttagcctggtcgcccgcaacacaatggtgaagactgttcggaaagagctggaaaataacccgcctagctgcttaatcggatcaatgcaccaagtgaatcagaagatcgcagatatcaatctccgcacggaaccctccgccaattccctggctatcgagagatttgaactcgagaaaaaggcactgagagagaaaacacgcagctcacctgaggacaaagtgaaaaggcaaagaaaatcccaatacagctgcaaaggctccgaactgcgccacgccaggtcttccgtgattaaaagaaaaaccgccgataagaatctcctcgctgaattataccagtacagcaatttcaactccagtaaacctaacaagctgcctaacggagtcgacttttgtgacatggttggaaacgtcgtcagggcagagagggactgcctgtccggaaagcacttctgttccggtagagagctggaaaaattcctgagctcttcgtctcccagagctatctggttggacagcttctggtggatttttcatgagaggtatcagcccaataaagagttacagaacaacttattcgaccgcatagctcagcattatgccctgttgttgttcagggttcctaaatctcattctgaagaggcactcctcaagagactgccaagtctgttgagcaaggccgtgtatacgtccttttgctgttgcttcccacagagctggttcgatacacatgaatttaagtctgatatttgtaatacaatgagcctttggattagtgtgggaacgtacccatcccctcagtcttatgactcttgggattattccgaactggatccagagagatttcgtagggaggaactgatgctctaccgtaggcggctcaccaaaggcagagaatttagtctctttgctggcaagagggccttctcgcaaaaacctgcgcagtcaagaaaattctaccacccacagagctccagcgcgaacagtccctccgagaagacctcctccgcaaagcagaattccgagaaatctttgaggatgcagaatacggcaaaggaacaccattgtcagacgcttgtcttgaagaagccaacccaggaagtgaagcgtatttccgaggccagggagtgtgagaatatgtttcctaagaagtcttgtgcagcctgtaaaagccccgaactgacatccaacttgttcaatatatacggaaagagtccactgatagtctatttcctccagaattacgctagcttacagcagcacggcaagaacgtccttatcgtaaggagggagaagacaaccagcactccggactgcacacctacctacactgatgttatttccgaaactttgtgctctatgaaaaagcgaaaagacaacctgaatcagttatatcagcaccactggacagagtggaactactttgataaacacctgaaagagctgcaagataatttcagccgcgagatgaagaacatcgacccaaaggctgcagacaccaagaaagctaaccatatgttcattccgccaagcgctgtgaatgaggagtcaccagataagaaaaccaagggatctctccagcgggaaattgaattcaaggggtgcagtaataagaaccacggaaaaggcagatcggtgaatatgagaggcaaagaagagcgcgaacgagaggagaagcagaagttgaatatcagcttccattcccttccttcccccgaggaattacacaacctcgaacctggctccgcttacagaataagagatattagtgctacccggacacctttgcgacgtccctctagttgggaacccagtttaatctatcaggaacaagtgctgctgaagacacataccctttctatggaggaagacaaattccgctgctag

SEQ ID NO: 34466 - DNA, 876 bp, Artificial Sequence
  Description of Artificial Sequence: Synthetic coding sequence
atggacgtcgtggaggtggcgggaagctggtgggcacaggagagagaggacatcataatgaaatacgaaaaagggcatagggccggcctgcccgaagataagggaccaaagagctttggctcatacaataataatgtagaccacctgggaatagtgcatgaaacagaactgccgcctctgaccgcccgcgaagtcaagcagatcagaagggaaatttcccgtaagagcaagtgggtcaaaatgctcggtgagtgggacacttacaaaaactctagaaagctgattgacagagcctaccagggcataccaatgaatattcgcggaccaatgtggagcgtgttgctgaatatcgaggagattaaattaaagaatcccgggaggtaccagattatgaaggagaaggggaagcggtcatccgaacacatacaacagatggatcttgacgtgtccggtacactccgaaggcacatttttttcagagaccgttatggaactaaacagcgcgagctgttgtacatcttacttgcatacgaggagtataatcctgaggttggatactgcagagatctatcccacatagctgcattgtttctgctgtatctgcccgaagaagacgcattttgggcgctagttcagcttctcgcttctgaacggcactcactccagggtttccacagccctaacggtggcaccgtccagggcttgcaagatcagcaagaacacgtggttgccacaagccttcccaacaccatgtggcatcagagtgcctccaggagacgcccaggcgttgccaggggccacgtcttcggcaccgggagccttatgccaggtccgggtatgatgactctctgtagctccattctgggacccctctag

SEQ ID NO: 34467 - DNA, 420 bp, Artificial Sequence
  Description of Artificial Sequence: Synthetic coding sequence
atgtttcttcttaaaaaatcttcagaaaagggttggtaccccgtgaaggaatcaagagatagaggtcctcggagatggtcccagggtctgtcgcgcaagaagcggacgtttcctactaagagttggcggaagaagaccccaggtttgctccttcccctcccaagcgggtggcaacacggcagcctgagagccggacaggtcctccacttggacggggcaggcggcgatagtgaggctgatgtactgatgatgctgcgtcgcctcatcagaggccaggtcaaaggcactctcggctggcgcgtgggtattgcagtgcctacaacacccactctcggcgggtgcccccggaggctcgaggtgtggtggtggctgctgcttttgctgctattgcttctgctgcttctgctgcttctcctatag

SEQ ID NO: 34468 - DNA, 666 bp, Artificial Sequence
  Description of Artificial Sequence: Synthetic coding sequence
atgtctgcactggtcttcttcccaccaagcagcccattgccgatcgccttcttccccccaagctcccctctgcctatcgcattcttccccccttcctcaccgctaccaatcgtgttttttcccagcctcttctccatctttctgccccctccttacccgcatcttctgcttgcagccgcgagcagttgtcgagccttcctctcaccgcatcacctgttgttcctcttccccactgtgctgtcgccccggccactgctatctctttcctcaccgagggcctttccaaccaccgttttctcccctgtattcttcccatcccacaggtttttgcctatgagctcccacagattagctgctgcatcagtgagccgtaatctgctacccaccttcttttccccaccccccattgtgttttttccgcagccccttatcttgcgacacctcctgcctctcccaactttctcgcagcaaaggctgcctgcggccttctttagtcccagaacactgttttccccactgcctctcccgaccgttttcgcacccgataggcttttggcccatccgctgcttgctctctctaactgcttgtccccaaggtccgctccaagagttaggcccccagtgtctcttcggctggtgtgtctttgcgctcaaccagctccatag

SEQ ID NO: 34469 - DNA, 1749 bp, Artificial Sequence
  Description of Artificial Sequence: Synthetic coding sequence
tgaccagggccaacctcatcagccaccaatgtttctatggtagtgtcagccggccctctgtctagcgaaaaagcagagatgaacatccttgagatcaatgagaagttgcacccccaactggctgagaagaaacagcagtttcgcaacttgaaggaacgctgcttcgtcacccagctagctggcttcctggcaaaccagcagaagaagtacaagtatgaggagtgtaaggacctgatcaagtcaatgctccgcaacgagcggcagttcaaggaggaaaaactggcagagcagctgaagcaggccgaagagctaagacagtacaaagtgctcgtgcacgcacaagaacgtgagttaacacagctccgagaaaagctgagggagggtcgagacgcctcccggagccttaatgagcatctacaggctttactgactcccgacgagcctgataaatcccaaggccaagatctccaggaacaactggccgagggctgccggctcgcccagcacttagtacagaagctgtcacccgaaaacgataatgacgacgacgaggatgtgcaggtggaattggcggaaaaggttcagaagtcttctgcaccccgggagatgcaaaaagctgaagagaaggaggtccctgaagactcccaagaagagtgtgctatcacttactctaattcccacggaccatacgatagcaaccagccacaccgaaagaccaagatcacctttgaagaggataaagtggattctacgttgattggcagcagtagtcatgtggagtgggaagacgcagttcacattattcctgaaaacgagagcgacgacgaggaggaggaagaaaagggaccagtgagcccaagaaatctccaagagagtgaggaggaggaggttcctcaggaatcttgggatgaaggatactcgaccttgagtatacccccagaaatgctcgccagttaccagtcatactcttccaccttccacagtcttgaagaacagcaggtgtgtatggcagtggacataggaagacatagatgggatcaagttaaaaaggaagatcaagaggcaaccggacccaggctgtcccgcgaactactcgatgagaaagggccggaggttctccaagactctctggatcgttgctattcgacgccttccggatgtctcgaactaactgatagttgccagccctaccgctccgctttttatgttctggaacagcaacgcgtgggtctcgccgttgacatggacgagatagaaaaataccaggaagtcgaggaggatcaggatccttcttgtcccaggctgtcgagagaactcctcgatgaaaaagagcccgaggttctacaggactcattggatagatgttactcaacaccttcaggatatctggaactgccagaccttgggcagccatattcatccgctgtgtactccttggaagaacagtatttgggtctggcattggacgtcgacagaaccaaaaaagaccaggaggaagaggaagatcaaggaccgccttgtccgaggctgagccgcgagctactggaggtggtggagcctgaagtcctgcaggactcccttgaccggtgctacagcaccccctcgtcatgtttggagcagcctgatagctgccagccatacggctcctctttctacgctttggaggagaagcacgtgggctttagcctggatgtcggcgagatcgaaaagaagggaaaaggcaagaaaaggagaggacggcgttcttag

SEQ ID NO: 34470 - DNA, 474 bp, Artificial Sequence
  Description of Artificial Sequence: Synthetic coding sequence
accctggctgaccatcgtcacaggggcacagactttggcggctccccatggctcctgatcatcactgtcttcctgcgctcctataagtttgctattagcttgtgtacatcctatctatgtgtctctttcctgaaaaccatcttccctagccagaatggacacgatggctctactgatgtccagcaacgagcacggagatccaaccggcgcaggcaagagggaatcaagatcgtgttagaggacattttcacactgtggaggcaggtggaaacaaaggtgcgggccaagatctgtaagatgaaggtgaccacgaaagtgaaccgccacgataagattaacggcaagcgcaagacggccaaagagcatttgcggaagctgtcaatgaaggagcgggagcatggggaaaaagagcgccaggtgtctgaggccgaagaaaacggaaaattagatatgaaagaaatccatacatactag

SEQ ID NO: 34471 - DNA, 516 bp, Artificial Sequence
  Description of Artificial Sequence: Synthetic coding sequence
atggctgaaatgagagcttggaggcccttggtgagaccctcacttcagtgcgttaagctcgggcgcgccactgccagatggtggtgggtggtgaaggtgaaaccccacgataaagatgccaaaatgaaatatcaggaatgcaataagatagtcaagcaaaaggctttcgaaagggcaatcgcaggggatgaacacaagagatcagtggtcgattctctggacattgagtcaatgaccatcgaaggcgaatatagtggccccaagctggaggatgataaagtcaccattacgtttatgaaagggcttatgcaatggtataaggaccagaaaaaacttcaccagaaatgtgcgtaccaggggttggccctgagcccacgattaaagtgtagcggcaccattacggctcattgtagtctgaatttgctgggtcccagagacccacccacatccgcatcccaagtggctgtgactgaaggcatgcaccatcacacatggcttatctttctatttctctag

SEQ ID NO: 34472 - DNA, 96 bp, Artificial Sequence
  Description of Artificial Sequence: Synthetic coding sequence
atgttggaggcaattctgggacccgtgagtaacagcctgtacgtatcaggaaaaacatgtcacggatccagaagcgtgttttcttctgccaagtag

SEQ ID NO: 34473 - DNA, 225 bp, Artificial Sequence
  Description of Artificial Sequence: Synthetic coding sequence
atgtcaaaggctcatcctccagaactgaagaagtttaccgataaaaagttctccctaaaactaaacggggggagacacgtccagggcatcctgcgaggattcgacccattcatgaacttagttatagacgaatgtgtagaaatggctacgagtggccaacagaaaaacatcggaatggtggagatcaggggcaacagcatcataatgctcgaagctctggaatag

SEQ ID NO: 34474 - DNA, 1893 bp, Artificial Sequence
  Description of Artificial Sequence: Synthetic coding sequence
atggatcccagctggcggcggtcctctcattcgtggccacagcctatgccagattcaggacgggcgcctgtacgcccccacctggctaagctagaagaggatgtgtggccttgccctcaattccaccaaaccaaggcggccagtgggccaccgttcgtgaacgaggccaactccaaatggttggacgcgcactacgaccccatggctaatatccacacattctccgcttgcttggcactcgcggatcttcacggagatggagagtacaagttggtggtgggtgatctagggcctggcggccagcagccccgactgaaagtcctgaaaggacctctggtcatgaccgaatcccctctgcccgcactgccagccgctgctgccactttcttgatggaacaacacgagccacgaacacctgcactcgcccttgcatctgggccctgcgtctatgtctacaagaaccttagaccctattttaagttcagcttacctcagctgcctcccaatcccttggaacaggatctctggaatcaagccaaggaggaccgcattgatcctctcacacttaaggagatgttagagtctatcagagagactgctgaagaaccattgagcatccagtcactgagatttttgcaactcgagctgagcgagatggaggcatttgtcaaccagcacaaatctaactccattaagaggcaaacagtgattacaaccatgactacactgaaaaagaatctcgctgatgaggacgcagtgtcgtgcttggttctcggcacagagaacaaagaacttctggttctggatccagaggccttcaccattttggccaagatgagtcttccttccgtccctgtgtttcttgaggtgagcggacagtttgacgtggaattccggctggctgccgcttgccggaatggcaacatatatattctgcgacgtgatagtaaacacccaaagtattgcatcgaactcagtgcccagcccgtcgggctcatcagagttcacaaagtcctggtggtggggtcaactcaagatagccttcacgggttcacccacaaaggcaagaaattgtggacagtccagatgcctgcagcgattctgacgatgaacttgctggagcaacactcacgtggccttcaggccgttatggctggcctggccaacggagaggttagaatctatcgcgacaaggccctcctgaatgtcatccatacccctgacgccgtcacatccctttgtttcggtcgctacggccgagaggataatacactgatcatgacaaccagaggggggggtcttatcatcaagatcctgaaacgaacagcggtgtttgtcgagggcggctccgaggttgggcctcccccagctcaggctatgaagctgaacgtcccaagaaagacccgtttatatgtggaccagacattgcgggaaagagaggccggaactgccatgcatagggcattccagactgatctataccttctaaggttgcgagcggccagggcttatcttcaagctctcgaaagtagcttatcccctctcagcaccactgcccgggaaccgctcaagttacatgctgtggtacagggcttgggcccaacatttaaactgaccttgcacctgcagaatactagtaccactagaccagtcctgggcctgttagtgtgcttcttatataacgaggccttatactctctgccgcgggccttcttcaaagtgccgctcctggtgcctggcctcaattatccccttgaaacattcgtggaaagtctgagcaacaagggtatcagcgatattatcaaagtgctggtgctaagagaaggacagtctgctccactgctctccgcacacgtgaacatgcccggctcagaaggccttgctgccgcttag

SEQ ID NO: 34475 - DNA, 474 bp, Artificial Sequence
  Description of Artificial Sequence: Synthetic coding sequence
atggttggccgaatgaaactgctcccgaatcggataaggactctggcactgaccgccattggcgtcgtactgctgggcgtagacgacccaggggcaccgagcgatcaggtcgaggtgcacctggaactggatctgcctacccagctgacctctgtatggcaggtgatgtctactgtgccattagcccccctacctgggcagctctcacttttggggcctccgggggctctggggtttccccagcaaggggggcctacccagttacccctgttgttaagggaggtaggagtggaacacaaggagcatattggtggtaggagatgcggtggcccgagacccgcactatctagctatcccggtcacctgctgctacagggccccagagtgctgcagccccttggggagaggccggggcatctgcaaaaccatgctgcccagggaaaaggcgacctggggcagtccgacagcgaatag

SEQ ID NO: 34476 - DNA, 738 bp, Artificial Sequence
  Description of Artificial Sequence: Synthetic coding sequence
aaagagggggaagaggaccagaaccctccctgccctagattatctagagagctccttgacgaaaaggaacctgaagtcctacaagactcactcgatcggtgttattccacaccaagtggctacctggaactgcccgatctgggccaaccatacagctccgcagtgtatagtttagaggaacaatatctcggtctcgccttggacgtggacagaaccaagaaggatcaggaagaagaggaggaccagggtcctccttgcccgcgactctccagggagttactggaagtggtggagcctgaagtactgcaagactcgcttgaccgttgttattcaaccccctcttcctgtttggagcagccagattcgtgtcagccgtacgggtcatccttctatgctctggaggaaaaacatgtcggattctccttggatgtcggtgagatcgagaagaaagggaaggggaagaaacggaggggtaggcgttctaagaaagagagacgcagaggcaggaaagagggagaggaggaccagaaccccccctgcccacgtctatctagggagctgcttgatgaaaaggggccagaggtacttcaggattctctggatcggagctactccactccctccggatgcctcgagctcactgatagctgtcaaccgtatagatccgccttctatgtgcttgagcagcagagagtcgggcttgctgtggatatggacggggagtatctgtccatgtag

SEQ ID NO: 34477 - DNA, 258 bp, Artificial Sequence
  Description of Artificial Sequence: Synthetic coding sequence
gagatgcaaaaggctgaagagaaagaggtccctgaggacagcttggaagagtgtgccataacttgctcaaattcccatggtccttacgatagcaaccagccacatagaaaaacgaaaattactttcgaagaagataaggtcgattccacgttaatcggcagcagcagccacgtggagtgggaggatgctgtgcatataatccctgagaatgagtcagacgatgaagaggaggaagagaaggggccagttagtccctag

SEQ ID NO: 34478 - DNA, 927 bp, Artificial Sequence
  Description of Artificial Sequence: Synthetic coding sequence
atgcacacccaggtgtgtgctcacacgtacatacgcatgcaccggcacttatgtactcacatgcagatccatccgcagcatcccatttgcgctacacaccgccacaggtacatggagaccgacgctcatacgggtctgtgtacccacattagaatgcacaggcatttatgtactcatatgcagatccacccacagcatccaatctgcgccacacatagacaccggtatatgaagactgacgcccacacagggctgtgcacgcatgtttgcatgcaccggcatttgtgtacacacatgcaaatgcatcctcagtatccaatttgcgcaacccacaggcatacgtatatggaaacagacgcccacactggcctgtgcacccacgttcatatgcacaggcatttatgtacacacatgcagatgcatcctcagtaccccatctgtgctatccaccggcatacttacatggagaccgatgcccacaccgggctgtgcacacacgtgcacatgcaccgccacctgtgcacccacatgcagatgcacccccagtaccccatatgcgccacgcatagacacacatatatggaaaccgatgtacacaccggtctttgtactcacgtgcacatgcaccggcatctgtgcactcatatgcagatgcatccacagtaccctatttgtgcaactcacagacacacctatatggaaacagatgcacacacaggcttgtgcacccatgtgcatatgcacagacacctctgtacacacatgcagatgcacccacaatacagaatttgcgctacgcagacgtacgtgcacggagaccggtgtacctatagatccatgcatacttgcactcacgctcaagctccagggcacacattgtacttattgatttgttctagccccccatgccgtctcttgggcaggtag

SEQ ID NO: 34479 - DNA, 300 bp, Artificial Sequence
  Description of Artificial Sequence: Synthetic coding sequence
atgtgggagcactggcttggggattctggagtgggactgcttatgcgattgaggagcgatgtaagccaggtgtgtttgcagctgaacgcctgcgtcgaggtggaggacccacttccgggatggttaacccactgcttgcctggacgcgctggctgctggtgggaggctagtgtccccttccacgggtgtttccagtactcgtgtggcatcccccccgagcaagttatgaaggagaataaagccgaggccgcagtattgtttacagcttccttccggtcccatgttccctccgacctttag

SEQ ID NO: 34480 - DNA, 315 bp, Artificial Sequence
  Description of Artificial Sequence: Synthetic coding sequence
atggctgcgctcatccctcaggggttctcctgcttaagtagagttctcggctggtggagcaggcagcctgtccttgtaacccaatccgccgccattgtgccggtgaggacaaagaaacgcttcacctcaccaatatatcagccaaagtttaaaaccgagaaggagtttatgcagcacgccaggaaagccggactggtgattccaccggaaaaatccgatagaagtatccacctcgcctgtaccgcaggtattttcgatgcctatgtaccccctgagggggacgcacggatcagctcgttatctaaagagcggtag

SEQ ID NO: 34481 - DNA, 366 bp, Artificial Sequence
  Description of Artificial Sequence: Synthetic coding sequence
atgtccctgacgtttcgtcgcccaaaaacactgcggctgcgcaggcagcctcgctatcccagaaaatccaccccaacgcgcaacaagctagggcattatgccataatcaagttccccctcgccacagagtctgctgtaaaaaagatcgaggagaataacactcttgtctttactgtggatgtaaaagctaataaacaccagatccgacaggccgtcaagaaggtgtatgacagcgatgtcgccaaagtgactacgcttatctgtccagacaaggaaaagaaagcatacgtacggctggctcctgattacgatgcattcgacgttgtgactaaactcggctcccctaagctttcgcctgccggctag

SEQ ID NO: 34482 - DNA, 1569 bp, Artificial Sequence
  Description of Artificial Sequence: Synthetic coding sequence
atgtggcctcagccaagactgcctccccatccagctatgagcgagaaaactcagcaagggaagcttgctgctgccaagaaaaagctcaaggcttattggcagcgtaaatccccgggaatccctgcaggcgccaatcgaaagaaaaaggtcaacggatctagtcccgacacagcaacttccgggggttatcacagccctggagattcagccaccggtatttacggagaaggcagggcttccagcacgacattgcaggacctggagtcgcaatatcaggaactcgctgtcgccctggactcctccagcgcaattatctcccagctgaccgaaaacatcaactcactcgtgcggacaagcaaggaagaaaaaaaacacgagatccacctcgtccagaaacttgggcgctccctctttaaactgaagaaccagacagcggaaccgctggcccctgaacccccggctggacctagcaaggtggaacagctgcaagatgaaaccaatcacttacggaaagagttggagtcagtaggccggcagttgcaggctgaagtggagaacaatcaaatgctgagcttgctgaataggaggcaggaggaacgactgcgagaacaagaagaaaggctccacgagcaggaggaacgactgcacgaacaggaggagagactgtgtgaacaagaagagcggctgagggagcaagaagagcgtctgagagaacaggaagaaagactaagagaacaggaagagcgattgcacgagcaggaggaacgactgcatgagcaggaggaacgcctttgcgagcaagaggagcggctgcgtgagcaagaggagcgtctgtgtgaacaggaggagagactgagggagcaagaggaacgactgtgtgaacaggaggaacgacttcgagaacaggaagagcgtctttgtgagcaggaagagcgcctgtgcgaacaagaggagcggttatgcgagcaagagaagttgccgggccaggagcggctgctagaggaggtcgagaaacttctggaacaggagcggcgccaagaggagcaagaaaggcttttggagcgggaacggctgctcgatgaggtggaggaattactggagcaggaaaggttgaggcaacaggatgaaagattgtggcagcaggagaccttgcgcgaactcgaacggctgcgcgagcttgagagactgcgtgagttagagagaatgctagagctgggatgggaagcactgtatgagcagagggctgaacctcgctcaggattcgaagaactgaacaatgagaataaatctacgcttcagctggagcaacaggtgaaagagctggagaaatccgggggagccgaggaaccccggggatccgagagcgccgccgcagctagaccagtgcccggagcccctgttccacagggcgcttggatgtgtgggcaggcagggtggacccctcaagaacacccaggactaagcggcgaggccgtcggaacaggggaagctgccggtggagcagaggaggcagcttgccacagctttcgtgcagccgaaaaccgggagttaaacataaccatcatttag

SEQ ID NO: 34483 - DNA, 783 bp, Artificial Sequence
  Description of Artificial Sequence: Synthetic coding sequence
atgctgagaaatgagctacagttcaaagaggagaagttggctgagcaacttaaacaggctgaagaacttcggcagtacaaagtcctggtccactcccaagaacgtgagttaactcagctcagggagaagctgcgtgaagggcgagacgcctcacgatcgctcaacgaacatctccaggccctgctgactccagatgaacctgacaagtctcagggacaggatttacaagagcagctggcagagggatgtcgcctcgcccagcacttggtgcagaagttgagccctgagaatgatgaggatgaggacgaggacgtgcaggtggaggaggacgagaaggtactggaaagtagctccccccgggagatgcaaaaagctgaggaaagcaaggtaccagaagactccttagaagaatgcgctatcacttgttctaactctcatggaccttgtgacagcaatcaacctcacaagaatattaagatcactttcgaggaggacaaagtgaacagttctcttgtggttgatagagaaagcagccatgatgaatgccaagatgccttgaacattctgcctgtgcctggcccaactagtagtgcaaccaatgttagcatggtagtgtctgctgggcctctctcatcagaaaaggccgagatgaatatcctcgagattaatgagaaacttcggccgcagttagctgagaaaaagcagcagtttagaagcctaaaagaaaagtgctttgtcacccaggtcgcctgctttctggccaagcagcaaaacaagtactag

SEQ ID NO: 34484 - DNA, 303 bp, Artificial Sequence
  Description of Artificial Sequence: Synthetic coding sequence
atggctaaaaataaattcagggggcagaagtcccggaatgtgtttcgcatcgcttcgcagaaatcctttaaggcgaaaaatagggtgaagcccatcaccgccaatctgaagaagattcatatcatgaatgacgaaaaagtcagtcgcgtaaacaaagctttcggtagtgtacaggaagagctcccgcactttagcaaaggactcagcttggacttgcttcagaaagagcttattccgcaacagaggcaccagtctaagcctgtcaatgtggatgaagccacaaagctgatggcacagctttag

SEQ ID NO: 34485 - DNA, 1659 bp, Artificial Sequence
  Description of Artificial Sequence: Synthetic coding sequence
atgttgaagagcagaatttcaatgcgctcccgccacccgagacgggccatctccgagggacataagtcagaaggcactatgcctccgaataaggaagctagtgggctttcctctagccccgcaggtcttatttgtttaccccccatcagtgaagagcttcagttggtctggactcaagcagcccagacgagcgagctagacagtaatgaacatctcctgaagactttttcatactttccttacccatcattagcagacatcgctttactgtgtctcaggtacggcctccagatggagaaagtcaagacctggttcatggcccagcgactgcggtgtggtataagctggtctagcgaggagatcgaagaaacacgcgctcgcgtggtctacaggcgcgaccagctccatttcaagagcctcctaagtttcacacatcacgcaggtaggccaccagaagaagtccctccccctcccgttccagcacccgagcaggttggaattggaatcgggccacctactttgtctaaacctacacagaccaagggcctgaaagtggaaccagaggaaccgtcccagatgcctccattgccccaaagccaccagaaactcaaagaaagcctcatgacccccgggagcggggcttttccataccagagcgatttttggcagcaccttcagtcaagcgggctctccaaagaacaggcgggtaggggtcccaaccagtcccacggaatcggtacagcaagctggaatcacagtacaacagtaccgcagccacaggccagggataaacccccacctatcgcactcatcgctagtagctgcaaggaagaatcagcaagctctgtgaccccctctagctcaagcacttcaagcagctttcaggtgttggccaatggagccacagccgcatctaagccgctgcagcctcttggatgtgtgcctcagtcggtgtccccatcagaacaagccttgcctccacatctggagcctgcttggcctcagggcttgcgtcataattctgtgccggggcgcgtaggcccaacagagtacctcagcccagacatgcagaggcagagaaagacaaaacgcaaaacaaaggaacaattagccattctgaagtcattcttcttgcagtgtcagtgggcgaggcgcgaagattatcagaagctagaacaaatcactggactgccgcggccggaaatcattcagtggttcggggacactcgctacgcgctgaagcacggccaactgaaatggtttagagataatgcagttccgggtgcacccagcttccaggatccagcaatcccaacgcctccacccagcacccggtcactgaacgagagagcggagacgcccccactacccattccacccccccctccagatatccagccactggagcgatactgggcagcccaccagcagttacgtgaaacagatatacctcaattgtcccaggccagccggttatcgacacaacaggtgttggattggtttgactcccgactgccccaacccgccgaagtggtggtgtgcctggatgaggaggaagaggaggaagaagaggagttgcctgaggacgacgaagaggaggaagaagaagaagaggaggacgatgatgatgacgacgatgacgtgattatccaggactag

SEQ ID NO: 34486 - DNA, 528 bp, Artificial Sequence
  Description of Artificial Sequence: Synthetic coding sequence
atgaaggtcaccactaaggttaaccggcacgacaagattaatggtaaaaggaaaactgccaaggaacacctgcgaaaactgtcaatgaaagagcgggagcacggggaaaaggaacgccaagtatccgaagccgaagaaaatggcaagctcgacatgaaggagatccacacctatatggagatgtttcagcgcgctcaggcgctgagacgccgggcagaagattactatcggtgcaaaatcactccttctgcaaggaagcccttatgtaatcgcgtatctctgctggtgttcctggcctttggacactcgctgccaggtcaggatatggatacattctttagtttacgcctctgtgcccaggcattgcaacgagagatggcggaacgcaaggcagcatacaagcaccactcaccgatccccgtgggcaatagagtcgctcagaagcatcttcatccgcacccggtgggaccccctagcaatattttatccgtgcgcggatcaatctttgtaatcgccaatggtccgtag

SEQ ID NO: 34487 - DNA, 228 bp, Artificial Sequence
  Description of Artificial Sequence: Synthetic coding sequence
atgagcaaactggtgtatctgtatatgctgcgggtatacataagcaatattaatagtaactcggtggtgtatatttttattagcatccctgttacacatagcctggataattggacatttctcgtcagtttcgagataggaaagtatgagagtagtaactttgtattgtttcacgactactctggttacgtaaggccactaagcatcccctacgagctcgaggggtag

SEQ ID NO: 34488 - DNA, 390 bp, Artificial Sequence
  Description of Artificial Sequence: Synthetic coding sequence
atgctgtgcccgtgtatccaggagtctacatttgagacttgcctgtttatggcagtgtcacgaatgagcaagtggagactctcgcgcgtaggaggttcccgcagcttgcctgccgagatggaggtgctcggagaggtgtggtgtgtgagggctgaggagcagcctatgacgggcctggggattgtctggcactctccattggacaaagcacttgagacatggtcactccaacagcaacctgacttttccttagggctcggtcacctcggtctcgggctctacattttagccagttatctcctctgccccagacagcctcctagtcagcctgatggtccctgcgggtcgcctaacccggtatccggggccaaaaaaacaacagtggcgtag

SEQ ID NO: 34489 - DNA, 288 bp, Artificial Sequence
  Description of Artificial Sequence: Synthetic coding sequence
ggcaggaaagagggcgaggaggatcagaacccaccctgccctcgcctgaacagcgttcttatggaagtggaggaaccagaggtgttacaggactccctggacagatgttatagtactccctccatgtattttgaactccccgattcttttcagcactacagatcggtgttctactcattcgaagagcagcacatcagttttgcactggacatggacaaccgctttttcacactcactgtaacttctctgcacctggtgttccagatgggcgttatttttccccaatag

SEQ ID NO: 34490 - DNA, 543 bp, Artificial Sequence
  Description of Artificial Sequence: Synthetic coding sequence
atgggccttggggctgtggagcaggaagctgctctggctggggaggcacccgcggcccaggtgcctacagagggggtcggaggttcgggcatggcaggatgtaggagtcgggcactgcccttgggaaaggccgcacgggctcccggcgagatagaacggtcagctggcgggagcgcattgttgggcgatcctgtccatcccccgcagcctctggcccgtgtgctcagcccatcgcttccgggcgcaggacgcgcctgtcggctcctgcgagtgagggccgccaaactaaccccgactcagaattccagttggcccgctagcgtggcctgctcccctggctcatgtagtcatcttagcctccatacgagcctgcaggctgagggtgcaggatctggactgggcaagcctagaaaaggacttcctcagtgtagtgggggcctaaaaggttcctcctcagcggcaaaagtcggggcccaggcagaagaggctcccagagcttccgaggggagcgaggattgtcagcatgccgtcacctcacactag

SEQ ID NO: 34491 - DNA, 390 bp, Artificial Sequence
  Description of Artificial Sequence: Synthetic coding sequence
atgctttgcccctgtatccaggagtctacatttgaaacctgtttattcatggctgtgtctagaatgtccaagtggcgactgagccgggtgggcgggagcagatccctgcctgcagagatggaggttttgggggaggtgtggtgtgttcgcgccgaggaacagcctatgaccggccttggaattgtgtggcattctccgctcgacaaagccctagagacatggtcgctccagcaacagccagactttagcttagggctgggacacctgggtttgggcctctatatcctcgcatcctacctgctctgccctcggcagccaccttcccagcccgatggaccatgtggcagcccgaaccctgtcagcggtgcaaaaaaaaccacagttgcctag

SEQ ID NO: 34492 - DNA, 417 bp, Artificial Sequence
  Description of Artificial Sequence: Synthetic coding sequence
atgatttttccacagatctacttggactatttcaaaatgcggcaggactactgtcagtcgctgaatgtgtggtcctacttgccctggatcttttttagtttcggactcggttttatcaataaccttaatattatcagttatagaatcaccaaggaggaagtcaatctgattcacttaagattacagccgaagatccagtctaattcatccttttcccttagttgttttttttttatgttccttttactgattgcagcccgaatcctgcatcggatctccatagaaatgtacgagatcctctggtctctccacgtcaggattgcccagtacgtcaccattcaattccagagagaacctacattcgtcagattcaccgatcaaggagttgtcgaggaagtggaattgcagatcaggtag

SEQ ID NO: 34493 - DNA, 504 bp, Artificial Sequence
  Description of Artificial Sequence: Synthetic coding sequence
atggagcaggaacacatacctcactggatccagaccagcgctttttcaggggggctcggtcgctcatggtgtaaaatccggtgcatggcccgcgccggcttgcccgtgcatatggtgaacggagaccctgacacaggaagacctttattgaccgccccgggcgcaaagcaacctccaaggggatggcgtcggcaagctggaagttcttgcagccgggcaaggggtgtctggagaggcgcgttggcaagccggcagggcgcgcagcgggggtccaaggggccgggagtgagtcatcaaagttatggggtggaggggcttggctccagtgtgtgtcccgtgacatggcacctgcgcgctttgccaaggcagctctgcgatgcttcacatcagaccgcatgtataaagagtggggtgtgttcctctctcaagtggagaaggccagaggcactagaccggcgtagccatatactcgagggatcggtgctggggcaccgatgcccttag

SEQ ID NO: 34494 - DNA, 1158 bp, Artificial Sequence
  Description of Artificial Sequence: Synthetic coding sequence
atggcgtacctgggcccctacccgacatcaagacaacctccacagatgagactgctgcctcataacagtctgcacaggcacagctcaatcgtgacaatggcgtccctcgaccctgcccccgcctcccaacccagtctgcaggccttgaacttcctgaaaagtacttcccctggtcccgcccacgcctccctgcagcccctgcaggcccagcttcttcatctgggaggacccagcagaccatccctctgcctgccttctgcctcaaccgtccctacgagcgcctcccagcagatactgcacgcgcaacatttaccccactgtggcccccccaagccgtctagtcagcccttttctagtttttatacgccgtcctcccgtctgcctgtggctagctcaggcccatggggtagcttcttgaccaccgctttcccgggtccagtgtttcccttcagacggccactgagagcacagaacctgcttaagtcagcgtcacctgatccactcgctcctagtggccggtcgctccgggcacaactgttcttcctggtgggttcccccggaccaattccagcctcccagcagccactttggacccagtgtcttcccatatcctggcggccctggagtgcccacagtttcctgaagccatcctcaccaggaccggggcaggcctctcgctggcctctgcaagacgagctccttccaagtgacggaatatcgaggcctcagatggtgagcggacgttgggcacctccgcgccaaggatgggccagtcggcgtccccctcaggcacaggtagtgttgaagtcaggatctcctggtccagccagtcagcaggtaagtaagctgttttggctcaacagctgcccagcaccgaatagactctgccgccctcgcacattctctagccaagccctacgtgcccatctccttccacccggcgggctatatagctctagcactgggtggaggaccgcatccgcgggcccttccctcgccagccaaggccctctgcaggcacagctattacccccccggcgccccccaggcgcaaaatcactgccagcctctcagcaacccgcatgtggaccagctcccccaagcaggtggccggtcgatgctcaacttatgcctctggctccctgcccggaggcgtag

SEQ ID NO: 34495 - DNA, 423 bp, Artificial Sequence
  Description of Artificial Sequence: Synthetic coding sequence
atgggcgggcctgaaactaaaggcttagagggggacccacatatgcaccactttctcttgttcacagtatgctgggaaagtagccgcgctttgtgtcaaatgccacaagaagagaaccctccacagtgcaccgtgaaagatgacactgctctcctccccaatgatacccgcccttcctggtgcctctatatggttgacgcaggtagcgtgggcccatctgtactcggcctcgtgcggcgcgaatctactcaggagcaatctgcctccgagagatccagcgttgcaccgcctgccggagcgaaccgtgatagccaccgacctctggcagactggcccaccttaccaacttctttgcttacatcatctttggttttccagaaaggcgagacgaccatcaaggataagagaaaagggagatactag

SEQ ID NO: 34496 - DNA, 375 bp, Artificial Sequence
  Description of Artificial Sequence: Synthetic coding sequence
atgaccccaaacgaacaccccgcctttaagcatttgttcaacaaagctcatctcgcccccccactgatccacctgaccctgagtgggcattccacatgcttcagggagcatagggtcgggggcaaagtgacagaccagcaagaccctaaggctgaggagttcttcctggtgcagaataaaatgaaatctctgccttgtttattgttgtcaacccagacacgacaaccctccgacttttctatctttagtccacccttcttgcccttttacagtactaagcccccacttagtagttggcccgtgctgaacgaacttctcggcacccccccccgtcgagggggagggcgcgctgaaggactattaacaagtcagtag

SEQ ID NO: 34497 - DNA, 465 bp, Artificial Sequence
  Description of Artificial Sequence: Synthetic coding sequence
atggggttatggcagcagatcagcaattgcatgcctgacctggctctatgcagtgacatcaaattcttccttagatgtctagagcgctggttgaataggaatagctctgcactccagctgcccgcaagaagcacgcaaaaagaaataatcagtgctttcccaacaaaagtgccctctagtagtcattgggactggctagacagcgggtgcagccctcagaaggctagtagaagccgtgtgggctgctgtctcacaagagaagcacagggggtaagagagctgccccctttggcaaagggaagttgcgagggcctgtgccgcgaggagcgggggatccctgcccaaattttgtgtttcccccatggactttgcaaccctcaaacaagaaggttcccctgggtgcctgctccacccggaccttgggtgtcttcaaaaaaactggggagccacctgggcagacactag

SEQ ID NO: 34498 - DNA, 168 bp, Artificial Sequence
  Description of Artificial Sequence: Synthetic coding sequence
atggtccagtctgcctcagtgtccaaggcaggaaagggctcatcaagctcccacggcgtagccgccgccctgaaccaggatttggaccccgaccctaaatgccacgtgtttaatgtgtcttcacagcgctgtcaaatgggatccgctcagccgtgcctttgttgttag

SEQ ID NO: 34499 - DNA, 621 bp, Artificial Sequence
  Description of Artificial Sequence: Synthetic coding sequence
atgcaccacaataagcaggctacggaaaacgccaaagaggaggtaaggaggatccttggactccttgacgcctatctgaagacaaggacctttctcgttggtgagcgggtaactctggcagccgaacccaaggctaaagatccctttgcccacttgcccaagtccacttttgtgcttgatgagttcaaaaggaaatactccaatgaagacaccttgagcgtcgcacttccttacttttgggagcatttcgataaagacggctggagtctctggtacagcgaatataggttcccggaagagctgacccagacgttcatgtcttgcaatcttataaccggtatgttccagagacttgacaagttgaggaagaatgcgtttgcatctgtgatactgttcgggacaaataattcgtcttccattagcggcgtgtgggtgtttcgtgggcaggagctggcatttcccctttcacctgattggcaggtagactatgaatcctatacctggcggaagctcgacccgggacgcgaagagacccagacccttgtgcgggaatatttttcttgggagggtgcttttcaacacgtgggcaaggccttcaatcatggcaaaatcttcaagtag

SEQ ID NO: 34500 - DNA, 498 bp, Artificial Sequence
  Description of Artificial Sequence: Synthetic coding sequence
atgtcttgctcaaggtcaaggtctttggaagcctcatcttctcgtggcactctgcccgcgtcgtgggtccgcggcagccgttgcctgggctcatccttcgcagacgaaggacaggctccactacatgccgacaggccgcgcttctttggcactgtgttgacgagctttcccagcgagaagctggccgcaaaagctttgctctggggtgctcttaacttctttctaggcccaaattggtcagagagtgagttcccatggccatccttcttaccgatcttgggcgcaggtggcgcagtggatttccttcccagggacttgttcattatatttctgtgtagcgttctccctcgcccatcagcagtgccggccagtccaccttcaccattctctctgctgccacccttcccaaccctgcccctgagtcctttctccctgtcccgaatcctgggctgctctaatcaacgcgccgtaagtctatttttccctcattattgttag

SEQ ID NO: 34501 - DNA, 1158 bp, Artificial Sequence
  Description of Artificial Sequence: Synthetic coding sequence
atggcttatctgggcccataccctacctctcgccaacccccacaaatgcgtctgctgccacacaattccctccacagacactcctctattgtaactatggcctctctcgaccctgcccctgcatctcagcctagcctgcaggcacttaattttttgaaaagcaccagtccaggtccggcccatgcttcactgcaacctctgcaagctcagctcctacatctaggcggacccagccgacctagtttatgcctgccaagcgcttcgaccgtccctacgagtgcctcgcagcaaattctgcatgcccagcacctgccccactgcggtcctccgaagccttcgtctcagcctttttcttccttctatacacccagctctcgcctcccagtagcgagcagtggtccctgggggtcttttctaacaaccgccttccctggccctgtgttccccttcagaagaccactacgggcccagaatcttctgaagtccgcgagccctgatccattggcaccatccggcaggtctcttagggcacagctgttctttctggtgggatcaccaggtcccatacccgcatctcagcagcctctgtggacccagtgcctgcccatctcttggagaccctggtctgcacactccttcctgaaaccgagtagcccgggcccgggacaggccagtcggtggccactgcaggacgagcttctgccgagcgacggcattagcaggccccagatggtctctggaagatgggcgccacccagacagggctgggcctctcgccgcctcccacaagcccaggtcgtcctcaagtctggatctcccggcccagcaagtcaacaggtgtctaaactcttctggctgaactcatgtcctgcaccaaatagactgtgccgaccaagaactttctcgtcccaagctctacgcgcccacctcctgccacccggaggactgtactcttcttcaactggctggagaaccgcctccgccgggccggctctggcttcccagggccccctccaggcacagctactgcctcccaggcgcccacccggagccaaaagtctgccagcatcacagcaaccggcatgcgggcccgccccgccttctcgatggccagtggacgctcaactcatgcccctggccccgtgtccagaggcctag

SEQ ID NO: 34502 - DNA, 510 bp, Artificial Sequence
  Description of Artificial Sequence: Synthetic coding sequence
atggtgccacgggctccaccctgtgcctggctgaggccaggaagacgagcccaggctggcgaggggcctagagatccaggcaatgctgcatggaggactcgaaggacaggattccccgaggccaccgggcccgccagacatcttcagctactctacgtggactttggtcgctggacccacggacggcctgttcctctgtgccgcgccggttggagaccccagtgtcctggagcagcggcagccctagggctggctgggctgggggatcacatatggcctcccggacgtactgtgccgcaggacccaccagcctgggcaccccccagttcgctggcacattcactcggcgcgcctgtgggtgccggggctgcgggctgtccctgtgggccagccattcaccgccccgctcatgcggcatcgccgtcaacatgcctgcccactcctccccagccgcccacctcccacctggaggaaacaatggggcccgctcctcctgcacctggctgttag

SEQ ID NO: 34503 - DNA, 783 bp, Artificial Sequence
  Description of Artificial Sequence: Synthetic coding sequence
atgggagataacctctggctagggctgagggctcaggacccatggcgggccttgcgcccagcccaatctcccagagcgtgcagacctcatgctgattgtggcgaccagggattcagaagaaaagcgcagacaccacagctaaatccacctaccgatcacaaggtgcccgaacagcgagacgaaggcgcagttcacttgctgagtcggccaggtcgggccagaccccagataagaagagctccagccccacacaattcacggactactacggccggaggcctaccatcgatcaggcctggccgccccgagccccctcctgctttaagcgatcatctgggcgctggattaagcgtgttgagccaagacggggccgtgagaattccaccacagggcctgcccgatctgcttgagctccggagagacgccccaactctcgagtctcgaccggcggcagcggcacttagccttctgtttcaggcagcttcgagcgccgccaggagggccatgtcacctgcacaggagacctatagttctagtcctcacccccttcgcaggctcgacaggtttagaccgttagaggccacatggggcgggcctcattggaagccgctgccggggattcactcggtaccaaaggcctattctaccgaaaacagcaggtccgggcgctgcaaaccaggtctcgtgggcgcctgtcgtgccagccccactcctgataccccacctggagtcggggctgagcagagctctggacaacccctgacaactcgatgcaggacttag

SEQ ID NO: 34504 - DNA, 1224 bp, Artificial Sequence
  Description of Artificial Sequence: Synthetic coding sequence
atgtataatgccttttggaaccatctgaaagaacaactgttgtctactccaccagactttacatgtgctcttgaacttctgaaggacgtgaaggagaaccgcctgaggaatgagattgaggaggccctggataccgacctgcttaaacaagaggccgaacacggggctctggatgtgcctcatctgtccaactacattcttaatctgatggcgttgctgtgcgctcccgtgcgggacgaggctatccagaagcttgagacaattcgtgatccagtgcagctgctgagaggaatcctgcgggtcctgggtctgatgaaaatggatatggtgaattatacgattcagtccttcaggccctatctgcaagagcatagcatacagtacgaacaagccaagttccaggaactgctagataaacaaccttcacttctggactacaccaccaagtggctaacaaaggcggcgacagacatcacaacactgtgtccttcatcccccgactccccttcaagcagttgcagcatggcctgcagtttgccgtctggcgccggaaacaacagtgagccaccctctcctactatggttttgtatcaagggtacctgaacctcctgctttgggacctggagaacgttgaatttcctgaaaccttgttaatggacagaatacgactgcaggagctggcttttcagcttcaccagctgaccgtcctcgcttcagtgctgctagtggcaagaagctttagcggagaggttctttttcggtccccagaatttgtggatcgactgaagtgtaccacaaaagccctgaccgaggagttcatcagccgccccgaagaaaccatgctaagtgtatctgagcaagtgtcacaggaagtgcatcagggactcaaggacatgggtctgacaacactctcctcggagaacacggcctcccttctcggccagctgcagaacattactaaaaaagaaaactgcatccggtcaatcgtcgaccaatggatccgattttttctgaaatgttgtctactacacggtatgcaggaatcactgcttcactttccaggtggccttatactgattgaaaaggagcttgccgagctgggctggaagtttctaaatcttatgcatcacaatcagcaggtctttgggccttactatgccgagatcctcaaacatattatccacccagcccaggcacaggaaacagatgtcgagcctaactag

SEQ ID NO: 34505 - DNA, 390 bp, Artificial Sequence
  Description of Artificial Sequence: Synthetic coding sequence
atgtgttgcaattattacgggaacagctgcggatatggatcaagttatgggtgcggttatggcagtggctacgggtacgggtacggctcttcctacggctgtggatatggtacaggttacagctgcggatatgggtgtggttatgggtctggctacggttgtgggtatgggagctcatacgggtgtggttacgggacgggatactcatgcggttacggcagcggctatagctgcggatacggcagtggttcgggttgcggctacggtactgggtttggatgtggatatggatgtggctatggaactgggtacggctgcggctgtggctccggcagcggttactgtgggtatcgcccgttttgcttccgaaggtgctacagctcttgttag

SEQ ID NO: 34506 - DNA, 144 bp, Artificial Sequence
  Description of Artificial Sequence: Synthetic coding sequence
atggcactcccacaggggctccttaccttccgagacgtggcaatcgagttcagtcaggaggaatggaaatgcctggatcctgcacagaggacgctctatcgcgatgtgatgcttgagaactacaggaatcttgtttctctatag

SEQ ID NO: 34507 - DNA, 1170 bp, Artificial Sequence
  Description of Artificial Sequence: Synthetic coding sequence
atgctgctcccaccaggctcgttaagccgaccccgcaccttctcctctcagccgttgcagactaaactgatgactcataatgggctgttcagaccaattccttatgtaacagccgcaagcgctgatgaggctaccgcctcccaacagcccccacaagcccaacttcacagatataacgggctgttccggccctcaagctgcctgcctgctttctcgccagggcctgagctctctcaggtcgacctaactcggcctagctcttgcttcttcgccgcctctcctggccctgctccagccagctggtggcccctgcaagcacagccactgccacctgtgagcttgtactcaccaaacgtgtgtctaaccgctgacagctcccgcccagctagtacttcgctttggaccccccaggcaaaactgccaacttttcagcagctcctccatacccaactacttcccccttctggattattccggccttcttcctgttttactcgagcgttccctggtcctactttcgtgagctggcagccctccctggctcggttcctacctgtttctcagcagccaaggcaggcgcaggtactcccacacaccgggctgtctactagctcactgtgcctcactgtggcctcccctgggcctacacccgtgcctggacggcacctccgcgctcagaacctgttgaaactggatagcttagtgccaaccgcagcatcctggtggcctatgaaggcacagaacctgctgaagcttacatgcccgggacccgctccagctagctgccagagacttcaagctcagcccctgccccacggaggttttagccggccgacaagcagcagttggctgggtctgcaagctcagctgctcccacacaacagcctgttctggccttcgtcgtgccctgctcacggaggccagtgcagacccaagactagcagtagccaaacattacaagcccatctgctgttacccggcggaattaacaggccttccttcgacctgaggacagccagcgctggtcccgccctggcctctcagggcctgttcccaggaccagcactggcatcctggcagctgccacaagcgaaattcctgcccgcttgtcagcagccacagcaagcacagctcctaccccactcagggccttttagacctaattcatag

SEQ ID NO: 34508 - DNA, 780 bp, Artificial Sequence
  Description of Artificial Sequence: Synthetic coding sequence
acatccttgtggactccgcaagcgaaactgccaacatttcagcagctgctgcacacccagttactgccccccagtggactcttccgcccctccagctgctttaccagggctttccctggtcccacctttgtatcttggcagccctccctggcacggttcctcccagtatcccagcaacctagacaagcccaagtactgcctcatacaggactgtcaacttcttcactgtgtctcaccgtggcgtcccctgggcccaccccagttcccggtcggcacctgagagcccagaatcttttgaagttggattctttagtccccacggctgcctcttggtggcctatgaaagcacaaaacctgctgaaactcacgtgccccggacctgcccccgcgagttgtcagcggttgcaggcacagcctctcccccatgggggcttctctcgcccgacatcctcttcttggctgggtctccaggcccagttgctcccccacaattcactgttctggccgagtagctgccccgcacacggtggccagtgcagacccaaaacatcctctagccaaacgctccaggctcatcttctgctgccaggaggaattaatcgcccatctttcgatctcaggactgctagcgccgggcctgccttagctagtcagggcctgtttcctgggccagcgcttgcgagctggcagctaccacaggctaagttcctgccggcctgtcagcagcctcagcaagctcagttactgccgcatagcggcccattccgcccaaacagctag

SEQ ID NO: 34509 - DNA, 1791 bp, Artificial Sequence
  Description of Artificial Sequence: Synthetic coding sequence
atgaaaatgcaaaagggaaacgtgctcctgatgttcggtctgttactgcacctcgaggccgcaaccaattcgaacgaaacatctacttcagccaataccggtagtagcgtcatcagcagtggagcctctacagcaacaaactcagggagttccgtcacttcttccggggtgtccactgctacaattagcggctctagtgtcaccagtaacggtgtctctatagtaactaattcggaattccataccacttcaagcggcatttctacagcaaccaactctgaattcagtacggcgtcctccggcatctcgattgctaccaattcagagagcagtacaacaagcagtggggcctccaccgctacaaatagcgagagtagcacaccatccagcggtgcttctactgtgaccaattctggcagttcagtaaccagtagcggcgcctccactgcgactaatagcgaaagctcaacagtatcaagccgtgccagtaccgcgaccaactccgaaagtagcacactgtcctccggcgctagcaccgccactaactctgactcctccaccacatcttccggcgcgagtactgccaccaattctgaaagcagcaccactagttccggggccagcaccgcaacaaattcagagagctctacagtcagttcccgagcctccacagccaccaacagtgagtcctctactacttcctccggagcgagcacagccacaaactccgagtctcggactacgtctaacggggccggcaccgccaccaattctgagtcatcaacaacatcctctggagccagcacagcaacgaatagcgacagtagcacagtttcatcaggggcttccaccgccacaaattccgagagtagcacgacgagtagcggagcttctaccgctaccaattctgagtcctccacgacttccagcggtgctagcaccgccactaatagtgactcctctaccacctcctcgggcgctggaaccgccacgaacagtgaatccagtactgtctccagcggcatttctaccgtcacgaattccgaatccagcacaccttcttccggggcaaacaccgcgacgaactctgagagtagcaccacgtcctcgggagctaatactgcaactaacagtgaaagcagcacagtctcaagtggcgctagtacggccactaattcagagtctagcaccacctcatctggcgtgtctacggctacgaattccgagtcctctacaacctcttccggagcgtctacggcaacaaattctgactcaagtaccacatctagcgaggcctcaactgccacaaacagcgagtcctccacagtctcatccggaatttctacagtgacgaactctgaaagttctaccaccagttccggtgccaacactgctaccaatagcgggtctagtgtgacatccgccggatctggcacggccgccctcaccggaatgcatactacatcgcattccgccagcacagcggtgtccgaggccaagcctggtggctctcttgtgccctgggaaatcttcctcataacattagtgtctgtggtggctgcagtaggcctcttcgctggtcttttcttttgcgtccgaaacagcctctccttacggaatacctttaacacagcggtttatcaccctcacggcctcaaccacggcttgggacccggccccgggggtaatcacggggcccctcataggccccggtggtctccgaactggttttggagaagaccagtttctagcatcgccatggagatgtcgggtcgcaactcaggcccatag

SEQ ID NO: 34510 - DNA, 1434 bp, Artificial Sequence
  Description of Artificial Sequence: Synthetic coding sequence
atgctgttctcctgggtgaaaaggcagagaaagagccagtattcctgcaagggttcggaactgcgtcatgccaggtcttccgttatcaaaagaaagaccgcagacaaaaacctgctggcagaactctaccagtactccaatttcaactcaagcaaacccaataagctgccaaacggtgtagatttctgcgacatggtagggaacgtggtgagggcagagcgggactgcctctccggcaagcatttttgctcaggtcgagaactggagaaatttttgagctcgagctctccccgagctatctggcttgattccttctggtggatcttccacgagcgttaccagccaaataaggagctccaaaacaaccttttcgatagaattgcacagcattatgccctccttctgtttcgggtgcctaagtcacactcagaggaggcgttattgaaaagactgccaagcttgttgtccaaagctgtgtatacctcattctgctgttgcttcccccagagttggttcgacactcacgagtttaaaagcgatatctgtaacacaatgtcactatggatctcgggaacttaccctagcccacaaagctatgattcttgggactattccgagctcgacccagagaggtttcggagagaagagcttatgctgtaccgcaggcgtcttaccaagggccgtgagttttccttgttcgctgggaagagggccttctcccagaagcccgctcaatcccgcaagttctaccacccccaatccagttccgctaactctcctagcgaaaaaacctccagcgccaaacagaactctgagaagtccctgagaatgcagaataccgccaaggagcaccactgtcagaccctggtgctgaagaaaccaacacaggaggtgaagcgcatatccgaagctagagagtgcgagaacatgtttcctaaaaagagctgcgcagcttgtaaaagtcccgaattgacttccaacctcttcaacatctacggaaaatctccactgatcgtgtatttcttacagaattatgctagtttacagcagcacggaaaaaatgttctgattgtgcggagagaaaaaaccacatccgccacagactgtactcccacttacactgacgtcattagtgagacgctctgctcaatgaaaaagaggaaggacaacttgaatcagttatatcaacatcattggacagagtggaattactttgacaaacatctcaaggaactgcaagataacttttcaagggaaatgaagaacattgaccccaaggcagctgacacgaagaaagctaatcatatgttcatcccaccatctgccgtgaacgaggaaagtcccgacaaaaaaactaaagagggcaaaggtggagaaggaaaaaggcgcgaaacagaagtcgagcattttttccctcttacctcgaagccgtag

SEQ ID NO: 34511 - DNA, 546 bp, Artificial Sequence
  Description of Artificial Sequence: Synthetic coding sequence
atgtccgaattgccttttacgattgcaagcaagcgtattaaatacttgcggattcagttaacccgagacgtgaaggatctgttcaagaagaattacaaacccctgttaaatgaaataaaggaagacaccaacaaatggaagaacatcccgtgctcctggattgggcgaattaatattatgaaaatggctatcctgcccaaagtgatttacagatttaacgcaatacccattaagctgccaatgacattcttcactaagctggagaagacaacacttaagtttatctggaatcaaaagcgggccctcattgccaaaactattatctctaagaaaaacaaagctggaggtatcactctgcctgactttaagttatgctacaaggccacggtaacgaagaccgcttgctgttggtacctgaatagggacatcgaccagtggaataggaccgaagtgagtgaaattacaattcacatatataaccaccttatctttgataaaccagataaaaataagcagtggggtaaggactctctgtttaacaagtag

SEQ ID NO: 34512 - DNA, 1737 bp, Artificial Sequence
  Description of Artificial Sequence: Synthetic coding sequence
atggccgaagaaactcaacacaataagctggccgcggcaaagaagaaactgaaggaatattggcagaaaaattctccccgggtacctgcaggcgcaaatagaaaccggaagaccaacggatccattcccgagaaagccacctctggaggatgtcagccaccaagggactctgccacaggtttccacagagagggaccaacaagttccgccacactcaaggacctggagagcccgtgccaagaaagagctgttgtgctggattcccgctccgttgaaatttcacaactcaaaaatactattaagagtcttaaacagcagaaaaagcaggtcgaacaccagttagaggaggagaaaaaagccaataacaagaagcagaaagcaaaaagggtgttggaagtgcaaattcagactttgaacatccaaaaagaggagcttaacacagatctttaccacatgaaaaggtcactccggtacttcgaagaaaaatcaaaagatttagctgtgagattgcagcacagtctgcagaggaaaggtgaattggaatcagtcctcagcaatgtaatggccacccaaaagaagaaagccaaccagctgaaagagagctttcaacaagtgcaactggagcgcgacgagtactctgagcatctcaagggagaacgcgcaaggtggcagcagcggatgcggaagatgtctcaggaaatttgcacccttaaaaaggagaagcagcaggatatgcgtagggtagaaaaattggagaggtcactgtccaagctgaagaaccagatggcagaacccctgccacctgaacctccggcagtgccctctgaggttgagttacaacacttaagaaaggaattagagcgggtcgctggcgagctccaggctcaagtaaaaaagaatcagagaatttctcttctgaaccagaggcaagaagagcgaatccaggaacaggaggaacgtttacgtaaacaggaagaaagaattcaggaacagcacaaaagcctgcagcagctagccaagccccaatcggtgtttgaggagccagaacacctggaggctgccagccaacagaaccaacagctgacggcacagctgtccctgatggctctgcctggggaggggcacggagagcatctcgattctgagggcgaagaggcaccacagccgatgcctagcgtccccgaggacttagagtcccgcgaagctatgtcctcctttatggaccatcttaaggagaaagccgatttaagcgagttggtgaaaaaagaactgtgttttattcaccactggagagatcgcagacatcaaaagactcaccacctgctcagtgagcctgggggttgtgccaaggacgccgctctgggaggcggacatcaccaggccggcgcacagggtggcgacgagggcgaggcagcaggtgctgccgctgacggtatcgcagcctattccaactataacaatggacaccgaaagtttttagcggctgcacataaccctgctgacgaacctggaccgggcgctcccgcccctcaggaattaggggcggccgataagcatggcgatctgagagaggtgtcactgactagcagcgcccaaggagaagcacgggaagatccactgctcgataagcccactgcccaacccatcgtccaagaccacaaggaacaccctggtctcggttcaaattgttgtgttcctttgttctgctgggcctggctgccccgcagaagacgttag

SEQ ID NO: 34513 - DNA, 1824 bp, Artificial Sequence
  Description of Artificial Sequence: Synthetic coding sequence
atggccgaagagacccaacacaataaactcgccgccgccaaaaaaaaactgaaagagtactggcagaaaaatagcccacgggtcccggctggtgccaacagaaataggaagaccaacgggtctattccagaaaaggccaccagcggaggttgccagccacctcgggattccgctactgggttccatagggaggggcccacttcgtcggccaccttgaaggatctggagagtccttgtcaagagagagcagtagtgttagattcaagatcagtggagatctcacagctgaagaacactatcaagagcctgaagcagcagaagaagcaggtagagcaccagttggaagaagaaaagaaagccaacaacaaaaagcagaaggctaaaagggtgctcgaagttcagattcaaactctgaatatacagaaggaggagctgaacaccgatttgtatcatatgaaaagatcattgaggtacttcgaggagaaatccaaggacctggccgtcagacttcagcattccttgcagcggaagggcgagcttgaaagtgttttgagtaacgtcatggccacgcagaaaaaaaaagctaaccagctctcaagcaggtctaaagccaggacggagtggaagctggaacagagtatgcgagaggaggctctcctcaaggtccagctgacgcagctcaaagaaagctttcagcaggtgcagcttgagcgtgatgaatatagcgaacacctgaaaggcgagagagcgaggtggcaacagaggatgcgaaagatgagccaggagatctgcaccctcaaaaaggagaaacagcaggatatgcgccgggtagaaaagcttgagagaagtttatccaaactgaaaaaccagatggctgaaccactgccaccagagccaccagccgtaccatctgaggtggaactccagcacctccgtaaggagctagagcgggtggccggcgagctgcaagcgcaggtaaaaaaaaaccagaggatcagtctgctcaaccagaggcaggaagagaggatccaagagcaagaggagagacttaggaagcaagaagagaggatccaggagcaacacaaaagcctccagcagctggcaaaaccacagagcgtgttcgaggaacccgagcacctcgaggctgcgtcccaacagaaccagcaattgacagcccagcttagtttgatggccctacctggggaaggccacggcgagcacctggactccgagggcgaagaggcccctcagcccatgcccagtgtcccagaggacctggaaagtagggaagccatgtcaagcttcatggaccacttaaaggagaaggccgacttgagcgagctagtgaaaaaagaactgtgctttattcaccattggagagaccggaggcaccagaagacccaccatttactttccgaacctgggggatgtgctaaggatgctgcgcttggtggcgggcatcatcaagctggagctcaggggggcgatgaaggagaggccgcgggagccgccgctgatggcatcgccgcctactctaactataataatggtcacagaaagttcctcgccgcggcgcacaacccagccgacgaacctgggccaggagcccccgcaccacaggagctgggagcagcagacaaacatggtgacctgagagaggtcagtctcactagcagtgctcagggcgaagcgcgcgaagaccccctgctagataagcctacggcccaacctatcgttcaagaccacaaggagcatcccggcctggggtcaaactgctgtgtgccactcttttgctgggcctggctaccaaggagaagacgttag

SEQ ID NO: 34514 - DNA, 258 bp, Artificial Sequence
  Description of Artificial Sequence: Synthetic coding sequence
atgattcagcaggaggagatccgcaagcttgaagaggagaaaaagcagctggaaggcgaaataattgatttctataaaatgaaggccgcttcagaagccctccagacccagctcagcactgataccaaaaaagacaagcacccggatccttacgaatttcttttactgcggaagatcaaacatcccggcttcaacgaagaactcacaattacactcctgatcattcaaaagcacgtcgccggcctttcacatttctag

SEQ ID NO: 34515 - DNA, 1713 bp, Artificial Sequence
  Description of Artificial Sequence: Synthetic coding sequence
atgaatcactttcgcaagatggaagtgataaatcttactacccttccaatgattccggtggatgagcacctggctgtttcactcgtcgccagaaatacaatggtaaaaacggtgcgcaaggagcttgagaataaccccccatcctgcctgatcggctcgatgcatcaggtgaatcagaaaatagctgacataaacctccggactgagccttctgcaaactctctggccatcgaacggtttgagctagagaagaaggcactaagggagaagactcgctcgtctccagaagataaggtgaagaggcagaggaaatcacagtactcgtgcaaagggagtgagctgcgccatgcccggtcctctgtcataaaaagaaaaactgcggataaaaaccttctggctgagctctatcagtattccaactttaattccagcaagccgaataagctgcccaatggtgtggacttctgtgacatggttgggaatgtggtgcgtgctgagcgcgattgcttgtcagggaagcatttctgtagcggccgagagctggaaaagttcctgtcaagcagctcccccagggccatctggttggactccttctggtggatatttcatgaaaggtatcagccgaataaggaactgcagaataacttattcgataggatcgctcagcactacgctctcttgttgttcagagtcccaaagtctcactctgaagaagcgttgctgaaaaggctccctagtctgctgagtaaggccgtgtacacaagtttctgttgctgctttccacaatcgtggtttgacacacatgagtttaaaagtgatatttgcaatacaatgtcgctctggattagcggtacgtacccgtctccacagtcctacgatagttgggattacagcgagctcgatcccgagcggtttcggcgagaagaacttatgctgtacaggaggagattaaccaaggggcgcgagttcagtctcttcgccgggaaacgagccttcagccagaaaccagcccagtccagaaagttttatcatccccaatcgagtagcgctaactcacccagcgaaaagacatctagtgcaaagcagaattcagagaaaagtctccgaatgcagaacaccgctaaagagcaccactgccagactctggtactgaaaaaacccacgcaagaagtcaagagaattagtgaagcaagggagtgcgagaatatgtttcccaaaaaaagctgtgcagcctgtaagtcacctgagctgacatccaatctcttcaatatttacgggaaaagcccacttatcgtatacttcctgcaaaactacgcatccctccagcaacatggcaaaaacgtgctgatcgtgaggagggagaagacgacctctacccccgactgtactcctacatacaccgatgtgatttcagagactctgtgttccatgaagaaacgtaaggacaatctgaatcagttataccaacaccactggaccgagtggaactacttcgacaagcatcttaaggagctgcaggataatttttctcgcgaaatgaaaaatattgaccccaaagcagcggatactaaaaaggctaatcatatgttcattcctccctcagccgttaatgaggaatctccagataagaagaccaaggaaggcaaaggaggcgagggaaaacgcagggaaaccgaagttgagcacttcttccccttgacctccaagccttag

SEQ ID NO: 34516 - DNA, 366 bp, Artificial Sequence
  Description of Artificial Sequence: Synthetic coding sequence
atgaccggggtttgcgaccatgctcagctcattttcgtatttttcgtggagatggagtttcggtatgtggtcccaggatggagccagacccccgagctccgccaatcggcccacctgcgcctgcagaaatgctgggactatcggccagaaccattgtgtccctccccatggttgattgattcccacctccttccagagagcttacaggggcatccgtttgtgtgtgtatgcgtcctgattagtccctataagaatacatgtcacactcgtctagggccaacactccttacgtctttctatctcaatcacctgtataaggatcctatttcaaagtactcaactatacttcgatcatgtaatatatag

SEQ ID NO: 34517 - DNA, 474 bp, Artificial Sequence
  Description of Artificial Sequence: Synthetic coding sequence
atggctccacaggctcagcccctgccactactgggaaagtgtaaggcgtccaacgctccaactcccagacctccacggaggcccacttggaagagaaagtccggcaaggtttctactaccgtaccgcagccccagaccgtgcccggcagttggccaagagagcgagagcgaaaacgggagcgggatcgcattaacagcctgctgctgcagattatagggcactctaagcaagcccttcctggacccggagagccggcccagcggttaacaccggccccagcagatccaggtggcagaggagaacaaggcggcgtagccgcccagggcgcaggcctcgctgcaggcaggaggagtgccgtgggaccatcaaaactctgtaatctcgttagcgcgtcgggcgcactggccgttttctccattacggggatgtgtcctggcagggatgtgtccgacgggctgagaatggggcagtag

SEQ ID NO: 34518 - DNA, 507 bp, Artificial Sequence
  Description of Artificial Sequence: Synthetic coding sequence
atgaaagggaacacaaactcagccgttaccccggctcctaaatgccactggctggaagatctcccgcccgtacgcagacagcataggtgggtgctgagcccgctgaggccggcagccctgaggaggctacagctattgagcgccgaccggaggccgcttagaagaacaggagcacccccagctcagggccccgcccagcacccttggtccagaggtccccctcgccgacctccccgctccgttaagctgtgccgggcacagcagtggccggagacccgagctgatccactgccggctggtactcgccagggagagtcccccctccccagagggagacgccctgatctggggcagggccgcccatctgccaggcgcctgcccagcgggccctggacccatagaacccgaacacgcgtgagaggttccctgcgagctgccgcacgctcgcagaatgcgaggcgcggtagtcccgcccgacaggctgcgaagccgaaattggaggcctag

SEQ ID NO: 34519 - DNA, 807 bp, Artificial Sequence
  Description of Artificial Sequence: Synthetic coding sequence
atgcgtcgtgcccctgactgggtacaaagacaggccgctcctggctctaaatgcagagtgccatggcaacgccgggaattcccctcacgtggtggcaggaaacaaccccaacccggcagccggcagagaaagcaaaatcctatctctctcccaggggagcagaacggccgtaaggcgacccctcaggcgggtgccctgggtgccctgggcatccggggcatcccttccctctgtcagagtgaaggaacccgctggagccgtcgaggtcgccggtgggctgagaggtgccctcccggcgtactcggtgccggtcgaagcttgcgggcacagagatcaaggttgcattcgcgccctccccccctgagtccactgagaaagcccggaggatccaaccagcctcgaagcgcggccgctgctggcacccacgaggcttgcctgcaggccagtggaacaactcggggttggaagtatcacgcgctgcccctgagactggatccacgaagcggtcacgccgggagtgccctgaaggccggctcctgtccgaggctgggagggggcggtaggggtcgtggtgaggctggagctccctctcgtttctggctccctcgctcactgcaacagctgctgccaaatgagcctaggaacgctgacgtccagacattgcacccaactccatcccacacacggcgaggacagagaaccggcaaaggagccagaggaccaaggttttggaagtccaaaaatagtcctgctaataggcaatcctccgccctggacttctggatcactaccagcattagcttttag

SEQ ID NO: 34520 - DNA, 327 bp, Artificial Sequence
  Description of Artificial Sequence: Synthetic coding sequence
atgctgcttacttctcagaccgttttcttctttttctttttctttctccgccagtctttaaccttgctgtcgtctctcgaatgcaatggcactatcagcgcccattgtattctcagacttctgggctcgagcaagagtcccgctagtgcctcgctagtcgccggcgtcactggcatgcatcaccatgctagactcatctttgtttttctcgtagaaatgggattccatcacgtcgggcaagccgggctggagctgctcaccagtgggaacccacctgctttggcgagtcagagggcagagatcaccggagcgtcataccgggcttag

SEQ ID NO: 34521 - DNA, 324 bp, Artificial Sequence
  Description of Artificial Sequence: Synthetic coding sequence
atgaggccaaagaccctgaggaattccgccgcgagaagccgcaaagaacccggcttcctgaatcaccatatggagggatcttgcctgcagctcggggagcttagtagtgtcggatattggtggccctttggccaccctggtcccgctcagggccaccttcccgtggctgtatgggcctcctgggtggtggctggcataagcatcgctctgtatttacccccacacccagaggggcgctatgagggaccctttaaaaggcataccaagaccttccgcagcgcacagtgcgcagactgtctcgtgcaatgcccagcttcgccttag

SEQ ID NO: 34522 - DNA, 465 bp, Artificial Sequence
  Description of Artificial Sequence: Synthetic coding sequence
atgcgtgacatggagagggcaggggtgactcgcgtgcgacagtctttgaagacatgggtggagcatgggcctttttccggcgaccccggactccctcgcagcgtgcgtgttgagctgctgactctggtggcgggccctgcccgtggccggagcggccatcgccagccacctccacagcctcaatcactgaggcggcctctctggctgtcgcatagcgacccttcactgaagttcagaactctggggctgcgcgaaggctcaggcgccgagtgcctgcctcctgggacattcctgccctttagttggtctttttccgcccccgagctggcacacctctctaacgcacgggccccttggatccctttgcccggcgcattccagatccagcaaaagcaaatctttttctttctagagagcaggaccaagtcgggtatgcgtagcaggggaggcaaagacagtaagtag

SEQ ID NO: 34523 - DNA, 723 bp, Artificial Sequence
  Description of Artificial Sequence: Synthetic coding sequence
atgaacaaacaaagaggcacattcagtgaagtttcactggcacaggaccctaaaagacagcagcggaaacccaaaggaaacaaaagttccattagcggtaccgagcaggagatcttccaggtagaattaaatctgcagaatccatcgctgaaccaccagggcatcgacaaaatttatgattgtcaaggcctgctgcccccccctgagaagttaactgccgaggtgctgggcattatttgtatcgtgctgatggcaaccgtcttaaaaacaatagtcctgattcctttcctggagcagaataattttagcccaaacacaagaactcagaaggcccgccactgtggtcactgccccgaagagtggatcacatacagcaactcttgctactacatcggaaaagagcgtcgcacctgggaggaaagtctgcaggcctgtgcaagcaaaaattccagttccctcctgtgcatcgacaatgaagaggagatgaaatttctagcctctattctaccaagcagctggatcggcgtcttccggaattcatcacaccacccttgggtcactatcaatggactcgccttcaaacacgaaatcaaagattcagatcatgccgagagaaattgcgcaatgcttcacgtgcgcggcctcatctccgaccagtgcggcagtagccgtatcatccgcaggggctttataatgctcacccggctagtcctcaattcttag

SEQ ID NO: 34524 - DNA, 732 bp, Artificial Sequence
  Description of Artificial Sequence: Synthetic coding sequence
atggaacggaggtggttgtcgttgcgtagttctagctgctccgcccctcgcctcaatacagcttggggtatgcgtagttcaccccaggcaacttccagctcctcgcgcaacgcggcttcttttctacggctgttcagagctactaggcgagccccgtctttgtgtcgcctatctctctgcaggtggcctgccacttcggtgacccttgcggggaccttccccgctctgttaaggcgcgataacaccctctcatgtttcagctcacggagactgagtcgggtggctgcacgggctagtagctggggaaagtccccctcacgctgttcgagctcaaaaccacggtcaccgaatacccagtccgggacaagccggtcctcgagtcatctcactcggattacattccgctggtccaggcgcaagacatgcaaagagaaaggctcacttgcaggcgaatggtccaagctgagttcctgcaagtgcacttcttgtgattcaccaggcgggaaggtcatctcccagatggcctcaagcttgtctgactccacttcattgtcctcgaaaacagtgagcgggcgacccggctcaatgcaacgggcgagttcctcaaggcctgccgcgctccgatgtagcttctgtcggtccttttcaggagttcacagctggctgaggctatcctgttttcggaggctcagtcttactagcgatcgcaagactgctaaacgattagagtag

SEQ ID NO: 34525 - DNA, 4041 bp, Artificial Sequence
  Description of Artificial Sequence: Synthetic coding sequence
atggataacaaaagggacaaggccaaggccggagcagccgcaaggacgccggcagccagagctccaggcttgctcacacccagacctcccggatctcccagaccccctccaccggtgacacctgccgccctgcgcgtactgggggcggctggcgccgtgggaaggaaacccttagccgagagagccggcggtatcgggggggccactatccccgaatcagccccccgcgccggccccacgagaagcgccgggacatcttctcggaatccagcctcacggccacctgcatctgggcggggcgagagagcccctccggccaagaacaccagccctggacccgtgtcctctccaggcagagctagtgggaccactagaccgggccctctaggtcaaaaggggctgcgtattagtgccgaagagacagtggccagaggtaaagccaccgaggccccaaagcgctcagcattgtcagcaggtgcccgtcgcgacacttctggacccaccccaggcacacccagcccggcgatggccaggagatcaagagcagccggcaccgaagtgggcctgccacgcccagccccgtccgcacggccccggcctcctacagaaggtcctaggaagtccgtcagtagcgcaagcgaacactctaccactgagccttcaccagccgccaggcggagaccatcagccggagggggtcttcaacgtcccgcctcacggtctctgagtagttccgctactcctctttccagccctgcccggagcggacctagcgctagaggcaccccaagggcccccgcgcacccctctcagccgaagcctaagggcctccaggccctgaggccccctcaggtcacccctccgagaaaagacgccgctccagctctggggccgctgtcctcctcccccctggccaccccgtctccctccggtacaaaagcacggcccgttcctccccccgataacgccgcaacgcctttaccggcgacccttcccccttccccccctgttaccccacctccgcctgcagctttgcagtcgcaggccccgcctacactgcccgccaccccccacagttctagcttgacctgtcagctggccacaccgcttccgttggccccaccctcaccttctgcccctcccagcttgcagaccctgccatccccaccagcaacccctccatctcaggtgccacccacacaactgattatgtctttcccagaagcaggcgtgtcttccctggccaccgccgcctttgtggcatccgtctctcccagcgtgagcagtccccttcagagtatgcctcccacacaggcaaatcctgcccttccgtcactaccaactcttttgtcaccactagccacccctcctctctcagccatgtctcctttgcaaggtccagtatctcccgccactagccttggaaacagtgcatttcccctcgccgctctgccccagcccggcctcagcgcactgactaccccccccccacaggcttccccttctcccagccctccaagtttacaggccactccacacaccctggctaccttgcccctgcaggacagtccgctcttagccaccctgcccctacaggcctccccatctccactcacaactgtgtccctgcaagacccccctctggtgtcaccgagcctcttagctagtcctcccctccaggcaccgccacatccacaggctcccccctctatgactacaccacctatgcaagctccaccttctctccagacaatcccacccatacaggtcccacacagcctgactagtccctctttgcaggccccaccatcaccccttgcgctgagtagccttcaagcaaccacttccctaggatcgcccactctgcaagcaacccatagctttctcactatgtccccaaggcaaacgcaagcttcactcatatccccctctagacctgccagcacccccccagactcacctccattgcaggccccactgtctcttcccgcttcccctccactgcaaacaagcctttctcctgccgtcagcccactctcctctccgctcacaatccacccattacaggccctgtcttctctcgcttctcatagcccacaggcccctctctcgtcactgatcatgcctcccttagagacccagtccagcctggcaccaccttcccttcagaccccccctgcctccctgactactcccccgctggaaaacctcccatctcttgctcctcctcccctccagaccgcctctgctcccctgacgactcctcctctggagaacttaccttcattagcccccccacctctacaaaccgcctcagctccgttgaccacaccacacctcgagacacctccttgtccagcaccctgtccgcttcaagcccctccatctcctctcactacgcctcccccggagactccctcttctatcgcaactccacccccacaggccccaccggctctggcctcccccccactgcaggggctgcctagtccccccctgtcacccctcgctaccccgccaccacaagccccaccagccctggcattgccccctctgcaggccccaccttccccccccgcttctcccccactttctccactggcaacaccttccccacaagcccctaacgctctggccgtacacttactgcaggctcccttctccccacctccatccccgccagtgcaggctccgttttcccctccagctagtcccccggtgtcaccaagcgcgacacctccgtctcaggccccaccttccctggctgctcctcctctgcaggtgccccccagtccacctgcttctccccctatgtcaccgagcgcgacgccacccccgcaggccccccctcccctcgccgcaccacccctgcaggtgcccccaagtccgcccgcatcacctccaatgtcacctagcgccaccccccctcctagagtgccgccacttcttgccgctccccccctacaggttcccccgtccccccctgcaagcctcccaatgagtcctctcgctaagcccccaccgcaagcacctcccgccctggcaaccccacccttacaggcactccctagtccaccagcaagctttccaggacaggcgcctttttctcctagcgcttccctgccaatgagtcctctcgctaccccgcccccacaggcaccgcccgttctggctgcccctctcctacaggtcccgccctctcccccggcctcgcctacccttcaggcacctagacggcctcccaccccagggccagatactagtgtgagcggtcccagacttaccctagcattggctcccggcccacctcccccaccatcacgtagcccatcttctacgctgtcaggtccagacttggcaggacactcgagttcagctacgtcaacacctgaggagctgcgcggctacgactcagggccggaaggaggagcggccgccagccccccccccgatgccgagctagccgcatgccatcctgccgcctggagcagaggtcctgcacccccactcgcattccgaggcgctccaggcgcccctctgccttggccccccgctaccggtccgggatcggcggatggactgtgcaccatctacgaaaccgaaggaccagagagcgcgacacctgcgccaggtgcactggaccctggcccatctcctgggacctcaggtggaaaagcggcagctggcgcaggagcaggagcctccagccggagccctaagcaggcaagacttggggaactcccgctgggtgctctgcaggctagcgttgtacagcacttattgtctagaacactgctgttggccgctgccgagggagccgccggaggcagtggaggagggcccggcggcgcagagggcggcggcgtcacagggggagcacgtgccgctctctctgacgcagaactaggacgctgggccgaactgttgtctcctctggatgaatcacgggccagtataaccagtgtgaccagcttttccccggacgatgtggcatcacctcagggcgactggacggtagttgaagtcgaaaccttccactag

SEQ ID NO: 34526 - DNA, 2010 bp, Artificial Sequence
  Description of Artificial Sequence: Synthetic coding sequence
atgttcacactgtcattgctgtctcggggccatggtaagctcggtcaggacaagcagaaactggaggtttatttcgaaccagaggattacctgaactggcgttcccccgaggactatgtgccagttagcaagccccaggataagaacaacgcttcacagcatagttggtccctgtttttacctaagactttcagtacaaggaagggggcgctgattctgtatagcgaaggattcgccataagtgcatggaccccaaaggagaggcgcaaaggcccctattgcccgcgcggcccatggcggaaactggacctagagctgcacactttgcaggacctaaaagaagctatattggcttacggccggcagcagggcgaacaggaccgggcctggcagccatacctgcacttcagatcgcaactggaatctcaagcacaaaggcaaatccaacccggccacagtgctaagagatatttaagagggctgttacgcacctggccacccgatgccatgtatcgcttatggtgcgcaggttatatcaaagattcagtgttactacaagatagtcagctgaacgtcccaaagaagctgagaccccagcaggatctctcaggcgttccaccgaaataccacttgctgcctgtctttccgtctttctggatacaacaggggaagtctttcgagcagcggcagcaaggcctggatgaaggcgaagctggcgccgcagggcacgtggatcaggggcctctggcaaaaaatcacgggtcacaggggacaaggctgccacctcggaggaagcaaccctggcaggaagatgaaacccaggcagaggacaccagtatagagaatcacctctgcctatacgccagtaaggagtcatataacgaaaagactcagcagacctctagaaaggcttttggacatggacgtattgatcactcatggctgccatccgacaagtcgcatatcaccttttgcggcggggcctttcccaacagaaaagcagatctgagcgacaagcagcgtaatgtgaagctccacaaggcacgatcctcacacctgctgcaagtcctgccggctgagagatctctgttccctcccgtggctagcgccacaggctctcgcatcattacgccgggggaagtgaaaaaaaagaaggccccaaaggccctgaaattaccccccatctcagaggagccacccagggtactcgagcccctgaagagtcagttcaaggcaaacgagccccctactgagctgtttatcttaccagtcgaaatccattaccacacgaagcagccgcctaaagaaaaggcccatcggaggggagcgccacaccccgaaagcgagccagagtcaagtgaagagagtactccagtctggaggcctccattgaagcatgctagcctggagacaccttgggagttaaccgtacacctgccagtagatgcaagtagggataccctaagcccccaggggagttcttcactgccccccgcctcccttggaaacttaacactgaagggctcgaaggcgcggcacacccgagtgcacagccagggtaagggcgtttggaagggtgatgatgacgcacccccccatgacgtggcacctccattggatttgctcccacccatcaaggggaaaaagagtccagagtctcaaaagggagtggacagcccccgcacctccgatcataatagccctcccagcctgccaaatatgagggtcccgcgcagagcattacccgccgcccaagaggatagttctgatcctacactgggacacttcttgttgggaccagatggagagaaggtgtgtctttccttgcccggacatacccaaacagaggccttaccctccggcaaggcatacgaatccgtgaacagcaatatatctcacgaggaagaggggcctagttcacagcattttctcaaggacatggcggccgcggctagcgaccagggaaaggatgatgaccttgagactttttctccaaaaaattccctgtag

SEQ ID NO: 34527 - DNA, 411 bp, Artificial Sequence
  Description of Artificial Sequence: Synthetic coding sequence
atgcgacaggaggttgagggtagaggcaggggttcccacgagctcattatcacagataaacggtgtggggtttgcggcggcagtctgagctgcatcgtctatctgtgcatttccctcaacttttccaggatcaagaagctcaaaaaatatacttggccaggccctacaagagattcacctaatgctagcctccagcccggaagagccaaatttgccttcagccacgcctcacacacgccgcttcattcccagctgggagcacttcagactggcaaacctcaggcattgcttgcctccgctaaccccctttcaagatcaatgggcccaccggaccatcacctcaccaccttgattctgatttccttggaaacccccttccctggactgctgtccagcggatgttttccctag

SEQ ID NO: 34528 - DNA, 381 bp, Artificial Sequence
  Description of Artificial Sequence: Synthetic coding sequence
atgcccacacagccacctccagggtcaggcgaagtcaggcaatcacctagtggaaatggggctctcgtgccaacaggccagggctgtcggggtaggaatctccccattcagggctattctcctgagggacgacccactgcctcctcacagcccgcgggcgcatggcactctgagtccagtcaaaagggaactgcctgccctctggctctgggacggggcggagcacggggcggcggtcaacgtaaaagcagaagcggcgcaagggcccctggccagcccgctgaagccggcctgagtgcttcacctgagaagacccggcccgagggacgcgccgagcgagggagagctgtagtttggcagagtcaacctaacaggtggtag

SEQ ID NO: 34529 - DNA, 699 bp, Artificial Sequence
  Description of Artificial Sequence: Synthetic coding sequence
atgttttgctgcctcgggtacgagtggctgagcgggggctgtaagacatggcactcagcttgggtgataaacaccttggcggatcatcgacaccggggtacagactttggcggaagtccatggctgctaatcattaccgtgtttttacgatcttacaaatttgccatcagcctttgtacttcatatctttgtgtatcatttcttaaaactattttccctagccaaaatgggcacgatggcagcactgatgtacagcagagagcccgtcggagcaactgccggagacaggaaggaattaaaatcgtgctggaagatatcttcacactctggcggcaggttgagaccaaggttcgggccaagattcggaaaatgaaggttacaacaaaggtgaatcggcacgacaagatcaatggaaaaaggaagactgcgaaagaacatttacggaagctgtccatgaaagaaagagagcatggtgaaaaggaacgccaagtgtctgaggccgaagaaaatggaaagttggacatgaaagaaatccacacctatatggaaatgtttcaacgggcccaggcccttcgtcgccgggctgaggattattaccggtgtaaaatcacaccatctgcccggaagcccctgtgcaatcgctgcacttacaatcttgtgctgcccggctcggagaaaaaatactattcacacgcctag

SEQ ID NO: 34530 - DNA, 636 bp, Artificial Sequence
  Description of Artificial Sequence: Synthetic coding sequence
atggcctacctcgggccttaccctactagccggcaacccccccagatgaggctgttaccccataattccctgcaccggcatagctcaatcgtcacaatggctagtttagaccccgccccagccagtcaaccgagtctacaggcactgaactttctgaagagcacttctccagggcccgcacctgccagctggtggccactgcaggcccagcccttgccgcccgtgtcactctactcccctaatgtctgcctgaccgctgattcaagtcgccccgcctcgacatccctttggactccccaggctaaactgcctacattccagcagctgctacatactcaactgcttcccccatcggggcttttcagaccaagtagctgttttacacgtgccttccccgggcctaccttcgtatcttggcagccgtccttagcacgatttctgcccgtgtcacaacagccccggcaagcacaggtgctgccccacacaggattgagtacgagctccctttgcctcaccgtagcctcacctggccctactccagttcctgggagacacctgcgggcccagaatctcttgaaaagtaactctcccggcccaccaagcgccagcaggtggcatcagcaagcacagctttag

SEQ ID NO: 34531 - DNA, 654 bp, Artificial Sequence
  Description of Artificial Sequence: Synthetic coding sequence
atgacattactcccccgcttagctcttcgcgaagaggcagctcgaagagggccccttcgggcccctgttcaaccaggtctgggcgagagaagtccgcagcggcatcgtgaaccaaagcaggggcgtgtatctcaaagatggcacccggctcgcgaaccactcgccgcaactggttttctccacggccttggccatttaggtcgcgccgcacagtcccctcgggcttcttgttgcattctgtggcctggcacctggggggaccctctgcggactctggggcgaagccagcgtgaagtccagaccgtgtgcaccggagtgagcggtgatcaggcccagaaagagcaggacggccacctgctagcgtggagaaagatcctgcttccaggcaagaaaacgacaccccgcggtatagggctgggttgtagaacactgtctcaggcaaccgcaccattcctgctgcaaaattgggggagaaagcgggcttttagacccggctcagagaacccttccagtggcactagtagaccatcccgcggaaggctcgaggctaggtctagtgggctcgacgaggcgtgggaggcccagcgcctgactggacatggtaggtttccttcccccagaaaggaaaagagcctgcagaggggactaggatag

SEQ ID NO: 34532 - DNA, 336 bp, Artificial Sequence
  Description of Artificial Sequence: Synthetic coding sequence
atggtgagcctgtgggtcgaggatacctttctgagcccaggattcggcttcgcccacgttgcctgctccgggttagggatgaagcaaaaaaggaaggccgcatcttccgaacccacaagcgaagtagcgctgggcggttctgcgggacccgtgcgcagccacctccaccccgaaggccttctatggtgtagcaggtgcttcttctctctgcgacccaaaggcaccgaacccccagggcggtccgcaggactgcaaggggcgacagagcggtccggctggacatccgttcaggctcaggcgcaagcctgcgaaaacctggtccccgctgccgtctag

SEQ ID NO: 34533 - DNA, 5103 bp, Artificial Sequence
  Description of Artificial Sequence: Synthetic coding sequence
atgacttccgcccagtgtcctgccctcgcctgtgtcatgagtcctctacgcttttggggtccatggcctttactgatgtggcagctcctgtggctgctggtgaaggaagcgcagcctctggagtgggtaaaggaccccctccagctgacttctaatccacttggcccacctgaaccttggtcttcccacagcagccactttccaagagagtcaccacacgcccctactttaccggctgacccatgggatttcgatcacctggggcccagcgcttcctcagagatgcccgccccacctcaggagtctactgagaatctggttccctttctggacacttgggactctgcgggggaattgcctctggagcccgaacagttcctggccagccagcaggacctgaaagacaagctgtctccacaggaaaggcttccggtctcccccaagaaactaaagaaagacccagcccaaagatggtccctagccgaaattataggcattatacggcagctgtcaactcctcaatcacagaagcagacactacaaaatgagtatagttccacggacaccccttacccaggatcactgccacccgagctgcgggtgaaaagcgatgaaccaccaggtcctagtgaacaggtaggaccgtcgcagttccacctcgagcctgagacccagaacccagaaacacttgaggacatccaaagctcctccttacaacaagaggcccctgcccaacttccccagctgctcgaggaggaaccctcatctatgcaacaagaagcaccggcgttgcctcccgaaagctccatggagagcctgacactgccaaaccacgaggtgagtgtgcagcccccaggagaggatcaagcctactaccacttgccaaacattaccgtcaagccagccgatgtagaggtgaccatcacatcagagcccactaatgagacagagagcagccaagcgcaacaggagactcctatccaatttccggaagaggtagagccttccgccacccagcaggaggctcctatcgagccacccgtaccgccaatggagcatgagctgtctatcagcgagcaacaacagcccgtgcagcccagcgaaagtcctcgtgaggtggaatcatcacctactcagcaggaaacaccaggccagccccccgagcaccacgaggtcaccgtgagccctcctggacaccatcagacgcatcatctcgctagtccaagcgtctcagtcaaacctccagatgtccaactcacaatagccgccgaaccttcagcagaggtcggtacatctctggttcaccaggaagccaccacccgcctgagcgggtctggcaacgatgtggagcctccggccatccagcacggcgggccccctctgttgcctgagagcagcgaggaagccgggcctctcgccgtgcagcaagagaccagctttcagtcacctgaaccaattaataacgagaacccttctcccacacagcaagaggccgcggccgagcatccccagacagctgaggaaggggaatcttcgcttacccaccaggaagcccccgcacaaacacccgagtttcctaacgtggttgtggcgcaaccccccgaacatagccacctcacgcaggcaaccgttcagccactagacctaggcttcaccattacccctgagtccaaaaccgaagtagagttgtccccaacgatgaaggagaccccaactcagccccctaaaaaggtcgtgccacagttaagggtttatcagggagtaacaaatcccacccccggtcaggatcaggcccaacatcctgtgtctccatccgtcacagtgcaacttttggacttagggttgactataacgcctgagcctacaaccgaagtgggccactcaactcctcccaagaggacaatagtttctcccaagcacccagaggtgacacttccacatccggaccaggtgcagacccagcattcccacctgacaagggctaccgtccagccacttgatttaggtttcacgattactcctaaatccatgaccgaggtcgaaccctcgaccgcgctgatgacaaccgccccgcctcctggtcaccccgaagtaacattaccaccaagtgataagggccaagcacagcacagccacctgacgcaggctacagtgcagcctttggatctggaactaaccataaccactaaacctacaaccgaggtgaagccctcaccgaccacagaagagacaagtacccagccacccgacctagggcttgccattatccctgaacctaccacagagactggtcattccacagcattagagaaaaccaccgcgccacgaccagaccgagtacaaactcttcataggagtttaaccgaagtcaccgggcctcctactgagctggagcccgcgcaggatagtctggttcagtccgaatcatacacccagaacaaagccttgactgcacccgaggagcataaggcctcgacctccacaaacatttgtgaactgtgcacttgcggagacgagatgctgtcctgtattgatttgaacccagagcagcgcttgagacaggtaccagtccctgagcccaacacccacaacggaacattcaccatcttgaactttcagggtaactatatctcatatatcgatgggaacgtgtggaaggcctattcatggactgaaaaattgattcttcgggaaaataatttgacagagctacacaaggatagctttgagggactgctgagtctgcagtatctggacctgtcgtgcaacaagatacagagcatagagcgccacactttcgagccccttccatttctcaagttcattaatctcagctgtaacgtcattactgaactgagtttcggaactttccaggcctggcacggcatgcaattcctgcataagttaatactcaatcataaccctctaaccacagtggaggatccttatctttttaagcttcccgctctgaaatacctcgacatgggaaccactctggttccactgaccacactaaagaacattctcatgatgactgtcgaacttgaaaagctgattttacctagtcacatggcctgttgtctatgccagttcaaaaattctatagaagccgtgtgtaaaacagttaagctccattgcaacagcgcatgcttaacaaatactacacactgccccgaggaggcctctgtcggaaaccctgagggtgcctttatgaaagtgctgcaagctagaaagaactatacgagcactgagcttatcgttgagcccgaagaaccttcggacagcagtggcataaatctttccggatttggaagtgaacagttggacacaaacgatgaatccgattttatctccacgcttcgctatatcctgccctacttctctgctgtaaatctggacgtgaagagccttctcctgcccctaataaaactgccgacgacaggcaacagcctagccaaaatccagacggttggacagaatcggcagcgggttaaaagggtcctcatgggtccccggtctattcagaagcgccacttcaaagaagtgggcaggcagtctatccgccgtgaacagggggcccaggcttccgtggaaaacgctgcagaggagaaaagactcggcagtcccgccccacgtgaagtggagcagcctcacacgcagcagggtcccgaaaagctagcagggaatgccgtctatactaagccctcttttactcaagagcacaaggcagccgtgagcgtcctgaaacccttctccaagggcgcgccctctacatctagcccagccaaagccctgcctcaagtaagagataggtggaaggacctgacccatgctatctccaccctcgagtccgcaaaggccagggttaccaatacgaaaacatccaagcccatcgtgcatgctagaaagaagtacagattccacaagactcggtcccacgtcacacacaggacaccaaaagtgaagaagtcaccaaaggtgaggaaaaaaagttatcttagccgactgatgctggctaatagattacctttctcagctgccaaatcattgattaatagcccatcacagggcgccttctccagcctgggagatctctccccacaggaaaacccctttctggaagtgtctgctccatctgagcactttattgaaaagaacaacacaaagcatactaccgcccgaaacgctttcgaggagaatgactttatggaaaacacaaacatgcctgaaggcacaatttctgagaacacaaactacaatcatcccccagaagcagattccgcgggtactgcctttaacttgggtcctaccgtcaaacagacggagaccaaatgggaatataataacgtaggcaccgacctcagtcctgagccaaaaagttttaactacccgttattgagctcccctggcgaccagttcgaaattcaattaacccaacagctgcagagtcttatccctaataacaatgtacggcgtctaatcgcacacgtaattaggacgctgaaaatggactgtagcggaacccacgtgcaagtcacatgcgccaagctcattagtaggactggccatctgatgaagctactgtccggtcagcaggaggtgaaagcttctaaaatcgaatgggataccgaccagtggaagatcgaaaactatatcaacgagagtacagaagcacagtctgagcagaaggaaaagtccctggaactgaagaaggaagtccctggatacgggtacaccgataaattaattctggctctgatcgttacaggaatcctgactatcctcataatcctgttttgcctaatcgtgatatgttgtcaccggagaagcctccaggaagatgaagagggcttctcgcggggcatctttcgatttctcccaaggaggggatgttccagccgtcgcgagagccaagatggactgtcttcttttggccaaccactgtggttcaaggatatgtataaacccctgagcgccactcgcattaacaaccacgcctggaaactgcacaaaaaaagttcaaacgaggataaaatcctcaatagagatccaggggatagtgaggctcctaccgaagaggaggagagcgaggccctaccttag
